United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 44

SEQ ID NO: 1843417 - DNA, 14 bp, Homo sapiens
ctcagggcctggtc

SEQ ID NO: 1843418 - DNA, 15 bp, Homo sapiens
ctcagggcctggtcg

SEQ ID NO: 1843419 - DNA, 16 bp, Homo sapiens
ctcagggtccctggtg

SEQ ID NO: 1843420 - DNA, 18 bp, Homo sapiens
ctcagggtccctggtggc

SEQ ID NO: 1843421 - DNA, 21 bp, Homo sapiens
ctcagggtccctggtggcagc

SEQ ID NO: 1843422 - DNA, 22 bp, Homo sapiens
ctcagggtccctggtggcagct

SEQ ID NO: 1843423 - DNA, 14 bp, Homo sapiens
ctcagggtctctgc

SEQ ID NO: 1843424 - DNA, 16 bp, Homo sapiens
ctcagggtctctgctg

SEQ ID NO: 1843425 - DNA, 14 bp, Homo sapiens
ctcaggtgagaagc

SEQ ID NO: 1843426 - DNA, 16 bp, Homo sapiens
ctcaggtgagaagcag

SEQ ID NO: 1843427 - DNA, 20 bp, Homo sapiens
ctcaggtggggtcactctgg

SEQ ID NO: 1843428 - DNA, 17 bp, Homo sapiens
ctcagtctggcccttcc

SEQ ID NO: 1843429 - DNA, 16 bp, Homo sapiens
ctcagtggggcagagg

SEQ ID NO: 1843430 - DNA, 21 bp, Homo sapiens
ctcagttcagaatcacttctg

SEQ ID NO: 1843431 - DNA, 17 bp, Homo sapiens
ctcataaggcatataca

SEQ ID NO: 1843432 - DNA, 21 bp, Homo sapiens
ctcatacccacccccacccaa

SEQ ID NO: 1843433 - DNA, 16 bp, Homo sapiens
ctcatccagggctctg

SEQ ID NO: 1843434 - DNA, 15 bp, Homo sapiens
ctcatctctgtccca

SEQ ID NO: 1843435 - DNA, 16 bp, Homo sapiens
ctcatgaagcaggagg

SEQ ID NO: 1843436 - DNA, 17 bp, Homo sapiens
ctcatgaagcaggaggc

SEQ ID NO: 1843437 - DNA, 14 bp, Homo sapiens
ctcatgcccagctc

SEQ ID NO: 1843438 - DNA, 17 bp, Homo sapiens
ctcattgacctgaggcc

SEQ ID NO: 1843439 - DNA, 19 bp, Homo sapiens
ctcattgacctgaggccct

SEQ ID NO: 1843440 - DNA, 16 bp, Homo sapiens
ctcattggaaatttag

SEQ ID NO: 1843441 - DNA, 21 bp, Homo sapiens
ctcatttcaggagcagcctca

SEQ ID NO: 1843442 - DNA, 15 bp, Homo sapiens
ctccaaaccctcgag

SEQ ID NO: 1843443 - DNA, 12 bp, Homo sapiens
ctccaaatgctg

SEQ ID NO: 1843444 - DNA, 15 bp, Homo sapiens
ctccaagaccttctc

SEQ ID NO: 1843445 - DNA, 14 bp, Homo sapiens
ctccaagcaggaca

SEQ ID NO: 1843446 - DNA, 22 bp, Homo sapiens
ctccaagcaggacatggacaag

SEQ ID NO: 1843447 - DNA, 15 bp, Homo sapiens
ctccacctgccaggg

SEQ ID NO: 1843448 - DNA, 18 bp, Homo sapiens
cttacctaccacatgcca

SEQ ID NO: 1843449 - DNA, 21 bp, Homo sapiens
cttacctcggtgccttcctct

SEQ ID NO: 1843450 - DNA, 18 bp, Homo sapiens
cttactttaaccctttct

SEQ ID NO: 1843451 - DNA, 20 bp, Homo sapiens
cttagaaaaaccaccaccat

SEQ ID NO: 1843452 - DNA, 11 bp, Homo sapiens
cttagaaaacc

SEQ ID NO: 1843453 - DNA, 23 bp, Homo sapiens
cttagaaaaccagctcagcactg

SEQ ID NO: 1843454 - DNA, 18 bp, Homo sapiens
cttagacagtccctgcca

SEQ ID NO: 1843455 - DNA, 11 bp, Homo sapiens
cttagagcagt

SEQ ID NO: 1843456 - DNA, 17 bp, Homo sapiens
cttagcaaaaaatgaac

SEQ ID NO: 1843457 - DNA, 12 bp, Homo sapiens
cttagcagtccc

SEQ ID NO: 1843458 - DNA, 17 bp, Homo sapiens
cttaggttggcaaaaag

SEQ ID NO: 1843459 - DNA, 21 bp, Homo sapiens
cttaggttggcaaaaaggcag

SEQ ID NO: 1843460 - DNA, 20 bp, Homo sapiens
cttagtatgtgcatttaatt

SEQ ID NO: 1843461 - DNA, 20 bp, Homo sapiens
cttagtcactgagacagccc

SEQ ID NO: 1843462 - DNA, 21 bp, Homo sapiens
cttagtcactgagacagcccg

SEQ ID NO: 1843463 - DNA, 13 bp, Homo sapiens
cttataggtggcc

SEQ ID NO: 1843464 - DNA, 15 bp, Homo sapiens
cttatccagctggtg

SEQ ID NO: 1843465 - DNA, 13 bp, Homo sapiens
cttatgaaaagaa

SEQ ID NO: 1843466 - DNA, 18 bp, Homo sapiens
cttatgaaaagaattgtt

SEQ ID NO: 1843467 - DNA, 21 bp, Homo sapiens
cttatgggctgggttctaccc

SEQ ID NO: 1843468 - DNA, 15 bp, Homo sapiens
cttattcccttcctg

SEQ ID NO: 1843469 - DNA, 11 bp, Homo sapiens
cttcaaactac

SEQ ID NO: 1843470 - DNA, 23 bp, Homo sapiens
cttcacagatgggtgcttggagg

SEQ ID NO: 1843471 - DNA, 18 bp, Homo sapiens
cttcacctaagtctctgt

SEQ ID NO: 1843472 - DNA, 14 bp, Homo sapiens
cttcacctttgtcc

SEQ ID NO: 1843473 - DNA, 21 bp, Homo sapiens
cttcacctttgtccccaccgc

SEQ ID NO: 1843474 - DNA, 16 bp, Homo sapiens
cttcagagactcctgc

SEQ ID NO: 1843475 - DNA, 19 bp, Homo sapiens
cttcagagactcctgcagg

SEQ ID NO: 1843476 - DNA, 20 bp, Homo sapiens
cttcagagactcctgcaggc

SEQ ID NO: 1843477 - DNA, 14 bp, Homo sapiens
cttcagagctgaca

SEQ ID NO: 1843478 - DNA, 20 bp, Homo sapiens
cttcagagctgacacaggat

SEQ ID NO: 1843479 - DNA, 15 bp, Homo sapiens
cttcagctgactttt

SEQ ID NO: 1843480 - DNA, 19 bp, Homo sapiens
cttcagctgacttttctgt

SEQ ID NO: 1843481 - DNA, 15 bp, Homo sapiens
cttcagtaagccgtg

SEQ ID NO: 1843482 - DNA, 23 bp, Homo sapiens
cttcagtaagccgtgattttcat

SEQ ID NO: 1843483 - DNA, 20 bp, Homo sapiens
cttcatacctacatgtattt

SEQ ID NO: 1843484 - DNA, 11 bp, Homo sapiens
cttcatctgga

SEQ ID NO: 1843485 - DNA, 13 bp, Homo sapiens
cttcatctggaac

SEQ ID NO: 1843486 - DNA, 13 bp, Homo sapiens
cttcatgcatgga

SEQ ID NO: 1843487 - DNA, 21 bp, Homo sapiens
cttcatgcatggaaattccct

SEQ ID NO: 1843488 - DNA, 16 bp, Homo sapiens
cttcattaataataaa

SEQ ID NO: 1843489 - DNA, 15 bp, Homo sapiens
cttcattagagcagg

SEQ ID NO: 1843490 - DNA, 16 bp, Homo sapiens
cttcattagagcaggc

SEQ ID NO: 1843491 - DNA, 20 bp, Homo sapiens
cttcattcaacccacctgcg

SEQ ID NO: 1843492 - DNA, 16 bp, Homo sapiens
cttccaggctgggaga

SEQ ID NO: 1843493 - DNA, 17 bp, Homo sapiens
cttccaggggtgggaca

SEQ ID NO: 1843494 - DNA, 18 bp, Homo sapiens
cttccagtgaggctctgc

SEQ ID NO: 1843495 - DNA, 19 bp, Homo sapiens
cttccagtgaggctctgcc

SEQ ID NO: 1843496 - DNA, 20 bp, Homo sapiens
cttccagtgaggctctgccc

SEQ ID NO: 1843497 - DNA, 23 bp, Homo sapiens
cttccagtgaggctctgcccttg

SEQ ID NO: 1843498 - DNA, 23 bp, Homo sapiens
cttcccacctctctcactccttg

SEQ ID NO: 1843499 - DNA, 19 bp, Homo sapiens
cttcccagtggctgctgcc

SEQ ID NO: 1843500 - DNA, 20 bp, Homo sapiens
cttcccagtggctgctgccc

SEQ ID NO: 1843501 - DNA, 17 bp, Homo sapiens
cttcccatgacccaggc

SEQ ID NO: 1843502 - DNA, 20 bp, Homo sapiens
cttcccatgacccaggctgg

SEQ ID NO: 1843503 - DNA, 23 bp, Homo sapiens
cttcccatgacccaggctgggca

SEQ ID NO: 1843504 - DNA, 17 bp, Homo sapiens
cttccctacagttgaaa

SEQ ID NO: 1843505 - DNA, 17 bp, Homo sapiens
cttccctatctttgcca

SEQ ID NO: 1843506 - DNA, 23 bp, Homo sapiens
cttccctatctttgccaccctca

SEQ ID NO: 1843507 - DNA, 23 bp, Homo sapiens
cttcctcagtaacatttctgttc

SEQ ID NO: 1843508 - DNA, 13 bp, Homo sapiens
cttcctccctccc

SEQ ID NO: 1843509 - DNA, 18 bp, Homo sapiens
cttcctccctccctcttt

SEQ ID NO: 1843510 - DNA, 21 bp, Homo sapiens
cttcctctttccatctaccct

SEQ ID NO: 1843511 - DNA, 19 bp, Homo sapiens
cttcgggaggtcgaggcag

SEQ ID NO: 1843512 - DNA, 19 bp, Homo sapiens
cttctaggacgccacccag

SEQ ID NO: 1843513 - DNA, 16 bp, Homo sapiens
cttctatttatttatt

SEQ ID NO: 1843514 - DNA, 21 bp, Homo sapiens
cttctcactgccatgccagct

SEQ ID NO: 1843515 - DNA, 22 bp, Homo sapiens
cttctcagaaggcaaatgactt

SEQ ID NO: 1843516 - DNA, 19 bp, Homo sapiens
cttctccagggtccacagg

SEQ ID NO: 1843517 - DNA, 22 bp, Homo sapiens
cttctccttcacctttgtcccc

SEQ ID NO: 1843518 - DNA, 19 bp, Homo sapiens
cttctctccagcccctgga

SEQ ID NO: 1843519 - DNA, 16 bp, Homo sapiens
cttctgacccatgctg

SEQ ID NO: 1843520 - DNA, 22 bp, Homo sapiens
cttctgacccatgctgccctgt

SEQ ID NO: 1843521 - DNA, 15 bp, Homo sapiens
cttctgtattcactt

SEQ ID NO: 1843522 - DNA, 19 bp, Homo sapiens
cttctgtattcacttatat

SEQ ID NO: 1843523 - DNA, 13 bp, Homo sapiens
cttcttcagagac

SEQ ID NO: 1843524 - DNA, 18 bp, Homo sapiens
cttcttcagagactcctg

SEQ ID NO: 1843525 - DNA, 21 bp, Homo sapiens
cttcttcagagactcctgcag

SEQ ID NO: 1843526 - DNA, 22 bp, Homo sapiens
cttcttcagagactcctgcagg

SEQ ID NO: 1843527 - DNA, 14 bp, Homo sapiens
cttcttcagagctg

SEQ ID NO: 1843528 - DNA, 16 bp, Homo sapiens
cttcttcagagctgac

SEQ ID NO: 1843529 - DNA, 17 bp, Homo sapiens
cttctttcatttcttct

SEQ ID NO: 1843530 - DNA, 23 bp, Homo sapiens
cttgaaaacactgttctctgccc

SEQ ID NO: 1843531 - DNA, 16 bp, Homo sapiens
cttgaagtaaccttat

SEQ ID NO: 1843532 - DNA, 21 bp, Homo sapiens
cttgaccattctccacctgcc

SEQ ID NO: 1843533 - DNA, 22 bp, Homo sapiens
cttgaccattctccacctgcca

SEQ ID NO: 1843534 - DNA, 14 bp, Homo sapiens
cttgagagggtgga

SEQ ID NO: 1843535 - DNA, 15 bp, Homo sapiens
cttgagcctgggagg

SEQ ID NO: 1843536 - DNA, 16 bp, Homo sapiens
cttgagcctgggaggt

SEQ ID NO: 1843537 - DNA, 16 bp, Homo sapiens
cttgaggattgtggaa

SEQ ID NO: 1843538 - DNA, 15 bp, Homo sapiens
cttgcaaaaagggtc

SEQ ID NO: 1843539 - DNA, 16 bp, Homo sapiens
cttgcaaaaagggtca

SEQ ID NO: 1843540 - DNA, 17 bp, Homo sapiens
cttgcatgaggctagtg

SEQ ID NO: 1843541 - DNA, 20 bp, Homo sapiens
cttgccgtctacctgagggg

SEQ ID NO: 1843542 - DNA, 17 bp, Homo sapiens
cttgctccagattctga

SEQ ID NO: 1843543 - DNA, 20 bp, Homo sapiens
cttgctccagattctgatgc

SEQ ID NO: 1843544 - DNA, 13 bp, Homo sapiens
cttgcttttcatg

SEQ ID NO: 1843545 - DNA, 14 bp, Homo sapiens
cttgcttttcatgc

SEQ ID NO: 1843546 - DNA, 21 bp, Homo sapiens
cttggaagggcgttctaggta

SEQ ID NO: 1843547 - DNA, 17 bp, Homo sapiens
cttggacattttatgtc

SEQ ID NO: 1843548 - DNA, 19 bp, Homo sapiens
cttggacattttatgtctt

SEQ ID NO: 1843549 - DNA, 13 bp, Homo sapiens
cttggaggaagga

SEQ ID NO: 1843550 - DNA, 22 bp, Homo sapiens
cttggaggaaggaaacccagct

SEQ ID NO: 1843551 - DNA, 23 bp, Homo sapiens
cttggcacatttaagagacagtc

SEQ ID NO: 1843552 - DNA, 16 bp, Homo sapiens
cttggcatcagctggc

SEQ ID NO: 1843553 - DNA, 23 bp, Homo sapiens
cttggggaaaatggccatgcagg

SEQ ID NO: 1843554 - DNA, 15 bp, Homo sapiens
cttggggggctgagg

SEQ ID NO: 1843555 - DNA, 22 bp, Homo sapiens
cttggggggctgaggtgggagg

SEQ ID NO: 1843556 - DNA, 16 bp, Homo sapiens
cttggtcctgctgcag

SEQ ID NO: 1843557 - DNA, 15 bp, Homo sapiens
cttggttggctggcc

SEQ ID NO: 1843558 - DNA, 12 bp, Homo sapiens
cttgtaaatata

SEQ ID NO: 1843559 - DNA, 13 bp, Homo sapiens
cttgtaaatataa

SEQ ID NO: 1843560 - DNA, 14 bp, Homo sapiens
cttgtaaatataaa

SEQ ID NO: 1843561 - DNA, 16 bp, Homo sapiens
cttgtaaatataaaga

SEQ ID NO: 1843562 - DNA, 19 bp, Homo sapiens
cttgtaaatataaagacgt

SEQ ID NO: 1843563 - DNA, 18 bp, Homo sapiens
cttgtactctacaaaata

SEQ ID NO: 1843564 - DNA, 17 bp, Homo sapiens
cttgtattaaagacaga

SEQ ID NO: 1843565 - DNA, 14 bp, Homo sapiens
cttgtattaagaat

SEQ ID NO: 1843566 - DNA, 13 bp, Homo sapiens
cttgtctgtagat

SEQ ID NO: 1843567 - DNA, 20 bp, Homo sapiens
cttgtcttattcccttcctg

SEQ ID NO: 1843568 - DNA, 15 bp, Homo sapiens
cttgtctttggaccc

SEQ ID NO: 1843569 - DNA, 14 bp, Homo sapiens
gacagtccctgcca

SEQ ID NO: 1843570 - DNA, 18 bp, Homo sapiens
gacatcatttgtattatg

SEQ ID NO: 1843571 - DNA, 16 bp, Homo sapiens
gacattcatgcctggc

SEQ ID NO: 1843572 - DNA, 16 bp, Homo sapiens
gacattttatgtcttt

SEQ ID NO: 1843573 - DNA, 22 bp, Homo sapiens
gaccacactccagctgggatca

SEQ ID NO: 1843574 - DNA, 17 bp, Homo sapiens
gaccagccaacctgggg

SEQ ID NO: 1843575 - DNA, 22 bp, Homo sapiens
gaccagcttttcccaaaagccc

SEQ ID NO: 1843576 - DNA, 15 bp, Homo sapiens
gaccatccctgaagg

SEQ ID NO: 1843577 - DNA, 19 bp, Homo sapiens
gaccattctccacctgcca

SEQ ID NO: 1843578 - DNA, 22 bp, Homo sapiens
gaccattctccacctgccaggg

SEQ ID NO: 1843579 - DNA, 14 bp, Homo sapiens
gacccaggctgggc

SEQ ID NO: 1843580 - DNA, 18 bp, Homo sapiens
gacccatgctgccctgtg

SEQ ID NO: 1843581 - DNA, 16 bp, Homo sapiens
gaccctattgctgctt

SEQ ID NO: 1843582 - DNA, 22 bp, Homo sapiens
gaccctccccacagtgccaccc

SEQ ID NO: 1843583 - DNA, 16 bp, Homo sapiens
gaccctgaggcccaga

SEQ ID NO: 1843584 - DNA, 18 bp, Homo sapiens
gaccctgaggcccagagg

SEQ ID NO: 1843585 - DNA, 19 bp, Homo sapiens
gaccctgaggcccagaggg

SEQ ID NO: 1843586 - DNA, 22 bp, Homo sapiens
gaccctgaggcccagagggcct

SEQ ID NO: 1843587 - DNA, 13 bp, Homo sapiens
gaccctgccctgt

SEQ ID NO: 1843588 - DNA, 22 bp, Homo sapiens
gaccctgccctgtgggccccca

SEQ ID NO: 1843589 - DNA, 19 bp, Homo sapiens
gacccttgtggtcccaccc

SEQ ID NO: 1843590 - DNA, 21 bp, Homo sapiens
gacccttgtggtcccacccca

SEQ ID NO: 1843591 - DNA, 14 bp, Homo sapiens
gacctcatgcccag

SEQ ID NO: 1843592 - DNA, 22 bp, Homo sapiens
gacctcatgcccagctctctga

SEQ ID NO: 1843593 - DNA, 15 bp, Homo sapiens
gacctgaggcccttc

SEQ ID NO: 1843594 - DNA, 18 bp, Homo sapiens
gacctgaggcccttctct

SEQ ID NO: 1843595 - DNA, 22 bp, Homo sapiens
gacctggcactggatgcagaaa

SEQ ID NO: 1843596 - DNA, 14 bp, Homo sapiens
gaccttctccttca

SEQ ID NO: 1843597 - DNA, 16 bp, Homo sapiens
gaccttctccttcacc

SEQ ID NO: 1843598 - DNA, 21 bp, Homo sapiens
gaccttctccttcacctttgt

SEQ ID NO: 1843599 - DNA, 18 bp, Homo sapiens
gacgcaggcccctctcct

SEQ ID NO: 1843600 - DNA, 13 bp, Homo sapiens
gacgccacccagc

SEQ ID NO: 1843601 - DNA, 13 bp, Homo sapiens
gacgccatcccag

SEQ ID NO: 1843602 - DNA, 18 bp, Homo sapiens
gacgccatcccagcccca

SEQ ID NO: 1843603 - DNA, 22 bp, Homo sapiens
gacgctacccgggaagggggct

SEQ ID NO: 1843604 - DNA, 17 bp, Homo sapiens
gacgctgtgctgccctg

SEQ ID NO: 1843605 - DNA, 20 bp, Homo sapiens
gactacttgggagcaccgcc

SEQ ID NO: 1843606 - DNA, 22 bp, Homo sapiens
gactcaaaacccatctgggctc

SEQ ID NO: 1843607 - DNA, 19 bp, Homo sapiens
gactcctaggcaggacatg

SEQ ID NO: 1843608 - DNA, 16 bp, Homo sapiens
gactcctgcaggcagc

SEQ ID NO: 1843609 - DNA, 17 bp, Homo sapiens
gactcctgcaggcagcc

SEQ ID NO: 1843610 - DNA, 19 bp, Homo sapiens
gactcctgcaggcagccag

SEQ ID NO: 1843611 - DNA, 19 bp, Homo sapiens
gactgtgacaggcagcaga

SEQ ID NO: 1843612 - DNA, 19 bp, Homo sapiens
gactgtgattcttagcaaa

SEQ ID NO: 1843613 - DNA, 17 bp, Homo sapiens
gacttaggtgtgaagac

SEQ ID NO: 1843614 - DNA, 16 bp, Homo sapiens
gactttggctgcatgc

SEQ ID NO: 1843615 - DNA, 22 bp, Homo sapiens
gactttgttagtttctccaagc

SEQ ID NO: 1843616 - DNA, 19 bp, Homo sapiens
gacttttccaaccctcatc

SEQ ID NO: 1843617 - DNA, 21 bp, Homo sapiens
gagaagtcttctatttattta

SEQ ID NO: 1843618 - DNA, 14 bp, Homo sapiens
gagaatatttttcc

SEQ ID NO: 1843619 - DNA, 17 bp, Homo sapiens
gagacagcccgggctct

SEQ ID NO: 1843620 - DNA, 18 bp, Homo sapiens
gagacagcccgggctctg

SEQ ID NO: 1843621 - DNA, 20 bp, Homo sapiens
gagaccctccccacagtgcc

SEQ ID NO: 1843622 - DNA, 21 bp, Homo sapiens
gagaccctgtctcaaaaaaag

SEQ ID NO: 1843623 - DNA, 15 bp, Homo sapiens
gagacctcctgcctc

SEQ ID NO: 1843624 - DNA, 19 bp, Homo sapiens
gagacctggcactggatgc

SEQ ID NO: 1843625 - DNA, 17 bp, Homo sapiens
gagactcctgcaggcag

SEQ ID NO: 1843626 - DNA, 19 bp, Homo sapiens
gagactcctgcaggcagcc

SEQ ID NO: 1843627 - DNA, 13 bp, Homo sapiens
gagagccttccag

SEQ ID NO: 1843628 - DNA, 18 bp, Homo sapiens
gagagccttccaggggtg

SEQ ID NO: 1843629 - DNA, 14 bp, Homo sapiens
gagagctggagcct

SEQ ID NO: 1843630 - DNA, 20 bp, Homo sapiens
gagaggaaatattgctgggg

SEQ ID NO: 1843631 - DNA, 21 bp, Homo sapiens
gagaggaaatattgctggggt

SEQ ID NO: 1843632 - DNA, 13 bp, Homo sapiens
gagaggaggcaac

SEQ ID NO: 1843633 - DNA, 18 bp, Homo sapiens
gagaggggacgcaggccc

SEQ ID NO: 1843634 - DNA, 20 bp, Homo sapiens
gagaggggacgcaggcccct

SEQ ID NO: 1843635 - DNA, 13 bp, Homo sapiens
gagaggggcacag

SEQ ID NO: 1843636 - DNA, 16 bp, Homo sapiens
gagagggtgggagtgg

SEQ ID NO: 1843637 - DNA, 12 bp, Homo sapiens
gagataagaaag

SEQ ID NO: 1843638 - DNA, 13 bp, Homo sapiens
gagatcagcctgg

SEQ ID NO: 1843639 - DNA, 16 bp, Homo sapiens
gagatttattaaagaa

SEQ ID NO: 1843640 - DNA, 13 bp, Homo sapiens
gagcaaacccaga

SEQ ID NO: 1843641 - DNA, 14 bp, Homo sapiens
gagcaaacccagag

SEQ ID NO: 1843642 - DNA, 16 bp, Homo sapiens
gagcaaaggctgagaa

SEQ ID NO: 1843643 - DNA, 18 bp, Homo sapiens
gagcaagacgctgtgctg

SEQ ID NO: 1843644 - DNA, 18 bp, Homo sapiens
gattcttcctccctccct

SEQ ID NO: 1843645 - DNA, 18 bp, Homo sapiens
gattctttcctgaggctg

SEQ ID NO: 1843646 - DNA, 20 bp, Homo sapiens
gattctttcctgaggctggg

SEQ ID NO: 1843647 - DNA, 18 bp, Homo sapiens
gattgcttgagctcagga

SEQ ID NO: 1843648 - DNA, 17 bp, Homo sapiens
gattggtgtttttttct

SEQ ID NO: 1843649 - DNA, 17 bp, Homo sapiens
gatttaagatatgtaac

SEQ ID NO: 1843650 - DNA, 12 bp, Homo sapiens
gatttattaaag

SEQ ID NO: 1843651 - DNA, 13 bp, Homo sapiens
gatttattaaaga

SEQ ID NO: 1843652 - DNA, 17 bp, Homo sapiens
gatttattaaagaaaaa

SEQ ID NO: 1843653 - DNA, 13 bp, Homo sapiens
gattttatgcttt

SEQ ID NO: 1843654 - DNA, 14 bp, Homo sapiens
gattttatgcttta

SEQ ID NO: 1843655 - DNA, 13 bp, Homo sapiens
gatttttaaaatg

SEQ ID NO: 1843656 - DNA, 14 bp, Homo sapiens
gcaaaaatagctct

SEQ ID NO: 1843657 - DNA, 17 bp, Homo sapiens
gcaaaagatgcttctca

SEQ ID NO: 1843658 - DNA, 21 bp, Homo sapiens
gcaaaattgtttttggttgga

SEQ ID NO: 1843659 - DNA, 17 bp, Homo sapiens
gcaaacccagaggtgga

SEQ ID NO: 1843660 - DNA, 20 bp, Homo sapiens
gcaaacccagaggtggatgt

SEQ ID NO: 1843661 - DNA, 12 bp, Homo sapiens
gcaaagccagaa

SEQ ID NO: 1843662 - DNA, 13 bp, Homo sapiens
gcaaaggctggga

SEQ ID NO: 1843663 - DNA, 22 bp, Homo sapiens
gcaaagggcatgggtcgggaga

SEQ ID NO: 1843664 - DNA, 22 bp, Homo sapiens
gcaaagtcatgcaaaggctggg

SEQ ID NO: 1843665 - DNA, 23 bp, Homo sapiens
gcaaagtcatgcaaaggctggga

SEQ ID NO: 1843666 - DNA, 14 bp, Homo sapiens
gcaaatcatctgca

SEQ ID NO: 1843667 - DNA, 22 bp, Homo sapiens
gcaaatcatctgcattcctgat

SEQ ID NO: 1843668 - DNA, 12 bp, Homo sapiens
gcaaatgacttt

SEQ ID NO: 1843669 - DNA, 20 bp, Homo sapiens
gcaaatgcccaagggaaaga

SEQ ID NO: 1843670 - DNA, 14 bp, Homo sapiens
gcaactcatcttag

SEQ ID NO: 1843671 - DNA, 22 bp, Homo sapiens
gcaagaaatggcgtctgctctg

SEQ ID NO: 1843672 - DNA, 17 bp, Homo sapiens
gcaagaattgaagcagg

SEQ ID NO: 1843673 - DNA, 22 bp, Homo sapiens
gcaagacgctgtgctgccctgc

SEQ ID NO: 1843674 - DNA, 23 bp, Homo sapiens
gcaagacgctgtgctgccctgcc

SEQ ID NO: 1843675 - DNA, 13 bp, Homo sapiens
gcaagctcccaag

SEQ ID NO: 1843676 - DNA, 19 bp, Homo sapiens
gcaagctcccaagggatgg

SEQ ID NO: 1843677 - DNA, 17 bp, Homo sapiens
gcaagctggcggctggg

SEQ ID NO: 1843678 - DNA, 14 bp, Homo sapiens
gcaaggctgattta

SEQ ID NO: 1843679 - DNA, 12 bp, Homo sapiens
gcaaggctgtgc

SEQ ID NO: 1843680 - DNA, 13 bp, Homo sapiens
gcaaggctgtgct

SEQ ID NO: 1843681 - DNA, 19 bp, Homo sapiens
gcaatgaagtctctgaagt

SEQ ID NO: 1843682 - DNA, 14 bp, Homo sapiens
gcaatgtatagtgt

SEQ ID NO: 1843683 - DNA, 14 bp, Homo sapiens
gcaatgtgataaaa

SEQ ID NO: 1843684 - DNA, 15 bp, Homo sapiens
gcaatgtgggcagag

SEQ ID NO: 1843685 - DNA, 22 bp, Homo sapiens
gcacaagctccaagctcccagg

SEQ ID NO: 1843686 - DNA, 20 bp, Homo sapiens
gcacaatagtaacctgggta

SEQ ID NO: 1843687 - DNA, 12 bp, Homo sapiens
gcacacaggaca

SEQ ID NO: 1843688 - DNA, 14 bp, Homo sapiens
gcacagaccctgcc

SEQ ID NO: 1843689 - DNA, 15 bp, Homo sapiens
gcacagaccctgccc

SEQ ID NO: 1843690 - DNA, 17 bp, Homo sapiens
gcacagaccctgccctg

SEQ ID NO: 1843691 - DNA, 18 bp, Homo sapiens
gcacagaccctgccctgt

SEQ ID NO: 1843692 - DNA, 22 bp, Homo sapiens
gcacagaccctgccctgtgggc

SEQ ID NO: 1843693 - DNA, 20 bp, Homo sapiens
gcacaggtgggcttcccagt

SEQ ID NO: 1843694 - DNA, 17 bp, Homo sapiens
gcacatttaagagacag

SEQ ID NO: 1843695 - DNA, 20 bp, Homo sapiens
gcaccactgcactccagcct

SEQ ID NO: 1843696 - DNA, 22 bp, Homo sapiens
gcaccactgcactccagcctgg

SEQ ID NO: 1843697 - DNA, 16 bp, Homo sapiens
ttgtgccagaatgctt

SEQ ID NO: 1843698 - DNA, 21 bp, Homo sapiens
ttgtggcctgggcctcctcac

SEQ ID NO: 1843699 - DNA, 20 bp, Homo sapiens
ttgttatttattgaaatgat

SEQ ID NO: 1843700 - DNA, 19 bp, Homo sapiens
ttgttccccatcatctgtg

SEQ ID NO: 1843701 - DNA, 20 bp, Homo sapiens
ttgttctggctcttccaggc

SEQ ID NO: 1843702 - DNA, 22 bp, Homo sapiens
ttgttctggctcttccaggctg

SEQ ID NO: 1843703 - DNA, 20 bp, Homo sapiens
ttgttggttggttttcttct

SEQ ID NO: 1843704 - DNA, 19 bp, Homo sapiens
ttgtttcgctctttgagaa

SEQ ID NO: 1843705 - DNA, 15 bp, Homo sapiens
ttgttttactgtctt

SEQ ID NO: 1843706 - DNA, 13 bp, Homo sapiens
tttaacaaaattt

SEQ ID NO: 1843707 - DNA, 19 bp, Homo sapiens
tttaagacatttttggaag

SEQ ID NO: 1843708 - DNA, 19 bp, Homo sapiens
tttaaggcatatttaacaa

SEQ ID NO: 1843709 - DNA, 23 bp, Homo sapiens
tttaatctctccaccttccaaag

SEQ ID NO: 1843710 - DNA, 19 bp, Homo sapiens
tttacagtgtttctggctt

SEQ ID NO: 1843711 - DNA, 21 bp, Homo sapiens
tttacctactgtgtcttggaa

SEQ ID NO: 1843712 - DNA, 11 bp, Homo sapiens
tttacttaaac

SEQ ID NO: 1843713 - DNA, 15 bp, Homo sapiens
tttagactttaacat

SEQ ID NO: 1843714 - DNA, 20 bp, Homo sapiens
tttagcattgtagtgctttg

SEQ ID NO: 1843715 - DNA, 23 bp, Homo sapiens
tttagctactatatatgtgatga

SEQ ID NO: 1843716 - DNA, 15 bp, Homo sapiens
tttataaatcgcttt

SEQ ID NO: 1843717 - DNA, 14 bp, Homo sapiens
tttataagcatcat

SEQ ID NO: 1843718 - DNA, 16 bp, Homo sapiens
tttataagcatcatta

SEQ ID NO: 1843719 - DNA, 17 bp, Homo sapiens
tttataagcatcattat

SEQ ID NO: 1843720 - DNA, 23 bp, Homo sapiens
tttataagcatcattatttatgt

SEQ ID NO: 1843721 - DNA, 11 bp, Homo sapiens
tttatgtattg

SEQ ID NO: 1843722 - DNA, 19 bp, Homo sapiens
tttatgtattgtgcaatgt

SEQ ID NO: 1843723 - DNA, 14 bp, Homo sapiens
tttatgttatatat

SEQ ID NO: 1843724 - DNA, 19 bp, Homo sapiens
tttattaaatgcccagccc

SEQ ID NO: 1843725 - DNA, 17 bp, Homo sapiens
tttcacccatctctcag

SEQ ID NO: 1843726 - DNA, 18 bp, Homo sapiens
tttcagataactgttatt

SEQ ID NO: 1843727 - DNA, 19 bp, Homo sapiens
tttcattttgcacctgcag

SEQ ID NO: 1843728 - DNA, 17 bp, Homo sapiens
tttccatgagtcccctg

SEQ ID NO: 1843729 - DNA, 23 bp, Homo sapiens
tttccatgcaccctcatacacag

SEQ ID NO: 1843730 - DNA, 21 bp, Homo sapiens
tttcctagcacacacttttgg

SEQ ID NO: 1843731 - DNA, 16 bp, Homo sapiens
tttcctgaggctgggc

SEQ ID NO: 1843732 - DNA, 23 bp, Homo sapiens
tttcctggcactgcttccagtga

SEQ ID NO: 1843733 - DNA, 16 bp, Homo sapiens
tttccttggctggtgc

SEQ ID NO: 1843734 - DNA, 22 bp, Homo sapiens
tttcgcaggattcttcctccct

SEQ ID NO: 1843735 - DNA, 14 bp, Homo sapiens
tttctaaaggagtt

SEQ ID NO: 1843736 - DNA, 20 bp, Homo sapiens
tttctagcccgaatacaaac

SEQ ID NO: 1843737 - DNA, 23 bp, Homo sapiens
tttctatgggtgttatcacctag

SEQ ID NO: 1843738 - DNA, 14 bp, Homo sapiens
tttctgaaacacac

SEQ ID NO: 1843739 - DNA, 19 bp, Homo sapiens
tttctgttatataaatggt

SEQ ID NO: 1843740 - DNA, 13 bp, Homo sapiens
tttcttaaataat

SEQ ID NO: 1843741 - DNA, 16 bp, Homo sapiens
tttgaagattctatgt

SEQ ID NO: 1843742 - DNA, 18 bp, Homo sapiens
tttgaagatttaattact

SEQ ID NO: 1843743 - DNA, 13 bp, Homo sapiens
tttgacgccatcc

SEQ ID NO: 1843744 - DNA, 16 bp, Homo sapiens
tttgacgccatcccag

SEQ ID NO: 1843745 - DNA, 19 bp, Homo sapiens
tttgacgccatcccagccc

SEQ ID NO: 1843746 - DNA, 20 bp, Homo sapiens
tttgacgccatcccagcccc

SEQ ID NO: 1843747 - DNA, 20 bp, Homo sapiens
tttgaggtttttaagcctta

SEQ ID NO: 1843748 - DNA, 13 bp, Homo sapiens
tttgagtgacagc

SEQ ID NO: 1843749 - DNA, 18 bp, Homo sapiens
tttgattcagacagctgc

SEQ ID NO: 1843750 - DNA, 20 bp, Homo sapiens
tttgcagaatgatgcaggtt

SEQ ID NO: 1843751 - DNA, 16 bp, Homo sapiens
tttgccaagtctccca

SEQ ID NO: 1843752 - DNA, 23 bp, Homo sapiens
tttgctttaatataaatgcaaat

SEQ ID NO: 1843753 - DNA, 15 bp, Homo sapiens
tttgctttgcccagc

SEQ ID NO: 1843754 - DNA, 14 bp, Homo sapiens
tttggaattttgtg

SEQ ID NO: 1843755 - DNA, 19 bp, Homo sapiens
tttggaccctgaggcccag

SEQ ID NO: 1843756 - DNA, 17 bp, Homo sapiens
tttggccatctgctcct

SEQ ID NO: 1843757 - DNA, 13 bp, Homo sapiens
tttggctgctgaa

SEQ ID NO: 1843758 - DNA, 22 bp, Homo sapiens
tttgggaggccaaggtgggagg

SEQ ID NO: 1843759 - DNA, 17 bp, Homo sapiens
tttggtccgtcataacc

SEQ ID NO: 1843760 - DNA, 18 bp, Homo sapiens
tttggttaagtctgtttt

SEQ ID NO: 1843761 - DNA, 19 bp, Homo sapiens
tttggttaagtctgtttta

SEQ ID NO: 1843762 - DNA, 22 bp, Homo sapiens
tttgtcctttttcactttgaaa

SEQ ID NO: 1843763 - DNA, 14 bp, Homo sapiens
tttgtcttaaaaag

SEQ ID NO: 1843764 - DNA, 19 bp, Homo sapiens
tttgtgaggaagccgctgg

SEQ ID NO: 1843765 - DNA, 14 bp, Homo sapiens
tttgttcattaaac

SEQ ID NO: 1843766 - DNA, 21 bp, Homo sapiens
tttgttctggctcttccaggc

SEQ ID NO: 1843767 - DNA, 13 bp, Homo sapiens
tttgttggttggt

SEQ ID NO: 1843768 - DNA, 13 bp, Homo sapiens
tttgttttgtgtc

SEQ ID NO: 1843769 - DNA, 18 bp, Homo sapiens
ttttaaaaaactgctgac

SEQ ID NO: 1843770 - DNA, 13 bp, Homo sapiens
ttttaaaatgtac

SEQ ID NO: 1843771 - DNA, 18 bp, Homo sapiens
ttttatgctttaaacatt

SEQ ID NO: 1843772 - DNA, 19 bp, Homo sapiens
ttttccaggtttaagctgt

SEQ ID NO: 1843773 - DNA, 18 bp, Homo sapiens
ttttccatgagtcccctg

SEQ ID NO: 1843774 - DNA, 22 bp, Homo sapiens
ttttccctattagagaagagat

SEQ ID NO: 1843775 - DNA, 18 bp, Homo sapiens
ttttctagcccgaataca

SEQ ID NO: 1843776 - DNA, 21 bp, Homo sapiens
ttttctagcccgaatacaaac

SEQ ID NO: 1843777 - DNA, 14 bp, Homo sapiens
ttttggctgctgaa

SEQ ID NO: 1843778 - DNA, 10 bp, Homo sapiens
ttttgtctgt

SEQ ID NO: 1843779 - DNA, 18 bp, Homo sapiens
tttttaagccttaaagga

SEQ ID NO: 1843780 - DNA, 19 bp, Homo sapiens
tttttatttttggcaaagc

SEQ ID NO: 1843781 - DNA, 15 bp, Homo sapiens
tttttcactttgaaa

SEQ ID NO: 1843782 - DNA, 13 bp, Homo sapiens
tttttctaaagga

SEQ ID NO: 1843783 - DNA, 15 bp, Homo sapiens
tttttgagtgacagc

SEQ ID NO: 1843784 - DNA, 13 bp, Homo sapiens
ttttttttccaaa

SEQ ID NO: 1843785 - DNA, 17 bp, Homo sapiens
atacagaggcaactgca

SEQ ID NO: 1843786 - DNA, 22 bp, Homo sapiens
atacagtttgtcacatgaaaca

SEQ ID NO: 1843787 - DNA, 20 bp, Homo sapiens
atacatcatacttaacttta

SEQ ID NO: 1843788 - DNA, 13 bp, Homo sapiens
atacccaccccca

SEQ ID NO: 1843789 - DNA, 19 bp, Homo sapiens
atacctggcctcatttaaa

SEQ ID NO: 1843790 - DNA, 12 bp, Homo sapiens
atacctgtcccc

SEQ ID NO: 1843791 - DNA, 16 bp, Homo sapiens
atacctgtccccctga

SEQ ID NO: 1843792 - DNA, 14 bp, Homo sapiens
atactcccatctgt

SEQ ID NO: 1843793 - DNA, 18 bp, Homo sapiens
atactcttatagacaaca

SEQ ID NO: 1843794 - DNA, 20 bp, Homo sapiens
atacttaactttactaagta

SEQ ID NO: 1843795 - DNA, 19 bp, Homo sapiens
atacttcgacactgttctt

SEQ ID NO: 1843796 - DNA, 19 bp, Homo sapiens
atagaagcttaaaataaag

SEQ ID NO: 1843797 - DNA, 12 bp, Homo sapiens
atagacttggga

SEQ ID NO: 1843798 - DNA, 13 bp, Homo sapiens
atagacttgggat

SEQ ID NO: 1843799 - DNA, 14 bp, Homo sapiens
atagacttgggatg

SEQ ID NO: 1843800 - DNA, 19 bp, Homo sapiens
atagagtgggacagttcct

SEQ ID NO: 1843801 - DNA, 15 bp, Homo sapiens
tgaggcccagagggc

SEQ ID NO: 1843802 - DNA, 18 bp, Homo sapiens
tgaggcccagagggcctg

SEQ ID NO: 1843803 - DNA, 22 bp, Homo sapiens
tgaggcccagagggcctgcaag

SEQ ID NO: 1843804 - DNA, 23 bp, Homo sapiens
tgaggcccagagggcctgcaagg

SEQ ID NO: 1843805 - DNA, 24 bp, Homo sapiens
tgaggcccttctctccagcccctg

SEQ ID NO: 1843806 - DNA, 23 bp, Homo sapiens
tgaggctagtgtggtgtttcctg

SEQ ID NO: 1843807 - DNA, 15 bp, Homo sapiens
tgaggctctgccctt

SEQ ID NO: 1843808 - DNA, 16 bp, Homo sapiens
tgaggctctgcccttg

SEQ ID NO: 1843809 - DNA, 20 bp, Homo sapiens
tgagggagctgggagaccct

SEQ ID NO: 1843810 - DNA, 18 bp, Homo sapiens
tgagggtatcaaataaaa

SEQ ID NO: 1843811 - DNA, 20 bp, Homo sapiens
tgaggtccagccctggctga

SEQ ID NO: 1843812 - DNA, 13 bp, Homo sapiens
tgaggtgggagga

SEQ ID NO: 1843813 - DNA, 21 bp, Homo sapiens
tgagtcccctgtttgtttctg

SEQ ID NO: 1843814 - DNA, 12 bp, Homo sapiens
tgagtgcctggc

SEQ ID NO: 1843815 - DNA, 14 bp, Homo sapiens
tgagtgcctggcca

SEQ ID NO: 1843816 - DNA, 19 bp, Homo sapiens
tgagtgtgcggctgtgtgt

SEQ ID NO: 1843817 - DNA, 16 bp, Homo sapiens
tgagttgatagcacag

SEQ ID NO: 1843818 - DNA, 20 bp, Homo sapiens
tgagttgatagcacagaccc

SEQ ID NO: 1843819 - DNA, 21 bp, Homo sapiens
tgagttgatagcacagaccct

SEQ ID NO: 1843820 - DNA, 14 bp, Homo sapiens
acaaaggtttaaat

SEQ ID NO: 1843821 - DNA, 20 bp, Homo sapiens
acaaaggtttaaatgaacaa

SEQ ID NO: 1843822 - DNA, 22 bp, Homo sapiens
acaaatggctacatctccaaat

SEQ ID NO: 1843823 - DNA, 21 bp, Homo sapiens
acaacactcattgacctgagg

SEQ ID NO: 1843824 - DNA, 18 bp, Homo sapiens
acaacgtgctctttgttt

SEQ ID NO: 1843825 - DNA, 14 bp, Homo sapiens
acaactcatacact

SEQ ID NO: 1843826 - DNA, 23 bp, Homo sapiens
acaagaaaaataaagaaaagatg

SEQ ID NO: 1843827 - DNA, 19 bp, Homo sapiens
acaagacccttgtggtccc

SEQ ID NO: 1843828 - DNA, 17 bp, Homo sapiens
acaagacttcagattcc

SEQ ID NO: 1843829 - DNA, 18 bp, Homo sapiens
acaagattggtgtttttt

SEQ ID NO: 1843830 - DNA, 13 bp, Homo sapiens
acaagctccaagc

SEQ ID NO: 1843831 - DNA, 22 bp, Homo sapiens
acaagctccaagctcccaggca

SEQ ID NO: 1843832 - DNA, 23 bp, Homo sapiens
acaagctgcaccctcaggcaggt

SEQ ID NO: 1843833 - DNA, 15 bp, Homo sapiens
acaagttgaagaagc

SEQ ID NO: 1843834 - DNA, 15 bp, Homo sapiens
acacaaacctgcctg

SEQ ID NO: 1843835 - DNA, 20 bp, Homo sapiens
acacaagattggtgtttttt

SEQ ID NO: 1843836 - DNA, 23 bp, Homo sapiens
acacacttttggttaagtctgtt

SEQ ID NO: 1843837 - DNA, 16 bp, Homo sapiens
acacagatgaaacaca

SEQ ID NO: 1843838 - DNA, 23 bp, Homo sapiens
acacagctaacacacagctccca

SEQ ID NO: 1843839 - DNA, 16 bp, Homo sapiens
acacaggacagcggga

SEQ ID NO: 1843840 - DNA, 16 bp, Homo sapiens
acacagtgtctggcac

SEQ ID NO: 1843841 - DNA, 12 bp, Homo sapiens
acacatcagtca

SEQ ID NO: 1843842 - DNA, 18 bp, Homo sapiens
acaccctgtgatggggcc

SEQ ID NO: 1843843 - DNA, 16 bp, Homo sapiens
acacgctccttcctct

SEQ ID NO: 1843844 - DNA, 16 bp, Homo sapiens
acactcaagaagcagg

SEQ ID NO: 1843845 - DNA, 16 bp, Homo sapiens
acactcattgacctga

SEQ ID NO: 1843846 - DNA, 17 bp, Homo sapiens
acactccaattaaggat

SEQ ID NO: 1843847 - DNA, 11 bp, Homo sapiens
acactccttca

SEQ ID NO: 1843848 - DNA, 13 bp, Homo sapiens
acactccttcaca

SEQ ID NO: 1843849 - DNA, 18 bp, Homo sapiens
acactggtattcctgcct

SEQ ID NO: 1843850 - DNA, 19 bp, Homo sapiens
acactggtattcctgcctc

SEQ ID NO: 1843851 - DNA, 18 bp, Homo sapiens
acactgtcctattatatt

SEQ ID NO: 1843852 - DNA, 22 bp, Homo sapiens
acactgtctggtttcaccgagg

SEQ ID NO: 1843853 - DNA, 18 bp, Homo sapiens
acactgttctctgccctc

SEQ ID NO: 1843854 - DNA, 18 bp, Homo sapiens
acactgttcttagctcaa

SEQ ID NO: 1843855 - DNA, 16 bp, Homo sapiens
acacttcaaactactt

SEQ ID NO: 1843856 - DNA, 13 bp, Homo sapiens
acacttttggtta

SEQ ID NO: 1843857 - DNA, 16 bp, Homo sapiens
acagaccctgccctgt

SEQ ID NO: 1843858 - DNA, 17 bp, Homo sapiens
acagaccctgccctgtg

SEQ ID NO: 1843859 - DNA, 20 bp, Homo sapiens
acagaccctgccctgtgggc

SEQ ID NO: 1843860 - DNA, 13 bp, Homo sapiens
acagacttctgaa

SEQ ID NO: 1843861 - DNA, 14 bp, Homo sapiens
acagagacctcctg

SEQ ID NO: 1843862 - DNA, 22 bp, Homo sapiens
acagagcgtgagctgagcaggc

SEQ ID NO: 1843863 - DNA, 14 bp, Homo sapiens
acagagggggtggc

SEQ ID NO: 1843864 - DNA, 21 bp, Homo sapiens
acagagggggtggcctcccaa

SEQ ID NO: 1843865 - DNA, 17 bp, Homo sapiens
acagattcacactgtct

SEQ ID NO: 1843866 - DNA, 19 bp, Homo sapiens
acagattcacactgtctgg

SEQ ID NO: 1843867 - DNA, 15 bp, Homo sapiens
acagcaattcctcag

SEQ ID NO: 1843868 - DNA, 16 bp, Homo sapiens
acagcccctcctccat

SEQ ID NO: 1843869 - DNA, 22 bp, Homo sapiens
acagcccgggctctgcctccca

SEQ ID NO: 1843870 - DNA, 19 bp, Homo sapiens
acagctaacaattgtgaag

SEQ ID NO: 1843871 - DNA, 16 bp, Homo sapiens
acagctgggtggcact

SEQ ID NO: 1843872 - DNA, 14 bp, Homo sapiens
acagctgtgtctgc

SEQ ID NO: 1843873 - DNA, 14 bp, Homo sapiens
acagctttctggga

SEQ ID NO: 1843874 - DNA, 20 bp, Homo sapiens
acagctttctgggatgtcac

SEQ ID NO: 1843875 - DNA, 22 bp, Homo sapiens
acagctttctgggatgtcacag

SEQ ID NO: 1843876 - DNA, 23 bp, Homo sapiens
acaggaccagggatttccatgat

SEQ ID NO: 1843877 - DNA, 14 bp, Homo sapiens
acaggagacctggc

SEQ ID NO: 1843878 - DNA, 17 bp, Homo sapiens
acaggcttctgagcagc

SEQ ID NO: 1843879 - DNA, 22 bp, Homo sapiens
acagggaatgcctgagtgcctg

SEQ ID NO: 1843880 - DNA, 20 bp, Homo sapiens
acaggtgccgccagctgccg

SEQ ID NO: 1843881 - DNA, 22 bp, Homo sapiens
acaggtgccgccagctgccgca

SEQ ID NO: 1843882 - DNA, 17 bp, Homo sapiens
acagtatgtcccatagg

SEQ ID NO: 1843883 - DNA, 13 bp, Homo sapiens
acagtcctcccat

SEQ ID NO: 1843884 - DNA, 17 bp, Homo sapiens
acagtgcctcttccagt

SEQ ID NO: 1843885 - DNA, 19 bp, Homo sapiens
acagtgcctcttccagtga

SEQ ID NO: 1843886 - DNA, 23 bp, Homo sapiens
acagtgcctcttccagtgaacat

SEQ ID NO: 1843887 - DNA, 20 bp, Homo sapiens
acagtgcttgccacagagcg

SEQ ID NO: 1843888 - DNA, 13 bp, Homo sapiens
acagtggccacgg

SEQ ID NO: 1843889 - DNA, 15 bp, Homo sapiens
acagttgaaaaacag

SEQ ID NO: 1843890 - DNA, 16 bp, Homo sapiens
acagttgaaaaacagc

SEQ ID NO: 1843891 - DNA, 18 bp, Homo sapiens
acagttttggttgcttta

SEQ ID NO: 1843892 - DNA, 19 bp, Homo sapiens
acataagctatttttctaa

SEQ ID NO: 1843893 - DNA, 17 bp, Homo sapiens
acatactcccatctgtg

SEQ ID NO: 1843894 - DNA, 16 bp, Homo sapiens
acatcatacttaactt

SEQ ID NO: 1843895 - DNA, 17 bp, Homo sapiens
acatgcggagaacaaat

SEQ ID NO: 1843896 - DNA, 15 bp, Homo sapiens
acatgctaaagccag

SEQ ID NO: 1843897 - DNA, 16 bp, Homo sapiens
acatgctaaagccagg

SEQ ID NO: 1843898 - DNA, 14 bp, Homo sapiens
acatgctgaagcca

SEQ ID NO: 1843899 - DNA, 19 bp, Homo sapiens
acatgcttagcagtcccct

SEQ ID NO: 1843900 - DNA, 15 bp, Homo sapiens
acatgcttttccaaa

SEQ ID NO: 1843901 - DNA, 13 bp, Homo sapiens
acatgtatgtaaa

SEQ ID NO: 1843902 - DNA, 18 bp, Homo sapiens
acatgtatgtaaatagct

SEQ ID NO: 1843903 - DNA, 17 bp, Homo sapiens
acatgtatttgtttgca

SEQ ID NO: 1843904 - DNA, 18 bp, Homo sapiens
acatgtatttgtttgcat

SEQ ID NO: 1843905 - DNA, 23 bp, Homo sapiens
acatgtcttttcttgcatgaggc

SEQ ID NO: 1843906 - DNA, 18 bp, Homo sapiens
acatgtgccttttctgaa

SEQ ID NO: 1843907 - DNA, 21 bp, Homo sapiens
acatgtttttcttctccctca

SEQ ID NO: 1843908 - DNA, 15 bp, Homo sapiens
acattaatctcaaag

SEQ ID NO: 1843909 - DNA, 15 bp, Homo sapiens
acattcatgcctggc

SEQ ID NO: 1843910 - DNA, 22 bp, Homo sapiens
acattggttcttgtattaagaa

SEQ ID NO: 1843911 - DNA, 23 bp, Homo sapiens
acattggttcttgtattaagaat

SEQ ID NO: 1843912 - DNA, 14 bp, Homo sapiens
accaacgtctgtgc

SEQ ID NO: 1843913 - DNA, 15 bp, Homo sapiens
accaagctatcctgg

SEQ ID NO: 1843914 - DNA, 17 bp, Homo sapiens
accaagctatcctggct

SEQ ID NO: 1843915 - DNA, 18 bp, Homo sapiens
accacactgggtgcgtct

SEQ ID NO: 1843916 - DNA, 13 bp, Homo sapiens
accacagctgctg

SEQ ID NO: 1843917 - DNA, 16 bp, Homo sapiens
accacagctgctggag

SEQ ID NO: 1843918 - DNA, 20 bp, Homo sapiens
accacatgccaagcactgtg

SEQ ID NO: 1843919 - DNA, 22 bp, Homo sapiens
accacatgccaagcactgtgct

SEQ ID NO: 1843920 - DNA, 18 bp, Homo sapiens
accacatgcggagaacaa

SEQ ID NO: 1843921 - DNA, 18 bp, Homo sapiens
accacatttctaagcctt

SEQ ID NO: 1843922 - DNA, 19 bp, Homo sapiens
accacatttctaagccttt

SEQ ID NO: 1843923 - DNA, 17 bp, Homo sapiens
accacctacaaggagat

SEQ ID NO: 1843924 - DNA, 15 bp, Homo sapiens
accagaaacacccct

SEQ ID NO: 1843925 - DNA, 11 bp, Homo sapiens
accagacaggt

SEQ ID NO: 1843926 - DNA, 21 bp, Homo sapiens
accagactacttgggagcacc

SEQ ID NO: 1843927 - DNA, 12 bp, Homo sapiens
accagcagagca

SEQ ID NO: 1843928 - DNA, 13 bp, Homo sapiens
accagcagagcac

SEQ ID NO: 1843929 - DNA, 22 bp, Homo sapiens
accagcatcccttgaccaggcc

SEQ ID NO: 1843930 - DNA, 22 bp, Homo sapiens
accagcgtgtgactactccccc

SEQ ID NO: 1843931 - DNA, 14 bp, Homo sapiens
accagctcagcact

SEQ ID NO: 1843932 - DNA, 16 bp, Homo sapiens
accagctcagcactgc

SEQ ID NO: 1843933 - DNA, 12 bp, Homo sapiens
accaggcctggg

SEQ ID NO: 1843934 - DNA, 17 bp, Homo sapiens
accagggccccggggcc

SEQ ID NO: 1843935 - DNA, 20 bp, Homo sapiens
accagtttaacctgatgcag

SEQ ID NO: 1843936 - DNA, 16 bp, Homo sapiens
accatccctgaaggcc

SEQ ID NO: 1843937 - DNA, 19 bp, Homo sapiens
accatgagtggcatggcca

SEQ ID NO: 1843938 - DNA, 13 bp, Homo sapiens
accattctccacc

SEQ ID NO: 1843939 - DNA, 16 bp, Homo sapiens
acccaagggcctggcc

SEQ ID NO: 1843940 - DNA, 23 bp, Homo sapiens
acccaagggcctggcctgagctg

SEQ ID NO: 1843941 - DNA, 15 bp, Homo sapiens
acccacccccaccca

SEQ ID NO: 1843942 - DNA, 15 bp, Homo sapiens
agcccacccctcaac

SEQ ID NO: 1843943 - DNA, 20 bp, Homo sapiens
agcccaggaaaggctccagg

SEQ ID NO: 1843944 - DNA, 17 bp, Homo sapiens
agcccattcattccatt

SEQ ID NO: 1843945 - DNA, 23 bp, Homo sapiens
agcccattcattccattctggaa

SEQ ID NO: 1843946 - DNA, 15 bp, Homo sapiens
agccccatcctctgt

SEQ ID NO: 1843947 - DNA, 14 bp, Homo sapiens
agccccctcacagt

SEQ ID NO: 1843948 - DNA, 22 bp, Homo sapiens
agccccctcacagtattgctca

SEQ ID NO: 1843949 - DNA, 23 bp, Homo sapiens
agccccctcacagtattgctcac

SEQ ID NO: 1843950 - DNA, 19 bp, Homo sapiens
agcccctggatgcagcctc

SEQ ID NO: 1843951 - DNA, 16 bp, Homo sapiens
agccccttctgaccca

SEQ ID NO: 1843952 - DNA, 24 bp, Homo sapiens
agccccttctgacccatgctgccc

SEQ ID NO: 1843953 - DNA, 15 bp, Homo sapiens
agcccgaatacaaac

SEQ ID NO: 1843954 - DNA, 20 bp, Homo sapiens
agcccgcagggccatgcaga

SEQ ID NO: 1843955 - DNA, 17 bp, Homo sapiens
agcccgggctctgcctc

SEQ ID NO: 1843956 - DNA, 20 bp, Homo sapiens
agcccgggctctgcctccca

SEQ ID NO: 1843957 - DNA, 21 bp, Homo sapiens
agcccgggctctgcctcccat

SEQ ID NO: 1843958 - DNA, 15 bp, Homo sapiens
agccctgagctttct

SEQ ID NO: 1843959 - DNA, 12 bp, Homo sapiens
agccctggctga

SEQ ID NO: 1843960 - DNA, 20 bp, Homo sapiens
agccgagattgcaccactgc

SEQ ID NO: 1843961 - DNA, 21 bp, Homo sapiens
agccgccatgctcctggccca

SEQ ID NO: 1843962 - DNA, 23 bp, Homo sapiens
agccgtttgttccccaagacatt

SEQ ID NO: 1843963 - DNA, 22 bp, Homo sapiens
agcctccagtccaaggaaacca

SEQ ID NO: 1843964 - DNA, 22 bp, Homo sapiens
agcctcccacgactgcccggca

SEQ ID NO: 1843965 - DNA, 19 bp, Homo sapiens
agcctgcctcttctctact

SEQ ID NO: 1843966 - DNA, 21 bp, Homo sapiens
agcctggaacatcatcaaggc

SEQ ID NO: 1843967 - DNA, 20 bp, Homo sapiens
agcctggctccaaaccctcg

SEQ ID NO: 1843968 - DNA, 22 bp, Homo sapiens
agcctgggtgacagagcaagtg

SEQ ID NO: 1843969 - DNA, 11 bp, Homo sapiens
agcctggtgcc

SEQ ID NO: 1843970 - DNA, 16 bp, Homo sapiens
agcctggtgctgctgc

SEQ ID NO: 1843971 - DNA, 16 bp, Homo sapiens
agccttcagcactaac

SEQ ID NO: 1843972 - DNA, 17 bp, Homo sapiens
agccttccaggggtggg

SEQ ID NO: 1843973 - DNA, 15 bp, Homo sapiens
agcctttgagactgt

SEQ ID NO: 1843974 - DNA, 22 bp, Homo sapiens
agcgctggccgggaccccgagc

SEQ ID NO: 1843975 - DNA, 20 bp, Homo sapiens
agcggtgtctctcctgcccc

SEQ ID NO: 1843976 - DNA, 17 bp, Homo sapiens
agctaacacacagctcc

SEQ ID NO: 1843977 - DNA, 16 bp, Homo sapiens
agctaataattcttca

SEQ ID NO: 1843978 - DNA, 20 bp, Homo sapiens
agctatgatttttttttcca

SEQ ID NO: 1843979 - DNA, 18 bp, Homo sapiens
agctcagagagggtggga

SEQ ID NO: 1843980 - DNA, 17 bp, Homo sapiens
agctcagcactgcctgc

SEQ ID NO: 1843981 - DNA, 21 bp, Homo sapiens
agctcagcactgcctgctccc

SEQ ID NO: 1843982 - DNA, 14 bp, Homo sapiens
agctcagggcctgg

SEQ ID NO: 1843983 - DNA, 14 bp, Homo sapiens
agctcataagagta

SEQ ID NO: 1843984 - DNA, 14 bp, Homo sapiens
agctcatctctgtc

SEQ ID NO: 1843985 - DNA, 13 bp, Homo sapiens
agctcccaggcat

SEQ ID NO: 1843986 - DNA, 23 bp, Homo sapiens
agctcccaggcattccccaggag

SEQ ID NO: 1843987 - DNA, 13 bp, Homo sapiens
agctccccagagt

SEQ ID NO: 1843988 - DNA, 18 bp, Homo sapiens
agctccccagagtcctct

SEQ ID NO: 1843989 - DNA, 13 bp, Homo sapiens
agctctcatagct

SEQ ID NO: 1843990 - DNA, 14 bp, Homo sapiens
agctctcatagctc

SEQ ID NO: 1843991 - DNA, 21 bp, Homo sapiens
agctctctgacgcttgtgaca

SEQ ID NO: 1843992 - DNA, 23 bp, Homo sapiens
agctctgctattaggccagcaag

SEQ ID NO: 1843993 - DNA, 12 bp, Homo sapiens
agctctggtcca

SEQ ID NO: 1843994 - DNA, 22 bp, Homo sapiens
agctgaatgtttttctaaagga

SEQ ID NO: 1843995 - DNA, 14 bp, Homo sapiens
agctgacacaaacc

SEQ ID NO: 1843996 - DNA, 15 bp, Homo sapiens
agctgacttttctgt

SEQ ID NO: 1843997 - DNA, 17 bp, Homo sapiens
agctgcaccctcaggca

SEQ ID NO: 1843998 - DNA, 22 bp, Homo sapiens
agctgcaccctcaggcaggtgg

SEQ ID NO: 1843999 - DNA, 13 bp, Homo sapiens
agctgctccccag

SEQ ID NO: 1844000 - DNA, 19 bp, Homo sapiens
agctgctccccaggccacc

SEQ ID NO: 1844001 - DNA, 20 bp, Homo sapiens
agctgctccccaggccaccc

SEQ ID NO: 1844002 - DNA, 23 bp, Homo sapiens
agctgctggagactcctaggcag

SEQ ID NO: 1844003 - DNA, 16 bp, Homo sapiens
agctggatagacttgg

SEQ ID NO: 1844004 - DNA, 18 bp, Homo sapiens
agctggatagacttggga

SEQ ID NO: 1844005 - DNA, 16 bp, Homo sapiens
agctggccgtgggcct

SEQ ID NO: 1844006 - DNA, 21 bp, Homo sapiens
agctggcgtcatgcaaagtca

SEQ ID NO: 1844007 - DNA, 20 bp, Homo sapiens
agctgggtggcactgccatg

SEQ ID NO: 1844008 - DNA, 13 bp, Homo sapiens
agctgtgtctgcc

SEQ ID NO: 1844009 - DNA, 14 bp, Homo sapiens
agctgttactgtct

SEQ ID NO: 1844010 - DNA, 19 bp, Homo sapiens
agctgttactgtcttcagt

SEQ ID NO: 1844011 - DNA, 12 bp, Homo sapiens
agcttatctcag

SEQ ID NO: 1844012 - DNA, 14 bp, Homo sapiens
agcttatctcaggg

SEQ ID NO: 1844013 - DNA, 15 bp, Homo sapiens
agcttatctcagggg

SEQ ID NO: 1844014 - DNA, 15 bp, Homo sapiens
agcttgctcacatct

SEQ ID NO: 1844015 - DNA, 21 bp, Homo sapiens
agcttgctccagattctgatg

SEQ ID NO: 1844016 - DNA, 16 bp, Homo sapiens
agcttggcactcaggt

SEQ ID NO: 1844017 - DNA, 18 bp, Homo sapiens
agctttaattaagctctc

SEQ ID NO: 1844018 - DNA, 12 bp, Homo sapiens
agctttgaaaat

SEQ ID NO: 1844019 - DNA, 21 bp, Homo sapiens
agctttgtttgttgtcagctg

SEQ ID NO: 1844020 - DNA, 18 bp, Homo sapiens
agcttttcccaaaagccc

SEQ ID NO: 1844021 - DNA, 20 bp, Homo sapiens
aggaaacccagctctggtcc

SEQ ID NO: 1844022 - DNA, 15 bp, Homo sapiens
aggaaaggctccagg

SEQ ID NO: 1844023 - DNA, 12 bp, Homo sapiens
aggaacactcct

SEQ ID NO: 1844024 - DNA, 20 bp, Homo sapiens
aggaagaagaaatctttctc

SEQ ID NO: 1844025 - DNA, 19 bp, Homo sapiens
aggaagccgctggggccag

SEQ ID NO: 1844026 - DNA, 13 bp, Homo sapiens
aggaagctcaggg

SEQ ID NO: 1844027 - DNA, 16 bp, Homo sapiens
aggaagctcagggcct

SEQ ID NO: 1844028 - DNA, 18 bp, Homo sapiens
aggaaggaaacccagctc

SEQ ID NO: 1844029 - DNA, 22 bp, Homo sapiens
aggaaggaaacccagctctggt

SEQ ID NO: 1844030 - DNA, 14 bp, Homo sapiens
aggaaggtggtggg

SEQ ID NO: 1844031 - DNA, 21 bp, Homo sapiens
aggaagtaaagtgaagaattt

SEQ ID NO: 1844032 - DNA, 16 bp, Homo sapiens
aggaataacctttctg

SEQ ID NO: 1844033 - DNA, 15 bp, Homo sapiens
aggacgccacccagc

SEQ ID NO: 1844034 - DNA, 13 bp, Homo sapiens
aggactcagctcc

SEQ ID NO: 1844035 - DNA, 14 bp, Homo sapiens
aggactcagctccc

SEQ ID NO: 1844036 - DNA, 17 bp, Homo sapiens
aggactgtgacaggcag

SEQ ID NO: 1844037 - DNA, 15 bp, Homo sapiens
aggagaggagagggg

SEQ ID NO: 1844038 - DNA, 13 bp, Homo sapiens
aggagataagaaa

SEQ ID NO: 1844039 - DNA, 16 bp, Homo sapiens
aggagataagaaagca

SEQ ID NO: 1844040 - DNA, 13 bp, Homo sapiens
aggagcagccaca

SEQ ID NO: 1844041 - DNA, 19 bp, Homo sapiens
aggagcagcctcagaacaa

SEQ ID NO: 1844042 - DNA, 14 bp, Homo sapiens
aggagcagtgcagg

SEQ ID NO: 1844043 - DNA, 14 bp, Homo sapiens
aggaggccacgtga

SEQ ID NO: 1844044 - DNA, 16 bp, Homo sapiens
aggaggccaggccacc

SEQ ID NO: 1844045 - DNA, 18 bp, Homo sapiens
aggagtacaggtgaagca

SEQ ID NO: 1844046 - DNA, 13 bp, Homo sapiens
aggagtgtgtgtg

SEQ ID NO: 1844047 - DNA, 21 bp, Homo sapiens
aggagtttgagaccaacctgg

SEQ ID NO: 1844048 - DNA, 12 bp, Homo sapiens
aggatctcttga

SEQ ID NO: 1844049 - DNA, 21 bp, Homo sapiens
aggatctcttgagcctgggag

SEQ ID NO: 1844050 - DNA, 23 bp, Homo sapiens
aggatctgctgaggcccagtgca

SEQ ID NO: 1844051 - DNA, 16 bp, Homo sapiens
aggatgatctaggaag

SEQ ID NO: 1844052 - DNA, 18 bp, Homo sapiens
aggatgctgacatcattt

SEQ ID NO: 1844053 - DNA, 16 bp, Homo sapiens
aggatggcctggccag

SEQ ID NO: 1844054 - DNA, 17 bp, Homo sapiens
aggattcttcctccctc

SEQ ID NO: 1844055 - DNA, 12 bp, Homo sapiens
aggattgtggaa

SEQ ID NO: 1844056 - DNA, 15 bp, Homo sapiens
aggattgtggaaaac

SEQ ID NO: 1844057 - DNA, 18 bp, Homo sapiens
aggattgtggaaaaccag

SEQ ID NO: 1844058 - DNA, 20 bp, Homo sapiens
aggatttggtccgtcataac

SEQ ID NO: 1844059 - DNA, 20 bp, Homo sapiens
aggattttatgctttaaaca

SEQ ID NO: 1844060 - DNA, 14 bp, Homo sapiens
aggcaaatgacttt

SEQ ID NO: 1844061 - DNA, 15 bp, Homo sapiens
aggcaaatgactttg

SEQ ID NO: 1844062 - DNA, 18 bp, Homo sapiens
aggcaaatgactttggac

SEQ ID NO: 1844063 - DNA, 17 bp, Homo sapiens
aggcaactcatcttagg

SEQ ID NO: 1844064 - DNA, 19 bp, Homo sapiens
atggcatttggtctcaggc

SEQ ID NO: 1844065 - DNA, 10 bp, Homo sapiens
atggccatgc

SEQ ID NO: 1844066 - DNA, 16 bp, Homo sapiens
atggccatgcaggagg

SEQ ID NO: 1844067 - DNA, 19 bp, Homo sapiens
atggcgtctgctctggtgg

SEQ ID NO: 1844068 - DNA, 16 bp, Homo sapiens
atggctacatctccaa

SEQ ID NO: 1844069 - DNA, 17 bp, Homo sapiens
atggcttatccagctgg

SEQ ID NO: 1844070 - DNA, 20 bp, Homo sapiens
atgggctgggttctacccag

SEQ ID NO: 1844071 - DNA, 23 bp, Homo sapiens
atgggctgggttctacccaggtg

SEQ ID NO: 1844072 - DNA, 14 bp, Homo sapiens
atggggccctgcct

SEQ ID NO: 1844073 - DNA, 20 bp, Homo sapiens
atggggccctgcctcctttg

SEQ ID NO: 1844074 - DNA, 22 bp, Homo sapiens
atgggggaaagcacaggtgggc

SEQ ID NO: 1844075 - DNA, 13 bp, Homo sapiens
atgggtcgggaga

SEQ ID NO: 1844076 - DNA, 18 bp, Homo sapiens
atggtaggggagggcagg

SEQ ID NO: 1844077 - DNA, 22 bp, Homo sapiens
atggtcagaatttccctctgat

SEQ ID NO: 1844078 - DNA, 23 bp, Homo sapiens
atggtcagaatttccctctgata

SEQ ID NO: 1844079 - DNA, 20 bp, Homo sapiens
atgtaaatagctaagatata

SEQ ID NO: 1844080 - DNA, 17 bp, Homo sapiens
atgtaacaacaattatt

SEQ ID NO: 1844081 - DNA, 23 bp, Homo sapiens
atgtaatctgatggcttctccag

SEQ ID NO: 1844082 - DNA, 15 bp, Homo sapiens
atgtaattatatata

SEQ ID NO: 1844083 - DNA, 21 bp, Homo sapiens
atgtaattatatatactatat

SEQ ID NO: 1844084 - DNA, 15 bp, Homo sapiens
atgtagtcagttgca

SEQ ID NO: 1844085 - DNA, 18 bp, Homo sapiens
atgtagtcagttgcattc

SEQ ID NO: 1844086 - DNA, 21 bp, Homo sapiens
atgtagttttgtgatgcattt

SEQ ID NO: 1844087 - DNA, 15 bp, Homo sapiens
atgtattgtgcaatg

SEQ ID NO: 1844088 - DNA, 18 bp, Homo sapiens
atgtattgtgcaatgtgt

SEQ ID NO: 1844089 - DNA, 14 bp, Homo sapiens
atgtatttgcaagg

SEQ ID NO: 1844090 - DNA, 14 bp, Homo sapiens
atgtatttgtttgc

SEQ ID NO: 1844091 - DNA, 14 bp, Homo sapiens
atgtattttatgtt

SEQ ID NO: 1844092 - DNA, 19 bp, Homo sapiens
atgtcacagtccaaccaga

SEQ ID NO: 1844093 - DNA, 15 bp, Homo sapiens
atgtcagttgttatt

SEQ ID NO: 1844094 - DNA, 17 bp, Homo sapiens
atgtcagttgttattta

SEQ ID NO: 1844095 - DNA, 18 bp, Homo sapiens
atgtccaagaagcccagg

SEQ ID NO: 1844096 - DNA, 22 bp, Homo sapiens
atgtcttcatacctacatgtat

SEQ ID NO: 1844097 - DNA, 13 bp, Homo sapiens
atgtcttcctgga

SEQ ID NO: 1844098 - DNA, 20 bp, Homo sapiens
atgtcttctgtattcactta

SEQ ID NO: 1844099 - DNA, 18 bp, Homo sapiens
atgtgactttgcatcagc

SEQ ID NO: 1844100 - DNA, 12 bp, Homo sapiens
atgtgtataaac

SEQ ID NO: 1844101 - DNA, 13 bp, Homo sapiens
atgtgtataaaca

SEQ ID NO: 1844102 - DNA, 13 bp, Homo sapiens
atgttaatatttc

SEQ ID NO: 1844103 - DNA, 23 bp, Homo sapiens
atgttagaggatccctctctgga

SEQ ID NO: 1844104 - DNA, 19 bp, Homo sapiens
atgttatatataaatatat

SEQ ID NO: 1844105 - DNA, 13 bp, Homo sapiens
atgttatgaacag

SEQ ID NO: 1844106 - DNA, 14 bp, Homo sapiens
atgttatgaacagc

SEQ ID NO: 1844107 - DNA, 20 bp, Homo sapiens
atgttatgaacagctgtgtc

SEQ ID NO: 1844108 - DNA, 14 bp, Homo sapiens
atgttccattaaac

SEQ ID NO: 1844109 - DNA, 20 bp, Homo sapiens
atgttctccagtcattatgt

SEQ ID NO: 1844110 - DNA, 17 bp, Homo sapiens
atgtttagactttaaca

SEQ ID NO: 1844111 - DNA, 21 bp, Homo sapiens
atgtttagactttaacataag

SEQ ID NO: 1844112 - DNA, 18 bp, Homo sapiens
atgttttccagctcctca

SEQ ID NO: 1844113 - DNA, 16 bp, Homo sapiens
atgtttttatatgtct

SEQ ID NO: 1844114 - DNA, 17 bp, Homo sapiens
atgtttttcttctccct

SEQ ID NO: 1844115 - DNA, 16 bp, Homo sapiens
attaaacgtcattcag

SEQ ID NO: 1844116 - DNA, 21 bp, Homo sapiens
attaaagaaaaaaatgtattt

SEQ ID NO: 1844117 - DNA, 22 bp, Homo sapiens
attaaagaaaaaaatgtatttt

SEQ ID NO: 1844118 - DNA, 13 bp, Homo sapiens
attaaagacagag

SEQ ID NO: 1844119 - DNA, 22 bp, Homo sapiens
attaaataaaatttttatgtaa

SEQ ID NO: 1844120 - DNA, 14 bp, Homo sapiens
attaaatgcccagc

SEQ ID NO: 1844121 - DNA, 13 bp, Homo sapiens
attaacaaattgc

SEQ ID NO: 1844122 - DNA, 14 bp, Homo sapiens
attaacaaattgca

SEQ ID NO: 1844123 - DNA, 16 bp, Homo sapiens
attaacaaattgcatt

SEQ ID NO: 1844124 - DNA, 18 bp, Homo sapiens
attaacaaattgcatttg

SEQ ID NO: 1844125 - DNA, 17 bp, Homo sapiens
attaaccacttcagctg

SEQ ID NO: 1844126 - DNA, 20 bp, Homo sapiens
attaagaatgaaatactgtt

SEQ ID NO: 1844127 - DNA, 21 bp, Homo sapiens
attaagaatgaaatactgttt

SEQ ID NO: 1844128 - DNA, 20 bp, Homo sapiens
attaaggattttatgcttta

SEQ ID NO: 1844129 - DNA, 16 bp, Homo sapiens
attacttgtaaatata

SEQ ID NO: 1844130 - DNA, 16 bp, Homo sapiens
attagctttaattaag

SEQ ID NO: 1844131 - DNA, 13 bp, Homo sapiens
attaggccagcaa

SEQ ID NO: 1844132 - DNA, 21 bp, Homo sapiens
attagttttgaagattctatg

SEQ ID NO: 1844133 - DNA, 23 bp, Homo sapiens
attatcacattaatctcaaagag

SEQ ID NO: 1844134 - DNA, 13 bp, Homo sapiens
attatgttccaag

SEQ ID NO: 1844135 - DNA, 17 bp, Homo sapiens
attattacttgtaaata

SEQ ID NO: 1844136 - DNA, 19 bp, Homo sapiens
attattacttgtaaatata

SEQ ID NO: 1844137 - DNA, 15 bp, Homo sapiens
attatttatgtattg

SEQ ID NO: 1844138 - DNA, 16 bp, Homo sapiens
attcaaaatgatgtat

SEQ ID NO: 1844139 - DNA, 21 bp, Homo sapiens
attcaattttaaggcatattt

SEQ ID NO: 1844140 - DNA, 11 bp, Homo sapiens
attcagacagc

SEQ ID NO: 1844141 - DNA, 14 bp, Homo sapiens
attcagacagctgc

SEQ ID NO: 1844142 - DNA, 19 bp, Homo sapiens
attcagacagctgcctggg

SEQ ID NO: 1844143 - DNA, 20 bp, Homo sapiens
attcagccccgggagtggcg

SEQ ID NO: 1844144 - DNA, 12 bp, Homo sapiens
attcaggaagct

SEQ ID NO: 1844145 - DNA, 14 bp, Homo sapiens
attcaggaagctca

SEQ ID NO: 1844146 - DNA, 22 bp, Homo sapiens
attcaggaagctcagggcctgg

SEQ ID NO: 1844147 - DNA, 18 bp, Homo sapiens
attcattccattctggaa

SEQ ID NO: 1844148 - DNA, 19 bp, Homo sapiens
attcattccattctggaag

SEQ ID NO: 1844149 - DNA, 16 bp, Homo sapiens
attcattctttttgaa

SEQ ID NO: 1844150 - DNA, 18 bp, Homo sapiens
attccagtcccctttctc

SEQ ID NO: 1844151 - DNA, 16 bp, Homo sapiens
attccattctggattt

SEQ ID NO: 1844152 - DNA, 17 bp, Homo sapiens
attccccactcagcctt

SEQ ID NO: 1844153 - DNA, 19 bp, Homo sapiens
attccctggcctttcatat

SEQ ID NO: 1844154 - DNA, 16 bp, Homo sapiens
attcccttcatctgga

SEQ ID NO: 1844155 - DNA, 19 bp, Homo sapiens
attcccttcatctggaacc

SEQ ID NO: 1844156 - DNA, 19 bp, Homo sapiens
attcccttcctgccagccc

SEQ ID NO: 1844157 - DNA, 23 bp, Homo sapiens
attcccttcctgccagcccctgc

SEQ ID NO: 1844158 - DNA, 18 bp, Homo sapiens
attcctcatttgttcatt

SEQ ID NO: 1844159 - DNA, 23 bp, Homo sapiens
attcctcatttgttcattaaacg

SEQ ID NO: 1844160 - DNA, 18 bp, Homo sapiens
attctatgttaatatttt

SEQ ID NO: 1844161 - DNA, 20 bp, Homo sapiens
attctcagggtctctgctgc

SEQ ID NO: 1844162 - DNA, 21 bp, Homo sapiens
attctcattggaaatttagca

SEQ ID NO: 1844163 - DNA, 23 bp, Homo sapiens
attctcattggaaatttagcatt

SEQ ID NO: 1844164 - DNA, 18 bp, Homo sapiens
attctctcttgtccttca

SEQ ID NO: 1844165 - DNA, 21 bp, Homo sapiens
attctggattttgtcaagcag

SEQ ID NO: 1844166 - DNA, 21 bp, Homo sapiens
attcttccctatctttgccac

SEQ ID NO: 1844167 - DNA, 17 bp, Homo sapiens
attcttggttggctggc

SEQ ID NO: 1844168 - DNA, 16 bp, Homo sapiens
attctttttgaaatgt

SEQ ID NO: 1844169 - DNA, 17 bp, Homo sapiens
attgacctgaggccctt

SEQ ID NO: 1844170 - DNA, 11 bp, Homo sapiens
attgacttctt

SEQ ID NO: 1844171 - DNA, 19 bp, Homo sapiens
attgagcacctgcaggcgt

SEQ ID NO: 1844172 - DNA, 23 bp, Homo sapiens
attgataagagggcacacactgt

SEQ ID NO: 1844173 - DNA, 16 bp, Homo sapiens
attgatgttttcatag

SEQ ID NO: 1844174 - DNA, 17 bp, Homo sapiens
attgatgttttcataga

SEQ ID NO: 1844175 - DNA, 12 bp, Homo sapiens
attgctgcttga

SEQ ID NO: 1844176 - DNA, 14 bp, Homo sapiens
attgcttgagctca

SEQ ID NO: 1844177 - DNA, 16 bp, Homo sapiens
attggaaatttagcat

SEQ ID NO: 1844178 - DNA, 22 bp, Homo sapiens
attggaactctactcaacccat

SEQ ID NO: 1844179 - DNA, 17 bp, Homo sapiens
attggagatagggaaag

SEQ ID NO: 1844180 - DNA, 16 bp, Homo sapiens
attggttcttgtatta

SEQ ID NO: 1844181 - DNA, 16 bp, Homo sapiens
attgtgcaatgtgtat

SEQ ID NO: 1844182 - DNA, 17 bp, Homo sapiens
attgtggaaaaccagga

SEQ ID NO: 1844183 - DNA, 20 bp, Homo sapiens
attgtggaaaaccaggaaaa

SEQ ID NO: 1844184 - DNA, 13 bp, Homo sapiens
attgtgggaaggg

SEQ ID NO: 1844185 - DNA, 14 bp, Homo sapiens
attgtgtctcttgg

SEQ ID NO: 1844186 - DNA, 16 bp, Homo sapiens
cagctgccgcaccagc

SEQ ID NO: 1844187 - DNA, 17 bp, Homo sapiens
cagctgccgcaccagcc

SEQ ID NO: 1844188 - DNA, 14 bp, Homo sapiens
cagctgcctgggat

SEQ ID NO: 1844189 - DNA, 15 bp, Homo sapiens
cagctgcctgggatc

SEQ ID NO: 1844190 - DNA, 23 bp, Homo sapiens
cagctgcctgggatccctcatcc

SEQ ID NO: 1844191 - DNA, 18 bp, Homo sapiens
cagctgggtggcactgcc

SEQ ID NO: 1844192 - DNA, 19 bp, Homo sapiens
cagctgggtggcactgcca

SEQ ID NO: 1844193 - DNA, 15 bp, Homo sapiens
cagctgtgtctgcca

SEQ ID NO: 1844194 - DNA, 21 bp, Homo sapiens
cagctgtgtctgccaaacaca

SEQ ID NO: 1844195 - DNA, 15 bp, Homo sapiens
cagctttctgggatg

SEQ ID NO: 1844196 - DNA, 16 bp, Homo sapiens
cagctttctgggatgt

SEQ ID NO: 1844197 - DNA, 22 bp, Homo sapiens
cagctttgtttgttgtcagctg

SEQ ID NO: 1844198 - DNA, 20 bp, Homo sapiens
cagcttttcccaaaagccca

SEQ ID NO: 1844199 - DNA, 16 bp, Homo sapiens
caggaaaggctccagg

SEQ ID NO: 1844200 - DNA, 17 bp, Homo sapiens
caggaaaggctccagga

SEQ ID NO: 1844201 - DNA, 19 bp, Homo sapiens
caggaaaggctccaggagc

SEQ ID NO: 1844202 - DNA, 20 bp, Homo sapiens
caggaaaggctccaggagca

SEQ ID NO: 1844203 - DNA, 21 bp, Homo sapiens
caggaaaggctccaggagcag

SEQ ID NO: 1844204 - DNA, 15 bp, Homo sapiens
caggaagctcagggc

SEQ ID NO: 1844205 - DNA, 18 bp, Homo sapiens
caggaagctcagggcctg

SEQ ID NO: 1844206 - DNA, 20 bp, Homo sapiens
caggaagctcagggcctggc

SEQ ID NO: 1844207 - DNA, 22 bp, Homo sapiens
caggaagctcagggcctggctc

SEQ ID NO: 1844208 - DNA, 14 bp, Homo sapiens
caggacagcgggaa

SEQ ID NO: 1844209 - DNA, 16 bp, Homo sapiens
caggacatgctgaagc

SEQ ID NO: 1844210 - DNA, 13 bp, Homo sapiens
caggaccagggat

SEQ ID NO: 1844211 - DNA, 13 bp, Homo sapiens
caggacctcaggt

SEQ ID NO: 1844212 - DNA, 16 bp, Homo sapiens
caggactagagcacaa

SEQ ID NO: 1844213 - DNA, 19 bp, Homo sapiens
caggactcagctccccaga

SEQ ID NO: 1844214 - DNA, 16 bp, Homo sapiens
caggagcacggctctg

SEQ ID NO: 1844215 - DNA, 15 bp, Homo sapiens
caggaggccagcctt

SEQ ID NO: 1844216 - DNA, 18 bp, Homo sapiens
caggaggccagccttgac

SEQ ID NO: 1844217 - DNA, 13 bp, Homo sapiens
caggaggcccttg

SEQ ID NO: 1844218 - DNA, 21 bp, Homo sapiens
caggaggcccttgtcgtggga

SEQ ID NO: 1844219 - DNA, 14 bp, Homo sapiens
caggaggtggagaa

SEQ ID NO: 1844220 - DNA, 15 bp, Homo sapiens
caggaggtggagaaa

SEQ ID NO: 1844221 - DNA, 13 bp, Homo sapiens
caggagtgtgtgt

SEQ ID NO: 1844222 - DNA, 21 bp, Homo sapiens
caggagtttgagaccaacctg

SEQ ID NO: 1844223 - DNA, 22 bp, Homo sapiens
caggagtttgagaccaacctgg

SEQ ID NO: 1844224 - DNA, 16 bp, Homo sapiens
caggcaaagcaagtga

SEQ ID NO: 1844225 - DNA, 18 bp, Homo sapiens
caggcagcaccacactgg

SEQ ID NO: 1844226 - DNA, 20 bp, Homo sapiens
caggcagcaccacactgggt

SEQ ID NO: 1844227 - DNA, 12 bp, Homo sapiens
caggcagcagag

SEQ ID NO: 1844228 - DNA, 23 bp, Homo sapiens
caggcagcagagacttgggacat

SEQ ID NO: 1844229 - DNA, 17 bp, Homo sapiens
caggcagccaggccaca

SEQ ID NO: 1844230 - DNA, 20 bp, Homo sapiens
caggcaggctaaggcgtgga

SEQ ID NO: 1844231 - DNA, 15 bp, Homo sapiens
caggcaggtgggatg

SEQ ID NO: 1844232 - DNA, 15 bp, Homo sapiens
caggcatcacagcta

SEQ ID NO: 1844233 - DNA, 17 bp, Homo sapiens
caggcatggtggcccac

SEQ ID NO: 1844234 - DNA, 18 bp, Homo sapiens
caggcattccccaggagg

SEQ ID NO: 1844235 - DNA, 22 bp, Homo sapiens
caggcattccccaggaggccag

SEQ ID NO: 1844236 - DNA, 23 bp, Homo sapiens
caggcattccccaggaggccagc

SEQ ID NO: 1844237 - DNA, 17 bp, Homo sapiens
caggccacaagaccctt

SEQ ID NO: 1844238 - DNA, 16 bp, Homo sapiens
caggccacacttcaaa

SEQ ID NO: 1844239 - DNA, 19 bp, Homo sapiens
caggccaccccgctgatgg

SEQ ID NO: 1844240 - DNA, 12 bp, Homo sapiens
caggccaggccc

SEQ ID NO: 1844241 - DNA, 13 bp, Homo sapiens
caggccaggccct

SEQ ID NO: 1844242 - DNA, 21 bp, Homo sapiens
caggccaggccctctgcccac

SEQ ID NO: 1844243 - DNA, 13 bp, Homo sapiens
caggcccctctcc

SEQ ID NO: 1844244 - DNA, 15 bp, Homo sapiens
caggcccctctcctc

SEQ ID NO: 1844245 - DNA, 17 bp, Homo sapiens
caggcccctctcctccg

SEQ ID NO: 1844246 - DNA, 13 bp, Homo sapiens
caggccctctgcc

SEQ ID NO: 1844247 - DNA, 12 bp, Homo sapiens
caggcctgggcc

SEQ ID NO: 1844248 - DNA, 20 bp, Homo sapiens
caggctacactgacactggt

SEQ ID NO: 1844249 - DNA, 15 bp, Homo sapiens
caggctgggagagcc

SEQ ID NO: 1844250 - DNA, 19 bp, Homo sapiens
caggctgggagagccttcc

SEQ ID NO: 1844251 - DNA, 16 bp, Homo sapiens
caggcttagtcactga

SEQ ID NO: 1844252 - DNA, 21 bp, Homo sapiens
caggcttagtcactgagacag

SEQ ID NO: 1844253 - DNA, 23 bp, Homo sapiens
caggcttagtcactgagacagcc

SEQ ID NO: 1844254 - DNA, 20 bp, Homo sapiens
cagggacagagggggtggcc

SEQ ID NO: 1844255 - DNA, 22 bp, Homo sapiens
cagggagatttgctcaatacct

SEQ ID NO: 1844256 - DNA, 12 bp, Homo sapiens
cagggatgagca

SEQ ID NO: 1844257 - DNA, 22 bp, Homo sapiens
cagggatgagcatggagctggc

SEQ ID NO: 1844258 - DNA, 14 bp, Homo sapiens
cagggccatgcaga

SEQ ID NO: 1844259 - DNA, 17 bp, Homo sapiens
cagggccatgcagacct

SEQ ID NO: 1844260 - DNA, 17 bp, Homo sapiens
cagggcctggaagacag

SEQ ID NO: 1844261 - DNA, 19 bp, Homo sapiens
cagggcctggaagacagag

SEQ ID NO: 1844262 - DNA, 16 bp, Homo sapiens
cagggcctggctcagg

SEQ ID NO: 1844263 - DNA, 12 bp, Homo sapiens
cagggctctgac

SEQ ID NO: 1844264 - DNA, 18 bp, Homo sapiens
cagggctgctagacggag

SEQ ID NO: 1844265 - DNA, 17 bp, Homo sapiens
caggggaaaatcagcct

SEQ ID NO: 1844266 - DNA, 14 bp, Homo sapiens
caggggtgggacac

SEQ ID NO: 1844267 - DNA, 20 bp, Homo sapiens
cagggtattccagagtgggg

SEQ ID NO: 1844268 - DNA, 22 bp, Homo sapiens
cagggtccacaggaagtgaaga

SEQ ID NO: 1844269 - DNA, 14 bp, Homo sapiens
cagggtccctggtg

SEQ ID NO: 1844270 - DNA, 15 bp, Homo sapiens
cagggtctctgctgc

SEQ ID NO: 1844271 - DNA, 14 bp, Homo sapiens
cagggtctgggcag

SEQ ID NO: 1844272 - DNA, 15 bp, Homo sapiens
cagggtctgggcagg

SEQ ID NO: 1844273 - DNA, 16 bp, Homo sapiens
cagggtctgggcagga

SEQ ID NO: 1844274 - DNA, 22 bp, Homo sapiens
caggtagtattacaccaccggc

SEQ ID NO: 1844275 - DNA, 14 bp, Homo sapiens
caggtcccctttca

SEQ ID NO: 1844276 - DNA, 18 bp, Homo sapiens
caggtcccctttcagaga

SEQ ID NO: 1844277 - DNA, 15 bp, Homo sapiens
caggtgagcccatgg

SEQ ID NO: 1844278 - DNA, 17 bp, Homo sapiens
caggtgagcccatggcc

SEQ ID NO: 1844279 - DNA, 21 bp, Homo sapiens
caggtgcacaagctccaagct

SEQ ID NO: 1844280 - DNA, 23 bp, Homo sapiens
caggtgcagcccccactgccttt

SEQ ID NO: 1844281 - DNA, 16 bp, Homo sapiens
caggtgccgccagctg

SEQ ID NO: 1844282 - DNA, 17 bp, Homo sapiens
caggtgccgccagctgc

SEQ ID NO: 1844283 - DNA, 22 bp, Homo sapiens
caggtgccgccagctgccgcac

SEQ ID NO: 1844284 - DNA, 16 bp, Homo sapiens
caggtgggcttcccag

SEQ ID NO: 1844285 - DNA, 18 bp, Homo sapiens
caggtggttatggagagg

SEQ ID NO: 1844286 - DNA, 19 bp, Homo sapiens
caggtgtgccgacagaagg

SEQ ID NO: 1844287 - DNA, 16 bp, Homo sapiens
caggttatctgggcat

SEQ ID NO: 1844288 - DNA, 14 bp, Homo sapiens
caggttggtggggg

SEQ ID NO: 1844289 - DNA, 20 bp, Homo sapiens
cagtaacatttctgttctca

SEQ ID NO: 1844290 - DNA, 12 bp, Homo sapiens
cagtagactgtg

SEQ ID NO: 1844291 - DNA, 21 bp, Homo sapiens
cagtatgggttagggaaaaca

SEQ ID NO: 1844292 - DNA, 23 bp, Homo sapiens
cagtatgggttagggaaaacatt

SEQ ID NO: 1844293 - DNA, 16 bp, Homo sapiens
cagtatgtcccatagg

SEQ ID NO: 1844294 - DNA, 15 bp, Homo sapiens
cagtattgaagcatt

SEQ ID NO: 1844295 - DNA, 16 bp, Homo sapiens
cagtattgaagcattt

SEQ ID NO: 1844296 - DNA, 21 bp, Homo sapiens
cagtattgaagcattttataa

SEQ ID NO: 1844297 - DNA, 18 bp, Homo sapiens
cagtcaccccggccacct

SEQ ID NO: 1844298 - DNA, 20 bp, Homo sapiens
cagtcaccccggccacctgc

SEQ ID NO: 1844299 - DNA, 18 bp, Homo sapiens
cagtcacgtggaggagca

SEQ ID NO: 1844300 - DNA, 14 bp, Homo sapiens
cagtcatcatttat

SEQ ID NO: 1844301 - DNA, 16 bp, Homo sapiens
cagtcatctgtaagag

SEQ ID NO: 1844302 - DNA, 19 bp, Homo sapiens
cagtccaaccagaaacacc

SEQ ID NO: 1844303 - DNA, 22 bp, Homo sapiens
cagtccaaggaaaccacagctg

SEQ ID NO: 1844304 - DNA, 24 bp, Homo sapiens
cagtccaaggaaaccacagctgct

SEQ ID NO: 1844305 - DNA, 14 bp, Homo sapiens
cagtccagcctgga

SEQ ID NO: 1844306 - DNA, 15 bp, Homo sapiens
cagtccagcctggag

SEQ ID NO: 1844307 - DNA, 17 bp, Homo sapiens
cagtccagcctggagat

SEQ ID NO: 1844308 - DNA, 24 bp, Homo sapiens
cattacagggaatgcctgagtgcc

SEQ ID NO: 1844309 - DNA, 15 bp, Homo sapiens
cattatgttaatatt

SEQ ID NO: 1844310 - DNA, 16 bp, Homo sapiens
cattatttatgtattg

SEQ ID NO: 1844311 - DNA, 16 bp, Homo sapiens
cattcattccattctg

SEQ ID NO: 1844312 - DNA, 14 bp, Homo sapiens
cattccatccttga

SEQ ID NO: 1844313 - DNA, 17 bp, Homo sapiens
cattccccaggaggcca

SEQ ID NO: 1844314 - DNA, 17 bp, Homo sapiens
cattccccgtctctggt

SEQ ID NO: 1844315 - DNA, 16 bp, Homo sapiens
cattcctgatgcttct

SEQ ID NO: 1844316 - DNA, 23 bp, Homo sapiens
cattcctgatgcttcttcagaga

SEQ ID NO: 1844317 - DNA, 15 bp, Homo sapiens
cattctcattggaaa

SEQ ID NO: 1844318 - DNA, 18 bp, Homo sapiens
cattctccacctgccagg

SEQ ID NO: 1844319 - DNA, 16 bp, Homo sapiens
cattctggaagtgact

SEQ ID NO: 1844320 - DNA, 16 bp, Homo sapiens
cattcttggttggctg

SEQ ID NO: 1844321 - DNA, 17 bp, Homo sapiens
cattcttggttggctgg

SEQ ID NO: 1844322 - DNA, 14 bp, Homo sapiens
cattggttcttgta

SEQ ID NO: 1844323 - DNA, 18 bp, Homo sapiens
cattggttcttgtattaa

SEQ ID NO: 1844324 - DNA, 15 bp, Homo sapiens
cattgtagtgctttg

SEQ ID NO: 1844325 - DNA, 19 bp, Homo sapiens
catttcacttgtcaggagt

SEQ ID NO: 1844326 - DNA, 15 bp, Homo sapiens
catttcaggagcagc

SEQ ID NO: 1844327 - DNA, 16 bp, Homo sapiens
catttcaggagcagcc

SEQ ID NO: 1844328 - DNA, 15 bp, Homo sapiens
catttctaagccttt

SEQ ID NO: 1844329 - DNA, 16 bp, Homo sapiens
catttctaagcctttg

SEQ ID NO: 1844330 - DNA, 16 bp, Homo sapiens
catttctgttctcatt

SEQ ID NO: 1844331 - DNA, 21 bp, Homo sapiens
catttgcgttccatgatgctg

SEQ ID NO: 1844332 - DNA, 13 bp, Homo sapiens
catttgctgaata

SEQ ID NO: 1844333 - DNA, 15 bp, Homo sapiens
catttggtctcaggc

SEQ ID NO: 1844334 - DNA, 16 bp, Homo sapiens
catttggtctcaggca

SEQ ID NO: 1844335 - DNA, 21 bp, Homo sapiens
catttggtctcaggcagcacc

SEQ ID NO: 1844336 - DNA, 20 bp, Homo sapiens
catttgtgctccattttttc

SEQ ID NO: 1844337 - DNA, 14 bp, Homo sapiens
catttgttcattaa

SEQ ID NO: 1844338 - DNA, 17 bp, Homo sapiens
cattttataaatcgctt

SEQ ID NO: 1844339 - DNA, 18 bp, Homo sapiens
cattttgctaaatgtgaa

SEQ ID NO: 1844340 - DNA, 20 bp, Homo sapiens
ccaaaactctcctctgctgc

SEQ ID NO: 1844341 - DNA, 15 bp, Homo sapiens
ccaaacccaggctat

SEQ ID NO: 1844342 - DNA, 14 bp, Homo sapiens
ccaaactggagctt

SEQ ID NO: 1844343 - DNA, 16 bp, Homo sapiens
ccaaagagtgctaagc

SEQ ID NO: 1844344 - DNA, 21 bp, Homo sapiens
ccaaagccaataacacacagc

SEQ ID NO: 1844345 - DNA, 19 bp, Homo sapiens
ccaaatatcagtgggctct

SEQ ID NO: 1844346 - DNA, 20 bp, Homo sapiens
ccaaatcactgaactttgct

SEQ ID NO: 1844347 - DNA, 12 bp, Homo sapiens
ccaaatgcagct

SEQ ID NO: 1844348 - DNA, 13 bp, Homo sapiens
ccaaatgcagctt

SEQ ID NO: 1844349 - DNA, 15 bp, Homo sapiens
ccaaatgcagcttta

SEQ ID NO: 1844350 - DNA, 22 bp, Homo sapiens
ccaaatggaaatgggcagagca

SEQ ID NO: 1844351 - DNA, 23 bp, Homo sapiens
ccaaatggaaatgggcagagcag

SEQ ID NO: 1844352 - DNA, 17 bp, Homo sapiens
ccaacaagttgaagaag

SEQ ID NO: 1844353 - DNA, 20 bp, Homo sapiens
ccaacatactcccatctgtg

SEQ ID NO: 1844354 - DNA, 13 bp, Homo sapiens
ccaaccctcatca

SEQ ID NO: 1844355 - DNA, 19 bp, Homo sapiens
ccaagaagcccaggaaagg

SEQ ID NO: 1844356 - DNA, 14 bp, Homo sapiens
ccaagcaaatgcct

SEQ ID NO: 1844357 - DNA, 15 bp, Homo sapiens
ccaagcggtgtctct

SEQ ID NO: 1844358 - DNA, 17 bp, Homo sapiens
ccaagcggtgtctctcc

SEQ ID NO: 1844359 - DNA, 16 bp, Homo sapiens
ccaagctatcctggct

SEQ ID NO: 1844360 - DNA, 17 bp, Homo sapiens
ccaagctcaaagcgtgg

SEQ ID NO: 1844361 - DNA, 18 bp, Homo sapiens
ccaagctcaaagcgtgga

SEQ ID NO: 1844362 - DNA, 13 bp, Homo sapiens
ccaagctcccagg

SEQ ID NO: 1844363 - DNA, 22 bp, Homo sapiens
ccaagctcccaggcattcccca

SEQ ID NO: 1844364 - DNA, 19 bp, Homo sapiens
ccaaggaaaccacagctgc

SEQ ID NO: 1844365 - DNA, 23 bp, Homo sapiens
ccaaggaaaccacagctgctgga

SEQ ID NO: 1844366 - DNA, 14 bp, Homo sapiens
ccaaggagacacaa

SEQ ID NO: 1844367 - DNA, 14 bp, Homo sapiens
ccaaggctggggga

SEQ ID NO: 1844368 - DNA, 20 bp, Homo sapiens
ccaagggatgaaagagaagg

SEQ ID NO: 1844369 - DNA, 16 bp, Homo sapiens
ccaaggtaccatccta

SEQ ID NO: 1844370 - DNA, 18 bp, Homo sapiens
ccaaggtgggaggattgc

SEQ ID NO: 1844371 - DNA, 15 bp, Homo sapiens
ccaagtggcagagct

SEQ ID NO: 1844372 - DNA, 18 bp, Homo sapiens
ccaatatcccttacttta

SEQ ID NO: 1844373 - DNA, 17 bp, Homo sapiens
ccaatatttaccagacc

SEQ ID NO: 1844374 - DNA, 14 bp, Homo sapiens
ccaatgcactttgt

SEQ ID NO: 1844375 - DNA, 23 bp, Homo sapiens
ccaatgcactttgttctggctct

SEQ ID NO: 1844376 - DNA, 14 bp, Homo sapiens
ccaatgctgatgtc

SEQ ID NO: 1844377 - DNA, 23 bp, Homo sapiens
ccaatggactaacttgtctttgg

SEQ ID NO: 1844378 - DNA, 22 bp, Homo sapiens
ccaatgggatgaggtcactttt

SEQ ID NO: 1844379 - DNA, 22 bp, Homo sapiens
ccacactgggtgcgtctccagt

SEQ ID NO: 1844380 - DNA, 17 bp, Homo sapiens
ccacacttcaaactact

SEQ ID NO: 1844381 - DNA, 18 bp, Homo sapiens
ccacacttcaaactactt

SEQ ID NO: 1844382 - DNA, 14 bp, Homo sapiens
ccacagagcgggga

SEQ ID NO: 1844383 - DNA, 17 bp, Homo sapiens
ccacaggcaaaactcag

SEQ ID NO: 1844384 - DNA, 16 bp, Homo sapiens
ccacagtgccacccat

SEQ ID NO: 1844385 - DNA, 23 bp, Homo sapiens
ccacatatttcaaaaacatgctt

SEQ ID NO: 1844386 - DNA, 17 bp, Homo sapiens
ccacatgcggagaacaa

SEQ ID NO: 1844387 - DNA, 16 bp, Homo sapiens
ccacattcctgatgct

SEQ ID NO: 1844388 - DNA, 17 bp, Homo sapiens
ccacatttctaagcctt

SEQ ID NO: 1844389 - DNA, 20 bp, Homo sapiens
ccaccaacatactcccatct

SEQ ID NO: 1844390 - DNA, 15 bp, Homo sapiens
ccaccatcaagccac

SEQ ID NO: 1844391 - DNA, 18 bp, Homo sapiens
ccaccatcaccagacagg

SEQ ID NO: 1844392 - DNA, 15 bp, Homo sapiens
ccacccaatgctgat

SEQ ID NO: 1844393 - DNA, 16 bp, Homo sapiens
ccacccatgcagctgc

SEQ ID NO: 1844394 - DNA, 20 bp, Homo sapiens
ccacccatgcagctgctccc

SEQ ID NO: 1844395 - DNA, 23 bp, Homo sapiens
ccacccatgcagctgctccccag

SEQ ID NO: 1844396 - DNA, 15 bp, Homo sapiens
ccaccccacacacgc

SEQ ID NO: 1844397 - DNA, 15 bp, Homo sapiens
ccacccccacccaag

SEQ ID NO: 1844398 - DNA, 16 bp, Homo sapiens
ccaccccgctgatgga

SEQ ID NO: 1844399 - DNA, 16 bp, Homo sapiens
ccaccctgaaagccct

SEQ ID NO: 1844400 - DNA, 18 bp, Homo sapiens
ccaccctgaaagccctga

SEQ ID NO: 1844401 - DNA, 18 bp, Homo sapiens
ccaccgcagacaggacca

SEQ ID NO: 1844402 - DNA, 19 bp, Homo sapiens
ccaccgcagacaggaccag

SEQ ID NO: 1844403 - DNA, 17 bp, Homo sapiens
ccacctcccacaaagga

SEQ ID NO: 1844404 - DNA, 22 bp, Homo sapiens
ccacctgcggtgctatctcccc

SEQ ID NO: 1844405 - DNA, 14 bp, Homo sapiens
ccacggccacagtc

SEQ ID NO: 1844406 - DNA, 23 bp, Homo sapiens
ccactaatcaggaggccaggcca

SEQ ID NO: 1844407 - DNA, 13 bp, Homo sapiens
ccactcagccttt

SEQ ID NO: 1844408 - DNA, 13 bp, Homo sapiens
ccactcccaggca

SEQ ID NO: 1844409 - DNA, 14 bp, Homo sapiens
ccactcccaggcag

SEQ ID NO: 1844410 - DNA, 13 bp, Homo sapiens
ccactccctgcaa

SEQ ID NO: 1844411 - DNA, 17 bp, Homo sapiens
ccactccctgcaacctg

SEQ ID NO: 1844412 - DNA, 18 bp, Homo sapiens
ccactgcactccagcctg

SEQ ID NO: 1844413 - DNA, 20 bp, Homo sapiens
ccactgcactccagcctggg

SEQ ID NO: 1844414 - DNA, 21 bp, Homo sapiens
ccactgcatcgtttcatcttc

SEQ ID NO: 1844415 - DNA, 23 bp, Homo sapiens
ccactggtgacatgtcttttctt

SEQ ID NO: 1844416 - DNA, 15 bp, Homo sapiens
ccactgtgaagagaa

SEQ ID NO: 1844417 - DNA, 21 bp, Homo sapiens
ccacttggctacacagggatg

SEQ ID NO: 1844418 - DNA, 18 bp, Homo sapiens
ccagaaacacccctctgt

SEQ ID NO: 1844419 - DNA, 16 bp, Homo sapiens
ccagaatgctttagga

SEQ ID NO: 1844420 - DNA, 13 bp, Homo sapiens
ccagaatttcaaa

SEQ ID NO: 1844421 - DNA, 19 bp, Homo sapiens
ccagagggcctgcaaggga

SEQ ID NO: 1844422 - DNA, 18 bp, Homo sapiens
ccagagttccccatgcag

SEQ ID NO: 1844423 - DNA, 19 bp, Homo sapiens
ccagagttccccatgcaga

SEQ ID NO: 1844424 - DNA, 18 bp, Homo sapiens
ccagatgcacatccctgg

SEQ ID NO: 1844425 - DNA, 20 bp, Homo sapiens
ccagatgggggaaagcacag

SEQ ID NO: 1844426 - DNA, 14 bp, Homo sapiens
ccagattctgatgc

SEQ ID NO: 1844427 - DNA, 19 bp, Homo sapiens
ccagattctttcctgaggc

SEQ ID NO: 1844428 - DNA, 22 bp, Homo sapiens
ccagcaagcggggatgtccctg

SEQ ID NO: 1844429 - DNA, 14 bp, Homo sapiens
ccagcagagcacct

SEQ ID NO: 1844430 - DNA, 20 bp, Homo sapiens
ctaaggcgtggagctgcctg

SEQ ID NO: 1844431 - DNA, 19 bp, Homo sapiens
ctaagtaatctcacagcat

SEQ ID NO: 1844432 - DNA, 22 bp, Homo sapiens
ctaagtaatctcacagcatttg

SEQ ID NO: 1844433 - DNA, 21 bp, Homo sapiens
ctaataaaatttaaaagtctt

SEQ ID NO: 1844434 - DNA, 22 bp, Homo sapiens
ctaatatcttaattctttgttc

SEQ ID NO: 1844435 - DNA, 17 bp, Homo sapiens
ctaatattttcctcctg

SEQ ID NO: 1844436 - DNA, 23 bp, Homo sapiens
ctaatgctgcagatttgggctgg

SEQ ID NO: 1844437 - DNA, 23 bp, Homo sapiens
ctacaaagctgaagaaaatgaag

SEQ ID NO: 1844438 - DNA, 19 bp, Homo sapiens
ctacaaaggtttaaatgaa

SEQ ID NO: 1844439 - DNA, 17 bp, Homo sapiens
ctacaaggagataagaa

SEQ ID NO: 1844440 - DNA, 13 bp, Homo sapiens
ctacaattgtaaa

SEQ ID NO: 1844441 - DNA, 18 bp, Homo sapiens
ctacaattgtaaactagt

SEQ ID NO: 1844442 - DNA, 17 bp, Homo sapiens
ctacactgtgctgagtc

SEQ ID NO: 1844443 - DNA, 13 bp, Homo sapiens
ctacagtcctccc

SEQ ID NO: 1844444 - DNA, 15 bp, Homo sapiens
ctacagtcctcccat

SEQ ID NO: 1844445 - DNA, 16 bp, Homo sapiens
ctacagtcctcccatc

SEQ ID NO: 1844446 - DNA, 19 bp, Homo sapiens
ctacagtcctcccatctca

SEQ ID NO: 1844447 - DNA, 22 bp, Homo sapiens
ctacagttgaaaaacagctgag

SEQ ID NO: 1844448 - DNA, 18 bp, Homo sapiens
ctacatctccaaatatca

SEQ ID NO: 1844449 - DNA, 21 bp, Homo sapiens
ctacccgggaagggggctggg

SEQ ID NO: 1844450 - DNA, 11 bp, Homo sapiens
ctacctgaggg

SEQ ID NO: 1844451 - DNA, 23 bp, Homo sapiens
ctacctgaggggcctcttatggg

SEQ ID NO: 1844452 - DNA, 14 bp, Homo sapiens
ctagagcacaacat

SEQ ID NO: 1844453 - DNA, 22 bp, Homo sapiens
ctagcagcagggagggcttctg

SEQ ID NO: 1844454 - DNA, 13 bp, Homo sapiens
ctaggaacactcc

SEQ ID NO: 1844455 - DNA, 20 bp, Homo sapiens
ctaggaacactccttcacag

SEQ ID NO: 1844456 - DNA, 21 bp, Homo sapiens
ctaggaagactttggaaagag

SEQ ID NO: 1844457 - DNA, 20 bp, Homo sapiens
ctaggaagtaaagtgaagaa

SEQ ID NO: 1844458 - DNA, 19 bp, Homo sapiens
ctagggaaaaaccagcgtg

SEQ ID NO: 1844459 - DNA, 21 bp, Homo sapiens
ctagggaaaaaccagcgtgtg

SEQ ID NO: 1844460 - DNA, 14 bp, Homo sapiens
ctagggaagggtgg

SEQ ID NO: 1844461 - DNA, 15 bp, Homo sapiens
ctagggccactgaag

SEQ ID NO: 1844462 - DNA, 11 bp, Homo sapiens
ctaggggctgg

SEQ ID NO: 1844463 - DNA, 15 bp, Homo sapiens
ctaggggctggggcc

SEQ ID NO: 1844464 - DNA, 18 bp, Homo sapiens
ctagttccaccatcaagc

SEQ ID NO: 1844465 - DNA, 23 bp, Homo sapiens
ctagttgtttgattcagacagct

SEQ ID NO: 1844466 - DNA, 19 bp, Homo sapiens
ctatcctggctctttggag

SEQ ID NO: 1844467 - DNA, 13 bp, Homo sapiens
ctatctcccccag

SEQ ID NO: 1844468 - DNA, 18 bp, Homo sapiens
ctatctcccccagcccca

SEQ ID NO: 1844469 - DNA, 19 bp, Homo sapiens
ctatctttgccaccctcat

SEQ ID NO: 1844470 - DNA, 21 bp, Homo sapiens
ctatgacctcgccctccacaa

SEQ ID NO: 1844471 - DNA, 20 bp, Homo sapiens
ctatgggtgttatcacctag

SEQ ID NO: 1844472 - DNA, 17 bp, Homo sapiens
ctatgttaatattttag

SEQ ID NO: 1844473 - DNA, 21 bp, Homo sapiens
ctatgttaatattttaggtgt

SEQ ID NO: 1844474 - DNA, 15 bp, Homo sapiens
ctattagagaagaga

SEQ ID NO: 1844475 - DNA, 17 bp, Homo sapiens
ctattcggcaaggaagt

SEQ ID NO: 1844476 - DNA, 13 bp, Homo sapiens
ctattgaataatg

SEQ ID NO: 1844477 - DNA, 12 bp, Homo sapiens
ctattgcccagg

SEQ ID NO: 1844478 - DNA, 12 bp, Homo sapiens
ctatttatttat

SEQ ID NO: 1844479 - DNA, 19 bp, Homo sapiens
ctatttatttatttattca

SEQ ID NO: 1844480 - DNA, 17 bp, Homo sapiens
ctcaaaaaaagaaaaag

SEQ ID NO: 1844481 - DNA, 18 bp, Homo sapiens
ctcaaaagctgggcaggt

SEQ ID NO: 1844482 - DNA, 16 bp, Homo sapiens
ctcaacccattgttgt

SEQ ID NO: 1844483 - DNA, 12 bp, Homo sapiens
ctcaatgagcat

SEQ ID NO: 1844484 - DNA, 19 bp, Homo sapiens
ctcaatgagcatgtttaga

SEQ ID NO: 1844485 - DNA, 19 bp, Homo sapiens
ctcaattcttccctatctt

SEQ ID NO: 1844486 - DNA, 14 bp, Homo sapiens
ctcacacatgagca

SEQ ID NO: 1844487 - DNA, 21 bp, Homo sapiens
ctcacacatgagcatcaggcc

SEQ ID NO: 1844488 - DNA, 23 bp, Homo sapiens
ctcacagtccttaccagcagagc

SEQ ID NO: 1844489 - DNA, 14 bp, Homo sapiens
ctcaccatctgtgc

SEQ ID NO: 1844490 - DNA, 14 bp, Homo sapiens
ctcaccccagcccc

SEQ ID NO: 1844491 - DNA, 15 bp, Homo sapiens
ctcacctctcccttg

SEQ ID NO: 1844492 - DNA, 20 bp, Homo sapiens
ctcactaggcttctggttga

SEQ ID NO: 1844493 - DNA, 19 bp, Homo sapiens
ctcactgccatgccagctt

SEQ ID NO: 1844494 - DNA, 23 bp, Homo sapiens
ctcagagagggcaggcatgaagt

SEQ ID NO: 1844495 - DNA, 14 bp, Homo sapiens
ctcagagagggtgg

SEQ ID NO: 1844496 - DNA, 17 bp, Homo sapiens
ctcagagtatggagctc

SEQ ID NO: 1844497 - DNA, 18 bp, Homo sapiens
ctcagagtatggagctca

SEQ ID NO: 1844498 - DNA, 19 bp, Homo sapiens
ctcagcaaaagatgcttct

SEQ ID NO: 1844499 - DNA, 21 bp, Homo sapiens
ctcagcactgcctgctcccat

SEQ ID NO: 1844500 - DNA, 20 bp, Homo sapiens
ctcagcccctgatcctgtga

SEQ ID NO: 1844501 - DNA, 15 bp, Homo sapiens
ctcagccttttggga

SEQ ID NO: 1844502 - DNA, 16 bp, Homo sapiens
ctcagcttggcactca

SEQ ID NO: 1844503 - DNA, 23 bp, Homo sapiens
ctcagcttggcactcaggtgctg

SEQ ID NO: 1844504 - DNA, 14 bp, Homo sapiens
ctcaggaccaggca

SEQ ID NO: 1844505 - DNA, 16 bp, Homo sapiens
ctcaggcagcaccaca

SEQ ID NO: 1844506 - DNA, 20 bp, Homo sapiens
ctcaggcagcaccacactgg

SEQ ID NO: 1844507 - DNA, 19 bp, Homo sapiens
ctcagggcctggctcaggt

SEQ ID NO: 1844508 - DNA, 15 bp, Homo sapiens
ctcagggtccctggt

SEQ ID NO: 1844509 - DNA, 17 bp, Homo sapiens
ctcagggtccctggtgg

SEQ ID NO: 1844510 - DNA, 17 bp, Homo sapiens
ctcagggtctctgctgc

SEQ ID NO: 1844511 - DNA, 19 bp, Homo sapiens
ctcaggtgagaagcagagg

SEQ ID NO: 1844512 - DNA, 19 bp, Homo sapiens
ctcaggtggggtcactctg

SEQ ID NO: 1844513 - DNA, 23 bp, Homo sapiens
ctcaggtggggtcactctggcag

SEQ ID NO: 1844514 - DNA, 20 bp, Homo sapiens
ctcagtaacatttctgttct

SEQ ID NO: 1844515 - DNA, 18 bp, Homo sapiens
ctcagtctggcccttcct

SEQ ID NO: 1844516 - DNA, 13 bp, Homo sapiens
ctcagtgtcctca

SEQ ID NO: 1844517 - DNA, 18 bp, Homo sapiens
ctcatacccacccccacc

SEQ ID NO: 1844518 - DNA, 22 bp, Homo sapiens
ctcatactcacctcaccccact

SEQ ID NO: 1844519 - DNA, 15 bp, Homo sapiens
ctcatcctcataccc

SEQ ID NO: 1844520 - DNA, 15 bp, Homo sapiens
ctcatgcccagctct

SEQ ID NO: 1844521 - DNA, 21 bp, Homo sapiens
ctcattagcattttgctaaat

SEQ ID NO: 1844522 - DNA, 13 bp, Homo sapiens
ctcattgacctga

SEQ ID NO: 1844523 - DNA, 16 bp, Homo sapiens
ctcattgacctgaggc

SEQ ID NO: 1844524 - DNA, 21 bp, Homo sapiens
ctcattgacctgaggcccttc

SEQ ID NO: 1844525 - DNA, 18 bp, Homo sapiens
ctcattggaaatttagca

SEQ ID NO: 1844526 - DNA, 12 bp, Homo sapiens
ctcatttcagga

SEQ ID NO: 1844527 - DNA, 17 bp, Homo sapiens
ctccaaaccctcgaggc

SEQ ID NO: 1844528 - DNA, 17 bp, Homo sapiens
ctccaagaccttctcct

SEQ ID NO: 1844529 - DNA, 18 bp, Homo sapiens
ctccaagaccttctcctt

SEQ ID NO: 1844530 - DNA, 21 bp, Homo sapiens
ctccaagaccttctccttcac

SEQ ID NO: 1844531 - DNA, 22 bp, Homo sapiens
ctccaagaccttctccttcacc

SEQ ID NO: 1844532 - DNA, 24 bp, Homo sapiens
ctccaagcaggacatggacaagga

SEQ ID NO: 1844533 - DNA, 14 bp, Homo sapiens
ctccaagctcccag

SEQ ID NO: 1844534 - DNA, 17 bp, Homo sapiens
ctccaattaaggatttt

SEQ ID NO: 1844535 - DNA, 20 bp, Homo sapiens
ctccaattaaggattttatg

SEQ ID NO: 1844536 - DNA, 21 bp, Homo sapiens
ctccacctgccagggacagag

SEQ ID NO: 1844537 - DNA, 11 bp, Homo sapiens
ctccagacaca

SEQ ID NO: 1844538 - DNA, 19 bp, Homo sapiens
ctccagacacatgtccaag

SEQ ID NO: 1844539 - DNA, 13 bp, Homo sapiens
ctccagattctga

SEQ ID NO: 1844540 - DNA, 15 bp, Homo sapiens
ctccagattctgatg

SEQ ID NO: 1844541 - DNA, 19 bp, Homo sapiens
ctccagattctgatgcata

SEQ ID NO: 1844542 - DNA, 20 bp, Homo sapiens
ctccagccagccagctcatt

SEQ ID NO: 1844543 - DNA, 11 bp, Homo sapiens
ctccaggagca

SEQ ID NO: 1844544 - DNA, 16 bp, Homo sapiens
ctccaggagcagccac

SEQ ID NO: 1844545 - DNA, 11 bp, Homo sapiens
ctccaggcagg

SEQ ID NO: 1844546 - DNA, 13 bp, Homo sapiens
ctccaggcaggct

SEQ ID NO: 1844547 - DNA, 18 bp, Homo sapiens
ctccaggtgcacaagctc

SEQ ID NO: 1844548 - DNA, 19 bp, Homo sapiens
ctccaggtgcacaagctcc

SEQ ID NO: 1844549 - DNA, 20 bp, Homo sapiens
ctccaggtgcacaagctcca

SEQ ID NO: 1844550 - DNA, 22 bp, Homo sapiens
ctccaggtgcacaagctccaag

SEQ ID NO: 1844551 - DNA, 17 bp, Homo sapiens
gaaaacattccatcctt

SEQ ID NO: 1844552 - DNA, 20 bp, Homo sapiens
gaaaaccagctcagcactgc

SEQ ID NO: 1844553 - DNA, 11 bp, Homo sapiens
gaaaagatgca

SEQ ID NO: 1844554 - DNA, 14 bp, Homo sapiens
gaaaagttggaagg

SEQ ID NO: 1844555 - DNA, 15 bp, Homo sapiens
gaaaatggccatgca

SEQ ID NO: 1844556 - DNA, 22 bp, Homo sapiens
gaaaatggccatgcaggaggtg

SEQ ID NO: 1844557 - DNA, 15 bp, Homo sapiens
gaaaccacagctgct

SEQ ID NO: 1844558 - DNA, 18 bp, Homo sapiens
gaaacccagctctggtcc

SEQ ID NO: 1844559 - DNA, 20 bp, Homo sapiens
gaaactccaccttgcgggga

SEQ ID NO: 1844560 - DNA, 22 bp, Homo sapiens
gaaagaaagttgcacggctgct

SEQ ID NO: 1844561 - DNA, 14 bp, Homo sapiens
gaaagcccctgccc

SEQ ID NO: 1844562 - DNA, 21 bp, Homo sapiens
gaaagccctgagctttctgct

SEQ ID NO: 1844563 - DNA, 11 bp, Homo sapiens
gaaaggaaaga

SEQ ID NO: 1844564 - DNA, 17 bp, Homo sapiens
gaaaggctccaggagca

SEQ ID NO: 1844565 - DNA, 19 bp, Homo sapiens
gaaaggctccaggagcagc

SEQ ID NO: 1844566 - DNA, 20 bp, Homo sapiens
gaaaggctccaggagcagcc

SEQ ID NO: 1844567 - DNA, 20 bp, Homo sapiens
gaaagttgcacggctgctga

SEQ ID NO: 1844568 - DNA, 14 bp, Homo sapiens
gaaagtttacagga

SEQ ID NO: 1844569 - DNA, 24 bp, Homo sapiens
gaaatggcgtctgctctggtggct

SEQ ID NO: 1844570 - DNA, 19 bp, Homo sapiens
gaaatgggcagagcagaga

SEQ ID NO: 1844571 - DNA, 20 bp, Homo sapiens
gaacactccaattaaggatt

SEQ ID NO: 1844572 - DNA, 15 bp, Homo sapiens
gaacactccttcaca

SEQ ID NO: 1844573 - DNA, 21 bp, Homo sapiens
gaacagattcacactgtctgg

SEQ ID NO: 1844574 - DNA, 20 bp, Homo sapiens
gaacatcatcaaggcactgc

SEQ ID NO: 1844575 - DNA, 18 bp, Homo sapiens
gaacatgtgccttttctg

SEQ ID NO: 1844576 - DNA, 19 bp, Homo sapiens
gaacatgtgccttttctga

SEQ ID NO: 1844577 - DNA, 20 bp, Homo sapiens
gaacatgtgccttttctgaa

SEQ ID NO: 1844578 - DNA, 21 bp, Homo sapiens
gaacctgcacacaggacagcg

SEQ ID NO: 1844579 - DNA, 14 bp, Homo sapiens
gaactaaactttca

SEQ ID NO: 1844580 - DNA, 18 bp, Homo sapiens
gaactaaactttcacacc

SEQ ID NO: 1844581 - DNA, 17 bp, Homo sapiens
gaactatggacggtgct

SEQ ID NO: 1844582 - DNA, 22 bp, Homo sapiens
gaactcacctggggctgctggc

SEQ ID NO: 1844583 - DNA, 22 bp, Homo sapiens
gaactcatccctaatgctgcag

SEQ ID NO: 1844584 - DNA, 17 bp, Homo sapiens
gaacttggaggcaccat

SEQ ID NO: 1844585 - DNA, 17 bp, Homo sapiens
gaacttgggccactgtg

SEQ ID NO: 1844586 - DNA, 20 bp, Homo sapiens
gaagaatctgtttcccagca

SEQ ID NO: 1844587 - DNA, 21 bp, Homo sapiens
gaagacagagacctcctgcct

SEQ ID NO: 1844588 - DNA, 11 bp, Homo sapiens
gaagactttgg

SEQ ID NO: 1844589 - DNA, 23 bp, Homo sapiens
gaagagcccgcagggccatgcag

SEQ ID NO: 1844590 - DNA, 12 bp, Homo sapiens
gaagagccttgc

SEQ ID NO: 1844591 - DNA, 20 bp, Homo sapiens
gaagaggtggccccatatta

SEQ ID NO: 1844592 - DNA, 17 bp, Homo sapiens
gaagatcctaaaacaaa

SEQ ID NO: 1844593 - DNA, 20 bp, Homo sapiens
gaagattctatgttaatatt

SEQ ID NO: 1844594 - DNA, 12 bp, Homo sapiens
gaagatttaatt

SEQ ID NO: 1844595 - DNA, 16 bp, Homo sapiens
gaagcaccataacttt

SEQ ID NO: 1844596 - DNA, 14 bp, Homo sapiens
gaagcaggctacac

SEQ ID NO: 1844597 - DNA, 21 bp, Homo sapiens
gaagcattctcattggaaatt

SEQ ID NO: 1844598 - DNA, 18 bp, Homo sapiens
gaagccaaacctctgtga

SEQ ID NO: 1844599 - DNA, 13 bp, Homo sapiens
gaagcccaggaaa

SEQ ID NO: 1844600 - DNA, 22 bp, Homo sapiens
gaagcccaggaaaggctccagg

SEQ ID NO: 1844601 - DNA, 13 bp, Homo sapiens
gaagcctggaaca

SEQ ID NO: 1844602 - DNA, 21 bp, Homo sapiens
gaagctcagggcctggctcag

SEQ ID NO: 1844603 - DNA, 23 bp, Homo sapiens
gaagctcagggcctggctcaggt

SEQ ID NO: 1844604 - DNA, 14 bp, Homo sapiens
gaagcttaaaataa

SEQ ID NO: 1844605 - DNA, 17 bp, Homo sapiens
gaaggaaacccagctct

SEQ ID NO: 1844606 - DNA, 20 bp, Homo sapiens
gaaggaaacccagctctggt

SEQ ID NO: 1844607 - DNA, 22 bp, Homo sapiens
gaaggaaacccagctctggtcc

SEQ ID NO: 1844608 - DNA, 19 bp, Homo sapiens
gaaggactgtgacaggcag

SEQ ID NO: 1844609 - DNA, 21 bp, Homo sapiens
gaaggactgtgacaggcagca

SEQ ID NO: 1844610 - DNA, 22 bp, Homo sapiens
gaaggatctgctgaggcccagt

SEQ ID NO: 1844611 - DNA, 13 bp, Homo sapiens
gaaggcaatgcca

SEQ ID NO: 1844612 - DNA, 17 bp, Homo sapiens
gaaggccccgcccaggc

SEQ ID NO: 1844613 - DNA, 17 bp, Homo sapiens
gaaggctcgagcatgcc

SEQ ID NO: 1844614 - DNA, 21 bp, Homo sapiens
gaaggctcttctccccagagt

SEQ ID NO: 1844615 - DNA, 22 bp, Homo sapiens
gaaggctgcctgctatgtattt

SEQ ID NO: 1844616 - DNA, 16 bp, Homo sapiens
gaagggcgttctaggt

SEQ ID NO: 1844617 - DNA, 13 bp, Homo sapiens
gaagggggctggg

SEQ ID NO: 1844618 - DNA, 15 bp, Homo sapiens
gaagggggctgggac

SEQ ID NO: 1844619 - DNA, 16 bp, Homo sapiens
gaaggtagaatgtttt

SEQ ID NO: 1844620 - DNA, 20 bp, Homo sapiens
gaaggttctggtgtgaacta

SEQ ID NO: 1844621 - DNA, 15 bp, Homo sapiens
gaagtaaagtgaaga

SEQ ID NO: 1844622 - DNA, 14 bp, Homo sapiens
gaagtgaaactgct

SEQ ID NO: 1844623 - DNA, 19 bp, Homo sapiens
gaataatagcacatgattt

SEQ ID NO: 1844624 - DNA, 13 bp, Homo sapiens
gaataatgggctt

SEQ ID NO: 1844625 - DNA, 17 bp, Homo sapiens
gaatccactcccaggca

SEQ ID NO: 1844626 - DNA, 18 bp, Homo sapiens
gaatctcataattggaat

SEQ ID NO: 1844627 - DNA, 18 bp, Homo sapiens
gaatgcctgagtgcctgg

SEQ ID NO: 1844628 - DNA, 19 bp, Homo sapiens
gaatgcctgagtgcctggc

SEQ ID NO: 1844629 - DNA, 21 bp, Homo sapiens
gaatgtcagttgttatttatt

SEQ ID NO: 1844630 - DNA, 14 bp, Homo sapiens
gaatgtttttctaa

SEQ ID NO: 1844631 - DNA, 13 bp, Homo sapiens
gaattccagtccc

SEQ ID NO: 1844632 - DNA, 19 bp, Homo sapiens
gaattccagtcccctttct

SEQ ID NO: 1844633 - DNA, 23 bp, Homo sapiens
gacaacactcattgacctgaggc

SEQ ID NO: 1844634 - DNA, 19 bp, Homo sapiens
gacaaggaaaggcaaatgc

SEQ ID NO: 1844635 - DNA, 12 bp, Homo sapiens
gacaatgtgaaa

SEQ ID NO: 1844636 - DNA, 18 bp, Homo sapiens
gacaatgtgaaaagaaaa

SEQ ID NO: 1844637 - DNA, 20 bp, Homo sapiens
gacacaaacctgcctgggtt

SEQ ID NO: 1844638 - DNA, 15 bp, Homo sapiens
gacacatgtccaaga

SEQ ID NO: 1844639 - DNA, 12 bp, Homo sapiens
gacaccctgtga

SEQ ID NO: 1844640 - DNA, 23 bp, Homo sapiens
gacaccctgtgatggggccctgc

SEQ ID NO: 1844641 - DNA, 15 bp, Homo sapiens
gacacctaactcttc

SEQ ID NO: 1844642 - DNA, 16 bp, Homo sapiens
gacacctaactcttct

SEQ ID NO: 1844643 - DNA, 19 bp, Homo sapiens
gacacgggcctgtccacag

SEQ ID NO: 1844644 - DNA, 20 bp, Homo sapiens
gacacgggcctgtccacagg

SEQ ID NO: 1844645 - DNA, 22 bp, Homo sapiens
gacagagggggtggcctcccaa

SEQ ID NO: 1844646 - DNA, 14 bp, Homo sapiens
gacagcccgggctc

SEQ ID NO: 1844647 - DNA, 16 bp, Homo sapiens
gacagcccgggctctg

SEQ ID NO: 1844648 - DNA, 21 bp, Homo sapiens
gacagcccgggctctgcctcc

SEQ ID NO: 1844649 - DNA, 22 bp, Homo sapiens
gacagcccgggctctgcctccc

SEQ ID NO: 1844650 - DNA, 20 bp, Homo sapiens
gacagcctccccctgtcccc

SEQ ID NO: 1844651 - DNA, 15 bp, Homo sapiens
gacagcgggaaaaat

SEQ ID NO: 1844652 - DNA, 14 bp, Homo sapiens
gacagctgcctggg

SEQ ID NO: 1844653 - DNA, 13 bp, Homo sapiens
gacagctttctgg

SEQ ID NO: 1844654 - DNA, 17 bp, Homo sapiens
gacagctttctgggatg

SEQ ID NO: 1844655 - DNA, 15 bp, Homo sapiens
gacaggaccagggat

SEQ ID NO: 1844656 - DNA, 14 bp, Homo sapiens
gacaggactgcaga

SEQ ID NO: 1844657 - DNA, 21 bp, Homo sapiens
gacaggagacctggcactgga

SEQ ID NO: 1844658 - DNA, 13 bp, Homo sapiens
gacaggcagcaga

SEQ ID NO: 1844659 - DNA, 21 bp, Homo sapiens
gacagggatgagcatggagct

SEQ ID NO: 1844660 - DNA, 16 bp, Homo sapiens
gacagtcaccccagga

SEQ ID NO: 1844661 - DNA, 17 bp, Homo sapiens
gacagtccagcctggag

SEQ ID NO: 1844662 - DNA, 20 bp, Homo sapiens
gacagtccctgccaatggac

SEQ ID NO: 1844663 - DNA, 17 bp, Homo sapiens
gacagtgcctcttccag

SEQ ID NO: 1844664 - DNA, 22 bp, Homo sapiens
gacagtgcctcttccagtgaac

SEQ ID NO: 1844665 - DNA, 13 bp, Homo sapiens
gacatcatttgta

SEQ ID NO: 1844666 - DNA, 23 bp, Homo sapiens
gacatccatgttccgagaagaac

SEQ ID NO: 1844667 - DNA, 14 bp, Homo sapiens
gacatgggaaaggg

SEQ ID NO: 1844668 - DNA, 17 bp, Homo sapiens
gacatgtcttttcttgc

SEQ ID NO: 1844669 - DNA, 21 bp, Homo sapiens
gacatgtcttttcttgcatga

SEQ ID NO: 1844670 - DNA, 20 bp, Homo sapiens
gacattttatgtctttcttg

SEQ ID NO: 1844671 - DNA, 18 bp, Homo sapiens
gaccacaaaacttttcta

SEQ ID NO: 1844672 - DNA, 14 bp, Homo sapiens
gccaaggtgggagg

SEQ ID NO: 1844673 - DNA, 20 bp, Homo sapiens
gccaatatcccttactttaa

SEQ ID NO: 1844674 - DNA, 19 bp, Homo sapiens
gccacacttcaaactactt

SEQ ID NO: 1844675 - DNA, 22 bp, Homo sapiens
gccaccaacatactcccatctg

SEQ ID NO: 1844676 - DNA, 22 bp, Homo sapiens
gccacccatgcagctgctcccc

SEQ ID NO: 1844677 - DNA, 22 bp, Homo sapiens
gccacctgcggtgctatctccc

SEQ ID NO: 1844678 - DNA, 13 bp, Homo sapiens
gccactgattctc

SEQ ID NO: 1844679 - DNA, 18 bp, Homo sapiens
gccactgtgaagagaacc

SEQ ID NO: 1844680 - DNA, 19 bp, Homo sapiens
gccactgtgaagagaacca

SEQ ID NO: 1844681 - DNA, 18 bp, Homo sapiens
gccagaaaaagatctttc

SEQ ID NO: 1844682 - DNA, 22 bp, Homo sapiens
gccagatgcacatccctggaag

SEQ ID NO: 1844683 - DNA, 22 bp, Homo sapiens
gccagccttgaccattctccac

SEQ ID NO: 1844684 - DNA, 14 bp, Homo sapiens
gccagctgccgcac

SEQ ID NO: 1844685 - DNA, 13 bp, Homo sapiens
gccaggccacaag

SEQ ID NO: 1844686 - DNA, 23 bp, Homo sapiens
gccaggccacaagacccttgtgg

SEQ ID NO: 1844687 - DNA, 13 bp, Homo sapiens
gccaggccctctg

SEQ ID NO: 1844688 - DNA, 15 bp, Homo sapiens
gccaggccctctgcc

SEQ ID NO: 1844689 - DNA, 13 bp, Homo sapiens
gccagggacagag

SEQ ID NO: 1844690 - DNA, 22 bp, Homo sapiens
gccagttggtcccccttccatg

SEQ ID NO: 1844691 - DNA, 13 bp, Homo sapiens
gccatcccagccc

SEQ ID NO: 1844692 - DNA, 20 bp, Homo sapiens
gccatcctcaaacactgcag

SEQ ID NO: 1844693 - DNA, 16 bp, Homo sapiens
gccatctctggatgcc

SEQ ID NO: 1844694 - DNA, 14 bp, Homo sapiens
gccatgcagacctc

SEQ ID NO: 1844695 - DNA, 23 bp, Homo sapiens
gccatgcagacctcatgcccagc

SEQ ID NO: 1844696 - DNA, 19 bp, Homo sapiens
gccatgccagcttatctca

SEQ ID NO: 1844697 - DNA, 24 bp, Homo sapiens
gccatgctcctggcccactgcatc

SEQ ID NO: 1844698 - DNA, 15 bp, Homo sapiens
gccatggagagctgg

SEQ ID NO: 1844699 - DNA, 16 bp, Homo sapiens
gccatgtagaagctgc

SEQ ID NO: 1844700 - DNA, 17 bp, Homo sapiens
gccattgacttcttccc

SEQ ID NO: 1844701 - DNA, 19 bp, Homo sapiens
gcccaacaagttgaagaag

SEQ ID NO: 1844702 - DNA, 15 bp, Homo sapiens
gcccacccctcaaca

SEQ ID NO: 1844703 - DNA, 16 bp, Homo sapiens
gcccacctggcctctg

SEQ ID NO: 1844704 - DNA, 17 bp, Homo sapiens
gcccacctggcctctgc

SEQ ID NO: 1844705 - DNA, 20 bp, Homo sapiens
gcccacctggcctctgcact

SEQ ID NO: 1844706 - DNA, 21 bp, Homo sapiens
gcccacctggcctctgcactc

SEQ ID NO: 1844707 - DNA, 15 bp, Homo sapiens
gcccacgcccccact

SEQ ID NO: 1844708 - DNA, 16 bp, Homo sapiens
gcccacgcccccactg

SEQ ID NO: 1844709 - DNA, 17 bp, Homo sapiens
gcccacgcccccactgg

SEQ ID NO: 1844710 - DNA, 13 bp, Homo sapiens
gcccactccctgc

SEQ ID NO: 1844711 - DNA, 21 bp, Homo sapiens
gcccagagggcctgcaaggga

SEQ ID NO: 1844712 - DNA, 22 bp, Homo sapiens
gcccagagggcctgcaagggag

SEQ ID NO: 1844713 - DNA, 9 bp, Homo sapiens
gcccagccc

SEQ ID NO: 1844714 - DNA, 12 bp, Homo sapiens
gcccagcccctt

SEQ ID NO: 1844715 - DNA, 20 bp, Homo sapiens
gcccagccccttctgaccca

SEQ ID NO: 1844716 - DNA, 15 bp, Homo sapiens
gcccagctctctgac

SEQ ID NO: 1844717 - DNA, 20 bp, Homo sapiens
gccccaaaactctcctctgc

SEQ ID NO: 1844718 - DNA, 22 bp, Homo sapiens
gccccacccagatgggggaaag

SEQ ID NO: 1844719 - DNA, 19 bp, Homo sapiens
gccccactttgaagggcaa

SEQ ID NO: 1844720 - DNA, 23 bp, Homo sapiens
gccccatcctctgtacagagccc

SEQ ID NO: 1844721 - DNA, 19 bp, Homo sapiens
gcccccactgcctttgacc

SEQ ID NO: 1844722 - DNA, 20 bp, Homo sapiens
gccccctccccccagactct

SEQ ID NO: 1844723 - DNA, 21 bp, Homo sapiens
gccccctgtacatttgtgctc

SEQ ID NO: 1844724 - DNA, 14 bp, Homo sapiens
gccccgcccaggct

SEQ ID NO: 1844725 - DNA, 16 bp, Homo sapiens
gcccctcagggtccct

SEQ ID NO: 1844726 - DNA, 18 bp, Homo sapiens
gcccctggatgcagcctc

SEQ ID NO: 1844727 - DNA, 21 bp, Homo sapiens
gcccgaatacaaacacctgga

SEQ ID NO: 1844728 - DNA, 12 bp, Homo sapiens
gcccgcagggcc

SEQ ID NO: 1844729 - DNA, 12 bp, Homo sapiens
gcccgggctctg

SEQ ID NO: 1844730 - DNA, 14 bp, Homo sapiens
gcccgggctctgcc

SEQ ID NO: 1844731 - DNA, 20 bp, Homo sapiens
gcccgggctctgcctcccat

SEQ ID NO: 1844732 - DNA, 21 bp, Homo sapiens
gcccgggctctgcctcccatc

SEQ ID NO: 1844733 - DNA, 22 bp, Homo sapiens
gccctccaagaccttctccttc

SEQ ID NO: 1844734 - DNA, 17 bp, Homo sapiens
gccctctcccctcagcc

SEQ ID NO: 1844735 - DNA, 16 bp, Homo sapiens
gccctctgcccactcc

SEQ ID NO: 1844736 - DNA, 18 bp, Homo sapiens
gccctctgcccactccct

SEQ ID NO: 1844737 - DNA, 19 bp, Homo sapiens
gccctctgcccactccctg

SEQ ID NO: 1844738 - DNA, 22 bp, Homo sapiens
gccctctgcccactccctgcaa

SEQ ID NO: 1844739 - DNA, 17 bp, Homo sapiens
gccctgcccacctggcc

SEQ ID NO: 1844740 - DNA, 20 bp, Homo sapiens
gccctgcccacctggcctct

SEQ ID NO: 1844741 - DNA, 22 bp, Homo sapiens
gccctgcccacctggcctctgc

SEQ ID NO: 1844742 - DNA, 16 bp, Homo sapiens
gccctgcctcctttgt

SEQ ID NO: 1844743 - DNA, 14 bp, Homo sapiens
gccctggctgaagg

SEQ ID NO: 1844744 - DNA, 16 bp, Homo sapiens
gccctggctgaaggac

SEQ ID NO: 1844745 - DNA, 13 bp, Homo sapiens
gcccttctctcca

SEQ ID NO: 1844746 - DNA, 18 bp, Homo sapiens
gcccttctctccagcccc

SEQ ID NO: 1844747 - DNA, 20 bp, Homo sapiens
gcccttgtcgtgggatggca

SEQ ID NO: 1844748 - DNA, 17 bp, Homo sapiens
gccgagattgcaccact

SEQ ID NO: 1844749 - DNA, 13 bp, Homo sapiens
gccgatggaaaat

SEQ ID NO: 1844750 - DNA, 12 bp, Homo sapiens
gccgcaccagcc

SEQ ID NO: 1844751 - DNA, 13 bp, Homo sapiens
gccgcaccagccc

SEQ ID NO: 1844752 - DNA, 16 bp, Homo sapiens
gccgccatgctcctgg

SEQ ID NO: 1844753 - DNA, 19 bp, Homo sapiens
gccgggaccccgagcctgg

SEQ ID NO: 1844754 - DNA, 23 bp, Homo sapiens
gccgggaccccgagcctggctcc

SEQ ID NO: 1844755 - DNA, 15 bp, Homo sapiens
gccggggcagccccc

SEQ ID NO: 1844756 - DNA, 16 bp, Homo sapiens
gccgtctacctgaggg

SEQ ID NO: 1844757 - DNA, 22 bp, Homo sapiens
gccgtctacctgaggggcctct

SEQ ID NO: 1844758 - DNA, 15 bp, Homo sapiens
gccgtgggcctgggg

SEQ ID NO: 1844759 - DNA, 19 bp, Homo sapiens
gccgttgatgttggctggg

SEQ ID NO: 1844760 - DNA, 16 bp, Homo sapiens
gcctaaggctgaactt

SEQ ID NO: 1844761 - DNA, 21 bp, Homo sapiens
gcctcacagtccttaccagca

SEQ ID NO: 1844762 - DNA, 17 bp, Homo sapiens
gcctcccaactcacccc

SEQ ID NO: 1844763 - DNA, 21 bp, Homo sapiens
gcctcccacgactgcccggca

SEQ ID NO: 1844764 - DNA, 14 bp, Homo sapiens
gcctcccatcaccc

SEQ ID NO: 1844765 - DNA, 16 bp, Homo sapiens
gcctcccatcacccgc

SEQ ID NO: 1844766 - DNA, 22 bp, Homo sapiens
gcctcccttcatgcatggaaat

SEQ ID NO: 1844767 - DNA, 16 bp, Homo sapiens
gcctctacccaaccag

SEQ ID NO: 1844768 - DNA, 15 bp, Homo sapiens
gcctctgcactcccc

SEQ ID NO: 1844769 - DNA, 18 bp, Homo sapiens
gcctctgcactcccctgc

SEQ ID NO: 1844770 - DNA, 21 bp, Homo sapiens
gcctctgcactcccctgctgg

SEQ ID NO: 1844771 - DNA, 12 bp, Homo sapiens
gcctcttctcta

SEQ ID NO: 1844772 - DNA, 15 bp, Homo sapiens
gcctgagtgcctggc

SEQ ID NO: 1844773 - DNA, 14 bp, Homo sapiens
gcctgatggacctg

SEQ ID NO: 1844774 - DNA, 13 bp, Homo sapiens
gcctgctccagct

SEQ ID NO: 1844775 - DNA, 18 bp, Homo sapiens
gcctgctccagctgttca

SEQ ID NO: 1844776 - DNA, 21 bp, Homo sapiens
gcctgctcccatcctgtgtgt

SEQ ID NO: 1844777 - DNA, 23 bp, Homo sapiens
gcctggaagacagagacctcctg

SEQ ID NO: 1844778 - DNA, 16 bp, Homo sapiens
gcctggatggggctgc

SEQ ID NO: 1844779 - DNA, 14 bp, Homo sapiens
gcctggcccctcag

SEQ ID NO: 1844780 - DNA, 17 bp, Homo sapiens
gcctggcccctcagggt

SEQ ID NO: 1844781 - DNA, 20 bp, Homo sapiens
gcctggcctgagctgggatg

SEQ ID NO: 1844782 - DNA, 23 bp, Homo sapiens
gcctgggatccctcatcctcata

SEQ ID NO: 1844783 - DNA, 21 bp, Homo sapiens
gcctgggcctcctcacaacat

SEQ ID NO: 1844784 - DNA, 22 bp, Homo sapiens
gcctggggtaccaagagactcc

SEQ ID NO: 1844785 - DNA, 15 bp, Homo sapiens
gcctgtaatcctagc

SEQ ID NO: 1844786 - DNA, 20 bp, Homo sapiens
gcctgttttagaaggttctc

SEQ ID NO: 1844787 - DNA, 22 bp, Homo sapiens
gccttccacttggctacacagg

SEQ ID NO: 1844788 - DNA, 23 bp, Homo sapiens
gccttgaccattctccacctgcc

SEQ ID NO: 1844789 - DNA, 23 bp, Homo sapiens
gccttgtttaatggtagttttac

SEQ ID NO: 1844790 - DNA, 15 bp, Homo sapiens
gcctttgagactgtt

SEQ ID NO: 1844791 - DNA, 13 bp, Homo sapiens
gcgagcctgctag

SEQ ID NO: 1844792 - DNA, 22 bp, Homo sapiens
gcgcaaagggcatgggtcggga

SEQ ID NO: 1844793 - DNA, 18 bp, Homo sapiens
gggcctcttatgggctgg

SEQ ID NO: 1844794 - DNA, 13 bp, Homo sapiens
gggcctggcctga

SEQ ID NO: 1844795 - DNA, 18 bp, Homo sapiens
gggcctggcctgagctgg

SEQ ID NO: 1844796 - DNA, 23 bp, Homo sapiens
gggcctgtccacaggcttctgag

SEQ ID NO: 1844797 - DNA, 16 bp, Homo sapiens
gggcgcggtggctcac

SEQ ID NO: 1844798 - DNA, 10 bp, Homo sapiens
gggctcagca

SEQ ID NO: 1844799 - DNA, 18 bp, Homo sapiens
gggctcagcaaaagatgc

SEQ ID NO: 1844800 - DNA, 10 bp, Homo sapiens
gggctccaga

SEQ ID NO: 1844801 - DNA, 17 bp, Homo sapiens
gggctcccttcccacct

SEQ ID NO: 1844802 - DNA, 18 bp, Homo sapiens
gggctcccttcccacctc

SEQ ID NO: 1844803 - DNA, 13 bp, Homo sapiens
gggctctgcctcc

SEQ ID NO: 1844804 - DNA, 16 bp, Homo sapiens
gggctctgcctcccat

SEQ ID NO: 1844805 - DNA, 17 bp, Homo sapiens
gggctctgcctcccatc

SEQ ID NO: 1844806 - DNA, 20 bp, Homo sapiens
gggctctgcctcccatcacc

SEQ ID NO: 1844807 - DNA, 16 bp, Homo sapiens
gggctgaggtgggagg

SEQ ID NO: 1844808 - DNA, 20 bp, Homo sapiens
gggctgcaccggctggcctg

SEQ ID NO: 1844809 - DNA, 22 bp, Homo sapiens
gggctgcaccggctggcctggc

SEQ ID NO: 1844810 - DNA, 20 bp, Homo sapiens
gggctgccggggcagccccc

SEQ ID NO: 1844811 - DNA, 23 bp, Homo sapiens
gggctggaacagattcacactgt

SEQ ID NO: 1844812 - DNA, 16 bp, Homo sapiens
gggctgtcgggggctg

SEQ ID NO: 1844813 - DNA, 13 bp, Homo sapiens
gggcttagagcag

SEQ ID NO: 1844814 - DNA, 23 bp, Homo sapiens
gggcttcccagtggctgctgccc

SEQ ID NO: 1844815 - DNA, 15 bp, Homo sapiens
gggctttagggacct

SEQ ID NO: 1844816 - DNA, 24 bp, Homo sapiens
ggggaaaatcagcctgctccagct

SEQ ID NO: 1844817 - DNA, 21 bp, Homo sapiens
ggggaaaatggccatgcagga

SEQ ID NO: 1844818 - DNA, 13 bp, Homo sapiens
ggggaaagcacag

SEQ ID NO: 1844819 - DNA, 13 bp, Homo sapiens
ggggacagggatg

SEQ ID NO: 1844820 - DNA, 17 bp, Homo sapiens
ggggatcacagcctctg

SEQ ID NO: 1844821 - DNA, 23 bp, Homo sapiens
ggggcagaggcagtacctgggca

SEQ ID NO: 1844822 - DNA, 16 bp, Homo sapiens
ggggccctgcctcctt

SEQ ID NO: 1844823 - DNA, 22 bp, Homo sapiens
ggggctgcaccggctggcctgg

SEQ ID NO: 1844824 - DNA, 15 bp, Homo sapiens
ggggctgctggcctg

SEQ ID NO: 1844825 - DNA, 17 bp, Homo sapiens
ggggctggcactgactg

SEQ ID NO: 1844826 - DNA, 21 bp, Homo sapiens
ggggctggggccaaataaagt

SEQ ID NO: 1844827 - DNA, 17 bp, Homo sapiens
gggggatcacagcctct

SEQ ID NO: 1844828 - DNA, 21 bp, Homo sapiens
ggggtcactctggcagctcag

SEQ ID NO: 1844829 - DNA, 23 bp, Homo sapiens
ggggttcccttttttggctgctg

SEQ ID NO: 1844830 - DNA, 20 bp, Homo sapiens
gggtcactctggcagctcag

SEQ ID NO: 1844831 - DNA, 18 bp, Homo sapiens
gggtcgggagaggggacg

SEQ ID NO: 1844832 - DNA, 12 bp, Homo sapiens
gggtctctgctg

SEQ ID NO: 1844833 - DNA, 13 bp, Homo sapiens
gggtctctgctgc

SEQ ID NO: 1844834 - DNA, 15 bp, Homo sapiens
gggtgcacccacctg

SEQ ID NO: 1844835 - DNA, 14 bp, Homo sapiens
gggtggcactgcca

SEQ ID NO: 1844836 - DNA, 17 bp, Homo sapiens
gggttctacccaggtgc

SEQ ID NO: 1844837 - DNA, 20 bp, Homo sapiens
ggtaagcacttaatgaatga

SEQ ID NO: 1844838 - DNA, 20 bp, Homo sapiens
ggtaaggaatacctgtcccc

SEQ ID NO: 1844839 - DNA, 18 bp, Homo sapiens
ggtaagtgttctcatgaa

SEQ ID NO: 1844840 - DNA, 14 bp, Homo sapiens
ggtattcctgcctc

SEQ ID NO: 1844841 - DNA, 16 bp, Homo sapiens
ggtcactctggcagct

SEQ ID NO: 1844842 - DNA, 13 bp, Homo sapiens
ggtcactggaact

SEQ ID NO: 1844843 - DNA, 20 bp, Homo sapiens
ggtccacaggaagtgaagaa

SEQ ID NO: 1844844 - DNA, 21 bp, Homo sapiens
ggtccagccctggctgaagga

SEQ ID NO: 1844845 - DNA, 15 bp, Homo sapiens
ggtcccaccccacac

SEQ ID NO: 1844846 - DNA, 17 bp, Homo sapiens
ggtcccaccccacacac

SEQ ID NO: 1844847 - DNA, 12 bp, Homo sapiens
ggtcctgctgca

SEQ ID NO: 1844848 - DNA, 14 bp, Homo sapiens
ggtcctgctgcagt

SEQ ID NO: 1844849 - DNA, 14 bp, Homo sapiens
ggtcggaccagctt

SEQ ID NO: 1844850 - DNA, 12 bp, Homo sapiens
ggtctctgctgc

SEQ ID NO: 1844851 - DNA, 18 bp, Homo sapiens
ggtgacatcaggtttttc

SEQ ID NO: 1844852 - DNA, 17 bp, Homo sapiens
ggtgaggggctggcact

SEQ ID NO: 1844853 - DNA, 22 bp, Homo sapiens
ggtgcacaagctccaagctccc

SEQ ID NO: 1844854 - DNA, 15 bp, Homo sapiens
ggtgcacccacctgt

SEQ ID NO: 1844855 - DNA, 19 bp, Homo sapiens
ggtgccctgttctctacca

SEQ ID NO: 1844856 - DNA, 16 bp, Homo sapiens
ggtgcgtgttcagcag

SEQ ID NO: 1844857 - DNA, 19 bp, Homo sapiens
ggtgctatctcccccagcc

SEQ ID NO: 1844858 - DNA, 23 bp, Homo sapiens
ggtgctatctcccccagccccat

SEQ ID NO: 1844859 - DNA, 15 bp, Homo sapiens
ggtgctccaggcagg

SEQ ID NO: 1844860 - DNA, 15 bp, Homo sapiens
ggtggaacaagcaca

SEQ ID NO: 1844861 - DNA, 21 bp, Homo sapiens
ggtggagccagtaaacagagg

SEQ ID NO: 1844862 - DNA, 17 bp, Homo sapiens
ggtggcctcccaactca

SEQ ID NO: 1844863 - DNA, 23 bp, Homo sapiens
ggtggcctcccaactcaccccag

SEQ ID NO: 1844864 - DNA, 13 bp, Homo sapiens
ggtgggacaccct

SEQ ID NO: 1844865 - DNA, 20 bp, Homo sapiens
ggtgggaggattgcttgagc

SEQ ID NO: 1844866 - DNA, 15 bp, Homo sapiens
ggtgggatcctccag

SEQ ID NO: 1844867 - DNA, 20 bp, Homo sapiens
ggtgggcttcccagtggctg

SEQ ID NO: 1844868 - DNA, 23 bp, Homo sapiens
ggtggggtcactctggcagctca

SEQ ID NO: 1844869 - DNA, 13 bp, Homo sapiens
ggtggtggagcca

SEQ ID NO: 1844870 - DNA, 16 bp, Homo sapiens
ggtgtatggttctgtg

SEQ ID NO: 1844871 - DNA, 23 bp, Homo sapiens
ggtgtggagaagcggctggcagc

SEQ ID NO: 1844872 - DNA, 11 bp, Homo sapiens
ggtgtggggga

SEQ ID NO: 1844873 - DNA, 17 bp, Homo sapiens
ggtgtttcctggcactg

SEQ ID NO: 1844874 - DNA, 17 bp, Homo sapiens
ggttaggcattgtggga

SEQ ID NO: 1844875 - DNA, 13 bp, Homo sapiens
ggttatggagagg

SEQ ID NO: 1844876 - DNA, 21 bp, Homo sapiens
ggttccctttgacgccatccc

SEQ ID NO: 1844877 - DNA, 23 bp, Homo sapiens
ggttccctttgacgccatcccag

SEQ ID NO: 1844878 - DNA, 22 bp, Homo sapiens
ggttcccttttttggctgctga

SEQ ID NO: 1844879 - DNA, 16 bp, Homo sapiens
ggttcctcccctcctc

SEQ ID NO: 1844880 - DNA, 18 bp, Homo sapiens
ggttggcaaaaaggcagg

SEQ ID NO: 1844881 - DNA, 13 bp, Homo sapiens
ggttggtgggggc

SEQ ID NO: 1844882 - DNA, 15 bp, Homo sapiens
ggtttctggtctcta

SEQ ID NO: 1844883 - DNA, 15 bp, Homo sapiens
ggtttgaagcctgga

SEQ ID NO: 1844884 - DNA, 17 bp, Homo sapiens
ggtttgaagcctggaac

SEQ ID NO: 1844885 - DNA, 13 bp, Homo sapiens
gtaaatataaaga

SEQ ID NO: 1844886 - DNA, 19 bp, Homo sapiens
gtaaatataaagacgtttt

SEQ ID NO: 1844887 - DNA, 22 bp, Homo sapiens
gtaactgtttagatgaatgtca

SEQ ID NO: 1844888 - DNA, 18 bp, Homo sapiens
gtaagagcttgctccaga

SEQ ID NO: 1844889 - DNA, 21 bp, Homo sapiens
gtaaggaatacctgtccccct

SEQ ID NO: 1844890 - DNA, 17 bp, Homo sapiens
gtaagtgttctcatgaa

SEQ ID NO: 1844891 - DNA, 22 bp, Homo sapiens
gtaatagaagcttaaaataaag

SEQ ID NO: 1844892 - DNA, 17 bp, Homo sapiens
gtaatatggactcagcc

SEQ ID NO: 1844893 - DNA, 21 bp, Homo sapiens
gtacaaatattcctgtttctg

SEQ ID NO: 1844894 - DNA, 18 bp, Homo sapiens
gtacagagcccacgcccc

SEQ ID NO: 1844895 - DNA, 16 bp, Homo sapiens
gtacctgggcaagctg

SEQ ID NO: 1844896 - DNA, 19 bp, Homo sapiens
gtactacagtcctcccatc

SEQ ID NO: 1844897 - DNA, 14 bp, Homo sapiens
gtagaatgttttca

SEQ ID NO: 1844898 - DNA, 13 bp, Homo sapiens
gtagagtgggagc

SEQ ID NO: 1844899 - DNA, 15 bp, Homo sapiens
gtaggaagactttgg

SEQ ID NO: 1844900 - DNA, 22 bp, Homo sapiens
gtaggggagggcaggcttgggg

SEQ ID NO: 1844901 - DNA, 15 bp, Homo sapiens
gtataaacaagaaaa

SEQ ID NO: 1844902 - DNA, 16 bp, Homo sapiens
gtataaacaagaaaaa

SEQ ID NO: 1844903 - DNA, 18 bp, Homo sapiens
gtatactgggggcaaaat

SEQ ID NO: 1844904 - DNA, 15 bp, Homo sapiens
gtatcaaataaaatt

SEQ ID NO: 1844905 - DNA, 19 bp, Homo sapiens
gtatctggtgactttcctc

SEQ ID NO: 1844906 - DNA, 16 bp, Homo sapiens
gtatgatacttcgaca

SEQ ID NO: 1844907 - DNA, 19 bp, Homo sapiens
gtatgatcggcaggacacc

SEQ ID NO: 1844908 - DNA, 16 bp, Homo sapiens
gtatgtgcatttaatt

SEQ ID NO: 1844909 - DNA, 19 bp, Homo sapiens
gtattatgttccaaggcta

SEQ ID NO: 1844910 - DNA, 14 bp, Homo sapiens
gtattcctgcctcc

SEQ ID NO: 1844911 - DNA, 19 bp, Homo sapiens
gtattgtgcaatgtgtata

SEQ ID NO: 1844912 - DNA, 17 bp, Homo sapiens
gtattttatgttatata

SEQ ID NO: 1844913 - DNA, 13 bp, Homo sapiens
gtcaacatttctc

SEQ ID NO: 1844914 - DNA, 17 bp, Homo sapiens
gtcaacatttctcatgt

SEQ ID NO: 1844915 - DNA, 14 bp, Homo sapiens
tagctttgctctgc

SEQ ID NO: 1844916 - DNA, 14 bp, Homo sapiens
taggcattgtggga

SEQ ID NO: 1844917 - DNA, 16 bp, Homo sapiens
taggcatttgctgaat

SEQ ID NO: 1844918 - DNA, 23 bp, Homo sapiens
taggctgacacctaactcttctt

SEQ ID NO: 1844919 - DNA, 11 bp, Homo sapiens
tagggaaaaac

SEQ ID NO: 1844920 - DNA, 19 bp, Homo sapiens
tagggaaaaaccagcgtgt

SEQ ID NO: 1844921 - DNA, 20 bp, Homo sapiens
tagggaaaaaccagcgtgtg

SEQ ID NO: 1844922 - DNA, 13 bp, Homo sapiens
tagggaaagaaag

SEQ ID NO: 1844923 - DNA, 20 bp, Homo sapiens
tagggaagggtggtggagcc

SEQ ID NO: 1844924 - DNA, 21 bp, Homo sapiens
tagggaagggtggtggagcca

SEQ ID NO: 1844925 - DNA, 12 bp, Homo sapiens
taggggctgggg

SEQ ID NO: 1844926 - DNA, 15 bp, Homo sapiens
tagtaattctcaggc

SEQ ID NO: 1844927 - DNA, 12 bp, Homo sapiens
tagtcttggcta

SEQ ID NO: 1844928 - DNA, 20 bp, Homo sapiens
tagtgatcacagcagcttct

SEQ ID NO: 1844929 - DNA, 12 bp, Homo sapiens
tagtgtctatca

SEQ ID NO: 1844930 - DNA, 23 bp, Homo sapiens
tagttagtgattatatttcaccc

SEQ ID NO: 1844931 - DNA, 21 bp, Homo sapiens
tagttgtttgattcagacagc

SEQ ID NO: 1844932 - DNA, 18 bp, Homo sapiens
tagttttgtgatgcattt

SEQ ID NO: 1844933 - DNA, 19 bp, Homo sapiens
tataaacaagaaaaataaa

SEQ ID NO: 1844934 - DNA, 22 bp, Homo sapiens
tataaacaagaaaaataaagaa

SEQ ID NO: 1844935 - DNA, 19 bp, Homo sapiens
tataaatcgcttttgataa

SEQ ID NO: 1844936 - DNA, 18 bp, Homo sapiens
tataaatgcaaataacaa

SEQ ID NO: 1844937 - DNA, 14 bp, Homo sapiens
tataaccacatttc

SEQ ID NO: 1844938 - DNA, 20 bp, Homo sapiens
tataatcacttttttccaca

SEQ ID NO: 1844939 - DNA, 20 bp, Homo sapiens
tataatttaaacgtgatttt

SEQ ID NO: 1844940 - DNA, 17 bp, Homo sapiens
tatacaaataaacttgt

SEQ ID NO: 1844941 - DNA, 23 bp, Homo sapiens
tatactgggggcaaaatcagaat

SEQ ID NO: 1844942 - DNA, 20 bp, Homo sapiens
tatagtaatgtgacttggat

SEQ ID NO: 1844943 - DNA, 16 bp, Homo sapiens
tatatgtgatgatcta

SEQ ID NO: 1844944 - DNA, 12 bp, Homo sapiens
tatattattact

SEQ ID NO: 1844945 - DNA, 19 bp, Homo sapiens
tatattcattctttttgaa

SEQ ID NO: 1844946 - DNA, 16 bp, Homo sapiens
tatcacctagctgaat

SEQ ID NO: 1844947 - DNA, 14 bp, Homo sapiens
tatcatcagtattg

SEQ ID NO: 1844948 - DNA, 16 bp, Homo sapiens
tatcatcagtattgaa

SEQ ID NO: 1844949 - DNA, 21 bp, Homo sapiens
tatccaattttaaaatgaaat

SEQ ID NO: 1844950 - DNA, 23 bp, Homo sapiens
tatcccttactttaaccctttct

SEQ ID NO: 1844951 - DNA, 18 bp, Homo sapiens
tatcccttggacatttta

SEQ ID NO: 1844952 - DNA, 15 bp, Homo sapiens
tatctcagggcctgg

SEQ ID NO: 1844953 - DNA, 14 bp, Homo sapiens
tatctcccccagcc

SEQ ID NO: 1844954 - DNA, 11 bp, Homo sapiens
tatctttgcca

SEQ ID NO: 1844955 - DNA, 16 bp, Homo sapiens
tatctttgccaccctc

SEQ ID NO: 1844956 - DNA, 16 bp, Homo sapiens
tatgaacagctgtgtc

SEQ ID NO: 1844957 - DNA, 20 bp, Homo sapiens
tatgatacttcgacactgtt

SEQ ID NO: 1844958 - DNA, 23 bp, Homo sapiens
tatgatacttcgacactgttctt

SEQ ID NO: 1844959 - DNA, 21 bp, Homo sapiens
tatgatagatgacaaattggg

SEQ ID NO: 1844960 - DNA, 15 bp, Homo sapiens
tatgctttaaacatt

SEQ ID NO: 1844961 - DNA, 21 bp, Homo sapiens
tatggacggtgctccaggcag

SEQ ID NO: 1844962 - DNA, 14 bp, Homo sapiens
tatggactcagcct

SEQ ID NO: 1844963 - DNA, 18 bp, Homo sapiens
tatggactcagccttgca

SEQ ID NO: 1844964 - DNA, 15 bp, Homo sapiens
tatggatgtccccag

SEQ ID NO: 1844965 - DNA, 16 bp, Homo sapiens
tatggatgtccccagc

SEQ ID NO: 1844966 - DNA, 17 bp, Homo sapiens
tatgtattgtgcaatgt

SEQ ID NO: 1844967 - DNA, 21 bp, Homo sapiens
tatgtctagggtgtgatttag

SEQ ID NO: 1844968 - DNA, 14 bp, Homo sapiens
tatgttaatatttt

SEQ ID NO: 1844969 - DNA, 20 bp, Homo sapiens
tatgttatatataaatatat

SEQ ID NO: 1844970 - DNA, 16 bp, Homo sapiens
tatgttccattaaacg

SEQ ID NO: 1844971 - DNA, 17 bp, Homo sapiens
tatgttgaagcctttgt

SEQ ID NO: 1844972 - DNA, 22 bp, Homo sapiens
tattaaagaaaaaaatgtattt

SEQ ID NO: 1844973 - DNA, 19 bp, Homo sapiens
tattaacaaattgcatttg

SEQ ID NO: 1844974 - DNA, 22 bp, Homo sapiens
tattacaccaccggccccctcc

SEQ ID NO: 1844975 - DNA, 21 bp, Homo sapiens
tattacttgtaaatataaaga

SEQ ID NO: 1844976 - DNA, 21 bp, Homo sapiens
tattacttgtttgtaagattt

SEQ ID NO: 1844977 - DNA, 13 bp, Homo sapiens
tattatattcatt

SEQ ID NO: 1844978 - DNA, 12 bp, Homo sapiens
tattattaatta

SEQ ID NO: 1844979 - DNA, 18 bp, Homo sapiens
tattcaggaagctcaggg

SEQ ID NO: 1844980 - DNA, 23 bp, Homo sapiens
tattcattctttttgaaatgtca

SEQ ID NO: 1844981 - DNA, 11 bp, Homo sapiens
tattcctgcct

SEQ ID NO: 1844982 - DNA, 12 bp, Homo sapiens
tattgaagcatt

SEQ ID NO: 1844983 - DNA, 13 bp, Homo sapiens
tattgaagcattt

SEQ ID NO: 1844984 - DNA, 13 bp, Homo sapiens
tattgatgttttc

SEQ ID NO: 1844985 - DNA, 12 bp, Homo sapiens
tattgctggggt

SEQ ID NO: 1844986 - DNA, 23 bp, Homo sapiens
tattgtgcaatgtgtataaacaa

SEQ ID NO: 1844987 - DNA, 16 bp, Homo sapiens
tatttaacaaaatttg

SEQ ID NO: 1844988 - DNA, 18 bp, Homo sapiens
tatttaacaaaatttgaa

SEQ ID NO: 1844989 - DNA, 12 bp, Homo sapiens
tatttatgtatt

SEQ ID NO: 1844990 - DNA, 20 bp, Homo sapiens
tatttatgtattgtgcaatg

SEQ ID NO: 1844991 - DNA, 22 bp, Homo sapiens
tatttattaaatgcccagcccc

SEQ ID NO: 1844992 - DNA, 12 bp, Homo sapiens
tatttattgaaa

SEQ ID NO: 1844993 - DNA, 16 bp, Homo sapiens
tatttattgaaatgat

SEQ ID NO: 1844994 - DNA, 20 bp, Homo sapiens
tatttattgaaatgatttca

SEQ ID NO: 1844995 - DNA, 14 bp, Homo sapiens
tatttatttattta

SEQ ID NO: 1844996 - DNA, 20 bp, Homo sapiens
tatttccctcccctggggac

SEQ ID NO: 1844997 - DNA, 23 bp, Homo sapiens
tatttctgaggagcctgcaacat

SEQ ID NO: 1844998 - DNA, 19 bp, Homo sapiens
tatttgcaaggctgattta

SEQ ID NO: 1844999 - DNA, 21 bp, Homo sapiens
tatttgcaaggctgatttatg

SEQ ID NO: 1845000 - DNA, 12 bp, Homo sapiens
tattttatgtta

SEQ ID NO: 1845001 - DNA, 21 bp, Homo sapiens
tattttgtagcgtacatcaat

SEQ ID NO: 1845002 - DNA, 22 bp, Homo sapiens
tcaaaacggttttactgcagct

SEQ ID NO: 1845003 - DNA, 14 bp, Homo sapiens
tcaaacactgcagg

SEQ ID NO: 1845004 - DNA, 21 bp, Homo sapiens
tcaaactactttgctgctaat

SEQ ID NO: 1845005 - DNA, 20 bp, Homo sapiens
tcaaatggaagacacattga

SEQ ID NO: 1845006 - DNA, 12 bp, Homo sapiens
tcaactgaaggg

SEQ ID NO: 1845007 - DNA, 18 bp, Homo sapiens
tcaactgggctgaacact

SEQ ID NO: 1845008 - DNA, 20 bp, Homo sapiens
tcaagactggaaggtgggga

SEQ ID NO: 1845009 - DNA, 15 bp, Homo sapiens
tcaagagcacacttg

SEQ ID NO: 1845010 - DNA, 12 bp, Homo sapiens
tcaagcagccaa

SEQ ID NO: 1845011 - DNA, 12 bp, Homo sapiens
tcaagccaccaa

SEQ ID NO: 1845012 - DNA, 20 bp, Homo sapiens
tcaagccaccaacatactcc

SEQ ID NO: 1845013 - DNA, 16 bp, Homo sapiens
tcaaggaagaagaaat

SEQ ID NO: 1845014 - DNA, 14 bp, Homo sapiens
tcaaggcactgcct

SEQ ID NO: 1845015 - DNA, 20 bp, Homo sapiens
tcaatacctggcctcattta

SEQ ID NO: 1845016 - DNA, 21 bp, Homo sapiens
tcaatacctggcctcatttaa

SEQ ID NO: 1845017 - DNA, 19 bp, Homo sapiens
tcaatgagcatgtttagac

SEQ ID NO: 1845018 - DNA, 19 bp, Homo sapiens
tcaattcttccctatcttt

SEQ ID NO: 1845019 - DNA, 23 bp, Homo sapiens
tcaattcttccctatctttgcca

SEQ ID NO: 1845020 - DNA, 17 bp, Homo sapiens
tcacacgggggcagctg

SEQ ID NO: 1845021 - DNA, 23 bp, Homo sapiens
tcacactgtggcctgatcagcag

SEQ ID NO: 1845022 - DNA, 20 bp, Homo sapiens
tcacagatgggtgcttggag

SEQ ID NO: 1845023 - DNA, 20 bp, Homo sapiens
tcacagcacttacaattttc

SEQ ID NO: 1845024 - DNA, 14 bp, Homo sapiens
tcacagtattgctc

SEQ ID NO: 1845025 - DNA, 15 bp, Homo sapiens
tcacagtattgctca

SEQ ID NO: 1845026 - DNA, 17 bp, Homo sapiens
tcacatagagtgatctt

SEQ ID NO: 1845027 - DNA, 19 bp, Homo sapiens
tcacatgctaaagccagga

SEQ ID NO: 1845028 - DNA, 20 bp, Homo sapiens
tcacattaatctcaaagaga

SEQ ID NO: 1845029 - DNA, 20 bp, Homo sapiens
tcaccacatgcggagaacaa

SEQ ID NO: 1845030 - DNA, 14 bp, Homo sapiens
tcaccccagcccca

SEQ ID NO: 1845031 - DNA, 20 bp, Homo sapiens
tcaccccagccccaaaactc

SEQ ID NO: 1845032 - DNA, 17 bp, Homo sapiens
tcaccccggccacctgc

SEQ ID NO: 1845033 - DNA, 18 bp, Homo sapiens
tcaccccggccacctgcg

SEQ ID NO: 1845034 - DNA, 18 bp, Homo sapiens
tcacctggggctgctggc

SEQ ID NO: 1845035 - DNA, 20 bp, Homo sapiens
tcacctggggctgctggcct

SEQ ID NO: 1845036 - DNA, 13 bp, Homo sapiens
tcaccttggaagg

SEQ ID NO: 1845037 - DNA, 20 bp, Homo sapiens
tcctgcaatgaagtctctga

SEQ ID NO: 1845038 - DNA, 21 bp, Homo sapiens
tcctgcacacgctccttcctc

SEQ ID NO: 1845039 - DNA, 22 bp, Homo sapiens
tcctgcacacgctccttcctct

SEQ ID NO: 1845040 - DNA, 12 bp, Homo sapiens
tcctgcaggcag

SEQ ID NO: 1845041 - DNA, 16 bp, Homo sapiens
tcctgcaggcagccag

SEQ ID NO: 1845042 - DNA, 17 bp, Homo sapiens
tcctgcaggcagccagg

SEQ ID NO: 1845043 - DNA, 20 bp, Homo sapiens
tcctgcaggcagccaggcca

SEQ ID NO: 1845044 - DNA, 14 bp, Homo sapiens
tcctgccaggcatg

SEQ ID NO: 1845045 - DNA, 14 bp, Homo sapiens
tcctgcctccgcct

SEQ ID NO: 1845046 - DNA, 21 bp, Homo sapiens
tcctgctgcagttgccagtca

SEQ ID NO: 1845047 - DNA, 18 bp, Homo sapiens
tcctggcactgcttccag

SEQ ID NO: 1845048 - DNA, 13 bp, Homo sapiens
tcctgtagcccta

SEQ ID NO: 1845049 - DNA, 18 bp, Homo sapiens
tcctgtgtgttaagctct

SEQ ID NO: 1845050 - DNA, 20 bp, Homo sapiens
tcctgtgtgttaagctctgc

SEQ ID NO: 1845051 - DNA, 22 bp, Homo sapiens
tcctgtgtgttaagctctgcta

SEQ ID NO: 1845052 - DNA, 19 bp, Homo sapiens
tccttcacagatgggtgct

SEQ ID NO: 1845053 - DNA, 21 bp, Homo sapiens
tccttcacctttgtccccacc

SEQ ID NO: 1845054 - DNA, 22 bp, Homo sapiens
tccttgaaaacactgttctctg

SEQ ID NO: 1845055 - DNA, 18 bp, Homo sapiens
tccttttcgcaggattct

SEQ ID NO: 1845056 - DNA, 18 bp, Homo sapiens
tcgagcatgcctggatgg

SEQ ID NO: 1845057 - DNA, 17 bp, Homo sapiens
tcgaggcggatctttgg

SEQ ID NO: 1845058 - DNA, 21 bp, Homo sapiens
tcgcaggattcttcctccctc

SEQ ID NO: 1845059 - DNA, 15 bp, Homo sapiens
tcgctctttgagaaa

SEQ ID NO: 1845060 - DNA, 15 bp, Homo sapiens
tcgggagaggggacg

SEQ ID NO: 1845061 - DNA, 21 bp, Homo sapiens
tcgggagaggggacgcaggcc

SEQ ID NO: 1845062 - DNA, 17 bp, Homo sapiens
tcgtgtgcaacagacaa

SEQ ID NO: 1845063 - DNA, 22 bp, Homo sapiens
tctaaatatcccttggacattt

SEQ ID NO: 1845064 - DNA, 17 bp, Homo sapiens
tctaactacaaaggttt

SEQ ID NO: 1845065 - DNA, 17 bp, Homo sapiens
tctaagcctttgagact

SEQ ID NO: 1845066 - DNA, 12 bp, Homo sapiens
tctacactgtgc

SEQ ID NO: 1845067 - DNA, 15 bp, Homo sapiens
tctacactgtgctga

SEQ ID NO: 1845068 - DNA, 21 bp, Homo sapiens
tctaccctcttagaaaaacca

SEQ ID NO: 1845069 - DNA, 19 bp, Homo sapiens
tctacctgaggggcctctt

SEQ ID NO: 1845070 - DNA, 20 bp, Homo sapiens
tctactcaacccattgttgt

SEQ ID NO: 1845071 - DNA, 16 bp, Homo sapiens
tctagccgatggaaaa

SEQ ID NO: 1845072 - DNA, 18 bp, Homo sapiens
tctaggacgccacccagc

SEQ ID NO: 1845073 - DNA, 14 bp, Homo sapiens
tctaggactgcagt

SEQ ID NO: 1845074 - DNA, 12 bp, Homo sapiens
tctaggctgggg

SEQ ID NO: 1845075 - DNA, 12 bp, Homo sapiens
tctagggaaaaa

SEQ ID NO: 1845076 - DNA, 19 bp, Homo sapiens
tctagggaaaaaccagcgt

SEQ ID NO: 1845077 - DNA, 20 bp, Homo sapiens
tctaggtaggaagagcccgc

SEQ ID NO: 1845078 - DNA, 18 bp, Homo sapiens
tctaggtggcaaggctgt

SEQ ID NO: 1845079 - DNA, 21 bp, Homo sapiens
tctatataaccacatttctaa

SEQ ID NO: 1845080 - DNA, 14 bp, Homo sapiens
tctatttatttatt

SEQ ID NO: 1845081 - DNA, 21 bp, Homo sapiens
tctcacacatgagcatcaggc

SEQ ID NO: 1845082 - DNA, 11 bp, Homo sapiens
tctcactcctt

SEQ ID NO: 1845083 - DNA, 13 bp, Homo sapiens
tctcactccttga

SEQ ID NO: 1845084 - DNA, 13 bp, Homo sapiens
tctcacttgtgcc

SEQ ID NO: 1845085 - DNA, 22 bp, Homo sapiens
tctcagaaggcaaatgactttg

SEQ ID NO: 1845086 - DNA, 11 bp, Homo sapiens
tctcaggcagc

SEQ ID NO: 1845087 - DNA, 12 bp, Homo sapiens
tctcagggcctg

SEQ ID NO: 1845088 - DNA, 18 bp, Homo sapiens
tctcagggtctctgctgc

SEQ ID NO: 1845089 - DNA, 19 bp, Homo sapiens
tctcagggtctctgctgcc

SEQ ID NO: 1845090 - DNA, 18 bp, Homo sapiens
tctcatgaatctgcaatg

SEQ ID NO: 1845091 - DNA, 22 bp, Homo sapiens
tctccaaatatcagtgggctct

SEQ ID NO: 1845092 - DNA, 15 bp, Homo sapiens
tctccaagcaggaca

SEQ ID NO: 1845093 - DNA, 16 bp, Homo sapiens
tctccaagcaggacat

SEQ ID NO: 1845094 - DNA, 15 bp, Homo sapiens
tctccacctgccagg

SEQ ID NO: 1845095 - DNA, 16 bp, Homo sapiens
tctccacctgccaggg

SEQ ID NO: 1845096 - DNA, 17 bp, Homo sapiens
tctccacctgccaggga

SEQ ID NO: 1845097 - DNA, 22 bp, Homo sapiens
tctccacctgccagggacagag

SEQ ID NO: 1845098 - DNA, 13 bp, Homo sapiens
tctccaccttcca

SEQ ID NO: 1845099 - DNA, 12 bp, Homo sapiens
tctccagcccct

SEQ ID NO: 1845100 - DNA, 15 bp, Homo sapiens
tctccagcccctgga

SEQ ID NO: 1845101 - DNA, 16 bp, Homo sapiens
tctccagcccctggat

SEQ ID NO: 1845102 - DNA, 18 bp, Homo sapiens
tctccctcccctctcaga

SEQ ID NO: 1845103 - DNA, 22 bp, Homo sapiens
tctccctgagatgggcttccca

SEQ ID NO: 1845104 - DNA, 21 bp, Homo sapiens
tctcccttggattgtccccga

SEQ ID NO: 1845105 - DNA, 12 bp, Homo sapiens
tctcctccccaa

SEQ ID NO: 1845106 - DNA, 12 bp, Homo sapiens
tctcctctgctg

SEQ ID NO: 1845107 - DNA, 20 bp, Homo sapiens
tctcctctgctgctggctgg

SEQ ID NO: 1845108 - DNA, 20 bp, Homo sapiens
tctccttcacctttgtcccc

SEQ ID NO: 1845109 - DNA, 14 bp, Homo sapiens
tctctaggctgggg

SEQ ID NO: 1845110 - DNA, 15 bp, Homo sapiens
tctctaggctgggga

SEQ ID NO: 1845111 - DNA, 15 bp, Homo sapiens
tctctcactccttga

SEQ ID NO: 1845112 - DNA, 14 bp, Homo sapiens
tctctccagcccct

SEQ ID NO: 1845113 - DNA, 17 bp, Homo sapiens
tctctccagcccctgga

SEQ ID NO: 1845114 - DNA, 18 bp, Homo sapiens
tctctccagcccctggat

SEQ ID NO: 1845115 - DNA, 13 bp, Homo sapiens
tctctcttgtcct

SEQ ID NO: 1845116 - DNA, 16 bp, Homo sapiens
tctctgaagtgaaact

SEQ ID NO: 1845117 - DNA, 18 bp, Homo sapiens
tctctgacgcttgtgaca

SEQ ID NO: 1845118 - DNA, 11 bp, Homo sapiens
tctctgccctc

SEQ ID NO: 1845119 - DNA, 17 bp, Homo sapiens
tctctgccctccaagac

SEQ ID NO: 1845120 - DNA, 13 bp, Homo sapiens
tctctgctgccgc

SEQ ID NO: 1845121 - DNA, 14 bp, Homo sapiens
tctctggatgcctg

SEQ ID NO: 1845122 - DNA, 14 bp, Homo sapiens
tctcttgagcctgg

SEQ ID NO: 1845123 - DNA, 16 bp, Homo sapiens
tctgaagtgaaactgc

SEQ ID NO: 1845124 - DNA, 18 bp, Homo sapiens
tctgaagtgaaactgctt

SEQ ID NO: 1845125 - DNA, 16 bp, Homo sapiens
tctgacaacagacttc

SEQ ID NO: 1845126 - DNA, 22 bp, Homo sapiens
tctgacgcttgtgacagtgcct

SEQ ID NO: 1845127 - DNA, 17 bp, Homo sapiens
tctgagcagcgagcctg

SEQ ID NO: 1845128 - DNA, 13 bp, Homo sapiens
tctgatggcttct

SEQ ID NO: 1845129 - DNA, 18 bp, Homo sapiens
tctgatggcttctccagg

SEQ ID NO: 1845130 - DNA, 16 bp, Homo sapiens
tctgcactcccctgct

SEQ ID NO: 1845131 - DNA, 19 bp, Homo sapiens
tctgcactcccctgctggg

SEQ ID NO: 1845132 - DNA, 22 bp, Homo sapiens
tctgcactcccctgctgggtgt

SEQ ID NO: 1845133 - DNA, 14 bp, Homo sapiens
tctgcattcctgat

SEQ ID NO: 1845134 - DNA, 14 bp, Homo sapiens
tctgccaaacacat

SEQ ID NO: 1845135 - DNA, 12 bp, Homo sapiens
tctgcccactcc

SEQ ID NO: 1845136 - DNA, 16 bp, Homo sapiens
tctgcccactccctgc

SEQ ID NO: 1845137 - DNA, 18 bp, Homo sapiens
tctgccctccaagacctt

SEQ ID NO: 1845138 - DNA, 12 bp, Homo sapiens
tctgcccttggt

SEQ ID NO: 1845139 - DNA, 12 bp, Homo sapiens
tctgctgaggcc

SEQ ID NO: 1845140 - DNA, 17 bp, Homo sapiens
tctgctgctggctggtt

SEQ ID NO: 1845141 - DNA, 15 bp, Homo sapiens
tctggattcatattt

SEQ ID NO: 1845142 - DNA, 15 bp, Homo sapiens
tctggcagctcagag

SEQ ID NO: 1845143 - DNA, 21 bp, Homo sapiens
tctggcagctcagagagggtg

SEQ ID NO: 1845144 - DNA, 20 bp, Homo sapiens
tctgggcaggactcagctcc

SEQ ID NO: 1845145 - DNA, 17 bp, Homo sapiens
tctgggtctcagtgtcc

SEQ ID NO: 1845146 - DNA, 18 bp, Homo sapiens
tctggtccatagagagca

SEQ ID NO: 1845147 - DNA, 16 bp, Homo sapiens
tctggtctctaggctg

SEQ ID NO: 1845148 - DNA, 20 bp, Homo sapiens
tctgtaagagcttgctccag

SEQ ID NO: 1845149 - DNA, 14 bp, Homo sapiens
tctgtacagagccc

SEQ ID NO: 1845150 - DNA, 23 bp, Homo sapiens
tctgtacagagcccacgccccca

SEQ ID NO: 1845151 - DNA, 15 bp, Homo sapiens
tctgtccccagcctg

SEQ ID NO: 1845152 - DNA, 19 bp, Homo sapiens
tctgtccgagctttgaaaa

SEQ ID NO: 1845153 - DNA, 23 bp, Homo sapiens
tctgtctaggactgcagtgtgga

SEQ ID NO: 1845154 - DNA, 14 bp, Homo sapiens
tctgtctccttaac

SEQ ID NO: 1845155 - DNA, 20 bp, Homo sapiens
tctgtgagcatcacagtttt

SEQ ID NO: 1845156 - DNA, 21 bp, Homo sapiens
tctgtgcacgcagtggccttc

SEQ ID NO: 1845157 - DNA, 18 bp, Homo sapiens
tctgttatataaatggtt

SEQ ID NO: 1845158 - DNA, 17 bp, Homo sapiens
tctgttttatgacttca

SEQ ID NO: 1845159 - DNA, 21 bp, Homo sapiens
tctgttttgtttcgctctttg

SEQ ID NO: 1845160 - DNA, 13 bp, Homo sapiens
tgtatctgtgtag

SEQ ID NO: 1845161 - DNA, 15 bp, Homo sapiens
tgtatggttctgtgc

SEQ ID NO: 1845162 - DNA, 15 bp, Homo sapiens
tgtattgtgcaatgt

SEQ ID NO: 1845163 - DNA, 18 bp, Homo sapiens
tgtattgtgcaatgtgta

SEQ ID NO: 1845164 - DNA, 19 bp, Homo sapiens
tgtattttactaataaaat

SEQ ID NO: 1845165 - DNA, 12 bp, Homo sapiens
tgtattttatgt

SEQ ID NO: 1845166 - DNA, 13 bp, Homo sapiens
tgtcaaggaagaa

SEQ ID NO: 1845167 - DNA, 20 bp, Homo sapiens
tgtcacatgaaacatttgca

SEQ ID NO: 1845168 - DNA, 16 bp, Homo sapiens
tgtcagctgaacctgg

SEQ ID NO: 1845169 - DNA, 19 bp, Homo sapiens
tgtcagctgaacctgggta

SEQ ID NO: 1845170 - DNA, 17 bp, Homo sapiens
tgtccaaagcagggtct

SEQ ID NO: 1845171 - DNA, 19 bp, Homo sapiens
tgtccaaagcagggtctgg

SEQ ID NO: 1845172 - DNA, 14 bp, Homo sapiens
tgtccaagaagccc

SEQ ID NO: 1845173 - DNA, 16 bp, Homo sapiens
tgtccaagaagcccag

SEQ ID NO: 1845174 - DNA, 18 bp, Homo sapiens
tgtccaagaagcccagga

SEQ ID NO: 1845175 - DNA, 18 bp, Homo sapiens
tgtccccaccgcagacag

SEQ ID NO: 1845176 - DNA, 18 bp, Homo sapiens
tgtcctttttcactttga

SEQ ID NO: 1845177 - DNA, 23 bp, Homo sapiens
tgtcctttttcactttgaaaagt

SEQ ID NO: 1845178 - DNA, 15 bp, Homo sapiens
tgtcgacatgttttt

SEQ ID NO: 1845179 - DNA, 14 bp, Homo sapiens
tgtcgtgggatggc

SEQ ID NO: 1845180 - DNA, 16 bp, Homo sapiens
tgtcgtgggatggcat

SEQ ID NO: 1845181 - DNA, 22 bp, Homo sapiens
tgtctaatatcttaattctttg

SEQ ID NO: 1845182 - DNA, 17 bp, Homo sapiens
tgtctaggactgcagtg

SEQ ID NO: 1845183 - DNA, 13 bp, Homo sapiens
tgtctctcctgcc

SEQ ID NO: 1845184 - DNA, 16 bp, Homo sapiens
tgtctctcctgcccct

SEQ ID NO: 1845185 - DNA, 22 bp, Homo sapiens
tgtctcttatggatgtccccag

SEQ ID NO: 1845186 - DNA, 15 bp, Homo sapiens
tgtctgccaaacaca

SEQ ID NO: 1845187 - DNA, 22 bp, Homo sapiens
tgtctttggaccctgaggccca

SEQ ID NO: 1845188 - DNA, 18 bp, Homo sapiens
tgtgagtactacagtcct

SEQ ID NO: 1845189 - DNA, 20 bp, Homo sapiens
tgtgagtactacagtcctcc

SEQ ID NO: 1845190 - DNA, 14 bp, Homo sapiens
tgtgatgcatttta

SEQ ID NO: 1845191 - DNA, 19 bp, Homo sapiens
tgtgatggggccctgcctc

SEQ ID NO: 1845192 - DNA, 12 bp, Homo sapiens
tgtgattcttag

SEQ ID NO: 1845193 - DNA, 15 bp, Homo sapiens
tgtgcaatgtgtata

SEQ ID NO: 1845194 - DNA, 17 bp, Homo sapiens
tgtgcacatctgttttg

SEQ ID NO: 1845195 - DNA, 17 bp, Homo sapiens
tgtgcacttatttatga

SEQ ID NO: 1845196 - DNA, 13 bp, Homo sapiens
tgtgcatttaatt

SEQ ID NO: 1845197 - DNA, 17 bp, Homo sapiens
tgtgcctaatgtgtttg

SEQ ID NO: 1845198 - DNA, 20 bp, Homo sapiens
tgtgcctgggtggacatggc

SEQ ID NO: 1845199 - DNA, 17 bp, Homo sapiens
tgtgctcccctttgcct

SEQ ID NO: 1845200 - DNA, 21 bp, Homo sapiens
tgtgctccctggttctgatga

SEQ ID NO: 1845201 - DNA, 15 bp, Homo sapiens
tgtgctgccctgccc

SEQ ID NO: 1845202 - DNA, 19 bp, Homo sapiens
tgtgctgccctgcccacct

SEQ ID NO: 1845203 - DNA, 12 bp, Homo sapiens
tgtgctgtgact

SEQ ID NO: 1845204 - DNA, 14 bp, Homo sapiens
tgtggaaaaccagg

SEQ ID NO: 1845205 - DNA, 18 bp, Homo sapiens
tgtggagttcaccttgga

SEQ ID NO: 1845206 - DNA, 21 bp, Homo sapiens
tgtggagttcaccttggaagg

SEQ ID NO: 1845207 - DNA, 15 bp, Homo sapiens
tgtggtcccacccca

SEQ ID NO: 1845208 - DNA, 15 bp, Homo sapiens
tgtgtaaaaagagag

SEQ ID NO: 1845209 - DNA, 22 bp, Homo sapiens
tgtgtctcttggtcctgctgca

SEQ ID NO: 1845210 - DNA, 20 bp, Homo sapiens
tgtgtgttaagctctgctat

SEQ ID NO: 1845211 - DNA, 16 bp, Homo sapiens
tgttaactgagtgcct

SEQ ID NO: 1845212 - DNA, 14 bp, Homo sapiens
tgttaagctctgct

SEQ ID NO: 1845213 - DNA, 16 bp, Homo sapiens
tgttactgtcttcagt

SEQ ID NO: 1845214 - DNA, 19 bp, Homo sapiens
tgttagaagaggtggcccc

SEQ ID NO: 1845215 - DNA, 13 bp, Homo sapiens
tgttatataaatg

SEQ ID NO: 1845216 - DNA, 16 bp, Homo sapiens
tgttatatataaatat

SEQ ID NO: 1845217 - DNA, 17 bp, Homo sapiens
tgttatgaacagctgtg

SEQ ID NO: 1845218 - DNA, 15 bp, Homo sapiens
tgttatttattgaaa

SEQ ID NO: 1845219 - DNA, 15 bp, Homo sapiens
tgttcagcagaacct

SEQ ID NO: 1845220 - DNA, 22 bp, Homo sapiens
tgttctaattaataaattattt

SEQ ID NO: 1845221 - DNA, 16 bp, Homo sapiens
tgttctattcatctca

SEQ ID NO: 1845222 - DNA, 16 bp, Homo sapiens
tgttctcatttgatca

SEQ ID NO: 1845223 - DNA, 14 bp, Homo sapiens
tgttctctgccctc

SEQ ID NO: 1845224 - DNA, 16 bp, Homo sapiens
tgttctctgccctcca

SEQ ID NO: 1845225 - DNA, 12 bp, Homo sapiens
tgttctggctct

SEQ ID NO: 1845226 - DNA, 17 bp, Homo sapiens
tgttctggctcttccag

SEQ ID NO: 1845227 - DNA, 13 bp, Homo sapiens
tgttctgttttgt

SEQ ID NO: 1845228 - DNA, 22 bp, Homo sapiens
tgttcttagctcaatgagcatg

SEQ ID NO: 1845229 - DNA, 15 bp, Homo sapiens
tgttgaagcctttgt

SEQ ID NO: 1845230 - DNA, 22 bp, Homo sapiens
tgttgagacctcagcttggcac

SEQ ID NO: 1845231 - DNA, 15 bp, Homo sapiens
tgtttaatggtagtt

SEQ ID NO: 1845232 - DNA, 20 bp, Homo sapiens
tgtttagcagatttaagata

SEQ ID NO: 1845233 - DNA, 16 bp, Homo sapiens
tgtttatacctttgcc

SEQ ID NO: 1845234 - DNA, 18 bp, Homo sapiens
tgtttctggcttagaaca

SEQ ID NO: 1845235 - DNA, 15 bp, Homo sapiens
tgttttccagctcct

SEQ ID NO: 1845236 - DNA, 12 bp, Homo sapiens
tgttttctgaaa

SEQ ID NO: 1845237 - DNA, 13 bp, Homo sapiens
tgtttttctaaag

SEQ ID NO: 1845238 - DNA, 12 bp, Homo sapiens
ttaaaaaagata

SEQ ID NO: 1845239 - DNA, 17 bp, Homo sapiens
ttaaactggcttaactt

SEQ ID NO: 1845240 - DNA, 19 bp, Homo sapiens
ttaaagaaaaaaatgtatt

SEQ ID NO: 1845241 - DNA, 12 bp, Homo sapiens
ttaaagacagag

SEQ ID NO: 1845242 - DNA, 22 bp, Homo sapiens
ttaaaggaaggttctggtgtga

SEQ ID NO: 1845243 - DNA, 14 bp, Homo sapiens
ttaaatgaacaaga

SEQ ID NO: 1845244 - DNA, 22 bp, Homo sapiens
ttaaatgaacaagagaagcatt

SEQ ID NO: 1845245 - DNA, 14 bp, Homo sapiens
ttaaatgcccagcc

SEQ ID NO: 1845246 - DNA, 15 bp, Homo sapiens
ttaaatgcccagccc

SEQ ID NO: 1845247 - DNA, 18 bp, Homo sapiens
ttaaatgcccagcccctt

SEQ ID NO: 1845248 - DNA, 17 bp, Homo sapiens
ttaacacagtgtctggc

SEQ ID NO: 1845249 - DNA, 13 bp, Homo sapiens
ttaacactgagct

SEQ ID NO: 1845250 - DNA, 18 bp, Homo sapiens
ttaacataagctattttt

SEQ ID NO: 1845251 - DNA, 17 bp, Homo sapiens
ttaaccacttcagctga

SEQ ID NO: 1845252 - DNA, 14 bp, Homo sapiens
ttaagtctgtttta

SEQ ID NO: 1845253 - DNA, 17 bp, Homo sapiens
ttaagtctgttttatga

SEQ ID NO: 1845254 - DNA, 21 bp, Homo sapiens
ttaagtctgttttatgacttc

SEQ ID NO: 1845255 - DNA, 23 bp, Homo sapiens
ttaataataaattccctggcctt

SEQ ID NO: 1845256 - DNA, 21 bp, Homo sapiens
ttaatctcaaagagattcgaa

SEQ ID NO: 1845257 - DNA, 18 bp, Homo sapiens
ttaatgtaatctgatggc

SEQ ID NO: 1845258 - DNA, 19 bp, Homo sapiens
ttaccagcagagcacctta

SEQ ID NO: 1845259 - DNA, 22 bp, Homo sapiens
ttaccctttggccccactttga

SEQ ID NO: 1845260 - DNA, 20 bp, Homo sapiens
ttacggttttccaggtttaa

SEQ ID NO: 1845261 - DNA, 21 bp, Homo sapiens
ttacttaaaccgccaaggctg

SEQ ID NO: 1845262 - DNA, 18 bp, Homo sapiens
ttacttaggtgtggggga

SEQ ID NO: 1845263 - DNA, 23 bp, Homo sapiens
ttacttgtaaatataaagacgtt

SEQ ID NO: 1845264 - DNA, 23 bp, Homo sapiens
ttagaaaaccagctcagcactgc

SEQ ID NO: 1845265 - DNA, 13 bp, Homo sapiens
ttagacagtccct

SEQ ID NO: 1845266 - DNA, 14 bp, Homo sapiens
ttagacagtccctg

SEQ ID NO: 1845267 - DNA, 16 bp, Homo sapiens
ttagacagtccctgcc

SEQ ID NO: 1845268 - DNA, 17 bp, Homo sapiens
ttagacagtccctgcca

SEQ ID NO: 1845269 - DNA, 15 bp, Homo sapiens
ttagactttaacata

SEQ ID NO: 1845270 - DNA, 14 bp, Homo sapiens
ttagctcaatgagc

SEQ ID NO: 1845271 - DNA, 17 bp, Homo sapiens
ttagcttgcaccttgtc

SEQ ID NO: 1845272 - DNA, 14 bp, Homo sapiens
ttagggaaaacatt

SEQ ID NO: 1845273 - DNA, 15 bp, Homo sapiens
ttagggaaaacattc

SEQ ID NO: 1845274 - DNA, 19 bp, Homo sapiens
ttaggtgtgggggaagcac

SEQ ID NO: 1845275 - DNA, 17 bp, Homo sapiens
ttataagcatcattatt

SEQ ID NO: 1845276 - DNA, 15 bp, Homo sapiens
ttatatataaatata

SEQ ID NO: 1845277 - DNA, 18 bp, Homo sapiens
ttatatataaatatatta

SEQ ID NO: 1845278 - DNA, 19 bp, Homo sapiens
ttatcacctagctgaatgt

SEQ ID NO: 1845279 - DNA, 23 bp, Homo sapiens
ttatcacctagctgaatgttttt

SEQ ID NO: 1845280 - DNA, 18 bp, Homo sapiens
ttatcatcacaaatggct

SEQ ID NO: 1845281 - DNA, 16 bp, Homo sapiens
ttatctcacttgtgcc

SEQ ID NO: 1845282 - DNA, 17 bp, Homo sapiens
ttatgaacagctgtgtc

SEQ ID NO: 1845283 - DNA, 18 bp, Homo sapiens
ttgagggagctgggagac

SEQ ID NO: 1845284 - DNA, 22 bp, Homo sapiens
ttgagggagctgggagaccctc

SEQ ID NO: 1845285 - DNA, 22 bp, Homo sapiens
ttgataagagggcacacactgt

SEQ ID NO: 1845286 - DNA, 19 bp, Homo sapiens
ttgataatcaactgggctg

SEQ ID NO: 1845287 - DNA, 22 bp, Homo sapiens
ttgatatagaacagtgcttgcc

SEQ ID NO: 1845288 - DNA, 21 bp, Homo sapiens
ttgatggtaaccataatggaa

SEQ ID NO: 1845289 - DNA, 17 bp, Homo sapiens
ttgattcagacagctgc

SEQ ID NO: 1845290 - DNA, 21 bp, Homo sapiens
ttgattcagacagctgcctgg

SEQ ID NO: 1845291 - DNA, 17 bp, Homo sapiens
ttgcaaggctgatttat

SEQ ID NO: 1845292 - DNA, 15 bp, Homo sapiens
ttgcacggctgctga

SEQ ID NO: 1845293 - DNA, 15 bp, Homo sapiens
ttgccagagccttaa

SEQ ID NO: 1845294 - DNA, 23 bp, Homo sapiens
ttgccccgactccgcttcccctg

SEQ ID NO: 1845295 - DNA, 18 bp, Homo sapiens
ttgccgtctacctgaggg

SEQ ID NO: 1845296 - DNA, 20 bp, Homo sapiens
ttgctactacttacctacca

SEQ ID NO: 1845297 - DNA, 13 bp, Homo sapiens
ttgctcacccagt

SEQ ID NO: 1845298 - DNA, 19 bp, Homo sapiens
ttgctcacccagtgccctc

SEQ ID NO: 1845299 - DNA, 20 bp, Homo sapiens
ttgctctgccaacttcttca

SEQ ID NO: 1845300 - DNA, 13 bp, Homo sapiens
ttgcttatttaat

SEQ ID NO: 1845301 - DNA, 14 bp, Homo sapiens
ttgctttaatataa

SEQ ID NO: 1845302 - DNA, 23 bp, Homo sapiens
ttgctttaatataaatgcaaata

SEQ ID NO: 1845303 - DNA, 23 bp, Homo sapiens
ttgctttgacttaggtgtgaaga

SEQ ID NO: 1845304 - DNA, 12 bp, Homo sapiens
ttgcttttcatg

SEQ ID NO: 1845305 - DNA, 16 bp, Homo sapiens
ttgcttttcatgcaaa

SEQ ID NO: 1845306 - DNA, 17 bp, Homo sapiens
ttgcttttcatgcaaac

SEQ ID NO: 1845307 - DNA, 18 bp, Homo sapiens
ttggaaagagtaggaaga

SEQ ID NO: 1845308 - DNA, 23 bp, Homo sapiens
ttggaaagagtaggaagactttg

SEQ ID NO: 1845309 - DNA, 15 bp, Homo sapiens
ttggaaatttagcat

SEQ ID NO: 1845310 - DNA, 14 bp, Homo sapiens
ttggacacgctcag

SEQ ID NO: 1845311 - DNA, 15 bp, Homo sapiens
ttggacattttatgt

SEQ ID NO: 1845312 - DNA, 18 bp, Homo sapiens
ttggacattttatgtctt

SEQ ID NO: 1845313 - DNA, 21 bp, Homo sapiens
ttggaccctgaggcccagagg

SEQ ID NO: 1845314 - DNA, 14 bp, Homo sapiens
ttggagatcaagga

SEQ ID NO: 1845315 - DNA, 14 bp, Homo sapiens
ttggattgtccccg

SEQ ID NO: 1845316 - DNA, 15 bp, Homo sapiens
ttggattgtccccga

SEQ ID NO: 1845317 - DNA, 16 bp, Homo sapiens
ttggccatctctggat

SEQ ID NO: 1845318 - DNA, 16 bp, Homo sapiens
ttggccccactttgaa

SEQ ID NO: 1845319 - DNA, 17 bp, Homo sapiens
ttggccccactttgaag

SEQ ID NO: 1845320 - DNA, 16 bp, Homo sapiens
ttggctcttaaggctt

SEQ ID NO: 1845321 - DNA, 15 bp, Homo sapiens
ttggctgctgaaggc

SEQ ID NO: 1845322 - DNA, 22 bp, Homo sapiens
ttggctttgggttgcaggacct

SEQ ID NO: 1845323 - DNA, 19 bp, Homo sapiens
ttgggaggtgcgtgttcag

SEQ ID NO: 1845324 - DNA, 19 bp, Homo sapiens
ttgggctctagaattccag

SEQ ID NO: 1845325 - DNA, 22 bp, Homo sapiens
ttggtcccccttccatggactt

SEQ ID NO: 1845326 - DNA, 21 bp, Homo sapiens
ttggtctcaggcagcaccaca

SEQ ID NO: 1845327 - DNA, 20 bp, Homo sapiens
ttggtttggccatctctgga

SEQ ID NO: 1845328 - DNA, 17 bp, Homo sapiens
ttgtaaatataaagacg

SEQ ID NO: 1845329 - DNA, 23 bp, Homo sapiens
ttgtagtgctttgagagagaaag

SEQ ID NO: 1845330 - DNA, 14 bp, Homo sapiens
ttgtattaaagaca

SEQ ID NO: 1845331 - DNA, 21 bp, Homo sapiens
ttgtcaaggaagaagaaatct

SEQ ID NO: 1845332 - DNA, 15 bp, Homo sapiens
ttgtccccgaccctt

SEQ ID NO: 1845333 - DNA, 16 bp, Homo sapiens
ttgtccccgacccttg

SEQ ID NO: 1845334 - DNA, 21 bp, Homo sapiens
ttgtctgtctccctcccctct

SEQ ID NO: 1845335 - DNA, 15 bp, Homo sapiens
ttgtctttggaccct

SEQ ID NO: 1845336 - DNA, 15 bp, Homo sapiens
ttgtgacagtgcctc

SEQ ID NO: 1845337 - DNA, 21 bp, Homo sapiens
ttgtgacagtgcctcttccag

SEQ ID NO: 1845338 - DNA, 13 bp, Homo sapiens
ttgtgaggaagcc

SEQ ID NO: 1845339 - DNA, 17 bp, Homo sapiens
ttgtgaggaagccgctg

SEQ ID NO: 1845340 - DNA, 18 bp, Homo sapiens
ttgtgcctaatgtgtttg

SEQ ID NO: 1845341 - DNA, 22 bp, Homo sapiens
ttgttaagtatcagctacaatt

SEQ ID NO: 1845342 - DNA, 15 bp, Homo sapiens
ttgttatttattgaa

SEQ ID NO: 1845343 - DNA, 16 bp, Homo sapiens
ttgttggttggttttc

SEQ ID NO: 1845344 - DNA, 12 bp, Homo sapiens
ttgtttaatggt

SEQ ID NO: 1845345 - DNA, 23 bp, Homo sapiens
ttgtttaatggtagttttacagt

SEQ ID NO: 1845346 - DNA, 13 bp, Homo sapiens
ttgtttcgctctt

SEQ ID NO: 1845347 - DNA, 15 bp, Homo sapiens
ttgtttcgctctttg

SEQ ID NO: 1845348 - DNA, 22 bp, Homo sapiens
ttgtttcgctctttgagaaata

SEQ ID NO: 1845349 - DNA, 21 bp, Homo sapiens
ttgtttgagaaattaagtatc

SEQ ID NO: 1845350 - DNA, 16 bp, Homo sapiens
ttgttttgtgcagaga

SEQ ID NO: 1845351 - DNA, 17 bp, Homo sapiens
tttaaaatgaaatgcat

SEQ ID NO: 1845352 - DNA, 20 bp, Homo sapiens
tttaaaatgaaatgcatttt

SEQ ID NO: 1845353 - DNA, 12 bp, Homo sapiens
tttaaaatgtac

SEQ ID NO: 1845354 - DNA, 21 bp, Homo sapiens
tttaaacgtgatttttaaatt

SEQ ID NO: 1845355 - DNA, 21 bp, Homo sapiens
tttaaatgaacaagagaagca

SEQ ID NO: 1845356 - DNA, 13 bp, Homo sapiens
tttaacataagct

SEQ ID NO: 1845357 - DNA, 21 bp, Homo sapiens
tttaagctgttactgtcttca

SEQ ID NO: 1845358 - DNA, 15 bp, Homo sapiens
tttaatataaatgca

SEQ ID NO: 1845359 - DNA, 15 bp, Homo sapiens
tttaattaaatgctc

SEQ ID NO: 1845360 - DNA, 17 bp, Homo sapiens
tttacagtgtttctggc

SEQ ID NO: 1845361 - DNA, 17 bp, Homo sapiens
tttactaagtaatctca

SEQ ID NO: 1845362 - DNA, 16 bp, Homo sapiens
tttacttttaaatgtc

SEQ ID NO: 1845363 - DNA, 22 bp, Homo sapiens
tttagaccctattgctgcttga

SEQ ID NO: 1845364 - DNA, 17 bp, Homo sapiens
tttagatgaatgtcagt

SEQ ID NO: 1845365 - DNA, 19 bp, Homo sapiens
tttagtgatcacagcagct

SEQ ID NO: 1845366 - DNA, 13 bp, Homo sapiens
tttagtggcttca

SEQ ID NO: 1845367 - DNA, 19 bp, Homo sapiens
tttataaatcgcttttgat

SEQ ID NO: 1845368 - DNA, 22 bp, Homo sapiens
tttataagcatcattatttatg

SEQ ID NO: 1845369 - DNA, 15 bp, Homo sapiens
tttatgctttaaaca

SEQ ID NO: 1845370 - DNA, 16 bp, Homo sapiens
tttatgctttaaacat

SEQ ID NO: 1845371 - DNA, 20 bp, Homo sapiens
tttatgttatatataaatat

SEQ ID NO: 1845372 - DNA, 14 bp, Homo sapiens
tttattaaagaaaa

SEQ ID NO: 1845373 - DNA, 16 bp, Homo sapiens
tttcactttgaaaagt

SEQ ID NO: 1845374 - DNA, 17 bp, Homo sapiens
tttcaggagcagcctca

SEQ ID NO: 1845375 - DNA, 17 bp, Homo sapiens
tttcatgcaaactcttt

SEQ ID NO: 1845376 - DNA, 21 bp, Homo sapiens
tttccaaaacaatttcttttt

SEQ ID NO: 1845377 - DNA, 20 bp, Homo sapiens
tttccacataaggaaactgg

SEQ ID NO: 1845378 - DNA, 23 bp, Homo sapiens
tttcccccttgaggattgtggaa

SEQ ID NO: 1845379 - DNA, 16 bp, Homo sapiens
tttccctattagagaa

SEQ ID NO: 1845380 - DNA, 21 bp, Homo sapiens
tttcctctttggtctacactg

SEQ ID NO: 1845381 - DNA, 21 bp, Homo sapiens
tttccttcattcaacccacct

SEQ ID NO: 1845382 - DNA, 18 bp, Homo sapiens
tttcgcaggattcttcct

SEQ ID NO: 1845383 - DNA, 16 bp, Homo sapiens
tttctaaaggagttta

SEQ ID NO: 1845384 - DNA, 19 bp, Homo sapiens
tttctagcccgaatacaaa

SEQ ID NO: 1845385 - DNA, 18 bp, Homo sapiens
tttctggagtgaaccaga

SEQ ID NO: 1845386 - DNA, 23 bp, Homo sapiens
tttctgggatgcaatactaggaa

SEQ ID NO: 1845387 - DNA, 14 bp, Homo sapiens
tttgaaaagttgga

SEQ ID NO: 1845388 - DNA, 17 bp, Homo sapiens
tttgaagatttaattac

SEQ ID NO: 1845389 - DNA, 21 bp, Homo sapiens
tttgaaggtagaatgttttca

SEQ ID NO: 1845390 - DNA, 16 bp, Homo sapiens
tttgagatcagcctgg

SEQ ID NO: 1845391 - DNA, 22 bp, Homo sapiens
tttgagtgacagctttctggga

SEQ ID NO: 1845392 - DNA, 18 bp, Homo sapiens
tttgataatcaactgggc

SEQ ID NO: 1845393 - DNA, 19 bp, Homo sapiens
tttgccaccctcatgctgt

SEQ ID NO: 1845394 - DNA, 21 bp, Homo sapiens
tttgctcaatacctggcctca

SEQ ID NO: 1845395 - DNA, 18 bp, Homo sapiens
tttgctttaatataaatg

SEQ ID NO: 1845396 - DNA, 13 bp, Homo sapiens
tttggaccctgag

SEQ ID NO: 1845397 - DNA, 13 bp, Homo sapiens
tttggcaggtgca

SEQ ID NO: 1845398 - DNA, 16 bp, Homo sapiens
tttggccccactttga

SEQ ID NO: 1845399 - DNA, 12 bp, Homo sapiens
tttggctgctga

SEQ ID NO: 1845400 - DNA, 21 bp, Homo sapiens
tttggtccttcaaaggcttgt

SEQ ID NO: 1845401 - DNA, 22 bp, Homo sapiens
tttggttaagtctgttttatga

SEQ ID NO: 1845402 - DNA, 22 bp, Homo sapiens
tttgtaactgtttagatgaatg

SEQ ID NO: 1845403 - DNA, 13 bp, Homo sapiens
tttgtctgtctcc

SEQ ID NO: 1845404 - DNA, 18 bp, Homo sapiens
atgatacttcgacactgt

SEQ ID NO: 1845405 - DNA, 23 bp, Homo sapiens
atgatacttcgacactgttctta

SEQ ID NO: 1845406 - DNA, 20 bp, Homo sapiens
atgatctaggaagactttgg

SEQ ID NO: 1845407 - DNA, 24 bp, Homo sapiens
atgatgttttccatgagtcccctg

SEQ ID NO: 1845408 - DNA, 22 bp, Homo sapiens
atgatttgggctctagaattcc

SEQ ID NO: 1845409 - DNA, 15 bp, Homo sapiens
atgatttttttttcc

SEQ ID NO: 1845410 - DNA, 12 bp, Homo sapiens
atgcaaactctt

SEQ ID NO: 1845411 - DNA, 14 bp, Homo sapiens
atgcaaaggctggg

SEQ ID NO: 1845412 - DNA, 15 bp, Homo sapiens
atgcaaaggctggga

SEQ ID NO: 1845413 - DNA, 12 bp, Homo sapiens
atgcactttgct

SEQ ID NO: 1845414 - DNA, 22 bp, Homo sapiens
atgcactttgctttaatataaa

SEQ ID NO: 1845415 - DNA, 23 bp, Homo sapiens
atgcactttgctttaatataaat

SEQ ID NO: 1845416 - DNA, 12 bp, Homo sapiens
atgcactttgtt

SEQ ID NO: 1845417 - DNA, 16 bp, Homo sapiens
atgcactttgttctgg

SEQ ID NO: 1845418 - DNA, 19 bp, Homo sapiens
atgcactttgttctggctc

SEQ ID NO: 1845419 - DNA, 19 bp, Homo sapiens
atgcagacctcatgcccag

SEQ ID NO: 1845420 - DNA, 14 bp, Homo sapiens
atgcagcctcacag

SEQ ID NO: 1845421 - DNA, 17 bp, Homo sapiens
atgcagcctcacagtcc

SEQ ID NO: 1845422 - DNA, 14 bp, Homo sapiens
atgcaggaggtgga

SEQ ID NO: 1845423 - DNA, 20 bp, Homo sapiens
atgcaggaggtggagaaaat

SEQ ID NO: 1845424 - DNA, 21 bp, Homo sapiens
atgcattcttggttggctggc

SEQ ID NO: 1845425 - DNA, 19 bp, Homo sapiens
atgcattttatagaatgtg

SEQ ID NO: 1845426 - DNA, 14 bp, Homo sapiens
atgccaaattaaaa

SEQ ID NO: 1845427 - DNA, 19 bp, Homo sapiens
atgccaaattaaaaaagat

SEQ ID NO: 1845428 - DNA, 21 bp, Homo sapiens
atgccaagcactgtgctcagg

SEQ ID NO: 1845429 - DNA, 17 bp, Homo sapiens
atgcccagccccttctg

SEQ ID NO: 1845430 - DNA, 17 bp, Homo sapiens
atgcccagctctctgac

SEQ ID NO: 1845431 - DNA, 20 bp, Homo sapiens
atgcctggatggggctgcac

SEQ ID NO: 1845432 - DNA, 14 bp, Homo sapiens
atgctaattttatt

SEQ ID NO: 1845433 - DNA, 19 bp, Homo sapiens
atgctcctggcccactgca

SEQ ID NO: 1845434 - DNA, 15 bp, Homo sapiens
atgctgacatcattt

SEQ ID NO: 1845435 - DNA, 16 bp, Homo sapiens
atgctgacatcatttg

SEQ ID NO: 1845436 - DNA, 14 bp, Homo sapiens
atgctgtgtgactc

SEQ ID NO: 1845437 - DNA, 23 bp, Homo sapiens
atgcttccacaggcaaaactcag

SEQ ID NO: 1845438 - DNA, 17 bp, Homo sapiens
atgcttcttcagagact

SEQ ID NO: 1845439 - DNA, 22 bp, Homo sapiens
atgcttcttcagagactcctgc

SEQ ID NO: 1845440 - DNA, 21 bp, Homo sapiens
atgctttaggatgtacagtta

SEQ ID NO: 1845441 - DNA, 20 bp, Homo sapiens
atggaaatgggcagagcaga

SEQ ID NO: 1845442 - DNA, 13 bp, Homo sapiens
atggaagacacat

SEQ ID NO: 1845443 - DNA, 19 bp, Homo sapiens
atggactcagccttgcaaa

SEQ ID NO: 1845444 - DNA, 11 bp, Homo sapiens
atggactttgt

SEQ ID NO: 1845445 - DNA, 13 bp, Homo sapiens
atggagagctgga

SEQ ID NO: 1845446 - DNA, 14 bp, Homo sapiens
atggagccccacct

SEQ ID NO: 1845447 - DNA, 22 bp, Homo sapiens
atggagccccaccttgtctgct

SEQ ID NO: 1845448 - DNA, 14 bp, Homo sapiens
atggagctcagaga

SEQ ID NO: 1845449 - DNA, 23 bp, Homo sapiens
atggcatttggtctcaggcagca

SEQ ID NO: 1845450 - DNA, 15 bp, Homo sapiens
atggccatgcaggag

SEQ ID NO: 1845451 - DNA, 21 bp, Homo sapiens
atggccgggcgcggtggctca

SEQ ID NO: 1845452 - DNA, 14 bp, Homo sapiens
atggcgtctgctct

SEQ ID NO: 1845453 - DNA, 19 bp, Homo sapiens
atggcttatccagctggtg

SEQ ID NO: 1845454 - DNA, 15 bp, Homo sapiens
atgggactggcctct

SEQ ID NO: 1845455 - DNA, 13 bp, Homo sapiens
atgggcagagcag

SEQ ID NO: 1845456 - DNA, 15 bp, Homo sapiens
atgggcagagcagag

SEQ ID NO: 1845457 - DNA, 13 bp, Homo sapiens
atggggccctgcc

SEQ ID NO: 1845458 - DNA, 20 bp, Homo sapiens
atgggtcgggagaggggacg

SEQ ID NO: 1845459 - DNA, 20 bp, Homo sapiens
atgggtgcttggaggaagga

SEQ ID NO: 1845460 - DNA, 16 bp, Homo sapiens
atggtaggggagggca

SEQ ID NO: 1845461 - DNA, 15 bp, Homo sapiens
atggtagttttacag

SEQ ID NO: 1845462 - DNA, 21 bp, Homo sapiens
atggtagttttacagtgtttc

SEQ ID NO: 1845463 - DNA, 13 bp, Homo sapiens
atggttctgtgcc

SEQ ID NO: 1845464 - DNA, 13 bp, Homo sapiens
atgtagaagctgc

SEQ ID NO: 1845465 - DNA, 20 bp, Homo sapiens
atgtattgtgcaatgtgtat

SEQ ID NO: 1845466 - DNA, 22 bp, Homo sapiens
atgtattgtgcaatgtgtataa

SEQ ID NO: 1845467 - DNA, 24 bp, Homo sapiens
atgtattgtgcaatgtgtataaac

SEQ ID NO: 1845468 - DNA, 12 bp, Homo sapiens
atgtatttgcaa

SEQ ID NO: 1845469 - DNA, 17 bp, Homo sapiens
atgtccaagaagcccag

SEQ ID NO: 1845470 - DNA, 17 bp, Homo sapiens
atgtcctcaccacatgc

SEQ ID NO: 1845471 - DNA, 20 bp, Homo sapiens
atgtgacttggattcaattt

SEQ ID NO: 1845472 - DNA, 13 bp, Homo sapiens
atgttaatatttt

SEQ ID NO: 1845473 - DNA, 17 bp, Homo sapiens
atgttatatataaatat

SEQ ID NO: 1845474 - DNA, 17 bp, Homo sapiens
atgttatgaacagctgt

SEQ ID NO: 1845475 - DNA, 16 bp, Homo sapiens
atgttctctcttctcc

SEQ ID NO: 1845476 - DNA, 15 bp, Homo sapiens
atgttttcaaatgtt

SEQ ID NO: 1845477 - DNA, 14 bp, Homo sapiens
atgttttccatgag

SEQ ID NO: 1845478 - DNA, 16 bp, Homo sapiens
atgtttttctaaagga

SEQ ID NO: 1845479 - DNA, 15 bp, Homo sapiens
attaaaaaagataaa

SEQ ID NO: 1845480 - DNA, 18 bp, Homo sapiens
attaaaaaagataaacac

SEQ ID NO: 1845481 - DNA, 22 bp, Homo sapiens
attaaacgatttttaaaatgta

SEQ ID NO: 1845482 - DNA, 17 bp, Homo sapiens
attaaagaaaaaaatgt

SEQ ID NO: 1845483 - DNA, 21 bp, Homo sapiens
attaaataaaatttttatgta

SEQ ID NO: 1845484 - DNA, 15 bp, Homo sapiens
attaaatgcccagcc

SEQ ID NO: 1845485 - DNA, 16 bp, Homo sapiens
attaaatgcccagccc

SEQ ID NO: 1845486 - DNA, 17 bp, Homo sapiens
attaacaaattgcattt

SEQ ID NO: 1845487 - DNA, 18 bp, Homo sapiens
attaaccacttcagctga

SEQ ID NO: 1845488 - DNA, 20 bp, Homo sapiens
attaaccacttcagctgact

SEQ ID NO: 1845489 - DNA, 16 bp, Homo sapiens
attaagaatgaaatac

SEQ ID NO: 1845490 - DNA, 22 bp, Homo sapiens
attaagaatgaaatactgtttg

SEQ ID NO: 1845491 - DNA, 22 bp, Homo sapiens
attaagctctcatagctcataa

SEQ ID NO: 1845492 - DNA, 15 bp, Homo sapiens
attaaggattttatg

SEQ ID NO: 1845493 - DNA, 17 bp, Homo sapiens
attaaggattttatgct

SEQ ID NO: 1845494 - DNA, 15 bp, Homo sapiens
attaataataaattc

SEQ ID NO: 1845495 - DNA, 13 bp, Homo sapiens
attaatctcaaag

SEQ ID NO: 1845496 - DNA, 15 bp, Homo sapiens
attaattacaatgta

SEQ ID NO: 1845497 - DNA, 19 bp, Homo sapiens
attacaggcgtgagccacc

SEQ ID NO: 1845498 - DNA, 18 bp, Homo sapiens
attacttgtaaatataaa

SEQ ID NO: 1845499 - DNA, 21 bp, Homo sapiens
attacttgtaaatataaagac

SEQ ID NO: 1845500 - DNA, 13 bp, Homo sapiens
attagagcaggcg

SEQ ID NO: 1845501 - DNA, 22 bp, Homo sapiens
attatagtaatgtgacttggat

SEQ ID NO: 1845502 - DNA, 15 bp, Homo sapiens
attatatatactata

SEQ ID NO: 1845503 - DNA, 16 bp, Homo sapiens
attattacttgtaaat

SEQ ID NO: 1845504 - DNA, 23 bp, Homo sapiens
attattacttgtaaatataaaga

SEQ ID NO: 1845505 - DNA, 13 bp, Homo sapiens
attatttatgtat

SEQ ID NO: 1845506 - DNA, 14 bp, Homo sapiens
attatttatgtatt

SEQ ID NO: 1845507 - DNA, 23 bp, Homo sapiens
attatttattaaatgcccagccc

SEQ ID NO: 1845508 - DNA, 12 bp, Homo sapiens
attattttcatc

SEQ ID NO: 1845509 - DNA, 22 bp, Homo sapiens
attcaacactcccttcccatga

SEQ ID NO: 1845510 - DNA, 16 bp, Homo sapiens
attcacttatatgttc

SEQ ID NO: 1845511 - DNA, 16 bp, Homo sapiens
attcagacagctgcct

SEQ ID NO: 1845512 - DNA, 23 bp, Homo sapiens
attcaggaagctcagggcctggc

SEQ ID NO: 1845513 - DNA, 19 bp, Homo sapiens
attcatcaaatggaagaca

SEQ ID NO: 1845514 - DNA, 16 bp, Homo sapiens
attcatcaagctgtac

SEQ ID NO: 1845515 - DNA, 13 bp, Homo sapiens
attcatgcctggc

SEQ ID NO: 1845516 - DNA, 14 bp, Homo sapiens
attcattagttttg

SEQ ID NO: 1845517 - DNA, 11 bp, Homo sapiens
attccatcctt

SEQ ID NO: 1845518 - DNA, 21 bp, Homo sapiens
attccctggcctttcatattt

SEQ ID NO: 1845519 - DNA, 13 bp, Homo sapiens
attcctcatttgt

SEQ ID NO: 1845520 - DNA, 21 bp, Homo sapiens
attcctgatgcttcttcagag

SEQ ID NO: 1845521 - DNA, 18 bp, Homo sapiens
caagctccaagctcccag

SEQ ID NO: 1845522 - DNA, 19 bp, Homo sapiens
caagctccaagctcccagg

SEQ ID NO: 1845523 - DNA, 17 bp, Homo sapiens
caagctcccaggcattc

SEQ ID NO: 1845524 - DNA, 20 bp, Homo sapiens
caagctgcaccctcaggcag

SEQ ID NO: 1845525 - DNA, 21 bp, Homo sapiens
caaggaaaccacagctgctgg

SEQ ID NO: 1845526 - DNA, 15 bp, Homo sapiens
caaggaagaagaaat

SEQ ID NO: 1845527 - DNA, 20 bp, Homo sapiens
caaggagacacaacaactcc

SEQ ID NO: 1845528 - DNA, 13 bp, Homo sapiens
caaggagaggagg

SEQ ID NO: 1845529 - DNA, 12 bp, Homo sapiens
caaggagataag

SEQ ID NO: 1845530 - DNA, 15 bp, Homo sapiens
caaggcactgcctga

SEQ ID NO: 1845531 - DNA, 15 bp, Homo sapiens
caaggctgcagtgag

SEQ ID NO: 1845532 - DNA, 17 bp, Homo sapiens
caaggctgcagtgagcc

SEQ ID NO: 1845533 - DNA, 21 bp, Homo sapiens
caaggctgggggaagaagctc

SEQ ID NO: 1845534 - DNA, 13 bp, Homo sapiens
caagggatggtgc

SEQ ID NO: 1845535 - DNA, 14 bp, Homo sapiens
caagggcctggcct

SEQ ID NO: 1845536 - DNA, 15 bp, Homo sapiens
caagggcctggcctg

SEQ ID NO: 1845537 - DNA, 19 bp, Homo sapiens
caagggcctggcctgagct

SEQ ID NO: 1845538 - DNA, 19 bp, Homo sapiens
caagtgactgtatctgtgt

SEQ ID NO: 1845539 - DNA, 21 bp, Homo sapiens
caagtgactgtatctgtgtag

SEQ ID NO: 1845540 - DNA, 16 bp, Homo sapiens
caagttgaagaagctg

SEQ ID NO: 1845541 - DNA, 23 bp, Homo sapiens
caagttgtttgagaaattaagta

SEQ ID NO: 1845542 - DNA, 23 bp, Homo sapiens
caataccctttgaattggacaat

SEQ ID NO: 1845543 - DNA, 14 bp, Homo sapiens
caatactaggaagt

SEQ ID NO: 1845544 - DNA, 15 bp, Homo sapiens
caatccaagagtctg

SEQ ID NO: 1845545 - DNA, 20 bp, Homo sapiens
caatctggattcatatttaa

SEQ ID NO: 1845546 - DNA, 19 bp, Homo sapiens
caatgagatcattgtgaag

SEQ ID NO: 1845547 - DNA, 20 bp, Homo sapiens
caatgagcatgtttagactt

SEQ ID NO: 1845548 - DNA, 17 bp, Homo sapiens
caatgcactttgttctg

SEQ ID NO: 1845549 - DNA, 21 bp, Homo sapiens
caatgcactttgttctggctc

SEQ ID NO: 1845550 - DNA, 23 bp, Homo sapiens
caatgcactttgttctggctctt

SEQ ID NO: 1845551 - DNA, 16 bp, Homo sapiens
caatgccatcctcaaa

SEQ ID NO: 1845552 - DNA, 17 bp, Homo sapiens
caatgtgataaaacccc

SEQ ID NO: 1845553 - DNA, 15 bp, Homo sapiens
caatgtgtataaaca

SEQ ID NO: 1845554 - DNA, 20 bp, Homo sapiens
caattaaggattttatgctt

SEQ ID NO: 1845555 - DNA, 14 bp, Homo sapiens
caattcaacactcc

SEQ ID NO: 1845556 - DNA, 22 bp, Homo sapiens
caattcctcatttgttcattaa

SEQ ID NO: 1845557 - DNA, 22 bp, Homo sapiens
caattcttccctatctttgcca

SEQ ID NO: 1845558 - DNA, 13 bp, Homo sapiens
cagcagagcacct

SEQ ID NO: 1845559 - DNA, 12 bp, Homo sapiens
cagcagcctgga

SEQ ID NO: 1845560 - DNA, 15 bp, Homo sapiens
cagcagcctggaccc

SEQ ID NO: 1845561 - DNA, 22 bp, Homo sapiens
cagcagcctggaccctgtggat

SEQ ID NO: 1845562 - DNA, 17 bp, Homo sapiens
cagcaggatagagtggg

SEQ ID NO: 1845563 - DNA, 16 bp, Homo sapiens
cagcatattcaggaag

SEQ ID NO: 1845564 - DNA, 17 bp, Homo sapiens
cagcatattcaggaagc

SEQ ID NO: 1845565 - DNA, 22 bp, Homo sapiens
cagcatattcaggaagctcagg

SEQ ID NO: 1845566 - DNA, 23 bp, Homo sapiens
cagcatcccttgaccaggcctgg

SEQ ID NO: 1845567 - DNA, 15 bp, Homo sapiens
cagcatttgccaagt

SEQ ID NO: 1845568 - DNA, 18 bp, Homo sapiens
cagcattttactgattca

SEQ ID NO: 1845569 - DNA, 15 bp, Homo sapiens
cagccaaagcctcct

SEQ ID NO: 1845570 - DNA, 21 bp, Homo sapiens
cagccaaagcctcctccagcc

SEQ ID NO: 1845571 - DNA, 22 bp, Homo sapiens
cagccaagcaaatgcctgccaa

SEQ ID NO: 1845572 - DNA, 12 bp, Homo sapiens
cagccaggccac

SEQ ID NO: 1845573 - DNA, 13 bp, Homo sapiens
cagccaggccaca

SEQ ID NO: 1845574 - DNA, 16 bp, Homo sapiens
cagccagggctgctag

SEQ ID NO: 1845575 - DNA, 23 bp, Homo sapiens
cagccagggctgctagacggagg

SEQ ID NO: 1845576 - DNA, 13 bp, Homo sapiens
cagccccatcctc

SEQ ID NO: 1845577 - DNA, 12 bp, Homo sapiens
cagccccctcac

SEQ ID NO: 1845578 - DNA, 14 bp, Homo sapiens
cagccccctcacag

SEQ ID NO: 1845579 - DNA, 21 bp, Homo sapiens
cagcccctgatcctgtgaagt

SEQ ID NO: 1845580 - DNA, 18 bp, Homo sapiens
cagcccctggatgcagcc

SEQ ID NO: 1845581 - DNA, 19 bp, Homo sapiens
cagcccctggatgcagcct

SEQ ID NO: 1845582 - DNA, 22 bp, Homo sapiens
cagcccctggatgcagcctcac

SEQ ID NO: 1845583 - DNA, 23 bp, Homo sapiens
cagcccctggatgcagcctcaca

SEQ ID NO: 1845584 - DNA, 13 bp, Homo sapiens
cagcccgaacacc

SEQ ID NO: 1845585 - DNA, 19 bp, Homo sapiens
cagcccgggctctgcctcc

SEQ ID NO: 1845586 - DNA, 15 bp, Homo sapiens
cagccctggctgaag

SEQ ID NO: 1845587 - DNA, 16 bp, Homo sapiens
cagccctggctgaagg

SEQ ID NO: 1845588 - DNA, 14 bp, Homo sapiens
cagcctcacagtcc

SEQ ID NO: 1845589 - DNA, 18 bp, Homo sapiens
cagcctctcccctgcctg

SEQ ID NO: 1845590 - DNA, 12 bp, Homo sapiens
cagcctgctcca

SEQ ID NO: 1845591 - DNA, 17 bp, Homo sapiens
cagccttgaccattctc

SEQ ID NO: 1845592 - DNA, 22 bp, Homo sapiens
cagccttgaccattctccacct

SEQ ID NO: 1845593 - DNA, 23 bp, Homo sapiens
cagccttgaccattctccacctg

SEQ ID NO: 1845594 - DNA, 12 bp, Homo sapiens
cagcgagcctgc

SEQ ID NO: 1845595 - DNA, 14 bp, Homo sapiens
cagcgagcctgcta

SEQ ID NO: 1845596 - DNA, 15 bp, Homo sapiens
cagctcacctctccc

SEQ ID NO: 1845597 - DNA, 20 bp, Homo sapiens
cagctcacctctcccttgga

SEQ ID NO: 1845598 - DNA, 17 bp, Homo sapiens
cagctcagagagggtgg

SEQ ID NO: 1845599 - DNA, 14 bp, Homo sapiens
cagctcagcactgc

SEQ ID NO: 1845600 - DNA, 15 bp, Homo sapiens
cagctcagcactgcc

SEQ ID NO: 1845601 - DNA, 20 bp, Homo sapiens
cagctcagcactgcctgctc

SEQ ID NO: 1845602 - DNA, 15 bp, Homo sapiens
cagctcatctctgtc

SEQ ID NO: 1845603 - DNA, 13 bp, Homo sapiens
cagctctctgacg

SEQ ID NO: 1845604 - DNA, 21 bp, Homo sapiens
cagctgacttttctgtccgag

SEQ ID NO: 1845605 - DNA, 15 bp, Homo sapiens
cagctgccaggagca

SEQ ID NO: 1845606 - DNA, 20 bp, Homo sapiens
cagctgctccccaggccacc

SEQ ID NO: 1845607 - DNA, 19 bp, Homo sapiens
cagctgctggagactccta

SEQ ID NO: 1845608 - DNA, 18 bp, Homo sapiens
cagctggttgaggtttca

SEQ ID NO: 1845609 - DNA, 16 bp, Homo sapiens
cagctgttcagctggt

SEQ ID NO: 1845610 - DNA, 19 bp, Homo sapiens
cagctgttcagctggttga

SEQ ID NO: 1845611 - DNA, 20 bp, Homo sapiens
cctcatgcccagctctctga

SEQ ID NO: 1845612 - DNA, 15 bp, Homo sapiens
cctcatttgttcatt

SEQ ID NO: 1845613 - DNA, 16 bp, Homo sapiens
cctccaagaccttctc

SEQ ID NO: 1845614 - DNA, 19 bp, Homo sapiens
cctccatattttctttaaa

SEQ ID NO: 1845615 - DNA, 21 bp, Homo sapiens
cctccatgtgagaatattttt

SEQ ID NO: 1845616 - DNA, 20 bp, Homo sapiens
cctcccaactcaccccagcc

SEQ ID NO: 1845617 - DNA, 23 bp, Homo sapiens
cctcccaactcaccccagcccca

SEQ ID NO: 1845618 - DNA, 17 bp, Homo sapiens
cctcccagtacctcctg

SEQ ID NO: 1845619 - DNA, 18 bp, Homo sapiens
cctccccacagtgccacc

SEQ ID NO: 1845620 - DNA, 19 bp, Homo sapiens
cctccccacagtgccaccc

SEQ ID NO: 1845621 - DNA, 14 bp, Homo sapiens
cctcccctctcaga

SEQ ID NO: 1845622 - DNA, 15 bp, Homo sapiens
cctcccctctcagaa

SEQ ID NO: 1845623 - DNA, 21 bp, Homo sapiens
cctcctccagccgccatgctc

SEQ ID NO: 1845624 - DNA, 20 bp, Homo sapiens
cctcctttgtgaggaagccg

SEQ ID NO: 1845625 - DNA, 14 bp, Homo sapiens
cctcggtgtggaga

SEQ ID NO: 1845626 - DNA, 13 bp, Homo sapiens
cctcgtttgtgtt

SEQ ID NO: 1845627 - DNA, 14 bp, Homo sapiens
cctcgtttgtgttc

SEQ ID NO: 1845628 - DNA, 15 bp, Homo sapiens
cctcgtttgtgttct

SEQ ID NO: 1845629 - DNA, 19 bp, Homo sapiens
cctctatgaactatggacg

SEQ ID NO: 1845630 - DNA, 20 bp, Homo sapiens
cctctcagaacatactgatt

SEQ ID NO: 1845631 - DNA, 16 bp, Homo sapiens
cctctcccctcagcct

SEQ ID NO: 1845632 - DNA, 13 bp, Homo sapiens
cctctctcactcc

SEQ ID NO: 1845633 - DNA, 15 bp, Homo sapiens
cctctctcactcctt

SEQ ID NO: 1845634 - DNA, 15 bp, Homo sapiens
cctctgcacaagctg

SEQ ID NO: 1845635 - DNA, 14 bp, Homo sapiens
cctctgcactcccc

SEQ ID NO: 1845636 - DNA, 16 bp, Homo sapiens
cctctgcactcccctg

SEQ ID NO: 1845637 - DNA, 17 bp, Homo sapiens
cctctgcactcccctgc

SEQ ID NO: 1845638 - DNA, 20 bp, Homo sapiens
cctctgcactcccctgctgg

SEQ ID NO: 1845639 - DNA, 13 bp, Homo sapiens
cctctgcccactc

SEQ ID NO: 1845640 - DNA, 17 bp, Homo sapiens
cctctgcccactccctg

SEQ ID NO: 1845641 - DNA, 19 bp, Homo sapiens
cctctgcccactccctgca

SEQ ID NO: 1845642 - DNA, 20 bp, Homo sapiens
cctctgcccactccctgcaa

SEQ ID NO: 1845643 - DNA, 13 bp, Homo sapiens
cctctgctgctgg

SEQ ID NO: 1845644 - DNA, 17 bp, Homo sapiens
cctctgtacagagccca

SEQ ID NO: 1845645 - DNA, 18 bp, Homo sapiens
cctctgtacagagcccac

SEQ ID NO: 1845646 - DNA, 14 bp, Homo sapiens
cctctgtctaggac

SEQ ID NO: 1845647 - DNA, 14 bp, Homo sapiens
cctcttagaaaaac

SEQ ID NO: 1845648 - DNA, 14 bp, Homo sapiens
cctcttatgggctg

SEQ ID NO: 1845649 - DNA, 16 bp, Homo sapiens
cctcttatgggctggg

SEQ ID NO: 1845650 - DNA, 20 bp, Homo sapiens
caggtggttatggagagggt

SEQ ID NO: 1845651 - DNA, 14 bp, Homo sapiens
caggtttaagctgt

SEQ ID NO: 1845652 - DNA, 20 bp, Homo sapiens
caggtttctggtctctaggc

SEQ ID NO: 1845653 - DNA, 16 bp, Homo sapiens
cagtaaacagaggagt

SEQ ID NO: 1845654 - DNA, 18 bp, Homo sapiens
cagtaacgcaggggaaac

SEQ ID NO: 1845655 - DNA, 12 bp, Homo sapiens
cagtacctcctg

SEQ ID NO: 1845656 - DNA, 20 bp, Homo sapiens
cagtacctcctgtctctggc

SEQ ID NO: 1845657 - DNA, 21 bp, Homo sapiens
cagtattgctcacccagtgcc

SEQ ID NO: 1845658 - DNA, 12 bp, Homo sapiens
cagtcaccccag

SEQ ID NO: 1845659 - DNA, 16 bp, Homo sapiens
cagtcaccccggccac

SEQ ID NO: 1845660 - DNA, 22 bp, Homo sapiens
cagtcaccccggccacctgcgg

SEQ ID NO: 1845661 - DNA, 19 bp, Homo sapiens
cagtccaaggaaaccacag

SEQ ID NO: 1845662 - DNA, 23 bp, Homo sapiens
cagtccaaggaaaccacagctgc

SEQ ID NO: 1845663 - DNA, 21 bp, Homo sapiens
cagtcccaagcggtgtctctc

SEQ ID NO: 1845664 - DNA, 19 bp, Homo sapiens
cagtccccttccctccaag

SEQ ID NO: 1845665 - DNA, 16 bp, Homo sapiens
cagtccctgccaatgg

SEQ ID NO: 1845666 - DNA, 17 bp, Homo sapiens
cagtccctgccaatgga

SEQ ID NO: 1845667 - DNA, 13 bp, Homo sapiens
cagtcctcccatc

SEQ ID NO: 1845668 - DNA, 14 bp, Homo sapiens
cagtcctcccatct

SEQ ID NO: 1845669 - DNA, 15 bp, Homo sapiens
cagtcctcccatctc

SEQ ID NO: 1845670 - DNA, 18 bp, Homo sapiens
cagtccttaccagcagag

SEQ ID NO: 1845671 - DNA, 21 bp, Homo sapiens
cagtccttaccagcagagcac

SEQ ID NO: 1845672 - DNA, 15 bp, Homo sapiens
cagtgaacattccca

SEQ ID NO: 1845673 - DNA, 18 bp, Homo sapiens
cagtgaacattcccagcc

SEQ ID NO: 1845674 - DNA, 21 bp, Homo sapiens
cagtgaacattcccagcccag

SEQ ID NO: 1845675 - DNA, 23 bp, Homo sapiens
cagtgaacattcccagcccagcc

SEQ ID NO: 1845676 - DNA, 14 bp, Homo sapiens
cagtgaggctctgc

SEQ ID NO: 1845677 - DNA, 17 bp, Homo sapiens
cagtgcatatgcaatgt

SEQ ID NO: 1845678 - DNA, 20 bp, Homo sapiens
cagtgccacccatgcagctg

SEQ ID NO: 1845679 - DNA, 21 bp, Homo sapiens
cagtgccacccatgcagctgc

SEQ ID NO: 1845680 - DNA, 22 bp, Homo sapiens
cagtgccctctcccctcagcct

SEQ ID NO: 1845681 - DNA, 15 bp, Homo sapiens
cagtgccgagaagga

SEQ ID NO: 1845682 - DNA, 20 bp, Homo sapiens
cagtgcctcttccagtgaac

SEQ ID NO: 1845683 - DNA, 23 bp, Homo sapiens
cagtggccaagatcacagtggcc

SEQ ID NO: 1845684 - DNA, 17 bp, Homo sapiens
cagtggctgctgcccag

SEQ ID NO: 1845685 - DNA, 21 bp, Homo sapiens
cagtggggcagaggcagtacc

SEQ ID NO: 1845686 - DNA, 16 bp, Homo sapiens
cagtgtccaaagcagg

SEQ ID NO: 1845687 - DNA, 17 bp, Homo sapiens
cagtgtccaaagcaggg

SEQ ID NO: 1845688 - DNA, 22 bp, Homo sapiens
cagtgtccaaagcagggtctgg

SEQ ID NO: 1845689 - DNA, 15 bp, Homo sapiens
cagttaaactggctt

SEQ ID NO: 1845690 - DNA, 15 bp, Homo sapiens
cagttaagcctttgg

SEQ ID NO: 1845691 - DNA, 19 bp, Homo sapiens
cagttggtcccccttccat

SEQ ID NO: 1845692 - DNA, 20 bp, Homo sapiens
cagttggtcccccttccatg

SEQ ID NO: 1845693 - DNA, 15 bp, Homo sapiens
cagtttctgtcctgc

SEQ ID NO: 1845694 - DNA, 16 bp, Homo sapiens
cagtttgagacaggag

SEQ ID NO: 1845695 - DNA, 19 bp, Homo sapiens
cagtttggaagtgttaact

SEQ ID NO: 1845696 - DNA, 17 bp, Homo sapiens
cagttttggttgcttta

SEQ ID NO: 1845697 - DNA, 19 bp, Homo sapiens
cagttttggttgctttaat

SEQ ID NO: 1845698 - DNA, 18 bp, Homo sapiens
cataagagtaacagtcat

SEQ ID NO: 1845699 - DNA, 17 bp, Homo sapiens
cataagctatttttcta

SEQ ID NO: 1845700 - DNA, 18 bp, Homo sapiens
cataagctatttttctaa

SEQ ID NO: 1845701 - DNA, 16 bp, Homo sapiens
cataccacaataaaaa

SEQ ID NO: 1845702 - DNA, 11 bp, Homo sapiens
catacccaccc

SEQ ID NO: 1845703 - DNA, 17 bp, Homo sapiens
catacccacccccaccc

SEQ ID NO: 1845704 - DNA, 21 bp, Homo sapiens
catacccacccccacccaagg

SEQ ID NO: 1845705 - DNA, 15 bp, Homo sapiens
catacctacatgtat

SEQ ID NO: 1845706 - DNA, 17 bp, Homo sapiens
ccaattttaaaatgaaa

SEQ ID NO: 1845707 - DNA, 18 bp, Homo sapiens
ccaattttaaaatgaaat

SEQ ID NO: 1845708 - DNA, 23 bp, Homo sapiens
ccaattttaaaatgaaatgcatt

SEQ ID NO: 1845709 - DNA, 12 bp, Homo sapiens
ccacactccagc

SEQ ID NO: 1845710 - DNA, 13 bp, Homo sapiens
ccacactccagct

SEQ ID NO: 1845711 - DNA, 17 bp, Homo sapiens
ccacactccagctggga

SEQ ID NO: 1845712 - DNA, 13 bp, Homo sapiens
ccacagagtataa

SEQ ID NO: 1845713 - DNA, 13 bp, Homo sapiens
ccacagctgctgg

SEQ ID NO: 1845714 - DNA, 17 bp, Homo sapiens
ccacaggaagtgaagaa

SEQ ID NO: 1845715 - DNA, 19 bp, Homo sapiens
ccacaggcttctgagcagc

SEQ ID NO: 1845716 - DNA, 18 bp, Homo sapiens
ccacatttctaagccttt

SEQ ID NO: 1845717 - DNA, 14 bp, Homo sapiens
ccaccaacatactc

SEQ ID NO: 1845718 - DNA, 16 bp, Homo sapiens
ccaccatcaagccacc

SEQ ID NO: 1845719 - DNA, 19 bp, Homo sapiens
ccacccaagggcctggcct

SEQ ID NO: 1845720 - DNA, 20 bp, Homo sapiens
ccacccaagggcctggcctg

SEQ ID NO: 1845721 - DNA, 21 bp, Homo sapiens
ccacccaagggcctggcctga

SEQ ID NO: 1845722 - DNA, 17 bp, Homo sapiens
ccaccctgaaagccctg

SEQ ID NO: 1845723 - DNA, 18 bp, Homo sapiens
ccaccctgcctctaccca

SEQ ID NO: 1845724 - DNA, 22 bp, Homo sapiens
ccaccgcagacaggaccaggga

SEQ ID NO: 1845725 - DNA, 16 bp, Homo sapiens
ccacctacaaggagat

SEQ ID NO: 1845726 - DNA, 14 bp, Homo sapiens
ccacctgccaggga

SEQ ID NO: 1845727 - DNA, 15 bp, Homo sapiens
ccacctggcctctgc

SEQ ID NO: 1845728 - DNA, 20 bp, Homo sapiens
ccacctggcctctgcactcc

SEQ ID NO: 1845729 - DNA, 17 bp, Homo sapiens
ccacctgttttctgaaa

SEQ ID NO: 1845730 - DNA, 13 bp, Homo sapiens
ccacgcccccact

SEQ ID NO: 1845731 - DNA, 18 bp, Homo sapiens
ccacgcccccactggtga

SEQ ID NO: 1845732 - DNA, 19 bp, Homo sapiens
ccacgcccccactggtgac

SEQ ID NO: 1845733 - DNA, 17 bp, Homo sapiens
ccacggtggtcactgga

SEQ ID NO: 1845734 - DNA, 16 bp, Homo sapiens
ccactactcaaaaatt

SEQ ID NO: 1845735 - DNA, 19 bp, Homo sapiens
ccactgcactccagcctgg

SEQ ID NO: 1845736 - DNA, 22 bp, Homo sapiens
ccagaagtttgagatcagcctg

SEQ ID NO: 1845737 - DNA, 17 bp, Homo sapiens
ccagacacatgtccaag

SEQ ID NO: 1845738 - DNA, 22 bp, Homo sapiens
ccagacacatgtccaagaagcc

SEQ ID NO: 1845739 - DNA, 13 bp, Homo sapiens
ccagacgatgtct

SEQ ID NO: 1845740 - DNA, 15 bp, Homo sapiens
ccagagccttaataa

SEQ ID NO: 1845741 - DNA, 13 bp, Homo sapiens
ccagagggcctgc

SEQ ID NO: 1845742 - DNA, 17 bp, Homo sapiens
ccagagggcctgcaagg

SEQ ID NO: 1845743 - DNA, 18 bp, Homo sapiens
ccagagggcctgcaaggg

SEQ ID NO: 1845744 - DNA, 16 bp, Homo sapiens
ccagaggtggatgtta

SEQ ID NO: 1845745 - DNA, 23 bp, Homo sapiens
ccagagtggagatcccacatatt

SEQ ID NO: 1845746 - DNA, 21 bp, Homo sapiens
ccagagttccccatgcagaca

SEQ ID NO: 1845747 - DNA, 12 bp, Homo sapiens
ccagattctgat

SEQ ID NO: 1845748 - DNA, 15 bp, Homo sapiens
ccagattctgatgca

SEQ ID NO: 1845749 - DNA, 21 bp, Homo sapiens
ccagattctttcctgaggctg

SEQ ID NO: 1845750 - DNA, 20 bp, Homo sapiens
ccagcaagcggggatgtccc

SEQ ID NO: 1845751 - DNA, 12 bp, Homo sapiens
ccagcagagcac

SEQ ID NO: 1845752 - DNA, 13 bp, Homo sapiens
ccagcagcctgga

SEQ ID NO: 1845753 - DNA, 18 bp, Homo sapiens
ccagcattttactgattc

SEQ ID NO: 1845754 - DNA, 15 bp, Homo sapiens
ccagccaaagcctcc

SEQ ID NO: 1845755 - DNA, 19 bp, Homo sapiens
ccagccaacctgggggctt

SEQ ID NO: 1845756 - DNA, 19 bp, Homo sapiens
ccagccccaaaactctcct

SEQ ID NO: 1845757 - DNA, 23 bp, Homo sapiens
ccagccccaaaactctcctctgc

SEQ ID NO: 1845758 - DNA, 18 bp, Homo sapiens
ccagccccatcctctgta

SEQ ID NO: 1845759 - DNA, 14 bp, Homo sapiens
ccagcccctggatg

SEQ ID NO: 1845760 - DNA, 18 bp, Homo sapiens
ccagcccctggatgcagc

SEQ ID NO: 1845761 - DNA, 21 bp, Homo sapiens
ccagcccctggatgcagcctc

SEQ ID NO: 1845762 - DNA, 16 bp, Homo sapiens
ccagccccttctgacc

SEQ ID NO: 1845763 - DNA, 18 bp, Homo sapiens
ccagccccttctgaccca

SEQ ID NO: 1845764 - DNA, 23 bp, Homo sapiens
ccagccccttctgacccatgctg

SEQ ID NO: 1845765 - DNA, 14 bp, Homo sapiens
ccagccctggctga

SEQ ID NO: 1845766 - DNA, 21 bp, Homo sapiens
ccagccctggctgaaggactg

SEQ ID NO: 1845767 - DNA, 13 bp, Homo sapiens
ccagcctggagat

SEQ ID NO: 1845768 - DNA, 20 bp, Homo sapiens
ccagcctgggaaagcccctg

SEQ ID NO: 1845769 - DNA, 20 bp, Homo sapiens
ccagccttgaccattctcca

SEQ ID NO: 1845770 - DNA, 23 bp, Homo sapiens
ccagccttgaccattctccacct

SEQ ID NO: 1845771 - DNA, 13 bp, Homo sapiens
ccagctcagcact

SEQ ID NO: 1845772 - DNA, 23 bp, Homo sapiens
ccagctcctcatccagggctctg

SEQ ID NO: 1845773 - DNA, 21 bp, Homo sapiens
ccagctggtgagtgatgcggc

SEQ ID NO: 1845774 - DNA, 19 bp, Homo sapiens
ccagcttaaaggggctaga

SEQ ID NO: 1845775 - DNA, 16 bp, Homo sapiens
ccagcttatctcaggg

SEQ ID NO: 1845776 - DNA, 13 bp, Homo sapiens
ccagcttttccca

SEQ ID NO: 1845777 - DNA, 23 bp, Homo sapiens
ccagcttttcccaaaagcccatt

SEQ ID NO: 1845778 - DNA, 17 bp, Homo sapiens
ccaggaaaggctccagg

SEQ ID NO: 1845779 - DNA, 20 bp, Homo sapiens
ccaggaaaggctccaggagc

SEQ ID NO: 1845780 - DNA, 17 bp, Homo sapiens
ccaggagcacggctctg

SEQ ID NO: 1845781 - DNA, 13 bp, Homo sapiens
ccaggagcagcca

SEQ ID NO: 1845782 - DNA, 20 bp, Homo sapiens
ccaggatgagcatcccagga

SEQ ID NO: 1845783 - DNA, 21 bp, Homo sapiens
ccaggcattccccaggaggcc

SEQ ID NO: 1845784 - DNA, 22 bp, Homo sapiens
ccaggcattccccaggaggcca

SEQ ID NO: 1845785 - DNA, 16 bp, Homo sapiens
ccaggccctctgccca

SEQ ID NO: 1845786 - DNA, 20 bp, Homo sapiens
ccaggccctctgcccactcc

SEQ ID NO: 1845787 - DNA, 23 bp, Homo sapiens
ccaggccctctgcccactccctg

SEQ ID NO: 1845788 - DNA, 18 bp, Homo sapiens
ccaggctgggagagcctt

SEQ ID NO: 1845789 - DNA, 16 bp, Homo sapiens
ccagggcctggaagac

SEQ ID NO: 1845790 - DNA, 20 bp, Homo sapiens
ccagggcctggaagacagag

SEQ ID NO: 1845791 - DNA, 21 bp, Homo sapiens
ccaggggaaaatcagcctgct

SEQ ID NO: 1845792 - DNA, 19 bp, Homo sapiens
ccaggggtgggacaccctg

SEQ ID NO: 1845793 - DNA, 23 bp, Homo sapiens
ccaggggtgggacaccctgtgat

SEQ ID NO: 1845794 - DNA, 17 bp, Homo sapiens
ccaggtttctggtctct

SEQ ID NO: 1845795 - DNA, 22 bp, Homo sapiens
ccaggtttctggtctctaggct

SEQ ID NO: 1845796 - DNA, 12 bp, Homo sapiens
ccagtaaacaga

SEQ ID NO: 1845797 - DNA, 12 bp, Homo sapiens
ccagtcaccccg

SEQ ID NO: 1845798 - DNA, 16 bp, Homo sapiens
ccagtcatctgtaaga

SEQ ID NO: 1845799 - DNA, 21 bp, Homo sapiens
ccagtcatctgtaagagcttg

SEQ ID NO: 1845800 - DNA, 14 bp, Homo sapiens
ccagtccaaggaaa

SEQ ID NO: 1845801 - DNA, 14 bp, Homo sapiens
ccagtcccctttct

SEQ ID NO: 1845802 - DNA, 22 bp, Homo sapiens
ccagtgaacattcccagcccag

SEQ ID NO: 1845803 - DNA, 13 bp, Homo sapiens
ccagtgagatgca

SEQ ID NO: 1845804 - DNA, 21 bp, Homo sapiens
ccagtgagatgcattcttggt

SEQ ID NO: 1845805 - DNA, 20 bp, Homo sapiens
ccagtgaggctctgcccttg

SEQ ID NO: 1845806 - DNA, 19 bp, Homo sapiens
ccagtgcatatgcaatgta

SEQ ID NO: 1845807 - DNA, 20 bp, Homo sapiens
ccagtgccgagaaggaagcc

SEQ ID NO: 1845808 - DNA, 15 bp, Homo sapiens
ccagtggctgctgcc

SEQ ID NO: 1845809 - DNA, 18 bp, Homo sapiens
ccagttggtcccccttcc

SEQ ID NO: 1845810 - DNA, 22 bp, Homo sapiens
ccataccacccaatgctgatgt

SEQ ID NO: 1845811 - DNA, 23 bp, Homo sapiens
ccatagagagcaagacgctgtgc

SEQ ID NO: 1845812 - DNA, 15 bp, Homo sapiens
ccatattaacaaatt

SEQ ID NO: 1845813 - DNA, 22 bp, Homo sapiens
ccatattaacaaattgcatttg

SEQ ID NO: 1845814 - DNA, 14 bp, Homo sapiens
ccatcaagccacca

SEQ ID NO: 1845815 - DNA, 22 bp, Homo sapiens
ccatcagaaacaccctcacact

SEQ ID NO: 1845816 - DNA, 13 bp, Homo sapiens
ccatcccagcccc

SEQ ID NO: 1845817 - DNA, 14 bp, Homo sapiens
ccatccctgaaggc

SEQ ID NO: 1845818 - DNA, 13 bp, Homo sapiens
ccatcctcaaaca

SEQ ID NO: 1845819 - DNA, 18 bp, Homo sapiens
ccatcctcaaacactgca

SEQ ID NO: 1845820 - DNA, 20 bp, Homo sapiens
ccatcctctgtacagagccc

SEQ ID NO: 1845821 - DNA, 14 bp, Homo sapiens
ccatcctgtgtgtt

SEQ ID NO: 1845822 - DNA, 12 bp, Homo sapiens
ccatctctggat

SEQ ID NO: 1845823 - DNA, 13 bp, Homo sapiens
ccatctgctcctg

SEQ ID NO: 1845824 - DNA, 16 bp, Homo sapiens
ccatgagtcccctgtt

SEQ ID NO: 1845825 - DNA, 21 bp, Homo sapiens
ccatgagtggcatggccacca

SEQ ID NO: 1845826 - DNA, 12 bp, Homo sapiens
ccatgatgctgg

SEQ ID NO: 1845827 - DNA, 18 bp, Homo sapiens
ccatgatgttttccatga

SEQ ID NO: 1845828 - DNA, 21 bp, Homo sapiens
ccatgattaaccacttcagct

SEQ ID NO: 1845829 - DNA, 18 bp, Homo sapiens
ccatgcaatatttcctca

SEQ ID NO: 1845830 - DNA, 12 bp, Homo sapiens
ccatgcagacct

SEQ ID NO: 1845831 - DNA, 18 bp, Homo sapiens
ccatgcagacctcatgcc

SEQ ID NO: 1845832 - DNA, 14 bp, Homo sapiens
ccatgcaggaggtg

SEQ ID NO: 1845833 - DNA, 13 bp, Homo sapiens
ccatgctcctggc

SEQ ID NO: 1845834 - DNA, 18 bp, Homo sapiens
ccatgctcctggcccact

SEQ ID NO: 1845835 - DNA, 15 bp, Homo sapiens
ccatgctgccctgtg

SEQ ID NO: 1845836 - DNA, 16 bp, Homo sapiens
ccatgctgccctgtga

SEQ ID NO: 1845837 - DNA, 14 bp, Homo sapiens
ccatggactttgtt

SEQ ID NO: 1845838 - DNA, 22 bp, Homo sapiens
ccatggagagctggagcctggt

SEQ ID NO: 1845839 - DNA, 14 bp, Homo sapiens
ccatgtctcgactc

SEQ ID NO: 1845840 - DNA, 18 bp, Homo sapiens
ccattcattccattctgg

SEQ ID NO: 1845841 - DNA, 14 bp, Homo sapiens
ccattctccacctg

SEQ ID NO: 1845842 - DNA, 18 bp, Homo sapiens
ccattctccacctgccag

SEQ ID NO: 1845843 - DNA, 15 bp, Homo sapiens
ccattctggaagtga

SEQ ID NO: 1845844 - DNA, 19 bp, Homo sapiens
ccattctggaagtgacttt

SEQ ID NO: 1845845 - DNA, 18 bp, Homo sapiens
ccattgttgtcaaggaag

SEQ ID NO: 1845846 - DNA, 20 bp, Homo sapiens
cccaaaactctcctctgctg

SEQ ID NO: 1845847 - DNA, 18 bp, Homo sapiens
cccaaatggaaatgggca

SEQ ID NO: 1845848 - DNA, 15 bp, Homo sapiens
cccaaccctggcacc

SEQ ID NO: 1845849 - DNA, 23 bp, Homo sapiens
cccaatgcactttgttctggctc

SEQ ID NO: 1845850 - DNA, 15 bp, Homo sapiens
cccaatgctgatgtc

SEQ ID NO: 1845851 - DNA, 21 bp, Homo sapiens
cccacaaaggagagctagcag

SEQ ID NO: 1845852 - DNA, 15 bp, Homo sapiens
cccacagtgccaccc

SEQ ID NO: 1845853 - DNA, 18 bp, Homo sapiens
cccacccaagggcctggc

SEQ ID NO: 1845854 - DNA, 21 bp, Homo sapiens
cccacccaagggcctggcctg

SEQ ID NO: 1845855 - DNA, 22 bp, Homo sapiens
cccacccaagggcctggcctga

SEQ ID NO: 1845856 - DNA, 15 bp, Homo sapiens
cccaccgcagacagg

SEQ ID NO: 1845857 - DNA, 18 bp, Homo sapiens
cccaccgcagacaggacc

SEQ ID NO: 1845858 - DNA, 19 bp, Homo sapiens
cccaccgcagacaggacca

SEQ ID NO: 1845859 - DNA, 19 bp, Homo sapiens
cccacctctctcactcctt

SEQ ID NO: 1845860 - DNA, 22 bp, Homo sapiens
cccacctctctcactccttgaa

SEQ ID NO: 1845861 - DNA, 16 bp, Homo sapiens
cccacctggcctctgc

SEQ ID NO: 1845862 - DNA, 17 bp, Homo sapiens
cccacctgttttctgaa

SEQ ID NO: 1845863 - DNA, 23 bp, Homo sapiens
cccacctgttttctgaaacacac

SEQ ID NO: 1845864 - DNA, 21 bp, Homo sapiens
cccacgactgcccggcagggt

SEQ ID NO: 1845865 - DNA, 14 bp, Homo sapiens
cccacgcccccact

SEQ ID NO: 1845866 - DNA, 14 bp, Homo sapiens
cccactcagccttt

SEQ ID NO: 1845867 - DNA, 12 bp, Homo sapiens
cccactccctgc

SEQ ID NO: 1845868 - DNA, 14 bp, Homo sapiens
cccactgcctttga

SEQ ID NO: 1845869 - DNA, 23 bp, Homo sapiens
cccacttgagaattacccttttg

SEQ ID NO: 1845870 - DNA, 14 bp, Homo sapiens
cccagagggcctgc

SEQ ID NO: 1845871 - DNA, 20 bp, Homo sapiens
cccagagggcctgcaaggga

SEQ ID NO: 1845872 - DNA, 12 bp, Homo sapiens
cccagaggtgga

SEQ ID NO: 1845873 - DNA, 15 bp, Homo sapiens
cccagccccatcctc

SEQ ID NO: 1845874 - DNA, 13 bp, Homo sapiens
cccagctctctga

SEQ ID NO: 1845875 - DNA, 16 bp, Homo sapiens
cccagctctctgacgc

SEQ ID NO: 1845876 - DNA, 14 bp, Homo sapiens
cccagctctggtcc

SEQ ID NO: 1845877 - DNA, 22 bp, Homo sapiens
cccaggaggccagccttgacca

SEQ ID NO: 1845878 - DNA, 15 bp, Homo sapiens
cccaggcattcccca

SEQ ID NO: 1845879 - DNA, 22 bp, Homo sapiens
cccaggcattccccaggaggcc

SEQ ID NO: 1845880 - DNA, 12 bp, Homo sapiens
cccaggctgggc

SEQ ID NO: 1845881 - DNA, 20 bp, Homo sapiens
cccaggcttagtcactgaga

SEQ ID NO: 1845882 - DNA, 22 bp, Homo sapiens
cccaggtgctaggaacactcct

SEQ ID NO: 1845883 - DNA, 20 bp, Homo sapiens
cccagtacctcctgtctctg

SEQ ID NO: 1845884 - DNA, 18 bp, Homo sapiens
cccagtgccctctcccct

SEQ ID NO: 1845885 - DNA, 16 bp, Homo sapiens
cccagtggctgctgcc

SEQ ID NO: 1845886 - DNA, 17 bp, Homo sapiens
cccagtggctgctgccc

SEQ ID NO: 1845887 - DNA, 18 bp, Homo sapiens
cccatattaacaaattgc

SEQ ID NO: 1845888 - DNA, 21 bp, Homo sapiens
cccatcctctgtacagagccc

SEQ ID NO: 1845889 - DNA, 15 bp, Homo sapiens
cccatgcagctgctc

SEQ ID NO: 1845890 - DNA, 12 bp, Homo sapiens
cccatgctgccc

SEQ ID NO: 1845891 - DNA, 14 bp, Homo sapiens
cccatgctgccctg

SEQ ID NO: 1845892 - DNA, 18 bp, Homo sapiens
cccatgctgccctgtgag

SEQ ID NO: 1845893 - DNA, 17 bp, Homo sapiens
cccatgttgagacctca

SEQ ID NO: 1845894 - DNA, 16 bp, Homo sapiens
cccattagcaaaaatt

SEQ ID NO: 1845895 - DNA, 22 bp, Homo sapiens
cccattcattccattctggaag

SEQ ID NO: 1845896 - DNA, 21 bp, Homo sapiens
ccccaaaactctcctctgctg

SEQ ID NO: 1845897 - DNA, 14 bp, Homo sapiens
gcttgcttttcatg

SEQ ID NO: 1845898 - DNA, 23 bp, Homo sapiens
gcttgcttttcatgcaaactctt

SEQ ID NO: 1845899 - DNA, 14 bp, Homo sapiens
gcttggaggaagga

SEQ ID NO: 1845900 - DNA, 15 bp, Homo sapiens
gcttggaggaaggaa

SEQ ID NO: 1845901 - DNA, 22 bp, Homo sapiens
gcttgtgacagtgcctcttcca

SEQ ID NO: 1845902 - DNA, 13 bp, Homo sapiens
gctttaatataaa

SEQ ID NO: 1845903 - DNA, 23 bp, Homo sapiens
gctttaatatcatcagtattgaa

SEQ ID NO: 1845904 - DNA, 14 bp, Homo sapiens
gctttctgggatgt

SEQ ID NO: 1845905 - DNA, 19 bp, Homo sapiens
gctttctgggatgtcacag

SEQ ID NO: 1845906 - DNA, 20 bp, Homo sapiens
gctttctgggatgtcacagt

SEQ ID NO: 1845907 - DNA, 12 bp, Homo sapiens
gcttttccaaac

SEQ ID NO: 1845908 - DNA, 16 bp, Homo sapiens
gcttttcccaaaagcc

SEQ ID NO: 1845909 - DNA, 13 bp, Homo sapiens
ggaaaaatagcct

SEQ ID NO: 1845910 - DNA, 12 bp, Homo sapiens
ggaaaaccagga

SEQ ID NO: 1845911 - DNA, 14 bp, Homo sapiens
ggaaaagggagcta

SEQ ID NO: 1845912 - DNA, 15 bp, Homo sapiens
ggaaaatcagcctgc

SEQ ID NO: 1845913 - DNA, 17 bp, Homo sapiens
ggaaagagtaggaagac

SEQ ID NO: 1845914 - DNA, 17 bp, Homo sapiens
ggaaagcacaggtgggc

SEQ ID NO: 1845915 - DNA, 16 bp, Homo sapiens
ggaaagcccctgcccc

SEQ ID NO: 1845916 - DNA, 12 bp, Homo sapiens
ggaaaggctcca

SEQ ID NO: 1845917 - DNA, 14 bp, Homo sapiens
ggaaaggctccagg

SEQ ID NO: 1845918 - DNA, 20 bp, Homo sapiens
ggaaaggctccaggagcagc

SEQ ID NO: 1845919 - DNA, 22 bp, Homo sapiens
ggaaaggctccaggagcagcca

SEQ ID NO: 1845920 - DNA, 19 bp, Homo sapiens
ggaacactccttcacagat

SEQ ID NO: 1845921 - DNA, 15 bp, Homo sapiens
ggaacatcatcaagg

SEQ ID NO: 1845922 - DNA, 23 bp, Homo sapiens
ggaacatcatcaaggcactgcct

SEQ ID NO: 1845923 - DNA, 21 bp, Homo sapiens
ggaacttgagcgtgaatctgt

SEQ ID NO: 1845924 - DNA, 22 bp, Homo sapiens
ggaagaagaaatctttctccct

SEQ ID NO: 1845925 - DNA, 14 bp, Homo sapiens
ggaagacctggcaa

SEQ ID NO: 1845926 - DNA, 17 bp, Homo sapiens
ggaagagcccgcagggc

SEQ ID NO: 1845927 - DNA, 13 bp, Homo sapiens
ggaagagccttgc

SEQ ID NO: 1845928 - DNA, 22 bp, Homo sapiens
ggaagccaaacctctgtgagca

SEQ ID NO: 1845929 - DNA, 15 bp, Homo sapiens
ggaagccgctggggc

SEQ ID NO: 1845930 - DNA, 21 bp, Homo sapiens
ggaagctcagggcctggctca

SEQ ID NO: 1845931 - DNA, 17 bp, Homo sapiens
ggaaggatctgctgagg

SEQ ID NO: 1845932 - DNA, 19 bp, Homo sapiens
ggaaggatctgctgaggcc

SEQ ID NO: 1845933 - DNA, 21 bp, Homo sapiens
ggaaggctcttctccccagag

SEQ ID NO: 1845934 - DNA, 13 bp, Homo sapiens
ggaagggtggtgg

SEQ ID NO: 1845935 - DNA, 11 bp, Homo sapiens
ggaaggtgggg

SEQ ID NO: 1845936 - DNA, 17 bp, Homo sapiens
ggaagtaaagtgaagaa

SEQ ID NO: 1845937 - DNA, 16 bp, Homo sapiens
ggaatacctgtccccc

SEQ ID NO: 1845938 - DNA, 19 bp, Homo sapiens
ggaatacctgtccccctga

SEQ ID NO: 1845939 - DNA, 20 bp, Homo sapiens
ggaatccactcccaggcagc

SEQ ID NO: 1845940 - DNA, 23 bp, Homo sapiens
ggaatgcctgagtgcctggccaa

SEQ ID NO: 1845941 - DNA, 22 bp, Homo sapiens
ggacaaggatgatctaggaaga

SEQ ID NO: 1845942 - DNA, 16 bp, Homo sapiens
ggacacagatgaaaca

SEQ ID NO: 1845943 - DNA, 22 bp, Homo sapiens
ggacactcaaaagctgggcagg

SEQ ID NO: 1845944 - DNA, 17 bp, Homo sapiens
ggacagaagcagctctt

SEQ ID NO: 1845945 - DNA, 21 bp, Homo sapiens
ggacagaggttatctgtccca

SEQ ID NO: 1845946 - DNA, 15 bp, Homo sapiens
ggacagcccctcctc

SEQ ID NO: 1845947 - DNA, 15 bp, Homo sapiens
ggacagcgggaaaaa

SEQ ID NO: 1845948 - DNA, 16 bp, Homo sapiens
ggacatgctgaagcca

SEQ ID NO: 1845949 - DNA, 14 bp, Homo sapiens
ggacatgcttagca

SEQ ID NO: 1845950 - DNA, 18 bp, Homo sapiens
ggacatggcccctgtgag

SEQ ID NO: 1845951 - DNA, 15 bp, Homo sapiens
ggaccagcttttccc

SEQ ID NO: 1845952 - DNA, 11 bp, Homo sapiens
ggaccctgagg

SEQ ID NO: 1845953 - DNA, 13 bp, Homo sapiens
ggacgcaggcccc

SEQ ID NO: 1845954 - DNA, 22 bp, Homo sapiens
ggacgcaggcccctctcctccg

SEQ ID NO: 1845955 - DNA, 20 bp, Homo sapiens
ggacggtgctccaggcaggc

SEQ ID NO: 1845956 - DNA, 20 bp, Homo sapiens
ggactaacttgtctttggac

SEQ ID NO: 1845957 - DNA, 24 bp, Homo sapiens
ggactaacttgtctttggaccctg

SEQ ID NO: 1845958 - DNA, 16 bp, Homo sapiens
ggactcagccttgcaa

SEQ ID NO: 1845959 - DNA, 13 bp, Homo sapiens
ggactcagctccc

SEQ ID NO: 1845960 - DNA, 23 bp, Homo sapiens
ggacttagaaaaccagctcagca

SEQ ID NO: 1845961 - DNA, 19 bp, Homo sapiens
ggacttgcaaaaagggtca

SEQ ID NO: 1845962 - DNA, 9 bp, Homo sapiens
ggactttgt

SEQ ID NO: 1845963 - DNA, 18 bp, Homo sapiens
ggacttttatttccagtg

SEQ ID NO: 1845964 - DNA, 15 bp, Homo sapiens
ggagaccctccccac

SEQ ID NO: 1845965 - DNA, 13 bp, Homo sapiens
ggagactcctagg

SEQ ID NO: 1845966 - DNA, 13 bp, Homo sapiens
ggagagccttcca

SEQ ID NO: 1845967 - DNA, 22 bp, Homo sapiens
ggagagctggagcctggtgccc

SEQ ID NO: 1845968 - DNA, 14 bp, Homo sapiens
ggagatagggaaag

SEQ ID NO: 1845969 - DNA, 20 bp, Homo sapiens
ggagatcaaggagaggaggc

SEQ ID NO: 1845970 - DNA, 21 bp, Homo sapiens
ggagcagccacattcctgatg

SEQ ID NO: 1845971 - DNA, 15 bp, Homo sapiens
ggagcggcagatggg

SEQ ID NO: 1845972 - DNA, 22 bp, Homo sapiens
ggagctatgatttttttttcca

SEQ ID NO: 1845973 - DNA, 21 bp, Homo sapiens
ggagctggccgtgggcctggg

SEQ ID NO: 1845974 - DNA, 12 bp, Homo sapiens
ggaggagcaaag

SEQ ID NO: 1845975 - DNA, 16 bp, Homo sapiens
ggagggagggctccag

SEQ ID NO: 1845976 - DNA, 21 bp, Homo sapiens
ggagggcacattccttgcctg

SEQ ID NO: 1845977 - DNA, 13 bp, Homo sapiens
ggagggctccaga

SEQ ID NO: 1845978 - DNA, 15 bp, Homo sapiens
ggagggctccagaca

SEQ ID NO: 1845979 - DNA, 22 bp, Homo sapiens
ggaggtgcgtgttcagcagaac

SEQ ID NO: 1845980 - DNA, 23 bp, Homo sapiens
ggaggtgggatcctccaggtgca

SEQ ID NO: 1845981 - DNA, 17 bp, Homo sapiens
ggatccctcatcctcat

SEQ ID NO: 1845982 - DNA, 18 bp, Homo sapiens
ggatctcttgagcctggg

SEQ ID NO: 1845983 - DNA, 21 bp, Homo sapiens
ggatctttggacagaagcagc

SEQ ID NO: 1845984 - DNA, 18 bp, Homo sapiens
ggatggatttccagccaa

SEQ ID NO: 1845985 - DNA, 15 bp, Homo sapiens
ggatgtccccagcag

SEQ ID NO: 1845986 - DNA, 15 bp, Homo sapiens
ggatgttatgaacag

SEQ ID NO: 1845987 - DNA, 16 bp, Homo sapiens
ggatgttatgaacagc

SEQ ID NO: 1845988 - DNA, 20 bp, Homo sapiens
ggatgttatgaacagctgtg

SEQ ID NO: 1845989 - DNA, 16 bp, Homo sapiens
ggattgtccccgaccc

SEQ ID NO: 1845990 - DNA, 23 bp, Homo sapiens
ggattgtgcctaatgtgtttgag

SEQ ID NO: 1845991 - DNA, 12 bp, Homo sapiens
ggattgtggaaa

SEQ ID NO: 1845992 - DNA, 14 bp, Homo sapiens
ggattgtggaaaac

SEQ ID NO: 1845993 - DNA, 15 bp, Homo sapiens
ggcaaaaaggcagga

SEQ ID NO: 1845994 - DNA, 13 bp, Homo sapiens
ggcaaatgacttt

SEQ ID NO: 1845995 - DNA, 16 bp, Homo sapiens
ggcaacgcacaaaaca

SEQ ID NO: 1845996 - DNA, 22 bp, Homo sapiens
ggcaactttccttgttccccat

SEQ ID NO: 1845997 - DNA, 13 bp, Homo sapiens
ggcaaggctgtgc

SEQ ID NO: 1845998 - DNA, 17 bp, Homo sapiens
ggcaccagcagcctgga

SEQ ID NO: 1845999 - DNA, 16 bp, Homo sapiens
ggcactgcttccagtg

SEQ ID NO: 1846000 - DNA, 24 bp, Homo sapiens
ggcactgcttccagtgaggctctg

SEQ ID NO: 1846001 - DNA, 22 bp, Homo sapiens
ggcacttgggacaaaaacaaac

SEQ ID NO: 1846002 - DNA, 23 bp, Homo sapiens
ggcagagattggaatgggcagct

SEQ ID NO: 1846003 - DNA, 12 bp, Homo sapiens
ggcagctcacct

SEQ ID NO: 1846004 - DNA, 16 bp, Homo sapiens
ggcagctcacctctcc

SEQ ID NO: 1846005 - DNA, 15 bp, Homo sapiens
ggcagctcatctctg

SEQ ID NO: 1846006 - DNA, 18 bp, Homo sapiens
ggcaggaggatcacttga

SEQ ID NO: 1846007 - DNA, 15 bp, Homo sapiens
ggcaggatggcctgg

SEQ ID NO: 1846008 - DNA, 16 bp, Homo sapiens
ggcaggatggcctggc

SEQ ID NO: 1846009 - DNA, 19 bp, Homo sapiens
ggcaggatggcctggccag

SEQ ID NO: 1846010 - DNA, 17 bp, Homo sapiens
ggcaggctaaggcgtgg

SEQ ID NO: 1846011 - DNA, 12 bp, Homo sapiens
ggcaggcttggg

SEQ ID NO: 1846012 - DNA, 12 bp, Homo sapiens
ggcagggtccta

SEQ ID NO: 1846013 - DNA, 23 bp, Homo sapiens
ggcagtacctgggcaagctggcg

SEQ ID NO: 1846014 - DNA, 19 bp, Homo sapiens
ggcatgggtcgggagaggg

SEQ ID NO: 1846015 - DNA, 20 bp, Homo sapiens
ggcatgggtcgggagagggg

SEQ ID NO: 1846016 - DNA, 21 bp, Homo sapiens
ggcatgtatgacgtgactggc

SEQ ID NO: 1846017 - DNA, 18 bp, Homo sapiens
ggcattccccaggaggcc

SEQ ID NO: 1846018 - DNA, 14 bp, Homo sapiens
ggccaaataaagtc

SEQ ID NO: 1846019 - DNA, 13 bp, Homo sapiens
ggccaaggtggga

SEQ ID NO: 1846020 - DNA, 16 bp, Homo sapiens
ggccacctgcggtgct

SEQ ID NO: 1846021 - DNA, 22 bp, Homo sapiens
ggccacctgcggtgctatctcc

SEQ ID NO: 1846022 - DNA, 19 bp, Homo sapiens
gacccatgctgccctgtga

SEQ ID NO: 1846023 - DNA, 23 bp, Homo sapiens
gaccctgaggcccagagggcctg

SEQ ID NO: 1846024 - DNA, 20 bp, Homo sapiens
gaccctgccctgtgggcccc

SEQ ID NO: 1846025 - DNA, 12 bp, Homo sapiens
gaccctgtctca

SEQ ID NO: 1846026 - DNA, 23 bp, Homo sapiens
gaccctgtctcaaaaaaagaaaa

SEQ ID NO: 1846027 - DNA, 23 bp, Homo sapiens
gacccttgccgtctacctgaggg

SEQ ID NO: 1846028 - DNA, 18 bp, Homo sapiens
gacctcaggtgagaagca

SEQ ID NO: 1846029 - DNA, 14 bp, Homo sapiens
gacctcctgcctcc

SEQ ID NO: 1846030 - DNA, 14 bp, Homo sapiens
gacctgaggccctt

SEQ ID NO: 1846031 - DNA, 17 bp, Homo sapiens
gacctggcaaggacaca

SEQ ID NO: 1846032 - DNA, 18 bp, Homo sapiens
gacctggcaaggacacag

SEQ ID NO: 1846033 - DNA, 15 bp, Homo sapiens
gaccttctccttcac

SEQ ID NO: 1846034 - DNA, 20 bp, Homo sapiens
gaccttctccttcacctttg

SEQ ID NO: 1846035 - DNA, 13 bp, Homo sapiens
gacgcaggcccct

SEQ ID NO: 1846036 - DNA, 16 bp, Homo sapiens
gacgcaggcccctctc

SEQ ID NO: 1846037 - DNA, 17 bp, Homo sapiens
gacgcaggcccctctcc

SEQ ID NO: 1846038 - DNA, 19 bp, Homo sapiens
gacgcaggcccctctcctc

SEQ ID NO: 1846039 - DNA, 12 bp, Homo sapiens
gacgccacccag

SEQ ID NO: 1846040 - DNA, 17 bp, Homo sapiens
gacgccatcccagcccc

SEQ ID NO: 1846041 - DNA, 21 bp, Homo sapiens
gacgccatcccagccccaatg

SEQ ID NO: 1846042 - DNA, 16 bp, Homo sapiens
gacgctacccgggaag

SEQ ID NO: 1846043 - DNA, 23 bp, Homo sapiens
gacgctacccgggaagggggctg

SEQ ID NO: 1846044 - DNA, 12 bp, Homo sapiens
gacgctgtgctg

SEQ ID NO: 1846045 - DNA, 18 bp, Homo sapiens
gacgctgtgctgccctgc

SEQ ID NO: 1846046 - DNA, 21 bp, Homo sapiens
gacggtaagtgttctcatgaa

SEQ ID NO: 1846047 - DNA, 16 bp, Homo sapiens
gacgttttataagcat

SEQ ID NO: 1846048 - DNA, 22 bp, Homo sapiens
gacgttttataagcatcattat

SEQ ID NO: 1846049 - DNA, 16 bp, Homo sapiens
gactaacttgtctttg

SEQ ID NO: 1846050 - DNA, 23 bp, Homo sapiens
gactaacttgtctttggaccctg

SEQ ID NO: 1846051 - DNA, 22 bp, Homo sapiens
gactatttgcttatttaataaa

SEQ ID NO: 1846052 - DNA, 12 bp, Homo sapiens
gactcagccttg

SEQ ID NO: 1846053 - DNA, 14 bp, Homo sapiens
gactcagccttgca

SEQ ID NO: 1846054 - DNA, 23 bp, Homo sapiens
gactcagccttgcaaatagccag

SEQ ID NO: 1846055 - DNA, 14 bp, Homo sapiens
gactcagctcccca

SEQ ID NO: 1846056 - DNA, 17 bp, Homo sapiens
gactcctaggcaggaca

SEQ ID NO: 1846057 - DNA, 23 bp, Homo sapiens
gactcctaggcaggacatgctga

SEQ ID NO: 1846058 - DNA, 13 bp, Homo sapiens
gactcctgcaggc

SEQ ID NO: 1846059 - DNA, 22 bp, Homo sapiens
gactccttgagagaccaggcaa

SEQ ID NO: 1846060 - DNA, 20 bp, Homo sapiens
gactctttttttgagtgaca

SEQ ID NO: 1846061 - DNA, 14 bp, Homo sapiens
gactgcagagggct

SEQ ID NO: 1846062 - DNA, 20 bp, Homo sapiens
gactgcagccactgattctc

SEQ ID NO: 1846063 - DNA, 12 bp, Homo sapiens
gactgcagtgtg

SEQ ID NO: 1846064 - DNA, 15 bp, Homo sapiens
gactgcagtgtggag

SEQ ID NO: 1846065 - DNA, 15 bp, Homo sapiens
gactgtatctgtgta

SEQ ID NO: 1846066 - DNA, 16 bp, Homo sapiens
gactgtatctgtgtag

SEQ ID NO: 1846067 - DNA, 17 bp, Homo sapiens
gactgtatctgtgtaga

SEQ ID NO: 1846068 - DNA, 19 bp, Homo sapiens
gactgttcaagagcacact

SEQ ID NO: 1846069 - DNA, 23 bp, Homo sapiens
gactgttcaagagcacacttggc

SEQ ID NO: 1846070 - DNA, 18 bp, Homo sapiens
gactgttttctcttgaga

SEQ ID NO: 1846071 - DNA, 16 bp, Homo sapiens
gacttaatagaaacat

SEQ ID NO: 1846072 - DNA, 15 bp, Homo sapiens
gacttcattaataat

SEQ ID NO: 1846073 - DNA, 14 bp, Homo sapiens
gactttaacataag

SEQ ID NO: 1846074 - DNA, 18 bp, Homo sapiens
gactttaacataagctat

SEQ ID NO: 1846075 - DNA, 14 bp, Homo sapiens
gactttggaaagag

SEQ ID NO: 1846076 - DNA, 22 bp, Homo sapiens
gagaaaattggaactctactca

SEQ ID NO: 1846077 - DNA, 23 bp, Homo sapiens
gagaaatagcttatgaaaagaat

SEQ ID NO: 1846078 - DNA, 16 bp, Homo sapiens
gagaagcagaggaagg

SEQ ID NO: 1846079 - DNA, 12 bp, Homo sapiens
gagaaggaagcc

SEQ ID NO: 1846080 - DNA, 17 bp, Homo sapiens
gagaaggggaagcactc

SEQ ID NO: 1846081 - DNA, 19 bp, Homo sapiens
gagacagcccgggctctgc

SEQ ID NO: 1846082 - DNA, 22 bp, Homo sapiens
gagacagcccgggctctgcctc

SEQ ID NO: 1846083 - DNA, 24 bp, Homo sapiens
gagacagcccgggctctgcctccc

SEQ ID NO: 1846084 - DNA, 16 bp, Homo sapiens
gagacagtcaccccag

SEQ ID NO: 1846085 - DNA, 14 bp, Homo sapiens
gagaccaggcaaag

SEQ ID NO: 1846086 - DNA, 12 bp, Homo sapiens
gagaccatccct

SEQ ID NO: 1846087 - DNA, 14 bp, Homo sapiens
gagaccatccctga

SEQ ID NO: 1846088 - DNA, 18 bp, Homo sapiens
gagaccatccctgaaggc

SEQ ID NO: 1846089 - DNA, 23 bp, Homo sapiens
gagaccctccccacagtgccacc

SEQ ID NO: 1846090 - DNA, 16 bp, Homo sapiens
gagacctcctgcctcc

SEQ ID NO: 1846091 - DNA, 13 bp, Homo sapiens
gagactcctgcag

SEQ ID NO: 1846092 - DNA, 14 bp, Homo sapiens
gagactcctgcagg

SEQ ID NO: 1846093 - DNA, 14 bp, Homo sapiens
gagagaaaggactc

SEQ ID NO: 1846094 - DNA, 17 bp, Homo sapiens
gagagcctggtgctgct

SEQ ID NO: 1846095 - DNA, 14 bp, Homo sapiens
gagagccttccagg

SEQ ID NO: 1846096 - DNA, 16 bp, Homo sapiens
gagagccttccagggg

SEQ ID NO: 1846097 - DNA, 20 bp, Homo sapiens
gagagccttccaggggtggg

SEQ ID NO: 1846098 - DNA, 15 bp, Homo sapiens
gagaggggacgcagg

SEQ ID NO: 1846099 - DNA, 16 bp, Homo sapiens
gagaggggacgcaggc

SEQ ID NO: 1846100 - DNA, 21 bp, Homo sapiens
gagaggggacgcaggcccctc

SEQ ID NO: 1846101 - DNA, 16 bp, Homo sapiens
gagatctatatttttg

SEQ ID NO: 1846102 - DNA, 18 bp, Homo sapiens
gagattgcaccactgcac

SEQ ID NO: 1846103 - DNA, 22 bp, Homo sapiens
gagcaaaggctgagaacactgt

SEQ ID NO: 1846104 - DNA, 22 bp, Homo sapiens
gagcaagacgctgtgctgccct

SEQ ID NO: 1846105 - DNA, 17 bp, Homo sapiens
gagcacaacataatttt

SEQ ID NO: 1846106 - DNA, 22 bp, Homo sapiens
gagcacaagaggagatccaggg

SEQ ID NO: 1846107 - DNA, 21 bp, Homo sapiens
gagcacctgcaggcgtgacct

SEQ ID NO: 1846108 - DNA, 17 bp, Homo sapiens
gagcaccttagacagtc

SEQ ID NO: 1846109 - DNA, 22 bp, Homo sapiens
gagcacggctctgtccccagcc

SEQ ID NO: 1846110 - DNA, 23 bp, Homo sapiens
gagcacggctctgtccccagcct

SEQ ID NO: 1846111 - DNA, 12 bp, Homo sapiens
gagcagagacca

SEQ ID NO: 1846112 - DNA, 17 bp, Homo sapiens
gagcagagaccatccct

SEQ ID NO: 1846113 - DNA, 18 bp, Homo sapiens
gagcagagaccatccctg

SEQ ID NO: 1846114 - DNA, 19 bp, Homo sapiens
gagcagagaccatccctga

SEQ ID NO: 1846115 - DNA, 21 bp, Homo sapiens
gagcagagaccatccctgaag

SEQ ID NO: 1846116 - DNA, 23 bp, Homo sapiens
gagcagagaccatccctgaaggc

SEQ ID NO: 1846117 - DNA, 14 bp, Homo sapiens
gagcagcgagcctg

SEQ ID NO: 1846118 - DNA, 15 bp, Homo sapiens
gagcagtgcaggcac

SEQ ID NO: 1846119 - DNA, 13 bp, Homo sapiens
gagcatcaggcca

SEQ ID NO: 1846120 - DNA, 15 bp, Homo sapiens
gagcatggagctggc

SEQ ID NO: 1846121 - DNA, 22 bp, Homo sapiens
gagcatgtttagactttaacat

SEQ ID NO: 1846122 - DNA, 18 bp, Homo sapiens
gagccagtaaacagagga

SEQ ID NO: 1846123 - DNA, 15 bp, Homo sapiens
gagcccacgccccca

SEQ ID NO: 1846124 - DNA, 18 bp, Homo sapiens
gagcccacgcccccactg

SEQ ID NO: 1846125 - DNA, 11 bp, Homo sapiens
gagccccacct

SEQ ID NO: 1846126 - DNA, 20 bp, Homo sapiens
gagccccaccttgtctgcta

SEQ ID NO: 1846127 - DNA, 21 bp, Homo sapiens
gagcccgcagggccatgcaga

SEQ ID NO: 1846128 - DNA, 22 bp, Homo sapiens
gagccctgtcctgcctaaggct

SEQ ID NO: 1846129 - DNA, 12 bp, Homo sapiens
gaggccagcctt

SEQ ID NO: 1846130 - DNA, 13 bp, Homo sapiens
gaggccagccttg

SEQ ID NO: 1846131 - DNA, 13 bp, Homo sapiens
gaggcccagaggg

SEQ ID NO: 1846132 - DNA, 16 bp, Homo sapiens
gaggcccagagggcct

SEQ ID NO: 1846133 - DNA, 19 bp, Homo sapiens
gaggcccagagggcctgca

SEQ ID NO: 1846134 - DNA, 13 bp, Homo sapiens
gaggcccggcctc

SEQ ID NO: 1846135 - DNA, 14 bp, Homo sapiens
gaggcccttctctc

SEQ ID NO: 1846136 - DNA, 20 bp, Homo sapiens
gaggcccttctctccagccc

SEQ ID NO: 1846137 - DNA, 21 bp, Homo sapiens
gaggcccttgtcgtgggatgg

SEQ ID NO: 1846138 - DNA, 12 bp, Homo sapiens
gaggctctgccc

SEQ ID NO: 1846139 - DNA, 13 bp, Homo sapiens
gaggctctgccct

SEQ ID NO: 1846140 - DNA, 14 bp, Homo sapiens
gaggctgggctccc

SEQ ID NO: 1846141 - DNA, 15 bp, Homo sapiens
gaggctgggctccct

SEQ ID NO: 1846142 - DNA, 20 bp, Homo sapiens
gaggctgggctcccttccca

SEQ ID NO: 1846143 - DNA, 22 bp, Homo sapiens
gaggcttagctttgctctgcca

SEQ ID NO: 1846144 - DNA, 15 bp, Homo sapiens
gagggagggagggct

SEQ ID NO: 1846145 - DNA, 19 bp, Homo sapiens
gagggagggctccagacac

SEQ ID NO: 1846146 - DNA, 16 bp, Homo sapiens
gagggagttttgtctg

SEQ ID NO: 1846147 - DNA, 23 bp, Homo sapiens
gagggcacattccttgcctgcac

SEQ ID NO: 1846148 - DNA, 14 bp, Homo sapiens
gagggcaggcttgg

SEQ ID NO: 1846149 - DNA, 16 bp, Homo sapiens
gagggcaggcttgggg

SEQ ID NO: 1846150 - DNA, 19 bp, Homo sapiens
gagggcaggcttggggaaa

SEQ ID NO: 1846151 - DNA, 20 bp, Homo sapiens
gagggcaggcttggggaaaa

SEQ ID NO: 1846152 - DNA, 15 bp, Homo sapiens
gagggctccagacac

SEQ ID NO: 1846153 - DNA, 15 bp, Homo sapiens
gaggggacgcaggcc

SEQ ID NO: 1846154 - DNA, 19 bp, Homo sapiens
gaggggacgcaggcccctc

SEQ ID NO: 1846155 - DNA, 12 bp, Homo sapiens
gagggtggaata

SEQ ID NO: 1846156 - DNA, 15 bp, Homo sapiens
gagggtgggagtggg

SEQ ID NO: 1846157 - DNA, 21 bp, Homo sapiens
gaggtaaggaatacctgtccc

SEQ ID NO: 1846158 - DNA, 17 bp, Homo sapiens
gaggtcaaggctgcagt

SEQ ID NO: 1846159 - DNA, 15 bp, Homo sapiens
gaggtcgaggcagga

SEQ ID NO: 1846160 - DNA, 22 bp, Homo sapiens
gaggtggatgttatgaacagct

SEQ ID NO: 1846161 - DNA, 11 bp, Homo sapiens
gaggtgggagg

SEQ ID NO: 1846162 - DNA, 16 bp, Homo sapiens
gaggtgggatcctcca

SEQ ID NO: 1846163 - DNA, 17 bp, Homo sapiens
gaggtgggatcctccag

SEQ ID NO: 1846164 - DNA, 21 bp, Homo sapiens
gaggtgggatcctccaggtgc

SEQ ID NO: 1846165 - DNA, 16 bp, Homo sapiens
gaggtttcaaacctcc

SEQ ID NO: 1846166 - DNA, 20 bp, Homo sapiens
gagtaacagtcatcatttat

SEQ ID NO: 1846167 - DNA, 16 bp, Homo sapiens
gagtacaggtgaagca

SEQ ID NO: 1846168 - DNA, 23 bp, Homo sapiens
gagtactacagtcctcccatctc

SEQ ID NO: 1846169 - DNA, 12 bp, Homo sapiens
gagtaggaagac

SEQ ID NO: 1846170 - DNA, 13 bp, Homo sapiens
gagtaggaagact

SEQ ID NO: 1846171 - DNA, 12 bp, Homo sapiens
gagtcacactca

SEQ ID NO: 1846172 - DNA, 21 bp, Homo sapiens
gagtctgaaggctgggttctg

SEQ ID NO: 1846173 - DNA, 12 bp, Homo sapiens
gagtctgatgat

SEQ ID NO: 1846174 - DNA, 19 bp, Homo sapiens
gagtgctaagcattagctt

SEQ ID NO: 1846175 - DNA, 18 bp, Homo sapiens
gagtgcttgcttttcatg

SEQ ID NO: 1846176 - DNA, 20 bp, Homo sapiens
gagtggcatggccaccacca

SEQ ID NO: 1846177 - DNA, 18 bp, Homo sapiens
gagtgtgcggctgtgtgt

SEQ ID NO: 1846178 - DNA, 12 bp, Homo sapiens
gagttcaccttg

SEQ ID NO: 1846179 - DNA, 20 bp, Homo sapiens
gagttcaccttggaagggcg

SEQ ID NO: 1846180 - DNA, 18 bp, Homo sapiens
gagttgattcagctctgc

SEQ ID NO: 1846181 - DNA, 22 bp, Homo sapiens
gagtttatgttccattaaacga

SEQ ID NO: 1846182 - DNA, 14 bp, Homo sapiens
gataaacacaagat

SEQ ID NO: 1846183 - DNA, 18 bp, Homo sapiens
gataactgttatttataa

SEQ ID NO: 1846184 - DNA, 18 bp, Homo sapiens
gatagcacagaccctgcc

SEQ ID NO: 1846185 - DNA, 22 bp, Homo sapiens
gatagcacagaccctgccctgt

SEQ ID NO: 1846186 - DNA, 13 bp, Homo sapiens
gatataatttaaa

SEQ ID NO: 1846187 - DNA, 16 bp, Homo sapiens
gatcaaggagaggagg

SEQ ID NO: 1846188 - DNA, 16 bp, Homo sapiens
gatcacagcagcttct

SEQ ID NO: 1846189 - DNA, 21 bp, Homo sapiens
gatcacagtggccacggccac

SEQ ID NO: 1846190 - DNA, 16 bp, Homo sapiens
gatcacatgtggactt

SEQ ID NO: 1846191 - DNA, 12 bp, Homo sapiens
gatcctccaggt

SEQ ID NO: 1846192 - DNA, 13 bp, Homo sapiens
gatctaggaagac

SEQ ID NO: 1846193 - DNA, 20 bp, Homo sapiens
gatctaggaagactttggaa

SEQ ID NO: 1846194 - DNA, 12 bp, Homo sapiens
gatctcttgagc

SEQ ID NO: 1846195 - DNA, 20 bp, Homo sapiens
gatgaaatcttacagctggg

SEQ ID NO: 1846196 - DNA, 17 bp, Homo sapiens
gatgaaccctggcattt

SEQ ID NO: 1846197 - DNA, 15 bp, Homo sapiens
gatgaccaatgggat

SEQ ID NO: 1846198 - DNA, 18 bp, Homo sapiens
gatgaccaatgggatgag

SEQ ID NO: 1846199 - DNA, 15 bp, Homo sapiens
gatgagcatggagct

SEQ ID NO: 1846200 - DNA, 15 bp, Homo sapiens
gatgagcgccacctc

SEQ ID NO: 1846201 - DNA, 16 bp, Homo sapiens
gatgagcgccacctct

SEQ ID NO: 1846202 - DNA, 14 bp, Homo sapiens
gatgatcctaggca

SEQ ID NO: 1846203 - DNA, 14 bp, Homo sapiens
gatgatgtgcctgg

SEQ ID NO: 1846204 - DNA, 17 bp, Homo sapiens
gatgatgtgcctgggtg

SEQ ID NO: 1846205 - DNA, 18 bp, Homo sapiens
gatgcaatactaggaagt

SEQ ID NO: 1846206 - DNA, 16 bp, Homo sapiens
gatgcacatccctgga

SEQ ID NO: 1846207 - DNA, 21 bp, Homo sapiens
gatgcactttgctttaatata

SEQ ID NO: 1846208 - DNA, 23 bp, Homo sapiens
gatgcactttgctttaatataaa

SEQ ID NO: 1846209 - DNA, 14 bp, Homo sapiens
gatgcagcctcaca

SEQ ID NO: 1846210 - DNA, 22 bp, Homo sapiens
gatgcaggtgagcccatggccc

SEQ ID NO: 1846211 - DNA, 20 bp, Homo sapiens
gatgcatgttttccagctcc

SEQ ID NO: 1846212 - DNA, 10 bp, Homo sapiens
gatgcatttt

SEQ ID NO: 1846213 - DNA, 20 bp, Homo sapiens
gatgcattttatagaatgtg

SEQ ID NO: 1846214 - DNA, 20 bp, Homo sapiens
gatgccaagttgtttgagaa

SEQ ID NO: 1846215 - DNA, 20 bp, Homo sapiens
gatgcctgtgaactgaactc

SEQ ID NO: 1846216 - DNA, 23 bp, Homo sapiens
gatgcttctcactgccatgccag

SEQ ID NO: 1846217 - DNA, 17 bp, Homo sapiens
gatgcttcttcagagac

SEQ ID NO: 1846218 - DNA, 21 bp, Homo sapiens
gatgctttaagtgcacaacat

SEQ ID NO: 1846219 - DNA, 23 bp, Homo sapiens
gatggagccccaccttgtctgct

SEQ ID NO: 1846220 - DNA, 17 bp, Homo sapiens
gatggcaggatggcctg

SEQ ID NO: 1846221 - DNA, 21 bp, Homo sapiens
gatggcaggatggcctggcca

SEQ ID NO: 1846222 - DNA, 22 bp, Homo sapiens
gatggcatttggtctcaggcag

SEQ ID NO: 1846223 - DNA, 14 bp, Homo sapiens
gatggcctggccag

SEQ ID NO: 1846224 - DNA, 15 bp, Homo sapiens
gatgggcttcccaag

SEQ ID NO: 1846225 - DNA, 21 bp, Homo sapiens
gatgggggaaagcacaggtgg

SEQ ID NO: 1846226 - DNA, 19 bp, Homo sapiens
gatgggtgcttggaggaag

SEQ ID NO: 1846227 - DNA, 11 bp, Homo sapiens
gatgtccccag

SEQ ID NO: 1846228 - DNA, 18 bp, Homo sapiens
gatgtcttcatacctaca

SEQ ID NO: 1846229 - DNA, 20 bp, Homo sapiens
gatgtgggggaagacctggc

SEQ ID NO: 1846230 - DNA, 14 bp, Homo sapiens
gatgttatgaacag

SEQ ID NO: 1846231 - DNA, 17 bp, Homo sapiens
gatgttatgaacagctg

SEQ ID NO: 1846232 - DNA, 19 bp, Homo sapiens
gatgttatgaacagctgtg

SEQ ID NO: 1846233 - DNA, 19 bp, Homo sapiens
gattaaccacttcagctga

SEQ ID NO: 1846234 - DNA, 14 bp, Homo sapiens
gattcagacagctg

SEQ ID NO: 1846235 - DNA, 18 bp, Homo sapiens
gattcagacagctgcctg

SEQ ID NO: 1846236 - DNA, 17 bp, Homo sapiens
gattcccaggatgagca

SEQ ID NO: 1846237 - DNA, 19 bp, Homo sapiens
gattccccactcagccttt

SEQ ID NO: 1846238 - DNA, 20 bp, Homo sapiens
gattctatgttaatatttta

SEQ ID NO: 1846239 - DNA, 19 bp, Homo sapiens
gattctcagggtctctgct

SEQ ID NO: 1846240 - DNA, 21 bp, Homo sapiens
gattctcagggtctctgctgc

SEQ ID NO: 1846241 - DNA, 22 bp, Homo sapiens
gattgggaggtgcgtgttcagc

SEQ ID NO: 1846242 - DNA, 20 bp, Homo sapiens
gattggtgtttttttctatg

SEQ ID NO: 1846243 - DNA, 15 bp, Homo sapiens
gattgtccccgaccc

SEQ ID NO: 1846244 - DNA, 20 bp, Homo sapiens
gattgtccccgacccttgcc

SEQ ID NO: 1846245 - DNA, 18 bp, Homo sapiens
gattgtgcctaatgtgtt

SEQ ID NO: 1846246 - DNA, 16 bp, Homo sapiens
gatttattaaagaaaa

SEQ ID NO: 1846247 - DNA, 19 bp, Homo sapiens
gatttattaaagaaaaaaa

SEQ ID NO: 1846248 - DNA, 12 bp, Homo sapiens
gatttgggctgg

SEQ ID NO: 1846249 - DNA, 13 bp, Homo sapiens
gatttttaaatta

SEQ ID NO: 1846250 - DNA, 16 bp, Homo sapiens
gcaaaagatgcttctc

SEQ ID NO: 1846251 - DNA, 20 bp, Homo sapiens
gcaaactctttggtcgtttt

SEQ ID NO: 1846252 - DNA, 23 bp, Homo sapiens
gcaaactctttggtcgttttttt

SEQ ID NO: 1846253 - DNA, 10 bp, Homo sapiens
gcaaagccag

SEQ ID NO: 1846254 - DNA, 20 bp, Homo sapiens
cttcctgccagcccctgcca

SEQ ID NO: 1846255 - DNA, 16 bp, Homo sapiens
cttcgacactgttctt

SEQ ID NO: 1846256 - DNA, 17 bp, Homo sapiens
cttcgacactgttctta

SEQ ID NO: 1846257 - DNA, 12 bp, Homo sapiens
cttctctccagc

SEQ ID NO: 1846258 - DNA, 15 bp, Homo sapiens
cttctctccagcccc

SEQ ID NO: 1846259 - DNA, 17 bp, Homo sapiens
cttctctccagcccctg

SEQ ID NO: 1846260 - DNA, 18 bp, Homo sapiens
cttctgacccatgctgcc

SEQ ID NO: 1846261 - DNA, 20 bp, Homo sapiens
cttctgccatttctgagatc

SEQ ID NO: 1846262 - DNA, 14 bp, Homo sapiens
cttcttcagagact

SEQ ID NO: 1846263 - DNA, 20 bp, Homo sapiens
cttcttcagagactcctgca

SEQ ID NO: 1846264 - DNA, 16 bp, Homo sapiens
cttcttctcggggaca

SEQ ID NO: 1846265 - DNA, 15 bp, Homo sapiens
cttgaccaggcctgg

SEQ ID NO: 1846266 - DNA, 20 bp, Homo sapiens
cttgaccattctccacctgc

SEQ ID NO: 1846267 - DNA, 23 bp, Homo sapiens
cttgaccattctccacctgccag

SEQ ID NO: 1846268 - DNA, 14 bp, Homo sapiens
cttgagagaccagg

SEQ ID NO: 1846269 - DNA, 16 bp, Homo sapiens
cttgagagaccaggca

SEQ ID NO: 1846270 - DNA, 19 bp, Homo sapiens
cttgaggattgtggaaaac

SEQ ID NO: 1846271 - DNA, 24 bp, Homo sapiens
cttgaggcttagctttgctctgcc

SEQ ID NO: 1846272 - DNA, 23 bp, Homo sapiens
cttgcagcaggatctagaggggg

SEQ ID NO: 1846273 - DNA, 14 bp, Homo sapiens
cttgcatgaggcta

SEQ ID NO: 1846274 - DNA, 21 bp, Homo sapiens
cttgcatgaggctagtgtggt

SEQ ID NO: 1846275 - DNA, 12 bp, Homo sapiens
cttgctccagat

SEQ ID NO: 1846276 - DNA, 16 bp, Homo sapiens
cttgctccagattctg

SEQ ID NO: 1846277 - DNA, 19 bp, Homo sapiens
cttgctccagattctgatg

SEQ ID NO: 1846278 - DNA, 12 bp, Homo sapiens
cttggaagggcg

SEQ ID NO: 1846279 - DNA, 15 bp, Homo sapiens
cttggacacgctcag

SEQ ID NO: 1846280 - DNA, 15 bp, Homo sapiens
cttggattcaatttt

SEQ ID NO: 1846281 - DNA, 16 bp, Homo sapiens
cttggattcaatttta

SEQ ID NO: 1846282 - DNA, 15 bp, Homo sapiens
cttggattgtccccg

SEQ ID NO: 1846283 - DNA, 22 bp, Homo sapiens
cttggattgtccccgacccttg

SEQ ID NO: 1846284 - DNA, 17 bp, Homo sapiens
cttggcatcagctggcg

SEQ ID NO: 1846285 - DNA, 15 bp, Homo sapiens
cttggctaaggaaat

SEQ ID NO: 1846286 - DNA, 13 bp, Homo sapiens
cttggctggtgca

SEQ ID NO: 1846287 - DNA, 14 bp, Homo sapiens
cttgggccactgtg

SEQ ID NO: 1846288 - DNA, 23 bp, Homo sapiens
cttggggggctgaggtgggagga

SEQ ID NO: 1846289 - DNA, 15 bp, Homo sapiens
cttggtcctgctgca

SEQ ID NO: 1846290 - DNA, 17 bp, Homo sapiens
cttggtcctgctgcagt

SEQ ID NO: 1846291 - DNA, 14 bp, Homo sapiens
cttggttggctggc

SEQ ID NO: 1846292 - DNA, 19 bp, Homo sapiens
cttgtactctacaaaatat

SEQ ID NO: 1846293 - DNA, 12 bp, Homo sapiens
cttgtagtcttg

SEQ ID NO: 1846294 - DNA, 16 bp, Homo sapiens
cttgtagtcttggcta

SEQ ID NO: 1846295 - DNA, 15 bp, Homo sapiens
cttgtattaagaatg

SEQ ID NO: 1846296 - DNA, 17 bp, Homo sapiens
cttgtcaggagtgtgtg

SEQ ID NO: 1846297 - DNA, 15 bp, Homo sapiens
cttgtcgtgggatgg

SEQ ID NO: 1846298 - DNA, 18 bp, Homo sapiens
cttgtctttggaccctga

SEQ ID NO: 1846299 - DNA, 19 bp, Homo sapiens
cttgtctttggaccctgag

SEQ ID NO: 1846300 - DNA, 20 bp, Homo sapiens
cttgtctttggaccctgagg

SEQ ID NO: 1846301 - DNA, 18 bp, Homo sapiens
cttgtgacagtgcctctt

SEQ ID NO: 1846302 - DNA, 15 bp, Homo sapiens
ctttaacacagtgtc

SEQ ID NO: 1846303 - DNA, 16 bp, Homo sapiens
ctttaacacagtgtct

SEQ ID NO: 1846304 - DNA, 14 bp, Homo sapiens
ctttaaccctttct

SEQ ID NO: 1846305 - DNA, 15 bp, Homo sapiens
ctttaagaactaaaa

SEQ ID NO: 1846306 - DNA, 15 bp, Homo sapiens
ctttaatataaatgc

SEQ ID NO: 1846307 - DNA, 20 bp, Homo sapiens
ctttagtgatcacagcagct

SEQ ID NO: 1846308 - DNA, 20 bp, Homo sapiens
ctttccccatgtctcgactc

SEQ ID NO: 1846309 - DNA, 11 bp, Homo sapiens
ctttccctccc

SEQ ID NO: 1846310 - DNA, 21 bp, Homo sapiens
ctttccggtgtttaagacatt

SEQ ID NO: 1846311 - DNA, 16 bp, Homo sapiens
ctttcctctttggtct

SEQ ID NO: 1846312 - DNA, 16 bp, Homo sapiens
ctttcctgaggctggg

SEQ ID NO: 1846313 - DNA, 21 bp, Homo sapiens
ctttcctgaggctgggctccc

SEQ ID NO: 1846314 - DNA, 12 bp, Homo sapiens
ctttctgggatg

SEQ ID NO: 1846315 - DNA, 22 bp, Homo sapiens
ctttcttacaaggaaggtggtg

SEQ ID NO: 1846316 - DNA, 18 bp, Homo sapiens
ctttcttttttggccatc

SEQ ID NO: 1846317 - DNA, 19 bp, Homo sapiens
ctttcttttttggccatct

SEQ ID NO: 1846318 - DNA, 13 bp, Homo sapiens
ctttgaaaagttg

SEQ ID NO: 1846319 - DNA, 12 bp, Homo sapiens
ctttgaagggca

SEQ ID NO: 1846320 - DNA, 18 bp, Homo sapiens
ctttgacctgcctccctt

SEQ ID NO: 1846321 - DNA, 15 bp, Homo sapiens
ctttgagactgttcc

SEQ ID NO: 1846322 - DNA, 18 bp, Homo sapiens
ctttgctgagcctgtaaa

SEQ ID NO: 1846323 - DNA, 19 bp, Homo sapiens
ctttgctttaatataaatg

SEQ ID NO: 1846324 - DNA, 21 bp, Homo sapiens
ctttgctttaatataaatgca

SEQ ID NO: 1846325 - DNA, 23 bp, Homo sapiens
ctttggaaagacttttccaaccc

SEQ ID NO: 1846326 - DNA, 19 bp, Homo sapiens
ctttggacagaagcagctc

SEQ ID NO: 1846327 - DNA, 20 bp, Homo sapiens
ctttggacagaagcagctct

SEQ ID NO: 1846328 - DNA, 16 bp, Homo sapiens
ctttggaccctgaggc

SEQ ID NO: 1846329 - DNA, 17 bp, Homo sapiens
ctttggaccctgaggcc

SEQ ID NO: 1846330 - DNA, 18 bp, Homo sapiens
ctttggaccctgaggccc

SEQ ID NO: 1846331 - DNA, 19 bp, Homo sapiens
ctttggaccctgaggccca

SEQ ID NO: 1846332 - DNA, 16 bp, Homo sapiens
ctttggagatcaagga

SEQ ID NO: 1846333 - DNA, 23 bp, Homo sapiens
ctttggagatcaaggagaggagg

SEQ ID NO: 1846334 - DNA, 13 bp, Homo sapiens
ctttggcaggtgc

SEQ ID NO: 1846335 - DNA, 21 bp, Homo sapiens
ctttggccccactttgaaggg

SEQ ID NO: 1846336 - DNA, 14 bp, Homo sapiens
ctttggtccttcaa

SEQ ID NO: 1846337 - DNA, 15 bp, Homo sapiens
ctttgtaaattgtca

SEQ ID NO: 1846338 - DNA, 14 bp, Homo sapiens
ctttgtccccaccg

SEQ ID NO: 1846339 - DNA, 15 bp, Homo sapiens
ctttgtccccaccgc

SEQ ID NO: 1846340 - DNA, 14 bp, Homo sapiens
ctttgttctggctc

SEQ ID NO: 1846341 - DNA, 15 bp, Homo sapiens
ctttgttctggctct

SEQ ID NO: 1846342 - DNA, 18 bp, Homo sapiens
ctttgtttgttgtcagct

SEQ ID NO: 1846343 - DNA, 21 bp, Homo sapiens
ctttgtttgttgtcagctgaa

SEQ ID NO: 1846344 - DNA, 17 bp, Homo sapiens
ctttgttttactgtctt

SEQ ID NO: 1846345 - DNA, 18 bp, Homo sapiens
ctttgttttgtgtctctt

SEQ ID NO: 1846346 - DNA, 20 bp, Homo sapiens
cttttaattaaatgctcatc

SEQ ID NO: 1846347 - DNA, 19 bp, Homo sapiens
cttttcatgcaaactcttt

SEQ ID NO: 1846348 - DNA, 23 bp, Homo sapiens
cttttctgtccgagctttgaaaa

SEQ ID NO: 1846349 - DNA, 14 bp, Homo sapiens
ctttttgaaatgtc

SEQ ID NO: 1846350 - DNA, 16 bp, Homo sapiens
cttttttggccatctg

SEQ ID NO: 1846351 - DNA, 15 bp, Homo sapiens
cttttttggctgctg

SEQ ID NO: 1846352 - DNA, 17 bp, Homo sapiens
cttttttggctgctgaa

SEQ ID NO: 1846353 - DNA, 13 bp, Homo sapiens
gaaaaaaatgtat

SEQ ID NO: 1846354 - DNA, 19 bp, Homo sapiens
gaaaaaaatgtattttatg

SEQ ID NO: 1846355 - DNA, 20 bp, Homo sapiens
gaaaaaaatgtattttatgt

SEQ ID NO: 1846356 - DNA, 20 bp, Homo sapiens
gaaaaagatctttcattttg

SEQ ID NO: 1846357 - DNA, 15 bp, Homo sapiens
gaaaaaggaggaaga

SEQ ID NO: 1846358 - DNA, 13 bp, Homo sapiens
gaaaaataaagaa

SEQ ID NO: 1846359 - DNA, 16 bp, Homo sapiens
gaaaaatgagcctggc

SEQ ID NO: 1846360 - DNA, 19 bp, Homo sapiens
gaaaacactgttctctgcc

SEQ ID NO: 1846361 - DNA, 20 bp, Homo sapiens
gaaaacactgttctctgccc

SEQ ID NO: 1846362 - DNA, 15 bp, Homo sapiens
gaaaaccagctcagc

SEQ ID NO: 1846363 - DNA, 20 bp, Homo sapiens
gaaaaccaggaaaagggagc

SEQ ID NO: 1846364 - DNA, 18 bp, Homo sapiens
gaaaagaaaaatgagcct

SEQ ID NO: 1846365 - DNA, 20 bp, Homo sapiens
gaaaagttggaaggatctgc

SEQ ID NO: 1846366 - DNA, 16 bp, Homo sapiens
gaaaatcagcctgctc

SEQ ID NO: 1846367 - DNA, 11 bp, Homo sapiens
gaaacacacga

SEQ ID NO: 1846368 - DNA, 17 bp, Homo sapiens
gaaacacccctctgtct

SEQ ID NO: 1846369 - DNA, 22 bp, Homo sapiens
gaaacaccctcacactgggact

SEQ ID NO: 1846370 - DNA, 14 bp, Homo sapiens
gaaaccacagctgc

SEQ ID NO: 1846371 - DNA, 18 bp, Homo sapiens
gaaaccacagctgctgga

SEQ ID NO: 1846372 - DNA, 13 bp, Homo sapiens
gaaacccagctct

SEQ ID NO: 1846373 - DNA, 19 bp, Homo sapiens
gaaacccagctctggtcca

SEQ ID NO: 1846374 - DNA, 21 bp, Homo sapiens
gaaactccaccttgcggggat

SEQ ID NO: 1846375 - DNA, 15 bp, Homo sapiens
gaaagagaaggtggg

SEQ ID NO: 1846376 - DNA, 20 bp, Homo sapiens
ctatgatttttttttccaaa

SEQ ID NO: 1846377 - DNA, 22 bp, Homo sapiens
ctatggacggtgctccaggcag

SEQ ID NO: 1846378 - DNA, 23 bp, Homo sapiens
ctatggacggtgctccaggcagg

SEQ ID NO: 1846379 - DNA, 13 bp, Homo sapiens
ctatgttaatatt

SEQ ID NO: 1846380 - DNA, 21 bp, Homo sapiens
ctattttttttctgttatata

SEQ ID NO: 1846381 - DNA, 22 bp, Homo sapiens
ctcaaaacccatctgggctcct

SEQ ID NO: 1846382 - DNA, 14 bp, Homo sapiens
ctcaaacactgcag

SEQ ID NO: 1846383 - DNA, 18 bp, Homo sapiens
ctcaaaccaaatcactga

SEQ ID NO: 1846384 - DNA, 21 bp, Homo sapiens
ctcaacacctctgcacaagct

SEQ ID NO: 1846385 - DNA, 15 bp, Homo sapiens
ctcaagaagcaggct

SEQ ID NO: 1846386 - DNA, 19 bp, Homo sapiens
ctcaagtctattgaataat

SEQ ID NO: 1846387 - DNA, 17 bp, Homo sapiens
ctcaatacctggcctca

SEQ ID NO: 1846388 - DNA, 22 bp, Homo sapiens
ctcaatacctggcctcatttaa

SEQ ID NO: 1846389 - DNA, 13 bp, Homo sapiens
ctcaatgagcatg

SEQ ID NO: 1846390 - DNA, 15 bp, Homo sapiens
ctcaatgagcatgtt

SEQ ID NO: 1846391 - DNA, 11 bp, Homo sapiens
ctcacaaaaga

SEQ ID NO: 1846392 - DNA, 19 bp, Homo sapiens
ctcacaacatggtgtctgg

SEQ ID NO: 1846393 - DNA, 22 bp, Homo sapiens
ctcacacatgagcatcaggcca

SEQ ID NO: 1846394 - DNA, 24 bp, Homo sapiens
ctcacacatgagcatcaggccagg

SEQ ID NO: 1846395 - DNA, 13 bp, Homo sapiens
ctcacagcatttg

SEQ ID NO: 1846396 - DNA, 14 bp, Homo sapiens
ctcacagcatttgc

SEQ ID NO: 1846397 - DNA, 22 bp, Homo sapiens
ctcacagcatttgccaagtctc

SEQ ID NO: 1846398 - DNA, 22 bp, Homo sapiens
ctcacagtattgctcacccagt

SEQ ID NO: 1846399 - DNA, 22 bp, Homo sapiens
ctcacagtccttaccagcagag

SEQ ID NO: 1846400 - DNA, 13 bp, Homo sapiens
ctcacccagtgcc

SEQ ID NO: 1846401 - DNA, 14 bp, Homo sapiens
ctcacccagtgccc

SEQ ID NO: 1846402 - DNA, 14 bp, Homo sapiens
ctcacctctccctt

SEQ ID NO: 1846403 - DNA, 13 bp, Homo sapiens
ctcactccttgaa

SEQ ID NO: 1846404 - DNA, 22 bp, Homo sapiens
ctcactgccatgccagcttatc

SEQ ID NO: 1846405 - DNA, 20 bp, Homo sapiens
ctcagaaggcaaatgacttt

SEQ ID NO: 1846406 - DNA, 19 bp, Homo sapiens
ctcagcactgcctgctccc

SEQ ID NO: 1846407 - DNA, 14 bp, Homo sapiens
ctcagctccccaga

SEQ ID NO: 1846408 - DNA, 19 bp, Homo sapiens
ctcagctccccagagtcct

SEQ ID NO: 1846409 - DNA, 21 bp, Homo sapiens
ctcagcttggcactcaggtgc

SEQ ID NO: 1846410 - DNA, 22 bp, Homo sapiens
ctcaggaatcatctcctttgca

SEQ ID NO: 1846411 - DNA, 21 bp, Homo sapiens
ctcaggcagcaccacactggg

SEQ ID NO: 1846412 - DNA, 18 bp, Homo sapiens
ctcagggcctggctcagg

SEQ ID NO: 1846413 - DNA, 20 bp, Homo sapiens
ctcagggcctggctcaggtg

SEQ ID NO: 1846414 - DNA, 22 bp, Homo sapiens
ctcagggctaaacgggcattgc

SEQ ID NO: 1846415 - DNA, 14 bp, Homo sapiens
ctcagggtccctgg

SEQ ID NO: 1846416 - DNA, 20 bp, Homo sapiens
ctcagggtccctggtggcag

SEQ ID NO: 1846417 - DNA, 13 bp, Homo sapiens
ctcagggtctctg

SEQ ID NO: 1846418 - DNA, 19 bp, Homo sapiens
ctcagggtctctgctgccg

SEQ ID NO: 1846419 - DNA, 21 bp, Homo sapiens
ctcaggtggggtcactctggc

SEQ ID NO: 1846420 - DNA, 22 bp, Homo sapiens
ctcaggtggggtcactctggca

SEQ ID NO: 1846421 - DNA, 16 bp, Homo sapiens
ctcagtaacatttctg

SEQ ID NO: 1846422 - DNA, 18 bp, Homo sapiens
ctcagtaacatttctgtt

SEQ ID NO: 1846423 - DNA, 22 bp, Homo sapiens
ctcagtaacatttctgttctca

SEQ ID NO: 1846424 - DNA, 19 bp, Homo sapiens
ctcagtaagacgacaagga

SEQ ID NO: 1846425 - DNA, 20 bp, Homo sapiens
ctcagtctggcccttccttt

SEQ ID NO: 1846426 - DNA, 22 bp, Homo sapiens
ctcagtctggcccttccttttc

SEQ ID NO: 1846427 - DNA, 16 bp, Homo sapiens
ctcagtgtgactcctc

SEQ ID NO: 1846428 - DNA, 17 bp, Homo sapiens
ctcatacactcgtatga

SEQ ID NO: 1846429 - DNA, 15 bp, Homo sapiens
ctcatacccaccccc

SEQ ID NO: 1846430 - DNA, 19 bp, Homo sapiens
ctcatacccacccccaccc

SEQ ID NO: 1846431 - DNA, 21 bp, Homo sapiens
ctcatcaccaacgtctgtgcc

SEQ ID NO: 1846432 - DNA, 21 bp, Homo sapiens
ctcatccctaatgctgcagat

SEQ ID NO: 1846433 - DNA, 16 bp, Homo sapiens
ctcatgcccagctctc

SEQ ID NO: 1846434 - DNA, 23 bp, Homo sapiens
ctcatgcccagctctctgacgct

SEQ ID NO: 1846435 - DNA, 17 bp, Homo sapiens
ctcatgttgaaacttta

SEQ ID NO: 1846436 - DNA, 15 bp, Homo sapiens
ctcattgacctgagg

SEQ ID NO: 1846437 - DNA, 19 bp, Homo sapiens
ctcattggaaatttagcat

SEQ ID NO: 1846438 - DNA, 20 bp, Homo sapiens
ctcattggaaatttagcatt

SEQ ID NO: 1846439 - DNA, 21 bp, Homo sapiens
ctccaaaccctcgaggcggat

SEQ ID NO: 1846440 - DNA, 16 bp, Homo sapiens
ctccaagaccttctcc

SEQ ID NO: 1846441 - DNA, 13 bp, Homo sapiens
ctccaagcaggac

SEQ ID NO: 1846442 - DNA, 13 bp, Homo sapiens
ctccaagctccca

SEQ ID NO: 1846443 - DNA, 15 bp, Homo sapiens
ctccaagctcccagg

SEQ ID NO: 1846444 - DNA, 16 bp, Homo sapiens
ctccaagctcccaggc

SEQ ID NO: 1846445 - DNA, 17 bp, Homo sapiens
ctccaagctcccaggca

SEQ ID NO: 1846446 - DNA, 22 bp, Homo sapiens
ctccaattaaggattttatgct

SEQ ID NO: 1846447 - DNA, 12 bp, Homo sapiens
ctccacctgcca

SEQ ID NO: 1846448 - DNA, 13 bp, Homo sapiens
ctccacctgccag

SEQ ID NO: 1846449 - DNA, 14 bp, Homo sapiens
ctccacctgccagg

SEQ ID NO: 1846450 - DNA, 18 bp, Homo sapiens
ctccacctgccagggaca

SEQ ID NO: 1846451 - DNA, 14 bp, Homo sapiens
ctccaccttccaaa

SEQ ID NO: 1846452 - DNA, 16 bp, Homo sapiens
ctccaccttccaaaga

SEQ ID NO: 1846453 - DNA, 13 bp, Homo sapiens
ctccagcccctgg

SEQ ID NO: 1846454 - DNA, 13 bp, Homo sapiens
ctccagctgttca

SEQ ID NO: 1846455 - DNA, 19 bp, Homo sapiens
ctccagctgttcagctggt

SEQ ID NO: 1846456 - DNA, 13 bp, Homo sapiens
ctccaggagcagc

SEQ ID NO: 1846457 - DNA, 18 bp, Homo sapiens
ctccaggagcagccacat

SEQ ID NO: 1846458 - DNA, 23 bp, Homo sapiens
ctccaggagcagccacattcctg

SEQ ID NO: 1846459 - DNA, 23 bp, Homo sapiens
ctccaggtgcacaagctccaagc

SEQ ID NO: 1846460 - DNA, 22 bp, Homo sapiens
ctccagtcatctgtaagagctt

SEQ ID NO: 1846461 - DNA, 14 bp, Homo sapiens
ctcccaactcaccc

SEQ ID NO: 1846462 - DNA, 17 bp, Homo sapiens
ctcccaactcaccccag

SEQ ID NO: 1846463 - DNA, 17 bp, Homo sapiens
ctcccaggcattcccca

SEQ ID NO: 1846464 - DNA, 14 bp, Homo sapiens
ctcccatctcacac

SEQ ID NO: 1846465 - DNA, 21 bp, Homo sapiens
ctcccatctcacacatgagca

SEQ ID NO: 1846466 - DNA, 11 bp, Homo sapiens
ctcccatctgt

SEQ ID NO: 1846467 - DNA, 22 bp, Homo sapiens
ctcccccagccccatcctctgt

SEQ ID NO: 1846468 - DNA, 15 bp, Homo sapiens
ctccccccagactct

SEQ ID NO: 1846469 - DNA, 16 bp, Homo sapiens
ctccccccagactctt

SEQ ID NO: 1846470 - DNA, 12 bp, Homo sapiens
ctcccctcagcc

SEQ ID NO: 1846471 - DNA, 15 bp, Homo sapiens
ctcccctcagcctct

SEQ ID NO: 1846472 - DNA, 20 bp, Homo sapiens
ctcccctcctcctggactcc

SEQ ID NO: 1846473 - DNA, 22 bp, Homo sapiens
ctcccctctcagaacatactga

SEQ ID NO: 1846474 - DNA, 19 bp, Homo sapiens
ctccctattttttttctgt

SEQ ID NO: 1846475 - DNA, 12 bp, Homo sapiens
ctccctcaactg

SEQ ID NO: 1846476 - DNA, 15 bp, Homo sapiens
ctccctcaactgaag

SEQ ID NO: 1846477 - DNA, 16 bp, Homo sapiens
ctccctcaactgaagg

SEQ ID NO: 1846478 - DNA, 21 bp, Homo sapiens
ctgattgtgtctcttggtcct

SEQ ID NO: 1846479 - DNA, 16 bp, Homo sapiens
ctgatttatggtcaga

SEQ ID NO: 1846480 - DNA, 18 bp, Homo sapiens
ctgcaagaattgaagcag

SEQ ID NO: 1846481 - DNA, 20 bp, Homo sapiens
ctgcaagaattgaagcagga

SEQ ID NO: 1846482 - DNA, 21 bp, Homo sapiens
ctgcaatgaagtctctgaagt

SEQ ID NO: 1846483 - DNA, 15 bp, Homo sapiens
ctgcacaagctgcac

SEQ ID NO: 1846484 - DNA, 16 bp, Homo sapiens
ctgcacaagctgcacc

SEQ ID NO: 1846485 - DNA, 22 bp, Homo sapiens
ctgcacaagctgcaccctcagg

SEQ ID NO: 1846486 - DNA, 15 bp, Homo sapiens
ctgcacacaggacag

SEQ ID NO: 1846487 - DNA, 16 bp, Homo sapiens
ctgcacacaggacagc

SEQ ID NO: 1846488 - DNA, 22 bp, Homo sapiens
ctgcacacgctccttcctctga

SEQ ID NO: 1846489 - DNA, 16 bp, Homo sapiens
ctgcaccctcaggcag

SEQ ID NO: 1846490 - DNA, 14 bp, Homo sapiens
ctgcaccggctggc

SEQ ID NO: 1846491 - DNA, 22 bp, Homo sapiens
ctgcaccggctggcctggcccc

SEQ ID NO: 1846492 - DNA, 13 bp, Homo sapiens
ctgcactccagcc

SEQ ID NO: 1846493 - DNA, 15 bp, Homo sapiens
ctgcactccagcctg

SEQ ID NO: 1846494 - DNA, 17 bp, Homo sapiens
ctgcactccagcctggg

SEQ ID NO: 1846495 - DNA, 15 bp, Homo sapiens
ctgcactcccctgct

SEQ ID NO: 1846496 - DNA, 17 bp, Homo sapiens
ctgcactcccctgctgg

SEQ ID NO: 1846497 - DNA, 19 bp, Homo sapiens
ctgcactcccctgctgggt

SEQ ID NO: 1846498 - DNA, 20 bp, Homo sapiens
ctgcactcccctgctgggtg

SEQ ID NO: 1846499 - DNA, 20 bp, Homo sapiens
ctgcagagggctccagagtg

SEQ ID NO: 1846500 - DNA, 15 bp, Homo sapiens
ctgcagccaagcaaa

SEQ ID NO: 1846501 - DNA, 20 bp, Homo sapiens
ctgcagccaagcaaatgcct

SEQ ID NO: 1846502 - DNA, 17 bp, Homo sapiens
ctgcaggcagccaggcc

SEQ ID NO: 1846503 - DNA, 19 bp, Homo sapiens
ctgcaggcagccaggccac

SEQ ID NO: 1846504 - DNA, 17 bp, Homo sapiens
ctgcaggcgtgacctga

SEQ ID NO: 1846505 - DNA, 16 bp, Homo sapiens
ctgcagtgtggagttc

SEQ ID NO: 1846506 - DNA, 13 bp, Homo sapiens
ctgcagttgccag

SEQ ID NO: 1846507 - DNA, 22 bp, Homo sapiens
ctgcagttgccagtcaccccgg

SEQ ID NO: 1846508 - DNA, 16 bp, Homo sapiens
ctgcatcgtttcatct

SEQ ID NO: 1846509 - DNA, 22 bp, Homo sapiens
ctgcatcgtttcatcttccaac

SEQ ID NO: 1846510 - DNA, 12 bp, Homo sapiens
ctgccaaacaca

SEQ ID NO: 1846511 - DNA, 22 bp, Homo sapiens
ctgccaacttcttcagagctga

SEQ ID NO: 1846512 - DNA, 11 bp, Homo sapiens
ctgccagggac

SEQ ID NO: 1846513 - DNA, 12 bp, Homo sapiens
ctgccagggaca

SEQ ID NO: 1846514 - DNA, 20 bp, Homo sapiens
ctgccagggacagagggggt

SEQ ID NO: 1846515 - DNA, 15 bp, Homo sapiens
ctgccatgcagggcc

SEQ ID NO: 1846516 - DNA, 15 bp, Homo sapiens
ctgccatttctgaga

SEQ ID NO: 1846517 - DNA, 22 bp, Homo sapiens
ctgcccacctggcctctgcact

SEQ ID NO: 1846518 - DNA, 15 bp, Homo sapiens
ctgcccactccctgc

SEQ ID NO: 1846519 - DNA, 16 bp, Homo sapiens
ctgcccactccctgca

SEQ ID NO: 1846520 - DNA, 20 bp, Homo sapiens
ctgcccggcagggtcctaga

SEQ ID NO: 1846521 - DNA, 12 bp, Homo sapiens
ctgccctccaag

SEQ ID NO: 1846522 - DNA, 19 bp, Homo sapiens
ctgccctccaagaccttct

SEQ ID NO: 1846523 - DNA, 13 bp, Homo sapiens
ctgccctgtgagt

SEQ ID NO: 1846524 - DNA, 14 bp, Homo sapiens
ctgccctgtgggcc

SEQ ID NO: 1846525 - DNA, 16 bp, Homo sapiens
ctgccctgtgggcccc

SEQ ID NO: 1846526 - DNA, 19 bp, Homo sapiens
ctgccctgtgggcccccaa

SEQ ID NO: 1846527 - DNA, 13 bp, Homo sapiens
ctgccggggcagc

SEQ ID NO: 1846528 - DNA, 20 bp, Homo sapiens
ctgccggggcagccccctca

SEQ ID NO: 1846529 - DNA, 14 bp, Homo sapiens
ctgcctcccatcac

SEQ ID NO: 1846530 - DNA, 15 bp, Homo sapiens
ctgcctgcacccctg

SEQ ID NO: 1846531 - DNA, 14 bp, Homo sapiens
ctgcctgctcccat

SEQ ID NO: 1846532 - DNA, 15 bp, Homo sapiens
ctgcctgctcccatc

SEQ ID NO: 1846533 - DNA, 18 bp, Homo sapiens
ctgcctgctcccatcctg

SEQ ID NO: 1846534 - DNA, 22 bp, Homo sapiens
ctgcctgggatccctcatcctc

SEQ ID NO: 1846535 - DNA, 15 bp, Homo sapiens
ctgctaatattttcc

SEQ ID NO: 1846536 - DNA, 17 bp, Homo sapiens
ctgctatgtatttgcaa

SEQ ID NO: 1846537 - DNA, 19 bp, Homo sapiens
ctgctccagctgttcagct

SEQ ID NO: 1846538 - DNA, 20 bp, Homo sapiens
ctgctccagctgttcagctg

SEQ ID NO: 1846539 - DNA, 18 bp, Homo sapiens
ctgctcccatcctgtgtg

SEQ ID NO: 1846540 - DNA, 19 bp, Homo sapiens
ctgctcccatcctgtgtgt

SEQ ID NO: 1846541 - DNA, 16 bp, Homo sapiens
ctgctccccaggccac

SEQ ID NO: 1846542 - DNA, 13 bp, Homo sapiens
ctgctctggtggc

SEQ ID NO: 1846543 - DNA, 18 bp, Homo sapiens
ctgctgaaggctcgagca

SEQ ID NO: 1846544 - DNA, 23 bp, Homo sapiens
ctgctgaaggctcgagcatgcct

SEQ ID NO: 1846545 - DNA, 11 bp, Homo sapiens
ctgctgaggcc

SEQ ID NO: 1846546 - DNA, 13 bp, Homo sapiens
ctgctgaggccca

SEQ ID NO: 1846547 - DNA, 15 bp, Homo sapiens
ctgctgcagttgcca

SEQ ID NO: 1846548 - DNA, 20 bp, Homo sapiens
ctgctgccgccccacccaga

SEQ ID NO: 1846549 - DNA, 19 bp, Homo sapiens
ctgctggattcaagtgatc

SEQ ID NO: 1846550 - DNA, 14 bp, Homo sapiens
ctgctgggtgtggc

SEQ ID NO: 1846551 - DNA, 12 bp, Homo sapiens
ctgcttagcttg

SEQ ID NO: 1846552 - DNA, 18 bp, Homo sapiens
ctgcttccagtgaggctc

SEQ ID NO: 1846553 - DNA, 21 bp, Homo sapiens
ctgcttccagtgaggctctgc

SEQ ID NO: 1846554 - DNA, 14 bp, Homo sapiens
ctgcttgtttccta

SEQ ID NO: 1846555 - DNA, 13 bp, Homo sapiens
ctggatagacttg

SEQ ID NO: 1846556 - DNA, 15 bp, Homo sapiens
ctggatggggctgca

SEQ ID NO: 1846557 - DNA, 14 bp, Homo sapiens
ctggcaagaatgtg

SEQ ID NO: 1846558 - DNA, 13 bp, Homo sapiens
ctggcactgcttc

SEQ ID NO: 1846559 - DNA, 23 bp, Homo sapiens
ctggcactgcttccagtgaggct

SEQ ID NO: 1846560 - DNA, 14 bp, Homo sapiens
ctggcagctcagag

SEQ ID NO: 1846561 - DNA, 16 bp, Homo sapiens
ctggcagctcagagag

SEQ ID NO: 1846562 - DNA, 17 bp, Homo sapiens
ctggcagctcagagagg

SEQ ID NO: 1846563 - DNA, 16 bp, Homo sapiens
ctggccagggcctgga

SEQ ID NO: 1846564 - DNA, 12 bp, Homo sapiens
ctggcccactgc

SEQ ID NO: 1846565 - DNA, 14 bp, Homo sapiens
ctggcctctgcact

SEQ ID NO: 1846566 - DNA, 16 bp, Homo sapiens
ctggcctctgcactcc

SEQ ID NO: 1846567 - DNA, 18 bp, Homo sapiens
ctggcctgagctgggatg

SEQ ID NO: 1846568 - DNA, 13 bp, Homo sapiens
ctggcctggcccc

SEQ ID NO: 1846569 - DNA, 14 bp, Homo sapiens
ctggcctggcccct

SEQ ID NO: 1846570 - DNA, 16 bp, Homo sapiens
ctggcctggcccctca

SEQ ID NO: 1846571 - DNA, 17 bp, Homo sapiens
ctggcctggcccctcag

SEQ ID NO: 1846572 - DNA, 19 bp, Homo sapiens
ctggcctggcccctcaggg

SEQ ID NO: 1846573 - DNA, 22 bp, Homo sapiens
ctggcggctggggtcccagcag

SEQ ID NO: 1846574 - DNA, 19 bp, Homo sapiens
ctggcgtcatgcaaagtca

SEQ ID NO: 1846575 - DNA, 15 bp, Homo sapiens
ctggctcttccaggc

SEQ ID NO: 1846576 - DNA, 19 bp, Homo sapiens
ctggctcttccaggctggg

SEQ ID NO: 1846577 - DNA, 12 bp, Homo sapiens
ctggctgaagga

SEQ ID NO: 1846578 - DNA, 13 bp, Homo sapiens
ctggctgaaggac

SEQ ID NO: 1846579 - DNA, 20 bp, Homo sapiens
ctggctggttagaggttccc

SEQ ID NO: 1846580 - DNA, 18 bp, Homo sapiens
ctgggacatgggaaaggg

SEQ ID NO: 1846581 - DNA, 22 bp, Homo sapiens
ctgggacatgggaaaggggaag

SEQ ID NO: 1846582 - DNA, 19 bp, Homo sapiens
ctgggagaccctccccaca

SEQ ID NO: 1846583 - DNA, 20 bp, Homo sapiens
ctgggatcacatgtggactt

SEQ ID NO: 1846584 - DNA, 15 bp, Homo sapiens
ctgggatgtcacagt

SEQ ID NO: 1846585 - DNA, 18 bp, Homo sapiens
ctgggatgtcacagtcca

SEQ ID NO: 1846586 - DNA, 15 bp, Homo sapiens
ctgggcaagctggcg

SEQ ID NO: 1846587 - DNA, 21 bp, Homo sapiens
ctgggcaaggaggccacgtga

SEQ ID NO: 1846588 - DNA, 17 bp, Homo sapiens
ctgggcaggactcagct

SEQ ID NO: 1846589 - DNA, 13 bp, Homo sapiens
ctgggccagagta

SEQ ID NO: 1846590 - DNA, 21 bp, Homo sapiens
ctgggctcccttcccacctct

SEQ ID NO: 1846591 - DNA, 18 bp, Homo sapiens
ctgggctgaacactccaa

SEQ ID NO: 1846592 - DNA, 16 bp, Homo sapiens
ctggggacagcaaggg

SEQ ID NO: 1846593 - DNA, 16 bp, Homo sapiens
ctggggccaaataaag

SEQ ID NO: 1846594 - DNA, 18 bp, Homo sapiens
ctggggccaaataaagtc

SEQ ID NO: 1846595 - DNA, 19 bp, Homo sapiens
ctggggccaaataaagtct

SEQ ID NO: 1846596 - DNA, 13 bp, Homo sapiens
ctgggggaagaag

SEQ ID NO: 1846597 - DNA, 16 bp, Homo sapiens
ttaagaactaaaatgt

SEQ ID NO: 1846598 - DNA, 19 bp, Homo sapiens
ttaagaactaaaatgttct

SEQ ID NO: 1846599 - DNA, 20 bp, Homo sapiens
ttaagaactaaaatgttcta

SEQ ID NO: 1846600 - DNA, 20 bp, Homo sapiens
ttaagaatgaaatactgttt

SEQ ID NO: 1846601 - DNA, 18 bp, Homo sapiens
ttaagacatttttggaag

SEQ ID NO: 1846602 - DNA, 17 bp, Homo sapiens
ttaagctgttactgtct

SEQ ID NO: 1846603 - DNA, 18 bp, Homo sapiens
ttaaggattttatgcttt

SEQ ID NO: 1846604 - DNA, 15 bp, Homo sapiens
ttaagtctgttttat

SEQ ID NO: 1846605 - DNA, 18 bp, Homo sapiens
ttaagtctgttttatgac

SEQ ID NO: 1846606 - DNA, 20 bp, Homo sapiens
ttaagtctgttttatgactt

SEQ ID NO: 1846607 - DNA, 22 bp, Homo sapiens
ttaataaagacgatttgtcagt

SEQ ID NO: 1846608 - DNA, 20 bp, Homo sapiens
ttaataaattatttattatt

SEQ ID NO: 1846609 - DNA, 17 bp, Homo sapiens
ttaatataaatgcaaat

SEQ ID NO: 1846610 - DNA, 22 bp, Homo sapiens
ttaatctctccaccttccaaag

SEQ ID NO: 1846611 - DNA, 14 bp, Homo sapiens
ttaattaaatgctc

SEQ ID NO: 1846612 - DNA, 15 bp, Homo sapiens
ttaattctttgttct

SEQ ID NO: 1846613 - DNA, 19 bp, Homo sapiens
ttacctaccacatgccaag

SEQ ID NO: 1846614 - DNA, 23 bp, Homo sapiens
ttactaagtaatctcacagcatt

SEQ ID NO: 1846615 - DNA, 15 bp, Homo sapiens
ttactgcagctttgt

SEQ ID NO: 1846616 - DNA, 17 bp, Homo sapiens
ttacttgtaaatataaa

SEQ ID NO: 1846617 - DNA, 19 bp, Homo sapiens
ttacttgtaaatataaaga

SEQ ID NO: 1846618 - DNA, 22 bp, Homo sapiens
ttacttgtaaatataaagacgt

SEQ ID NO: 1846619 - DNA, 18 bp, Homo sapiens
ttagacagtccctgccaa

SEQ ID NO: 1846620 - DNA, 12 bp, Homo sapiens
ttagctaaagga

SEQ ID NO: 1846621 - DNA, 17 bp, Homo sapiens
ttagctcaatgagcatg

SEQ ID NO: 1846622 - DNA, 18 bp, Homo sapiens
ttagctcaatgagcatgt

SEQ ID NO: 1846623 - DNA, 14 bp, Homo sapiens
ttagctttaattaa

SEQ ID NO: 1846624 - DNA, 19 bp, Homo sapiens
ttagctttaattaagctct

SEQ ID NO: 1846625 - DNA, 19 bp, Homo sapiens
ttagtgacctcagctttga

SEQ ID NO: 1846626 - DNA, 12 bp, Homo sapiens
ttagtggcttca

SEQ ID NO: 1846627 - DNA, 16 bp, Homo sapiens
ttagttcctcattagc

SEQ ID NO: 1846628 - DNA, 18 bp, Homo sapiens
ttataaatcgcttttgat

SEQ ID NO: 1846629 - DNA, 13 bp, Homo sapiens
ttataagcatcat

SEQ ID NO: 1846630 - DNA, 19 bp, Homo sapiens
ttataagcatcattattta

SEQ ID NO: 1846631 - DNA, 22 bp, Homo sapiens
ttataagcatcattatttatgt

SEQ ID NO: 1846632 - DNA, 13 bp, Homo sapiens
ttataatcacttt

SEQ ID NO: 1846633 - DNA, 20 bp, Homo sapiens
ttatctgggcatagatgcag

SEQ ID NO: 1846634 - DNA, 12 bp, Homo sapiens
ttatctgtccca

SEQ ID NO: 1846635 - DNA, 19 bp, Homo sapiens
ttatgacttcattaataat

SEQ ID NO: 1846636 - DNA, 22 bp, Homo sapiens
ttatgacttcattaataataaa

SEQ ID NO: 1846637 - DNA, 14 bp, Homo sapiens
ttatgctttaaaca

SEQ ID NO: 1846638 - DNA, 22 bp, Homo sapiens
ttatgtcaaactgtcttggctg

SEQ ID NO: 1846639 - DNA, 15 bp, Homo sapiens
ttatgttatatataa

SEQ ID NO: 1846640 - DNA, 17 bp, Homo sapiens
ttatgttatatataaat

SEQ ID NO: 1846641 - DNA, 21 bp, Homo sapiens
ttattaaatgcccagcccctt

SEQ ID NO: 1846642 - DNA, 23 bp, Homo sapiens
ttattacagggcattcaaatggg

SEQ ID NO: 1846643 - DNA, 15 bp, Homo sapiens
ttattacttgtaaat

SEQ ID NO: 1846644 - DNA, 23 bp, Homo sapiens
ttattcccttcctgccagcccct

SEQ ID NO: 1846645 - DNA, 12 bp, Homo sapiens
ttatttatgtat

SEQ ID NO: 1846646 - DNA, 13 bp, Homo sapiens
ttatttatgtatt

SEQ ID NO: 1846647 - DNA, 11 bp, Homo sapiens
ttatttattga

SEQ ID NO: 1846648 - DNA, 23 bp, Homo sapiens
ttatttgagacagggaaagggtc

SEQ ID NO: 1846649 - DNA, 23 bp, Homo sapiens
ttcaaaaacatgcttttccaaac

SEQ ID NO: 1846650 - DNA, 12 bp, Homo sapiens
ttcaaactactt

SEQ ID NO: 1846651 - DNA, 16 bp, Homo sapiens
ttcaatcccaggatgt

SEQ ID NO: 1846652 - DNA, 23 bp, Homo sapiens
ttcaatctggattcatatttaat

SEQ ID NO: 1846653 - DNA, 17 bp, Homo sapiens
ttcaattcaacactccc

SEQ ID NO: 1846654 - DNA, 13 bp, Homo sapiens
ttcacactgtctg

SEQ ID NO: 1846655 - DNA, 17 bp, Homo sapiens
ttcacagcacttacaat

SEQ ID NO: 1846656 - DNA, 20 bp, Homo sapiens
ttcacctttgtccccaccgc

SEQ ID NO: 1846657 - DNA, 22 bp, Homo sapiens
ttcacctttgtccccaccgcag

SEQ ID NO: 1846658 - DNA, 17 bp, Homo sapiens
ttcacggaagagccttg

SEQ ID NO: 1846659 - DNA, 15 bp, Homo sapiens
ttcacttatatgttc

SEQ ID NO: 1846660 - DNA, 16 bp, Homo sapiens
ttcagacagctgcctg

SEQ ID NO: 1846661 - DNA, 23 bp, Homo sapiens
ttcagagctgacacaggatgaag

SEQ ID NO: 1846662 - DNA, 18 bp, Homo sapiens
ttcagataactgttattt

SEQ ID NO: 1846663 - DNA, 16 bp, Homo sapiens
ttcagcagaacctgca

SEQ ID NO: 1846664 - DNA, 23 bp, Homo sapiens
ttcagcagaacctgcacacagga

SEQ ID NO: 1846665 - DNA, 17 bp, Homo sapiens
ttcagctctgcaagaat

SEQ ID NO: 1846666 - DNA, 17 bp, Homo sapiens
ttcagctgacttttctg

SEQ ID NO: 1846667 - DNA, 13 bp, Homo sapiens
ttcaggaagctca

SEQ ID NO: 1846668 - DNA, 15 bp, Homo sapiens
ttcaggaagctcagg

SEQ ID NO: 1846669 - DNA, 14 bp, Homo sapiens
ttcagtaagccgtg

SEQ ID NO: 1846670 - DNA, 23 bp, Homo sapiens
ttcatatgacattcatgcctggc

SEQ ID NO: 1846671 - DNA, 13 bp, Homo sapiens
ttcatatttaatt

SEQ ID NO: 1846672 - DNA, 19 bp, Homo sapiens
ttcatcaaatggaagacac

SEQ ID NO: 1846673 - DNA, 17 bp, Homo sapiens
ttcatctggaaccatca

SEQ ID NO: 1846674 - DNA, 14 bp, Homo sapiens
ttcatgcatggaaa

SEQ ID NO: 1846675 - DNA, 18 bp, Homo sapiens
ttcattaataataaattc

SEQ ID NO: 1846676 - DNA, 19 bp, Homo sapiens
ttcattctttttgaaatgt

SEQ ID NO: 1846677 - DNA, 23 bp, Homo sapiens
ttccaaaggccatggagagctgg

SEQ ID NO: 1846678 - DNA, 20 bp, Homo sapiens
ttccaaggctactacagaga

SEQ ID NO: 1846679 - DNA, 18 bp, Homo sapiens
ttccaccatcaagccacc

SEQ ID NO: 1846680 - DNA, 19 bp, Homo sapiens
ttccaccatcaagccacca

SEQ ID NO: 1846681 - DNA, 19 bp, Homo sapiens
ttccacttggctacacagg

SEQ ID NO: 1846682 - DNA, 13 bp, Homo sapiens
ttccaggctggga

SEQ ID NO: 1846683 - DNA, 17 bp, Homo sapiens
ttccaggctgggagagc

SEQ ID NO: 1846684 - DNA, 17 bp, Homo sapiens
ttccaggtttaagctgt

SEQ ID NO: 1846685 - DNA, 17 bp, Homo sapiens
ttccagtgaacattccc

SEQ ID NO: 1846686 - DNA, 20 bp, Homo sapiens
ttccagtgaggctctgccct

SEQ ID NO: 1846687 - DNA, 17 bp, Homo sapiens
ttccatgagtcccctgt

SEQ ID NO: 1846688 - DNA, 13 bp, Homo sapiens
ttccatgatgctg

SEQ ID NO: 1846689 - DNA, 15 bp, Homo sapiens
ttccatggactttgt

SEQ ID NO: 1846690 - DNA, 13 bp, Homo sapiens
ttcccaagggctg

SEQ ID NO: 1846691 - DNA, 12 bp, Homo sapiens
ttcccacctctc

SEQ ID NO: 1846692 - DNA, 21 bp, Homo sapiens
ttcccagtggctgctgcccag

SEQ ID NO: 1846693 - DNA, 20 bp, Homo sapiens
ttcccatgacccaggctggg

SEQ ID NO: 1846694 - DNA, 22 bp, Homo sapiens
ttccccacttgagaattaccct

SEQ ID NO: 1846695 - DNA, 19 bp, Homo sapiens
ttccccatgtctcgactca

SEQ ID NO: 1846696 - DNA, 14 bp, Homo sapiens
ttcccttcctgcca

SEQ ID NO: 1846697 - DNA, 20 bp, Homo sapiens
ttcccttttttggctgctga

SEQ ID NO: 1846698 - DNA, 23 bp, Homo sapiens
ttcctcatttgttcattaaacgt

SEQ ID NO: 1846699 - DNA, 21 bp, Homo sapiens
ttcctccctccctctttccct

SEQ ID NO: 1846700 - DNA, 21 bp, Homo sapiens
ttcctctgaggctgaaattca

SEQ ID NO: 1846701 - DNA, 18 bp, Homo sapiens
ttcctgatgcttcttcag

SEQ ID NO: 1846702 - DNA, 23 bp, Homo sapiens
ttcctgatgcttcttcagagact

SEQ ID NO: 1846703 - DNA, 21 bp, Homo sapiens
ttcctgcaatgaagtctctga

SEQ ID NO: 1846704 - DNA, 17 bp, Homo sapiens
ttcctgccaggcatggt

SEQ ID NO: 1846705 - DNA, 13 bp, Homo sapiens
tatttttctaact

SEQ ID NO: 1846706 - DNA, 14 bp, Homo sapiens
tatttttctcatga

SEQ ID NO: 1846707 - DNA, 14 bp, Homo sapiens
tattttttttctgt

SEQ ID NO: 1846708 - DNA, 15 bp, Homo sapiens
tcaaaaaaagaaaaa

SEQ ID NO: 1846709 - DNA, 20 bp, Homo sapiens
tcaaaaacatgcttttccaa

SEQ ID NO: 1846710 - DNA, 16 bp, Homo sapiens
tcaaacactgcaggca

SEQ ID NO: 1846711 - DNA, 14 bp, Homo sapiens
tcaaactcttaaaa

SEQ ID NO: 1846712 - DNA, 18 bp, Homo sapiens
tcaaactgtcttggctgt

SEQ ID NO: 1846713 - DNA, 16 bp, Homo sapiens
tcaaagagattcgaat

SEQ ID NO: 1846714 - DNA, 12 bp, Homo sapiens
tcaaagaggttt

SEQ ID NO: 1846715 - DNA, 17 bp, Homo sapiens
tcaaatggaagacacat

SEQ ID NO: 1846716 - DNA, 18 bp, Homo sapiens
tcaacactcccttcccat

SEQ ID NO: 1846717 - DNA, 17 bp, Homo sapiens
tcaaccacctttcagat

SEQ ID NO: 1846718 - DNA, 22 bp, Homo sapiens
tcaacccattgttgtcaaggaa

SEQ ID NO: 1846719 - DNA, 23 bp, Homo sapiens
tcaagaagcaggctacactgaca

SEQ ID NO: 1846720 - DNA, 14 bp, Homo sapiens
tcaaggagaggagg

SEQ ID NO: 1846721 - DNA, 13 bp, Homo sapiens
tcaaggcactgcc

SEQ ID NO: 1846722 - DNA, 15 bp, Homo sapiens
tcaaggcactgcctg

SEQ ID NO: 1846723 - DNA, 16 bp, Homo sapiens
tcaaggcactgcctga

SEQ ID NO: 1846724 - DNA, 15 bp, Homo sapiens
tcaagtgaaaaagga

SEQ ID NO: 1846725 - DNA, 13 bp, Homo sapiens
tcaatgagcatgt

SEQ ID NO: 1846726 - DNA, 17 bp, Homo sapiens
tcaattttagttgtcaa

SEQ ID NO: 1846727 - DNA, 18 bp, Homo sapiens
tcacagcacttacaattt

SEQ ID NO: 1846728 - DNA, 16 bp, Homo sapiens
tcacagtccaaccaga

SEQ ID NO: 1846729 - DNA, 20 bp, Homo sapiens
tcacagtccaaccagaaaca

SEQ ID NO: 1846730 - DNA, 23 bp, Homo sapiens
tcacagtccttaccagcagagca

SEQ ID NO: 1846731 - DNA, 18 bp, Homo sapiens
tcacagtggccacggcca

SEQ ID NO: 1846732 - DNA, 20 bp, Homo sapiens
tcacatcacccatgttgaga

SEQ ID NO: 1846733 - DNA, 18 bp, Homo sapiens
tcaccaacgtctgtgcca

SEQ ID NO: 1846734 - DNA, 19 bp, Homo sapiens
tcacctaagtctctgtgaa

SEQ ID NO: 1846735 - DNA, 22 bp, Homo sapiens
tcacctagctgaatgtttttct

SEQ ID NO: 1846736 - DNA, 23 bp, Homo sapiens
tcacctagctgaatgtttttcta

SEQ ID NO: 1846737 - DNA, 18 bp, Homo sapiens
tcacctttgtccccaccg

SEQ ID NO: 1846738 - DNA, 22 bp, Homo sapiens
tcacctttgtccccaccgcaga

SEQ ID NO: 1846739 - DNA, 21 bp, Homo sapiens
tcacgattgtcatcaggagaa

SEQ ID NO: 1846740 - DNA, 20 bp, Homo sapiens
tcacgcctgtaatcctagca

SEQ ID NO: 1846741 - DNA, 16 bp, Homo sapiens
tcacggaagagccttg

SEQ ID NO: 1846742 - DNA, 16 bp, Homo sapiens
tcacgtggaggagcag

SEQ ID NO: 1846743 - DNA, 16 bp, Homo sapiens
tcactaggcttctggt

SEQ ID NO: 1846744 - DNA, 15 bp, Homo sapiens
tcactctggcagctc

SEQ ID NO: 1846745 - DNA, 18 bp, Homo sapiens
tcactctggcagctcaga

SEQ ID NO: 1846746 - DNA, 19 bp, Homo sapiens
tcactctggcagctcagag

SEQ ID NO: 1846747 - DNA, 22 bp, Homo sapiens
tcactctggcagctcagagagg

SEQ ID NO: 1846748 - DNA, 17 bp, Homo sapiens
tcactgagacagcccgg

SEQ ID NO: 1846749 - DNA, 22 bp, Homo sapiens
tcactgagacagcccgggctct

SEQ ID NO: 1846750 - DNA, 20 bp, Homo sapiens
tctcagaaggcaaatgactt

SEQ ID NO: 1846751 - DNA, 19 bp, Homo sapiens
tctcaggcagcaccacact

SEQ ID NO: 1846752 - DNA, 13 bp, Homo sapiens
tctcagggcctgg

SEQ ID NO: 1846753 - DNA, 18 bp, Homo sapiens
tctcatactcacctcacc

SEQ ID NO: 1846754 - DNA, 14 bp, Homo sapiens
tctcatgaagcagg

SEQ ID NO: 1846755 - DNA, 23 bp, Homo sapiens
tctcattggaaatttagcattgt

SEQ ID NO: 1846756 - DNA, 16 bp, Homo sapiens
tctcatttaatcctct

SEQ ID NO: 1846757 - DNA, 16 bp, Homo sapiens
tctccaccttccaaag

SEQ ID NO: 1846758 - DNA, 12 bp, Homo sapiens
tctccccagagt

SEQ ID NO: 1846759 - DNA, 17 bp, Homo sapiens
tctcccccagccccatc

SEQ ID NO: 1846760 - DNA, 18 bp, Homo sapiens
tctcccccagccccatcc

SEQ ID NO: 1846761 - DNA, 20 bp, Homo sapiens
tctcccccagccccatcctc

SEQ ID NO: 1846762 - DNA, 23 bp, Homo sapiens
tctccctcagtctggcccttcct

SEQ ID NO: 1846763 - DNA, 17 bp, Homo sapiens
tctccctcccctctcag

SEQ ID NO: 1846764 - DNA, 19 bp, Homo sapiens
tctccctcccctctcagaa

SEQ ID NO: 1846765 - DNA, 16 bp, Homo sapiens
tctcctctcagcccct

SEQ ID NO: 1846766 - DNA, 13 bp, Homo sapiens
tctcctctgctgc

SEQ ID NO: 1846767 - DNA, 17 bp, Homo sapiens
tctcctctgctgctggc

SEQ ID NO: 1846768 - DNA, 18 bp, Homo sapiens
tctcctctgctgctggct

SEQ ID NO: 1846769 - DNA, 18 bp, Homo sapiens
tctccttcacctttgtcc

SEQ ID NO: 1846770 - DNA, 14 bp, Homo sapiens
tctccttgtggcct

SEQ ID NO: 1846771 - DNA, 16 bp, Homo sapiens
tctcgaactgctggat

SEQ ID NO: 1846772 - DNA, 13 bp, Homo sapiens
tctctcactcctt

SEQ ID NO: 1846773 - DNA, 12 bp, Homo sapiens
tctctcaggaat

SEQ ID NO: 1846774 - DNA, 19 bp, Homo sapiens
tctctccaccttccaaaga

SEQ ID NO: 1846775 - DNA, 20 bp, Homo sapiens
tctctgacgcttgtgacagt

SEQ ID NO: 1846776 - DNA, 15 bp, Homo sapiens
tctctgccctccaag

SEQ ID NO: 1846777 - DNA, 16 bp, Homo sapiens
tctctgccctccaaga

SEQ ID NO: 1846778 - DNA, 20 bp, Homo sapiens
tctcttatggatgtccccag

SEQ ID NO: 1846779 - DNA, 16 bp, Homo sapiens
tctcttggtcctgctg

SEQ ID NO: 1846780 - DNA, 18 bp, Homo sapiens
tctcttggtcctgctgca

SEQ ID NO: 1846781 - DNA, 13 bp, Homo sapiens
tctgaaagggacg

SEQ ID NO: 1846782 - DNA, 22 bp, Homo sapiens
tctgaagtgaaactgcttgttt

SEQ ID NO: 1846783 - DNA, 15 bp, Homo sapiens
tctgacaacagactt

SEQ ID NO: 1846784 - DNA, 15 bp, Homo sapiens
tctgacatctctgca

SEQ ID NO: 1846785 - DNA, 23 bp, Homo sapiens
tctgaccagtttaacctgatgca

SEQ ID NO: 1846786 - DNA, 17 bp, Homo sapiens
tctgacccatgctgccc

SEQ ID NO: 1846787 - DNA, 22 bp, Homo sapiens
tctgacccatgctgccctgtga

SEQ ID NO: 1846788 - DNA, 23 bp, Homo sapiens
tctgacccatgctgccctgtgag

SEQ ID NO: 1846789 - DNA, 13 bp, Homo sapiens
tctgacgcttgtg

SEQ ID NO: 1846790 - DNA, 24 bp, Homo sapiens
tctgagatcaaaacggttttactg

SEQ ID NO: 1846791 - DNA, 19 bp, Homo sapiens
tctgagcagcgagcctgct

SEQ ID NO: 1846792 - DNA, 21 bp, Homo sapiens
tctgagcagcgagcctgctag

SEQ ID NO: 1846793 - DNA, 11 bp, Homo sapiens
tctgaggctga

SEQ ID NO: 1846794 - DNA, 20 bp, Homo sapiens
tctgcaagaattgaagcagg

SEQ ID NO: 1846795 - DNA, 21 bp, Homo sapiens
tctgcaagaattgaagcagga

SEQ ID NO: 1846796 - DNA, 13 bp, Homo sapiens
tctgcattcctga

SEQ ID NO: 1846797 - DNA, 13 bp, Homo sapiens
tctgcccactccc

SEQ ID NO: 1846798 - DNA, 14 bp, Homo sapiens
tctgcccactccct

SEQ ID NO: 1846799 - DNA, 17 bp, Homo sapiens
tctgcccactccctgca

SEQ ID NO: 1846800 - DNA, 18 bp, Homo sapiens
tctgcccactccctgcaa

SEQ ID NO: 1846801 - DNA, 21 bp, Homo sapiens
tctgcccactccctgcaacct

SEQ ID NO: 1846802 - DNA, 23 bp, Homo sapiens
tctgcccactccctgcaacctga

SEQ ID NO: 1846803 - DNA, 14 bp, Homo sapiens
tctgccctccaaga

SEQ ID NO: 1846804 - DNA, 19 bp, Homo sapiens
tctgccctccaagaccttc

SEQ ID NO: 1846805 - DNA, 23 bp, Homo sapiens
tctgcccttggttaggcattgtg

SEQ ID NO: 1846806 - DNA, 12 bp, Homo sapiens
tctgcctcccat

SEQ ID NO: 1846807 - DNA, 13 bp, Homo sapiens
tctgcctcccatc

SEQ ID NO: 1846808 - DNA, 16 bp, Homo sapiens
tctgctaaataaacat

SEQ ID NO: 1846809 - DNA, 19 bp, Homo sapiens
tctgctgaggcccagtgca

SEQ ID NO: 1846810 - DNA, 13 bp, Homo sapiens
tctgctgctggct

SEQ ID NO: 1846811 - DNA, 19 bp, Homo sapiens
tctggaagtgactttggct

SEQ ID NO: 1846812 - DNA, 22 bp, Homo sapiens
tctggatgcctgattgccaagc

SEQ ID NO: 1846813 - DNA, 16 bp, Homo sapiens
tctggattcatattta

SEQ ID NO: 1846814 - DNA, 19 bp, Homo sapiens
tctggattcatatttaatt

SEQ ID NO: 1846815 - DNA, 22 bp, Homo sapiens
tctggattcccaggatgagcat

SEQ ID NO: 1846816 - DNA, 14 bp, Homo sapiens
tctggcagctcaga

SEQ ID NO: 1846817 - DNA, 17 bp, Homo sapiens
tctggcagctcagagag

SEQ ID NO: 1846818 - DNA, 16 bp, Homo sapiens
tctggctcttccaggc

SEQ ID NO: 1846819 - DNA, 18 bp, Homo sapiens
tctggctcttccaggctg

SEQ ID NO: 1846820 - DNA, 14 bp, Homo sapiens
tctgggcaggactc

SEQ ID NO: 1846821 - DNA, 14 bp, Homo sapiens
tctgggccagaatt

SEQ ID NO: 1846822 - DNA, 21 bp, Homo sapiens
tctggtctctaggctggggaa

SEQ ID NO: 1846823 - DNA, 13 bp, Homo sapiens
tctggttcctccc

SEQ ID NO: 1846824 - DNA, 20 bp, Homo sapiens
tctggttcctcccctcctcc

SEQ ID NO: 1846825 - DNA, 21 bp, Homo sapiens
tctggttcctcccctcctcct

SEQ ID NO: 1846826 - DNA, 15 bp, Homo sapiens
tctggtttcaccgag

SEQ ID NO: 1846827 - DNA, 13 bp, Homo sapiens
tctgtaagagctt

SEQ ID NO: 1846828 - DNA, 22 bp, Homo sapiens
tctgtaagagcttgctccagat

SEQ ID NO: 1846829 - DNA, 17 bp, Homo sapiens
tctgtcccacttggcat

SEQ ID NO: 1846830 - DNA, 16 bp, Homo sapiens
tctgtccccagcctgg

SEQ ID NO: 1846831 - DNA, 14 bp, Homo sapiens
tctgtctaggactg

SEQ ID NO: 1846832 - DNA, 23 bp, Homo sapiens
tctgtctccctcccctctcagaa

SEQ ID NO: 1846833 - DNA, 15 bp, Homo sapiens
tctgttatataaatg

SEQ ID NO: 1846834 - DNA, 16 bp, Homo sapiens
tctgttttatgacttc

SEQ ID NO: 1846835 - DNA, 17 bp, Homo sapiens
tcttaattctttgttct

SEQ ID NO: 1846836 - DNA, 16 bp, Homo sapiens
tcttagctcaatgagc

SEQ ID NO: 1846837 - DNA, 18 bp, Homo sapiens
tcttagctcaatgagcat

SEQ ID NO: 1846838 - DNA, 19 bp, Homo sapiens
tcttagctcaatgagcatg

SEQ ID NO: 1846839 - DNA, 21 bp, Homo sapiens
tcttagctcaatgagcatgtt

SEQ ID NO: 1846840 - DNA, 13 bp, Homo sapiens
tcttatcaagcag

SEQ ID NO: 1846841 - DNA, 16 bp, Homo sapiens
tcttatgggctgggtt

SEQ ID NO: 1846842 - DNA, 18 bp, Homo sapiens
tcttatgggctgggttct

SEQ ID NO: 1846843 - DNA, 19 bp, Homo sapiens
tcttcacctaagtctctgt

SEQ ID NO: 1846844 - DNA, 12 bp, Homo sapiens
tcttcagagact

SEQ ID NO: 1846845 - DNA, 21 bp, Homo sapiens
tcttcagagactcctgcaggc

SEQ ID NO: 1846846 - DNA, 15 bp, Homo sapiens
tcttcagtaagccgt

SEQ ID NO: 1846847 - DNA, 16 bp, Homo sapiens
tcttcagtaagccgtg

SEQ ID NO: 1846848 - DNA, 14 bp, Homo sapiens
tcttccaggctggg

SEQ ID NO: 1846849 - DNA, 20 bp, Homo sapiens
tcttccaggctgggagagcc

SEQ ID NO: 1846850 - DNA, 19 bp, Homo sapiens
tcttccctacagttgaaaa

SEQ ID NO: 1846851 - DNA, 22 bp, Homo sapiens
tcttccctacagttgaaaaaca

SEQ ID NO: 1846852 - DNA, 17 bp, Homo sapiens
tcttcctggattattca

SEQ ID NO: 1846853 - DNA, 23 bp, Homo sapiens
tcttctgtgattcggtggagact

SEQ ID NO: 1846854 - DNA, 21 bp, Homo sapiens
tcttggcacatttaagagaca

SEQ ID NO: 1846855 - DNA, 14 bp, Homo sapiens
tcttggtcctgctg

SEQ ID NO: 1846856 - DNA, 15 bp, Homo sapiens
tcttggtcctgctgc

SEQ ID NO: 1846857 - DNA, 15 bp, Homo sapiens
tcttgtattaagaat

SEQ ID NO: 1846858 - DNA, 21 bp, Homo sapiens
tctttagttagtgattatatt

SEQ ID NO: 1846859 - DNA, 12 bp, Homo sapiens
tctttccctccc

SEQ ID NO: 1846860 - DNA, 13 bp, Homo sapiens
tctttccctccct

SEQ ID NO: 1846861 - DNA, 13 bp, Homo sapiens
tctttcctgaggc

SEQ ID NO: 1846862 - DNA, 20 bp, Homo sapiens
tctttgccaccctcatgctg

SEQ ID NO: 1846863 - DNA, 21 bp, Homo sapiens
tctttgccaccctcatgctgt

SEQ ID NO: 1846864 - DNA, 17 bp, Homo sapiens
tctttgctttgcccagc

SEQ ID NO: 1846865 - DNA, 19 bp, Homo sapiens
tctttggacagaagcagct

SEQ ID NO: 1846866 - DNA, 21 bp, Homo sapiens
tctttggacagaagcagctct

SEQ ID NO: 1846867 - DNA, 15 bp, Homo sapiens
tctttggaccctgag

SEQ ID NO: 1846868 - DNA, 21 bp, Homo sapiens
tctttggaccctgaggcccag

SEQ ID NO: 1846869 - DNA, 22 bp, Homo sapiens
tctttgttctgttttgtgagaa

SEQ ID NO: 1846870 - DNA, 16 bp, Homo sapiens
tctttgttttgtgtct

SEQ ID NO: 1846871 - DNA, 18 bp, Homo sapiens
tctttgttttgtgtctct

SEQ ID NO: 1846872 - DNA, 22 bp, Homo sapiens
tactctaccctcttagaaaaac

SEQ ID NO: 1846873 - DNA, 18 bp, Homo sapiens
tactcttatagacaacat

SEQ ID NO: 1846874 - DNA, 21 bp, Homo sapiens
tactgggggcaaaatcagaat

SEQ ID NO: 1846875 - DNA, 18 bp, Homo sapiens
tacttcgacactgttctt

SEQ ID NO: 1846876 - DNA, 17 bp, Homo sapiens
tagaaagagatacagag

SEQ ID NO: 1846877 - DNA, 19 bp, Homo sapiens
tagaattggctgaactcat

SEQ ID NO: 1846878 - DNA, 21 bp, Homo sapiens
tagacagtccctgccaatgga

SEQ ID NO: 1846879 - DNA, 21 bp, Homo sapiens
tagacagttaaactggcttaa

SEQ ID NO: 1846880 - DNA, 14 bp, Homo sapiens
tagactttaacata

SEQ ID NO: 1846881 - DNA, 21 bp, Homo sapiens
tagactttaacataagctatt

SEQ ID NO: 1846882 - DNA, 23 bp, Homo sapiens
tagaggggggatttccagccagg

SEQ ID NO: 1846883 - DNA, 12 bp, Homo sapiens
tagagtgggagc

SEQ ID NO: 1846884 - DNA, 20 bp, Homo sapiens
tagatgaatgtcagttgtta

SEQ ID NO: 1846885 - DNA, 16 bp, Homo sapiens
tagcaaaaaatgaaca

SEQ ID NO: 1846886 - DNA, 18 bp, Homo sapiens
tagcacacacttttggtt

SEQ ID NO: 1846887 - DNA, 15 bp, Homo sapiens
tagcacagaccctgc

SEQ ID NO: 1846888 - DNA, 19 bp, Homo sapiens
tagcacagaccctgccctg

SEQ ID NO: 1846889 - DNA, 21 bp, Homo sapiens
tagcacagaccctgccctgtg

SEQ ID NO: 1846890 - DNA, 21 bp, Homo sapiens
tagcattgtagtgctttgaga

SEQ ID NO: 1846891 - DNA, 19 bp, Homo sapiens
tagccagtgctagttctga

SEQ ID NO: 1846892 - DNA, 14 bp, Homo sapiens
tagcccaaaaccaa

SEQ ID NO: 1846893 - DNA, 15 bp, Homo sapiens
tagcccgaatacaaa

SEQ ID NO: 1846894 - DNA, 17 bp, Homo sapiens
tagcctgcctcttctct

SEQ ID NO: 1846895 - DNA, 12 bp, Homo sapiens
tagctcaatgag

SEQ ID NO: 1846896 - DNA, 17 bp, Homo sapiens
tagctcaatgagcatgt

SEQ ID NO: 1846897 - DNA, 21 bp, Homo sapiens
tagctcaatgagcatgtttag

SEQ ID NO: 1846898 - DNA, 18 bp, Homo sapiens
tagctcataagagtaaca

SEQ ID NO: 1846899 - DNA, 11 bp, Homo sapiens
tagctcttgct

SEQ ID NO: 1846900 - DNA, 18 bp, Homo sapiens
tagctgaatgtttttcta

SEQ ID NO: 1846901 - DNA, 19 bp, Homo sapiens
tagctgaatgtttttctaa

SEQ ID NO: 1846902 - DNA, 17 bp, Homo sapiens
taggaacactccttcac

SEQ ID NO: 1846903 - DNA, 20 bp, Homo sapiens
taggaagtaaagtgaagaat

SEQ ID NO: 1846904 - DNA, 16 bp, Homo sapiens
taggacgccacccagc

SEQ ID NO: 1846905 - DNA, 14 bp, Homo sapiens
taggactgcagtgt

SEQ ID NO: 1846906 - DNA, 20 bp, Homo sapiens
taggagaagtcttctattta

SEQ ID NO: 1846907 - DNA, 22 bp, Homo sapiens
taggcaggacatgctgaagcca

SEQ ID NO: 1846908 - DNA, 20 bp, Homo sapiens
taggcatttgctgaatacag

SEQ ID NO: 1846909 - DNA, 17 bp, Homo sapiens
taggccgttccttcaaa

SEQ ID NO: 1846910 - DNA, 21 bp, Homo sapiens
taggctgacacctaactcttc

SEQ ID NO: 1846911 - DNA, 21 bp, Homo sapiens
tagggaaaaaccagcgtgtga

SEQ ID NO: 1846912 - DNA, 18 bp, Homo sapiens
tagggaaaacattccatc

SEQ ID NO: 1846913 - DNA, 13 bp, Homo sapiens
tagggaagataat

SEQ ID NO: 1846914 - DNA, 14 bp, Homo sapiens
tagggaagtaacag

SEQ ID NO: 1846915 - DNA, 15 bp, Homo sapiens
taggggagggcaggc

SEQ ID NO: 1846916 - DNA, 14 bp, Homo sapiens
taggggctggggcc

SEQ ID NO: 1846917 - DNA, 23 bp, Homo sapiens
taggggctggggccaaataaagt

SEQ ID NO: 1846918 - DNA, 14 bp, Homo sapiens
taggtaggaagagc

SEQ ID NO: 1846919 - DNA, 13 bp, Homo sapiens
taggtgtggggga

SEQ ID NO: 1846920 - DNA, 17 bp, Homo sapiens
taggtgtgggggaagca

SEQ ID NO: 1846921 - DNA, 20 bp, Homo sapiens
tagtcactgagacagcccgg

SEQ ID NO: 1846922 - DNA, 17 bp, Homo sapiens
tagtcttggctaaggaa

SEQ ID NO: 1846923 - DNA, 23 bp, Homo sapiens
tagttcaatctggattcatattt

SEQ ID NO: 1846924 - DNA, 20 bp, Homo sapiens
tagttccaccatcaagccac

SEQ ID NO: 1846925 - DNA, 20 bp, Homo sapiens
tagttcctcattagcatttt

SEQ ID NO: 1846926 - DNA, 20 bp, Homo sapiens
tagttgtttgattcagacag

SEQ ID NO: 1846927 - DNA, 22 bp, Homo sapiens
tagttgtttgattcagacagct

SEQ ID NO: 1846928 - DNA, 19 bp, Homo sapiens
tagttttgtgatgcatttt

SEQ ID NO: 1846929 - DNA, 20 bp, Homo sapiens
tagttttgtgatgcatttta

SEQ ID NO: 1846930 - DNA, 13 bp, Homo sapiens
tataaacaagaaa

SEQ ID NO: 1846931 - DNA, 20 bp, Homo sapiens
tataaacaagaaaaataaag

SEQ ID NO: 1846932 - DNA, 21 bp, Homo sapiens
tataaacaagaaaaataaaga

SEQ ID NO: 1846933 - DNA, 21 bp, Homo sapiens
tataaagacgttttataagca

SEQ ID NO: 1846934 - DNA, 19 bp, Homo sapiens
tataaatatattattactt

SEQ ID NO: 1846935 - DNA, 16 bp, Homo sapiens
tataaatgcaaataac

SEQ ID NO: 1846936 - DNA, 17 bp, Homo sapiens
tataaatgcaaataaca

SEQ ID NO: 1846937 - DNA, 22 bp, Homo sapiens
tataaccacatttctaagcctt

SEQ ID NO: 1846938 - DNA, 15 bp, Homo sapiens
tataagcatcattat

SEQ ID NO: 1846939 - DNA, 17 bp, Homo sapiens
tataagcatcattattt

SEQ ID NO: 1846940 - DNA, 20 bp, Homo sapiens
tatactcttatagacaacat

SEQ ID NO: 1846941 - DNA, 20 bp, Homo sapiens
tataggttactcataaggca

SEQ ID NO: 1846942 - DNA, 22 bp, Homo sapiens
tatataaatatattattacttg

SEQ ID NO: 1846943 - DNA, 18 bp, Homo sapiens
tatataaatggttaaaag

SEQ ID NO: 1846944 - DNA, 20 bp, Homo sapiens
tatataaccacatttctaag

SEQ ID NO: 1846945 - DNA, 21 bp, Homo sapiens
tatatacatcatacttaactt

SEQ ID NO: 1846946 - DNA, 11 bp, Homo sapiens
tatatataaat

SEQ ID NO: 1846947 - DNA, 16 bp, Homo sapiens
tatattattacttgta

SEQ ID NO: 1846948 - DNA, 20 bp, Homo sapiens
tatattattacttgtaaata

SEQ ID NO: 1846949 - DNA, 18 bp, Homo sapiens
tatcacattaatctcaaa

SEQ ID NO: 1846950 - DNA, 16 bp, Homo sapiens
tatcagctacaattgt

SEQ ID NO: 1846951 - DNA, 20 bp, Homo sapiens
tatcatcacaaatggctaca

SEQ ID NO: 1846952 - DNA, 15 bp, Homo sapiens
tatcatcagtattga

SEQ ID NO: 1846953 - DNA, 22 bp, Homo sapiens
tatcatcagtattgaagcattt

SEQ ID NO: 1846954 - DNA, 17 bp, Homo sapiens
tatcccttggacatttt

SEQ ID NO: 1846955 - DNA, 19 bp, Homo sapiens
tatcccttggacattttat

SEQ ID NO: 1846956 - DNA, 13 bp, Homo sapiens
tatctcccccagc

SEQ ID NO: 1846957 - DNA, 16 bp, Homo sapiens
tatctcccccagcccc

SEQ ID NO: 1846958 - DNA, 23 bp, Homo sapiens
tatctctttagttagtgattata

SEQ ID NO: 1846959 - DNA, 17 bp, Homo sapiens
tatcttaattctttgtt

SEQ ID NO: 1846960 - DNA, 14 bp, Homo sapiens
tatctttgccaccc

SEQ ID NO: 1846961 - DNA, 19 bp, Homo sapiens
tatgacattcatgcctggc

SEQ ID NO: 1846962 - DNA, 16 bp, Homo sapiens
tatgacttcattaata

SEQ ID NO: 1846963 - DNA, 20 bp, Homo sapiens
tatgacttcattaataataa

SEQ ID NO: 1846964 - DNA, 16 bp, Homo sapiens
tatgtaacaacaatta

SEQ ID NO: 1846965 - DNA, 15 bp, Homo sapiens
tatgtattgtgcaat

SEQ ID NO: 1846966 - DNA, 20 bp, Homo sapiens
tatgtattgtgcaatgtgta

SEQ ID NO: 1846967 - DNA, 13 bp, Homo sapiens
tatgttaatattt

SEQ ID NO: 1846968 - DNA, 15 bp, Homo sapiens
tatgttatatataaa

SEQ ID NO: 1846969 - DNA, 19 bp, Homo sapiens
tatgttatatataaatata

SEQ ID NO: 1846970 - DNA, 21 bp, Homo sapiens
tattaaagaaaaaaatgtatt

SEQ ID NO: 1846971 - DNA, 12 bp, Homo sapiens
tattaaagacag

SEQ ID NO: 1846972 - DNA, 15 bp, Homo sapiens
tattaaatgcccagc

SEQ ID NO: 1846973 - DNA, 18 bp, Homo sapiens
tattaacaaattgcattt

SEQ ID NO: 1846974 - DNA, 16 bp, Homo sapiens
tattaagaatgaaata

SEQ ID NO: 1846975 - DNA, 18 bp, Homo sapiens
tattacttgtaaatataa

SEQ ID NO: 1846976 - DNA, 19 bp, Homo sapiens
tattacttgtaaatataaa

SEQ ID NO: 1846977 - DNA, 22 bp, Homo sapiens
tattacttgtaaatataaagac

SEQ ID NO: 1846978 - DNA, 23 bp, Homo sapiens
tattatattcattctttttgaaa

SEQ ID NO: 1846979 - DNA, 13 bp, Homo sapiens
tattatcacatta

SEQ ID NO: 1846980 - DNA, 22 bp, Homo sapiens
tattatcacattaatctcaaag

SEQ ID NO: 1846981 - DNA, 16 bp, Homo sapiens
tattcaggaagctcag

SEQ ID NO: 1846982 - DNA, 22 bp, Homo sapiens
tattcaggaagctcagggcctg

SEQ ID NO: 1846983 - DNA, 18 bp, Homo sapiens
tattcattctttttgaaa

SEQ ID NO: 1846984 - DNA, 16 bp, Homo sapiens
tattgaagcattttat

SEQ ID NO: 1846985 - DNA, 14 bp, Homo sapiens
tattgatgttttca

SEQ ID NO: 1846986 - DNA, 13 bp, Homo sapiens
tattgcccaggtt

SEQ ID NO: 1846987 - DNA, 19 bp, Homo sapiens
tatttaacaaaatttgaat

SEQ ID NO: 1846988 - DNA, 13 bp, Homo sapiens
tatttaatttgaa

SEQ ID NO: 1846989 - DNA, 16 bp, Homo sapiens
tatttaatttgaaggt

SEQ ID NO: 1846990 - DNA, 23 bp, Homo sapiens
tatttattaaatgcccagcccct

SEQ ID NO: 1846991 - DNA, 15 bp, Homo sapiens
tatttccctcccctg

SEQ ID NO: 1846992 - DNA, 20 bp, Homo sapiens
tatttgaagatttaattact

SEQ ID NO: 1846993 - DNA, 21 bp, Homo sapiens
tatttggtttggccatctctg

SEQ ID NO: 1846994 - DNA, 21 bp, Homo sapiens
tattttgttttgtgcagagat

SEQ ID NO: 1846995 - DNA, 23 bp, Homo sapiens
ggccacgtgggcaaacaggcagt

SEQ ID NO: 1846996 - DNA, 20 bp, Homo sapiens
ggccactgtgaagagaacca

SEQ ID NO: 1846997 - DNA, 20 bp, Homo sapiens
ggccagccttgaccattctc

SEQ ID NO: 1846998 - DNA, 14 bp, Homo sapiens
ggccaggccctctg

SEQ ID NO: 1846999 - DNA, 15 bp, Homo sapiens
ggccaggccctctgc

SEQ ID NO: 1847000 - DNA, 17 bp, Homo sapiens
ggccaggccctctgccc

SEQ ID NO: 1847001 - DNA, 11 bp, Homo sapiens
ggccaggctgg

SEQ ID NO: 1847002 - DNA, 17 bp, Homo sapiens
ggccagggcctggaaga

SEQ ID NO: 1847003 - DNA, 19 bp, Homo sapiens
ggccagggcctggaagaca

SEQ ID NO: 1847004 - DNA, 19 bp, Homo sapiens
ggccatctctggatgcctg

SEQ ID NO: 1847005 - DNA, 13 bp, Homo sapiens
ggccatctgctcc

SEQ ID NO: 1847006 - DNA, 17 bp, Homo sapiens
ggccatctgctcctgga

SEQ ID NO: 1847007 - DNA, 14 bp, Homo sapiens
ggccatgcagacct

SEQ ID NO: 1847008 - DNA, 11 bp, Homo sapiens
ggccatgcagg

SEQ ID NO: 1847009 - DNA, 15 bp, Homo sapiens
ggccatgcaggaggt

SEQ ID NO: 1847010 - DNA, 21 bp, Homo sapiens
ggccatggagagctggagcct

SEQ ID NO: 1847011 - DNA, 17 bp, Homo sapiens
ggcccagagggcctgca

SEQ ID NO: 1847012 - DNA, 19 bp, Homo sapiens
ggcccagagggcctgcaag

SEQ ID NO: 1847013 - DNA, 19 bp, Homo sapiens
ggccccactttgaagggca

SEQ ID NO: 1847014 - DNA, 22 bp, Homo sapiens
ggccccatattaacaaattgca

SEQ ID NO: 1847015 - DNA, 21 bp, Homo sapiens
ggccccctccccccagactct

SEQ ID NO: 1847016 - DNA, 20 bp, Homo sapiens
ggcccctcagggtccctggt

SEQ ID NO: 1847017 - DNA, 13 bp, Homo sapiens
ggcccctgtgagt

SEQ ID NO: 1847018 - DNA, 13 bp, Homo sapiens
ggccctctgccca

SEQ ID NO: 1847019 - DNA, 16 bp, Homo sapiens
ggccctctgcccactc

SEQ ID NO: 1847020 - DNA, 17 bp, Homo sapiens
ggccctctgcccactcc

SEQ ID NO: 1847021 - DNA, 21 bp, Homo sapiens
ggccctctgcccactccctgc

SEQ ID NO: 1847022 - DNA, 19 bp, Homo sapiens
ggcccttctctccagcccc

SEQ ID NO: 1847023 - DNA, 14 bp, Homo sapiens
ggccgtgggcctgg

SEQ ID NO: 1847024 - DNA, 18 bp, Homo sapiens
ggcctcccaactcacccc

SEQ ID NO: 1847025 - DNA, 19 bp, Homo sapiens
ggcctcccaactcacccca

SEQ ID NO: 1847026 - DNA, 20 bp, Homo sapiens
ggcctcccaactcaccccag

SEQ ID NO: 1847027 - DNA, 23 bp, Homo sapiens
ggcctcccaactcaccccagccc

SEQ ID NO: 1847028 - DNA, 22 bp, Homo sapiens
ggcctcctcacaacatggtgtc

SEQ ID NO: 1847029 - DNA, 20 bp, Homo sapiens
ggcctcggtgtggagaagcg

SEQ ID NO: 1847030 - DNA, 15 bp, Homo sapiens
ggcctctgcactccc

SEQ ID NO: 1847031 - DNA, 18 bp, Homo sapiens
ggcctctgcactcccctg

SEQ ID NO: 1847032 - DNA, 19 bp, Homo sapiens
ggcctctgcactcccctgc

SEQ ID NO: 1847033 - DNA, 17 bp, Homo sapiens
ggcctcttatgggctgg

SEQ ID NO: 1847034 - DNA, 16 bp, Homo sapiens
ggcctggaagacagag

SEQ ID NO: 1847035 - DNA, 15 bp, Homo sapiens
ggcctggcccctcag

SEQ ID NO: 1847036 - DNA, 23 bp, Homo sapiens
ggcctggcccctcagggtccctg

SEQ ID NO: 1847037 - DNA, 16 bp, Homo sapiens
ggcctggcctgagctg

SEQ ID NO: 1847038 - DNA, 24 bp, Homo sapiens
ggcgcagcatattcaggaagctca

SEQ ID NO: 1847039 - DNA, 12 bp, Homo sapiens
ggcgtctgctct

SEQ ID NO: 1847040 - DNA, 15 bp, Homo sapiens
ggcgtctgctctggt

SEQ ID NO: 1847041 - DNA, 15 bp, Homo sapiens
ggcgtggagctgcct

SEQ ID NO: 1847042 - DNA, 22 bp, Homo sapiens
ggctaaggcgtggagctgcctg

SEQ ID NO: 1847043 - DNA, 15 bp, Homo sapiens
ggctacacagggatg

SEQ ID NO: 1847044 - DNA, 23 bp, Homo sapiens
ggctacaccttagcctgccctcc

SEQ ID NO: 1847045 - DNA, 16 bp, Homo sapiens
ggctacatctccaaat

SEQ ID NO: 1847046 - DNA, 13 bp, Homo sapiens
ggctaggggctgg

SEQ ID NO: 1847047 - DNA, 20 bp, Homo sapiens
ggctcaggtggggtcactct

SEQ ID NO: 1847048 - DNA, 10 bp, Homo sapiens
ggctccagac

SEQ ID NO: 1847049 - DNA, 12 bp, Homo sapiens
ggctccaggagc

SEQ ID NO: 1847050 - DNA, 20 bp, Homo sapiens
ggctcccttcccacctctct

SEQ ID NO: 1847051 - DNA, 16 bp, Homo sapiens
ggctctagaattccag

SEQ ID NO: 1847052 - DNA, 12 bp, Homo sapiens
ggctctgccctt

SEQ ID NO: 1847053 - DNA, 15 bp, Homo sapiens
ggctctgcccttggt

SEQ ID NO: 1847054 - DNA, 17 bp, Homo sapiens
ggctctgcctcccatca

SEQ ID NO: 1847055 - DNA, 14 bp, Homo sapiens
ggctctgtccccag

SEQ ID NO: 1847056 - DNA, 20 bp, Homo sapiens
ggctcttccaggctgggaga

SEQ ID NO: 1847057 - DNA, 23 bp, Homo sapiens
ggctcttccaggctgggagagcc

SEQ ID NO: 1847058 - DNA, 16 bp, Homo sapiens
ggctcttctccccaga

SEQ ID NO: 1847059 - DNA, 17 bp, Homo sapiens
ggctcttctccccagag

SEQ ID NO: 1847060 - DNA, 18 bp, Homo sapiens
ggctgaaggactgtgaca

SEQ ID NO: 1847061 - DNA, 17 bp, Homo sapiens
ggctgctgaaggctcga

SEQ ID NO: 1847062 - DNA, 18 bp, Homo sapiens
ggctgctgaaggctcgag

SEQ ID NO: 1847063 - DNA, 23 bp, Homo sapiens
ggctggaacagattcacactgtc

SEQ ID NO: 1847064 - DNA, 21 bp, Homo sapiens
ggctggagtgcagtggcgcaa

SEQ ID NO: 1847065 - DNA, 15 bp, Homo sapiens
ggctggcctggcccc

SEQ ID NO: 1847066 - DNA, 23 bp, Homo sapiens
ggctgggagagccttccaggggt

SEQ ID NO: 1847067 - DNA, 16 bp, Homo sapiens
ggctgggggaagaagc

SEQ ID NO: 1847068 - DNA, 16 bp, Homo sapiens
gtatgggactggcctc

SEQ ID NO: 1847069 - DNA, 21 bp, Homo sapiens
gtatgggttagggaaaacatt

SEQ ID NO: 1847070 - DNA, 17 bp, Homo sapiens
gtatgttgaagcctttg

SEQ ID NO: 1847071 - DNA, 10 bp, Homo sapiens
gtattgaagc

SEQ ID NO: 1847072 - DNA, 22 bp, Homo sapiens
gtattgtgcaatgtgtataaac

SEQ ID NO: 1847073 - DNA, 12 bp, Homo sapiens
gtatttgtttgc

SEQ ID NO: 1847074 - DNA, 14 bp, Homo sapiens
gtattttactaata

SEQ ID NO: 1847075 - DNA, 22 bp, Homo sapiens
gtattttatgttatatataaat

SEQ ID NO: 1847076 - DNA, 22 bp, Homo sapiens
gtattttgtttttgtcttaaaa

SEQ ID NO: 1847077 - DNA, 18 bp, Homo sapiens
gtcaagtgaaaaaggagg

SEQ ID NO: 1847078 - DNA, 23 bp, Homo sapiens
gtcaccatcttaagagatgcctc

SEQ ID NO: 1847079 - DNA, 13 bp, Homo sapiens
gtcaccccggcca

SEQ ID NO: 1847080 - DNA, 23 bp, Homo sapiens
gtcactctggcagctcagagagg

SEQ ID NO: 1847081 - DNA, 17 bp, Homo sapiens
gtcactgagacagcccg

SEQ ID NO: 1847082 - DNA, 23 bp, Homo sapiens
gtcactgagacagcccgggctct

SEQ ID NO: 1847083 - DNA, 20 bp, Homo sapiens
gtcaggagtgtgtgtgagtg

SEQ ID NO: 1847084 - DNA, 17 bp, Homo sapiens
gtcagttgttatttatt

SEQ ID NO: 1847085 - DNA, 21 bp, Homo sapiens
gtcagttgttatttattgaaa

SEQ ID NO: 1847086 - DNA, 17 bp, Homo sapiens
gtcatctgtaagagctt

SEQ ID NO: 1847087 - DNA, 18 bp, Homo sapiens
gtcatgcaaaggctggga

SEQ ID NO: 1847088 - DNA, 17 bp, Homo sapiens
gtccaaagcagggtctg

SEQ ID NO: 1847089 - DNA, 15 bp, Homo sapiens
gtccaaccagaaaca

SEQ ID NO: 1847090 - DNA, 14 bp, Homo sapiens
gtccagccctggct

SEQ ID NO: 1847091 - DNA, 17 bp, Homo sapiens
gtccagccctggctgaa

SEQ ID NO: 1847092 - DNA, 14 bp, Homo sapiens
gtccatagagagca

SEQ ID NO: 1847093 - DNA, 20 bp, Homo sapiens
gtcccaccccacacacgcca

SEQ ID NO: 1847094 - DNA, 19 bp, Homo sapiens
gtcccacttggcatcagct

SEQ ID NO: 1847095 - DNA, 11 bp, Homo sapiens
gtcccagcagc

SEQ ID NO: 1847096 - DNA, 15 bp, Homo sapiens
gtcccagcagctgcc

SEQ ID NO: 1847097 - DNA, 17 bp, Homo sapiens
gtcccagcagctgccag

SEQ ID NO: 1847098 - DNA, 22 bp, Homo sapiens
gtcccagcagctgccaggagca

SEQ ID NO: 1847099 - DNA, 18 bp, Homo sapiens
gtcccataggcccagtga

SEQ ID NO: 1847100 - DNA, 18 bp, Homo sapiens
gtccccaccgcagacagg

SEQ ID NO: 1847101 - DNA, 23 bp, Homo sapiens
gtcccctgtttgtttctgaaagg

SEQ ID NO: 1847102 - DNA, 18 bp, Homo sapiens
gtccctggtggcagctca

SEQ ID NO: 1847103 - DNA, 19 bp, Homo sapiens
gtcctattatattcattct

SEQ ID NO: 1847104 - DNA, 21 bp, Homo sapiens
gtcctattatattcattcttt

SEQ ID NO: 1847105 - DNA, 14 bp, Homo sapiens
gtcctcgtttgtgt

SEQ ID NO: 1847106 - DNA, 18 bp, Homo sapiens
gtcctcgtttgtgttctg

SEQ ID NO: 1847107 - DNA, 17 bp, Homo sapiens
gtccttaccagcagagc

SEQ ID NO: 1847108 - DNA, 13 bp, Homo sapiens
gtccttcaaaggc

SEQ ID NO: 1847109 - DNA, 21 bp, Homo sapiens
gtcctttttcactttgaaaag

SEQ ID NO: 1847110 - DNA, 15 bp, Homo sapiens
gtctacactgtgctg

SEQ ID NO: 1847111 - DNA, 14 bp, Homo sapiens
gtctacctgagggg

SEQ ID NO: 1847112 - DNA, 15 bp, Homo sapiens
gtctacctgaggggc

SEQ ID NO: 1847113 - DNA, 16 bp, Homo sapiens
gtctacctgaggggcc

SEQ ID NO: 1847114 - DNA, 15 bp, Homo sapiens
gtctaggactgcagt

SEQ ID NO: 1847115 - DNA, 20 bp, Homo sapiens
gtctaggactgcagtgtgga

SEQ ID NO: 1847116 - DNA, 21 bp, Homo sapiens
gtctatataaccacatttcta

SEQ ID NO: 1847117 - DNA, 22 bp, Homo sapiens
gtctatataaccacatttctaa

SEQ ID NO: 1847118 - DNA, 12 bp, Homo sapiens
gtctattcatta

SEQ ID NO: 1847119 - DNA, 19 bp, Homo sapiens
gtctcaggcagcaccacac

SEQ ID NO: 1847120 - DNA, 12 bp, Homo sapiens
gtctcagtgtcc

SEQ ID NO: 1847121 - DNA, 15 bp, Homo sapiens
gtctcccaaagtgct

SEQ ID NO: 1847122 - DNA, 18 bp, Homo sapiens
gtctccctcccctctcag

SEQ ID NO: 1847123 - DNA, 23 bp, Homo sapiens
gtctccctcccctctcagaacat

SEQ ID NO: 1847124 - DNA, 13 bp, Homo sapiens
gctaagagggagg

SEQ ID NO: 1847125 - DNA, 22 bp, Homo sapiens
gctaagagggagggagggctcc

SEQ ID NO: 1847126 - DNA, 23 bp, Homo sapiens
gctaagagggagggagggctcca

SEQ ID NO: 1847127 - DNA, 17 bp, Homo sapiens
gctaagatataatttaa

SEQ ID NO: 1847128 - DNA, 18 bp, Homo sapiens
gctaaggcgtggagctgc

SEQ ID NO: 1847129 - DNA, 15 bp, Homo sapiens
gctaggaacactcct

SEQ ID NO: 1847130 - DNA, 21 bp, Homo sapiens
gctaggaacactccttcacag

SEQ ID NO: 1847131 - DNA, 13 bp, Homo sapiens
gctatctccccca

SEQ ID NO: 1847132 - DNA, 14 bp, Homo sapiens
gctatctcccccag

SEQ ID NO: 1847133 - DNA, 16 bp, Homo sapiens
gctatctcccccagcc

SEQ ID NO: 1847134 - DNA, 19 bp, Homo sapiens
gctatctcccccagcccca

SEQ ID NO: 1847135 - DNA, 20 bp, Homo sapiens
gctatgatttttttttccaa

SEQ ID NO: 1847136 - DNA, 21 bp, Homo sapiens
gctatttttctaactacaaag

SEQ ID NO: 1847137 - DNA, 18 bp, Homo sapiens
gctcaatacctggcctca

SEQ ID NO: 1847138 - DNA, 19 bp, Homo sapiens
gctcaatgagcatgtttag

SEQ ID NO: 1847139 - DNA, 16 bp, Homo sapiens
gctcagagagggcagg

SEQ ID NO: 1847140 - DNA, 14 bp, Homo sapiens
gctcagagagggtg

SEQ ID NO: 1847141 - DNA, 22 bp, Homo sapiens
gctcagagagggtgggagtggg

SEQ ID NO: 1847142 - DNA, 22 bp, Homo sapiens
gctcagcaaaagatgcttctca

SEQ ID NO: 1847143 - DNA, 19 bp, Homo sapiens
gctcagcactgcctgctcc

SEQ ID NO: 1847144 - DNA, 16 bp, Homo sapiens
gctcaggaccaggcaa

SEQ ID NO: 1847145 - DNA, 13 bp, Homo sapiens
gctcaggagtttg

SEQ ID NO: 1847146 - DNA, 12 bp, Homo sapiens
gctcagggcctg

SEQ ID NO: 1847147 - DNA, 13 bp, Homo sapiens
gctcagggcctgg

SEQ ID NO: 1847148 - DNA, 16 bp, Homo sapiens
gctcagggcctggctc

SEQ ID NO: 1847149 - DNA, 19 bp, Homo sapiens
gctcagggcctggctcagg

SEQ ID NO: 1847150 - DNA, 16 bp, Homo sapiens
gctcagttcagaatca

SEQ ID NO: 1847151 - DNA, 13 bp, Homo sapiens
gctccaaaccctc

SEQ ID NO: 1847152 - DNA, 16 bp, Homo sapiens
gctccaaaccctcgag

SEQ ID NO: 1847153 - DNA, 19 bp, Homo sapiens
gctccaaaccctcgaggcg

SEQ ID NO: 1847154 - DNA, 17 bp, Homo sapiens
gctccaagctcccaggc

SEQ ID NO: 1847155 - DNA, 9 bp, Homo sapiens
gctccagac

SEQ ID NO: 1847156 - DNA, 21 bp, Homo sapiens
gctccagacacatgtccaaga

SEQ ID NO: 1847157 - DNA, 18 bp, Homo sapiens
gctccagattctgatgca

SEQ ID NO: 1847158 - DNA, 20 bp, Homo sapiens
gctccagctgttcagctggt

SEQ ID NO: 1847159 - DNA, 11 bp, Homo sapiens
gctccaggagc

SEQ ID NO: 1847160 - DNA, 14 bp, Homo sapiens
gctccattttttct

SEQ ID NO: 1847161 - DNA, 23 bp, Homo sapiens
gctcccaagggatggtgccctgt

SEQ ID NO: 1847162 - DNA, 17 bp, Homo sapiens
gctcccaggcattcccc

SEQ ID NO: 1847163 - DNA, 23 bp, Homo sapiens
gctcccaggcattccccaggagg

SEQ ID NO: 1847164 - DNA, 18 bp, Homo sapiens
gctcctcatccagggctc

SEQ ID NO: 1847165 - DNA, 15 bp, Homo sapiens
gctcctggcccactg

SEQ ID NO: 1847166 - DNA, 20 bp, Homo sapiens
gctcctggcccactgcatcg

SEQ ID NO: 1847167 - DNA, 18 bp, Homo sapiens
gctccttcctctgaggct

SEQ ID NO: 1847168 - DNA, 18 bp, Homo sapiens
gctctcaagttatcaggg

SEQ ID NO: 1847169 - DNA, 13 bp, Homo sapiens
gctctcatagctc

SEQ ID NO: 1847170 - DNA, 23 bp, Homo sapiens
gctctgcaagaattgaagcagga

SEQ ID NO: 1847171 - DNA, 13 bp, Homo sapiens
gctctgcccttgg

SEQ ID NO: 1847172 - DNA, 23 bp, Homo sapiens
gctctgcccttggttaggcattg

SEQ ID NO: 1847173 - DNA, 14 bp, Homo sapiens
gctctgcctcccat

SEQ ID NO: 1847174 - DNA, 22 bp, Homo sapiens
gctctgcctcccatcacccgct

SEQ ID NO: 1847175 - DNA, 23 bp, Homo sapiens
gctctggtggcttaagtgagcag

SEQ ID NO: 1847176 - DNA, 13 bp, Homo sapiens
gctctgtccccag

SEQ ID NO: 1847177 - DNA, 14 bp, Homo sapiens
gctctgtccccagc

SEQ ID NO: 1847178 - DNA, 15 bp, Homo sapiens
gctcttccaggctgg

SEQ ID NO: 1847179 - DNA, 14 bp, Homo sapiens
gctctttggagatc

SEQ ID NO: 1847180 - DNA, 21 bp, Homo sapiens
gctctttgttttgtgtctctt

SEQ ID NO: 1847181 - DNA, 20 bp, Homo sapiens
gctgaacactccaattaagg

SEQ ID NO: 1847182 - DNA, 21 bp, Homo sapiens
gctgaacactccaattaagga

SEQ ID NO: 1847183 - DNA, 14 bp, Homo sapiens
gctgaaggactgtg

SEQ ID NO: 1847184 - DNA, 22 bp, Homo sapiens
gctgaagggtaatatggactca

SEQ ID NO: 1847185 - DNA, 17 bp, Homo sapiens
gctgaatgtttttctaa

SEQ ID NO: 1847186 - DNA, 17 bp, Homo sapiens
gctgacacaaacctgcc

SEQ ID NO: 1847187 - DNA, 21 bp, Homo sapiens
gctgacacaaacctgcctggg

SEQ ID NO: 1847188 - DNA, 14 bp, Homo sapiens
gctgacatcatttg

SEQ ID NO: 1847189 - DNA, 22 bp, Homo sapiens
gctgaggccccttctaggtggc

SEQ ID NO: 1847190 - DNA, 14 bp, Homo sapiens
gctgaggtgggagg

SEQ ID NO: 1847191 - DNA, 15 bp, Homo sapiens
gctgagtctgaaggc

SEQ ID NO: 1847192 - DNA, 18 bp, Homo sapiens
gctgatggagccccacct

SEQ ID NO: 1847193 - DNA, 13 bp, Homo sapiens
gctgattctcagg

SEQ ID NO: 1847194 - DNA, 22 bp, Homo sapiens
gctgcaccggctggcctggccc

SEQ ID NO: 1847195 - DNA, 17 bp, Homo sapiens
gctgcagatttgggctg

SEQ ID NO: 1847196 - DNA, 13 bp, Homo sapiens
gctgcagttgcca

SEQ ID NO: 1847197 - DNA, 21 bp, Homo sapiens
gctgcagttgccagtcacccc

SEQ ID NO: 1847198 - DNA, 13 bp, Homo sapiens
gctgccctgccca

SEQ ID NO: 1847199 - DNA, 14 bp, Homo sapiens
gctgccctgcccac

SEQ ID NO: 1847200 - DNA, 21 bp, Homo sapiens
gctgccctgcccacctggcct

SEQ ID NO: 1847201 - DNA, 15 bp, Homo sapiens
gctgccgcaccagcc

SEQ ID NO: 1847202 - DNA, 19 bp, Homo sapiens
gctgccggggcagccccct

SEQ ID NO: 1847203 - DNA, 18 bp, Homo sapiens
gctgcctgggatccctca

SEQ ID NO: 1847204 - DNA, 20 bp, Homo sapiens
gctgcctgggatccctcatc

SEQ ID NO: 1847205 - DNA, 21 bp, Homo sapiens
gctgctaatattttcctcctg

SEQ ID NO: 1847206 - DNA, 24 bp, Homo sapiens
gctgctaatattttcctcctgagt

SEQ ID NO: 1847207 - DNA, 12 bp, Homo sapiens
gctgctgaaggc

SEQ ID NO: 1847208 - DNA, 14 bp, Homo sapiens
gtctctaggctggg

SEQ ID NO: 1847209 - DNA, 13 bp, Homo sapiens
gtctctggcctgt

SEQ ID NO: 1847210 - DNA, 23 bp, Homo sapiens
gtctcttatggatgtccccagca

SEQ ID NO: 1847211 - DNA, 13 bp, Homo sapiens
gtctcttggtcct

SEQ ID NO: 1847212 - DNA, 17 bp, Homo sapiens
gtctcttggtcctgctg

SEQ ID NO: 1847213 - DNA, 16 bp, Homo sapiens
gtctgctaaataaaca

SEQ ID NO: 1847214 - DNA, 12 bp, Homo sapiens
gtctgctctggt

SEQ ID NO: 1847215 - DNA, 14 bp, Homo sapiens
gtctgctctggtgg

SEQ ID NO: 1847216 - DNA, 12 bp, Homo sapiens
gtcttctattta

SEQ ID NO: 1847217 - DNA, 14 bp, Homo sapiens
gtcttctatttatt

SEQ ID NO: 1847218 - DNA, 17 bp, Homo sapiens
gtcttctatttatttat

SEQ ID NO: 1847219 - DNA, 14 bp, Homo sapiens
gtctttggaccctg

SEQ ID NO: 1847220 - DNA, 18 bp, Homo sapiens
gtctttggaccctgaggc

SEQ ID NO: 1847221 - DNA, 24 bp, Homo sapiens
gtcttttcttgcatgaggctagtg

SEQ ID NO: 1847222 - DNA, 20 bp, Homo sapiens
gtgaaactgcttgtttccta

SEQ ID NO: 1847223 - DNA, 19 bp, Homo sapiens
gtgaaaggaaagagggagg

SEQ ID NO: 1847224 - DNA, 20 bp, Homo sapiens
gtgaacattcccagcccagc

SEQ ID NO: 1847225 - DNA, 19 bp, Homo sapiens
gtgaacttgggccactgtg

SEQ ID NO: 1847226 - DNA, 21 bp, Homo sapiens
gtgaatgatgatcctaggcat

SEQ ID NO: 1847227 - DNA, 13 bp, Homo sapiens
gtgacagctttct

SEQ ID NO: 1847228 - DNA, 18 bp, Homo sapiens
gtgacagtgcctcttcca

SEQ ID NO: 1847229 - DNA, 14 bp, Homo sapiens
gtgacatgtctttt

SEQ ID NO: 1847230 - DNA, 20 bp, Homo sapiens
gtgactcgagtcacactcaa

SEQ ID NO: 1847231 - DNA, 18 bp, Homo sapiens
gtgagacagtccagcctg

SEQ ID NO: 1847232 - DNA, 19 bp, Homo sapiens
gtgagacagtccagcctgg

SEQ ID NO: 1847233 - DNA, 13 bp, Homo sapiens
gtgagcagaacag

SEQ ID NO: 1847234 - DNA, 13 bp, Homo sapiens
gtgagctgagcag

SEQ ID NO: 1847235 - DNA, 17 bp, Homo sapiens
gtgagctgagcaggcca

SEQ ID NO: 1847236 - DNA, 20 bp, Homo sapiens
gtgagctggatagacttggg

SEQ ID NO: 1847237 - DNA, 16 bp, Homo sapiens
gtgaggaagccgctgg

SEQ ID NO: 1847238 - DNA, 15 bp, Homo sapiens
gtgatgcattttata

SEQ ID NO: 1847239 - DNA, 17 bp, Homo sapiens
gtgatggggccctgcct

SEQ ID NO: 1847240 - DNA, 22 bp, Homo sapiens
gtgattcaattcaacactccct

SEQ ID NO: 1847241 - DNA, 17 bp, Homo sapiens
gtgattcttagcaaaaa

SEQ ID NO: 1847242 - DNA, 19 bp, Homo sapiens
gtgatttttaaattaaata

SEQ ID NO: 1847243 - DNA, 13 bp, Homo sapiens
gtgcaacagacaa

SEQ ID NO: 1847244 - DNA, 14 bp, Homo sapiens
gtgcaacagacaag

SEQ ID NO: 1847245 - DNA, 14 bp, Homo sapiens
gtgcacccacctgt

SEQ ID NO: 1847246 - DNA, 22 bp, Homo sapiens
gtgcacccacctgttttctgaa

SEQ ID NO: 1847247 - DNA, 18 bp, Homo sapiens
gtgcacgcagtggccttc

SEQ ID NO: 1847248 - DNA, 13 bp, Homo sapiens
gtgccaacactca

SEQ ID NO: 1847249 - DNA, 14 bp, Homo sapiens
gtgccgacagaagg

SEQ ID NO: 1847250 - DNA, 15 bp, Homo sapiens
gtgccgccagctgcc

SEQ ID NO: 1847251 - DNA, 15 bp, Homo sapiens
gtgcctaatgtgttt

SEQ ID NO: 1847252 - DNA, 22 bp, Homo sapiens
gtgcctgggtggacatggcccc

SEQ ID NO: 1847253 - DNA, 18 bp, Homo sapiens
gtgctatctcccccagcc

SEQ ID NO: 1847254 - DNA, 17 bp, Homo sapiens
gtgctgagtctgaaggc

SEQ ID NO: 1847255 - DNA, 19 bp, Homo sapiens
gtgctgagtctgaaggctg

SEQ ID NO: 1847256 - DNA, 19 bp, Homo sapiens
gtgctgccctgcccacctg

SEQ ID NO: 1847257 - DNA, 14 bp, Homo sapiens
gtgctgctgctgct

SEQ ID NO: 1847258 - DNA, 15 bp, Homo sapiens
gtgctttgagagaga

SEQ ID NO: 1847259 - DNA, 17 bp, Homo sapiens
gtgctttgagagagaaa

SEQ ID NO: 1847260 - DNA, 13 bp, Homo sapiens
gtggacttttatt

SEQ ID NO: 1847261 - DNA, 20 bp, Homo sapiens
gtggagaagcggctggcagc

SEQ ID NO: 1847262 - DNA, 20 bp, Homo sapiens
gtggagttcaccttggaagg

SEQ ID NO: 1847263 - DNA, 13 bp, Homo sapiens
gtggcaaggctgt

SEQ ID NO: 1847264 - DNA, 19 bp, Homo sapiens
gtggcagagcttggactgg

SEQ ID NO: 1847265 - DNA, 14 bp, Homo sapiens
gtggcagctcacct

SEQ ID NO: 1847266 - DNA, 13 bp, Homo sapiens
gtggcatggccac

SEQ ID NO: 1847267 - DNA, 15 bp, Homo sapiens
gtggcctcccaactc

SEQ ID NO: 1847268 - DNA, 22 bp, Homo sapiens
gtggcctcccaactcaccccag

SEQ ID NO: 1847269 - DNA, 21 bp, Homo sapiens
gtggcctctccttgtggcctg

SEQ ID NO: 1847270 - DNA, 14 bp, Homo sapiens
gtggctcacgcctg

SEQ ID NO: 1847271 - DNA, 12 bp, Homo sapiens
gtggctgctgcc

SEQ ID NO: 1847272 - DNA, 15 bp, Homo sapiens
gtggctgctgcccag

SEQ ID NO: 1847273 - DNA, 19 bp, Homo sapiens
gtggcttaagtgagcagaa

SEQ ID NO: 1847274 - DNA, 21 bp, Homo sapiens
gtggcttcattagagcaggcg

SEQ ID NO: 1847275 - DNA, 17 bp, Homo sapiens
gtgggaagggctacacc

SEQ ID NO: 1847276 - DNA, 13 bp, Homo sapiens
gtgggacaccctg

SEQ ID NO: 1847277 - DNA, 22 bp, Homo sapiens
gtgggacaccctgtgatggggc

SEQ ID NO: 1847278 - DNA, 23 bp, Homo sapiens
gtgggacagttcctgagaccagc

SEQ ID NO: 1847279 - DNA, 18 bp, Homo sapiens
gtgggatcctccaggtgc

SEQ ID NO: 1847280 - DNA, 17 bp, Homo sapiens
gtgggcaaacaggcagt

SEQ ID NO: 1847281 - DNA, 22 bp, Homo sapiens
gtgggcttcccagtggctgctg

SEQ ID NO: 1847282 - DNA, 20 bp, Homo sapiens
gtggggctaggggctggggc

SEQ ID NO: 1847283 - DNA, 21 bp, Homo sapiens
gtggggtcactctggcagctc

SEQ ID NO: 1847284 - DNA, 17 bp, Homo sapiens
gtggtagagtgtgcctg

SEQ ID NO: 1847285 - DNA, 14 bp, Homo sapiens
gtggtggagccagt

SEQ ID NO: 1847286 - DNA, 15 bp, Homo sapiens
gtggtgtttcctggc

SEQ ID NO: 1847287 - DNA, 14 bp, Homo sapiens
gtgtataaacaaga

SEQ ID NO: 1847288 - DNA, 20 bp, Homo sapiens
gtgtctgccaaacacattta

SEQ ID NO: 1847289 - DNA, 13 bp, Homo sapiens
gtgtgcaggagcg

SEQ ID NO: 1847290 - DNA, 15 bp, Homo sapiens
gtgtggtgtttcctg

SEQ ID NO: 1847291 - DNA, 16 bp, Homo sapiens
gtgttatcacctagct

SEQ ID NO: 1847292 - DNA, 13 bp, Homo sapiens
gtgtttaagacat

SEQ ID NO: 1847293 - DNA, 14 bp, Homo sapiens
gttaaaagaggttt

SEQ ID NO: 1847294 - DNA, 20 bp, Homo sapiens
gttaaaagaggtttttctta

SEQ ID NO: 1847295 - DNA, 18 bp, Homo sapiens
gttaactgagtgcctttt

SEQ ID NO: 1847296 - DNA, 13 bp, Homo sapiens
gttaagcctttgg

SEQ ID NO: 1847297 - DNA, 21 bp, Homo sapiens
gttaagtatcagctacaattg

SEQ ID NO: 1847298 - DNA, 22 bp, Homo sapiens
gttaagtctgttttatgacttc

SEQ ID NO: 1847299 - DNA, 23 bp, Homo sapiens
gttactcttcagttaagcctttg

SEQ ID NO: 1847300 - DNA, 19 bp, Homo sapiens
gttaggcattgtgggaagg

SEQ ID NO: 1847301 - DNA, 16 bp, Homo sapiens
gttagtttctccaagc

SEQ ID NO: 1847302 - DNA, 22 bp, Homo sapiens
gttagtttctccaagcaggaca

SEQ ID NO: 1847303 - DNA, 10 bp, Homo sapiens
gttatataaa

SEQ ID NO: 1847304 - DNA, 12 bp, Homo sapiens
gttatgaacagc

SEQ ID NO: 1847305 - DNA, 22 bp, Homo sapiens
gttcaccttgaagaacctctca

SEQ ID NO: 1847306 - DNA, 15 bp, Homo sapiens
gttcaccttggaagg

SEQ ID NO: 1847307 - DNA, 12 bp, Homo sapiens
gttcagcagaac

SEQ ID NO: 1847308 - DNA, 19 bp, Homo sapiens
gttcaggtcccctttcaga

SEQ ID NO: 1847309 - DNA, 20 bp, Homo sapiens
gttccaccatcaagccacca

SEQ ID NO: 1847310 - DNA, 16 bp, Homo sapiens
gttccatgatgctggg

SEQ ID NO: 1847311 - DNA, 22 bp, Homo sapiens
gttcctcattagcattttgcta

SEQ ID NO: 1847312 - DNA, 18 bp, Homo sapiens
gttctctgccctccaaga

SEQ ID NO: 1847313 - DNA, 17 bp, Homo sapiens
gttctgatgatgtgcct

SEQ ID NO: 1847314 - DNA, 12 bp, Homo sapiens
gttctggctctt

SEQ ID NO: 1847315 - DNA, 16 bp, Homo sapiens
gttctgttttgtttcg

SEQ ID NO: 1847316 - DNA, 16 bp, Homo sapiens
gttcttagctcaatga

SEQ ID NO: 1847317 - DNA, 21 bp, Homo sapiens
gttgaggtccagccctggctg

SEQ ID NO: 1847318 - DNA, 14 bp, Homo sapiens
gttgatagcacaga

SEQ ID NO: 1847319 - DNA, 19 bp, Homo sapiens
gttgatagcacagaccctg

SEQ ID NO: 1847320 - DNA, 18 bp, Homo sapiens
gttgccagtcaccccggc

SEQ ID NO: 1847321 - DNA, 12 bp, Homo sapiens
gttggctggcct

SEQ ID NO: 1847322 - DNA, 12 bp, Homo sapiens
gttgtcagctga

SEQ ID NO: 1847323 - DNA, 21 bp, Homo sapiens
gtttatgttccattaaacgat

SEQ ID NO: 1847324 - DNA, 22 bp, Homo sapiens
gtttatgttccattaaacgatt

SEQ ID NO: 1847325 - DNA, 17 bp, Homo sapiens
gtttctgtcctgctggt

SEQ ID NO: 1847326 - DNA, 18 bp, Homo sapiens
gtttgagatcagcctggg

SEQ ID NO: 1847327 - DNA, 16 bp, Homo sapiens
gtttgcagtcccaagc

SEQ ID NO: 1847328 - DNA, 18 bp, Homo sapiens
gtttgtttctgaaaggga

SEQ ID NO: 1847329 - DNA, 20 bp, Homo sapiens
gtttgtttctgaaagggacg

SEQ ID NO: 1847330 - DNA, 18 bp, Homo sapiens
gttttactgcagctttgt

SEQ ID NO: 1847331 - DNA, 13 bp, Homo sapiens
gttttatgacttc

SEQ ID NO: 1847332 - DNA, 19 bp, Homo sapiens
gttttccatgagtcccctg

SEQ ID NO: 1847333 - DNA, 18 bp, Homo sapiens
cctcccctctcagaacat

SEQ ID NO: 1847334 - DNA, 14 bp, Homo sapiens
cctcctcctggact

SEQ ID NO: 1847335 - DNA, 13 bp, Homo sapiens
cctcctggactcc

SEQ ID NO: 1847336 - DNA, 15 bp, Homo sapiens
cctcctgtctctggc

SEQ ID NO: 1847337 - DNA, 16 bp, Homo sapiens
cctcggtgccttcctc

SEQ ID NO: 1847338 - DNA, 14 bp, Homo sapiens
cctctcagaacata

SEQ ID NO: 1847339 - DNA, 12 bp, Homo sapiens
cctctcccctca

SEQ ID NO: 1847340 - DNA, 12 bp, Homo sapiens
catacccacccc

SEQ ID NO: 1847341 - DNA, 18 bp, Homo sapiens
catacccacccccaccca

SEQ ID NO: 1847342 - DNA, 15 bp, Homo sapiens
catactcccatctgt

SEQ ID NO: 1847343 - DNA, 15 bp, Homo sapiens
catactgattgggag

SEQ ID NO: 1847344 - DNA, 13 bp, Homo sapiens
catacttaacttt

SEQ ID NO: 1847345 - DNA, 14 bp, Homo sapiens
catacttaacttta

SEQ ID NO: 1847346 - DNA, 19 bp, Homo sapiens
catagagagcaagacgctg

SEQ ID NO: 1847347 - DNA, 15 bp, Homo sapiens
catatacaaataaac

SEQ ID NO: 1847348 - DNA, 14 bp, Homo sapiens
catattaacaaatt

SEQ ID NO: 1847349 - DNA, 20 bp, Homo sapiens
catattaacaaattgcattt

SEQ ID NO: 1847350 - DNA, 20 bp, Homo sapiens
catattcaggaagctcaggg

SEQ ID NO: 1847351 - DNA, 15 bp, Homo sapiens
ccaaccacagaggat

SEQ ID NO: 1847352 - DNA, 13 bp, Homo sapiens
ccaacgtctgtgc

SEQ ID NO: 1847353 - DNA, 15 bp, Homo sapiens
ccaacgtctgtgcca

SEQ ID NO: 1847354 - DNA, 21 bp, Homo sapiens
ccaactcaccccagccccaaa

SEQ ID NO: 1847355 - DNA, 19 bp, Homo sapiens
ccaacttcttcagagctga

SEQ ID NO: 1847356 - DNA, 20 bp, Homo sapiens
ccaagaagcccaggaaaggc

SEQ ID NO: 1847357 - DNA, 19 bp, Homo sapiens
ccaagcaaatgcctgccaa

SEQ ID NO: 1847358 - DNA, 21 bp, Homo sapiens
ccaagcactgtgctcagggct

SEQ ID NO: 1847359 - DNA, 15 bp, Homo sapiens
ccaagctcccaggca

SEQ ID NO: 1847360 - DNA, 18 bp, Homo sapiens
ccaaggaaaccacagctg

SEQ ID NO: 1847361 - DNA, 20 bp, Homo sapiens
ccaaggaaaccacagctgct

SEQ ID NO: 1847362 - DNA, 22 bp, Homo sapiens
ccaaggaaaccacagctgctgg

SEQ ID NO: 1847363 - DNA, 18 bp, Homo sapiens
ccaaggagtaagtacaaa

SEQ ID NO: 1847364 - DNA, 21 bp, Homo sapiens
ccaagggaaagaaaaggaagg

SEQ ID NO: 1847365 - DNA, 15 bp, Homo sapiens
ccaagggcctggcct

SEQ ID NO: 1847366 - DNA, 18 bp, Homo sapiens
ccaagggcctggcctgag

SEQ ID NO: 1847367 - DNA, 13 bp, Homo sapiens
ccaagggctgccg

SEQ ID NO: 1847368 - DNA, 20 bp, Homo sapiens
ccaagtcaagtgaaaaagga

SEQ ID NO: 1847369 - DNA, 14 bp, Homo sapiens
ccaagtggcagagc

SEQ ID NO: 1847370 - DNA, 14 bp, Homo sapiens
ccaataacacacag

SEQ ID NO: 1847371 - DNA, 16 bp, Homo sapiens
ccaataacacacagct

SEQ ID NO: 1847372 - DNA, 21 bp, Homo sapiens
ccaatatccaattttaaaatg

SEQ ID NO: 1847373 - DNA, 20 bp, Homo sapiens
ccaatgcactttgttctggc

SEQ ID NO: 1847374 - DNA, 22 bp, Homo sapiens
ccaattaaggattttatgcttt

SEQ ID NO: 1847375 - DNA, 21 bp, Homo sapiens
ccaattttaaaatgaaatgca

SEQ ID NO: 1847376 - DNA, 18 bp, Homo sapiens
ccacaaaggagagctagc

SEQ ID NO: 1847377 - DNA, 16 bp, Homo sapiens
ccacaagacccttgtg

SEQ ID NO: 1847378 - DNA, 14 bp, Homo sapiens
ccacactccagctg

SEQ ID NO: 1847379 - DNA, 23 bp, Homo sapiens
ccacagcgctggccgggaccccg

SEQ ID NO: 1847380 - DNA, 12 bp, Homo sapiens
ccacagctgctg

SEQ ID NO: 1847381 - DNA, 16 bp, Homo sapiens
ccacagctgctggaga

SEQ ID NO: 1847382 - DNA, 14 bp, Homo sapiens
ccacaggcttctga

SEQ ID NO: 1847383 - DNA, 14 bp, Homo sapiens
ccacagtgccaccc

SEQ ID NO: 1847384 - DNA, 18 bp, Homo sapiens
ccaccaacatactcccat

SEQ ID NO: 1847385 - DNA, 21 bp, Homo sapiens
ccaccaacatactcccatctg

SEQ ID NO: 1847386 - DNA, 20 bp, Homo sapiens
ccaccatcaagccaccaaca

SEQ ID NO: 1847387 - DNA, 17 bp, Homo sapiens
ccacccaagggcctggc

SEQ ID NO: 1847388 - DNA, 22 bp, Homo sapiens
ccacccaagggcctggcctgag

SEQ ID NO: 1847389 - DNA, 17 bp, Homo sapiens
ccacccccacccaaggg

SEQ ID NO: 1847390 - DNA, 19 bp, Homo sapiens
ccacccccacccaagggcc

SEQ ID NO: 1847391 - DNA, 14 bp, Homo sapiens
ccacctctctcact

SEQ ID NO: 1847392 - DNA, 16 bp, Homo sapiens
ccacctctctcactcc

SEQ ID NO: 1847393 - DNA, 19 bp, Homo sapiens
ccacctctctcactccttg

SEQ ID NO: 1847394 - DNA, 12 bp, Homo sapiens
ccacctgccagg

SEQ ID NO: 1847395 - DNA, 15 bp, Homo sapiens
ccacctgccagggac

SEQ ID NO: 1847396 - DNA, 16 bp, Homo sapiens
ccacctgccagggaca

SEQ ID NO: 1847397 - DNA, 13 bp, Homo sapiens
ccacctggcctct

SEQ ID NO: 1847398 - DNA, 17 bp, Homo sapiens
ccacctggcctctgcac

SEQ ID NO: 1847399 - DNA, 14 bp, Homo sapiens
ccaccttgcgggga

SEQ ID NO: 1847400 - DNA, 15 bp, Homo sapiens
ccactcccaggcagc

SEQ ID NO: 1847401 - DNA, 12 bp, Homo sapiens
ccactccctgca

SEQ ID NO: 1847402 - DNA, 15 bp, Homo sapiens
ccactccctgcaacc

SEQ ID NO: 1847403 - DNA, 23 bp, Homo sapiens
ccactgcatcgtttcatcttcca

SEQ ID NO: 1847404 - DNA, 14 bp, Homo sapiens
ccactgcctttgac

SEQ ID NO: 1847405 - DNA, 14 bp, Homo sapiens
ccactgtgaagaga

SEQ ID NO: 1847406 - DNA, 14 bp, Homo sapiens
ccacttcagctgac

SEQ ID NO: 1847407 - DNA, 18 bp, Homo sapiens
ccacttggcatcagctgg

SEQ ID NO: 1847408 - DNA, 19 bp, Homo sapiens
ccactttgaagggcaagaa

SEQ ID NO: 1847409 - DNA, 19 bp, Homo sapiens
ccagaaacacccctctgtc

SEQ ID NO: 1847410 - DNA, 20 bp, Homo sapiens
ccagaaacacccctctgtct

SEQ ID NO: 1847411 - DNA, 16 bp, Homo sapiens
ccagaaccaattattt

SEQ ID NO: 1847412 - DNA, 15 bp, Homo sapiens
ccagaccttctagga

SEQ ID NO: 1847413 - DNA, 21 bp, Homo sapiens
ccagagagcctggtgctgctg

SEQ ID NO: 1847414 - DNA, 22 bp, Homo sapiens
ccagagagcctggtgctgctgc

SEQ ID NO: 1847415 - DNA, 15 bp, Homo sapiens
ccagagggcctgcaa

SEQ ID NO: 1847416 - DNA, 11 bp, Homo sapiens
ccagaggtgga

SEQ ID NO: 1847417 - DNA, 14 bp, Homo sapiens
ccagaggtggatgt

SEQ ID NO: 1847418 - DNA, 13 bp, Homo sapiens
ccagattctgatg

SEQ ID NO: 1847419 - DNA, 18 bp, Homo sapiens
ccagattctttcctgagg

SEQ ID NO: 1847420 - DNA, 22 bp, Homo sapiens
ccagattctttcctgaggctgg

SEQ ID NO: 1847421 - DNA, 23 bp, Homo sapiens
ccagattctttcctgaggctggg

SEQ ID NO: 1847422 - DNA, 13 bp, Homo sapiens
ccagcagagcacc

SEQ ID NO: 1847423 - DNA, 19 bp, Homo sapiens
ccagcagcctggaccctgt

SEQ ID NO: 1847424 - DNA, 18 bp, Homo sapiens
ccagcatcccttgaccag

SEQ ID NO: 1847425 - DNA, 21 bp, Homo sapiens
ccagcatcccttgaccaggcc

SEQ ID NO: 1847426 - DNA, 13 bp, Homo sapiens
ccagccagggctg

SEQ ID NO: 1847427 - DNA, 15 bp, Homo sapiens
ccagccagggctgct

SEQ ID NO: 1847428 - DNA, 15 bp, Homo sapiens
ccagccccatcctct

SEQ ID NO: 1847429 - DNA, 17 bp, Homo sapiens
ccagccccatcctctgt

SEQ ID NO: 1847430 - DNA, 17 bp, Homo sapiens
ccagccccttctgaccc

SEQ ID NO: 1847431 - DNA, 16 bp, Homo sapiens
ccagcccgaacaccat

SEQ ID NO: 1847432 - DNA, 17 bp, Homo sapiens
ccagcccgaacaccatt

SEQ ID NO: 1847433 - DNA, 20 bp, Homo sapiens
ccagcctggagatgaaatct

SEQ ID NO: 1847434 - DNA, 13 bp, Homo sapiens
ccagcctgggtga

SEQ ID NO: 1847435 - DNA, 12 bp, Homo sapiens
ccagctcagcac

SEQ ID NO: 1847436 - DNA, 15 bp, Homo sapiens
ccagctcagcactgc

SEQ ID NO: 1847437 - DNA, 12 bp, Homo sapiens
ccagctcctcat

SEQ ID NO: 1847438 - DNA, 13 bp, Homo sapiens
ccagctctctgac

SEQ ID NO: 1847439 - DNA, 11 bp, Homo sapiens
ccagctctggt

SEQ ID NO: 1847440 - DNA, 12 bp, Homo sapiens
ccagctctggtc

SEQ ID NO: 1847441 - DNA, 13 bp, Homo sapiens
ccagctctggtcc

SEQ ID NO: 1847442 - DNA, 14 bp, Homo sapiens
ccagctctggtcca

SEQ ID NO: 1847443 - DNA, 15 bp, Homo sapiens
ccagctgccgcacca

SEQ ID NO: 1847444 - DNA, 17 bp, Homo sapiens
ccagctgccgcaccagc

SEQ ID NO: 1847445 - DNA, 18 bp, Homo sapiens
ccagctgccgcaccagcc

SEQ ID NO: 1847446 - DNA, 14 bp, Homo sapiens
ccaggaaaggctcc

SEQ ID NO: 1847447 - DNA, 15 bp, Homo sapiens
ccaggaaaggctcca

SEQ ID NO: 1847448 - DNA, 16 bp, Homo sapiens
ccaggaaaggctccag

SEQ ID NO: 1847449 - DNA, 22 bp, Homo sapiens
ccaggaaaggctccaggagcag

SEQ ID NO: 1847450 - DNA, 16 bp, Homo sapiens
ccaggactagagcaca

SEQ ID NO: 1847451 - DNA, 18 bp, Homo sapiens
ccaggagcacggctctgt

SEQ ID NO: 1847452 - DNA, 19 bp, Homo sapiens
ccaggagcacggctctgtc

SEQ ID NO: 1847453 - DNA, 14 bp, Homo sapiens
ccaggagcagccac

SEQ ID NO: 1847454 - DNA, 15 bp, Homo sapiens
ccaggaggccagcct

SEQ ID NO: 1847455 - DNA, 21 bp, Homo sapiens
ccaggagtgtggccacgtggg

SEQ ID NO: 1847456 - DNA, 14 bp, Homo sapiens
ccaggcattcccca

SEQ ID NO: 1847457 - DNA, 17 bp, Homo sapiens
ccaggcattccccagga

SEQ ID NO: 1847458 - DNA, 18 bp, Homo sapiens
ccaggcattccccaggag

SEQ ID NO: 1847459 - DNA, 23 bp, Homo sapiens
ccaggcattccccaggaggccag

SEQ ID NO: 1847460 - DNA, 15 bp, Homo sapiens
ccaggccctctgccc

SEQ ID NO: 1847461 - DNA, 18 bp, Homo sapiens
ccaggccctctgcccact

SEQ ID NO: 1847462 - DNA, 14 bp, Homo sapiens
ccaggctgggagag

SEQ ID NO: 1847463 - DNA, 15 bp, Homo sapiens
ccaggctgggagagc

SEQ ID NO: 1847464 - DNA, 23 bp, Homo sapiens
ccaggctgggagagccttccagg

SEQ ID NO: 1847465 - DNA, 18 bp, Homo sapiens
ccaggctgggcaaggagg

SEQ ID NO: 1847466 - DNA, 17 bp, Homo sapiens
ccaggcttagtcactga

SEQ ID NO: 1847467 - DNA, 15 bp, Homo sapiens
ccagggacagagggg

SEQ ID NO: 1847468 - DNA, 16 bp, Homo sapiens
ccagggccccggggcc

SEQ ID NO: 1847469 - DNA, 17 bp, Homo sapiens
ccagggcctggaagaca

SEQ ID NO: 1847470 - DNA, 21 bp, Homo sapiens
ccagggcctggaagacagaga

SEQ ID NO: 1847471 - DNA, 14 bp, Homo sapiens
atctcaattcttcc

SEQ ID NO: 1847472 - DNA, 16 bp, Homo sapiens
atctcacacatgagca

SEQ ID NO: 1847473 - DNA, 12 bp, Homo sapiens
atctcccccagc

SEQ ID NO: 1847474 - DNA, 19 bp, Homo sapiens
atctctcaggaatcatctc

SEQ ID NO: 1847475 - DNA, 16 bp, Homo sapiens
atctctccaccttcca

SEQ ID NO: 1847476 - DNA, 17 bp, Homo sapiens
atctctccaccttccaa

SEQ ID NO: 1847477 - DNA, 19 bp, Homo sapiens
atctctccaccttccaaag

SEQ ID NO: 1847478 - DNA, 21 bp, Homo sapiens
atctctgcaatcttctcagaa

SEQ ID NO: 1847479 - DNA, 17 bp, Homo sapiens
atctgatggcttctcca

SEQ ID NO: 1847480 - DNA, 21 bp, Homo sapiens
atctgctgaggcccagtgcat

SEQ ID NO: 1847481 - DNA, 18 bp, Homo sapiens
atctggaaccatcagaaa

SEQ ID NO: 1847482 - DNA, 23 bp, Homo sapiens
atctggccgttgatgttggctgg

SEQ ID NO: 1847483 - DNA, 22 bp, Homo sapiens
atctgggctcctaaccttcctg

SEQ ID NO: 1847484 - DNA, 10 bp, Homo sapiens
atctggtgac

SEQ ID NO: 1847485 - DNA, 16 bp, Homo sapiens
atctggtgactttcct

SEQ ID NO: 1847486 - DNA, 17 bp, Homo sapiens
atctgtgaaaggaaaga

SEQ ID NO: 1847487 - DNA, 13 bp, Homo sapiens
atctgtttcccag

SEQ ID NO: 1847488 - DNA, 14 bp, Homo sapiens
atctgtttcccagc

SEQ ID NO: 1847489 - DNA, 22 bp, Homo sapiens
atcttaattctttgttctgttt

SEQ ID NO: 1847490 - DNA, 19 bp, Homo sapiens
atcttccaactcaaactct

SEQ ID NO: 1847491 - DNA, 17 bp, Homo sapiens
atcttgccggtcatttt

SEQ ID NO: 1847492 - DNA, 22 bp, Homo sapiens
atctttcattttgcacctgcag

SEQ ID NO: 1847493 - DNA, 14 bp, Homo sapiens
atgaaatgcatttt

SEQ ID NO: 1847494 - DNA, 17 bp, Homo sapiens
atgaaatgcattttgct

SEQ ID NO: 1847495 - DNA, 17 bp, Homo sapiens
atgaacagctgtgtctg

SEQ ID NO: 1847496 - DNA, 11 bp, Homo sapiens
atgaagaggag

SEQ ID NO: 1847497 - DNA, 13 bp, Homo sapiens
atgaagcaggagg

SEQ ID NO: 1847498 - DNA, 14 bp, Homo sapiens
atgaatgaatgaat

SEQ ID NO: 1847499 - DNA, 17 bp, Homo sapiens
atgacattcatgcctgg

SEQ ID NO: 1847500 - DNA, 22 bp, Homo sapiens
atgacccaggctgggcaaggag

SEQ ID NO: 1847501 - DNA, 17 bp, Homo sapiens
atgactgtagaatttgt

SEQ ID NO: 1847502 - DNA, 16 bp, Homo sapiens
atgacttcattaataa

SEQ ID NO: 1847503 - DNA, 16 bp, Homo sapiens
caccatcaagccacca

SEQ ID NO: 1847504 - DNA, 24 bp, Homo sapiens
caccatcaagccaccaacatactc

SEQ ID NO: 1847505 - DNA, 15 bp, Homo sapiens
cacccaagggcctgg

SEQ ID NO: 1847506 - DNA, 20 bp, Homo sapiens
cacccacctgttttctgaaa

SEQ ID NO: 1847507 - DNA, 22 bp, Homo sapiens
cacccacctgttttctgaaaca

SEQ ID NO: 1847508 - DNA, 14 bp, Homo sapiens
cacccatgcagctg

SEQ ID NO: 1847509 - DNA, 19 bp, Homo sapiens
cacccatgcagctgctccc

SEQ ID NO: 1847510 - DNA, 13 bp, Homo sapiens
caccccagcccca

SEQ ID NO: 1847511 - DNA, 12 bp, Homo sapiens
caccctcacact

SEQ ID NO: 1847512 - DNA, 21 bp, Homo sapiens
caccctcatgctgtgtgactc

SEQ ID NO: 1847513 - DNA, 17 bp, Homo sapiens
caccctgaaagccctga

SEQ ID NO: 1847514 - DNA, 12 bp, Homo sapiens
caccctgtgatg

SEQ ID NO: 1847515 - DNA, 15 bp, Homo sapiens
caccctgtgatgggg

SEQ ID NO: 1847516 - DNA, 20 bp, Homo sapiens
caccctgtgatggggccctg

SEQ ID NO: 1847517 - DNA, 21 bp, Homo sapiens
caccctgtgatggggccctgc

SEQ ID NO: 1847518 - DNA, 22 bp, Homo sapiens
caccctgtgatggggccctgcc

SEQ ID NO: 1847519 - DNA, 23 bp, Homo sapiens
caccctgtgatggggccctgcct

SEQ ID NO: 1847520 - DNA, 12 bp, Homo sapiens
caccgcagacag

SEQ ID NO: 1847521 - DNA, 18 bp, Homo sapiens
caccgcagacaggaccag

SEQ ID NO: 1847522 - DNA, 17 bp, Homo sapiens
caccggctggcctggcc

SEQ ID NO: 1847523 - DNA, 18 bp, Homo sapiens
caccggctggcctggccc

SEQ ID NO: 1847524 - DNA, 20 bp, Homo sapiens
caccggctggcctggcccct

SEQ ID NO: 1847525 - DNA, 16 bp, Homo sapiens
cacctagaattggctg

SEQ ID NO: 1847526 - DNA, 14 bp, Homo sapiens
cacctagctgaatg

SEQ ID NO: 1847527 - DNA, 18 bp, Homo sapiens
cacctagctgaatgtttt

SEQ ID NO: 1847528 - DNA, 19 bp, Homo sapiens
cacctagctgaatgttttt

SEQ ID NO: 1847529 - DNA, 21 bp, Homo sapiens
cacctagctgaatgtttttct

SEQ ID NO: 1847530 - DNA, 22 bp, Homo sapiens
cacctcagagtatggagctcag

SEQ ID NO: 1847531 - DNA, 19 bp, Homo sapiens
cacctctctcactccttga

SEQ ID NO: 1847532 - DNA, 12 bp, Homo sapiens
cacctctttaaa

SEQ ID NO: 1847533 - DNA, 18 bp, Homo sapiens
cacctctttaaaaactca

SEQ ID NO: 1847534 - DNA, 19 bp, Homo sapiens
cacctctttgtgttttatt

SEQ ID NO: 1847535 - DNA, 14 bp, Homo sapiens
cacctgcagccaag

SEQ ID NO: 1847536 - DNA, 14 bp, Homo sapiens
cacctgccagggac

SEQ ID NO: 1847537 - DNA, 17 bp, Homo sapiens
cacctgccagggacaga

SEQ ID NO: 1847538 - DNA, 12 bp, Homo sapiens
cacctggcctct

SEQ ID NO: 1847539 - DNA, 14 bp, Homo sapiens
cacctggcctctgc

SEQ ID NO: 1847540 - DNA, 19 bp, Homo sapiens
cacctggcctctgcactcc

SEQ ID NO: 1847541 - DNA, 14 bp, Homo sapiens
cacctggggctgct

SEQ ID NO: 1847542 - DNA, 15 bp, Homo sapiens
cacctggggctgctg

SEQ ID NO: 1847543 - DNA, 21 bp, Homo sapiens
cacctgttttctgaaacacac

SEQ ID NO: 1847544 - DNA, 14 bp, Homo sapiens
caccttagacagtc

SEQ ID NO: 1847545 - DNA, 16 bp, Homo sapiens
caccttagacagtccc

SEQ ID NO: 1847546 - DNA, 19 bp, Homo sapiens
caccttagacagtccctgc

SEQ ID NO: 1847547 - DNA, 10 bp, Homo sapiens
caccttccaa

SEQ ID NO: 1847548 - DNA, 22 bp, Homo sapiens
caccttgaagaacctctcactt

SEQ ID NO: 1847549 - DNA, 15 bp, Homo sapiens
cacctttgtccccac

SEQ ID NO: 1847550 - DNA, 16 bp, Homo sapiens
cacgactgcccggcag

SEQ ID NO: 1847551 - DNA, 14 bp, Homo sapiens
cacgagcaaaccca

SEQ ID NO: 1847552 - DNA, 17 bp, Homo sapiens
cacgagcaaacccagag

SEQ ID NO: 1847553 - DNA, 19 bp, Homo sapiens
cacgccagattctttcctg

SEQ ID NO: 1847554 - DNA, 15 bp, Homo sapiens
cacgcccccactggt

SEQ ID NO: 1847555 - DNA, 17 bp, Homo sapiens
cacgcccccactggtga

SEQ ID NO: 1847556 - DNA, 20 bp, Homo sapiens
cacgcctgtaatcctagcac

SEQ ID NO: 1847557 - DNA, 13 bp, Homo sapiens
cacggccacagtc

SEQ ID NO: 1847558 - DNA, 17 bp, Homo sapiens
cacggctctgtccccag

SEQ ID NO: 1847559 - DNA, 21 bp, Homo sapiens
cacggctctgtccccagcctg

SEQ ID NO: 1847560 - DNA, 18 bp, Homo sapiens
cacggtttgaagcctgga

SEQ ID NO: 1847561 - DNA, 19 bp, Homo sapiens
cacggtttgaagcctggaa

SEQ ID NO: 1847562 - DNA, 13 bp, Homo sapiens
cacgtgacagccg

SEQ ID NO: 1847563 - DNA, 19 bp, Homo sapiens
cactcaaaagctgggcagg

SEQ ID NO: 1847564 - DNA, 19 bp, Homo sapiens
cactcaagaagcaggctac

SEQ ID NO: 1847565 - DNA, 20 bp, Homo sapiens
cactcattgacctgaggccc

SEQ ID NO: 1847566 - DNA, 17 bp, Homo sapiens
cactccaattaaggatt

SEQ ID NO: 1847567 - DNA, 18 bp, Homo sapiens
cactccaattaaggattt

SEQ ID NO: 1847568 - DNA, 22 bp, Homo sapiens
cactccaattaaggattttatg

SEQ ID NO: 1847569 - DNA, 16 bp, Homo sapiens
cactccagcctgggtg

SEQ ID NO: 1847570 - DNA, 12 bp, Homo sapiens
cactccagctgg

SEQ ID NO: 1847571 - DNA, 15 bp, Homo sapiens
cactccagctgggat

SEQ ID NO: 1847572 - DNA, 13 bp, Homo sapiens
cactcccaggcag

SEQ ID NO: 1847573 - DNA, 16 bp, Homo sapiens
cactccctgcaacctg

SEQ ID NO: 1847574 - DNA, 20 bp, Homo sapiens
cactcgtgtgcaacagacaa

SEQ ID NO: 1847575 - DNA, 21 bp, Homo sapiens
cactctggcagctcagagagg

SEQ ID NO: 1847576 - DNA, 23 bp, Homo sapiens
cactctggcagctcagagagggt

SEQ ID NO: 1847577 - DNA, 13 bp, Homo sapiens
cactgacactggt

SEQ ID NO: 1847578 - DNA, 17 bp, Homo sapiens
cactgagacagcccggg

SEQ ID NO: 1847579 - DNA, 22 bp, Homo sapiens
cactgagacagcccgggctctg

SEQ ID NO: 1847580 - DNA, 15 bp, Homo sapiens
cactgcactccagcc

SEQ ID NO: 1847581 - DNA, 16 bp, Homo sapiens
cactgcactccagcct

SEQ ID NO: 1847582 - DNA, 18 bp, Homo sapiens
cactgcactccagcctgg

SEQ ID NO: 1847583 - DNA, 20 bp, Homo sapiens
cactgcactccagcctgggt

SEQ ID NO: 1847584 - DNA, 19 bp, Homo sapiens
cactgcctgctcccatcct

SEQ ID NO: 1847585 - DNA, 12 bp, Homo sapiens
cactgcctttga

SEQ ID NO: 1847586 - DNA, 20 bp, Homo sapiens
cactgctctgatgaagagga

SEQ ID NO: 1847587 - DNA, 19 bp, Homo sapiens
cactggaactcagtgtgac

SEQ ID NO: 1847588 - DNA, 15 bp, Homo sapiens
cactggatgcagaaa

SEQ ID NO: 1847589 - DNA, 17 bp, Homo sapiens
cactgggacttgcaaaa

SEQ ID NO: 1847590 - DNA, 20 bp, Homo sapiens
cactggtattcctgcctcca

SEQ ID NO: 1847591 - DNA, 21 bp, Homo sapiens
cactgtgctgagtctgaaggc

SEQ ID NO: 1847592 - DNA, 20 bp, Homo sapiens
cactgtggcctgatcagcag

SEQ ID NO: 1847593 - DNA, 13 bp, Homo sapiens
cactgttctctgc

SEQ ID NO: 1847594 - DNA, 15 bp, Homo sapiens
cactgttctctgccc

SEQ ID NO: 1847595 - DNA, 21 bp, Homo sapiens
cactgttctctgccctccaag

SEQ ID NO: 1847596 - DNA, 22 bp, Homo sapiens
cactgttctctgccctccaaga

SEQ ID NO: 1847597 - DNA, 22 bp, Homo sapiens
cacttatatgttctaattaata

SEQ ID NO: 1847598 - DNA, 12 bp, Homo sapiens
cacttcagctga

SEQ ID NO: 1847599 - DNA, 17 bp, Homo sapiens
cacttgagaattaccct

SEQ ID NO: 1847600 - DNA, 13 bp, Homo sapiens
cacttgagtccag

SEQ ID NO: 1847601 - DNA, 22 bp, Homo sapiens
cacttggcccaagtggcagagc

SEQ ID NO: 1847602 - DNA, 20 bp, Homo sapiens
cacttgtcaggagtgtgtgt

SEQ ID NO: 1847603 - DNA, 18 bp, Homo sapiens
cacttgtgccaacactca

SEQ ID NO: 1847604 - DNA, 24 bp, Homo sapiens
cacttgtgccaacactcaagaagc

SEQ ID NO: 1847605 - DNA, 21 bp, Homo sapiens
cactttgaaaagttggaagga

SEQ ID NO: 1847606 - DNA, 12 bp, Homo sapiens
cactttgcttta

SEQ ID NO: 1847607 - DNA, 18 bp, Homo sapiens
cactttgctttaatataa

SEQ ID NO: 1847608 - DNA, 19 bp, Homo sapiens
cactttgctttaatataaa

SEQ ID NO: 1847609 - DNA, 13 bp, Homo sapiens
cactttgggaggc

SEQ ID NO: 1847610 - DNA, 13 bp, Homo sapiens
cactttgttctgg

SEQ ID NO: 1847611 - DNA, 14 bp, Homo sapiens
cactttgttctggc

SEQ ID NO: 1847612 - DNA, 19 bp, Homo sapiens
cactttttttttttttccc

SEQ ID NO: 1847613 - DNA, 17 bp, Homo sapiens
cagaaacacccctctgt

SEQ ID NO: 1847614 - DNA, 15 bp, Homo sapiens
cagaacacataattc

SEQ ID NO: 1847615 - DNA, 18 bp, Homo sapiens
cagaacctgcacacagga

SEQ ID NO: 1847616 - DNA, 13 bp, Homo sapiens
cagaagcagctct

SEQ ID NO: 1847617 - DNA, 20 bp, Homo sapiens
cagaagtttgagatcagcct

SEQ ID NO: 1847618 - DNA, 22 bp, Homo sapiens
cagaagtttgagatcagcctgg

SEQ ID NO: 1847619 - DNA, 20 bp, Homo sapiens
cagaatggaatgctctggtc

SEQ ID NO: 1847620 - DNA, 14 bp, Homo sapiens
cagacacatgtcca

SEQ ID NO: 1847621 - DNA, 17 bp, Homo sapiens
cagacacatgtccaaga

SEQ ID NO: 1847622 - DNA, 14 bp, Homo sapiens
cagacagctgcctg

SEQ ID NO: 1847623 - DNA, 16 bp, Homo sapiens
cagacagctgcctggg

SEQ ID NO: 1847624 - DNA, 16 bp, Homo sapiens
cagacaggaccaggga

SEQ ID NO: 1847625 - DNA, 20 bp, Homo sapiens
caggagcagcctcagaacaa

SEQ ID NO: 1847626 - DNA, 23 bp, Homo sapiens
caggatggccgggcgcggtggct

SEQ ID NO: 1847627 - DNA, 15 bp, Homo sapiens
caggatggcctggcc

SEQ ID NO: 1847628 - DNA, 16 bp, Homo sapiens
caggatggcctggcca

SEQ ID NO: 1847629 - DNA, 18 bp, Homo sapiens
caggattcttcctccctc

SEQ ID NO: 1847630 - DNA, 13 bp, Homo sapiens
caggcagcaccac

SEQ ID NO: 1847631 - DNA, 15 bp, Homo sapiens
caggcagcaccacac

SEQ ID NO: 1847632 - DNA, 11 bp, Homo sapiens
caggcagcaga

SEQ ID NO: 1847633 - DNA, 16 bp, Homo sapiens
caggcagccaggccac

SEQ ID NO: 1847634 - DNA, 12 bp, Homo sapiens
caggcagcccta

SEQ ID NO: 1847635 - DNA, 17 bp, Homo sapiens
caggcagttggccagag

SEQ ID NO: 1847636 - DNA, 12 bp, Homo sapiens
caggcatgaagt

SEQ ID NO: 1847637 - DNA, 13 bp, Homo sapiens
caggcattcccca

SEQ ID NO: 1847638 - DNA, 17 bp, Homo sapiens
caggcattccccaggag

SEQ ID NO: 1847639 - DNA, 20 bp, Homo sapiens
caggcattccccaggaggcc

SEQ ID NO: 1847640 - DNA, 21 bp, Homo sapiens
caggcattccccaggaggcca

SEQ ID NO: 1847641 - DNA, 13 bp, Homo sapiens
caggccacaagac

SEQ ID NO: 1847642 - DNA, 11 bp, Homo sapiens
caggccaggcc

SEQ ID NO: 1847643 - DNA, 15 bp, Homo sapiens
caggccaggccctct

SEQ ID NO: 1847644 - DNA, 17 bp, Homo sapiens
caggccaggccctctgc

SEQ ID NO: 1847645 - DNA, 18 bp, Homo sapiens
caggccaggccctctgcc

SEQ ID NO: 1847646 - DNA, 19 bp, Homo sapiens
caggccaggccctctgccc

SEQ ID NO: 1847647 - DNA, 20 bp, Homo sapiens
caggccaggccctctgccca

SEQ ID NO: 1847648 - DNA, 16 bp, Homo sapiens
caggcccctctcctcc

SEQ ID NO: 1847649 - DNA, 18 bp, Homo sapiens
caggcccctctcctccgt

SEQ ID NO: 1847650 - DNA, 19 bp, Homo sapiens
caggccctctgcccactcc

SEQ ID NO: 1847651 - DNA, 17 bp, Homo sapiens
caggcctgggccagagt

SEQ ID NO: 1847652 - DNA, 16 bp, Homo sapiens
caggcgtgacctgaca

SEQ ID NO: 1847653 - DNA, 19 bp, Homo sapiens
caggctaaggcgtggagct

SEQ ID NO: 1847654 - DNA, 13 bp, Homo sapiens
caggctacactga

SEQ ID NO: 1847655 - DNA, 15 bp, Homo sapiens
caggctccaaactgg

SEQ ID NO: 1847656 - DNA, 16 bp, Homo sapiens
caggctgggagagcct

SEQ ID NO: 1847657 - DNA, 20 bp, Homo sapiens
caggctgggagagccttcca

SEQ ID NO: 1847658 - DNA, 23 bp, Homo sapiens
caggctgggagagccttccaggg

SEQ ID NO: 1847659 - DNA, 18 bp, Homo sapiens
caggctgggcaaggaggc

SEQ ID NO: 1847660 - DNA, 14 bp, Homo sapiens
caggctgtgagttt

SEQ ID NO: 1847661 - DNA, 20 bp, Homo sapiens
caggcttagtcactgagaca

SEQ ID NO: 1847662 - DNA, 23 bp, Homo sapiens
cagggaatgcctgagtgcctggc

SEQ ID NO: 1847663 - DNA, 21 bp, Homo sapiens
cagggatgagcatggagctgg

SEQ ID NO: 1847664 - DNA, 15 bp, Homo sapiens
cagggcaaggccatt

SEQ ID NO: 1847665 - DNA, 15 bp, Homo sapiens
cagggccatgcagac

SEQ ID NO: 1847666 - DNA, 12 bp, Homo sapiens
cagggcctggaa

SEQ ID NO: 1847667 - DNA, 18 bp, Homo sapiens
cagggcctggaagacaga

SEQ ID NO: 1847668 - DNA, 13 bp, Homo sapiens
cagggcctggctc

SEQ ID NO: 1847669 - DNA, 14 bp, Homo sapiens
cagggcctggctca

SEQ ID NO: 1847670 - DNA, 15 bp, Homo sapiens
cagggcctggctcag

SEQ ID NO: 1847671 - DNA, 22 bp, Homo sapiens
cagggcctggctgggagtggca

SEQ ID NO: 1847672 - DNA, 19 bp, Homo sapiens
caggggaaaatcagcctgc

SEQ ID NO: 1847673 - DNA, 21 bp, Homo sapiens
cagggtattccagagtgggga

SEQ ID NO: 1847674 - DNA, 12 bp, Homo sapiens
cagggtccctgg

SEQ ID NO: 1847675 - DNA, 18 bp, Homo sapiens
cagggtcctgtagcccta

SEQ ID NO: 1847676 - DNA, 16 bp, Homo sapiens
cagggtctctgctgcc

SEQ ID NO: 1847677 - DNA, 18 bp, Homo sapiens
cagggtctctgctgccgc

SEQ ID NO: 1847678 - DNA, 19 bp, Homo sapiens
cagggtctctgctgccgcc

SEQ ID NO: 1847679 - DNA, 16 bp, Homo sapiens
caggtcccctttcaga

SEQ ID NO: 1847680 - DNA, 13 bp, Homo sapiens
caggtgagaagca

SEQ ID NO: 1847681 - DNA, 20 bp, Homo sapiens
caggtgagaagcagaggaag

SEQ ID NO: 1847682 - DNA, 15 bp, Homo sapiens
caggtgcacaagctc

SEQ ID NO: 1847683 - DNA, 18 bp, Homo sapiens
caggtgcagcccccactg

SEQ ID NO: 1847684 - DNA, 23 bp, Homo sapiens
caggtgccgccagctgccgcacc

SEQ ID NO: 1847685 - DNA, 20 bp, Homo sapiens
caggtgctaggaacactcct

SEQ ID NO: 1847686 - DNA, 22 bp, Homo sapiens
caggtgggcttcccagtggctg

SEQ ID NO: 1847687 - DNA, 23 bp, Homo sapiens
caggtgggcttcccagtggctgc

SEQ ID NO: 1847688 - DNA, 21 bp, Homo sapiens
caggtggggtcactctggcag

SEQ ID NO: 1847689 - DNA, 23 bp, Homo sapiens
caggtggggtcactctggcagct

SEQ ID NO: 1847690 - DNA, 13 bp, Homo sapiens
caggttcaggtcc

SEQ ID NO: 1847691 - DNA, 21 bp, Homo sapiens
caggttggtgggggcctcggt

SEQ ID NO: 1847692 - DNA, 14 bp, Homo sapiens
cagtaaacttttaa

SEQ ID NO: 1847693 - DNA, 17 bp, Homo sapiens
cagtaacatttctgttc

SEQ ID NO: 1847694 - DNA, 15 bp, Homo sapiens
cagtatctcagggcc

SEQ ID NO: 1847695 - DNA, 20 bp, Homo sapiens
cagtattgaagcattttata

SEQ ID NO: 1847696 - DNA, 15 bp, Homo sapiens
cagtattgctcaccc

SEQ ID NO: 1847697 - DNA, 12 bp, Homo sapiens
cagtcatcattt

SEQ ID NO: 1847698 - DNA, 15 bp, Homo sapiens
cagtcatcatttatc

SEQ ID NO: 1847699 - DNA, 20 bp, Homo sapiens
cagtcatggtggccacggcc

SEQ ID NO: 1847700 - DNA, 16 bp, Homo sapiens
cagtccagcctggaga

SEQ ID NO: 1847701 - DNA, 14 bp, Homo sapiens
cagtccccttccct

SEQ ID NO: 1847702 - DNA, 14 bp, Homo sapiens
cagtccctgccaat

SEQ ID NO: 1847703 - DNA, 16 bp, Homo sapiens
cagtcctcccatctca

SEQ ID NO: 1847704 - DNA, 15 bp, Homo sapiens
cagtcttgcagcagg

SEQ ID NO: 1847705 - DNA, 24 bp, Homo sapiens
cagtgagccgagattgcaccactg

SEQ ID NO: 1847706 - DNA, 12 bp, Homo sapiens
cagtgaggctct

SEQ ID NO: 1847707 - DNA, 16 bp, Homo sapiens
cagtgaggctctgccc

SEQ ID NO: 1847708 - DNA, 18 bp, Homo sapiens
cagtgaggctctgccctt

SEQ ID NO: 1847709 - DNA, 21 bp, Homo sapiens
cagtgaggctctgcccttggt

SEQ ID NO: 1847710 - DNA, 12 bp, Homo sapiens
cagtgcaggcac

SEQ ID NO: 1847711 - DNA, 14 bp, Homo sapiens
cagtgccacccatg

SEQ ID NO: 1847712 - DNA, 22 bp, Homo sapiens
cagtgcctcttccagtgaacat

SEQ ID NO: 1847713 - DNA, 14 bp, Homo sapiens
cagtgcttgccaca

SEQ ID NO: 1847714 - DNA, 18 bp, Homo sapiens
cagtgcttgccacagagc

SEQ ID NO: 1847715 - DNA, 22 bp, Homo sapiens
cagtggccaagatcacagtggc

SEQ ID NO: 1847716 - DNA, 13 bp, Homo sapiens
cagtggctgctgc

SEQ ID NO: 1847717 - DNA, 13 bp, Homo sapiens
cagtgtggagttc

SEQ ID NO: 1847718 - DNA, 22 bp, Homo sapiens
cagtgtggagttcaccttggaa

SEQ ID NO: 1847719 - DNA, 21 bp, Homo sapiens
cagtgtgtggtcaacatttct

SEQ ID NO: 1847720 - DNA, 14 bp, Homo sapiens
cagttaagcctttg

SEQ ID NO: 1847721 - DNA, 17 bp, Homo sapiens
cagttaagcctttggaa

SEQ ID NO: 1847722 - DNA, 19 bp, Homo sapiens
cagttcctgagaccagcca

SEQ ID NO: 1847723 - DNA, 12 bp, Homo sapiens
cagttgaaaaac

SEQ ID NO: 1847724 - DNA, 18 bp, Homo sapiens
cagttgaaaaacagctga

SEQ ID NO: 1847725 - DNA, 16 bp, Homo sapiens
cagttggccagagagc

SEQ ID NO: 1847726 - DNA, 17 bp, Homo sapiens
cagttggccagagagcc

SEQ ID NO: 1847727 - DNA, 21 bp, Homo sapiens
cagttggtcccccttccatgg

SEQ ID NO: 1847728 - DNA, 22 bp, Homo sapiens
cagttggtcccccttccatgga

SEQ ID NO: 1847729 - DNA, 19 bp, Homo sapiens
cagttgttatttattgaaa

SEQ ID NO: 1847730 - DNA, 19 bp, Homo sapiens
cagtttctgtcctgctggt

SEQ ID NO: 1847731 - DNA, 15 bp, Homo sapiens
cagtttgagacagga

SEQ ID NO: 1847732 - DNA, 21 bp, Homo sapiens
cataaaaattagccaagtgtg

SEQ ID NO: 1847733 - DNA, 22 bp, Homo sapiens
cataagagtaacagtcatcatt

SEQ ID NO: 1847734 - DNA, 17 bp, Homo sapiens
cataaggaaactgggtt

SEQ ID NO: 1847735 - DNA, 22 bp, Homo sapiens
aagctcccaggcattccccagg

SEQ ID NO: 1847736 - DNA, 24 bp, Homo sapiens
aagctgagatgaaccctggcattt

SEQ ID NO: 1847737 - DNA, 11 bp, Homo sapiens
aagctgggcag

SEQ ID NO: 1847738 - DNA, 18 bp, Homo sapiens
aagctgttactgtcttca

SEQ ID NO: 1847739 - DNA, 15 bp, Homo sapiens
aagctttctgtctcc

SEQ ID NO: 1847740 - DNA, 16 bp, Homo sapiens
aaggaaggttctggtg

SEQ ID NO: 1847741 - DNA, 17 bp, Homo sapiens
aaggaatacctgtcccc

SEQ ID NO: 1847742 - DNA, 19 bp, Homo sapiens
aaggacagcccctcctcca

SEQ ID NO: 1847743 - DNA, 20 bp, Homo sapiens
aaggaggaagagaaaaaata

SEQ ID NO: 1847744 - DNA, 24 bp, Homo sapiens
aaggatctgctgaggcccagtgca

SEQ ID NO: 1847745 - DNA, 16 bp, Homo sapiens
aaggatgtgggggaag

SEQ ID NO: 1847746 - DNA, 14 bp, Homo sapiens
aaggcaaatgactt

SEQ ID NO: 1847747 - DNA, 14 bp, Homo sapiens
aaggccccgcccag

SEQ ID NO: 1847748 - DNA, 16 bp, Homo sapiens
aaggccccgcccaggc

SEQ ID NO: 1847749 - DNA, 19 bp, Homo sapiens
aaggccccgcccaggctta

SEQ ID NO: 1847750 - DNA, 18 bp, Homo sapiens
aaggctccaggagcagcc

SEQ ID NO: 1847751 - DNA, 19 bp, Homo sapiens
aaggctccaggagcagcca

SEQ ID NO: 1847752 - DNA, 22 bp, Homo sapiens
aaggctccaggagcagccacat

SEQ ID NO: 1847753 - DNA, 13 bp, Homo sapiens
aaggctgcctgct

SEQ ID NO: 1847754 - DNA, 22 bp, Homo sapiens
aaggctgtgctccctggttctg

SEQ ID NO: 1847755 - DNA, 20 bp, Homo sapiens
aagggattttagtcacacgt

SEQ ID NO: 1847756 - DNA, 15 bp, Homo sapiens
aagggcagagtcaca

SEQ ID NO: 1847757 - DNA, 13 bp, Homo sapiens
aagggcctggcct

SEQ ID NO: 1847758 - DNA, 21 bp, Homo sapiens
aagggctgccggggcagcccc

SEQ ID NO: 1847759 - DNA, 18 bp, Homo sapiens
aaggggtgcacccacctg

SEQ ID NO: 1847760 - DNA, 13 bp, Homo sapiens
aaggtagaatgtt

SEQ ID NO: 1847761 - DNA, 11 bp, Homo sapiens
aaggtgggagg

SEQ ID NO: 1847762 - DNA, 14 bp, Homo sapiens
aaggtttaaatgaa

SEQ ID NO: 1847763 - DNA, 16 bp, Homo sapiens
aaggtttaaatgaaca

SEQ ID NO: 1847764 - DNA, 21 bp, Homo sapiens
aagtcaagtgaaaaaggagga

SEQ ID NO: 1847765 - DNA, 17 bp, Homo sapiens
aagtcatgcaaaggctg

SEQ ID NO: 1847766 - DNA, 19 bp, Homo sapiens
aagtcatgcaaaggctggg

SEQ ID NO: 1847767 - DNA, 20 bp, Homo sapiens
aagtcatgcaaaggctggga

SEQ ID NO: 1847768 - DNA, 20 bp, Homo sapiens
aagtctattgaataatgtag

SEQ ID NO: 1847769 - DNA, 19 bp, Homo sapiens
aagtctctgaagtgaaact

SEQ ID NO: 1847770 - DNA, 12 bp, Homo sapiens
aagtctctgtga

SEQ ID NO: 1847771 - DNA, 13 bp, Homo sapiens
aagtctgttttat

SEQ ID NO: 1847772 - DNA, 14 bp, Homo sapiens
aagtctgttttatg

SEQ ID NO: 1847773 - DNA, 19 bp, Homo sapiens
aagtctgttttatgacttc

SEQ ID NO: 1847774 - DNA, 17 bp, Homo sapiens
aagtgactgtatctgtg

SEQ ID NO: 1847775 - DNA, 22 bp, Homo sapiens
aagtgagacagtccagcctgga

SEQ ID NO: 1847776 - DNA, 22 bp, Homo sapiens
aagtgctgggaattacaggcgt

SEQ ID NO: 1847777 - DNA, 14 bp, Homo sapiens
aagtggatggaagt

SEQ ID NO: 1847778 - DNA, 16 bp, Homo sapiens
aagtggatggaagtgt

SEQ ID NO: 1847779 - DNA, 18 bp, Homo sapiens
aagttagtttttaatctc

SEQ ID NO: 1847780 - DNA, 17 bp, Homo sapiens
aagttgatatagaacag

SEQ ID NO: 1847781 - DNA, 20 bp, Homo sapiens
aagttgatatagaacagtgc

SEQ ID NO: 1847782 - DNA, 16 bp, Homo sapiens
aagttgcacggctgct

SEQ ID NO: 1847783 - DNA, 11 bp, Homo sapiens
aagttggaagg

SEQ ID NO: 1847784 - DNA, 19 bp, Homo sapiens
aagttggaaggatctgctg

SEQ ID NO: 1847785 - DNA, 12 bp, Homo sapiens
aagttgtttgag

SEQ ID NO: 1847786 - DNA, 20 bp, Homo sapiens
aagtttccttggctggtgca

SEQ ID NO: 1847787 - DNA, 20 bp, Homo sapiens
aagtttgagatcagcctggg

SEQ ID NO: 1847788 - DNA, 21 bp, Homo sapiens
acagtttggaagtgttaacta

SEQ ID NO: 1847789 - DNA, 13 bp, Homo sapiens
acataagctattt

SEQ ID NO: 1847790 - DNA, 20 bp, Homo sapiens
acataagctatttttctaac

SEQ ID NO: 1847791 - DNA, 20 bp, Homo sapiens
acataattcaggaagcagct

SEQ ID NO: 1847792 - DNA, 22 bp, Homo sapiens
acatatttcaaaaacatgcttt

SEQ ID NO: 1847793 - DNA, 19 bp, Homo sapiens
acatcatttgtattatgtt

SEQ ID NO: 1847794 - DNA, 13 bp, Homo sapiens
acatcttggcaca

SEQ ID NO: 1847795 - DNA, 18 bp, Homo sapiens
acatgagcatcaggccag

SEQ ID NO: 1847796 - DNA, 19 bp, Homo sapiens
acatgagcatcaggccagg

SEQ ID NO: 1847797 - DNA, 20 bp, Homo sapiens
acatgagcatcaggccaggc

SEQ ID NO: 1847798 - DNA, 14 bp, Homo sapiens
acatgccaagcact

SEQ ID NO: 1847799 - DNA, 23 bp, Homo sapiens
acatgcggagaacaaatgtgaag

SEQ ID NO: 1847800 - DNA, 17 bp, Homo sapiens
acatgctgaagccaaag

SEQ ID NO: 1847801 - DNA, 13 bp, Homo sapiens
acatgcttttcca

SEQ ID NO: 1847802 - DNA, 23 bp, Homo sapiens
acatggtgtctggattcccagga

SEQ ID NO: 1847803 - DNA, 12 bp, Homo sapiens
acatgtatttgt

SEQ ID NO: 1847804 - DNA, 17 bp, Homo sapiens
acatgtgccttttctga

SEQ ID NO: 1847805 - DNA, 13 bp, Homo sapiens
acattccatcctt

SEQ ID NO: 1847806 - DNA, 18 bp, Homo sapiens
acattccttgcctgcaca

SEQ ID NO: 1847807 - DNA, 22 bp, Homo sapiens
acattgccttttctagcccgaa

SEQ ID NO: 1847808 - DNA, 17 bp, Homo sapiens
acatttctcatgttgaa

SEQ ID NO: 1847809 - DNA, 22 bp, Homo sapiens
acatttgtgctccattttttct

SEQ ID NO: 1847810 - DNA, 13 bp, Homo sapiens
acattttatgtct

SEQ ID NO: 1847811 - DNA, 16 bp, Homo sapiens
accaacatactcccat

SEQ ID NO: 1847812 - DNA, 22 bp, Homo sapiens
accaacatactcccatctgtga

SEQ ID NO: 1847813 - DNA, 19 bp, Homo sapiens
accaacctgaagacaccgt

SEQ ID NO: 1847814 - DNA, 23 bp, Homo sapiens
accaagttggaacatccttggaa

SEQ ID NO: 1847815 - DNA, 14 bp, Homo sapiens
accaattattttca

SEQ ID NO: 1847816 - DNA, 16 bp, Homo sapiens
accaattattttcatc

SEQ ID NO: 1847817 - DNA, 17 bp, Homo sapiens
accaattcctcatttgt

SEQ ID NO: 1847818 - DNA, 14 bp, Homo sapiens
accacactccagct

SEQ ID NO: 1847819 - DNA, 23 bp, Homo sapiens
accacactgggtgcgtctccagt

SEQ ID NO: 1847820 - DNA, 14 bp, Homo sapiens
accacctttcagat

SEQ ID NO: 1847821 - DNA, 13 bp, Homo sapiens
accacttcagctg

SEQ ID NO: 1847822 - DNA, 14 bp, Homo sapiens
accacttcagctga

SEQ ID NO: 1847823 - DNA, 15 bp, Homo sapiens
accacttcagctgac

SEQ ID NO: 1847824 - DNA, 17 bp, Homo sapiens
accagaaacacccctct

SEQ ID NO: 1847825 - DNA, 21 bp, Homo sapiens
accagaaacacccctctgtct

SEQ ID NO: 1847826 - DNA, 22 bp, Homo sapiens
accagaaacacccctctgtcta

SEQ ID NO: 1847827 - DNA, 19 bp, Homo sapiens
accagaaccaattattttc

SEQ ID NO: 1847828 - DNA, 22 bp, Homo sapiens
accagatatatagaaggactgc

SEQ ID NO: 1847829 - DNA, 13 bp, Homo sapiens
accagcagcctgg

SEQ ID NO: 1847830 - DNA, 14 bp, Homo sapiens
accagcagcctgga

SEQ ID NO: 1847831 - DNA, 17 bp, Homo sapiens
accagcagcctggaccc

SEQ ID NO: 1847832 - DNA, 17 bp, Homo sapiens
accagggcctggctggg

SEQ ID NO: 1847833 - DNA, 14 bp, Homo sapiens
accatcaagccacc

SEQ ID NO: 1847834 - DNA, 21 bp, Homo sapiens
accatccctgaaggccccgcc

SEQ ID NO: 1847835 - DNA, 22 bp, Homo sapiens
accatgagtggcatggccacca

SEQ ID NO: 1847836 - DNA, 22 bp, Homo sapiens
accatgattaaccacttcagct

SEQ ID NO: 1847837 - DNA, 19 bp, Homo sapiens
accattctccacctgccag

SEQ ID NO: 1847838 - DNA, 16 bp, Homo sapiens
acccaaccacagagga

SEQ ID NO: 1847839 - DNA, 18 bp, Homo sapiens
acccaagggcctggcctg

SEQ ID NO: 1847840 - DNA, 19 bp, Homo sapiens
acccaagggcctggcctga

SEQ ID NO: 1847841 - DNA, 17 bp, Homo sapiens
acccacctgttttctga

SEQ ID NO: 1847842 - DNA, 18 bp, Homo sapiens
acccacctgttttctgaa

SEQ ID NO: 1847843 - DNA, 13 bp, Homo sapiens
acccagctctggt

SEQ ID NO: 1847844 - DNA, 12 bp, Homo sapiens
acccaggctggg

SEQ ID NO: 1847845 - DNA, 14 bp, Homo sapiens
acccagtgccctct

SEQ ID NO: 1847846 - DNA, 13 bp, Homo sapiens
acccatctgggct

SEQ ID NO: 1847847 - DNA, 13 bp, Homo sapiens
acccatgctgccc

SEQ ID NO: 1847848 - DNA, 14 bp, Homo sapiens
acccatgctgccct

SEQ ID NO: 1847849 - DNA, 15 bp, Homo sapiens
acccatgctgccctg

SEQ ID NO: 1847850 - DNA, 19 bp, Homo sapiens
acccatgctgccctgtgag

SEQ ID NO: 1847851 - DNA, 16 bp, Homo sapiens
accccacacacgccag

SEQ ID NO: 1847852 - DNA, 13 bp, Homo sapiens
accccagccccaa

SEQ ID NO: 1847853 - DNA, 22 bp, Homo sapiens
accccagccccaaaactctcct

SEQ ID NO: 1847854 - DNA, 19 bp, Homo sapiens
acccgctaagagggaggga

SEQ ID NO: 1847855 - DNA, 14 bp, Homo sapiens
accctattgctgct

SEQ ID NO: 1847856 - DNA, 13 bp, Homo sapiens
accctcatcacca

SEQ ID NO: 1847857 - DNA, 11 bp, Homo sapiens
accctccccac

SEQ ID NO: 1847858 - DNA, 22 bp, Homo sapiens
accctccccacagtgccaccca

SEQ ID NO: 1847859 - DNA, 22 bp, Homo sapiens
accctctgggtctcagtgtcct

SEQ ID NO: 1847860 - DNA, 14 bp, Homo sapiens
accctcttagaaaa

SEQ ID NO: 1847861 - DNA, 14 bp, Homo sapiens
accctgaggcccag

SEQ ID NO: 1847862 - DNA, 19 bp, Homo sapiens
accctgataggaagagggg

SEQ ID NO: 1847863 - DNA, 15 bp, Homo sapiens
accctgccctgtggg

SEQ ID NO: 1847864 - DNA, 20 bp, Homo sapiens
accctgcctctacccaacca

SEQ ID NO: 1847865 - DNA, 18 bp, Homo sapiens
accctggcacccagggtg

SEQ ID NO: 1847866 - DNA, 17 bp, Homo sapiens
acccttgccgtctacct

SEQ ID NO: 1847867 - DNA, 20 bp, Homo sapiens
accctttgaattggacaata

SEQ ID NO: 1847868 - DNA, 18 bp, Homo sapiens
accggctggcctggcccc

SEQ ID NO: 1847869 - DNA, 18 bp, Homo sapiens
acctaactcttctttcat

SEQ ID NO: 1847870 - DNA, 14 bp, Homo sapiens
acctaagtctctgt

SEQ ID NO: 1847871 - DNA, 15 bp, Homo sapiens
acctaagtctctgtg

SEQ ID NO: 1847872 - DNA, 16 bp, Homo sapiens
acctaagtctctgtga

SEQ ID NO: 1847873 - DNA, 14 bp, Homo sapiens
acctaattgtggat

SEQ ID NO: 1847874 - DNA, 21 bp, Homo sapiens
acctacaaggagataagaaag

SEQ ID NO: 1847875 - DNA, 13 bp, Homo sapiens
acctacatgtatt

SEQ ID NO: 1847876 - DNA, 15 bp, Homo sapiens
acctaccacatgcca

SEQ ID NO: 1847877 - DNA, 22 bp, Homo sapiens
acctagctgaatgtttttctaa

SEQ ID NO: 1847878 - DNA, 16 bp, Homo sapiens
acctcatgcccagctc

SEQ ID NO: 1847879 - DNA, 17 bp, Homo sapiens
acctcatgcccagctct

SEQ ID NO: 1847880 - DNA, 23 bp, Homo sapiens
acctctcccttggattgtccccg

SEQ ID NO: 1847881 - DNA, 14 bp, Homo sapiens
acctctctcactcc

SEQ ID NO: 1847882 - DNA, 12 bp, Homo sapiens
acctctgcacaa

SEQ ID NO: 1847883 - DNA, 20 bp, Homo sapiens
acctgagatttattaaagaa

SEQ ID NO: 1847884 - DNA, 20 bp, Homo sapiens
acctgaggcccttctctcca

SEQ ID NO: 1847885 - DNA, 23 bp, Homo sapiens
acctgaggcccttctctccagcc

SEQ ID NO: 1847886 - DNA, 16 bp, Homo sapiens
acctgaggggcctctt

SEQ ID NO: 1847887 - DNA, 14 bp, Homo sapiens
acctgattgtgtct

SEQ ID NO: 1847888 - DNA, 18 bp, Homo sapiens
acctgattgtgtctcttg

SEQ ID NO: 1847889 - DNA, 17 bp, Homo sapiens
acctgcacacaggacag

SEQ ID NO: 1847890 - DNA, 18 bp, Homo sapiens
acctgcacacaggacagc

SEQ ID NO: 1847891 - DNA, 19 bp, Homo sapiens
acctgcacacaggacagcg

SEQ ID NO: 1847892 - DNA, 20 bp, Homo sapiens
acctgcacacaggacagcgg

SEQ ID NO: 1847893 - DNA, 12 bp, Homo sapiens
acctgccaggga

SEQ ID NO: 1847894 - DNA, 22 bp, Homo sapiens
acctggattgtgcctaatgtgt

SEQ ID NO: 1847895 - DNA, 14 bp, Homo sapiens
acctggcctcattt

SEQ ID NO: 1847896 - DNA, 13 bp, Homo sapiens
acctggcctctgc

SEQ ID NO: 1847897 - DNA, 18 bp, Homo sapiens
acctggggctgctggcct

SEQ ID NO: 1847898 - DNA, 19 bp, Homo sapiens
acctgggtaaatgcagcgt

SEQ ID NO: 1847899 - DNA, 21 bp, Homo sapiens
acctgggtaactagggaagat

SEQ ID NO: 1847900 - DNA, 13 bp, Homo sapiens
acctgttttctga

SEQ ID NO: 1847901 - DNA, 16 bp, Homo sapiens
acctgttttctgaaac

SEQ ID NO: 1847902 - DNA, 19 bp, Homo sapiens
accttagacagtccctgcc

SEQ ID NO: 1847903 - DNA, 14 bp, Homo sapiens
accttagcctgccc

SEQ ID NO: 1847904 - DNA, 22 bp, Homo sapiens
accttctaggacgccacccagc

SEQ ID NO: 1847905 - DNA, 14 bp, Homo sapiens
accttctccttcac

SEQ ID NO: 1847906 - DNA, 12 bp, Homo sapiens
accttgtctgct

SEQ ID NO: 1847907 - DNA, 13 bp, Homo sapiens
acctttgtcccca

SEQ ID NO: 1847908 - DNA, 16 bp, Homo sapiens
acctttgtccccaccg

SEQ ID NO: 1847909 - DNA, 17 bp, Homo sapiens
acctttgtccccaccgc

SEQ ID NO: 1847910 - DNA, 18 bp, Homo sapiens
acctttgtccccaccgca

SEQ ID NO: 1847911 - DNA, 13 bp, Homo sapiens
acgatgtcttcat

SEQ ID NO: 1847912 - DNA, 18 bp, Homo sapiens
acgatttttaaaatgtac

SEQ ID NO: 1847913 - DNA, 15 bp, Homo sapiens
acgcaggcccctctc

SEQ ID NO: 1847914 - DNA, 17 bp, Homo sapiens
acgccagattctttcct

SEQ ID NO: 1847915 - DNA, 18 bp, Homo sapiens
acgccatcccagccccaa

SEQ ID NO: 1847916 - DNA, 13 bp, Homo sapiens
acgctcagtgggg

SEQ ID NO: 1847917 - DNA, 14 bp, Homo sapiens
acgctccttcctct

SEQ ID NO: 1847918 - DNA, 15 bp, Homo sapiens
acgctccttcctctg

SEQ ID NO: 1847919 - DNA, 16 bp, Homo sapiens
acgctgtgctgccctg

SEQ ID NO: 1847920 - DNA, 17 bp, Homo sapiens
acgctgtgctgccctgc

SEQ ID NO: 1847921 - DNA, 19 bp, Homo sapiens
acgctgtgctgccctgccc

SEQ ID NO: 1847922 - DNA, 15 bp, Homo sapiens
acgcttgtgacagtg

SEQ ID NO: 1847923 - DNA, 16 bp, Homo sapiens
acgcttgtgacagtgc

SEQ ID NO: 1847924 - DNA, 18 bp, Homo sapiens
acgcttgtgacagtgcct

SEQ ID NO: 1847925 - DNA, 17 bp, Homo sapiens
acgggcctgtccacagg

SEQ ID NO: 1847926 - DNA, 18 bp, Homo sapiens
acggtaagtgttctcatg

SEQ ID NO: 1847927 - DNA, 15 bp, Homo sapiens
acggtgctccaggca

SEQ ID NO: 1847928 - DNA, 18 bp, Homo sapiens
acggtgctccaggcaggc

SEQ ID NO: 1847929 - DNA, 17 bp, Homo sapiens
acggtttgaagcctgga

SEQ ID NO: 1847930 - DNA, 16 bp, Homo sapiens
acgtgagatcattcac

SEQ ID NO: 1847931 - DNA, 16 bp, Homo sapiens
acgtgatttttaaatt

SEQ ID NO: 1847932 - DNA, 23 bp, Homo sapiens
acgtgctctttgttttgtgtctc

SEQ ID NO: 1847933 - DNA, 13 bp, Homo sapiens
acgtggaggagca

SEQ ID NO: 1847934 - DNA, 18 bp, Homo sapiens
acgtggaggagcagtgca

SEQ ID NO: 1847935 - DNA, 14 bp, Homo sapiens
acgttttataagca

SEQ ID NO: 1847936 - DNA, 14 bp, Homo sapiens
actaaaatgttcta

SEQ ID NO: 1847937 - DNA, 16 bp, Homo sapiens
actaaacatgtatgta

SEQ ID NO: 1847938 - DNA, 20 bp, Homo sapiens
actaagtaatctcacagcat

SEQ ID NO: 1847939 - DNA, 17 bp, Homo sapiens
actacaaaggtttaaat

SEQ ID NO: 1847940 - DNA, 19 bp, Homo sapiens
actacaaaggtttaaatga

SEQ ID NO: 1847941 - DNA, 22 bp, Homo sapiens
actacaaaggtttaaatgaaca

SEQ ID NO: 1847942 - DNA, 17 bp, Homo sapiens
actagggaagataatat

SEQ ID NO: 1847943 - DNA, 20 bp, Homo sapiens
actatcagcccaagatgctt

SEQ ID NO: 1847944 - DNA, 13 bp, Homo sapiens
actattgcccagg

SEQ ID NO: 1847945 - DNA, 20 bp, Homo sapiens
actcaaaacccatctgggct

SEQ ID NO: 1847946 - DNA, 19 bp, Homo sapiens
actcaagaagcaggctaca

SEQ ID NO: 1847947 - DNA, 20 bp, Homo sapiens
actcaagtctattgaataat

SEQ ID NO: 1847948 - DNA, 22 bp, Homo sapiens
actcaagtctattgaataatgt

SEQ ID NO: 1847949 - DNA, 12 bp, Homo sapiens
actcaccccagc

SEQ ID NO: 1847950 - DNA, 19 bp, Homo sapiens
actcacctggggctgctgg

SEQ ID NO: 1847951 - DNA, 20 bp, Homo sapiens
actcagccttgcaaatagcc

SEQ ID NO: 1847952 - DNA, 14 bp, Homo sapiens
actcagctccccag

SEQ ID NO: 1847953 - DNA, 14 bp, Homo sapiens
actcatgagaagtt

SEQ ID NO: 1847954 - DNA, 18 bp, Homo sapiens
actcattgacctgaggcc

SEQ ID NO: 1847955 - DNA, 21 bp, Homo sapiens
actccaattaaggattttatg

SEQ ID NO: 1847956 - DNA, 19 bp, Homo sapiens
actccatcagttagagctg

SEQ ID NO: 1847957 - DNA, 13 bp, Homo sapiens
actcccaggcagc

SEQ ID NO: 1847958 - DNA, 14 bp, Homo sapiens
actcccccaggtgg

SEQ ID NO: 1847959 - DNA, 13 bp, Homo sapiens
actcccctgctgg

SEQ ID NO: 1847960 - DNA, 13 bp, Homo sapiens
actcccttcccat

SEQ ID NO: 1847961 - DNA, 18 bp, Homo sapiens
actcctaggcaggacatg

SEQ ID NO: 1847962 - DNA, 19 bp, Homo sapiens
actcctcagggttgaggtc

SEQ ID NO: 1847963 - DNA, 14 bp, Homo sapiens
actcctgaaaaaaa

SEQ ID NO: 1847964 - DNA, 19 bp, Homo sapiens
actcctgaaaaaaaacctg

SEQ ID NO: 1847965 - DNA, 14 bp, Homo sapiens
actcctgcaggcag

SEQ ID NO: 1847966 - DNA, 21 bp, Homo sapiens
actcctgcaggcagccaggcc

SEQ ID NO: 1847967 - DNA, 21 bp, Homo sapiens
actccttgagagaccaggcaa

SEQ ID NO: 1847968 - DNA, 18 bp, Homo sapiens
actcgagtcacactcaag

SEQ ID NO: 1847969 - DNA, 17 bp, Homo sapiens
actctagggaaaaacca

SEQ ID NO: 1847970 - DNA, 14 bp, Homo sapiens
actctcctctgctg

SEQ ID NO: 1847971 - DNA, 17 bp, Homo sapiens
actctcctctgctgctg

SEQ ID NO: 1847972 - DNA, 19 bp, Homo sapiens
actctcctctgctgctggc

SEQ ID NO: 1847973 - DNA, 17 bp, Homo sapiens
actctgacaacagactt

SEQ ID NO: 1847974 - DNA, 20 bp, Homo sapiens
actcttcagttaagcctttg

SEQ ID NO: 1847975 - DNA, 17 bp, Homo sapiens
agagggggtggcctccc

SEQ ID NO: 1847976 - DNA, 23 bp, Homo sapiens
agagggggtggcctcccaactca

SEQ ID NO: 1847977 - DNA, 20 bp, Homo sapiens
agaggtggatgttatgaaca

SEQ ID NO: 1847978 - DNA, 20 bp, Homo sapiens
agaggtttgcagtcccaagc

SEQ ID NO: 1847979 - DNA, 13 bp, Homo sapiens
agagtatggagct

SEQ ID NO: 1847980 - DNA, 14 bp, Homo sapiens
agagtatggagctc

SEQ ID NO: 1847981 - DNA, 20 bp, Homo sapiens
agagtcacacgggggcagct

SEQ ID NO: 1847982 - DNA, 22 bp, Homo sapiens
agagtgctaagcattagcttta

SEQ ID NO: 1847983 - DNA, 19 bp, Homo sapiens
agagtggggatatgattta

SEQ ID NO: 1847984 - DNA, 14 bp, Homo sapiens
agagtgtgcctgaa

SEQ ID NO: 1847985 - DNA, 19 bp, Homo sapiens
agagttccccatgcagaca

SEQ ID NO: 1847986 - DNA, 16 bp, Homo sapiens
agataactgttattta

SEQ ID NO: 1847987 - DNA, 18 bp, Homo sapiens
agataatattaaggaaga

SEQ ID NO: 1847988 - DNA, 13 bp, Homo sapiens
agataatccctgt

SEQ ID NO: 1847989 - DNA, 20 bp, Homo sapiens
agatatattaagtgactgtt

SEQ ID NO: 1847990 - DNA, 16 bp, Homo sapiens
agatcaaggagaggag

SEQ ID NO: 1847991 - DNA, 15 bp, Homo sapiens
agatcacagtggcca

SEQ ID NO: 1847992 - DNA, 13 bp, Homo sapiens
agatcagcctggg

SEQ ID NO: 1847993 - DNA, 19 bp, Homo sapiens
agatctatatttttgtact

SEQ ID NO: 1847994 - DNA, 20 bp, Homo sapiens
agatgaaccctggcatttgg

SEQ ID NO: 1847995 - DNA, 15 bp, Homo sapiens
agatgaatgtcagtt

SEQ ID NO: 1847996 - DNA, 22 bp, Homo sapiens
agatgcactttgctttaatata

SEQ ID NO: 1847997 - DNA, 18 bp, Homo sapiens
agatgggggaaagcacag

SEQ ID NO: 1847998 - DNA, 22 bp, Homo sapiens
agatgggtgcttggaggaagga

SEQ ID NO: 1847999 - DNA, 16 bp, Homo sapiens
agattccccactcagc

SEQ ID NO: 1848000 - DNA, 20 bp, Homo sapiens
agattccccactcagccttt

SEQ ID NO: 1848001 - DNA, 14 bp, Homo sapiens
agattctttcctga

SEQ ID NO: 1848002 - DNA, 21 bp, Homo sapiens
agattctttcctgaggctggg

SEQ ID NO: 1848003 - DNA, 19 bp, Homo sapiens
agattggtgtttttttcta

SEQ ID NO: 1848004 - DNA, 18 bp, Homo sapiens
agatttattaaagaaaaa

SEQ ID NO: 1848005 - DNA, 18 bp, Homo sapiens
agcaaaagatgcttctca

SEQ ID NO: 1848006 - DNA, 17 bp, Homo sapiens
agcaagacgctgtgctg

SEQ ID NO: 1848007 - DNA, 20 bp, Homo sapiens
agcacacacttttggttaag

SEQ ID NO: 1848008 - DNA, 15 bp, Homo sapiens
agcacagaccctgcc

SEQ ID NO: 1848009 - DNA, 18 bp, Homo sapiens
agcacagaccctgccctg

SEQ ID NO: 1848010 - DNA, 19 bp, Homo sapiens
agcacatgatttgggctct

SEQ ID NO: 1848011 - DNA, 14 bp, Homo sapiens
agcaccacactggg

SEQ ID NO: 1848012 - DNA, 23 bp, Homo sapiens
agcaccttagacagtccctgcca

SEQ ID NO: 1848013 - DNA, 15 bp, Homo sapiens
agcacggctctgtcc

SEQ ID NO: 1848014 - DNA, 21 bp, Homo sapiens
agcacggctctgtccccagcc

SEQ ID NO: 1848015 - DNA, 14 bp, Homo sapiens
agcactcgtgtgca

SEQ ID NO: 1848016 - DNA, 16 bp, Homo sapiens
agcactgcctgctccc

SEQ ID NO: 1848017 - DNA, 19 bp, Homo sapiens
agcactgcctgctcccatc

SEQ ID NO: 1848018 - DNA, 21 bp, Homo sapiens
agcactgcctgctcccatcct

SEQ ID NO: 1848019 - DNA, 14 bp, Homo sapiens
agcagaacaggtag

SEQ ID NO: 1848020 - DNA, 22 bp, Homo sapiens
agcagaacaggtagtattacac

SEQ ID NO: 1848021 - DNA, 15 bp, Homo sapiens
agcagaacctgcaca

SEQ ID NO: 1848022 - DNA, 24 bp, Homo sapiens
agcagaacctgcacacaggacagc

SEQ ID NO: 1848023 - DNA, 18 bp, Homo sapiens
agcagagaccatccctga

SEQ ID NO: 1848024 - DNA, 19 bp, Homo sapiens
agcagagaccatccctgaa

SEQ ID NO: 1848025 - DNA, 17 bp, Homo sapiens
agcagaggaaggagagg

SEQ ID NO: 1848026 - DNA, 11 bp, Homo sapiens
agcagccacat

SEQ ID NO: 1848027 - DNA, 16 bp, Homo sapiens
agcagcctggaccctg

SEQ ID NO: 1848028 - DNA, 13 bp, Homo sapiens
agcagcgagcctg

SEQ ID NO: 1848029 - DNA, 15 bp, Homo sapiens
agcagcgagcctgct

SEQ ID NO: 1848030 - DNA, 18 bp, Homo sapiens
agcagctgccaggagcac

SEQ ID NO: 1848031 - DNA, 21 bp, Homo sapiens
agcaggcgttcagctcactgt

SEQ ID NO: 1848032 - DNA, 22 bp, Homo sapiens
agcaggctacactgacactggt

SEQ ID NO: 1848033 - DNA, 20 bp, Homo sapiens
agcagtttctgtcctgctgg

SEQ ID NO: 1848034 - DNA, 19 bp, Homo sapiens
agcataaaaattagccaag

SEQ ID NO: 1848035 - DNA, 23 bp, Homo sapiens
agcataaaaattagccaagtgtg

SEQ ID NO: 1848036 - DNA, 16 bp, Homo sapiens
agcatattcaggaagc

SEQ ID NO: 1848037 - DNA, 21 bp, Homo sapiens
agcatcagaggtttgcttcct

SEQ ID NO: 1848038 - DNA, 12 bp, Homo sapiens
agcatcaggcca

SEQ ID NO: 1848039 - DNA, 14 bp, Homo sapiens
agcatcaggccagg

SEQ ID NO: 1848040 - DNA, 17 bp, Homo sapiens
agcatcaggccaggccc

SEQ ID NO: 1848041 - DNA, 19 bp, Homo sapiens
agcatcaggccaggccctc

SEQ ID NO: 1848042 - DNA, 22 bp, Homo sapiens
agcatcattatttatgtattgt

SEQ ID NO: 1848043 - DNA, 13 bp, Homo sapiens
agcatggagctgg

SEQ ID NO: 1848044 - DNA, 14 bp, Homo sapiens
agcatggagctggc

SEQ ID NO: 1848045 - DNA, 21 bp, Homo sapiens
agcatgtttagactttaacat

SEQ ID NO: 1848046 - DNA, 22 bp, Homo sapiens
agcatgtttagactttaacata

SEQ ID NO: 1848047 - DNA, 15 bp, Homo sapiens
agcattagctttaat

SEQ ID NO: 1848048 - DNA, 14 bp, Homo sapiens
agccaagcaaatgc

SEQ ID NO: 1848049 - DNA, 23 bp, Homo sapiens
agccaagtgtggtagagtgtgcc

SEQ ID NO: 1848050 - DNA, 14 bp, Homo sapiens
agccaggccacaag

SEQ ID NO: 1848051 - DNA, 22 bp, Homo sapiens
agccaggccacaagacccttgt

SEQ ID NO: 1848052 - DNA, 14 bp, Homo sapiens
agccagggctgcta

SEQ ID NO: 1848053 - DNA, 21 bp, Homo sapiens
agccagggctgctagacggag

SEQ ID NO: 1848054 - DNA, 18 bp, Homo sapiens
agccagtaaacagaggag

SEQ ID NO: 1848055 - DNA, 15 bp, Homo sapiens
agcccacgcccccac

SEQ ID NO: 1848056 - DNA, 17 bp, Homo sapiens
agcccacgcccccactg

SEQ ID NO: 1848057 - DNA, 18 bp, Homo sapiens
agcccacgcccccactgg

SEQ ID NO: 1848058 - DNA, 21 bp, Homo sapiens
agcccaggaaaggctccagga

SEQ ID NO: 1848059 - DNA, 23 bp, Homo sapiens
agcccaggaaaggctccaggagc

SEQ ID NO: 1848060 - DNA, 24 bp, Homo sapiens
agcccaggaaaggctccaggagca

SEQ ID NO: 1848061 - DNA, 19 bp, Homo sapiens
agcccatggccctcccagt

SEQ ID NO: 1848062 - DNA, 14 bp, Homo sapiens
agcccattcattcc

SEQ ID NO: 1848063 - DNA, 22 bp, Homo sapiens
agcccattcattccattctgga

SEQ ID NO: 1848064 - DNA, 18 bp, Homo sapiens
agccccaaaactctcctc

SEQ ID NO: 1848065 - DNA, 22 bp, Homo sapiens
agccccaaaactctcctctgct

SEQ ID NO: 1848066 - DNA, 24 bp, Homo sapiens
agccccaaaactctcctctgctgc

SEQ ID NO: 1848067 - DNA, 11 bp, Homo sapiens
agccccacctt

SEQ ID NO: 1848068 - DNA, 17 bp, Homo sapiens
agccccatcctctgtac

SEQ ID NO: 1848069 - DNA, 23 bp, Homo sapiens
agccccatcctctgtacagagcc

SEQ ID NO: 1848070 - DNA, 11 bp, Homo sapiens
agccccctcac

SEQ ID NO: 1848071 - DNA, 23 bp, Homo sapiens
agccccgccccgttgtgagctgg

SEQ ID NO: 1848072 - DNA, 22 bp, Homo sapiens
agcccctggatgcagcctcaca

SEQ ID NO: 1848073 - DNA, 15 bp, Homo sapiens
agccccttctgaccc

SEQ ID NO: 1848074 - DNA, 21 bp, Homo sapiens
agcccgaacaccattgaggga

SEQ ID NO: 1848075 - DNA, 14 bp, Homo sapiens
agcccgggctctgc

SEQ ID NO: 1848076 - DNA, 18 bp, Homo sapiens
agcccgggctctgcctcc

SEQ ID NO: 1848077 - DNA, 13 bp, Homo sapiens
agccctggctgaa

SEQ ID NO: 1848078 - DNA, 20 bp, Homo sapiens
agccctggctgaaggactgt

SEQ ID NO: 1848079 - DNA, 14 bp, Homo sapiens
agccgctggggcca

SEQ ID NO: 1848080 - DNA, 17 bp, Homo sapiens
agcctcacagtccttac

SEQ ID NO: 1848081 - DNA, 18 bp, Homo sapiens
agcctcacagtccttacc

SEQ ID NO: 1848082 - DNA, 23 bp, Homo sapiens
agcctccctattttttttctgtt

SEQ ID NO: 1848083 - DNA, 14 bp, Homo sapiens
agcctctcccctgc

SEQ ID NO: 1848084 - DNA, 21 bp, Homo sapiens
agcctctcccctgcctgccct

SEQ ID NO: 1848085 - DNA, 16 bp, Homo sapiens
agcctgcctcttctct

SEQ ID NO: 1848086 - DNA, 16 bp, Homo sapiens
agcctgctccagctgt

SEQ ID NO: 1848087 - DNA, 19 bp, Homo sapiens
agcctgctccagctgttca

SEQ ID NO: 1848088 - DNA, 22 bp, Homo sapiens
agcctgctccagctgttcagct

SEQ ID NO: 1848089 - DNA, 14 bp, Homo sapiens
agcctggtgctgct

SEQ ID NO: 1848090 - DNA, 12 bp, Homo sapiens
agccttaataaa

SEQ ID NO: 1848091 - DNA, 14 bp, Homo sapiens
agccttccaggggt

SEQ ID NO: 1848092 - DNA, 21 bp, Homo sapiens
agccttgaccattctccacct

SEQ ID NO: 1848093 - DNA, 22 bp, Homo sapiens
agccttgaccattctccacctg

SEQ ID NO: 1848094 - DNA, 23 bp, Homo sapiens
agccttgaccattctccacctgc

SEQ ID NO: 1848095 - DNA, 19 bp, Homo sapiens
agccttgcggaaggttcta

SEQ ID NO: 1848096 - DNA, 18 bp, Homo sapiens
aggccaaggtgggaggat

SEQ ID NO: 1848097 - DNA, 16 bp, Homo sapiens
aggccacaagaccctt

SEQ ID NO: 1848098 - DNA, 19 bp, Homo sapiens
aggccacgtgatgtggagg

SEQ ID NO: 1848099 - DNA, 14 bp, Homo sapiens
aggccaggccaccc

SEQ ID NO: 1848100 - DNA, 15 bp, Homo sapiens
aggccaggccctctg

SEQ ID NO: 1848101 - DNA, 17 bp, Homo sapiens
aggccatggagagctgg

SEQ ID NO: 1848102 - DNA, 13 bp, Homo sapiens
aggcccagagggc

SEQ ID NO: 1848103 - DNA, 15 bp, Homo sapiens
aggcccagagggcct

SEQ ID NO: 1848104 - DNA, 19 bp, Homo sapiens
aggcccagagggcctgcaa

SEQ ID NO: 1848105 - DNA, 21 bp, Homo sapiens
aggcccagagggcctgcaagg

SEQ ID NO: 1848106 - DNA, 13 bp, Homo sapiens
aggcccagtgaga

SEQ ID NO: 1848107 - DNA, 14 bp, Homo sapiens
aggccccgcccagg

SEQ ID NO: 1848108 - DNA, 14 bp, Homo sapiens
aggccctctgccca

SEQ ID NO: 1848109 - DNA, 15 bp, Homo sapiens
aggccctctgcccac

SEQ ID NO: 1848110 - DNA, 19 bp, Homo sapiens
aggccctctgcccactccc

SEQ ID NO: 1848111 - DNA, 22 bp, Homo sapiens
aggcccttctctccagcccctg

SEQ ID NO: 1848112 - DNA, 17 bp, Homo sapiens
aggcgtggagctgcctg

SEQ ID NO: 1848113 - DNA, 20 bp, Homo sapiens
aggctaaggcgtggagctgc

SEQ ID NO: 1848114 - DNA, 23 bp, Homo sapiens
aggctaaggcgtggagctgcctg

SEQ ID NO: 1848115 - DNA, 18 bp, Homo sapiens
aggctacactgacactgg

SEQ ID NO: 1848116 - DNA, 13 bp, Homo sapiens
aggctccaggagc

SEQ ID NO: 1848117 - DNA, 16 bp, Homo sapiens
aggctccaggagcagc

SEQ ID NO: 1848118 - DNA, 18 bp, Homo sapiens
aggctccaggagcagcca

SEQ ID NO: 1848119 - DNA, 19 bp, Homo sapiens
aggctccaggagcagccac

SEQ ID NO: 1848120 - DNA, 19 bp, Homo sapiens
aggctcgagcatgcctgga

SEQ ID NO: 1848121 - DNA, 12 bp, Homo sapiens
aggctctgccct

SEQ ID NO: 1848122 - DNA, 14 bp, Homo sapiens
aggctctgcccttg

SEQ ID NO: 1848123 - DNA, 15 bp, Homo sapiens
aggctctgcccttgg

SEQ ID NO: 1848124 - DNA, 16 bp, Homo sapiens
aggctcttctccccag

SEQ ID NO: 1848125 - DNA, 17 bp, Homo sapiens
aggctcttctccccaga

SEQ ID NO: 1848126 - DNA, 21 bp, Homo sapiens
aggctgaacttgttttctggg

SEQ ID NO: 1848127 - DNA, 19 bp, Homo sapiens
aggctgcctgctatgtatt

SEQ ID NO: 1848128 - DNA, 13 bp, Homo sapiens
aggctgggcaagg

SEQ ID NO: 1848129 - DNA, 13 bp, Homo sapiens
aggctgggctccc

SEQ ID NO: 1848130 - DNA, 18 bp, Homo sapiens
aggctggggaagtcctct

SEQ ID NO: 1848131 - DNA, 21 bp, Homo sapiens
aggctggggaagtcctctggg

SEQ ID NO: 1848132 - DNA, 14 bp, Homo sapiens
aggctgggttctga

SEQ ID NO: 1848133 - DNA, 18 bp, Homo sapiens
aggctgggttctgatcct

SEQ ID NO: 1848134 - DNA, 13 bp, Homo sapiens
aggctgtgctccc

SEQ ID NO: 1848135 - DNA, 20 bp, Homo sapiens
aggctgtgctccctggttct

SEQ ID NO: 1848136 - DNA, 15 bp, Homo sapiens
aggcttagctttgct

SEQ ID NO: 1848137 - DNA, 15 bp, Homo sapiens
agggaaaacattcca

SEQ ID NO: 1848138 - DNA, 16 bp, Homo sapiens
agggaagtaacagtaa

SEQ ID NO: 1848139 - DNA, 22 bp, Homo sapiens
agggaagtaacagtaacgcagg

SEQ ID NO: 1848140 - DNA, 13 bp, Homo sapiens
agggaatgcctga

SEQ ID NO: 1848141 - DNA, 18 bp, Homo sapiens
agggaatgcctgagtgcc

SEQ ID NO: 1848142 - DNA, 23 bp, Homo sapiens
agggacagagggggtggcctccc

SEQ ID NO: 1848143 - DNA, 14 bp, Homo sapiens
agggacatgcttag

SEQ ID NO: 1848144 - DNA, 15 bp, Homo sapiens
agggagggagggctc

SEQ ID NO: 1848145 - DNA, 15 bp, Homo sapiens
agggagggctccaga

SEQ ID NO: 1848146 - DNA, 15 bp, Homo sapiens
agggagggcttctgc

SEQ ID NO: 1848147 - DNA, 20 bp, Homo sapiens
agggagtgagttgatagcac

SEQ ID NO: 1848148 - DNA, 21 bp, Homo sapiens
agggagttttgtctgtctccc

SEQ ID NO: 1848149 - DNA, 20 bp, Homo sapiens
agggatgagcatggagctgg

SEQ ID NO: 1848150 - DNA, 14 bp, Homo sapiens
agggcaagaaatgg

SEQ ID NO: 1848151 - DNA, 20 bp, Homo sapiens
agggcacattccttgcctgc

SEQ ID NO: 1848152 - DNA, 17 bp, Homo sapiens
agggcagagtcacacgg

SEQ ID NO: 1848153 - DNA, 19 bp, Homo sapiens
agggcaggcttggggaaaa

SEQ ID NO: 1848154 - DNA, 14 bp, Homo sapiens
agggccactgaaga

SEQ ID NO: 1848155 - DNA, 15 bp, Homo sapiens
agggcctgcaaggga

SEQ ID NO: 1848156 - DNA, 12 bp, Homo sapiens
agggcctggcct

SEQ ID NO: 1848157 - DNA, 18 bp, Homo sapiens
agggcctggctcaggtgg

SEQ ID NO: 1848158 - DNA, 15 bp, Homo sapiens
agggcgcaaagggca

SEQ ID NO: 1848159 - DNA, 18 bp, Homo sapiens
agggcgcaaagggcatgg

SEQ ID NO: 1848160 - DNA, 23 bp, Homo sapiens
agggcgttctaggtaggaagagc

SEQ ID NO: 1848161 - DNA, 12 bp, Homo sapiens
agggctccagac

SEQ ID NO: 1848162 - DNA, 23 bp, Homo sapiens
agggcttctgccatttctgagat

SEQ ID NO: 1848163 - DNA, 15 bp, Homo sapiens
aggggacgcaggccc

SEQ ID NO: 1848164 - DNA, 17 bp, Homo sapiens
aggggacgcaggcccct

SEQ ID NO: 1848165 - DNA, 19 bp, Homo sapiens
aggggcctcttatgggctg

SEQ ID NO: 1848166 - DNA, 21 bp, Homo sapiens
aggggcctcttatgggctggg

SEQ ID NO: 1848167 - DNA, 13 bp, Homo sapiens
aggggctggggcc

SEQ ID NO: 1848168 - DNA, 20 bp, Homo sapiens
agggggtggcctcccaactc

SEQ ID NO: 1848169 - DNA, 24 bp, Homo sapiens
aggggttcccttttttggctgctg

SEQ ID NO: 1848170 - DNA, 18 bp, Homo sapiens
agggtatcaaataaaatt

SEQ ID NO: 1848171 - DNA, 15 bp, Homo sapiens
agggtatctggtgac

SEQ ID NO: 1848172 - DNA, 16 bp, Homo sapiens
agggtccctggtggca

SEQ ID NO: 1848173 - DNA, 16 bp, Homo sapiens
agggtctctgctgccg

SEQ ID NO: 1848174 - DNA, 12 bp, Homo sapiens
aggtaccatcct

SEQ ID NO: 1848175 - DNA, 17 bp, Homo sapiens
aggtagaatgttttcaa

SEQ ID NO: 1848176 - DNA, 20 bp, Homo sapiens
aggtagtattacaccaccgg

SEQ ID NO: 1848177 - DNA, 16 bp, Homo sapiens
aggtccagccctggct

SEQ ID NO: 1848178 - DNA, 16 bp, Homo sapiens
aggtgcaacactcaag

SEQ ID NO: 1848179 - DNA, 21 bp, Homo sapiens
aggtgcacaagctccaagctc

SEQ ID NO: 1848180 - DNA, 22 bp, Homo sapiens
aggtgctaggaacactccttca

SEQ ID NO: 1848181 - DNA, 23 bp, Homo sapiens
aggtggatgttatgaacagctgt

SEQ ID NO: 1848182 - DNA, 18 bp, Homo sapiens
aggtggcaaggctgtgct

SEQ ID NO: 1848183 - DNA, 15 bp, Homo sapiens
aggtgggatcctcca

SEQ ID NO: 1848184 - DNA, 17 bp, Homo sapiens
aggtgggatcctccagg

SEQ ID NO: 1848185 - DNA, 19 bp, Homo sapiens
aggtggggtcactctggca

SEQ ID NO: 1848186 - DNA, 16 bp, Homo sapiens
aggttatctgtcccag

SEQ ID NO: 1848187 - DNA, 14 bp, Homo sapiens
aggttctctcctcc

SEQ ID NO: 1848188 - DNA, 15 bp, Homo sapiens
aggtttaaatgaaca

SEQ ID NO: 1848189 - DNA, 14 bp, Homo sapiens
aggtttaagctgtt

SEQ ID NO: 1848190 - DNA, 22 bp, Homo sapiens
aggtttctggtctctaggctgg

SEQ ID NO: 1848191 - DNA, 14 bp, Homo sapiens
aggtttttaagcct

SEQ ID NO: 1848192 - DNA, 20 bp, Homo sapiens
agtaaagtgaagaatttatc

SEQ ID NO: 1848193 - DNA, 17 bp, Homo sapiens
agtaacagtcatcattt

SEQ ID NO: 1848194 - DNA, 18 bp, Homo sapiens
agtaacagtcatcattta

SEQ ID NO: 1848195 - DNA, 12 bp, Homo sapiens
agtacctcctgt

SEQ ID NO: 1848196 - DNA, 19 bp, Homo sapiens
agtactacagtcctcccat

SEQ ID NO: 1848197 - DNA, 14 bp, Homo sapiens
agtagactgtgatt

SEQ ID NO: 1848198 - DNA, 18 bp, Homo sapiens
agtaggaagactttggaa

SEQ ID NO: 1848199 - DNA, 15 bp, Homo sapiens
agtatcagctacaat

SEQ ID NO: 1848200 - DNA, 18 bp, Homo sapiens
agtattgaagcattttat

SEQ ID NO: 1848201 - DNA, 20 bp, Homo sapiens
agtattgaagcattttataa

SEQ ID NO: 1848202 - DNA, 21 bp, Homo sapiens
agtattgaagcattttataaa

SEQ ID NO: 1848203 - DNA, 15 bp, Homo sapiens
agtcactgagacagc

SEQ ID NO: 1848204 - DNA, 17 bp, Homo sapiens
agtcactgagacagccc

SEQ ID NO: 1848205 - DNA, 18 bp, Homo sapiens
agtcactgagacagcccg

SEQ ID NO: 1848206 - DNA, 13 bp, Homo sapiens
agtcatcatttat

SEQ ID NO: 1848207 - DNA, 18 bp, Homo sapiens
agtcatgcaaaggctggg

SEQ ID NO: 1848208 - DNA, 20 bp, Homo sapiens
agtcatgcaaaggctgggac

SEQ ID NO: 1848209 - DNA, 18 bp, Homo sapiens
agtcattatgttaatatt

SEQ ID NO: 1848210 - DNA, 16 bp, Homo sapiens
agtccaaccagaaaca

SEQ ID NO: 1848211 - DNA, 21 bp, Homo sapiens
agtccaaggaaaccacagctg

SEQ ID NO: 1848212 - DNA, 14 bp, Homo sapiens
agtcccaagcggtg

SEQ ID NO: 1848213 - DNA, 19 bp, Homo sapiens
agtcccaagcggtgtctct

SEQ ID NO: 1848214 - DNA, 14 bp, Homo sapiens
agtcccctgtttgt

SEQ ID NO: 1848215 - DNA, 23 bp, Homo sapiens
agtcccctgtttgtttctgaaag

SEQ ID NO: 1848216 - DNA, 16 bp, Homo sapiens
agtcctcccatctcac

SEQ ID NO: 1848217 - DNA, 17 bp, Homo sapiens
agtctattcattatatt

SEQ ID NO: 1848218 - DNA, 18 bp, Homo sapiens
gagtaacagtcatcattt

SEQ ID NO: 1848219 - DNA, 15 bp, Homo sapiens
gagtactacagtcct

SEQ ID NO: 1848220 - DNA, 18 bp, Homo sapiens
gagtactacagtcctccc

SEQ ID NO: 1848221 - DNA, 19 bp, Homo sapiens
gagtactacagtcctccca

SEQ ID NO: 1848222 - DNA, 20 bp, Homo sapiens
gagtactacagtcctcccat

SEQ ID NO: 1848223 - DNA, 21 bp, Homo sapiens
gagtactacagtcctcccatc

SEQ ID NO: 1848224 - DNA, 17 bp, Homo sapiens
gagtaggaagactttgg

SEQ ID NO: 1848225 - DNA, 12 bp, Homo sapiens
gagtgaaccaga

SEQ ID NO: 1848226 - DNA, 12 bp, Homo sapiens
gagtgacagctt

SEQ ID NO: 1848227 - DNA, 19 bp, Homo sapiens
gagtgacagctttctggga

SEQ ID NO: 1848228 - DNA, 23 bp, Homo sapiens
gagtgacagctttctgggatgtc

SEQ ID NO: 1848229 - DNA, 14 bp, Homo sapiens
gagtgcctggccaa

SEQ ID NO: 1848230 - DNA, 20 bp, Homo sapiens
gagtggcgcgcgccaccacg

SEQ ID NO: 1848231 - DNA, 20 bp, Homo sapiens
gagtgtgcctgaagtcccag

SEQ ID NO: 1848232 - DNA, 17 bp, Homo sapiens
gagttcaccttggaagg

SEQ ID NO: 1848233 - DNA, 18 bp, Homo sapiens
gagttccccatgcagaca

SEQ ID NO: 1848234 - DNA, 21 bp, Homo sapiens
gagttgatagcacagaccctg

SEQ ID NO: 1848235 - DNA, 15 bp, Homo sapiens
gagttgattcagctc

SEQ ID NO: 1848236 - DNA, 17 bp, Homo sapiens
gagttgattcagctctg

SEQ ID NO: 1848237 - DNA, 15 bp, Homo sapiens
gataaacacaagatt

SEQ ID NO: 1848238 - DNA, 17 bp, Homo sapiens
gataagaccaccacctc

SEQ ID NO: 1848239 - DNA, 18 bp, Homo sapiens
gataatattgtggtgcca

SEQ ID NO: 1848240 - DNA, 20 bp, Homo sapiens
gatacttcgacactgttctt

SEQ ID NO: 1848241 - DNA, 22 bp, Homo sapiens
gatacttcgacactgttcttag

SEQ ID NO: 1848242 - DNA, 23 bp, Homo sapiens
gatacttcgacactgttcttagc

SEQ ID NO: 1848243 - DNA, 15 bp, Homo sapiens
gatagacttgggatg

SEQ ID NO: 1848244 - DNA, 21 bp, Homo sapiens
gatagacttgggatggggagg

SEQ ID NO: 1848245 - DNA, 15 bp, Homo sapiens
gatagcacagaccct

SEQ ID NO: 1848246 - DNA, 17 bp, Homo sapiens
gatagcacagaccctgc

SEQ ID NO: 1848247 - DNA, 20 bp, Homo sapiens
gatagcacagaccctgccct

SEQ ID NO: 1848248 - DNA, 19 bp, Homo sapiens
gatcacagtggccacggcc

SEQ ID NO: 1848249 - DNA, 15 bp, Homo sapiens
gatccctcatcctca

SEQ ID NO: 1848250 - DNA, 18 bp, Homo sapiens
gatcctaggcatttgctg

SEQ ID NO: 1848251 - DNA, 16 bp, Homo sapiens
gatctccctgagatgg

SEQ ID NO: 1848252 - DNA, 19 bp, Homo sapiens
gatctcttgagcctgggag

SEQ ID NO: 1848253 - DNA, 17 bp, Homo sapiens
gatctgctgaggcccag

SEQ ID NO: 1848254 - DNA, 19 bp, Homo sapiens
gatgaaagagaaggtgggt

SEQ ID NO: 1848255 - DNA, 16 bp, Homo sapiens
gatgagcatcccagga

SEQ ID NO: 1848256 - DNA, 17 bp, Homo sapiens
gatgagcatcccaggat

SEQ ID NO: 1848257 - DNA, 21 bp, Homo sapiens
gatgatctaggaagactttgg

SEQ ID NO: 1848258 - DNA, 19 bp, Homo sapiens
gatgattgcgcagggaggg

SEQ ID NO: 1848259 - DNA, 22 bp, Homo sapiens
gatgattggaggggggaggtgg

SEQ ID NO: 1848260 - DNA, 22 bp, Homo sapiens
gatgcactttgctttaatataa

SEQ ID NO: 1848261 - DNA, 19 bp, Homo sapiens
gatgcagcctcacagtcct

SEQ ID NO: 1848262 - DNA, 21 bp, Homo sapiens
gatgcatgttttccagctcct

SEQ ID NO: 1848263 - DNA, 15 bp, Homo sapiens
gatgcctgattgcca

SEQ ID NO: 1848264 - DNA, 14 bp, Homo sapiens
gatggagccccacc

SEQ ID NO: 1848265 - DNA, 22 bp, Homo sapiens
gatggatttccagccaaagcct

SEQ ID NO: 1848266 - DNA, 23 bp, Homo sapiens
gatggcatttggtctcaggcagc

SEQ ID NO: 1848267 - DNA, 20 bp, Homo sapiens
gatggcctggccagggcctg

SEQ ID NO: 1848268 - DNA, 21 bp, Homo sapiens
gatggcctggccagggcctgg

SEQ ID NO: 1848269 - DNA, 13 bp, Homo sapiens
gatgggcttccca

SEQ ID NO: 1848270 - DNA, 13 bp, Homo sapiens
gatggggccctgc

SEQ ID NO: 1848271 - DNA, 22 bp, Homo sapiens
gatggggccctgcctcctttgt

SEQ ID NO: 1848272 - DNA, 24 bp, Homo sapiens
gatggggccctgcctcctttgtga

SEQ ID NO: 1848273 - DNA, 19 bp, Homo sapiens
gatggggctgcaccggctg

SEQ ID NO: 1848274 - DNA, 23 bp, Homo sapiens
gatggggctgcaccggctggcct

SEQ ID NO: 1848275 - DNA, 13 bp, Homo sapiens
gatgtccccagca

SEQ ID NO: 1848276 - DNA, 17 bp, Homo sapiens
gatgtcctcaccacatg

SEQ ID NO: 1848277 - DNA, 21 bp, Homo sapiens
gatgtcctcaccacatgcgga

SEQ ID NO: 1848278 - DNA, 14 bp, Homo sapiens
gatgtcttcatacc

SEQ ID NO: 1848279 - DNA, 19 bp, Homo sapiens
gatgtgcttgttaactgag

SEQ ID NO: 1848280 - DNA, 14 bp, Homo sapiens
gatgttggctggga

SEQ ID NO: 1848281 - DNA, 15 bp, Homo sapiens
gatgttggctgggaa

SEQ ID NO: 1848282 - DNA, 14 bp, Homo sapiens
gatgttttccatga

SEQ ID NO: 1848283 - DNA, 15 bp, Homo sapiens
gatgttttccatgag

SEQ ID NO: 1848284 - DNA, 13 bp, Homo sapiens
gattcagacagct

SEQ ID NO: 1848285 - DNA, 17 bp, Homo sapiens
gattcagacagctgcct

SEQ ID NO: 1848286 - DNA, 12 bp, Homo sapiens
gattcatattta

SEQ ID NO: 1848287 - DNA, 17 bp, Homo sapiens
gattctatgttaatatt

SEQ ID NO: 1848288 - DNA, 23 bp, Homo sapiens
gattctcagggtctctgctgccg

SEQ ID NO: 1848289 - DNA, 17 bp, Homo sapiens
gaagggtggtggagcca

SEQ ID NO: 1848290 - DNA, 15 bp, Homo sapiens
gaaggtagaatgttt

SEQ ID NO: 1848291 - DNA, 16 bp, Homo sapiens
gaaggttctggtgtga

SEQ ID NO: 1848292 - DNA, 18 bp, Homo sapiens
gaagtcgtcttaactcac

SEQ ID NO: 1848293 - DNA, 21 bp, Homo sapiens
gaagtctctgaagtgaaactg

SEQ ID NO: 1848294 - DNA, 18 bp, Homo sapiens
gaagttgatatagaacag

SEQ ID NO: 1848295 - DNA, 20 bp, Homo sapiens
gaagtttgagatcagcctgg

SEQ ID NO: 1848296 - DNA, 17 bp, Homo sapiens
gaataatacagtatctc

SEQ ID NO: 1848297 - DNA, 21 bp, Homo sapiens
gaatacagaggcaactgcatt

SEQ ID NO: 1848298 - DNA, 16 bp, Homo sapiens
gaatctcataattgga

SEQ ID NO: 1848299 - DNA, 20 bp, Homo sapiens
gaatgatgatcctaggcatt

SEQ ID NO: 1848300 - DNA, 16 bp, Homo sapiens
gaatgcctgagtgcct

SEQ ID NO: 1848301 - DNA, 22 bp, Homo sapiens
gaatgcttataggtggcctctc

SEQ ID NO: 1848302 - DNA, 17 bp, Homo sapiens
gaatgggttttctattt

SEQ ID NO: 1848303 - DNA, 22 bp, Homo sapiens
gaatgtcagttgttatttattg

SEQ ID NO: 1848304 - DNA, 17 bp, Homo sapiens
gaatgttttcaaatgtt

SEQ ID NO: 1848305 - DNA, 13 bp, Homo sapiens
gaattatgcttcc

SEQ ID NO: 1848306 - DNA, 15 bp, Homo sapiens
gacaaatcaaagcag

SEQ ID NO: 1848307 - DNA, 22 bp, Homo sapiens
gacaacactcattgacctgagg

SEQ ID NO: 1848308 - DNA, 19 bp, Homo sapiens
gacaagtgactgtatctgt

SEQ ID NO: 1848309 - DNA, 19 bp, Homo sapiens
gacaatgatgtgagtaccc

SEQ ID NO: 1848310 - DNA, 20 bp, Homo sapiens
gacaatgtgaaaagaaaaat

SEQ ID NO: 1848311 - DNA, 14 bp, Homo sapiens
gacacaaacctgcc

SEQ ID NO: 1848312 - DNA, 15 bp, Homo sapiens
gacacagatgaaaca

SEQ ID NO: 1848313 - DNA, 17 bp, Homo sapiens
gacacaggatgaaggca

SEQ ID NO: 1848314 - DNA, 20 bp, Homo sapiens
gacacaggatgaaggcaatg

SEQ ID NO: 1848315 - DNA, 20 bp, Homo sapiens
gacacatgtccaagaagccc

SEQ ID NO: 1848316 - DNA, 12 bp, Homo sapiens
gacaccaccacc

SEQ ID NO: 1848317 - DNA, 22 bp, Homo sapiens
gacaccctgtgatggggccctg

SEQ ID NO: 1848318 - DNA, 22 bp, Homo sapiens
gacacgggcctgtccacaggct

SEQ ID NO: 1848319 - DNA, 20 bp, Homo sapiens
gacactggtattcctgcctc

SEQ ID NO: 1848320 - DNA, 12 bp, Homo sapiens
gacactgttctt

SEQ ID NO: 1848321 - DNA, 15 bp, Homo sapiens
gacagagacctcctg

SEQ ID NO: 1848322 - DNA, 21 bp, Homo sapiens
gacagagcaagtgagaccctg

SEQ ID NO: 1848323 - DNA, 21 bp, Homo sapiens
gacagagggggtggcctccca

SEQ ID NO: 1848324 - DNA, 23 bp, Homo sapiens
gacagagggggtggcctcccaac

SEQ ID NO: 1848325 - DNA, 17 bp, Homo sapiens
gacagcccgggctctgc

SEQ ID NO: 1848326 - DNA, 19 bp, Homo sapiens
gacagcccgggctctgcct

SEQ ID NO: 1848327 - DNA, 18 bp, Homo sapiens
gacagcctccccctgtcc

SEQ ID NO: 1848328 - DNA, 13 bp, Homo sapiens
gacagcgggaaaa

SEQ ID NO: 1848329 - DNA, 15 bp, Homo sapiens
gacagctgcctggga

SEQ ID NO: 1848330 - DNA, 18 bp, Homo sapiens
gacagctgcctgggatcc

SEQ ID NO: 1848331 - DNA, 20 bp, Homo sapiens
gacagctttctgggatgtca

SEQ ID NO: 1848332 - DNA, 23 bp, Homo sapiens
gacagctttctgggatgtcacag

SEQ ID NO: 1848333 - DNA, 14 bp, Homo sapiens
gacaggcagcagag

SEQ ID NO: 1848334 - DNA, 19 bp, Homo sapiens
gcaccagcccgaacaccat

SEQ ID NO: 1848335 - DNA, 21 bp, Homo sapiens
gcacccacctgttttctgaaa

SEQ ID NO: 1848336 - DNA, 22 bp, Homo sapiens
gcacccacctgttttctgaaac

SEQ ID NO: 1848337 - DNA, 19 bp, Homo sapiens
gcaccctcaggcaggtggg

SEQ ID NO: 1848338 - DNA, 17 bp, Homo sapiens
gcaccctcatacacaga

SEQ ID NO: 1848339 - DNA, 18 bp, Homo sapiens
gcaccggctggcctggcc

SEQ ID NO: 1848340 - DNA, 23 bp, Homo sapiens
gcaccggctggcctggcccctca

SEQ ID NO: 1848341 - DNA, 13 bp, Homo sapiens
gcacctgcagcca

SEQ ID NO: 1848342 - DNA, 19 bp, Homo sapiens
gcacctgcagccaagcaaa

SEQ ID NO: 1848343 - DNA, 18 bp, Homo sapiens
gcacctgcaggcgtgacc

SEQ ID NO: 1848344 - DNA, 15 bp, Homo sapiens
gcacgcgtgtgcagg

SEQ ID NO: 1848345 - DNA, 18 bp, Homo sapiens
gcacggctctgtccccag

SEQ ID NO: 1848346 - DNA, 19 bp, Homo sapiens
gcacggctctgtccccagc

SEQ ID NO: 1848347 - DNA, 15 bp, Homo sapiens
gcactcccctgctgg

SEQ ID NO: 1848348 - DNA, 17 bp, Homo sapiens
gcactgccatgcagggc

SEQ ID NO: 1848349 - DNA, 22 bp, Homo sapiens
gcactgcttccagtgaggctct

SEQ ID NO: 1848350 - DNA, 23 bp, Homo sapiens
gcactgcttccagtgaggctctg

SEQ ID NO: 1848351 - DNA, 13 bp, Homo sapiens
gcactgtgctcag

SEQ ID NO: 1848352 - DNA, 14 bp, Homo sapiens
gcactgtgctcagg

SEQ ID NO: 1848353 - DNA, 18 bp, Homo sapiens
gcactgtgctcagggcta

SEQ ID NO: 1848354 - DNA, 18 bp, Homo sapiens
gcactttaaatgaagcta

SEQ ID NO: 1848355 - DNA, 18 bp, Homo sapiens
gcactttaacacagtgtc

SEQ ID NO: 1848356 - DNA, 17 bp, Homo sapiens
gcactttgctttaatat

SEQ ID NO: 1848357 - DNA, 16 bp, Homo sapiens
gcactttgttctggct

SEQ ID NO: 1848358 - DNA, 18 bp, Homo sapiens
gcactttgttctggctct

SEQ ID NO: 1848359 - DNA, 15 bp, Homo sapiens
gcagaacctgcacac

SEQ ID NO: 1848360 - DNA, 21 bp, Homo sapiens
gcagaacctgcacacaggaca

SEQ ID NO: 1848361 - DNA, 13 bp, Homo sapiens
gcagacaggacca

SEQ ID NO: 1848362 - DNA, 21 bp, Homo sapiens
gcagagaccatccctgaaggc

SEQ ID NO: 1848363 - DNA, 22 bp, Homo sapiens
gcagagaccatccctgaaggcc

SEQ ID NO: 1848364 - DNA, 23 bp, Homo sapiens
gcagagattggaatgggcagctc

SEQ ID NO: 1848365 - DNA, 19 bp, Homo sapiens
gcagagcaccttagacagt

SEQ ID NO: 1848366 - DNA, 24 bp, Homo sapiens
gcagagcaccttagacagtccctg

SEQ ID NO: 1848367 - DNA, 13 bp, Homo sapiens
gcagagtcacacg

SEQ ID NO: 1848368 - DNA, 16 bp, Homo sapiens
gcagatttgggctgga

SEQ ID NO: 1848369 - DNA, 19 bp, Homo sapiens
gcagcagggagggcttctg

SEQ ID NO: 1848370 - DNA, 12 bp, Homo sapiens
gcagccaaggga

SEQ ID NO: 1848371 - DNA, 15 bp, Homo sapiens
gcagccacattcctg

SEQ ID NO: 1848372 - DNA, 12 bp, Homo sapiens
gcagccaggcca

SEQ ID NO: 1848373 - DNA, 15 bp, Homo sapiens
gcagcctcacagtcc

SEQ ID NO: 1848374 - DNA, 15 bp, Homo sapiens
gcagctcacctctcc

SEQ ID NO: 1848375 - DNA, 16 bp, Homo sapiens
gcagctcacctctccc

SEQ ID NO: 1848376 - DNA, 17 bp, Homo sapiens
gcagctcacctctccct

SEQ ID NO: 1848377 - DNA, 17 bp, Homo sapiens
gcagctgccaggagcac

SEQ ID NO: 1848378 - DNA, 13 bp, Homo sapiens
gcagctgctcccc

SEQ ID NO: 1848379 - DNA, 24 bp, Homo sapiens
gcaggatggcctggccagggcctg

SEQ ID NO: 1848380 - DNA, 12 bp, Homo sapiens
gcaggcagccag

SEQ ID NO: 1848381 - DNA, 21 bp, Homo sapiens
gcaggccacacttcaaactac

SEQ ID NO: 1848382 - DNA, 13 bp, Homo sapiens
gcaggcccctctc

SEQ ID NO: 1848383 - DNA, 23 bp, Homo sapiens
gcaggcccctctcctccgtggca

SEQ ID NO: 1848384 - DNA, 17 bp, Homo sapiens
gcaggctaaggcgtgga

SEQ ID NO: 1848385 - DNA, 20 bp, Homo sapiens
gcaggctaaggcgtggagct

SEQ ID NO: 1848386 - DNA, 16 bp, Homo sapiens
gcagggagggcttctg

SEQ ID NO: 1848387 - DNA, 19 bp, Homo sapiens
gcagggtcctagaaattcc

SEQ ID NO: 1848388 - DNA, 22 bp, Homo sapiens
gcaggtatgatcggcaggacac

SEQ ID NO: 1848389 - DNA, 16 bp, Homo sapiens
gcagtcccaagcggtg

SEQ ID NO: 1848390 - DNA, 14 bp, Homo sapiens
gcagtccccttccc

SEQ ID NO: 1848391 - DNA, 14 bp, Homo sapiens
gcagttggccagag

SEQ ID NO: 1848392 - DNA, 15 bp, Homo sapiens
gcatattcaggaagc

SEQ ID NO: 1848393 - DNA, 20 bp, Homo sapiens
gcatattcaggaagctcagg

SEQ ID NO: 1848394 - DNA, 15 bp, Homo sapiens
gcatcaggccaggcc

SEQ ID NO: 1848395 - DNA, 16 bp, Homo sapiens
gcatcaggccaggccc

SEQ ID NO: 1848396 - DNA, 18 bp, Homo sapiens
gcatcaggccaggccctc

SEQ ID NO: 1848397 - DNA, 19 bp, Homo sapiens
gcatcattatttatgtatt

SEQ ID NO: 1848398 - DNA, 14 bp, Homo sapiens
gcatgcctggatgg

SEQ ID NO: 1848399 - DNA, 22 bp, Homo sapiens
gcatgcctggatggggctgcac

SEQ ID NO: 1848400 - DNA, 23 bp, Homo sapiens
gcatggaaattcccttcatctgg

SEQ ID NO: 1848401 - DNA, 15 bp, Homo sapiens
gcatggagctggccg

SEQ ID NO: 1848402 - DNA, 17 bp, Homo sapiens
gcatgggtcgggagagg

SEQ ID NO: 1848403 - DNA, 20 bp, Homo sapiens
gcatgggtcgggagagggga

SEQ ID NO: 1848404 - DNA, 21 bp, Homo sapiens
gcatgggtcgggagaggggac

SEQ ID NO: 1848405 - DNA, 22 bp, Homo sapiens
gcatgtttagactttaacataa

SEQ ID NO: 1848406 - DNA, 19 bp, Homo sapiens
gcatgttttccagctcctc

SEQ ID NO: 1848407 - DNA, 12 bp, Homo sapiens
gcattccccagg

SEQ ID NO: 1848408 - DNA, 18 bp, Homo sapiens
gcattccccaggaggcca

SEQ ID NO: 1848409 - DNA, 19 bp, Homo sapiens
gcattccccaggaggccag

SEQ ID NO: 1848410 - DNA, 21 bp, Homo sapiens
gcattcttggttggctggcct

SEQ ID NO: 1848411 - DNA, 12 bp, Homo sapiens
gcatttggtctc

SEQ ID NO: 1848412 - DNA, 16 bp, Homo sapiens
gcatttggtctcaggc

SEQ ID NO: 1848413 - DNA, 19 bp, Homo sapiens
gccaaagcctcctccagcc

SEQ ID NO: 1848414 - DNA, 12 bp, Homo sapiens
gccaaataaagt

SEQ ID NO: 1848415 - DNA, 23 bp, Homo sapiens
gccaagctcaggaccaggcaatg

SEQ ID NO: 1848416 - DNA, 21 bp, Homo sapiens
gccaaggctgggggaagaagc

SEQ ID NO: 1848417 - DNA, 15 bp, Homo sapiens
gccacaaataaaatg

SEQ ID NO: 1848418 - DNA, 16 bp, Homo sapiens
gccacaagacccttgt

SEQ ID NO: 1848419 - DNA, 22 bp, Homo sapiens
gccacaagacccttgtggtccc

SEQ ID NO: 1848420 - DNA, 19 bp, Homo sapiens
gccaccaacatactcccat

SEQ ID NO: 1848421 - DNA, 21 bp, Homo sapiens
gccacccatgcagctgctccc

SEQ ID NO: 1848422 - DNA, 13 bp, Homo sapiens
gccaccctcatgc

SEQ ID NO: 1848423 - DNA, 20 bp, Homo sapiens
gccacctgcggtgctatctc

SEQ ID NO: 1848424 - DNA, 15 bp, Homo sapiens
gccacggccacagtc

SEQ ID NO: 1848425 - DNA, 15 bp, Homo sapiens
gccagaatttcaaac

SEQ ID NO: 1848426 - DNA, 21 bp, Homo sapiens
gccagagagcctggtgctgct

SEQ ID NO: 1848427 - DNA, 21 bp, Homo sapiens
gccagatgcacatccctggaa

SEQ ID NO: 1848428 - DNA, 16 bp, Homo sapiens
gccagattctttcctg

SEQ ID NO: 1848429 - DNA, 12 bp, Homo sapiens
gccagccttgac

SEQ ID NO: 1848430 - DNA, 21 bp, Homo sapiens
gccagccttgaccattctcca

SEQ ID NO: 1848431 - DNA, 18 bp, Homo sapiens
gccagctgccgcaccagc

SEQ ID NO: 1848432 - DNA, 14 bp, Homo sapiens
gccaggccctctgc

SEQ ID NO: 1848433 - DNA, 19 bp, Homo sapiens
gccaggccctctgcccact

SEQ ID NO: 1848434 - DNA, 16 bp, Homo sapiens
gccagggacagagggg

SEQ ID NO: 1848435 - DNA, 18 bp, Homo sapiens
gccagggacagagggggt

SEQ ID NO: 1848436 - DNA, 22 bp, Homo sapiens
gccagggcctggaagacagaga

SEQ ID NO: 1848437 - DNA, 13 bp, Homo sapiens
gccagttggtccc

SEQ ID NO: 1848438 - DNA, 18 bp, Homo sapiens
gccagttggtcccccttc

SEQ ID NO: 1848439 - DNA, 19 bp, Homo sapiens
gccatcctcaaacactgca

SEQ ID NO: 1848440 - DNA, 23 bp, Homo sapiens
gccatcctcaaacactgcaggca

SEQ ID NO: 1848441 - DNA, 12 bp, Homo sapiens
gccatctctgga

SEQ ID NO: 1848442 - DNA, 15 bp, Homo sapiens
gccatctctggatgc

SEQ ID NO: 1848443 - DNA, 19 bp, Homo sapiens
gccatctctggatgcctga

SEQ ID NO: 1848444 - DNA, 16 bp, Homo sapiens
gccatctgctcctgga

SEQ ID NO: 1848445 - DNA, 13 bp, Homo sapiens
gccatgcaggagg

SEQ ID NO: 1848446 - DNA, 21 bp, Homo sapiens
gccatgcaggaggtggagaaa

SEQ ID NO: 1848447 - DNA, 18 bp, Homo sapiens
gccatgccagcttatctc

SEQ ID NO: 1848448 - DNA, 21 bp, Homo sapiens
gccatgctggccaggctggtc

SEQ ID NO: 1848449 - DNA, 23 bp, Homo sapiens
gccatgttaatgtaatctgatgg

SEQ ID NO: 1848450 - DNA, 17 bp, Homo sapiens
gccattccccgtctctg

SEQ ID NO: 1848451 - DNA, 12 bp, Homo sapiens
gcccaagggtgg

SEQ ID NO: 1848452 - DNA, 22 bp, Homo sapiens
gcccacaccagggcctggctgg

SEQ ID NO: 1848453 - DNA, 14 bp, Homo sapiens
gcccacgcccccac

SEQ ID NO: 1848454 - DNA, 21 bp, Homo sapiens
gcccacgcccccactggtgac

SEQ ID NO: 1848455 - DNA, 12 bp, Homo sapiens
gcccagagggcc

SEQ ID NO: 1848456 - DNA, 14 bp, Homo sapiens
gcccagagggcctg

SEQ ID NO: 1848457 - DNA, 18 bp, Homo sapiens
gcccagagggcctgcaag

SEQ ID NO: 1848458 - DNA, 16 bp, Homo sapiens
gcctcttgtagtcttg

SEQ ID NO: 1848459 - DNA, 13 bp, Homo sapiens
gcctgatggacct

SEQ ID NO: 1848460 - DNA, 20 bp, Homo sapiens
gcctgattgccaagctcagg

SEQ ID NO: 1848461 - DNA, 12 bp, Homo sapiens
gcctgccctggt

SEQ ID NO: 1848462 - DNA, 15 bp, Homo sapiens
gcctgctccagctgt

SEQ ID NO: 1848463 - DNA, 13 bp, Homo sapiens
gcctggaagacag

SEQ ID NO: 1848464 - DNA, 15 bp, Homo sapiens
gcctggaagacagag

SEQ ID NO: 1848465 - DNA, 14 bp, Homo sapiens
gcctggatggggct

SEQ ID NO: 1848466 - DNA, 15 bp, Homo sapiens
gcctggatggggctg

SEQ ID NO: 1848467 - DNA, 20 bp, Homo sapiens
gcctggatggggctgcaccg

SEQ ID NO: 1848468 - DNA, 20 bp, Homo sapiens
gcctggcccctcagggtccc

SEQ ID NO: 1848469 - DNA, 22 bp, Homo sapiens
gcctggcccctcagggtccctg

SEQ ID NO: 1848470 - DNA, 10 bp, Homo sapiens
gcctggcctg

SEQ ID NO: 1848471 - DNA, 14 bp, Homo sapiens
gcctggcctgagct

SEQ ID NO: 1848472 - DNA, 23 bp, Homo sapiens
gcctggctccaaaccctcgaggc

SEQ ID NO: 1848473 - DNA, 21 bp, Homo sapiens
gcctgggaggtcaaggctgca

SEQ ID NO: 1848474 - DNA, 18 bp, Homo sapiens
gcctgggatccctcatcc

SEQ ID NO: 1848475 - DNA, 15 bp, Homo sapiens
gcctgtccacaggct

SEQ ID NO: 1848476 - DNA, 18 bp, Homo sapiens
gcctgtccacaggcttct

SEQ ID NO: 1848477 - DNA, 20 bp, Homo sapiens
gcctgtccacaggcttctga

SEQ ID NO: 1848478 - DNA, 16 bp, Homo sapiens
gccttgaccattctcc

SEQ ID NO: 1848479 - DNA, 20 bp, Homo sapiens
gccttgaccattctccacct

SEQ ID NO: 1848480 - DNA, 21 bp, Homo sapiens
gccttgaccattctccacctg

SEQ ID NO: 1848481 - DNA, 19 bp, Homo sapiens
gccttggaagttgcatggc

SEQ ID NO: 1848482 - DNA, 19 bp, Homo sapiens
gcctttagtgatcacagca

SEQ ID NO: 1848483 - DNA, 22 bp, Homo sapiens
gcctttagtgatcacagcagct

SEQ ID NO: 1848484 - DNA, 13 bp, Homo sapiens
gcctttggcttca

SEQ ID NO: 1848485 - DNA, 12 bp, Homo sapiens
gcgagcctgcta

SEQ ID NO: 1848486 - DNA, 21 bp, Homo sapiens
gcgcagcatattcaggaagct

SEQ ID NO: 1848487 - DNA, 16 bp, Homo sapiens
gcggcctttggcttca

SEQ ID NO: 1848488 - DNA, 16 bp, Homo sapiens
gcggctggggtcccag

SEQ ID NO: 1848489 - DNA, 19 bp, Homo sapiens
gcggctggggtcccagcag

SEQ ID NO: 1848490 - DNA, 20 bp, Homo sapiens
gcggctggggtcccagcagc

SEQ ID NO: 1848491 - DNA, 22 bp, Homo sapiens
gcggctggggtcccagcagctg

SEQ ID NO: 1848492 - DNA, 12 bp, Homo sapiens
gcggctgtgtgt

SEQ ID NO: 1848493 - DNA, 14 bp, Homo sapiens
gcgggacacaggct

SEQ ID NO: 1848494 - DNA, 17 bp, Homo sapiens
gcgtgttcagcagaacc

SEQ ID NO: 1848495 - DNA, 17 bp, Homo sapiens
gcgttccatgatgctgg

SEQ ID NO: 1848496 - DNA, 13 bp, Homo sapiens
gctaaataaacat

SEQ ID NO: 1848497 - DNA, 22 bp, Homo sapiens
gctaaataaacatgtgccctca

SEQ ID NO: 1848498 - DNA, 13 bp, Homo sapiens
gctaagatataat

SEQ ID NO: 1848499 - DNA, 16 bp, Homo sapiens
gctaaggcgtggagct

SEQ ID NO: 1848500 - DNA, 20 bp, Homo sapiens
gctaaggcgtggagctgcct

SEQ ID NO: 1848501 - DNA, 21 bp, Homo sapiens
gctaaggcgtggagctgcctg

SEQ ID NO: 1848502 - DNA, 15 bp, Homo sapiens
gctacccgggaaggg

SEQ ID NO: 1848503 - DNA, 21 bp, Homo sapiens
gctacccgggaagggggctgg

SEQ ID NO: 1848504 - DNA, 18 bp, Homo sapiens
gctaggaacactccttca

SEQ ID NO: 1848505 - DNA, 21 bp, Homo sapiens
gctagtgtggtgtttcctggc

SEQ ID NO: 1848506 - DNA, 15 bp, Homo sapiens
gctatcctggctctt

SEQ ID NO: 1848507 - DNA, 17 bp, Homo sapiens
gctatctcccccagccc

SEQ ID NO: 1848508 - DNA, 20 bp, Homo sapiens
gctatctcccccagccccat

SEQ ID NO: 1848509 - DNA, 21 bp, Homo sapiens
gctatctcccccagccccatc

SEQ ID NO: 1848510 - DNA, 22 bp, Homo sapiens
gctatctcccccagccccatcc

SEQ ID NO: 1848511 - DNA, 21 bp, Homo sapiens
gctatgtatttgcaaggctga

SEQ ID NO: 1848512 - DNA, 13 bp, Homo sapiens
gctcaatgagcat

SEQ ID NO: 1848513 - DNA, 14 bp, Homo sapiens
gctcaatgagcatg

SEQ ID NO: 1848514 - DNA, 15 bp, Homo sapiens
gctcagagagggtgg

SEQ ID NO: 1848515 - DNA, 18 bp, Homo sapiens
gctcagagagggtgggag

SEQ ID NO: 1848516 - DNA, 20 bp, Homo sapiens
gctcagagagggtgggagtg

SEQ ID NO: 1848517 - DNA, 18 bp, Homo sapiens
gctcagcactgcctgctc

SEQ ID NO: 1848518 - DNA, 22 bp, Homo sapiens
gctcagcactgcctgctcccat

SEQ ID NO: 1848519 - DNA, 14 bp, Homo sapiens
gctcaggaccaggc

SEQ ID NO: 1848520 - DNA, 15 bp, Homo sapiens
gctcaggaccaggca

SEQ ID NO: 1848521 - DNA, 17 bp, Homo sapiens
gctcagtggggcagagg

SEQ ID NO: 1848522 - DNA, 22 bp, Homo sapiens
gctcatctctgtcccacttggc

SEQ ID NO: 1848523 - DNA, 17 bp, Homo sapiens
gctccaaaccctcgagg

SEQ ID NO: 1848524 - DNA, 15 bp, Homo sapiens
gctccaagctcccag

SEQ ID NO: 1848525 - DNA, 16 bp, Homo sapiens
gctccaagctcccagg

SEQ ID NO: 1848526 - DNA, 18 bp, Homo sapiens
gctccaagctcccaggca

SEQ ID NO: 1848527 - DNA, 21 bp, Homo sapiens
gctccaagctcccaggcattc

SEQ ID NO: 1848528 - DNA, 23 bp, Homo sapiens
gctccagacacatgtccaagaag

SEQ ID NO: 1848529 - DNA, 14 bp, Homo sapiens
gctccagattctga

SEQ ID NO: 1848530 - DNA, 15 bp, Homo sapiens
gctccagattctgat

SEQ ID NO: 1848531 - DNA, 20 bp, Homo sapiens
gctccagattctgatgcata

SEQ ID NO: 1848532 - DNA, 11 bp, Homo sapiens
gctccagctgt

SEQ ID NO: 1848533 - DNA, 15 bp, Homo sapiens
gctccaggagcagcc

SEQ ID NO: 1848534 - DNA, 18 bp, Homo sapiens
gctccaggagcagccaca

SEQ ID NO: 1848535 - DNA, 13 bp, Homo sapiens
gctcccacagaac

SEQ ID NO: 1848536 - DNA, 20 bp, Homo sapiens
gctcccaggcattccccagg

SEQ ID NO: 1848537 - DNA, 21 bp, Homo sapiens
gctcccaggcattccccagga

SEQ ID NO: 1848538 - DNA, 20 bp, Homo sapiens
gctcccttcccacctctctc

SEQ ID NO: 1848539 - DNA, 21 bp, Homo sapiens
gctcctcatccagggctctga

SEQ ID NO: 1848540 - DNA, 14 bp, Homo sapiens
gctcctggcccact

SEQ ID NO: 1848541 - DNA, 16 bp, Homo sapiens
gctcgagcatgcctgg

SEQ ID NO: 1848542 - DNA, 21 bp, Homo sapiens
gctcgagcatgcctggatggg

SEQ ID NO: 1848543 - DNA, 15 bp, Homo sapiens
gctctcatagctcat

SEQ ID NO: 1848544 - DNA, 19 bp, Homo sapiens
gctctctgacgcttgtgac

SEQ ID NO: 1848545 - DNA, 11 bp, Homo sapiens
gctctgccctt

SEQ ID NO: 1848546 - DNA, 15 bp, Homo sapiens
gctctggtccataga

SEQ ID NO: 1848547 - DNA, 23 bp, Homo sapiens
gctgaaggactgtgacaggcagc

SEQ ID NO: 1848548 - DNA, 20 bp, Homo sapiens
gctgaaggctcgagcatgcc

SEQ ID NO: 1848549 - DNA, 17 bp, Homo sapiens
gctgaatacagaggcaa

SEQ ID NO: 1848550 - DNA, 22 bp, Homo sapiens
gctgaatacagaggcaactgca

SEQ ID NO: 1848551 - DNA, 19 bp, Homo sapiens
gctgacacaaacctgcctg

SEQ ID NO: 1848552 - DNA, 20 bp, Homo sapiens
gctgacacaaacctgcctgg

SEQ ID NO: 1848553 - DNA, 16 bp, Homo sapiens
gctgacacctaactct

SEQ ID NO: 1848554 - DNA, 17 bp, Homo sapiens
gctgacacctaactctt

SEQ ID NO: 1848555 - DNA, 12 bp, Homo sapiens
gctgaccagaca

SEQ ID NO: 1848556 - DNA, 14 bp, Homo sapiens
gctgagcaggccac

SEQ ID NO: 1848557 - DNA, 18 bp, Homo sapiens
gctgagggtgagtgggtg

SEQ ID NO: 1848558 - DNA, 16 bp, Homo sapiens
gctgagtctgaaggct

SEQ ID NO: 1848559 - DNA, 19 bp, Homo sapiens
gctgagtctgaaggctggg

SEQ ID NO: 1848560 - DNA, 23 bp, Homo sapiens
gctgagtgggggatcacagcctc

SEQ ID NO: 1848561 - DNA, 13 bp, Homo sapiens
gctgatggagccc

SEQ ID NO: 1848562 - DNA, 20 bp, Homo sapiens
gctgattctcagggtctctg

SEQ ID NO: 1848563 - DNA, 15 bp, Homo sapiens
gctgcaccctcaggc

SEQ ID NO: 1848564 - DNA, 18 bp, Homo sapiens
gctgcaccctcaggcagg

SEQ ID NO: 1848565 - DNA, 14 bp, Homo sapiens
gctgcaccggctgg

SEQ ID NO: 1848566 - DNA, 17 bp, Homo sapiens
gctgcaccggctggcct

SEQ ID NO: 1848567 - DNA, 18 bp, Homo sapiens
gctgcaccggctggcctg

SEQ ID NO: 1848568 - DNA, 18 bp, Homo sapiens
gctgcagatttgggctgg

SEQ ID NO: 1848569 - DNA, 21 bp, Homo sapiens
gctgcagatttgggctggaac

SEQ ID NO: 1848570 - DNA, 18 bp, Homo sapiens
gctgcagttgccagtcac

SEQ ID NO: 1848571 - DNA, 13 bp, Homo sapiens
gctgccaggagca

SEQ ID NO: 1848572 - DNA, 16 bp, Homo sapiens
gctgccctgcccacct

SEQ ID NO: 1848573 - DNA, 18 bp, Homo sapiens
gctgccctgcccacctgg

SEQ ID NO: 1848574 - DNA, 24 bp, Homo sapiens
gctgccctgcccacctggcctctg

SEQ ID NO: 1848575 - DNA, 11 bp, Homo sapiens
gctgccctgtg

SEQ ID NO: 1848576 - DNA, 16 bp, Homo sapiens
gctgccgcaccagccc

SEQ ID NO: 1848577 - DNA, 16 bp, Homo sapiens
gctgcctgggatccct

SEQ ID NO: 1848578 - DNA, 23 bp, Homo sapiens
gctgctaatattttcctcctgag

SEQ ID NO: 1848579 - DNA, 16 bp, Homo sapiens
gctgctccccaggcca

SEQ ID NO: 1848580 - DNA, 23 bp, Homo sapiens
ggaggaaggaaacccagctctgg

SEQ ID NO: 1848581 - DNA, 17 bp, Homo sapiens
ggaggatctcttgagcc

SEQ ID NO: 1848582 - DNA, 13 bp, Homo sapiens
ggagggagggctc

SEQ ID NO: 1848583 - DNA, 21 bp, Homo sapiens
ggagggagttttgtctgtctc

SEQ ID NO: 1848584 - DNA, 14 bp, Homo sapiens
ggaggggggaggtg

SEQ ID NO: 1848585 - DNA, 20 bp, Homo sapiens
ggaggtcaaggctgcagtga

SEQ ID NO: 1848586 - DNA, 16 bp, Homo sapiens
ggaggtcgaggcagga

SEQ ID NO: 1848587 - DNA, 20 bp, Homo sapiens
ggaggtgcgtgttcagcaga

SEQ ID NO: 1848588 - DNA, 22 bp, Homo sapiens
ggagtgggcccaatgcactttg

SEQ ID NO: 1848589 - DNA, 20 bp, Homo sapiens
ggagttttgtctgtctccct

SEQ ID NO: 1848590 - DNA, 16 bp, Homo sapiens
ggatcacagcctctga

SEQ ID NO: 1848591 - DNA, 22 bp, Homo sapiens
ggatccctcatcctcataccca

SEQ ID NO: 1848592 - DNA, 22 bp, Homo sapiens
ggatctttggacagaagcagct

SEQ ID NO: 1848593 - DNA, 20 bp, Homo sapiens
ggatgagcatggagctggcc

SEQ ID NO: 1848594 - DNA, 16 bp, Homo sapiens
ggatgatctaggaaga

SEQ ID NO: 1848595 - DNA, 18 bp, Homo sapiens
ggatgatctaggaagact

SEQ ID NO: 1848596 - DNA, 21 bp, Homo sapiens
ggatgattggaggggggaggt

SEQ ID NO: 1848597 - DNA, 14 bp, Homo sapiens
ggatgtcacagtcc

SEQ ID NO: 1848598 - DNA, 13 bp, Homo sapiens
ggatgtccccagc

SEQ ID NO: 1848599 - DNA, 12 bp, Homo sapiens
ggatgtccctgg

SEQ ID NO: 1848600 - DNA, 13 bp, Homo sapiens
ggattcaagtgat

SEQ ID NO: 1848601 - DNA, 18 bp, Homo sapiens
ggcaactgcattggcttt

SEQ ID NO: 1848602 - DNA, 19 bp, Homo sapiens
ggcaactgcattggctttg

SEQ ID NO: 1848603 - DNA, 11 bp, Homo sapiens
ggcaaggaagt

SEQ ID NO: 1848604 - DNA, 14 bp, Homo sapiens
ggcaaggctgtgct

SEQ ID NO: 1848605 - DNA, 12 bp, Homo sapiens
ggcactgcctga

SEQ ID NO: 1848606 - DNA, 20 bp, Homo sapiens
ggcactgcttccagtgaggc

SEQ ID NO: 1848607 - DNA, 10 bp, Homo sapiens
ggcagagcag

SEQ ID NO: 1848608 - DNA, 15 bp, Homo sapiens
ggcagagcagagacc

SEQ ID NO: 1848609 - DNA, 15 bp, Homo sapiens
ggcagaggcagtacc

SEQ ID NO: 1848610 - DNA, 17 bp, Homo sapiens
ggcagcaccacactggg

SEQ ID NO: 1848611 - DNA, 14 bp, Homo sapiens
ggcagctcacctct

SEQ ID NO: 1848612 - DNA, 23 bp, Homo sapiens
ggcaggacatgctgaagccaaag

SEQ ID NO: 1848613 - DNA, 21 bp, Homo sapiens
ggcaggactcagctccccaga

SEQ ID NO: 1848614 - DNA, 21 bp, Homo sapiens
ggcaggtatgatcggcaggac

SEQ ID NO: 1848615 - DNA, 21 bp, Homo sapiens
ggcatagctccccgcttctgc

SEQ ID NO: 1848616 - DNA, 22 bp, Homo sapiens
ggcatatttaacaaaatttgaa

SEQ ID NO: 1848617 - DNA, 13 bp, Homo sapiens
ggcatcagctggc

SEQ ID NO: 1848618 - DNA, 23 bp, Homo sapiens
ggcatgaagtttccttggctggt

SEQ ID NO: 1848619 - DNA, 14 bp, Homo sapiens
ggcatgggtcggga

SEQ ID NO: 1848620 - DNA, 15 bp, Homo sapiens
ggcattccccaggag

SEQ ID NO: 1848621 - DNA, 12 bp, Homo sapiens
ggcattgtggga

SEQ ID NO: 1848622 - DNA, 14 bp, Homo sapiens
ggcatttgctgaat

SEQ ID NO: 1848623 - DNA, 14 bp, Homo sapiens
ggcatttggcctct

SEQ ID NO: 1848624 - DNA, 17 bp, Homo sapiens
ggccaaataaagtctct

SEQ ID NO: 1848625 - DNA, 17 bp, Homo sapiens
ggccacaagacccttgt

SEQ ID NO: 1848626 - DNA, 17 bp, Homo sapiens
ggccacacttcaaacta

SEQ ID NO: 1848627 - DNA, 21 bp, Homo sapiens
ggccacagccactaatcagga

SEQ ID NO: 1848628 - DNA, 22 bp, Homo sapiens
ggccacagtcatggtggccacg

SEQ ID NO: 1848629 - DNA, 18 bp, Homo sapiens
ggccacgtgatgtggagg

SEQ ID NO: 1848630 - DNA, 14 bp, Homo sapiens
ggccactgaagata

SEQ ID NO: 1848631 - DNA, 16 bp, Homo sapiens
ggccactgtgaagaga

SEQ ID NO: 1848632 - DNA, 18 bp, Homo sapiens
ggccagagagcctggtgc

SEQ ID NO: 1848633 - DNA, 20 bp, Homo sapiens
ggccagatgcacatccctgg

SEQ ID NO: 1848634 - DNA, 23 bp, Homo sapiens
ggccagatgcacatccctggaag

SEQ ID NO: 1848635 - DNA, 18 bp, Homo sapiens
ggccaggccctctgccca

SEQ ID NO: 1848636 - DNA, 16 bp, Homo sapiens
ggccatctgctcctgg

SEQ ID NO: 1848637 - DNA, 15 bp, Homo sapiens
ggccatgcagacctc

SEQ ID NO: 1848638 - DNA, 18 bp, Homo sapiens
ggccatgcaggaggtgga

SEQ ID NO: 1848639 - DNA, 14 bp, Homo sapiens
ggcccagagggcct

SEQ ID NO: 1848640 - DNA, 20 bp, Homo sapiens
ggcccagagggcctgcaagg

SEQ ID NO: 1848641 - DNA, 19 bp, Homo sapiens
ggccccctccccccagact

SEQ ID NO: 1848642 - DNA, 16 bp, Homo sapiens
ggcccctcagggtccc

SEQ ID NO: 1848643 - DNA, 19 bp, Homo sapiens
ggcccctcagggtccctgg

SEQ ID NO: 1848644 - DNA, 12 bp, Homo sapiens
ggcccctctcct

SEQ ID NO: 1848645 - DNA, 14 bp, Homo sapiens
ggcccctctcctcc

SEQ ID NO: 1848646 - DNA, 22 bp, Homo sapiens
ggcccctctcctccgtggcaca

SEQ ID NO: 1848647 - DNA, 23 bp, Homo sapiens
ggcccctctcctccgtggcacat

SEQ ID NO: 1848648 - DNA, 17 bp, Homo sapiens
ggcccttctctccagcc

SEQ ID NO: 1848649 - DNA, 18 bp, Homo sapiens
ggcccttctctccagccc

SEQ ID NO: 1848650 - DNA, 20 bp, Homo sapiens
ggctgtgctccctggttctg

SEQ ID NO: 1848651 - DNA, 11 bp, Homo sapiens
ggctgtgtgtg

SEQ ID NO: 1848652 - DNA, 15 bp, Homo sapiens
ggcttaacttagtat

SEQ ID NO: 1848653 - DNA, 21 bp, Homo sapiens
ggcttaagtgagcagaacagg

SEQ ID NO: 1848654 - DNA, 21 bp, Homo sapiens
ggcttaattattgatgttttc

SEQ ID NO: 1848655 - DNA, 18 bp, Homo sapiens
ggcttagctttgctctgc

SEQ ID NO: 1848656 - DNA, 14 bp, Homo sapiens
ggcttagtcactga

SEQ ID NO: 1848657 - DNA, 15 bp, Homo sapiens
ggcttagtcactgag

SEQ ID NO: 1848658 - DNA, 16 bp, Homo sapiens
ggcttatccagctggt

SEQ ID NO: 1848659 - DNA, 21 bp, Homo sapiens
ggcttcacggaagagccttgc

SEQ ID NO: 1848660 - DNA, 20 bp, Homo sapiens
ggcttcccaagggctgccgg

SEQ ID NO: 1848661 - DNA, 22 bp, Homo sapiens
ggcttctgagcagcgagcctgc

SEQ ID NO: 1848662 - DNA, 13 bp, Homo sapiens
gggaaaatcagcc

SEQ ID NO: 1848663 - DNA, 23 bp, Homo sapiens
gggaaaatcagcctgctccagct

SEQ ID NO: 1848664 - DNA, 16 bp, Homo sapiens
gggaaagcccctgccc

SEQ ID NO: 1848665 - DNA, 17 bp, Homo sapiens
gggaatgcctgagtgcc

SEQ ID NO: 1848666 - DNA, 21 bp, Homo sapiens
gggaatgcctgagtgcctggc

SEQ ID NO: 1848667 - DNA, 13 bp, Homo sapiens
gggacagaggggg

SEQ ID NO: 1848668 - DNA, 23 bp, Homo sapiens
gggacagagggggtggcctccca

SEQ ID NO: 1848669 - DNA, 12 bp, Homo sapiens
gggacgcaggcc

SEQ ID NO: 1848670 - DNA, 16 bp, Homo sapiens
gggacgcaggcccctc

SEQ ID NO: 1848671 - DNA, 16 bp, Homo sapiens
gggagaccctccccac

SEQ ID NO: 1848672 - DNA, 19 bp, Homo sapiens
gggagagccttccaggggt

SEQ ID NO: 1848673 - DNA, 14 bp, Homo sapiens
gggagaggggacgc

SEQ ID NO: 1848674 - DNA, 23 bp, Homo sapiens
gggagctgggagaccctccccac

SEQ ID NO: 1848675 - DNA, 21 bp, Homo sapiens
gggaggattgcttgagctcag

SEQ ID NO: 1848676 - DNA, 11 bp, Homo sapiens
gggagggaggg

SEQ ID NO: 1848677 - DNA, 15 bp, Homo sapiens
gggagggagggctcc

SEQ ID NO: 1848678 - DNA, 18 bp, Homo sapiens
gggaggtcaaggctgcag

SEQ ID NO: 1848679 - DNA, 19 bp, Homo sapiens
gggaggtcgaggcaggagg

SEQ ID NO: 1848680 - DNA, 12 bp, Homo sapiens
gggagtggcgcg

SEQ ID NO: 1848681 - DNA, 15 bp, Homo sapiens
gggatcctccaggtg

SEQ ID NO: 1848682 - DNA, 12 bp, Homo sapiens
gggatggtgccc

SEQ ID NO: 1848683 - DNA, 22 bp, Homo sapiens
gggatgtacaaggcgatcccat

SEQ ID NO: 1848684 - DNA, 15 bp, Homo sapiens
gggcaaacaggcagt

SEQ ID NO: 1848685 - DNA, 12 bp, Homo sapiens
gggcagagtcac

SEQ ID NO: 1848686 - DNA, 16 bp, Homo sapiens
gggcagagtcacacgg

SEQ ID NO: 1848687 - DNA, 22 bp, Homo sapiens
gggcaggactcagctccccaga

SEQ ID NO: 1848688 - DNA, 16 bp, Homo sapiens
gggcaggcttggggaa

SEQ ID NO: 1848689 - DNA, 17 bp, Homo sapiens
gggcaggttggtggggg

SEQ ID NO: 1848690 - DNA, 22 bp, Homo sapiens
gggcatgggtcgggagagggga

SEQ ID NO: 1848691 - DNA, 20 bp, Homo sapiens
gggccagagtattggtctcc

SEQ ID NO: 1848692 - DNA, 18 bp, Homo sapiens
gggccagttggtccccct

SEQ ID NO: 1848693 - DNA, 23 bp, Homo sapiens
gggccagttggtcccccttccat

SEQ ID NO: 1848694 - DNA, 20 bp, Homo sapiens
gggcctcttatgggctgggt

SEQ ID NO: 1848695 - DNA, 14 bp, Homo sapiens
gggcctggctcagg

SEQ ID NO: 1848696 - DNA, 17 bp, Homo sapiens
gggcctggctcaggtgg

SEQ ID NO: 1848697 - DNA, 16 bp, Homo sapiens
gggcctttggcaggtg

SEQ ID NO: 1848698 - DNA, 13 bp, Homo sapiens
gggcgcaaagggc

SEQ ID NO: 1848699 - DNA, 23 bp, Homo sapiens
gggctacaccttagcctgccctc

SEQ ID NO: 1848700 - DNA, 14 bp, Homo sapiens
gggctaggggctgg

SEQ ID NO: 1848701 - DNA, 18 bp, Homo sapiens
gggctaggggctggggcc

SEQ ID NO: 1848702 - DNA, 22 bp, Homo sapiens
gggctcagcaaaagatgcttct

SEQ ID NO: 1848703 - DNA, 13 bp, Homo sapiens
gggctcccttccc

SEQ ID NO: 1848704 - DNA, 15 bp, Homo sapiens
gggctctgcctccca

SEQ ID NO: 1848705 - DNA, 14 bp, Homo sapiens
gggcttagagcagt

SEQ ID NO: 1848706 - DNA, 13 bp, Homo sapiens
gggcttcccaagg

SEQ ID NO: 1848707 - DNA, 16 bp, Homo sapiens
gggcttcccaagggct

SEQ ID NO: 1848708 - DNA, 17 bp, Homo sapiens
ggggaaaatcagcctgc

SEQ ID NO: 1848709 - DNA, 13 bp, Homo sapiens
ggggacgcaggcc

SEQ ID NO: 1848710 - DNA, 20 bp, Homo sapiens
ggggcagctgatacaaattg

SEQ ID NO: 1848711 - DNA, 16 bp, Homo sapiens
ggggctaggggctggg

SEQ ID NO: 1848712 - DNA, 17 bp, Homo sapiens
ggggctgaggtgggagg

SEQ ID NO: 1848713 - DNA, 12 bp, Homo sapiens
ggggtggcctcc

SEQ ID NO: 1848714 - DNA, 14 bp, Homo sapiens
gggtcactctggca

SEQ ID NO: 1848715 - DNA, 15 bp, Homo sapiens
gggtctctgctgccg

SEQ ID NO: 1848716 - DNA, 19 bp, Homo sapiens
gggtgacagagcaagtgag

SEQ ID NO: 1848717 - DNA, 19 bp, Homo sapiens
gggtgcgtctccagtcatc

SEQ ID NO: 1848718 - DNA, 14 bp, Homo sapiens
gggtggcctcccaa

SEQ ID NO: 1848719 - DNA, 18 bp, Homo sapiens
gggtgggacaccctgtga

SEQ ID NO: 1848720 - DNA, 23 bp, Homo sapiens
gggttcccttttttggctgctga

SEQ ID NO: 1848721 - DNA, 22 bp, Homo sapiens
gggttctacccaggtgctagga

SEQ ID NO: 1848722 - DNA, 23 bp, Homo sapiens
ggtagaatgttttcaaatgttct

SEQ ID NO: 1848723 - DNA, 17 bp, Homo sapiens
ggtaggggagggcaggc

SEQ ID NO: 1848724 - DNA, 19 bp, Homo sapiens
ggtcaggttctaccctcca

SEQ ID NO: 1848725 - DNA, 17 bp, Homo sapiens
ggtccagccctggctga

SEQ ID NO: 1848726 - DNA, 19 bp, Homo sapiens
ggtccagccctggctgaag

SEQ ID NO: 1848727 - DNA, 20 bp, Homo sapiens
ggtccagccctggctgaagg

SEQ ID NO: 1848728 - DNA, 22 bp, Homo sapiens
ggtccagccctggctgaaggac

SEQ ID NO: 1848729 - DNA, 23 bp, Homo sapiens
ggtccagccctggctgaaggact

SEQ ID NO: 1848730 - DNA, 14 bp, Homo sapiens
ggtcccaccccaca

SEQ ID NO: 1848731 - DNA, 22 bp, Homo sapiens
ggtcccaccccacacacgccag

SEQ ID NO: 1848732 - DNA, 14 bp, Homo sapiens
ggtcccagcagctg

SEQ ID NO: 1848733 - DNA, 15 bp, Homo sapiens
ggtcccagcagctgc

SEQ ID NO: 1848734 - DNA, 13 bp, Homo sapiens
ggtcccccttcca

SEQ ID NO: 1848735 - DNA, 23 bp, Homo sapiens
ggtcccccttccatggactttgt

SEQ ID NO: 1848736 - DNA, 11 bp, Homo sapiens
ggtcctgctgc

SEQ ID NO: 1848737 - DNA, 10 bp, Homo sapiens
ggtccttcaa

SEQ ID NO: 1848738 - DNA, 13 bp, Homo sapiens
ggtcgaggcagga

SEQ ID NO: 1848739 - DNA, 13 bp, Homo sapiens
ggtcggaccagct

SEQ ID NO: 1848740 - DNA, 17 bp, Homo sapiens
ggtctacactgtgctga

SEQ ID NO: 1848741 - DNA, 16 bp, Homo sapiens
ggtctctaggctgggg

SEQ ID NO: 1848742 - DNA, 15 bp, Homo sapiens
ggtgagaagcagagg

SEQ ID NO: 1848743 - DNA, 19 bp, Homo sapiens
ggtgagcccatggccctcc

SEQ ID NO: 1848744 - DNA, 20 bp, Homo sapiens
ggtgcacttttctgtgtcat

SEQ ID NO: 1848745 - DNA, 18 bp, Homo sapiens
ggtgccacaaataaaatg

SEQ ID NO: 1848746 - DNA, 20 bp, Homo sapiens
ggtgcgtgttcagcagaacc

SEQ ID NO: 1848747 - DNA, 16 bp, Homo sapiens
ggtgctatctccccca

SEQ ID NO: 1848748 - DNA, 21 bp, Homo sapiens
ggtgctatctcccccagcccc

SEQ ID NO: 1848749 - DNA, 22 bp, Homo sapiens
ggtgctatctcccccagcccca

SEQ ID NO: 1848750 - DNA, 21 bp, Homo sapiens
ggtggatgttatgaacagctg

SEQ ID NO: 1848751 - DNA, 17 bp, Homo sapiens
ggtggcaaggctgtgct

SEQ ID NO: 1848752 - DNA, 20 bp, Homo sapiens
ggtggcaaggctgtgctccc

SEQ ID NO: 1848753 - DNA, 14 bp, Homo sapiens
ggtggcaccagcag

SEQ ID NO: 1848754 - DNA, 20 bp, Homo sapiens
ggtggcaccagcagcctgga

SEQ ID NO: 1848755 - DNA, 13 bp, Homo sapiens
ggtggcactgcca

SEQ ID NO: 1848756 - DNA, 13 bp, Homo sapiens
ggtggcctcccaa

SEQ ID NO: 1848757 - DNA, 22 bp, Homo sapiens
ggtggcctcccaactcacccca

SEQ ID NO: 1848758 - DNA, 23 bp, Homo sapiens
ggtggcctctccttgtggcctgg

SEQ ID NO: 1848759 - DNA, 20 bp, Homo sapiens
ggtgggaggatctcttgagc

SEQ ID NO: 1848760 - DNA, 14 bp, Homo sapiens
ggtgggatcctcca

SEQ ID NO: 1848761 - DNA, 14 bp, Homo sapiens
ggtgggcttcccag

SEQ ID NO: 1848762 - DNA, 21 bp, Homo sapiens
ggtggttatggagagggtgtc

SEQ ID NO: 1848763 - DNA, 13 bp, Homo sapiens
ggttaagtctgtt

SEQ ID NO: 1848764 - DNA, 23 bp, Homo sapiens
ggttaagtctgttttatgacttc

SEQ ID NO: 1848765 - DNA, 21 bp, Homo sapiens
ggttacccagttagctctcaa

SEQ ID NO: 1848766 - DNA, 15 bp, Homo sapiens
ggttatctgtcccag

SEQ ID NO: 1848767 - DNA, 22 bp, Homo sapiens
ggttccctttgacgccatccca

SEQ ID NO: 1848768 - DNA, 14 bp, Homo sapiens
ggttcttgtattaa

SEQ ID NO: 1848769 - DNA, 13 bp, Homo sapiens
ggttgaggtttca

SEQ ID NO: 1848770 - DNA, 12 bp, Homo sapiens
ggtttaaatgaa

SEQ ID NO: 1848771 - DNA, 17 bp, Homo sapiens
ggtttaaatgaacaaga

SEQ ID NO: 1848772 - DNA, 16 bp, Homo sapiens
gtaaaataaaaggtcg

SEQ ID NO: 1848773 - DNA, 20 bp, Homo sapiens
gtaaagggcgcaaagggcat

SEQ ID NO: 1848774 - DNA, 14 bp, Homo sapiens
gtaaagtgaagaat

SEQ ID NO: 1848775 - DNA, 12 bp, Homo sapiens
gtaaatataaag

SEQ ID NO: 1848776 - DNA, 14 bp, Homo sapiens
gtaaatataaagac

SEQ ID NO: 1848777 - DNA, 17 bp, Homo sapiens
gtaacagtcatcattta

SEQ ID NO: 1848778 - DNA, 19 bp, Homo sapiens
gtaacagtcatcatttatc

SEQ ID NO: 1848779 - DNA, 15 bp, Homo sapiens
gtaacatttctgttc

SEQ ID NO: 1848780 - DNA, 17 bp, Homo sapiens
gtaacatttctgttctc

SEQ ID NO: 1848781 - DNA, 17 bp, Homo sapiens
gtaagagcttgctccag

SEQ ID NO: 1848782 - DNA, 20 bp, Homo sapiens
gtaaggaatacctgtccccc

SEQ ID NO: 1848783 - DNA, 22 bp, Homo sapiens
gtaagtgttctcatgaagcagg

SEQ ID NO: 1848784 - DNA, 19 bp, Homo sapiens
gtaatctcacagcatttgc

SEQ ID NO: 1848785 - DNA, 12 bp, Homo sapiens
gtacagagccca

SEQ ID NO: 1848786 - DNA, 17 bp, Homo sapiens
gtacccaggatgatttc

SEQ ID NO: 1848787 - DNA, 15 bp, Homo sapiens
gtacctgggcaagct

SEQ ID NO: 1848788 - DNA, 18 bp, Homo sapiens
gtactacagtcctcccat

SEQ ID NO: 1848789 - DNA, 15 bp, Homo sapiens
gtagagtgggagctg

SEQ ID NO: 1848790 - DNA, 20 bp, Homo sapiens
gtaggggagggcaggcttgg

SEQ ID NO: 1848791 - DNA, 13 bp, Homo sapiens
gtagtgctttgag

SEQ ID NO: 1848792 - DNA, 20 bp, Homo sapiens
gtagttttgtgatgcatttt

SEQ ID NO: 1848793 - DNA, 22 bp, Homo sapiens
gtataaacaagaaaaataaaga

SEQ ID NO: 1848794 - DNA, 21 bp, Homo sapiens
gtatagtgtctattatcacat

SEQ ID NO: 1848795 - DNA, 13 bp, Homo sapiens
gtattaaagacag

SEQ ID NO: 1848796 - DNA, 17 bp, Homo sapiens
gtattgaagcattttat

SEQ ID NO: 1848797 - DNA, 22 bp, Homo sapiens
gtattgaagcattttataaatc

SEQ ID NO: 1848798 - DNA, 23 bp, Homo sapiens
gtatttgtttgcataggtgatct

SEQ ID NO: 1848799 - DNA, 16 bp, Homo sapiens
gtattttatgttatat

SEQ ID NO: 1848800 - DNA, 16 bp, Homo sapiens
gtcaagtgaaaaagga

SEQ ID NO: 1848801 - DNA, 19 bp, Homo sapiens
gtcaagtgaaaaaggagga

SEQ ID NO: 1848802 - DNA, 15 bp, Homo sapiens
gtcaccccggccacc

SEQ ID NO: 1848803 - DNA, 17 bp, Homo sapiens
gtcaccccggccacctg

SEQ ID NO: 1848804 - DNA, 22 bp, Homo sapiens
gtcaccccggccacctgcggtg

SEQ ID NO: 1848805 - DNA, 16 bp, Homo sapiens
gtcactctggcagctc

SEQ ID NO: 1848806 - DNA, 14 bp, Homo sapiens
gtcactgagacagc

SEQ ID NO: 1848807 - DNA, 16 bp, Homo sapiens
gtcactgagacagccc

SEQ ID NO: 1848808 - DNA, 23 bp, Homo sapiens
gtcagtgtccaaagcagggtctg

SEQ ID NO: 1848809 - DNA, 14 bp, Homo sapiens
gtcatctgtaagag

SEQ ID NO: 1848810 - DNA, 21 bp, Homo sapiens
gtcatctgtaagagcttgctc

SEQ ID NO: 1848811 - DNA, 16 bp, Homo sapiens
gtcatgcaaaggctgg

SEQ ID NO: 1848812 - DNA, 13 bp, Homo sapiens
gtccaagaagccc

SEQ ID NO: 1848813 - DNA, 15 bp, Homo sapiens
gtccaagaagcccag

SEQ ID NO: 1848814 - DNA, 18 bp, Homo sapiens
gtccaagaagcccaggaa

SEQ ID NO: 1848815 - DNA, 17 bp, Homo sapiens
gtccaaggaaaccacag

SEQ ID NO: 1848816 - DNA, 13 bp, Homo sapiens
gtccacaggaagt

SEQ ID NO: 1848817 - DNA, 22 bp, Homo sapiens
gtccacaggcttctgagcagcg

SEQ ID NO: 1848818 - DNA, 18 bp, Homo sapiens
gtccagccctggctgaag

SEQ ID NO: 1848819 - DNA, 19 bp, Homo sapiens
gtccagccctggctgaagg

SEQ ID NO: 1848820 - DNA, 20 bp, Homo sapiens
gtccagccctggctgaagga

SEQ ID NO: 1848821 - DNA, 23 bp, Homo sapiens
gtccagccctggctgaaggactg

SEQ ID NO: 1848822 - DNA, 17 bp, Homo sapiens
gtcccagatacttgggg

SEQ ID NO: 1848823 - DNA, 17 bp, Homo sapiens
gtcccaggttatctggg

SEQ ID NO: 1848824 - DNA, 17 bp, Homo sapiens
gtccccaccgcagacag

SEQ ID NO: 1848825 - DNA, 22 bp, Homo sapiens
gtccccaccgcagacaggacca

SEQ ID NO: 1848826 - DNA, 12 bp, Homo sapiens
gtccccagcaga

SEQ ID NO: 1848827 - DNA, 11 bp, Homo sapiens
gtccctgccaa

SEQ ID NO: 1848828 - DNA, 14 bp, Homo sapiens
gtccctgccaatgg

SEQ ID NO: 1848829 - DNA, 17 bp, Homo sapiens
gtccctggtggcagctc

SEQ ID NO: 1848830 - DNA, 12 bp, Homo sapiens
gtcctcccatct

SEQ ID NO: 1848831 - DNA, 17 bp, Homo sapiens
gtcctgctgcagttgcc

SEQ ID NO: 1848832 - DNA, 19 bp, Homo sapiens
gtcctgctgcagttgccag

SEQ ID NO: 1848833 - DNA, 15 bp, Homo sapiens
gtccttaccagcaga

SEQ ID NO: 1848834 - DNA, 16 bp, Homo sapiens
gtccttaccagcagag

SEQ ID NO: 1848835 - DNA, 14 bp, Homo sapiens
gtcgtgggatggca

SEQ ID NO: 1848836 - DNA, 16 bp, Homo sapiens
gtcgttttttttttgt

SEQ ID NO: 1848837 - DNA, 21 bp, Homo sapiens
gtcgttttttttttgtttgtt

SEQ ID NO: 1848838 - DNA, 17 bp, Homo sapiens
gtctagggtgtgattta

SEQ ID NO: 1848839 - DNA, 14 bp, Homo sapiens
gtctattatcacat

SEQ ID NO: 1848840 - DNA, 19 bp, Homo sapiens
gtctcaaaaaaagaaaaag

SEQ ID NO: 1848841 - DNA, 13 bp, Homo sapiens
gtctcaggcagca

SEQ ID NO: 1848842 - DNA, 19 bp, Homo sapiens
gtctccctcccctctcaga

SEQ ID NO: 1848843 - DNA, 15 bp, Homo sapiens
gtctcctctcagccc

SEQ ID NO: 1848844 - DNA, 12 bp, Homo sapiens
gtctctgctgcc

SEQ ID NO: 1848845 - DNA, 15 bp, Homo sapiens
gtctcttatggatgt

SEQ ID NO: 1848846 - DNA, 22 bp, Homo sapiens
gtctcttatggatgtccccagc

SEQ ID NO: 1848847 - DNA, 18 bp, Homo sapiens
gtctcttggtcctgctgc

SEQ ID NO: 1848848 - DNA, 14 bp, Homo sapiens
gtctgccaaacaca

SEQ ID NO: 1848849 - DNA, 13 bp, Homo sapiens
gtctgttttatga

SEQ ID NO: 1848850 - DNA, 16 bp, Homo sapiens
gtcttcagtaagccgt

SEQ ID NO: 1848851 - DNA, 15 bp, Homo sapiens
gtctttggaccctga

SEQ ID NO: 1848852 - DNA, 14 bp, Homo sapiens
gtgaacattcccag

SEQ ID NO: 1848853 - DNA, 15 bp, Homo sapiens
gtgaacattcccagc

SEQ ID NO: 1848854 - DNA, 17 bp, Homo sapiens
gtgaacttgggccactg

SEQ ID NO: 1848855 - DNA, 15 bp, Homo sapiens
gtgacaggcagcaga

SEQ ID NO: 1848856 - DNA, 16 bp, Homo sapiens
gtgacaggcagcagag

SEQ ID NO: 1848857 - DNA, 18 bp, Homo sapiens
gtgaccatgttttgttta

SEQ ID NO: 1848858 - DNA, 14 bp, Homo sapiens
gtgagcagaacagg

SEQ ID NO: 1848859 - DNA, 16 bp, Homo sapiens
gtgagcagaacaggta

SEQ ID NO: 1848860 - DNA, 15 bp, Homo sapiens
gtgagcaggctgtga

SEQ ID NO: 1848861 - DNA, 17 bp, Homo sapiens
gtgagcaggctgtgagt

SEQ ID NO: 1848862 - DNA, 17 bp, Homo sapiens
gtgagcccatggccctc

SEQ ID NO: 1848863 - DNA, 19 bp, Homo sapiens
gtgagctggatagacttgg

SEQ ID NO: 1848864 - DNA, 19 bp, Homo sapiens
gtgaggaagccgctggggc

SEQ ID NO: 1848865 - DNA, 12 bp, Homo sapiens
gtgaggctctgc

SEQ ID NO: 1848866 - DNA, 13 bp, Homo sapiens
gtgaggctctgcc

SEQ ID NO: 1848867 - DNA, 15 bp, Homo sapiens
gtgaggctctgccct

SEQ ID NO: 1848868 - DNA, 16 bp, Homo sapiens
gtgaggctctgccctt

SEQ ID NO: 1848869 - DNA, 17 bp, Homo sapiens
gtgatcacagcagcttc

SEQ ID NO: 1848870 - DNA, 14 bp, Homo sapiens
gtgatctcatttaa

SEQ ID NO: 1848871 - DNA, 19 bp, Homo sapiens
gtgatggggccctgcctcc

SEQ ID NO: 1848872 - DNA, 13 bp, Homo sapiens
gtgcacaagctcc

SEQ ID NO: 1848873 - DNA, 21 bp, Homo sapiens
gtgcacaagctccaagctccc

SEQ ID NO: 1848874 - DNA, 17 bp, Homo sapiens
gtgcacatctgttttgt

SEQ ID NO: 1848875 - DNA, 16 bp, Homo sapiens
gtgcgtctccagtcat

SEQ ID NO: 1848876 - DNA, 12 bp, Homo sapiens
gtgcgtgctcag

SEQ ID NO: 1848877 - DNA, 18 bp, Homo sapiens
gtgctaggaacactcctt

SEQ ID NO: 1848878 - DNA, 13 bp, Homo sapiens
gtgctcagggcta

SEQ ID NO: 1848879 - DNA, 13 bp, Homo sapiens
gtgctccaggcag

SEQ ID NO: 1848880 - DNA, 22 bp, Homo sapiens
gtgctctttgttttgtgtctct

SEQ ID NO: 1848881 - DNA, 23 bp, Homo sapiens
gtgctctttgttttgtgtctctt

SEQ ID NO: 1848882 - DNA, 12 bp, Homo sapiens
gtgctgccctgc

SEQ ID NO: 1848883 - DNA, 18 bp, Homo sapiens
gtgctgccctgcccacct

SEQ ID NO: 1848884 - DNA, 21 bp, Homo sapiens
gtgctgccctgcccacctggc

SEQ ID NO: 1848885 - DNA, 15 bp, Homo sapiens
gtgctgctgctgctg

SEQ ID NO: 1848886 - DNA, 21 bp, Homo sapiens
gtgctgggaattacaggcgtg

SEQ ID NO: 1848887 - DNA, 16 bp, Homo sapiens
gtgcttgccacagagc

SEQ ID NO: 1848888 - DNA, 13 bp, Homo sapiens
gtgcttggaggaa

SEQ ID NO: 1848889 - DNA, 12 bp, Homo sapiens
gtggaaaaccag

SEQ ID NO: 1848890 - DNA, 13 bp, Homo sapiens
gtggagctgcctg

SEQ ID NO: 1848891 - DNA, 16 bp, Homo sapiens
gtggcaaggctgtgct

SEQ ID NO: 1848892 - DNA, 18 bp, Homo sapiens
gtggcaccagcagcctgg

SEQ ID NO: 1848893 - DNA, 20 bp, Homo sapiens
gtggcagctcacctctccct

SEQ ID NO: 1848894 - DNA, 22 bp, Homo sapiens
gtggcagctcacctctcccttg

SEQ ID NO: 1848895 - DNA, 23 bp, Homo sapiens
tagagctgacacaaacctgcctg

SEQ ID NO: 1848896 - DNA, 14 bp, Homo sapiens
tagcacagaccctg

SEQ ID NO: 1848897 - DNA, 20 bp, Homo sapiens
tagcacagaccctgccctgt

SEQ ID NO: 1848898 - DNA, 20 bp, Homo sapiens
tagcacatgatttgggctct

SEQ ID NO: 1848899 - DNA, 15 bp, Homo sapiens
tagcagatttaagat

SEQ ID NO: 1848900 - DNA, 16 bp, Homo sapiens
tagcagtccccttccc

SEQ ID NO: 1848901 - DNA, 16 bp, Homo sapiens
tagcattttgctaaat

SEQ ID NO: 1848902 - DNA, 16 bp, Homo sapiens
tagctcaatgagcatg

SEQ ID NO: 1848903 - DNA, 12 bp, Homo sapiens
tagcttatgaaa

SEQ ID NO: 1848904 - DNA, 16 bp, Homo sapiens
tagctttgctctgcca

SEQ ID NO: 1848905 - DNA, 13 bp, Homo sapiens
taggaacactcct

SEQ ID NO: 1848906 - DNA, 15 bp, Homo sapiens
taggaagactttgga

SEQ ID NO: 1848907 - DNA, 16 bp, Homo sapiens
taggaagactttggaa

SEQ ID NO: 1848908 - DNA, 14 bp, Homo sapiens
taggaatcagcaag

SEQ ID NO: 1848909 - DNA, 15 bp, Homo sapiens
taggacgccacccag

SEQ ID NO: 1848910 - DNA, 19 bp, Homo sapiens
taggctgacacctaactct

SEQ ID NO: 1848911 - DNA, 13 bp, Homo sapiens
tagggaaaacatt

SEQ ID NO: 1848912 - DNA, 16 bp, Homo sapiens
tagggaaaacattcca

SEQ ID NO: 1848913 - DNA, 21 bp, Homo sapiens
taggtgatctcatttaatcct

SEQ ID NO: 1848914 - DNA, 15 bp, Homo sapiens
taggtggcaaggctg

SEQ ID NO: 1848915 - DNA, 16 bp, Homo sapiens
taggtggcaaggctgt

SEQ ID NO: 1848916 - DNA, 14 bp, Homo sapiens
tagtaattctcagg

SEQ ID NO: 1848917 - DNA, 23 bp, Homo sapiens
tagtatgtgcatttaattagaaa

SEQ ID NO: 1848918 - DNA, 15 bp, Homo sapiens
tagtattacaccacc

SEQ ID NO: 1848919 - DNA, 14 bp, Homo sapiens
tagtcactgagaca

SEQ ID NO: 1848920 - DNA, 17 bp, Homo sapiens
tagtcactgagacagcc

SEQ ID NO: 1848921 - DNA, 13 bp, Homo sapiens
tagtcttggctaa

SEQ ID NO: 1848922 - DNA, 14 bp, Homo sapiens
tagtgatcacagca

SEQ ID NO: 1848923 - DNA, 15 bp, Homo sapiens
tagtgatcacagcag

SEQ ID NO: 1848924 - DNA, 20 bp, Homo sapiens
tagtggcttcattagagcag

SEQ ID NO: 1848925 - DNA, 22 bp, Homo sapiens
tagttactaaacatgtatgtaa

SEQ ID NO: 1848926 - DNA, 17 bp, Homo sapiens
tagttgcaatagaacag

SEQ ID NO: 1848927 - DNA, 17 bp, Homo sapiens
tataaagacgttttata

SEQ ID NO: 1848928 - DNA, 22 bp, Homo sapiens
tcaggagcagcctcagaacaaa

SEQ ID NO: 1848929 - DNA, 16 bp, Homo sapiens
tcaggagtgtgtgtga

SEQ ID NO: 1848930 - DNA, 18 bp, Homo sapiens
tcaggcagcaccacactg

SEQ ID NO: 1848931 - DNA, 13 bp, Homo sapiens
tcaggccaggccc

SEQ ID NO: 1848932 - DNA, 17 bp, Homo sapiens
tcaggccaggccctctg

SEQ ID NO: 1848933 - DNA, 19 bp, Homo sapiens
tcaggccaggccctctgcc

SEQ ID NO: 1848934 - DNA, 23 bp, Homo sapiens
tcaggccatcatcagtggagcca

SEQ ID NO: 1848935 - DNA, 14 bp, Homo sapiens
tcagggcctggctc

SEQ ID NO: 1848936 - DNA, 12 bp, Homo sapiens
tcaggggtgtgc

SEQ ID NO: 1848937 - DNA, 14 bp, Homo sapiens
tcagggtccctggt

SEQ ID NO: 1848938 - DNA, 18 bp, Homo sapiens
tcagggtccctggtggca

SEQ ID NO: 1848939 - DNA, 15 bp, Homo sapiens
tcaggtcccctttca

SEQ ID NO: 1848940 - DNA, 22 bp, Homo sapiens
tcaggtgctgaagggtaatatg

SEQ ID NO: 1848941 - DNA, 20 bp, Homo sapiens
tcaggtggggtcactctggc

SEQ ID NO: 1848942 - DNA, 22 bp, Homo sapiens
tcaggtggggtcactctggcag

SEQ ID NO: 1848943 - DNA, 18 bp, Homo sapiens
tcagtaacatttctgttc

SEQ ID NO: 1848944 - DNA, 21 bp, Homo sapiens
tcagtaagacgacaaggaaag

SEQ ID NO: 1848945 - DNA, 22 bp, Homo sapiens
tcagtaagacgacaaggaaagg

SEQ ID NO: 1848946 - DNA, 16 bp, Homo sapiens
tcagtagactgtgatt

SEQ ID NO: 1848947 - DNA, 17 bp, Homo sapiens
tcagtattgaagcattt

SEQ ID NO: 1848948 - DNA, 22 bp, Homo sapiens
tcagtattgaagcattttataa

SEQ ID NO: 1848949 - DNA, 20 bp, Homo sapiens
tcagtggggcccatggatgt

SEQ ID NO: 1848950 - DNA, 11 bp, Homo sapiens
tcagtgtcctc

SEQ ID NO: 1848951 - DNA, 16 bp, Homo sapiens
tcagttaagcctttgg

SEQ ID NO: 1848952 - DNA, 20 bp, Homo sapiens
tcagttcagaatcacttctg

SEQ ID NO: 1848953 - DNA, 19 bp, Homo sapiens
tcataagagtaacagtcat

SEQ ID NO: 1848954 - DNA, 23 bp, Homo sapiens
tcataaggcatatacaaataaac

SEQ ID NO: 1848955 - DNA, 14 bp, Homo sapiens
tcatacccaccccc

SEQ ID NO: 1848956 - DNA, 15 bp, Homo sapiens
tcatacccaccccca

SEQ ID NO: 1848957 - DNA, 19 bp, Homo sapiens
tcatacttaactttactaa

SEQ ID NO: 1848958 - DNA, 11 bp, Homo sapiens
tcatcaagact

SEQ ID NO: 1848959 - DNA, 16 bp, Homo sapiens
tcatcagtattgaagc

SEQ ID NO: 1848960 - DNA, 23 bp, Homo sapiens
tcatcagtattgaagcattttat

SEQ ID NO: 1848961 - DNA, 15 bp, Homo sapiens
tcatcagtggagcca

SEQ ID NO: 1848962 - DNA, 14 bp, Homo sapiens
tcatccagggctct

SEQ ID NO: 1848963 - DNA, 13 bp, Homo sapiens
tcatccatccagg

SEQ ID NO: 1848964 - DNA, 18 bp, Homo sapiens
tcatccctaatgctgcag

SEQ ID NO: 1848965 - DNA, 13 bp, Homo sapiens
tcatctggaacca

SEQ ID NO: 1848966 - DNA, 16 bp, Homo sapiens
tcatgaatctgcaatg

SEQ ID NO: 1848967 - DNA, 22 bp, Homo sapiens
tcatgattcacccccaaacagt

SEQ ID NO: 1848968 - DNA, 15 bp, Homo sapiens
tcatgcatggaaatt

SEQ ID NO: 1848969 - DNA, 14 bp, Homo sapiens
tcatgcccagctct

SEQ ID NO: 1848970 - DNA, 18 bp, Homo sapiens
tcatggtggccacggcca

SEQ ID NO: 1848971 - DNA, 12 bp, Homo sapiens
tcattagagcag

SEQ ID NO: 1848972 - DNA, 14 bp, Homo sapiens
tcattagttttgaa

SEQ ID NO: 1848973 - DNA, 17 bp, Homo sapiens
tcattatttatgtattg

SEQ ID NO: 1848974 - DNA, 19 bp, Homo sapiens
tcattccattctggaagtg

SEQ ID NO: 1848975 - DNA, 22 bp, Homo sapiens
tcattgacctgaggcccttctc

SEQ ID NO: 1848976 - DNA, 19 bp, Homo sapiens
tcattggaaatttagcatt

SEQ ID NO: 1848977 - DNA, 15 bp, Homo sapiens
tcatttcaggagcag

SEQ ID NO: 1848978 - DNA, 18 bp, Homo sapiens
tcatttgtgccagaatgc

SEQ ID NO: 1848979 - DNA, 12 bp, Homo sapiens
tcatttgttcat

SEQ ID NO: 1848980 - DNA, 16 bp, Homo sapiens
tcatttgttcattaaa

SEQ ID NO: 1848981 - DNA, 18 bp, Homo sapiens
tcatttgttcattaaacg

SEQ ID NO: 1848982 - DNA, 20 bp, Homo sapiens
tccaaagagtgctaagcatt

SEQ ID NO: 1848983 - DNA, 21 bp, Homo sapiens
tccaaaggccatggagagctg

SEQ ID NO: 1848984 - DNA, 14 bp, Homo sapiens
tccaaatgcagctt

SEQ ID NO: 1848985 - DNA, 23 bp, Homo sapiens
tccaaccctcatcaccaacgtct

SEQ ID NO: 1848986 - DNA, 16 bp, Homo sapiens
tccaagaagcccagga

SEQ ID NO: 1848987 - DNA, 17 bp, Homo sapiens
tccaagagtctgatgat

SEQ ID NO: 1848988 - DNA, 12 bp, Homo sapiens
tccaagctccca

SEQ ID NO: 1848989 - DNA, 13 bp, Homo sapiens
tccaagctcccag

SEQ ID NO: 1848990 - DNA, 16 bp, Homo sapiens
tccaagctcccaggca

SEQ ID NO: 1848991 - DNA, 16 bp, Homo sapiens
tccaattaaggatttt

SEQ ID NO: 1848992 - DNA, 13 bp, Homo sapiens
tccacaggaagtg

SEQ ID NO: 1848993 - DNA, 18 bp, Homo sapiens
tccacaggcaaaactcag

SEQ ID NO: 1848994 - DNA, 15 bp, Homo sapiens
tccacctgccaggga

SEQ ID NO: 1848995 - DNA, 20 bp, Homo sapiens
tccaccttccaaagagtgct

SEQ ID NO: 1848996 - DNA, 22 bp, Homo sapiens
tccagaagtttgagatcagcct

SEQ ID NO: 1848997 - DNA, 13 bp, Homo sapiens
tccagattctgat

SEQ ID NO: 1848998 - DNA, 14 bp, Homo sapiens
tccagattctgatg

SEQ ID NO: 1848999 - DNA, 17 bp, Homo sapiens
tccagattctgatgcat

SEQ ID NO: 1849000 - DNA, 14 bp, Homo sapiens
tccagccagggctg

SEQ ID NO: 1849001 - DNA, 17 bp, Homo sapiens
tccagccagggctgcta

SEQ ID NO: 1849002 - DNA, 15 bp, Homo sapiens
tccagcccctggatg

SEQ ID NO: 1849003 - DNA, 12 bp, Homo sapiens
tccaggagcagc

SEQ ID NO: 1849004 - DNA, 14 bp, Homo sapiens
tccaggagcagcca

SEQ ID NO: 1849005 - DNA, 16 bp, Homo sapiens
tccaggagcagccaca

SEQ ID NO: 1849006 - DNA, 22 bp, Homo sapiens
tccaggagcagccacattcctg

SEQ ID NO: 1849007 - DNA, 23 bp, Homo sapiens
tccaggctgggagagccttccag

SEQ ID NO: 1849008 - DNA, 13 bp, Homo sapiens
tccagggctctga

SEQ ID NO: 1849009 - DNA, 17 bp, Homo sapiens
tccaggtttaagctgtt

SEQ ID NO: 1849010 - DNA, 18 bp, Homo sapiens
tccagtcatctgtaagag

SEQ ID NO: 1849011 - DNA, 14 bp, Homo sapiens
tccagtcattatgt

SEQ ID NO: 1849012 - DNA, 23 bp, Homo sapiens
tccagtcattatgttaatatttc

SEQ ID NO: 1849013 - DNA, 16 bp, Homo sapiens
tccagtccaaggaaac

SEQ ID NO: 1849014 - DNA, 23 bp, Homo sapiens
tccagtccaaggaaaccacagct

SEQ ID NO: 1849015 - DNA, 15 bp, Homo sapiens
tccagtgaggctctg

SEQ ID NO: 1849016 - DNA, 17 bp, Homo sapiens
tccatcagttagagctg

SEQ ID NO: 1849017 - DNA, 14 bp, Homo sapiens
tccatggactttgt

SEQ ID NO: 1849018 - DNA, 15 bp, Homo sapiens
tccatggactttgtt

SEQ ID NO: 1849019 - DNA, 13 bp, Homo sapiens
tccattctggaag

SEQ ID NO: 1849020 - DNA, 13 bp, Homo sapiens
tcccaactcaccc

SEQ ID NO: 1849021 - DNA, 14 bp, Homo sapiens
tcccaactcacccc

SEQ ID NO: 1849022 - DNA, 15 bp, Homo sapiens
tcccaactcacccca

SEQ ID NO: 1849023 - DNA, 21 bp, Homo sapiens
tcccaactcaccccagcccca

SEQ ID NO: 1849024 - DNA, 21 bp, Homo sapiens
tcccaagggatggtgccctgt

SEQ ID NO: 1849025 - DNA, 20 bp, Homo sapiens
tcccacctctctcactcctt

SEQ ID NO: 1849026 - DNA, 15 bp, Homo sapiens
ttccttggctggtgc

SEQ ID NO: 1849027 - DNA, 23 bp, Homo sapiens
ttcgaatgacggtaagtgttctc

SEQ ID NO: 1849028 - DNA, 21 bp, Homo sapiens
ttcgcaggattcttcctccct

SEQ ID NO: 1849029 - DNA, 20 bp, Homo sapiens
ttcgggaggtcgaggcagga

SEQ ID NO: 1849030 - DNA, 22 bp, Homo sapiens
ttctaaatatcccttggacatt

SEQ ID NO: 1849031 - DNA, 23 bp, Homo sapiens
ttctaacgcaaaaatagctcttg

SEQ ID NO: 1849032 - DNA, 23 bp, Homo sapiens
ttctaactacaaaggtttaaatg

SEQ ID NO: 1849033 - DNA, 17 bp, Homo sapiens
ttctaggtaggaagagc

SEQ ID NO: 1849034 - DNA, 18 bp, Homo sapiens
ttctaggtggcaaggctg

SEQ ID NO: 1849035 - DNA, 22 bp, Homo sapiens
ttctcagaaggcaaatgacttt

SEQ ID NO: 1849036 - DNA, 16 bp, Homo sapiens
ttctcagggtctctgc

SEQ ID NO: 1849037 - DNA, 19 bp, Homo sapiens
ttctcagggtctctgctgc

SEQ ID NO: 1849038 - DNA, 22 bp, Homo sapiens
ttctcatgttgaaactttaaga

SEQ ID NO: 1849039 - DNA, 12 bp, Homo sapiens
ttctccacctgc

SEQ ID NO: 1849040 - DNA, 20 bp, Homo sapiens
ttctccacctgccagggaca

SEQ ID NO: 1849041 - DNA, 19 bp, Homo sapiens
ttctccagtcattatgtta

SEQ ID NO: 1849042 - DNA, 15 bp, Homo sapiens
ttctcctgcctgtgc

SEQ ID NO: 1849043 - DNA, 21 bp, Homo sapiens
ttctcctgcctgtgctgtgac

SEQ ID NO: 1849044 - DNA, 15 bp, Homo sapiens
ttctctccagcccct

SEQ ID NO: 1849045 - DNA, 16 bp, Homo sapiens
ttctctccagcccctg

SEQ ID NO: 1849046 - DNA, 17 bp, Homo sapiens
ttctctgccctccaaga

SEQ ID NO: 1849047 - DNA, 15 bp, Homo sapiens
ttctgaaacacacga

SEQ ID NO: 1849048 - DNA, 14 bp, Homo sapiens
ttctgacccatgct

SEQ ID NO: 1849049 - DNA, 16 bp, Homo sapiens
ttctgacccatgctgc

SEQ ID NO: 1849050 - DNA, 18 bp, Homo sapiens
ttctgacccatgctgccc

SEQ ID NO: 1849051 - DNA, 21 bp, Homo sapiens
ttctgacccatgctgccctgt

SEQ ID NO: 1849052 - DNA, 19 bp, Homo sapiens
ttctgatcctagttccacc

SEQ ID NO: 1849053 - DNA, 18 bp, Homo sapiens
ttctgatgatgtgcctgg

SEQ ID NO: 1849054 - DNA, 13 bp, Homo sapiens
ttctgggatgcaa

SEQ ID NO: 1849055 - DNA, 19 bp, Homo sapiens
ttctgggatgcaatactag

SEQ ID NO: 1849056 - DNA, 17 bp, Homo sapiens
ttctgtaccaaagtgtt

SEQ ID NO: 1849057 - DNA, 13 bp, Homo sapiens
ttctgtcctgctg

SEQ ID NO: 1849058 - DNA, 12 bp, Homo sapiens
ttcttacaagga

SEQ ID NO: 1849059 - DNA, 15 bp, Homo sapiens
ttcttagctcaatga

SEQ ID NO: 1849060 - DNA, 16 bp, Homo sapiens
ttcttagctcaatgag

SEQ ID NO: 1849061 - DNA, 20 bp, Homo sapiens
ttcttagtatgtgcatttaa

SEQ ID NO: 1849062 - DNA, 21 bp, Homo sapiens
ttcttcacctaagtctctgtg

SEQ ID NO: 1849063 - DNA, 13 bp, Homo sapiens
ttcttcagagact

SEQ ID NO: 1849064 - DNA, 14 bp, Homo sapiens
ttcttcccttttcc

SEQ ID NO: 1849065 - DNA, 22 bp, Homo sapiens
ttcttctacaactcatacactc

SEQ ID NO: 1849066 - DNA, 11 bp, Homo sapiens
ttcttctccct

SEQ ID NO: 1849067 - DNA, 20 bp, Homo sapiens
ttcttggttggctggccttc

SEQ ID NO: 1849068 - DNA, 13 bp, Homo sapiens
ttcttgtattaag

SEQ ID NO: 1849069 - DNA, 19 bp, Homo sapiens
ttcttgtattaagaatgaa

SEQ ID NO: 1849070 - DNA, 23 bp, Homo sapiens
ttcttttttggccatctgctcct

SEQ ID NO: 1849071 - DNA, 21 bp, Homo sapiens
ttgaaaacactgttctctgcc

SEQ ID NO: 1849072 - DNA, 16 bp, Homo sapiens
ttgaaagtttacagga

SEQ ID NO: 1849073 - DNA, 14 bp, Homo sapiens
ttgaaatagtgtct

SEQ ID NO: 1849074 - DNA, 14 bp, Homo sapiens
ttgaaatgatttca

SEQ ID NO: 1849075 - DNA, 23 bp, Homo sapiens
ttgaagattctatgttaatattt

SEQ ID NO: 1849076 - DNA, 15 bp, Homo sapiens
ttgaaggtagaatgt

SEQ ID NO: 1849077 - DNA, 16 bp, Homo sapiens
ttgaaggtagaatgtt

SEQ ID NO: 1849078 - DNA, 18 bp, Homo sapiens
ttgaccattctccacctg

SEQ ID NO: 1849079 - DNA, 19 bp, Homo sapiens
ttgaccattctccacctgc

SEQ ID NO: 1849080 - DNA, 24 bp, Homo sapiens
ttgaccattctccacctgccaggg

SEQ ID NO: 1849081 - DNA, 22 bp, Homo sapiens
ttgacctgcctcccttcatgca

SEQ ID NO: 1849082 - DNA, 17 bp, Homo sapiens
ttgacgccatcccagcc

SEQ ID NO: 1849083 - DNA, 20 bp, Homo sapiens
ttgacttaggtgtgaagacc

SEQ ID NO: 1849084 - DNA, 10 bp, Homo sapiens
ttgagacagg

SEQ ID NO: 1849085 - DNA, 22 bp, Homo sapiens
ttgagacctcagcttggcactc

SEQ ID NO: 1849086 - DNA, 16 bp, Homo sapiens
ttgagatcagcctggg

SEQ ID NO: 1849087 - DNA, 11 bp, Homo sapiens
ttgagcctggg

SEQ ID NO: 1849088 - DNA, 17 bp, Homo sapiens
ttgaggattgtggaaaa

SEQ ID NO: 1849089 - DNA, 21 bp, Homo sapiens
ttgaggtccagccctggctga

SEQ ID NO: 1849090 - DNA, 18 bp, Homo sapiens
ttgagttttcttctgtga

SEQ ID NO: 1849091 - DNA, 16 bp, Homo sapiens
ttgataagagggcaca

SEQ ID NO: 1849092 - DNA, 18 bp, Homo sapiens
ttgatagcacagaccctg

SEQ ID NO: 1849093 - DNA, 20 bp, Homo sapiens
ttgatagcacagaccctgcc

SEQ ID NO: 1849094 - DNA, 13 bp, Homo sapiens
ttgatgttggctg

SEQ ID NO: 1849095 - DNA, 23 bp, Homo sapiens
ttgattcagacagctgcctggga

SEQ ID NO: 1849096 - DNA, 15 bp, Homo sapiens
ttgcaccactgcact

SEQ ID NO: 1849097 - DNA, 18 bp, Homo sapiens
ttgcaccactgcactcca

SEQ ID NO: 1849098 - DNA, 21 bp, Homo sapiens
ttgcaccactgcactccagcc

SEQ ID NO: 1849099 - DNA, 15 bp, Homo sapiens
ttgcacctgcagcca

SEQ ID NO: 1849100 - DNA, 17 bp, Homo sapiens
ttgcacctgcagccaag

SEQ ID NO: 1849101 - DNA, 22 bp, Homo sapiens
ttgcagtaaacttttaattaaa

SEQ ID NO: 1849102 - DNA, 21 bp, Homo sapiens
ttgcagtcccaagcggtgtct

SEQ ID NO: 1849103 - DNA, 23 bp, Homo sapiens
ttgcagtcccaagcggtgtctct

SEQ ID NO: 1849104 - DNA, 12 bp, Homo sapiens
ttgcatgaggct

SEQ ID NO: 1849105 - DNA, 14 bp, Homo sapiens
ttgcatgaggctag

SEQ ID NO: 1849106 - DNA, 13 bp, Homo sapiens
ttgccaccctcat

SEQ ID NO: 1849107 - DNA, 13 bp, Homo sapiens
ttgccagtcaccc

SEQ ID NO: 1849108 - DNA, 13 bp, Homo sapiens
ttgccgtctacct

SEQ ID NO: 1849109 - DNA, 15 bp, Homo sapiens
ttgccgtctacctga

SEQ ID NO: 1849110 - DNA, 17 bp, Homo sapiens
ttgctccagattctgat

SEQ ID NO: 1849111 - DNA, 16 bp, Homo sapiens
ttgctgctaatatttt

SEQ ID NO: 1849112 - DNA, 20 bp, Homo sapiens
ttgctgctaatattttcctc

SEQ ID NO: 1849113 - DNA, 16 bp, Homo sapiens
ttgcttatttaataaa

SEQ ID NO: 1849114 - DNA, 12 bp, Homo sapiens
ttgcttcactca

SEQ ID NO: 1849115 - DNA, 21 bp, Homo sapiens
ttgctttaatataaatgcaaa

SEQ ID NO: 1849116 - DNA, 13 bp, Homo sapiens
ttgcttttcatgc

SEQ ID NO: 1849117 - DNA, 16 bp, Homo sapiens
ttggaaatttagcatt

SEQ ID NO: 1849118 - DNA, 17 bp, Homo sapiens
ttggaaatttagcattg

SEQ ID NO: 1849119 - DNA, 18 bp, Homo sapiens
ttggaagaaggggcaggt

SEQ ID NO: 1849120 - DNA, 16 bp, Homo sapiens
ttggaagttgcatggc

SEQ ID NO: 1849121 - DNA, 17 bp, Homo sapiens
ttggaatgggcagctca

SEQ ID NO: 1849122 - DNA, 18 bp, Homo sapiens
ttggaatgggcagctcat

SEQ ID NO: 1849123 - DNA, 20 bp, Homo sapiens
ttggacattttatgtctttc

SEQ ID NO: 1849124 - DNA, 15 bp, Homo sapiens
ttggaccctgaggcc

SEQ ID NO: 1849125 - DNA, 18 bp, Homo sapiens
ttggaccctgaggcccag

SEQ ID NO: 1849126 - DNA, 19 bp, Homo sapiens
ttggaccctgaggcccaga

SEQ ID NO: 1849127 - DNA, 11 bp, Homo sapiens
ttggctgctga

SEQ ID NO: 1849128 - DNA, 23 bp, Homo sapiens
ttggcttcacggaagagccttgc

SEQ ID NO: 1849129 - DNA, 19 bp, Homo sapiens
ttggggctgtcgggggctg

SEQ ID NO: 1849130 - DNA, 22 bp, Homo sapiens
ttggggggctgaggtgggagga

SEQ ID NO: 1849131 - DNA, 23 bp, Homo sapiens
ttgggtagaaagagatacagagg

SEQ ID NO: 1849132 - DNA, 16 bp, Homo sapiens
ttggtcccccttccat

SEQ ID NO: 1849133 - DNA, 12 bp, Homo sapiens
ttggtcctgctg

SEQ ID NO: 1849134 - DNA, 17 bp, Homo sapiens
ttggtctcaggcagcac

SEQ ID NO: 1849135 - DNA, 22 bp, Homo sapiens
ttaaaataaagttaaactgatt

SEQ ID NO: 1849136 - DNA, 17 bp, Homo sapiens
ttaaaatgaaatgcatt

SEQ ID NO: 1849137 - DNA, 20 bp, Homo sapiens
ttaaaatgaaatgcattttg

SEQ ID NO: 1849138 - DNA, 18 bp, Homo sapiens
ttaaacattggttcttgt

SEQ ID NO: 1849139 - DNA, 17 bp, Homo sapiens
ttaaaccgccaaggctg

SEQ ID NO: 1849140 - DNA, 15 bp, Homo sapiens
ttaaacgatttttaa

SEQ ID NO: 1849141 - DNA, 18 bp, Homo sapiens
ttaaacgatttttaaaat

SEQ ID NO: 1849142 - DNA, 22 bp, Homo sapiens
ttaaacgatttttaaaatgtac

SEQ ID NO: 1849143 - DNA, 16 bp, Homo sapiens
ttaaataataaagatc

SEQ ID NO: 1849144 - DNA, 17 bp, Homo sapiens
ttaaatgaacaagagaa

SEQ ID NO: 1849145 - DNA, 20 bp, Homo sapiens
ttaaatgaacaagagaagca

SEQ ID NO: 1849146 - DNA, 16 bp, Homo sapiens
ttaaatgcccagcccc

SEQ ID NO: 1849147 - DNA, 17 bp, Homo sapiens
ttaaatgcccagcccct

SEQ ID NO: 1849148 - DNA, 17 bp, Homo sapiens
ttaacaaattgcatttg

SEQ ID NO: 1849149 - DNA, 14 bp, Homo sapiens
ttaacacagtgtct

SEQ ID NO: 1849150 - DNA, 15 bp, Homo sapiens
ttaacataagctatt

SEQ ID NO: 1849151 - DNA, 16 bp, Homo sapiens
ttaacataagctattt

SEQ ID NO: 1849152 - DNA, 22 bp, Homo sapiens
ttaagaatgaaatactgtttga

SEQ ID NO: 1849153 - DNA, 15 bp, Homo sapiens
ttaagcctttggaaa

SEQ ID NO: 1849154 - DNA, 16 bp, Homo sapiens
ttaagctctcatagct

SEQ ID NO: 1849155 - DNA, 13 bp, Homo sapiens
ttaaggattttat

SEQ ID NO: 1849156 - DNA, 15 bp, Homo sapiens
ttaaggattttatgc

SEQ ID NO: 1849157 - DNA, 14 bp, Homo sapiens
ttaagtgagcagaa

SEQ ID NO: 1849158 - DNA, 23 bp, Homo sapiens
ttaataaacgtccacagagtata

SEQ ID NO: 1849159 - DNA, 18 bp, Homo sapiens
ttaataaattatttatta

SEQ ID NO: 1849160 - DNA, 14 bp, Homo sapiens
ttaataataaattc

SEQ ID NO: 1849161 - DNA, 14 bp, Homo sapiens
ttaatataaatgca

SEQ ID NO: 1849162 - DNA, 15 bp, Homo sapiens
ttaatataaatgcaa

SEQ ID NO: 1849163 - DNA, 20 bp, Homo sapiens
ttaatctctccaccttccaa

SEQ ID NO: 1849164 - DNA, 22 bp, Homo sapiens
ttaattaagctctcatagctca

SEQ ID NO: 1849165 - DNA, 18 bp, Homo sapiens
ttacaatgtaatagaagc

SEQ ID NO: 1849166 - DNA, 21 bp, Homo sapiens
ttacaccaccggccccctccc

SEQ ID NO: 1849167 - DNA, 21 bp, Homo sapiens
ttacagctgggtggcactgcc

SEQ ID NO: 1849168 - DNA, 14 bp, Homo sapiens
ttaccagcagagca

SEQ ID NO: 1849169 - DNA, 21 bp, Homo sapiens
ttacctactgtgtcttggaat

SEQ ID NO: 1849170 - DNA, 21 bp, Homo sapiens
ttactcataaggcatatacaa

SEQ ID NO: 1849171 - DNA, 13 bp, Homo sapiens
ttacttgtaaata

SEQ ID NO: 1849172 - DNA, 17 bp, Homo sapiens
ttactttaaccctttct

SEQ ID NO: 1849173 - DNA, 15 bp, Homo sapiens
ttagacagtccctgc

SEQ ID NO: 1849174 - DNA, 16 bp, Homo sapiens
ttagactttaacataa

SEQ ID NO: 1849175 - DNA, 20 bp, Homo sapiens
ttagagcagtttctgtcctg

SEQ ID NO: 1849176 - DNA, 21 bp, Homo sapiens
ttagagctgacacaaacctgc

SEQ ID NO: 1849177 - DNA, 18 bp, Homo sapiens
ttagcaaattctgttttt

SEQ ID NO: 1849178 - DNA, 18 bp, Homo sapiens
ttagccaagtgtggtaga

SEQ ID NO: 1849179 - DNA, 16 bp, Homo sapiens
ttagctactatatatg

SEQ ID NO: 1849180 - DNA, 13 bp, Homo sapiens
ttagctcaatgag

SEQ ID NO: 1849181 - DNA, 20 bp, Homo sapiens
ttaggagaagtcttctattt

SEQ ID NO: 1849182 - DNA, 18 bp, Homo sapiens
ttaggttggcaaaaaggc

SEQ ID NO: 1849183 - DNA, 24 bp, Homo sapiens
ttagtatattattattaattacaa

SEQ ID NO: 1849184 - DNA, 18 bp, Homo sapiens
ttagtatgtgcatttaat

SEQ ID NO: 1849185 - DNA, 14 bp, Homo sapiens
ttagttccttgagt

SEQ ID NO: 1849186 - DNA, 23 bp, Homo sapiens
ttatatataaatatattattact

SEQ ID NO: 1849187 - DNA, 19 bp, Homo sapiens
ttatatttcacccatctct

SEQ ID NO: 1849188 - DNA, 14 bp, Homo sapiens
ttatgaacagctgt

SEQ ID NO: 1849189 - DNA, 18 bp, Homo sapiens
ttatgaacagctgtgtct

SEQ ID NO: 1849190 - DNA, 13 bp, Homo sapiens
ttatgctttaaac

SEQ ID NO: 1849191 - DNA, 22 bp, Homo sapiens
ttatgggctgggttctacccag

SEQ ID NO: 1849192 - DNA, 13 bp, Homo sapiens
ttatgttatatat

SEQ ID NO: 1849193 - DNA, 22 bp, Homo sapiens
ttattaaagaaaaaaatgtatt

SEQ ID NO: 1849194 - DNA, 23 bp, Homo sapiens
ttattaaagaaaaaaatgtattt

SEQ ID NO: 1849195 - DNA, 15 bp, Homo sapiens
ttattattaattaca

SEQ ID NO: 1849196 - DNA, 13 bp, Homo sapiens
ttattcccttcct

SEQ ID NO: 1849197 - DNA, 18 bp, Homo sapiens
ttattcccttcctgccag

SEQ ID NO: 1849198 - DNA, 15 bp, Homo sapiens
ttattgatgttttca

SEQ ID NO: 1849199 - DNA, 16 bp, Homo sapiens
ttatttagttccttga

SEQ ID NO: 1849200 - DNA, 14 bp, Homo sapiens
ttatttatgtattg

SEQ ID NO: 1849201 - DNA, 15 bp, Homo sapiens
ttatttatgtattgt

SEQ ID NO: 1849202 - DNA, 18 bp, Homo sapiens
ttatttttggcaaagcca

SEQ ID NO: 1849203 - DNA, 15 bp, Homo sapiens
ttcaaaaacatgctt

SEQ ID NO: 1849204 - DNA, 22 bp, Homo sapiens
ttcaaactactttgctgctaat

SEQ ID NO: 1849205 - DNA, 21 bp, Homo sapiens
ttcaagtactgtaactgtgtc

SEQ ID NO: 1849206 - DNA, 19 bp, Homo sapiens
ttcaatctggattcatatt

SEQ ID NO: 1849207 - DNA, 20 bp, Homo sapiens
ttcaattttaaggcatattt

SEQ ID NO: 1849208 - DNA, 20 bp, Homo sapiens
ttcacagatgggtgcttgga

SEQ ID NO: 1849209 - DNA, 14 bp, Homo sapiens
ttcaccgaggacat

SEQ ID NO: 1849210 - DNA, 17 bp, Homo sapiens
ttcacctaagtctctgt

SEQ ID NO: 1849211 - DNA, 19 bp, Homo sapiens
ttcacctttgtccccaccg

SEQ ID NO: 1849212 - DNA, 13 bp, Homo sapiens
ttcacggaagagc

SEQ ID NO: 1849213 - DNA, 10 bp, Homo sapiens
ttcactttga

SEQ ID NO: 1849214 - DNA, 15 bp, Homo sapiens
ttcagacagctgcct

SEQ ID NO: 1849215 - DNA, 17 bp, Homo sapiens
ttcagacagctgcctgg

SEQ ID NO: 1849216 - DNA, 21 bp, Homo sapiens
ttcagacagctgcctgggatc

SEQ ID NO: 1849217 - DNA, 17 bp, Homo sapiens
ttcagataactgttatt

SEQ ID NO: 1849218 - DNA, 21 bp, Homo sapiens
ttcagattccccactcagcct

SEQ ID NO: 1849219 - DNA, 20 bp, Homo sapiens
ttcaggagcagcctcagaac

SEQ ID NO: 1849220 - DNA, 11 bp, Homo sapiens
ttcatagagaa

SEQ ID NO: 1849221 - DNA, 16 bp, Homo sapiens
ttcatcaaatggaaga

SEQ ID NO: 1849222 - DNA, 13 bp, Homo sapiens
ttcatgcatggaa

SEQ ID NO: 1849223 - DNA, 15 bp, Homo sapiens
ttcatgcatggaaat

SEQ ID NO: 1849224 - DNA, 19 bp, Homo sapiens
ttcattagttttgaagatt

SEQ ID NO: 1849225 - DNA, 21 bp, Homo sapiens
ttccaaagagtgctaagcatt

SEQ ID NO: 1849226 - DNA, 19 bp, Homo sapiens
ttccaaccctcatcaccaa

SEQ ID NO: 1849227 - DNA, 12 bp, Homo sapiens
ttccagccaggg

SEQ ID NO: 1849228 - DNA, 16 bp, Homo sapiens
ttccagccagggctgc

SEQ ID NO: 1849229 - DNA, 16 bp, Homo sapiens
ttccagtcccctttct

SEQ ID NO: 1849230 - DNA, 17 bp, Homo sapiens
ttccagtcccctttctc

SEQ ID NO: 1849231 - DNA, 23 bp, Homo sapiens
ttccagtgaacattcccagccca

SEQ ID NO: 1849232 - DNA, 16 bp, Homo sapiens
ttccagtgaggctctg

SEQ ID NO: 1849233 - DNA, 17 bp, Homo sapiens
ttccagtgaggctctgc

SEQ ID NO: 1849234 - DNA, 22 bp, Homo sapiens
ttccagtgaggctctgcccttg

SEQ ID NO: 1849235 - DNA, 18 bp, Homo sapiens
ttccatgatgctgggatt

SEQ ID NO: 1849236 - DNA, 13 bp, Homo sapiens
ttccattaaacga

SEQ ID NO: 1849237 - DNA, 23 bp, Homo sapiens
ttccattaaacgatttttaaaat

SEQ ID NO: 1849238 - DNA, 11 bp, Homo sapiens
ttcccaaaagc

SEQ ID NO: 1849239 - DNA, 14 bp, Homo sapiens
ttcccagtggctgc

SEQ ID NO: 1849240 - DNA, 17 bp, Homo sapiens
ttccccaggaggccagc

SEQ ID NO: 1849241 - DNA, 18 bp, Homo sapiens
ttccccaggaggccagcc

SEQ ID NO: 1849242 - DNA, 20 bp, Homo sapiens
ttccccaggaggccagcctt

SEQ ID NO: 1849243 - DNA, 21 bp, Homo sapiens
ttccccaggaggccagccttg

SEQ ID NO: 1849244 - DNA, 22 bp, Homo sapiens
ttcccccttgaggattgtggaa

SEQ ID NO: 1849245 - DNA, 19 bp, Homo sapiens
ttccctagtctattcatta

SEQ ID NO: 1849246 - DNA, 15 bp, Homo sapiens
ttccctattagagaa

SEQ ID NO: 1849247 - DNA, 15 bp, Homo sapiens
ttcccttcctgccag

SEQ ID NO: 1849248 - DNA, 21 bp, Homo sapiens
ttccctttgacgccatcccag

SEQ ID NO: 1849249 - DNA, 21 bp, Homo sapiens
tcccccttgaggattgtggaa

SEQ ID NO: 1849250 - DNA, 18 bp, Homo sapiens
tcccctgtttgtttctga

SEQ ID NO: 1849251 - DNA, 20 bp, Homo sapiens
tcccctgtttgtttctgaaa

SEQ ID NO: 1849252 - DNA, 22 bp, Homo sapiens
tccctagtctattcattatatt

SEQ ID NO: 1849253 - DNA, 17 bp, Homo sapiens
tccctccctctttccct

SEQ ID NO: 1849254 - DNA, 18 bp, Homo sapiens
tccctcccttcctctttc

SEQ ID NO: 1849255 - DNA, 18 bp, Homo sapiens
tccctctttccctccctt

SEQ ID NO: 1849256 - DNA, 17 bp, Homo sapiens
tccctgaaggccccgcc

SEQ ID NO: 1849257 - DNA, 16 bp, Homo sapiens
tccctgccaatggact

SEQ ID NO: 1849258 - DNA, 16 bp, Homo sapiens
tccctggtggcagctc

SEQ ID NO: 1849259 - DNA, 22 bp, Homo sapiens
tccctggtggcagctcacctct

SEQ ID NO: 1849260 - DNA, 17 bp, Homo sapiens
tcccttcatgcatggaa

SEQ ID NO: 1849261 - DNA, 15 bp, Homo sapiens
tcccttcctctttcc

SEQ ID NO: 1849262 - DNA, 17 bp, Homo sapiens
tcccttgaccaggcctg

SEQ ID NO: 1849263 - DNA, 16 bp, Homo sapiens
tcccttggacatttta

SEQ ID NO: 1849264 - DNA, 21 bp, Homo sapiens
tcccttggacattttatgtct

SEQ ID NO: 1849265 - DNA, 20 bp, Homo sapiens
tcccttggattgtccccgac

SEQ ID NO: 1849266 - DNA, 22 bp, Homo sapiens
tccctttccaaatgcccagctt

SEQ ID NO: 1849267 - DNA, 16 bp, Homo sapiens
tccctttgacgccatc

SEQ ID NO: 1849268 - DNA, 21 bp, Homo sapiens
tccctttgacgccatcccagc

SEQ ID NO: 1849269 - DNA, 23 bp, Homo sapiens
tcccttttttggctgctgaaggc

SEQ ID NO: 1849270 - DNA, 17 bp, Homo sapiens
tccgaatgggttttcta

SEQ ID NO: 1849271 - DNA, 19 bp, Homo sapiens
tcctagcacacacttttgg

SEQ ID NO: 1849272 - DNA, 15 bp, Homo sapiens
tcctagcgcagccat

SEQ ID NO: 1849273 - DNA, 13 bp, Homo sapiens
tcctaggcatttg

SEQ ID NO: 1849274 - DNA, 18 bp, Homo sapiens
tcctcatacccaccccca

SEQ ID NO: 1849275 - DNA, 22 bp, Homo sapiens
tcctcatacccacccccaccca

SEQ ID NO: 1849276 - DNA, 16 bp, Homo sapiens
tcctcatccagggctc

SEQ ID NO: 1849277 - DNA, 17 bp, Homo sapiens
tcctcattagcattttg

SEQ ID NO: 1849278 - DNA, 12 bp, Homo sapiens
tcctccaggtgc

SEQ ID NO: 1849279 - DNA, 22 bp, Homo sapiens
tcctccaggtgcacaagctcca

SEQ ID NO: 1849280 - DNA, 20 bp, Homo sapiens
tcctcccctcctcctggact

SEQ ID NO: 1849281 - DNA, 16 bp, Homo sapiens
tcctcgtttgtgttct

SEQ ID NO: 1849282 - DNA, 21 bp, Homo sapiens
tcctctcaaccacctttcaga

SEQ ID NO: 1849283 - DNA, 16 bp, Homo sapiens
tcctctgtacagagcc

SEQ ID NO: 1849284 - DNA, 12 bp, Homo sapiens
tcctctttccat

SEQ ID NO: 1849285 - DNA, 12 bp, Homo sapiens
tcctgaggctgg

SEQ ID NO: 1849286 - DNA, 19 bp, Homo sapiens
tcctgaggctgggctccct

SEQ ID NO: 1849287 - DNA, 15 bp, Homo sapiens
tcctgagtgcttgct

SEQ ID NO: 1849288 - DNA, 21 bp, Homo sapiens
tcctgcaatgaagtctctgaa

SEQ ID NO: 1849289 - DNA, 22 bp, Homo sapiens
tcctgcaatgaagtctctgaag

SEQ ID NO: 1849290 - DNA, 13 bp, Homo sapiens
tcctgcaggcagc

SEQ ID NO: 1849291 - DNA, 15 bp, Homo sapiens
tcctgcaggcagcca

SEQ ID NO: 1849292 - DNA, 13 bp, Homo sapiens
tcctgccagcccc

SEQ ID NO: 1849293 - DNA, 13 bp, Homo sapiens
tcctgccaggcat

SEQ ID NO: 1849294 - DNA, 16 bp, Homo sapiens
tcctgcctaaggctga

SEQ ID NO: 1849295 - DNA, 19 bp, Homo sapiens
tcctgcctaaggctgaact

SEQ ID NO: 1849296 - DNA, 16 bp, Homo sapiens
tcctggcactgcttcc

SEQ ID NO: 1849297 - DNA, 11 bp, Homo sapiens
tcctgtagccc

SEQ ID NO: 1849298 - DNA, 20 bp, Homo sapiens
tccttaccagcagagcacct

SEQ ID NO: 1849299 - DNA, 21 bp, Homo sapiens
tccttaccagcagagcacctt

SEQ ID NO: 1849300 - DNA, 15 bp, Homo sapiens
tccttcacatcaccc

SEQ ID NO: 1849301 - DNA, 22 bp, Homo sapiens
tccttcacctttgtccccaccg

SEQ ID NO: 1849302 - DNA, 20 bp, Homo sapiens
tccttgagagaccaggcaaa

SEQ ID NO: 1849303 - DNA, 18 bp, Homo sapiens
tcctttgtgaggaagccg

SEQ ID NO: 1849304 - DNA, 22 bp, Homo sapiens
tcgacactgttcttagctcaat

SEQ ID NO: 1849305 - DNA, 14 bp, Homo sapiens
tcgagcatgcctgg

SEQ ID NO: 1849306 - DNA, 17 bp, Homo sapiens
tcgcaggattcttcctc

SEQ ID NO: 1849307 - DNA, 13 bp, Homo sapiens
tcgctctttgaga

SEQ ID NO: 1849308 - DNA, 13 bp, Homo sapiens
tcggcaaggaagt

SEQ ID NO: 1849309 - DNA, 17 bp, Homo sapiens
tcgggaggtcgaggcag

SEQ ID NO: 1849310 - DNA, 18 bp, Homo sapiens
tcgtatgatacttcgaca

SEQ ID NO: 1849311 - DNA, 16 bp, Homo sapiens
tcgtcttaactcacca

SEQ ID NO: 1849312 - DNA, 19 bp, Homo sapiens
tcgtgtgcaacagacaagt

SEQ ID NO: 1849313 - DNA, 14 bp, Homo sapiens
tcgtttgtgttctg

SEQ ID NO: 1849314 - DNA, 13 bp, Homo sapiens
tctaaaggagttt

SEQ ID NO: 1849315 - DNA, 23 bp, Homo sapiens
tctaacgcaaaaatagctcttgc

SEQ ID NO: 1849316 - DNA, 21 bp, Homo sapiens
tctacaactcatacactcgta

SEQ ID NO: 1849317 - DNA, 22 bp, Homo sapiens
tctaccagcctccctatttttt

SEQ ID NO: 1849318 - DNA, 22 bp, Homo sapiens
tctactcaacccattgttgtca

SEQ ID NO: 1849319 - DNA, 12 bp, Homo sapiens
tctaggaagact

SEQ ID NO: 1849320 - DNA, 15 bp, Homo sapiens
tctaggaagactttg

SEQ ID NO: 1849321 - DNA, 21 bp, Homo sapiens
tctaggaagactttggaaaga

SEQ ID NO: 1849322 - DNA, 14 bp, Homo sapiens
tctaggtaggaaga

SEQ ID NO: 1849323 - DNA, 16 bp, Homo sapiens
tctatgttaatatttt

SEQ ID NO: 1849324 - DNA, 15 bp, Homo sapiens
tctattatcacatta

SEQ ID NO: 1849325 - DNA, 13 bp, Homo sapiens
tctatttatttat

SEQ ID NO: 1849326 - DNA, 16 bp, Homo sapiens
tctcacacatgagcat

SEQ ID NO: 1849327 - DNA, 20 bp, Homo sapiens
tctcactgccatgccagctt

SEQ ID NO: 1849328 - DNA, 11 bp, Homo sapiens
tctcagaacat

SEQ ID NO: 1849329 - DNA, 16 bp, Homo sapiens
tctcagaacatactga

SEQ ID NO: 1849330 - DNA, 19 bp, Homo sapiens
tctcagaaggcaaatgact

SEQ ID NO: 1849331 - DNA, 21 bp, Homo sapiens
tctcagaaggcaaatgacttt

SEQ ID NO: 1849332 - DNA, 23 bp, Homo sapiens
tctcaggaatcatctcctttgca

SEQ ID NO: 1849333 - DNA, 17 bp, Homo sapiens
tctcagggtctctgctg

SEQ ID NO: 1849334 - DNA, 20 bp, Homo sapiens
tctcagggtctctgctgccg

SEQ ID NO: 1849335 - DNA, 11 bp, Homo sapiens
tctcagtgtcc

SEQ ID NO: 1849336 - DNA, 14 bp, Homo sapiens
tctcatagctcata

SEQ ID NO: 1849337 - DNA, 14 bp, Homo sapiens
tctcattggaaatt

SEQ ID NO: 1849338 - DNA, 24 bp, Homo sapiens
tctcattggaaatttagcattgta

SEQ ID NO: 1849339 - DNA, 18 bp, Homo sapiens
tctccaagcaggacatgg

SEQ ID NO: 1849340 - DNA, 14 bp, Homo sapiens
tctccacctgccag

SEQ ID NO: 1849341 - DNA, 19 bp, Homo sapiens
tctccacctgccagggaca

SEQ ID NO: 1849342 - DNA, 14 bp, Homo sapiens
tctccaccttccaa

SEQ ID NO: 1849343 - DNA, 14 bp, Homo sapiens
tctccagcccctgg

SEQ ID NO: 1849344 - DNA, 22 bp, Homo sapiens
tctccagcccctggatgcagcc

SEQ ID NO: 1849345 - DNA, 12 bp, Homo sapiens
tctcccccagcc

SEQ ID NO: 1849346 - DNA, 13 bp, Homo sapiens
tctcccccagccc

SEQ ID NO: 1849347 - DNA, 17 bp, Homo sapiens
tctccctcaactgaagg

SEQ ID NO: 1849348 - DNA, 19 bp, Homo sapiens
tctccctcaactgaagggg

SEQ ID NO: 1849349 - DNA, 23 bp, Homo sapiens
tctccctcccctctcagaacata

SEQ ID NO: 1849350 - DNA, 11 bp, Homo sapiens
tctcccttgga

SEQ ID NO: 1849351 - DNA, 17 bp, Homo sapiens
cccccactgcctttgac

SEQ ID NO: 1849352 - DNA, 11 bp, Homo sapiens
cccccactggt

SEQ ID NO: 1849353 - DNA, 19 bp, Homo sapiens
aaaaaaacctgagatttat

SEQ ID NO: 1849354 - DNA, 12 bp, Homo sapiens
aaaaataaagaa

SEQ ID NO: 1849355 - DNA, 16 bp, Homo sapiens
aaaaatagctcttgct

SEQ ID NO: 1849356 - DNA, 23 bp, Homo sapiens
aaaaatatgaccacactccagct

SEQ ID NO: 1849357 - DNA, 23 bp, Homo sapiens
aaaaatcgatgagcgccacctct

SEQ ID NO: 1849358 - DNA, 12 bp, Homo sapiens
aaaaatgtattt

SEQ ID NO: 1849359 - DNA, 16 bp, Homo sapiens
aaaacaatttcttttt

SEQ ID NO: 1849360 - DNA, 16 bp, Homo sapiens
aaaacattccatcctt

SEQ ID NO: 1849361 - DNA, 15 bp, Homo sapiens
aaaaccaatgttctc

SEQ ID NO: 1849362 - DNA, 21 bp, Homo sapiens
aaaaccaatgttctctcttct

SEQ ID NO: 1849363 - DNA, 12 bp, Homo sapiens
aaaacccaagtg

SEQ ID NO: 1849364 - DNA, 18 bp, Homo sapiens
aaaactctcctctgctgc

SEQ ID NO: 1849365 - DNA, 19 bp, Homo sapiens
aaaagataaacacaagatt

SEQ ID NO: 1849366 - DNA, 19 bp, Homo sapiens
aagggcgcaaagggcatgg

SEQ ID NO: 1849367 - DNA, 21 bp, Homo sapiens
aagggcgcaaagggcatgggt

SEQ ID NO: 1849368 - DNA, 23 bp, Homo sapiens
aagggggctgggacatgggaaag

SEQ ID NO: 1849369 - DNA, 16 bp, Homo sapiens
aaggggtgcacccacc

SEQ ID NO: 1849370 - DNA, 19 bp, Homo sapiens
aagtaatctcacagcattt

SEQ ID NO: 1849371 - DNA, 21 bp, Homo sapiens
aagtaatctcacagcatttgc

SEQ ID NO: 1849372 - DNA, 15 bp, Homo sapiens
aagtatctgacatct

SEQ ID NO: 1849373 - DNA, 22 bp, Homo sapiens
aagtatctgacatctctgcaat

SEQ ID NO: 1849374 - DNA, 12 bp, Homo sapiens
aagtctgtttta

SEQ ID NO: 1849375 - DNA, 15 bp, Homo sapiens
aagtctgttttatga

SEQ ID NO: 1849376 - DNA, 20 bp, Homo sapiens
aagtctgttttatgacttca

SEQ ID NO: 1849377 - DNA, 17 bp, Homo sapiens
aagtcttatcaagcagc

SEQ ID NO: 1849378 - DNA, 13 bp, Homo sapiens
aagtcttctattt

SEQ ID NO: 1849379 - DNA, 21 bp, Homo sapiens
aagtgaaaaaggaggaagaga

SEQ ID NO: 1849380 - DNA, 21 bp, Homo sapiens
aagtgaagaatttatctcttt

SEQ ID NO: 1849381 - DNA, 16 bp, Homo sapiens
aagtgactgtatctgt

SEQ ID NO: 1849382 - DNA, 18 bp, Homo sapiens
aagtgactgtatctgtgt

SEQ ID NO: 1849383 - DNA, 19 bp, Homo sapiens
aagtgactgttcaagagca

SEQ ID NO: 1849384 - DNA, 19 bp, Homo sapiens
aagtgactttggctgcatg

SEQ ID NO: 1849385 - DNA, 20 bp, Homo sapiens
aagtgagacagtccagcctg

SEQ ID NO: 1849386 - DNA, 12 bp, Homo sapiens
aagtgagcagaa

SEQ ID NO: 1849387 - DNA, 15 bp, Homo sapiens
aagtgagcagaacag

SEQ ID NO: 1849388 - DNA, 17 bp, Homo sapiens
aagtgagcagaacaggt

SEQ ID NO: 1849389 - DNA, 18 bp, Homo sapiens
aagtgattgggacagagg

SEQ ID NO: 1849390 - DNA, 21 bp, Homo sapiens
aagtggaaaaatagcctgcct

SEQ ID NO: 1849391 - DNA, 13 bp, Homo sapiens
aagtgtggtagag

SEQ ID NO: 1849392 - DNA, 20 bp, Homo sapiens
aagtgttctcatgaagcagg

SEQ ID NO: 1849393 - DNA, 23 bp, Homo sapiens
aagtgttctcatgaagcaggagg

SEQ ID NO: 1849394 - DNA, 17 bp, Homo sapiens
aagttagtttttaatct

SEQ ID NO: 1849395 - DNA, 18 bp, Homo sapiens
aagttgcacggctgctga

SEQ ID NO: 1849396 - DNA, 13 bp, Homo sapiens
aagttggaaggat

SEQ ID NO: 1849397 - DNA, 18 bp, Homo sapiens
aagtttccttggctggtg

SEQ ID NO: 1849398 - DNA, 20 bp, Homo sapiens
aataaagaaaagatgcactt

SEQ ID NO: 1849399 - DNA, 11 bp, Homo sapiens
aataaagtctc

SEQ ID NO: 1849400 - DNA, 17 bp, Homo sapiens
aataaattatttattat

SEQ ID NO: 1849401 - DNA, 18 bp, Homo sapiens
aataacaaatgccaaatt

SEQ ID NO: 1849402 - DNA, 22 bp, Homo sapiens
aataagcccaacaagttgaaga

SEQ ID NO: 1849403 - DNA, 21 bp, Homo sapiens
aataataaagatcatgtaaaa

SEQ ID NO: 1849404 - DNA, 18 bp, Homo sapiens
aataatagcacatgattt

SEQ ID NO: 1849405 - DNA, 13 bp, Homo sapiens
aatacagaggcaa

SEQ ID NO: 1849406 - DNA, 17 bp, Homo sapiens
aatacctaattgtggat

SEQ ID NO: 1849407 - DNA, 14 bp, Homo sapiens
aatacctggcctca

SEQ ID NO: 1849408 - DNA, 19 bp, Homo sapiens
aatacctgtccccctgaca

SEQ ID NO: 1849409 - DNA, 20 bp, Homo sapiens
aatactctaccctcttagaa

SEQ ID NO: 1849410 - DNA, 21 bp, Homo sapiens
aatagaagcttaaaataaagt

SEQ ID NO: 1849411 - DNA, 17 bp, Homo sapiens
aatagctaagatataat

SEQ ID NO: 1849412 - DNA, 16 bp, Homo sapiens
aatagcttatgaaaag

SEQ ID NO: 1849413 - DNA, 18 bp, Homo sapiens
aatagcttatgaaaagaa

SEQ ID NO: 1849414 - DNA, 19 bp, Homo sapiens
aatagcttatgaaaagaat

SEQ ID NO: 1849415 - DNA, 13 bp, Homo sapiens
aatataaaaataa

SEQ ID NO: 1849416 - DNA, 18 bp, Homo sapiens
aatataaagacgttttat

SEQ ID NO: 1849417 - DNA, 13 bp, Homo sapiens
aatataaatgcaa

SEQ ID NO: 1849418 - DNA, 14 bp, Homo sapiens
aatataaatgcaaa

SEQ ID NO: 1849419 - DNA, 17 bp, Homo sapiens
aatataaatgcaaataa

SEQ ID NO: 1849420 - DNA, 16 bp, Homo sapiens
aatatcccttacttta

SEQ ID NO: 1849421 - DNA, 17 bp, Homo sapiens
aatatcccttactttaa

SEQ ID NO: 1849422 - DNA, 22 bp, Homo sapiens
aatatcccttggacattttatg

SEQ ID NO: 1849423 - DNA, 17 bp, Homo sapiens
aatatggactcagcctt

SEQ ID NO: 1849424 - DNA, 21 bp, Homo sapiens
aatattagtgacctcagcttt

SEQ ID NO: 1849425 - DNA, 14 bp, Homo sapiens
aatcagcaagaaga

SEQ ID NO: 1849426 - DNA, 18 bp, Homo sapiens
aatcatctcctttgcaga

SEQ ID NO: 1849427 - DNA, 20 bp, Homo sapiens
aatcatctcctttgcagaat

SEQ ID NO: 1849428 - DNA, 16 bp, Homo sapiens
aatcatctgcattcct

SEQ ID NO: 1849429 - DNA, 18 bp, Homo sapiens
aatctagccgatggaaaa

SEQ ID NO: 1849430 - DNA, 16 bp, Homo sapiens
aatctcacagcatttg

SEQ ID NO: 1849431 - DNA, 17 bp, Homo sapiens
aatctcataattggaat

SEQ ID NO: 1849432 - DNA, 17 bp, Homo sapiens
aatctggattcatattt

SEQ ID NO: 1849433 - DNA, 16 bp, Homo sapiens
aatctgggccagaatt

SEQ ID NO: 1849434 - DNA, 14 bp, Homo sapiens
aatgaaatgcattt

SEQ ID NO: 1849435 - DNA, 16 bp, Homo sapiens
aatgaaatgcattttg

SEQ ID NO: 1849436 - DNA, 14 bp, Homo sapiens
aatgaacaagagaa

SEQ ID NO: 1849437 - DNA, 23 bp, Homo sapiens
aatgaagtctctgaagtgaaact

SEQ ID NO: 1849438 - DNA, 14 bp, Homo sapiens
aatgagcatgttta

SEQ ID NO: 1849439 - DNA, 22 bp, Homo sapiens
aatgagcatgtttagactttaa

SEQ ID NO: 1849440 - DNA, 13 bp, Homo sapiens
aatgagcctggca

SEQ ID NO: 1849441 - DNA, 14 bp, Homo sapiens
aatgagcctggcaa

SEQ ID NO: 1849442 - DNA, 15 bp, Homo sapiens
aatgagcctggcaag

SEQ ID NO: 1849443 - DNA, 16 bp, Homo sapiens
aatgcaaataacaaat

SEQ ID NO: 1849444 - DNA, 21 bp, Homo sapiens
aatgcactttgttctggctct

SEQ ID NO: 1849445 - DNA, 15 bp, Homo sapiens
aatgccaaattaaaa

SEQ ID NO: 1849446 - DNA, 16 bp, Homo sapiens
aatgccaaattaaaaa

SEQ ID NO: 1849447 - DNA, 21 bp, Homo sapiens
aatgccaaattaaaaaagata

SEQ ID NO: 1849448 - DNA, 22 bp, Homo sapiens
aatgccaaattaaaaaagataa

SEQ ID NO: 1849449 - DNA, 17 bp, Homo sapiens
aatgccatcctcaaaca

SEQ ID NO: 1849450 - DNA, 22 bp, Homo sapiens
aatgccatcctcaaacactgca

SEQ ID NO: 1849451 - DNA, 12 bp, Homo sapiens
aatgcccagccc

SEQ ID NO: 1849452 - DNA, 13 bp, Homo sapiens
aatgctaatttta

SEQ ID NO: 1849453 - DNA, 12 bp, Homo sapiens
aatgctcatctg

SEQ ID NO: 1849454 - DNA, 14 bp, Homo sapiens
aatggaagacacat

SEQ ID NO: 1849455 - DNA, 15 bp, Homo sapiens
aatggccatgcagga

SEQ ID NO: 1849456 - DNA, 14 bp, Homo sapiens
aatggcgtctgctc

SEQ ID NO: 1849457 - DNA, 16 bp, Homo sapiens
aatggcgtctgctctg

SEQ ID NO: 1849458 - DNA, 23 bp, Homo sapiens
aatggcgtctgctctggtggctt

SEQ ID NO: 1849459 - DNA, 18 bp, Homo sapiens
aatggctacatctccaaa

SEQ ID NO: 1849460 - DNA, 13 bp, Homo sapiens
aatgggcagagca

SEQ ID NO: 1849461 - DNA, 15 bp, Homo sapiens
aatgggcagagcaga

SEQ ID NO: 1849462 - DNA, 23 bp, Homo sapiens
aatgtagttttgtgatgcatttt

SEQ ID NO: 1849463 - DNA, 13 bp, Homo sapiens
aatgtattttatg

SEQ ID NO: 1849464 - DNA, 22 bp, Homo sapiens
aatgtcttctgtattcacttat

SEQ ID NO: 1849465 - DNA, 15 bp, Homo sapiens
aatgtgaaaagaaaa

SEQ ID NO: 1849466 - DNA, 17 bp, Homo sapiens
aatgtgaaaagaaaaat

SEQ ID NO: 1849467 - DNA, 19 bp, Homo sapiens
aatgtgacttggattcaat

SEQ ID NO: 1849468 - DNA, 15 bp, Homo sapiens
aatgtttttctaaag

SEQ ID NO: 1849469 - DNA, 15 bp, Homo sapiens
aattaaaaaagataa

SEQ ID NO: 1849470 - DNA, 11 bp, Homo sapiens
aattaataaat

SEQ ID NO: 1849471 - DNA, 16 bp, Homo sapiens
aattacttcttagtat

SEQ ID NO: 1849472 - DNA, 13 bp, Homo sapiens
aattatatatact

SEQ ID NO: 1849473 - DNA, 17 bp, Homo sapiens
aattattgatgttttca

SEQ ID NO: 1849474 - DNA, 21 bp, Homo sapiens
aattatttattaaatgcccag

SEQ ID NO: 1849475 - DNA, 22 bp, Homo sapiens
aattatttattaaatgcccagc

SEQ ID NO: 1849476 - DNA, 12 bp, Homo sapiens
aattatttgaag

SEQ ID NO: 1849477 - DNA, 23 bp, Homo sapiens
aattcatcaaatggaagacacat

SEQ ID NO: 1849478 - DNA, 13 bp, Homo sapiens
aattcctcatttg

SEQ ID NO: 1849479 - DNA, 15 bp, Homo sapiens
aattcctcatttgtt

SEQ ID NO: 1849480 - DNA, 23 bp, Homo sapiens
aattctaacgcaaaaatagctct

SEQ ID NO: 1849481 - DNA, 23 bp, Homo sapiens
aattggggctgtcgggggctgtg

SEQ ID NO: 1849482 - DNA, 13 bp, Homo sapiens
aatttagcattgt

SEQ ID NO: 1849483 - DNA, 16 bp, Homo sapiens
aatttgcttcactcaa

SEQ ID NO: 1849484 - DNA, 23 bp, Homo sapiens
aattttaaaatgaaatgcatttt

SEQ ID NO: 1849485 - DNA, 20 bp, Homo sapiens
aatttttatgtaattatata

SEQ ID NO: 1849486 - DNA, 16 bp, Homo sapiens
acaaaaagcataaaaa

SEQ ID NO: 1849487 - DNA, 20 bp, Homo sapiens
acaaactcaccatctgtgca

SEQ ID NO: 1849488 - DNA, 15 bp, Homo sapiens
agacctcatgcccag

SEQ ID NO: 1849489 - DNA, 23 bp, Homo sapiens
agacctcatgcccagctctctga

SEQ ID NO: 1849490 - DNA, 22 bp, Homo sapiens
agacctggcaaggacacagatg

SEQ ID NO: 1849491 - DNA, 23 bp, Homo sapiens
agaccttctccttcacctttgtc

SEQ ID NO: 1849492 - DNA, 16 bp, Homo sapiens
agacgttttataagca

SEQ ID NO: 1849493 - DNA, 11 bp, Homo sapiens
agactcctagg

SEQ ID NO: 1849494 - DNA, 14 bp, Homo sapiens
agactcctaggcag

SEQ ID NO: 1849495 - DNA, 14 bp, Homo sapiens
agactcctgcaggc

SEQ ID NO: 1849496 - DNA, 23 bp, Homo sapiens
agactcctgcaggcagccaggcc

SEQ ID NO: 1849497 - DNA, 23 bp, Homo sapiens
agactctttttttgagtgacagc

SEQ ID NO: 1849498 - DNA, 14 bp, Homo sapiens
agactgtgattctt

SEQ ID NO: 1849499 - DNA, 15 bp, Homo sapiens
agacttgggacattg

SEQ ID NO: 1849500 - DNA, 17 bp, Homo sapiens
agactttaacataagct

SEQ ID NO: 1849501 - DNA, 12 bp, Homo sapiens
agactttggaaa

SEQ ID NO: 1849502 - DNA, 15 bp, Homo sapiens
agactttggaaagag

SEQ ID NO: 1849503 - DNA, 22 bp, Homo sapiens
agagaaggggaagcactcgtgt

SEQ ID NO: 1849504 - DNA, 19 bp, Homo sapiens
agagaccaggcaaagcaag

SEQ ID NO: 1849505 - DNA, 14 bp, Homo sapiens
agagaccatccctg

SEQ ID NO: 1849506 - DNA, 22 bp, Homo sapiens
agagaccatccctgaaggcccc

SEQ ID NO: 1849507 - DNA, 15 bp, Homo sapiens
agagactcctgcagg

SEQ ID NO: 1849508 - DNA, 20 bp, Homo sapiens
agagacttgggacattgcct

SEQ ID NO: 1849509 - DNA, 14 bp, Homo sapiens
agagagaaaaacaa

SEQ ID NO: 1849510 - DNA, 16 bp, Homo sapiens
agagagtcttccaggt

SEQ ID NO: 1849511 - DNA, 13 bp, Homo sapiens
agagatacagagg

SEQ ID NO: 1849512 - DNA, 12 bp, Homo sapiens
agagatataata

SEQ ID NO: 1849513 - DNA, 13 bp, Homo sapiens
agagatataataa

SEQ ID NO: 1849514 - DNA, 20 bp, Homo sapiens
agagatatgtagaaggcaca

SEQ ID NO: 1849515 - DNA, 19 bp, Homo sapiens
agagcaagacgctgtgctg

SEQ ID NO: 1849516 - DNA, 23 bp, Homo sapiens
agagcaagacgctgtgctgccct

SEQ ID NO: 1849517 - DNA, 19 bp, Homo sapiens
agagcaggcgttcagctca

SEQ ID NO: 1849518 - DNA, 16 bp, Homo sapiens
agagcctggtgctgct

SEQ ID NO: 1849519 - DNA, 18 bp, Homo sapiens
agagcctggtgctgctgc

SEQ ID NO: 1849520 - DNA, 13 bp, Homo sapiens
agagccttccagg

SEQ ID NO: 1849521 - DNA, 22 bp, Homo sapiens
agagccttccaggggtgggaca

SEQ ID NO: 1849522 - DNA, 16 bp, Homo sapiens
agagcgtgagctgagc

SEQ ID NO: 1849523 - DNA, 15 bp, Homo sapiens
agagctggagcctgg

SEQ ID NO: 1849524 - DNA, 17 bp, Homo sapiens
agagctggagcctggtg

SEQ ID NO: 1849525 - DNA, 18 bp, Homo sapiens
agagctggagcctggtgc

SEQ ID NO: 1849526 - DNA, 21 bp, Homo sapiens
agagcttaatgataatattgt

SEQ ID NO: 1849527 - DNA, 14 bp, Homo sapiens
agagcttgctccag

SEQ ID NO: 1849528 - DNA, 23 bp, Homo sapiens
agagcttgctccagattctgatg

SEQ ID NO: 1849529 - DNA, 23 bp, Homo sapiens
agaggagggagcatcagtgccct

SEQ ID NO: 1849530 - DNA, 16 bp, Homo sapiens
agagggagggagggct

SEQ ID NO: 1849531 - DNA, 13 bp, Homo sapiens
agagggcctgcaa

SEQ ID NO: 1849532 - DNA, 17 bp, Homo sapiens
agaggggacgcaggccc

SEQ ID NO: 1849533 - DNA, 18 bp, Homo sapiens
agaggggacgcaggcccc

SEQ ID NO: 1849534 - DNA, 12 bp, Homo sapiens
agaggtggatgt

SEQ ID NO: 1849535 - DNA, 20 bp, Homo sapiens
agaggttatctgtcccaggt

SEQ ID NO: 1849536 - DNA, 22 bp, Homo sapiens
agaggtttttcttaaataataa

SEQ ID NO: 1849537 - DNA, 21 bp, Homo sapiens
agagtatggagctcagagagg

SEQ ID NO: 1849538 - DNA, 15 bp, Homo sapiens
agatcagcctgggca

SEQ ID NO: 1849539 - DNA, 22 bp, Homo sapiens
agatcctaaaacaaaagctcat

SEQ ID NO: 1849540 - DNA, 14 bp, Homo sapiens
agatgaaacacaaa

SEQ ID NO: 1849541 - DNA, 23 bp, Homo sapiens
agatgaaatcttacagctgggtg

SEQ ID NO: 1849542 - DNA, 15 bp, Homo sapiens
agatgcactttgctt

SEQ ID NO: 1849543 - DNA, 19 bp, Homo sapiens
agatgcactttgctttaat

SEQ ID NO: 1849544 - DNA, 15 bp, Homo sapiens
agatgcttctcactg

SEQ ID NO: 1849545 - DNA, 17 bp, Homo sapiens
agatgggcttcccaagg

SEQ ID NO: 1849546 - DNA, 20 bp, Homo sapiens
agatgggtgcttggaggaag

SEQ ID NO: 1849547 - DNA, 16 bp, Homo sapiens
agattctttcctgagg

SEQ ID NO: 1849548 - DNA, 19 bp, Homo sapiens
agattctttcctgaggctg

SEQ ID NO: 1849549 - DNA, 14 bp, Homo sapiens
agattggtgttttt

SEQ ID NO: 1849550 - DNA, 15 bp, Homo sapiens
agatttattaaagaa

SEQ ID NO: 1849551 - DNA, 17 bp, Homo sapiens
agatttattaaagaaaa

SEQ ID NO: 1849552 - DNA, 14 bp, Homo sapiens
agcaaaaaatgaac

SEQ ID NO: 1849553 - DNA, 14 bp, Homo sapiens
agcaaacccagagg

SEQ ID NO: 1849554 - DNA, 20 bp, Homo sapiens
agcaaatcatctgcattcct

SEQ ID NO: 1849555 - DNA, 18 bp, Homo sapiens
agcaaatgcctgccaaat

SEQ ID NO: 1849556 - DNA, 17 bp, Homo sapiens
agcaaatgtcttcctgg

SEQ ID NO: 1849557 - DNA, 19 bp, Homo sapiens
agcaaattctgtttttcta

SEQ ID NO: 1849558 - DNA, 21 bp, Homo sapiens
agcaagaagatcctaaaacaa

SEQ ID NO: 1849559 - DNA, 21 bp, Homo sapiens
agcaagacgctgtgctgccct

SEQ ID NO: 1849560 - DNA, 23 bp, Homo sapiens
agcaagacgctgtgctgccctgc

SEQ ID NO: 1849561 - DNA, 14 bp, Homo sapiens
agcacagaccctgc

SEQ ID NO: 1849562 - DNA, 16 bp, Homo sapiens
agcacagaccctgccc

SEQ ID NO: 1849563 - DNA, 15 bp, Homo sapiens
agcacaggtgggctt

SEQ ID NO: 1849564 - DNA, 19 bp, Homo sapiens
agcacaggtgggcttccca

SEQ ID NO: 1849565 - DNA, 11 bp, Homo sapiens
agcacatgatt

SEQ ID NO: 1849566 - DNA, 17 bp, Homo sapiens
agcacccttctgctgta

SEQ ID NO: 1849567 - DNA, 20 bp, Homo sapiens
agcaccttagacagtccctg

SEQ ID NO: 1849568 - DNA, 13 bp, Homo sapiens
agcactgcctgct

SEQ ID NO: 1849569 - DNA, 15 bp, Homo sapiens
agcactgtgctcagg

SEQ ID NO: 1849570 - DNA, 18 bp, Homo sapiens
agcactgtgctcagggct

SEQ ID NO: 1849571 - DNA, 20 bp, Homo sapiens
agcactttaacacagtgtct

SEQ ID NO: 1849572 - DNA, 22 bp, Homo sapiens
agcactttgggaggccaaggtg

SEQ ID NO: 1849573 - DNA, 18 bp, Homo sapiens
agcagaaatccaagcacc

SEQ ID NO: 1849574 - DNA, 15 bp, Homo sapiens
agcagaacaggtagt

SEQ ID NO: 1849575 - DNA, 16 bp, Homo sapiens
agcagaacctgcacac

SEQ ID NO: 1849576 - DNA, 18 bp, Homo sapiens
agcagaacctgcacacag

SEQ ID NO: 1849577 - DNA, 16 bp, Homo sapiens
agcagagaccatccct

SEQ ID NO: 1849578 - DNA, 20 bp, Homo sapiens
agcagagaccatccctgaag

SEQ ID NO: 1849579 - DNA, 16 bp, Homo sapiens
agcagcagggagggct

SEQ ID NO: 1849580 - DNA, 23 bp, Homo sapiens
agcaggccacacttcaaactact

SEQ ID NO: 1849581 - DNA, 16 bp, Homo sapiens
agcaggctacactgac

SEQ ID NO: 1849582 - DNA, 15 bp, Homo sapiens
agcaggctgtgagtt

SEQ ID NO: 1849583 - DNA, 20 bp, Homo sapiens
agcagggagggcttctgcca

SEQ ID NO: 1849584 - DNA, 17 bp, Homo sapiens
agcagggtctgggcagg

SEQ ID NO: 1849585 - DNA, 15 bp, Homo sapiens
agcagtccccttccc

SEQ ID NO: 1849586 - DNA, 16 bp, Homo sapiens
agcagtccccttccct

SEQ ID NO: 1849587 - DNA, 22 bp, Homo sapiens
agcagtccccttccctccaaga

SEQ ID NO: 1849588 - DNA, 19 bp, Homo sapiens
agcagtttctgtcctgctg

SEQ ID NO: 1849589 - DNA, 17 bp, Homo sapiens
agcatattcaggaagct

SEQ ID NO: 1849590 - DNA, 22 bp, Homo sapiens
agcatattcaggaagctcaggg

SEQ ID NO: 1849591 - DNA, 15 bp, Homo sapiens
agcatcacagttttg

SEQ ID NO: 1849592 - DNA, 17 bp, Homo sapiens
agcatcacagttttggt

SEQ ID NO: 1849593 - DNA, 18 bp, Homo sapiens
agcatcattatttatgta

SEQ ID NO: 1849594 - DNA, 21 bp, Homo sapiens
agcatcattatttatgtattg

SEQ ID NO: 1849595 - DNA, 22 bp, Homo sapiens
agcatcccaggatcgcaagagc

SEQ ID NO: 1849596 - DNA, 22 bp, Homo sapiens
agcatcccttgaccaggcctgg

SEQ ID NO: 1849597 - DNA, 19 bp, Homo sapiens
agcatcgcttaggagaagt

SEQ ID NO: 1849598 - DNA, 17 bp, Homo sapiens
agcattagctttaatta

SEQ ID NO: 1849599 - DNA, 22 bp, Homo sapiens
agcattctcattggaaatttag

SEQ ID NO: 1849600 - DNA, 15 bp, Homo sapiens
agcattttataaatc

SEQ ID NO: 1849601 - DNA, 15 bp, Homo sapiens
agcattttgctaaat

SEQ ID NO: 1849602 - DNA, 16 bp, Homo sapiens
agccaaacctctgtga

SEQ ID NO: 1849603 - DNA, 12 bp, Homo sapiens
agccaaagccaa

SEQ ID NO: 1849604 - DNA, 21 bp, Homo sapiens
agccaagcaaatgcctgccaa

SEQ ID NO: 1849605 - DNA, 18 bp, Homo sapiens
agccaataacacacagct

SEQ ID NO: 1849606 - DNA, 18 bp, Homo sapiens
agccacattcctgatgct

SEQ ID NO: 1849607 - DNA, 13 bp, Homo sapiens
agccagaaaaaga

SEQ ID NO: 1849608 - DNA, 21 bp, Homo sapiens
agccagaaaaagatctttcat

SEQ ID NO: 1849609 - DNA, 12 bp, Homo sapiens
agccagggctgc

SEQ ID NO: 1849610 - DNA, 23 bp, Homo sapiens
atcacccgctaagagggagggag

SEQ ID NO: 1849611 - DNA, 21 bp, Homo sapiens
atcactgaactttgctgagcc

SEQ ID NO: 1849612 - DNA, 20 bp, Homo sapiens
atcagaaacaccctcacact

SEQ ID NO: 1849613 - DNA, 20 bp, Homo sapiens
atcagaggtttgcttcctca

SEQ ID NO: 1849614 - DNA, 11 bp, Homo sapiens
atcagcctggg

SEQ ID NO: 1849615 - DNA, 13 bp, Homo sapiens
atcaggagaaaaa

SEQ ID NO: 1849616 - DNA, 15 bp, Homo sapiens
atcaggccaggccct

SEQ ID NO: 1849617 - DNA, 22 bp, Homo sapiens
atcaggccaggccctctgccca

SEQ ID NO: 1849618 - DNA, 13 bp, Homo sapiens
atcagtgccctcc

SEQ ID NO: 1849619 - DNA, 13 bp, Homo sapiens
atcatcacaaatg

SEQ ID NO: 1849620 - DNA, 19 bp, Homo sapiens
atcatcagtattgaagcat

SEQ ID NO: 1849621 - DNA, 18 bp, Homo sapiens
atcatctgtggaacccat

SEQ ID NO: 1849622 - DNA, 17 bp, Homo sapiens
atcccaggatgtacaag

SEQ ID NO: 1849623 - DNA, 15 bp, Homo sapiens
atcccctgtagagtg

SEQ ID NO: 1849624 - DNA, 16 bp, Homo sapiens
atccctaatgctgcag

SEQ ID NO: 1849625 - DNA, 17 bp, Homo sapiens
atccctgaaggccccgc

SEQ ID NO: 1849626 - DNA, 14 bp, Homo sapiens
atcccttgaccagg

SEQ ID NO: 1849627 - DNA, 17 bp, Homo sapiens
atcccttggacatttta

SEQ ID NO: 1849628 - DNA, 19 bp, Homo sapiens
atcccttggacattttatg

SEQ ID NO: 1849629 - DNA, 20 bp, Homo sapiens
atcccttggacattttatgt

SEQ ID NO: 1849630 - DNA, 23 bp, Homo sapiens
atcctaaaacaaaagctcatcca

SEQ ID NO: 1849631 - DNA, 16 bp, Homo sapiens
atcctaggcatttgct

SEQ ID NO: 1849632 - DNA, 15 bp, Homo sapiens
atcctcaaacactgc

SEQ ID NO: 1849633 - DNA, 19 bp, Homo sapiens
atcctcaaacactgcaggc

SEQ ID NO: 1849634 - DNA, 19 bp, Homo sapiens
atcctcatacccaccccca

SEQ ID NO: 1849635 - DNA, 23 bp, Homo sapiens
atcctcatacccacccccaccca

SEQ ID NO: 1849636 - DNA, 11 bp, Homo sapiens
atcctccaggt

SEQ ID NO: 1849637 - DNA, 22 bp, Homo sapiens
atcctccaggtgcacaagctcc

SEQ ID NO: 1849638 - DNA, 23 bp, Homo sapiens
atcctccaggtgcacaagctcca

SEQ ID NO: 1849639 - DNA, 16 bp, Homo sapiens
atcctctgtacagagc

SEQ ID NO: 1849640 - DNA, 11 bp, Homo sapiens
atcctgtgtgt

SEQ ID NO: 1849641 - DNA, 12 bp, Homo sapiens
atcctgtgtgtt

SEQ ID NO: 1849642 - DNA, 21 bp, Homo sapiens
atcctgtgtgttaagctctgc

SEQ ID NO: 1849643 - DNA, 14 bp, Homo sapiens
atcgaaaagttatt

SEQ ID NO: 1849644 - DNA, 17 bp, Homo sapiens
atctagccgatggaaaa

SEQ ID NO: 1849645 - DNA, 18 bp, Homo sapiens
atctaggaagactttgga

SEQ ID NO: 1849646 - DNA, 22 bp, Homo sapiens
atctaggaagactttggaaaga

SEQ ID NO: 1849647 - DNA, 16 bp, Homo sapiens
atctcaattcttccct

SEQ ID NO: 1849648 - DNA, 23 bp, Homo sapiens
atctcacacatgagcatcaggcc

SEQ ID NO: 1849649 - DNA, 22 bp, Homo sapiens
atctcacagcatttgccaagtc

SEQ ID NO: 1849650 - DNA, 13 bp, Homo sapiens
atctcacttgtgc

SEQ ID NO: 1849651 - DNA, 16 bp, Homo sapiens
atctcagggcctggtc

SEQ ID NO: 1849652 - DNA, 13 bp, Homo sapiens
atctcccccagcc

SEQ ID NO: 1849653 - DNA, 14 bp, Homo sapiens
atctcccccagccc

SEQ ID NO: 1849654 - DNA, 21 bp, Homo sapiens
atctcccccagccccatcctc

SEQ ID NO: 1849655 - DNA, 20 bp, Homo sapiens
atctccctgagatgggcttc

SEQ ID NO: 1849656 - DNA, 18 bp, Homo sapiens
atctcctttgcagaatga

SEQ ID NO: 1849657 - DNA, 18 bp, Homo sapiens
atctctgcaatcttctca

SEQ ID NO: 1849658 - DNA, 18 bp, Homo sapiens
atctgatggcttctccag

SEQ ID NO: 1849659 - DNA, 13 bp, Homo sapiens
atctgctgaggcc

SEQ ID NO: 1849660 - DNA, 17 bp, Homo sapiens
atctgggccagaatttc

SEQ ID NO: 1849661 - DNA, 17 bp, Homo sapiens
atctgtaagagcttgct

SEQ ID NO: 1849662 - DNA, 18 bp, Homo sapiens
atctgtgaaaggaaagag

SEQ ID NO: 1849663 - DNA, 19 bp, Homo sapiens
atcttaattctttgttctg

SEQ ID NO: 1849664 - DNA, 15 bp, Homo sapiens
atctttgccaccctc

SEQ ID NO: 1849665 - DNA, 22 bp, Homo sapiens
atctttggacagaagcagctct

SEQ ID NO: 1849666 - DNA, 22 bp, Homo sapiens
atgaaatactgtttgaggtttt

SEQ ID NO: 1849667 - DNA, 18 bp, Homo sapiens
atgaaatcttacagctgg

SEQ ID NO: 1849668 - DNA, 16 bp, Homo sapiens
atgaaatgcattttgc

SEQ ID NO: 1849669 - DNA, 14 bp, Homo sapiens
atgaacaagagaag

SEQ ID NO: 1849670 - DNA, 13 bp, Homo sapiens
atgaacagctgtg

SEQ ID NO: 1849671 - DNA, 14 bp, Homo sapiens
atgaagcaggaggc

SEQ ID NO: 1849672 - DNA, 17 bp, Homo sapiens
atgacaaattggggctg

SEQ ID NO: 1849673 - DNA, 16 bp, Homo sapiens
atgacccaggctgggc

SEQ ID NO: 1849674 - DNA, 22 bp, Homo sapiens
atgacggtaagtgttctcatga

SEQ ID NO: 1849675 - DNA, 11 bp, Homo sapiens
atgactttgga

SEQ ID NO: 1849676 - DNA, 22 bp, Homo sapiens
atgagaagttgatatagaacag

SEQ ID NO: 1849677 - DNA, 15 bp, Homo sapiens
atgagcatcaggcca

SEQ ID NO: 1849678 - DNA, 16 bp, Homo sapiens
atgagcatcaggccag

SEQ ID NO: 1849679 - DNA, 15 bp, Homo sapiens
atgagcatcccagga

SEQ ID NO: 1849680 - DNA, 11 bp, Homo sapiens
atgagcctggc

SEQ ID NO: 1849681 - DNA, 14 bp, Homo sapiens
atgagcgccacctc

SEQ ID NO: 1849682 - DNA, 16 bp, Homo sapiens
atgagtgcgtgctcag

SEQ ID NO: 1849683 - DNA, 15 bp, Homo sapiens
atgataaaacacaaa

SEQ ID NO: 1849684 - DNA, 23 bp, Homo sapiens
atgatctaccagcctccctattt

SEQ ID NO: 1849685 - DNA, 15 bp, Homo sapiens
atgatctaggaagac

SEQ ID NO: 1849686 - DNA, 17 bp, Homo sapiens
atgatctaggaagactt

SEQ ID NO: 1849687 - DNA, 16 bp, Homo sapiens
atgatgtgtgaaaact

SEQ ID NO: 1849688 - DNA, 19 bp, Homo sapiens
atgattaaccacttcagct

SEQ ID NO: 1849689 - DNA, 21 bp, Homo sapiens
atgattaaccacttcagctga

SEQ ID NO: 1849690 - DNA, 13 bp, Homo sapiens
atgatttcacagt

SEQ ID NO: 1849691 - DNA, 17 bp, Homo sapiens
atgatttttttttccaa

SEQ ID NO: 1849692 - DNA, 22 bp, Homo sapiens
atgcaaactctttggtcgtttt

SEQ ID NO: 1849693 - DNA, 21 bp, Homo sapiens
atgcactttgctttaatataa

SEQ ID NO: 1849694 - DNA, 15 bp, Homo sapiens
atgcactttgttctg

SEQ ID NO: 1849695 - DNA, 17 bp, Homo sapiens
atgcactttgttctggc

SEQ ID NO: 1849696 - DNA, 23 bp, Homo sapiens
atgcactttgttctggctcttcc

SEQ ID NO: 1849697 - DNA, 13 bp, Homo sapiens
atgcagcctcaca

SEQ ID NO: 1849698 - DNA, 16 bp, Homo sapiens
atgcagctgctcccca

SEQ ID NO: 1849699 - DNA, 17 bp, Homo sapiens
atgcagctgctccccag

SEQ ID NO: 1849700 - DNA, 16 bp, Homo sapiens
atgcaggaggtggaga

SEQ ID NO: 1849701 - DNA, 19 bp, Homo sapiens
atgcagggcctcacacggt

SEQ ID NO: 1849702 - DNA, 12 bp, Homo sapiens
atgcatggaaat

SEQ ID NO: 1849703 - DNA, 19 bp, Homo sapiens
atgcatgttttccagctcc

SEQ ID NO: 1849704 - DNA, 20 bp, Homo sapiens
atgcatgttttccagctcct

SEQ ID NO: 1849705 - DNA, 18 bp, Homo sapiens
atgcattttgctagacag

SEQ ID NO: 1849706 - DNA, 16 bp, Homo sapiens
atgccaagcactgtgc

SEQ ID NO: 1849707 - DNA, 14 bp, Homo sapiens
atgccaagttgttt

SEQ ID NO: 1849708 - DNA, 23 bp, Homo sapiens
atgccaagttgtttgagaaatta

SEQ ID NO: 1849709 - DNA, 21 bp, Homo sapiens
atgccatcctcaaacactgca

SEQ ID NO: 1849710 - DNA, 11 bp, Homo sapiens
atgcccagccc

SEQ ID NO: 1849711 - DNA, 14 bp, Homo sapiens
atgcccagcccctt

SEQ ID NO: 1849712 - DNA, 13 bp, Homo sapiens
atgcccagctctc

SEQ ID NO: 1849713 - DNA, 16 bp, Homo sapiens
atgcccagctctctga

SEQ ID NO: 1849714 - DNA, 18 bp, Homo sapiens
atgcccagctctctgacg

SEQ ID NO: 1849715 - DNA, 16 bp, Homo sapiens
atgcctgagtgcctgg

SEQ ID NO: 1849716 - DNA, 20 bp, Homo sapiens
atgcctgagtgcctggccaa

SEQ ID NO: 1849717 - DNA, 19 bp, Homo sapiens
atgcctggatggggctgca

SEQ ID NO: 1849718 - DNA, 19 bp, Homo sapiens
atgcgagtgctcatttcag

SEQ ID NO: 1849719 - DNA, 14 bp, Homo sapiens
atgctgatgtcctc

SEQ ID NO: 1849720 - DNA, 12 bp, Homo sapiens
atgctgccctgt

SEQ ID NO: 1849721 - DNA, 13 bp, Homo sapiens
atgctgccctgtg

SEQ ID NO: 1849722 - DNA, 15 bp, Homo sapiens
atgctgccctgtgag

SEQ ID NO: 1849723 - DNA, 16 bp, Homo sapiens
atgcttctcactgcca

SEQ ID NO: 1849724 - DNA, 18 bp, Homo sapiens
atgctttaggatgtacag

SEQ ID NO: 1849725 - DNA, 19 bp, Homo sapiens
atggaaatgggcagagcag

SEQ ID NO: 1849726 - DNA, 14 bp, Homo sapiens
atggaagacacatt

SEQ ID NO: 1849727 - DNA, 15 bp, Homo sapiens
atggacggtgctcca

SEQ ID NO: 1849728 - DNA, 20 bp, Homo sapiens
atggacggtgctccaggcag

SEQ ID NO: 1849729 - DNA, 15 bp, Homo sapiens
atggactcagccttg

SEQ ID NO: 1849730 - DNA, 15 bp, Homo sapiens
atggagccccacctt

SEQ ID NO: 1849731 - DNA, 16 bp, Homo sapiens
atggagccccaccttg

SEQ ID NO: 1849732 - DNA, 18 bp, Homo sapiens
atggatgtccccagcaga

SEQ ID NO: 1849733 - DNA, 13 bp, Homo sapiens
cactgtgaagaga

SEQ ID NO: 1849734 - DNA, 15 bp, Homo sapiens
cactgtgctcagggc

SEQ ID NO: 1849735 - DNA, 13 bp, Homo sapiens
cactgtgctgagt

SEQ ID NO: 1849736 - DNA, 17 bp, Homo sapiens
cactgtgctgagtctga

SEQ ID NO: 1849737 - DNA, 20 bp, Homo sapiens
cactgtgctgagtctgaagg

SEQ ID NO: 1849738 - DNA, 23 bp, Homo sapiens
cactgttctattcatctcaagga

SEQ ID NO: 1849739 - DNA, 17 bp, Homo sapiens
cactgttctctgccctc

SEQ ID NO: 1849740 - DNA, 13 bp, Homo sapiens
cacttacaatttt

SEQ ID NO: 1849741 - DNA, 12 bp, Homo sapiens
cacttcaaacta

SEQ ID NO: 1849742 - DNA, 14 bp, Homo sapiens
cacttcaaactact

SEQ ID NO: 1849743 - DNA, 17 bp, Homo sapiens
cacttggcatcagctgg

SEQ ID NO: 1849744 - DNA, 16 bp, Homo sapiens
cacttgtcaggagtgt

SEQ ID NO: 1849745 - DNA, 22 bp, Homo sapiens
cacttgtcaggagtgtgtgtga

SEQ ID NO: 1849746 - DNA, 22 bp, Homo sapiens
cacttgtgccaacactcaagaa

SEQ ID NO: 1849747 - DNA, 16 bp, Homo sapiens
cactttaacacagtgt

SEQ ID NO: 1849748 - DNA, 12 bp, Homo sapiens
cactttgaaaag

SEQ ID NO: 1849749 - DNA, 14 bp, Homo sapiens
cactttgaagggca

SEQ ID NO: 1849750 - DNA, 17 bp, Homo sapiens
cactttgctttaatata

SEQ ID NO: 1849751 - DNA, 16 bp, Homo sapiens
cactttgttctggctc

SEQ ID NO: 1849752 - DNA, 23 bp, Homo sapiens
cactttgttctggctcttccagg

SEQ ID NO: 1849753 - DNA, 12 bp, Homo sapiens
cacttttttcca

SEQ ID NO: 1849754 - DNA, 14 bp, Homo sapiens
cacttttttccaca

SEQ ID NO: 1849755 - DNA, 20 bp, Homo sapiens
cactttttttttttttcccc

SEQ ID NO: 1849756 - DNA, 18 bp, Homo sapiens
cagaaacaccctcacact

SEQ ID NO: 1849757 - DNA, 15 bp, Homo sapiens
cagaacatactgatt

SEQ ID NO: 1849758 - DNA, 19 bp, Homo sapiens
cagaacctgcacacaggac

SEQ ID NO: 1849759 - DNA, 19 bp, Homo sapiens
cagaaggcaaatgactttg

SEQ ID NO: 1849760 - DNA, 23 bp, Homo sapiens
cagaagtttgagatcagcctggg

SEQ ID NO: 1849761 - DNA, 21 bp, Homo sapiens
cagacaagtgactgtatctgt

SEQ ID NO: 1849762 - DNA, 22 bp, Homo sapiens
cagacacatgtccaagaagccc

SEQ ID NO: 1849763 - DNA, 17 bp, Homo sapiens
cagacagctgcctggga

SEQ ID NO: 1849764 - DNA, 15 bp, Homo sapiens
cagacaggaccaggg

SEQ ID NO: 1849765 - DNA, 14 bp, Homo sapiens
cagaccacaaaact

SEQ ID NO: 1849766 - DNA, 21 bp, Homo sapiens
cagaccctgccctgtgggccc

SEQ ID NO: 1849767 - DNA, 22 bp, Homo sapiens
cagaccctgccctgtgggcccc

SEQ ID NO: 1849768 - DNA, 22 bp, Homo sapiens
cagactctttttttgagtgaca

SEQ ID NO: 1849769 - DNA, 23 bp, Homo sapiens
cagactctttttttgagtgacag

SEQ ID NO: 1849770 - DNA, 13 bp, Homo sapiens
cagagaaagagga

SEQ ID NO: 1849771 - DNA, 13 bp, Homo sapiens
cagagaccatccc

SEQ ID NO: 1849772 - DNA, 18 bp, Homo sapiens
cagagaccatccctgaag

SEQ ID NO: 1849773 - DNA, 19 bp, Homo sapiens
cagagaccatccctgaagg

SEQ ID NO: 1849774 - DNA, 20 bp, Homo sapiens
cagagaccatccctgaaggc

SEQ ID NO: 1849775 - DNA, 13 bp, Homo sapiens
cagagactcctgc

SEQ ID NO: 1849776 - DNA, 16 bp, Homo sapiens
cagagactcctgcagg

SEQ ID NO: 1849777 - DNA, 17 bp, Homo sapiens
cagagactcctgcaggc

SEQ ID NO: 1849778 - DNA, 20 bp, Homo sapiens
cagagactcctgcaggcagc

SEQ ID NO: 1849779 - DNA, 21 bp, Homo sapiens
cagagactcctgcaggcagcc

SEQ ID NO: 1849780 - DNA, 23 bp, Homo sapiens
cagagactcctgcaggcagccag

SEQ ID NO: 1849781 - DNA, 20 bp, Homo sapiens
cagagagcctggtgctgctg

SEQ ID NO: 1849782 - DNA, 21 bp, Homo sapiens
cagagagggcaggcatgaagt

SEQ ID NO: 1849783 - DNA, 16 bp, Homo sapiens
cagagataaagacctt

SEQ ID NO: 1849784 - DNA, 21 bp, Homo sapiens
cagagattggaatgggcagct

SEQ ID NO: 1849785 - DNA, 23 bp, Homo sapiens
cagagattggaatgggcagctca

SEQ ID NO: 1849786 - DNA, 20 bp, Homo sapiens
cagagcaagtgagaccctgt

SEQ ID NO: 1849787 - DNA, 21 bp, Homo sapiens
cagagcaccttagacagtccc

SEQ ID NO: 1849788 - DNA, 23 bp, Homo sapiens
cagagcaccttagacagtccctg

SEQ ID NO: 1849789 - DNA, 13 bp, Homo sapiens
cagagcagagacc

SEQ ID NO: 1849790 - DNA, 21 bp, Homo sapiens
cagagcccacgcccccactgg

SEQ ID NO: 1849791 - DNA, 15 bp, Homo sapiens
cagagcgtgagctga

SEQ ID NO: 1849792 - DNA, 19 bp, Homo sapiens
cagagcttggactggatgc

SEQ ID NO: 1849793 - DNA, 13 bp, Homo sapiens
cagaggatgctga

SEQ ID NO: 1849794 - DNA, 22 bp, Homo sapiens
cagaggatgctgacatcatttg

SEQ ID NO: 1849795 - DNA, 17 bp, Homo sapiens
cagaggcagtacctggg

SEQ ID NO: 1849796 - DNA, 23 bp, Homo sapiens
cagagggggtggcctcccaactc

SEQ ID NO: 1849797 - DNA, 13 bp, Homo sapiens
cagaggtggatgt

SEQ ID NO: 1849798 - DNA, 18 bp, Homo sapiens
cagaggtggatgttatga

SEQ ID NO: 1849799 - DNA, 22 bp, Homo sapiens
cagaggtggatgttatgaacag

SEQ ID NO: 1849800 - DNA, 23 bp, Homo sapiens
cagaggtggatgttatgaacagc

SEQ ID NO: 1849801 - DNA, 18 bp, Homo sapiens
cagaggttatctgtccca

SEQ ID NO: 1849802 - DNA, 21 bp, Homo sapiens
cagaggttatctgtcccaggt

SEQ ID NO: 1849803 - DNA, 20 bp, Homo sapiens
cagagtatggagctcagaga

SEQ ID NO: 1849804 - DNA, 24 bp, Homo sapiens
cagagttccccatgcagacatgag

SEQ ID NO: 1849805 - DNA, 21 bp, Homo sapiens
cagataactgttatttataat

SEQ ID NO: 1849806 - DNA, 18 bp, Homo sapiens
cagatgggtgcttggagg

SEQ ID NO: 1849807 - DNA, 12 bp, Homo sapiens
cagattctgatg

SEQ ID NO: 1849808 - DNA, 14 bp, Homo sapiens
cagattctgatgca

SEQ ID NO: 1849809 - DNA, 15 bp, Homo sapiens
cagattctttcctga

SEQ ID NO: 1849810 - DNA, 20 bp, Homo sapiens
cagatttaagatatgtaaca

SEQ ID NO: 1849811 - DNA, 18 bp, Homo sapiens
cagcaaaagatgcttctc

SEQ ID NO: 1849812 - DNA, 22 bp, Homo sapiens
cagcaagaagatcctaaaacaa

SEQ ID NO: 1849813 - DNA, 22 bp, Homo sapiens
cagcaccacactgggtgcgtct

SEQ ID NO: 1849814 - DNA, 14 bp, Homo sapiens
cagcactgcctgct

SEQ ID NO: 1849815 - DNA, 17 bp, Homo sapiens
cagcactgcctgctccc

SEQ ID NO: 1849816 - DNA, 18 bp, Homo sapiens
cagcagcctggaccctgt

SEQ ID NO: 1849817 - DNA, 17 bp, Homo sapiens
cagcatagaagtaactt

SEQ ID NO: 1849818 - DNA, 18 bp, Homo sapiens
cagcatcccttgaccagg

SEQ ID NO: 1849819 - DNA, 19 bp, Homo sapiens
cagcatcccttgaccaggc

SEQ ID NO: 1849820 - DNA, 22 bp, Homo sapiens
cagcatcccttgaccaggcctg

SEQ ID NO: 1849821 - DNA, 16 bp, Homo sapiens
cagccaaagcctcctc

SEQ ID NO: 1849822 - DNA, 14 bp, Homo sapiens
cagccacattcctg

SEQ ID NO: 1849823 - DNA, 17 bp, Homo sapiens
cagccacattcctgatg

SEQ ID NO: 1849824 - DNA, 22 bp, Homo sapiens
cagccaggccacaagacccttg

SEQ ID NO: 1849825 - DNA, 13 bp, Homo sapiens
cagccagggctgc

SEQ ID NO: 1849826 - DNA, 23 bp, Homo sapiens
cagcccagccccgccccgttgtg

SEQ ID NO: 1849827 - DNA, 12 bp, Homo sapiens
cagccccatcct

SEQ ID NO: 1849828 - DNA, 16 bp, Homo sapiens
cagccccatcctctgt

SEQ ID NO: 1849829 - DNA, 21 bp, Homo sapiens
cagcccccactgcctttgacc

SEQ ID NO: 1849830 - DNA, 21 bp, Homo sapiens
cagccccttctgacccatgct

SEQ ID NO: 1849831 - DNA, 22 bp, Homo sapiens
cagccccttctgacccatgctg

SEQ ID NO: 1849832 - DNA, 23 bp, Homo sapiens
cagccccttctgacccatgctgc

SEQ ID NO: 1849833 - DNA, 17 bp, Homo sapiens
cagcccgggctctgcct

SEQ ID NO: 1849834 - DNA, 13 bp, Homo sapiens
cagccctggctga

SEQ ID NO: 1849835 - DNA, 17 bp, Homo sapiens
cagccctggctgaagga

SEQ ID NO: 1849836 - DNA, 20 bp, Homo sapiens
cagccctggctgaaggactg

SEQ ID NO: 1849837 - DNA, 21 bp, Homo sapiens
cagccgtgtaaccatggaccc

SEQ ID NO: 1849838 - DNA, 20 bp, Homo sapiens
cagcctcacagtccttacca

SEQ ID NO: 1849839 - DNA, 15 bp, Homo sapiens
cagcctgctccagct

SEQ ID NO: 1849840 - DNA, 20 bp, Homo sapiens
cagcgctggccgggaccccg

SEQ ID NO: 1849841 - DNA, 12 bp, Homo sapiens
cagctcagagag

SEQ ID NO: 1849842 - DNA, 20 bp, Homo sapiens
cagctcagagagggtgggag

SEQ ID NO: 1849843 - DNA, 23 bp, Homo sapiens
cagctcccataaccgctgattct

SEQ ID NO: 1849844 - DNA, 13 bp, Homo sapiens
cagctccccagag

SEQ ID NO: 1849845 - DNA, 15 bp, Homo sapiens
cagctcctcatccag

SEQ ID NO: 1849846 - DNA, 20 bp, Homo sapiens
cagctcctcatccagggctc

SEQ ID NO: 1849847 - DNA, 12 bp, Homo sapiens
cagctctctgac

SEQ ID NO: 1849848 - DNA, 15 bp, Homo sapiens
cagctctctgacgct

SEQ ID NO: 1849849 - DNA, 21 bp, Homo sapiens
cagctctgcaagaattgaagc

SEQ ID NO: 1849850 - DNA, 10 bp, Homo sapiens
cagctctggt

SEQ ID NO: 1849851 - DNA, 13 bp, Homo sapiens
cagctctggtcca

SEQ ID NO: 1849852 - DNA, 21 bp, Homo sapiens
cagctctggtccatagagagc

SEQ ID NO: 1849853 - DNA, 22 bp, Homo sapiens
cagctctggtccatagagagca

SEQ ID NO: 1849854 - DNA, 18 bp, Homo sapiens
cccaggcattccccagga

SEQ ID NO: 1849855 - DNA, 15 bp, Homo sapiens
cccaggcttagtcac

SEQ ID NO: 1849856 - DNA, 21 bp, Homo sapiens
cccagtacctcctgtctctgg

SEQ ID NO: 1849857 - DNA, 17 bp, Homo sapiens
cccagtgccgagaagga

SEQ ID NO: 1849858 - DNA, 18 bp, Homo sapiens
cccagtggctgctgccca

SEQ ID NO: 1849859 - DNA, 23 bp, Homo sapiens
cccatattaacaaattgcatttg

SEQ ID NO: 1849860 - DNA, 20 bp, Homo sapiens
cccatccagtctcccaactt

SEQ ID NO: 1849861 - DNA, 13 bp, Homo sapiens
cccatcctctgta

SEQ ID NO: 1849862 - DNA, 14 bp, Homo sapiens
cccatcctctgtac

SEQ ID NO: 1849863 - DNA, 13 bp, Homo sapiens
cccatgctgccct

SEQ ID NO: 1849864 - DNA, 16 bp, Homo sapiens
cccatgtctcgactca

SEQ ID NO: 1849865 - DNA, 17 bp, Homo sapiens
cccatgtctcgactcat

SEQ ID NO: 1849866 - DNA, 17 bp, Homo sapiens
cccattgttgtcaagga

SEQ ID NO: 1849867 - DNA, 22 bp, Homo sapiens
ccccaaaactctcctctgctgc

SEQ ID NO: 1849868 - DNA, 21 bp, Homo sapiens
ccccacccaagggcctggcct

SEQ ID NO: 1849869 - DNA, 15 bp, Homo sapiens
ccccactcagccttt

SEQ ID NO: 1849870 - DNA, 11 bp, Homo sapiens
ccccagcctgg

SEQ ID NO: 1849871 - DNA, 14 bp, Homo sapiens
ccccaggaggccag

SEQ ID NO: 1849872 - DNA, 17 bp, Homo sapiens
ccccaggaggccagcct

SEQ ID NO: 1849873 - DNA, 22 bp, Homo sapiens
ccccaggtggttatggagaggg

SEQ ID NO: 1849874 - DNA, 19 bp, Homo sapiens
ccccatcctctgtacagag

SEQ ID NO: 1849875 - DNA, 19 bp, Homo sapiens
ccccctgacaacactcatt

SEQ ID NO: 1849876 - DNA, 14 bp, Homo sapiens
ccccgcccaggctt

SEQ ID NO: 1849877 - DNA, 17 bp, Homo sapiens
ccccgctgatggagccc

SEQ ID NO: 1849878 - DNA, 14 bp, Homo sapiens
ccccggccacctgc

SEQ ID NO: 1849879 - DNA, 15 bp, Homo sapiens
cccctcaacacctct

SEQ ID NO: 1849880 - DNA, 20 bp, Homo sapiens
cccctcagggtccctggtgg

SEQ ID NO: 1849881 - DNA, 14 bp, Homo sapiens
cccctccccccaga

SEQ ID NO: 1849882 - DNA, 18 bp, Homo sapiens
cccctccccccagactct

SEQ ID NO: 1849883 - DNA, 15 bp, Homo sapiens
cccctggatgcagcc

SEQ ID NO: 1849884 - DNA, 18 bp, Homo sapiens
cccctggatgcagcctca

SEQ ID NO: 1849885 - DNA, 14 bp, Homo sapiens
ccccttaccactgc

SEQ ID NO: 1849886 - DNA, 22 bp, Homo sapiens
ccccttctaggtggcaaggctg

SEQ ID NO: 1849887 - DNA, 14 bp, Homo sapiens
cccgaatacaaaca

SEQ ID NO: 1849888 - DNA, 15 bp, Homo sapiens
cccgagcctggctcc

SEQ ID NO: 1849889 - DNA, 15 bp, Homo sapiens
cccgcagggccatgc

SEQ ID NO: 1849890 - DNA, 20 bp, Homo sapiens
cccgcccaggcttagtcact

SEQ ID NO: 1849891 - DNA, 22 bp, Homo sapiens
cccgcccaggcttagtcactga

SEQ ID NO: 1849892 - DNA, 22 bp, Homo sapiens
cccgctaagagggagggagggc

SEQ ID NO: 1849893 - DNA, 20 bp, Homo sapiens
cccgctgatggagccccacc

SEQ ID NO: 1849894 - DNA, 12 bp, Homo sapiens
cccgggaagggg

SEQ ID NO: 1849895 - DNA, 22 bp, Homo sapiens
cccgggaagggggctgggacat

SEQ ID NO: 1849896 - DNA, 19 bp, Homo sapiens
ccctatctttgccaccctc

SEQ ID NO: 1849897 - DNA, 21 bp, Homo sapiens
ccctattttttttctgttata

SEQ ID NO: 1849898 - DNA, 16 bp, Homo sapiens
ccctcaacacctctgc

SEQ ID NO: 1849899 - DNA, 15 bp, Homo sapiens
ccctcaactgaaggg

SEQ ID NO: 1849900 - DNA, 12 bp, Homo sapiens
ccctcacactgg

SEQ ID NO: 1849901 - DNA, 16 bp, Homo sapiens
ccctcagggtccctgg

SEQ ID NO: 1849902 - DNA, 16 bp, Homo sapiens
ccctccatgtgagaat

SEQ ID NO: 1849903 - DNA, 14 bp, Homo sapiens
ccctcccacagcgc

SEQ ID NO: 1849904 - DNA, 19 bp, Homo sapiens
ccctccccacagtgccacc

SEQ ID NO: 1849905 - DNA, 13 bp, Homo sapiens
ccctccccccaga

SEQ ID NO: 1849906 - DNA, 17 bp, Homo sapiens
ccctccccccagactct

SEQ ID NO: 1849907 - DNA, 11 bp, Homo sapiens
ccctcctcctg

SEQ ID NO: 1849908 - DNA, 18 bp, Homo sapiens
ccctcctcctggactcct

SEQ ID NO: 1849909 - DNA, 23 bp, Homo sapiens
ccctcgaggcggatctttggaca

SEQ ID NO: 1849910 - DNA, 14 bp, Homo sapiens
ccctctgtctagga

SEQ ID NO: 1849911 - DNA, 22 bp, Homo sapiens
ccctctgtctaggactgcagtg

SEQ ID NO: 1849912 - DNA, 17 bp, Homo sapiens
ccctctttccctccctt

SEQ ID NO: 1849913 - DNA, 13 bp, Homo sapiens
ccctgaaggcccc

SEQ ID NO: 1849914 - DNA, 19 bp, Homo sapiens
ccctgaaggccccgcccag

SEQ ID NO: 1849915 - DNA, 14 bp, Homo sapiens
ccctgacaacactc

SEQ ID NO: 1849916 - DNA, 16 bp, Homo sapiens
ccctgagctttctgct

SEQ ID NO: 1849917 - DNA, 12 bp, Homo sapiens
ccctgaggccca

SEQ ID NO: 1849918 - DNA, 15 bp, Homo sapiens
ccctgaggcccagag

SEQ ID NO: 1849919 - DNA, 16 bp, Homo sapiens
ccctgaggcccagagg

SEQ ID NO: 1849920 - DNA, 19 bp, Homo sapiens
ccctgaggcccagagggcc

SEQ ID NO: 1849921 - DNA, 20 bp, Homo sapiens
ccctgaggcccagagggcct

SEQ ID NO: 1849922 - DNA, 13 bp, Homo sapiens
ccctgcccacctg

SEQ ID NO: 1849923 - DNA, 22 bp, Homo sapiens
ccctgcccacctggcctctgca

SEQ ID NO: 1849924 - DNA, 11 bp, Homo sapiens
ccctgccctgt

SEQ ID NO: 1849925 - DNA, 13 bp, Homo sapiens
ccctgccctgtgg

SEQ ID NO: 1849926 - DNA, 16 bp, Homo sapiens
ccctgccctgtgggcc

SEQ ID NO: 1849927 - DNA, 21 bp, Homo sapiens
ccctggaaggacatccatgtt

SEQ ID NO: 1849928 - DNA, 12 bp, Homo sapiens
ccctggagccca

SEQ ID NO: 1849929 - DNA, 14 bp, Homo sapiens
ccctggctgaagga

SEQ ID NO: 1849930 - DNA, 23 bp, Homo sapiens
ccctgggagggacatgcttagca

SEQ ID NO: 1849931 - DNA, 16 bp, Homo sapiens
ccctggtggcagctca

SEQ ID NO: 1849932 - DNA, 22 bp, Homo sapiens
ccctggttctgatgatgtgcct

SEQ ID NO: 1849933 - DNA, 23 bp, Homo sapiens
ccctgtgagtttgtacagtcttg

SEQ ID NO: 1849934 - DNA, 18 bp, Homo sapiens
ccctgtgatggggccctg

SEQ ID NO: 1849935 - DNA, 20 bp, Homo sapiens
ccctgtgatggggccctgcc

SEQ ID NO: 1849936 - DNA, 21 bp, Homo sapiens
cccttaccactgctctgatga

SEQ ID NO: 1849937 - DNA, 19 bp, Homo sapiens
cccttacctcggtgccttc

SEQ ID NO: 1849938 - DNA, 20 bp, Homo sapiens
cccttactttaaccctttct

SEQ ID NO: 1849939 - DNA, 16 bp, Homo sapiens
cccttcatctggaacc

SEQ ID NO: 1849940 - DNA, 15 bp, Homo sapiens
cccttcctctttcca

SEQ ID NO: 1849941 - DNA, 14 bp, Homo sapiens
cccttctctccagc

SEQ ID NO: 1849942 - DNA, 19 bp, Homo sapiens
cccttctctccagcccctg

SEQ ID NO: 1849943 - DNA, 21 bp, Homo sapiens
cccttctctccagcccctgga

SEQ ID NO: 1849944 - DNA, 22 bp, Homo sapiens
cccttctctccagcccctggat

SEQ ID NO: 1849945 - DNA, 23 bp, Homo sapiens
cccttctgacccatgctgccctg

SEQ ID NO: 1849946 - DNA, 12 bp, Homo sapiens
cccttctgctgt

SEQ ID NO: 1849947 - DNA, 20 bp, Homo sapiens
cccttgaggattgtggaaaa

SEQ ID NO: 1849948 - DNA, 22 bp, Homo sapiens
cccttgccgtctacctgagggg

SEQ ID NO: 1849949 - DNA, 17 bp, Homo sapiens
cccttttttggctgctg

SEQ ID NO: 1849950 - DNA, 19 bp, Homo sapiens
cccttttttggctgctgaa

SEQ ID NO: 1849951 - DNA, 21 bp, Homo sapiens
cccttttttggctgctgaagg

SEQ ID NO: 1849952 - DNA, 16 bp, Homo sapiens
ccgacccttgccgtct

SEQ ID NO: 1849953 - DNA, 17 bp, Homo sapiens
ccgagaaggaagcctcc

SEQ ID NO: 1849954 - DNA, 19 bp, Homo sapiens
ccgagattgcaccactgca

SEQ ID NO: 1849955 - DNA, 16 bp, Homo sapiens
ccgagcctggctccaa

SEQ ID NO: 1849956 - DNA, 19 bp, Homo sapiens
ccgatgtcgacatgttttt

SEQ ID NO: 1849957 - DNA, 21 bp, Homo sapiens
ccgcaccagcccgaacaccat

SEQ ID NO: 1849958 - DNA, 20 bp, Homo sapiens
ccgcagggccatgcagacct

SEQ ID NO: 1849959 - DNA, 15 bp, Homo sapiens
ccgccagctgccgca

SEQ ID NO: 1849960 - DNA, 22 bp, Homo sapiens
ccgccagctgccgcaccagccc

SEQ ID NO: 1849961 - DNA, 12 bp, Homo sapiens
ccgcccaggctt

SEQ ID NO: 1849962 - DNA, 20 bp, Homo sapiens
ccgcccaggcttagtcactg

SEQ ID NO: 1849963 - DNA, 23 bp, Homo sapiens
ccgctaagagggagggagggctc

SEQ ID NO: 1849964 - DNA, 18 bp, Homo sapiens
ccgctgatggagccccac

SEQ ID NO: 1849965 - DNA, 13 bp, Homo sapiens
ccgctgattctca

SEQ ID NO: 1849966 - DNA, 11 bp, Homo sapiens
ccggaagccaa

SEQ ID NO: 1849967 - DNA, 23 bp, Homo sapiens
ccggacttagaaaaccagctcag

SEQ ID NO: 1849968 - DNA, 18 bp, Homo sapiens
ccggcagggtcctagaaa

SEQ ID NO: 1849969 - DNA, 23 bp, Homo sapiens
ccggccccctccccccagactct

SEQ ID NO: 1849970 - DNA, 13 bp, Homo sapiens
ccggctggcctgg

SEQ ID NO: 1849971 - DNA, 15 bp, Homo sapiens
ccggctggcctggcc

SEQ ID NO: 1849972 - DNA, 18 bp, Homo sapiens
ccggctggcctggcccct

SEQ ID NO: 1849973 - DNA, 20 bp, Homo sapiens
ccgggaagggggctgggaca

SEQ ID NO: 1849974 - DNA, 14 bp, Homo sapiens
ccgtctacctgagg

SEQ ID NO: 1849975 - DNA, 11 bp, Homo sapiens
ccgtggcacat

SEQ ID NO: 1849976 - DNA, 12 bp, Homo sapiens
cctggcctctgc

SEQ ID NO: 1849977 - DNA, 15 bp, Homo sapiens
cctggcctctgcact

SEQ ID NO: 1849978 - DNA, 22 bp, Homo sapiens
cctggcctctgcactcccctgc

SEQ ID NO: 1849979 - DNA, 20 bp, Homo sapiens
cctggctccaaaccctcgag

SEQ ID NO: 1849980 - DNA, 20 bp, Homo sapiens
cctgggaggtcaaggctgca

SEQ ID NO: 1849981 - DNA, 22 bp, Homo sapiens
cctggggtaccaagagactcct

SEQ ID NO: 1849982 - DNA, 22 bp, Homo sapiens
cctgggtaaatgcagcgtgaag

SEQ ID NO: 1849983 - DNA, 10 bp, Homo sapiens
cctggtgccc

SEQ ID NO: 1849984 - DNA, 12 bp, Homo sapiens
cctggtgctgct

SEQ ID NO: 1849985 - DNA, 14 bp, Homo sapiens
cctggtggcagctc

SEQ ID NO: 1849986 - DNA, 16 bp, Homo sapiens
cctggtggcagctcac

SEQ ID NO: 1849987 - DNA, 21 bp, Homo sapiens
cctggttctgatgatgtgcct

SEQ ID NO: 1849988 - DNA, 19 bp, Homo sapiens
cctgtagagtgggagctga

SEQ ID NO: 1849989 - DNA, 13 bp, Homo sapiens
cctgtagccctaa

SEQ ID NO: 1849990 - DNA, 12 bp, Homo sapiens
cctgtccccctg

SEQ ID NO: 1849991 - DNA, 16 bp, Homo sapiens
cctgtccccctgacaa

SEQ ID NO: 1849992 - DNA, 17 bp, Homo sapiens
cctgtcctgcctaaggc

SEQ ID NO: 1849993 - DNA, 19 bp, Homo sapiens
cctgtcctgcctaaggctg

SEQ ID NO: 1849994 - DNA, 17 bp, Homo sapiens
cctgtgaactgaactct

SEQ ID NO: 1849995 - DNA, 22 bp, Homo sapiens
cctgtgatggggccctgcctcc

SEQ ID NO: 1849996 - DNA, 17 bp, Homo sapiens
cctgtgtgttaagctct

SEQ ID NO: 1849997 - DNA, 20 bp, Homo sapiens
cctgttttagaaggttctct

SEQ ID NO: 1849998 - DNA, 12 bp, Homo sapiens
ccttaacactga

SEQ ID NO: 1849999 - DNA, 20 bp, Homo sapiens
ccttaccactgctctgatga

SEQ ID NO: 1850000 - DNA, 13 bp, Homo sapiens
ccttaccagcaga

SEQ ID NO: 1850001 - DNA, 15 bp, Homo sapiens
ccttaccagcagagc

SEQ ID NO: 1850002 - DNA, 21 bp, Homo sapiens
ccttagacagtccctgccaat

SEQ ID NO: 1850003 - DNA, 16 bp, Homo sapiens
ccttagcaaattctgt

SEQ ID NO: 1850004 - DNA, 22 bp, Homo sapiens
ccttccaggggtgggacaccct

SEQ ID NO: 1850005 - DNA, 14 bp, Homo sapiens
ccttcccacctctc

SEQ ID NO: 1850006 - DNA, 16 bp, Homo sapiens
ccttctgacccatgct

SEQ ID NO: 1850007 - DNA, 17 bp, Homo sapiens
ccttctgacccatgctg

SEQ ID NO: 1850008 - DNA, 21 bp, Homo sapiens
ccttctgacccatgctgccct

SEQ ID NO: 1850009 - DNA, 20 bp, Homo sapiens
ccttgaccattctccacctg

SEQ ID NO: 1850010 - DNA, 18 bp, Homo sapiens
ccttgagagaccaggcaa

SEQ ID NO: 1850011 - DNA, 23 bp, Homo sapiens
ccttgaggattgtggaaaaccag

SEQ ID NO: 1850012 - DNA, 20 bp, Homo sapiens
ccttgccgtctacctgaggg

SEQ ID NO: 1850013 - DNA, 16 bp, Homo sapiens
ccttggacattttatg

SEQ ID NO: 1850014 - DNA, 19 bp, Homo sapiens
ccttggattgtccccgacc

SEQ ID NO: 1850015 - DNA, 13 bp, Homo sapiens
ccttggctggtgc

SEQ ID NO: 1850016 - DNA, 23 bp, Homo sapiens
ccttgttaagtatcagctacaat

SEQ ID NO: 1850017 - DNA, 20 bp, Homo sapiens
cctttctcggggtcaggttc

SEQ ID NO: 1850018 - DNA, 15 bp, Homo sapiens
cctttgacctgcctc

SEQ ID NO: 1850019 - DNA, 16 bp, Homo sapiens
cctttgacctgcctcc

SEQ ID NO: 1850020 - DNA, 23 bp, Homo sapiens
cctttgacgccatcccagcccca

SEQ ID NO: 1850021 - DNA, 11 bp, Homo sapiens
cctttggcttc

SEQ ID NO: 1850022 - DNA, 18 bp, Homo sapiens
cctttgtccccaccgcag

SEQ ID NO: 1850023 - DNA, 23 bp, Homo sapiens
cctttgtgaggaagccgctgggg

SEQ ID NO: 1850024 - DNA, 12 bp, Homo sapiens
ccttttccatgc

SEQ ID NO: 1850025 - DNA, 15 bp, Homo sapiens
ccttttttggctgct

SEQ ID NO: 1850026 - DNA, 20 bp, Homo sapiens
cgaaaggatgaaagtgacca

SEQ ID NO: 1850027 - DNA, 17 bp, Homo sapiens
cgaatgacggtaagtgt

SEQ ID NO: 1850028 - DNA, 15 bp, Homo sapiens
cgagcaaacccagag

SEQ ID NO: 1850029 - DNA, 23 bp, Homo sapiens
cgagcaaacccagaggtggatgt

SEQ ID NO: 1850030 - DNA, 13 bp, Homo sapiens
cgagcatgcctgg

SEQ ID NO: 1850031 - DNA, 14 bp, Homo sapiens
cgagcatgcctgga

SEQ ID NO: 1850032 - DNA, 17 bp, Homo sapiens
cgagcatgcctggatgg

SEQ ID NO: 1850033 - DNA, 18 bp, Homo sapiens
cgagcatgcctggatggg

SEQ ID NO: 1850034 - DNA, 19 bp, Homo sapiens
cgatgagcgccacctcttt

SEQ ID NO: 1850035 - DNA, 22 bp, Homo sapiens
cgcaagagccatgtagaagctg

SEQ ID NO: 1850036 - DNA, 20 bp, Homo sapiens
cgcaccagcccgaacaccat

SEQ ID NO: 1850037 - DNA, 22 bp, Homo sapiens
cgcaggattcttcctccctccc

SEQ ID NO: 1850038 - DNA, 17 bp, Homo sapiens
cgcaggcccctctcctc

SEQ ID NO: 1850039 - DNA, 23 bp, Homo sapiens
cgcaggcccctctcctccgtggc

SEQ ID NO: 1850040 - DNA, 14 bp, Homo sapiens
cgcagggccatgca

SEQ ID NO: 1850041 - DNA, 12 bp, Homo sapiens
cgccaaggctgg

SEQ ID NO: 1850042 - DNA, 17 bp, Homo sapiens
cgccagattctttcctg

SEQ ID NO: 1850043 - DNA, 15 bp, Homo sapiens
cgcccccactggtga

SEQ ID NO: 1850044 - DNA, 19 bp, Homo sapiens
cgccccgttgtgagctgga

SEQ ID NO: 1850045 - DNA, 19 bp, Homo sapiens
cgcccctcccacagcgctg

SEQ ID NO: 1850046 - DNA, 15 bp, Homo sapiens
cgctaagagggaggg

SEQ ID NO: 1850047 - DNA, 16 bp, Homo sapiens
cgctaagagggaggga

SEQ ID NO: 1850048 - DNA, 22 bp, Homo sapiens
cgctaagagggagggagggctc

SEQ ID NO: 1850049 - DNA, 18 bp, Homo sapiens
cgctacccgggaaggggg

SEQ ID NO: 1850050 - DNA, 13 bp, Homo sapiens
cgctctttgagaa

SEQ ID NO: 1850051 - DNA, 14 bp, Homo sapiens
cgctgatggagccc

SEQ ID NO: 1850052 - DNA, 18 bp, Homo sapiens
cgctgatggagccccacc

SEQ ID NO: 1850053 - DNA, 14 bp, Homo sapiens
cgctgattctcagg

SEQ ID NO: 1850054 - DNA, 23 bp, Homo sapiens
cgctgattctcagggtctctgct

SEQ ID NO: 1850055 - DNA, 18 bp, Homo sapiens
cgctggccgggaccccga

SEQ ID NO: 1850056 - DNA, 21 bp, Homo sapiens
cgctgtgctgccctgcccacc

SEQ ID NO: 1850057 - DNA, 13 bp, Homo sapiens
cgcttgtgacagt

SEQ ID NO: 1850058 - DNA, 15 bp, Homo sapiens
cggcattaaagccat

SEQ ID NO: 1850059 - DNA, 17 bp, Homo sapiens
cggccacctgcggtgct

SEQ ID NO: 1850060 - DNA, 20 bp, Homo sapiens
cggccccctccccccagact

SEQ ID NO: 1850061 - DNA, 15 bp, Homo sapiens
cggctctgtccccag

SEQ ID NO: 1850062 - DNA, 19 bp, Homo sapiens
cggctctgtccccagcctg

SEQ ID NO: 1850063 - DNA, 14 bp, Homo sapiens
cggctggcctggcc

SEQ ID NO: 1850064 - DNA, 15 bp, Homo sapiens
cggctggcctggccc

SEQ ID NO: 1850065 - DNA, 19 bp, Homo sapiens
cggctggcctggcccctca

SEQ ID NO: 1850066 - DNA, 11 bp, Homo sapiens
cggctgtgtgt

SEQ ID NO: 1850067 - DNA, 17 bp, Homo sapiens
cgggagaggggacgcag

SEQ ID NO: 1850068 - DNA, 22 bp, Homo sapiens
cgggagaggggacgcaggcccc

SEQ ID NO: 1850069 - DNA, 16 bp, Homo sapiens
cgggaggtcgaggcag

SEQ ID NO: 1850070 - DNA, 17 bp, Homo sapiens
cgggaggtcgaggcagg

SEQ ID NO: 1850071 - DNA, 18 bp, Homo sapiens
cgggaggtcgaggcagga

SEQ ID NO: 1850072 - DNA, 20 bp, Homo sapiens
cgggaggtcgaggcaggagg

SEQ ID NO: 1850073 - DNA, 15 bp, Homo sapiens
cgggctcagcaaaag

SEQ ID NO: 1850074 - DNA, 13 bp, Homo sapiens
cgggctctgcctc

SEQ ID NO: 1850075 - DNA, 13 bp, Homo sapiens
cggggacacaggc

SEQ ID NO: 1850076 - DNA, 12 bp, Homo sapiens
cgggggcagctg

SEQ ID NO: 1850077 - DNA, 18 bp, Homo sapiens
cggtgctatctcccccag

SEQ ID NO: 1850078 - DNA, 22 bp, Homo sapiens
cggtgctatctcccccagcccc

SEQ ID NO: 1850079 - DNA, 14 bp, Homo sapiens
cggtgctccaggca

SEQ ID NO: 1850080 - DNA, 16 bp, Homo sapiens
cggtgctccaggcagg

SEQ ID NO: 1850081 - DNA, 23 bp, Homo sapiens
cggtgtttaagacatttttggaa

SEQ ID NO: 1850082 - DNA, 13 bp, Homo sapiens
cgtgaagggattt

SEQ ID NO: 1850083 - DNA, 14 bp, Homo sapiens
cgtgctctttgttt

SEQ ID NO: 1850084 - DNA, 14 bp, Homo sapiens
cgtggagctgcctg

SEQ ID NO: 1850085 - DNA, 16 bp, Homo sapiens
cgtggaggagcagtgc

SEQ ID NO: 1850086 - DNA, 15 bp, Homo sapiens
cgtgttcagcagaac

SEQ ID NO: 1850087 - DNA, 20 bp, Homo sapiens
cgttccatgatgctgggatt

SEQ ID NO: 1850088 - DNA, 15 bp, Homo sapiens
cgttttctgtttgga

SEQ ID NO: 1850089 - DNA, 22 bp, Homo sapiens
ctaaaataagggcagagtcaca

SEQ ID NO: 1850090 - DNA, 13 bp, Homo sapiens
ctaaaatgttcta

SEQ ID NO: 1850091 - DNA, 15 bp, Homo sapiens
ctaaacatgtatgta

SEQ ID NO: 1850092 - DNA, 21 bp, Homo sapiens
ctaacgcaaaaatagctcttg

SEQ ID NO: 1850093 - DNA, 22 bp, Homo sapiens
ctaacgcaaaaatagctcttgc

SEQ ID NO: 1850094 - DNA, 14 bp, Homo sapiens
ctaacttgtctttg

SEQ ID NO: 1850095 - DNA, 23 bp, Homo sapiens
ctaagagggagggagggctccag

SEQ ID NO: 1850096 - DNA, 10 bp, Homo sapiens
ctaaggaaat

SEQ ID NO: 1850097 - DNA, 18 bp, Homo sapiens
ctaaggcgtggagctgcc

SEQ ID NO: 1850098 - DNA, 17 bp, Homo sapiens
ctgggagagccttccag

SEQ ID NO: 1850099 - DNA, 19 bp, Homo sapiens
ctgggagagccttccaggg

SEQ ID NO: 1850100 - DNA, 21 bp, Homo sapiens
ctgggagagccttccaggggt

SEQ ID NO: 1850101 - DNA, 22 bp, Homo sapiens
ctgggagggacatgcttagcag

SEQ ID NO: 1850102 - DNA, 18 bp, Homo sapiens
ctgggaggtcaaggctgc

SEQ ID NO: 1850103 - DNA, 21 bp, Homo sapiens
ctgggaggtcaaggctgcagt

SEQ ID NO: 1850104 - DNA, 20 bp, Homo sapiens
ctgggatccctcatcctcat

SEQ ID NO: 1850105 - DNA, 15 bp, Homo sapiens
ctgggcaaggaggcc

SEQ ID NO: 1850106 - DNA, 20 bp, Homo sapiens
ctgggcaatgtgataaaacc

SEQ ID NO: 1850107 - DNA, 23 bp, Homo sapiens
ctgggcatagatgcaggtgagcc

SEQ ID NO: 1850108 - DNA, 14 bp, Homo sapiens
ctgggccagaattt

SEQ ID NO: 1850109 - DNA, 19 bp, Homo sapiens
ctgggctcccttcccacct

SEQ ID NO: 1850110 - DNA, 22 bp, Homo sapiens
ctgggctcccttcccacctctc

SEQ ID NO: 1850111 - DNA, 15 bp, Homo sapiens
ctggggccaaataaa

SEQ ID NO: 1850112 - DNA, 15 bp, Homo sapiens
ctggggctgctggcc

SEQ ID NO: 1850113 - DNA, 16 bp, Homo sapiens
ctggggctgctggcct

SEQ ID NO: 1850114 - DNA, 20 bp, Homo sapiens
ctgggggcaaaatcagaatg

SEQ ID NO: 1850115 - DNA, 15 bp, Homo sapiens
ctggggtcccagcag

SEQ ID NO: 1850116 - DNA, 22 bp, Homo sapiens
ctgggtaactagggaagataat

SEQ ID NO: 1850117 - DNA, 17 bp, Homo sapiens
ctgggtctcagtgtcct

SEQ ID NO: 1850118 - DNA, 18 bp, Homo sapiens
ctgggtctcagtgtcctc

SEQ ID NO: 1850119 - DNA, 21 bp, Homo sapiens
ctgggtggcaccagcagcctg

SEQ ID NO: 1850120 - DNA, 20 bp, Homo sapiens
ctgggtggcactgccatgca

SEQ ID NO: 1850121 - DNA, 14 bp, Homo sapiens
ctgggtgtggcgca

SEQ ID NO: 1850122 - DNA, 17 bp, Homo sapiens
ctgggtgtggcgcagca

SEQ ID NO: 1850123 - DNA, 14 bp, Homo sapiens
ctgggttctaccca

SEQ ID NO: 1850124 - DNA, 15 bp, Homo sapiens
ctgggttctacccag

SEQ ID NO: 1850125 - DNA, 18 bp, Homo sapiens
ctgggtttaaggggagag

SEQ ID NO: 1850126 - DNA, 14 bp, Homo sapiens
ctggtattcctgcc

SEQ ID NO: 1850127 - DNA, 17 bp, Homo sapiens
ctggtccatagagagca

SEQ ID NO: 1850128 - DNA, 20 bp, Homo sapiens
ctggtctatataaccacatt

SEQ ID NO: 1850129 - DNA, 17 bp, Homo sapiens
ctggtctctaggctggg

SEQ ID NO: 1850130 - DNA, 18 bp, Homo sapiens
ctggtggcagctcacctc

SEQ ID NO: 1850131 - DNA, 19 bp, Homo sapiens
ctggtggcttaagtgagca

SEQ ID NO: 1850132 - DNA, 16 bp, Homo sapiens
ctggtgtgaactaaac

SEQ ID NO: 1850133 - DNA, 17 bp, Homo sapiens
ctggtgtgaactaaact

SEQ ID NO: 1850134 - DNA, 20 bp, Homo sapiens
ctggttaacttgtttggcct

SEQ ID NO: 1850135 - DNA, 23 bp, Homo sapiens
ctggttaatatttataggtcact

SEQ ID NO: 1850136 - DNA, 22 bp, Homo sapiens
ctggttagaggttccctttgac

SEQ ID NO: 1850137 - DNA, 17 bp, Homo sapiens
ctggttgatgcctgtga

SEQ ID NO: 1850138 - DNA, 16 bp, Homo sapiens
ctgtaaaatggagaca

SEQ ID NO: 1850139 - DNA, 22 bp, Homo sapiens
ctgtaaacccctttagtggctt

SEQ ID NO: 1850140 - DNA, 12 bp, Homo sapiens
ctgtaagagctt

SEQ ID NO: 1850141 - DNA, 15 bp, Homo sapiens
ctgtacagagcccac

SEQ ID NO: 1850142 - DNA, 18 bp, Homo sapiens
ctgtacagagcccacgcc

SEQ ID NO: 1850143 - DNA, 22 bp, Homo sapiens
ctgtacagagcccacgccccca

SEQ ID NO: 1850144 - DNA, 23 bp, Homo sapiens
ctgtacagagcccacgcccccac

SEQ ID NO: 1850145 - DNA, 18 bp, Homo sapiens
ctgtatctgtgtagacta

SEQ ID NO: 1850146 - DNA, 19 bp, Homo sapiens
ctgtcccaggttatctggg

SEQ ID NO: 1850147 - DNA, 16 bp, Homo sapiens
ctgtccccagcctggg

SEQ ID NO: 1850148 - DNA, 13 bp, Homo sapiens
ctgtccccctgac

SEQ ID NO: 1850149 - DNA, 15 bp, Homo sapiens
ctgtcctattatatt

SEQ ID NO: 1850150 - DNA, 20 bp, Homo sapiens
ctgtctaggactgcagtgtg

SEQ ID NO: 1850151 - DNA, 21 bp, Homo sapiens
ctgtctaggactgcagtgtgg

SEQ ID NO: 1850152 - DNA, 22 bp, Homo sapiens
ctgtctccctcccctctcagaa

SEQ ID NO: 1850153 - DNA, 20 bp, Homo sapiens
ctgtctccttaacactgagc

SEQ ID NO: 1850154 - DNA, 15 bp, Homo sapiens
ctgtgaaaggaaaga

SEQ ID NO: 1850155 - DNA, 19 bp, Homo sapiens
ctgtgatggggccctgcct

SEQ ID NO: 1850156 - DNA, 14 bp, Homo sapiens
ctgtgccattttgt

SEQ ID NO: 1850157 - DNA, 14 bp, Homo sapiens
ctgtgctccctggt

SEQ ID NO: 1850158 - DNA, 19 bp, Homo sapiens
ctgtgctgagtctgaaggc

SEQ ID NO: 1850159 - DNA, 12 bp, Homo sapiens
ctgtgctgccct

SEQ ID NO: 1850160 - DNA, 15 bp, Homo sapiens
ctgtgctgccctgcc

SEQ ID NO: 1850161 - DNA, 17 bp, Homo sapiens
ctgtggatgataaaaca

SEQ ID NO: 1850162 - DNA, 20 bp, Homo sapiens
ctgtggggctaggggctggg

SEQ ID NO: 1850163 - DNA, 21 bp, Homo sapiens
ctgtggggctaggggctgggg

SEQ ID NO: 1850164 - DNA, 16 bp, Homo sapiens
ctgtgtaaaaagagag

SEQ ID NO: 1850165 - DNA, 18 bp, Homo sapiens
ctgtgtctgccaaacaca

SEQ ID NO: 1850166 - DNA, 21 bp, Homo sapiens
ctgtgtctgccaaacacattt

SEQ ID NO: 1850167 - DNA, 18 bp, Homo sapiens
ctgtgtgttaagctctgc

SEQ ID NO: 1850168 - DNA, 18 bp, Homo sapiens
ctgtgttcacactgtaaa

SEQ ID NO: 1850169 - DNA, 14 bp, Homo sapiens
ctgttatataaatg

SEQ ID NO: 1850170 - DNA, 22 bp, Homo sapiens
ctgttatataaatggttaaaag

SEQ ID NO: 1850171 - DNA, 12 bp, Homo sapiens
ctgttcaagagc

SEQ ID NO: 1850172 - DNA, 21 bp, Homo sapiens
ctgttcagctggttgaggttt

SEQ ID NO: 1850173 - DNA, 14 bp, Homo sapiens
ctgttctctgccct

SEQ ID NO: 1850174 - DNA, 19 bp, Homo sapiens
ctgttctctgccctccaag

SEQ ID NO: 1850175 - DNA, 20 bp, Homo sapiens
ctgttctctgccctccaaga

SEQ ID NO: 1850176 - DNA, 16 bp, Homo sapiens
ctgttcttagctcaat

SEQ ID NO: 1850177 - DNA, 19 bp, Homo sapiens
ctgttcttagctcaatgag

SEQ ID NO: 1850178 - DNA, 12 bp, Homo sapiens
ctgtttcccagc

SEQ ID NO: 1850179 - DNA, 15 bp, Homo sapiens
ctgtttcccagcagt

SEQ ID NO: 1850180 - DNA, 13 bp, Homo sapiens
ctgttttctcttg

SEQ ID NO: 1850181 - DNA, 12 bp, Homo sapiens
ctgttttctgaa

SEQ ID NO: 1850182 - DNA, 23 bp, Homo sapiens
ctgttttgtttcgctctttgaga

SEQ ID NO: 1850183 - DNA, 19 bp, Homo sapiens
cttaaaataaagttaaact

SEQ ID NO: 1850184 - DNA, 13 bp, Homo sapiens
cttaaataataaa

SEQ ID NO: 1850185 - DNA, 12 bp, Homo sapiens
cttaacttagta

SEQ ID NO: 1850186 - DNA, 18 bp, Homo sapiens
cttaagtgagcagaacag

SEQ ID NO: 1850187 - DNA, 19 bp, Homo sapiens
cttaagtgagcagaacagg

SEQ ID NO: 1850188 - DNA, 18 bp, Homo sapiens
cttaattctttgttctgt

SEQ ID NO: 1850189 - DNA, 22 bp, Homo sapiens
cttacaaaaacaagacacccaa

SEQ ID NO: 1850190 - DNA, 20 bp, Homo sapiens
cttaccagggagatttgctc

SEQ ID NO: 1850191 - DNA, 19 bp, Homo sapiens
cttacctcggtgccttcct

SEQ ID NO: 1850192 - DNA, 18 bp, Homo sapiens
cttagaaaaccagctcag

SEQ ID NO: 1850193 - DNA, 24 bp, Homo sapiens
cttagaaaaccagctcagcactgc

SEQ ID NO: 1850194 - DNA, 21 bp, Homo sapiens
cttagcatcagaggtttgctt

SEQ ID NO: 1850195 - DNA, 19 bp, Homo sapiens
cttaggcatgactgtagaa

SEQ ID NO: 1850196 - DNA, 23 bp, Homo sapiens
cttaggttggcaaaaaggcagga

SEQ ID NO: 1850197 - DNA, 23 bp, Homo sapiens
cttagtatattattattaattac

SEQ ID NO: 1850198 - DNA, 14 bp, Homo sapiens
cttagtcactgaga

SEQ ID NO: 1850199 - DNA, 22 bp, Homo sapiens
cttagtcactgagacagcccgg

SEQ ID NO: 1850200 - DNA, 14 bp, Homo sapiens
cttatgaaaagaat

SEQ ID NO: 1850201 - DNA, 14 bp, Homo sapiens
cttatggatgtccc

SEQ ID NO: 1850202 - DNA, 17 bp, Homo sapiens
cttatggatgtccccag

SEQ ID NO: 1850203 - DNA, 18 bp, Homo sapiens
cttatggatgtccccagc

SEQ ID NO: 1850204 - DNA, 14 bp, Homo sapiens
cttatgggctgggt

SEQ ID NO: 1850205 - DNA, 15 bp, Homo sapiens
cttcaccctggagcc

SEQ ID NO: 1850206 - DNA, 19 bp, Homo sapiens
cttcacctaagtctctgtg

SEQ ID NO: 1850207 - DNA, 20 bp, Homo sapiens
cttcacctaagtctctgtga

SEQ ID NO: 1850208 - DNA, 17 bp, Homo sapiens
cttcacctttgtcccca

SEQ ID NO: 1850209 - DNA, 22 bp, Homo sapiens
cttcacctttgtccccaccgca

SEQ ID NO: 1850210 - DNA, 17 bp, Homo sapiens
cttcagagactcctgca

SEQ ID NO: 1850211 - DNA, 21 bp, Homo sapiens
cttcagagactcctgcaggca

SEQ ID NO: 1850212 - DNA, 11 bp, Homo sapiens
cttcagattcc

SEQ ID NO: 1850213 - DNA, 16 bp, Homo sapiens
cttcagtaagccgtga

SEQ ID NO: 1850214 - DNA, 17 bp, Homo sapiens
cttcagttaagcctttg

SEQ ID NO: 1850215 - DNA, 18 bp, Homo sapiens
cttcagttaagcctttgg

SEQ ID NO: 1850216 - DNA, 12 bp, Homo sapiens
cttcatctggaa

SEQ ID NO: 1850217 - DNA, 15 bp, Homo sapiens
cttcatgcatggaaa

SEQ ID NO: 1850218 - DNA, 15 bp, Homo sapiens
cttccaggctgggag

SEQ ID NO: 1850219 - DNA, 18 bp, Homo sapiens
gattgtggaaaaccagga

SEQ ID NO: 1850220 - DNA, 20 bp, Homo sapiens
gattgtgtctcttggtcctg

SEQ ID NO: 1850221 - DNA, 19 bp, Homo sapiens
gatttagcacccttctgct

SEQ ID NO: 1850222 - DNA, 15 bp, Homo sapiens
gatttccagccaggg

SEQ ID NO: 1850223 - DNA, 18 bp, Homo sapiens
gatttccagccagggctg

SEQ ID NO: 1850224 - DNA, 23 bp, Homo sapiens
gatttgctcaatacctggcctca

SEQ ID NO: 1850225 - DNA, 20 bp, Homo sapiens
gatttgggctctagaattcc

SEQ ID NO: 1850226 - DNA, 19 bp, Homo sapiens
gattttatgctttaaacat

SEQ ID NO: 1850227 - DNA, 14 bp, Homo sapiens
gatttttaaattaa

SEQ ID NO: 1850228 - DNA, 15 bp, Homo sapiens
gcaaaagatgcttct

SEQ ID NO: 1850229 - DNA, 22 bp, Homo sapiens
gcaaacccagaggtggatgtta

SEQ ID NO: 1850230 - DNA, 15 bp, Homo sapiens
gcaaagggcatgggt

SEQ ID NO: 1850231 - DNA, 20 bp, Homo sapiens
gcaaagggcatgggtcggga

SEQ ID NO: 1850232 - DNA, 17 bp, Homo sapiens
gcaaataacaaatgcca

SEQ ID NO: 1850233 - DNA, 19 bp, Homo sapiens
gcaaataacaaatgccaaa

SEQ ID NO: 1850234 - DNA, 17 bp, Homo sapiens
gcaaatgcctgccaaat

SEQ ID NO: 1850235 - DNA, 13 bp, Homo sapiens
gcaacagacaagt

SEQ ID NO: 1850236 - DNA, 17 bp, Homo sapiens
gcaagaaatggcgtctg

SEQ ID NO: 1850237 - DNA, 19 bp, Homo sapiens
gcaagtgattgggacagag

SEQ ID NO: 1850238 - DNA, 17 bp, Homo sapiens
gcaatgtgtataaacaa

SEQ ID NO: 1850239 - DNA, 23 bp, Homo sapiens
gcacaagctccaagctcccaggc

SEQ ID NO: 1850240 - DNA, 11 bp, Homo sapiens
gcacacactgt

SEQ ID NO: 1850241 - DNA, 13 bp, Homo sapiens
gcacacaggacag

SEQ ID NO: 1850242 - DNA, 20 bp, Homo sapiens
gcacacttggcccaagtggc

SEQ ID NO: 1850243 - DNA, 19 bp, Homo sapiens
gcacagaccctgccctgtg

SEQ ID NO: 1850244 - DNA, 13 bp, Homo sapiens
gcacatccctgga

SEQ ID NO: 1850245 - DNA, 23 bp, Homo sapiens
gcaccacactgggtgcgtctcca

SEQ ID NO: 1850246 - DNA, 21 bp, Homo sapiens
gcaccactgcactccagcctg

SEQ ID NO: 1850247 - DNA, 16 bp, Homo sapiens
gcaccagcagcctgga

SEQ ID NO: 1850248 - DNA, 12 bp, Homo sapiens
gcaccataactt

SEQ ID NO: 1850249 - DNA, 13 bp, Homo sapiens
gcacccacctgtt

SEQ ID NO: 1850250 - DNA, 23 bp, Homo sapiens
gcacccacctgttttctgaaaca

SEQ ID NO: 1850251 - DNA, 15 bp, Homo sapiens
gcaccctcaggcagg

SEQ ID NO: 1850252 - DNA, 20 bp, Homo sapiens
gcaccctcatacacagaaac

SEQ ID NO: 1850253 - DNA, 16 bp, Homo sapiens
gcaccggctggcctgg

SEQ ID NO: 1850254 - DNA, 14 bp, Homo sapiens
gcaccttagacagt

SEQ ID NO: 1850255 - DNA, 12 bp, Homo sapiens
gcacgcagtggc

SEQ ID NO: 1850256 - DNA, 20 bp, Homo sapiens
gcacggctctgtccccagcc

SEQ ID NO: 1850257 - DNA, 13 bp, Homo sapiens
gcacggctgctga

SEQ ID NO: 1850258 - DNA, 14 bp, Homo sapiens
gcactcccctgctg

SEQ ID NO: 1850259 - DNA, 16 bp, Homo sapiens
gcactcccctgctggg

SEQ ID NO: 1850260 - DNA, 17 bp, Homo sapiens
gcactcccctgctgggt

SEQ ID NO: 1850261 - DNA, 14 bp, Homo sapiens
gcactgccatgcag

SEQ ID NO: 1850262 - DNA, 11 bp, Homo sapiens
gcactgcctga

SEQ ID NO: 1850263 - DNA, 19 bp, Homo sapiens
gcactgcctgctcccatcc

SEQ ID NO: 1850264 - DNA, 14 bp, Homo sapiens
gcactgcttccagt

SEQ ID NO: 1850265 - DNA, 16 bp, Homo sapiens
gcactgcttccagtga

SEQ ID NO: 1850266 - DNA, 20 bp, Homo sapiens
gcactgcttccagtgaggct

SEQ ID NO: 1850267 - DNA, 22 bp, Homo sapiens
gcacttcgggaggtcgaggcag

SEQ ID NO: 1850268 - DNA, 21 bp, Homo sapiens
gcactttgctttaatataaat

SEQ ID NO: 1850269 - DNA, 22 bp, Homo sapiens
gcactttgttctggctcttcca

SEQ ID NO: 1850270 - DNA, 14 bp, Homo sapiens
gcacttttctgtgt

SEQ ID NO: 1850271 - DNA, 23 bp, Homo sapiens
gcagaacaggtagtattacacca

SEQ ID NO: 1850272 - DNA, 14 bp, Homo sapiens
gcagacctcatgcc

SEQ ID NO: 1850273 - DNA, 19 bp, Homo sapiens
gcagagaccatccctgaag

SEQ ID NO: 1850274 - DNA, 20 bp, Homo sapiens
gcagagaccatccctgaagg

SEQ ID NO: 1850275 - DNA, 22 bp, Homo sapiens
gcagagaggtttgcagtcccaa

SEQ ID NO: 1850276 - DNA, 14 bp, Homo sapiens
gcagagcagagacc

SEQ ID NO: 1850277 - DNA, 15 bp, Homo sapiens
gcagagcagagacca

SEQ ID NO: 1850278 - DNA, 19 bp, Homo sapiens
gcagagcagagaccatccc

SEQ ID NO: 1850279 - DNA, 17 bp, Homo sapiens
gcagagcttggactgga

SEQ ID NO: 1850280 - DNA, 18 bp, Homo sapiens
gcagaggcagtacctggg

SEQ ID NO: 1850281 - DNA, 21 bp, Homo sapiens
gcagaggcagtacctgggcaa

SEQ ID NO: 1850282 - DNA, 23 bp, Homo sapiens
gcagagtcacacgggggcagctg

SEQ ID NO: 1850283 - DNA, 14 bp, Homo sapiens
gcagatgaggttgc

SEQ ID NO: 1850284 - DNA, 19 bp, Homo sapiens
gcagatgaggttgctagag

SEQ ID NO: 1850285 - DNA, 15 bp, Homo sapiens
gcagcaccacactgg

SEQ ID NO: 1850286 - DNA, 16 bp, Homo sapiens
gcagcaccacactggg

SEQ ID NO: 1850287 - DNA, 20 bp, Homo sapiens
gcagcagggagggcttctgc

SEQ ID NO: 1850288 - DNA, 17 bp, Homo sapiens
gcagcatattcaggaag

SEQ ID NO: 1850289 - DNA, 14 bp, Homo sapiens
gcagccaagcaaat

SEQ ID NO: 1850290 - DNA, 16 bp, Homo sapiens
gcagccacattcctga

SEQ ID NO: 1850291 - DNA, 14 bp, Homo sapiens
gcagccaggccaca

SEQ ID NO: 1850292 - DNA, 18 bp, Homo sapiens
gcagcccacccctcaaca

SEQ ID NO: 1850293 - DNA, 19 bp, Homo sapiens
gcagcctcacagtccttac

SEQ ID NO: 1850294 - DNA, 15 bp, Homo sapiens
gcagcgagcctgcta

SEQ ID NO: 1850295 - DNA, 20 bp, Homo sapiens
gcagctcacctctcccttgg

SEQ ID NO: 1850296 - DNA, 21 bp, Homo sapiens
gcagctcatctctgtcccact

SEQ ID NO: 1850297 - DNA, 14 bp, Homo sapiens
gcagctgctcccca

SEQ ID NO: 1850298 - DNA, 22 bp, Homo sapiens
gcagctgctccccaggccaccc

SEQ ID NO: 1850299 - DNA, 14 bp, Homo sapiens
gcaggaggtggaga

SEQ ID NO: 1850300 - DNA, 14 bp, Homo sapiens
gcaggcagccaggc

SEQ ID NO: 1850301 - DNA, 15 bp, Homo sapiens
gcaggcagccaggcc

SEQ ID NO: 1850302 - DNA, 16 bp, Homo sapiens
gcaggcagccaggcca

SEQ ID NO: 1850303 - DNA, 23 bp, Homo sapiens
gcaggccacacttcaaactactt

SEQ ID NO: 1850304 - DNA, 17 bp, Homo sapiens
gcaggcccctctcctcc

SEQ ID NO: 1850305 - DNA, 19 bp, Homo sapiens
gcaggcgttcagctcactg

SEQ ID NO: 1850306 - DNA, 22 bp, Homo sapiens
gcaggctaaggcgtggagctgc

SEQ ID NO: 1850307 - DNA, 16 bp, Homo sapiens
gcaggctacactgaca

SEQ ID NO: 1850308 - DNA, 19 bp, Homo sapiens
gcagtacctgggcaagctg

SEQ ID NO: 1850309 - DNA, 23 bp, Homo sapiens
gcagttgccagtcaccccggcca

SEQ ID NO: 1850310 - DNA, 20 bp, Homo sapiens
gcagtttctgtcctgctggt

SEQ ID NO: 1850311 - DNA, 16 bp, Homo sapiens
gcatagatgcaggtga

SEQ ID NO: 1850312 - DNA, 19 bp, Homo sapiens
gcatagatgcaggtgagcc

SEQ ID NO: 1850313 - DNA, 18 bp, Homo sapiens
gcatattcaggaagctca

SEQ ID NO: 1850314 - DNA, 17 bp, Homo sapiens
gcatatttaacaaaatt

SEQ ID NO: 1850315 - DNA, 15 bp, Homo sapiens
gcatcacctccacca

SEQ ID NO: 1850316 - DNA, 17 bp, Homo sapiens
gcatcagctggcgtcat

SEQ ID NO: 1850317 - DNA, 12 bp, Homo sapiens
gcatcaggccag

SEQ ID NO: 1850318 - DNA, 17 bp, Homo sapiens
gcatcaggccaggccct

SEQ ID NO: 1850319 - DNA, 17 bp, Homo sapiens
gcatcattatttatgta

SEQ ID NO: 1850320 - DNA, 23 bp, Homo sapiens
gcatgggtcgggagaggggacgc

SEQ ID NO: 1850321 - DNA, 18 bp, Homo sapiens
gcatgttttccagctcct

SEQ ID NO: 1850322 - DNA, 15 bp, Homo sapiens
gcattccccaggagg

SEQ ID NO: 1850323 - DNA, 17 bp, Homo sapiens
gcattccccaggaggcc

SEQ ID NO: 1850324 - DNA, 20 bp, Homo sapiens
gcattccccaggaggccagc

SEQ ID NO: 1850325 - DNA, 17 bp, Homo sapiens
gcattcttggttggctg

SEQ ID NO: 1850326 - DNA, 15 bp, Homo sapiens
gcattgtgggaaggg

SEQ ID NO: 1850327 - DNA, 14 bp, Homo sapiens
gcatttgctgaata

SEQ ID NO: 1850328 - DNA, 17 bp, Homo sapiens
gcatttgctgaatacag

SEQ ID NO: 1850329 - DNA, 13 bp, Homo sapiens
gcatttggcctct

SEQ ID NO: 1850330 - DNA, 13 bp, Homo sapiens
gccaaataaagtc

SEQ ID NO: 1850331 - DNA, 14 bp, Homo sapiens
gccaaataaagtct

SEQ ID NO: 1850332 - DNA, 14 bp, Homo sapiens
gccaaattaaaaaa

SEQ ID NO: 1850333 - DNA, 16 bp, Homo sapiens
gccaaattaaaaaaga

SEQ ID NO: 1850334 - DNA, 18 bp, Homo sapiens
gccaaattaaaaaagata

SEQ ID NO: 1850335 - DNA, 21 bp, Homo sapiens
gccaaattaaaaaagataaac

SEQ ID NO: 1850336 - DNA, 23 bp, Homo sapiens
gccaaattaaaaaagataaacac

SEQ ID NO: 1850337 - DNA, 19 bp, Homo sapiens
gccaacttcttcagagctg

SEQ ID NO: 1850338 - DNA, 20 bp, Homo sapiens
gccaacttcttcagagctga

SEQ ID NO: 1850339 - DNA, 15 bp, Homo sapiens
gccaagatcacagtg

SEQ ID NO: 1850340 - DNA, 15 bp, Homo sapiens
gccaagcactgtgct

SEQ ID NO: 1850341 - DNA, 21 bp, Homo sapiens
ggattcttcctccctccctct

SEQ ID NO: 1850342 - DNA, 13 bp, Homo sapiens
ggattgtccccga

SEQ ID NO: 1850343 - DNA, 13 bp, Homo sapiens
ggattgtggaaaa

SEQ ID NO: 1850344 - DNA, 19 bp, Homo sapiens
ggatttccagccagggctg

SEQ ID NO: 1850345 - DNA, 23 bp, Homo sapiens
ggcaaacaggcagttggccagag

SEQ ID NO: 1850346 - DNA, 13 bp, Homo sapiens
ggcaaatgcccaa

SEQ ID NO: 1850347 - DNA, 16 bp, Homo sapiens
ggcaaatgcccaaggg

SEQ ID NO: 1850348 - DNA, 14 bp, Homo sapiens
ggcaaggacacaga

SEQ ID NO: 1850349 - DNA, 17 bp, Homo sapiens
ggcacagtatgtcccat

SEQ ID NO: 1850350 - DNA, 18 bp, Homo sapiens
ggcacatttaagagacag

SEQ ID NO: 1850351 - DNA, 16 bp, Homo sapiens
ggcaccagcagcctgg

SEQ ID NO: 1850352 - DNA, 12 bp, Homo sapiens
ggcagagcagag

SEQ ID NO: 1850353 - DNA, 22 bp, Homo sapiens
ggcagagcagagaccatccctg

SEQ ID NO: 1850354 - DNA, 17 bp, Homo sapiens
ggcagagcttggactgg

SEQ ID NO: 1850355 - DNA, 13 bp, Homo sapiens
ggcagccaggcca

SEQ ID NO: 1850356 - DNA, 16 bp, Homo sapiens
ggcagcctcttcaaaa

SEQ ID NO: 1850357 - DNA, 18 bp, Homo sapiens
ggcagctcacctctccct

SEQ ID NO: 1850358 - DNA, 22 bp, Homo sapiens
ggcagctcacctctcccttgga

SEQ ID NO: 1850359 - DNA, 21 bp, Homo sapiens
ggcagctcagagagggtggga

SEQ ID NO: 1850360 - DNA, 23 bp, Homo sapiens
ggcaggactcagctccccagagt

SEQ ID NO: 1850361 - DNA, 22 bp, Homo sapiens
ggcaggctaaggcgtggagctg

SEQ ID NO: 1850362 - DNA, 16 bp, Homo sapiens
ggcaggcttggggaaa

SEQ ID NO: 1850363 - DNA, 23 bp, Homo sapiens
ggcaggtatgatcggcaggacac

SEQ ID NO: 1850364 - DNA, 14 bp, Homo sapiens
ggcagttggccaga

SEQ ID NO: 1850365 - DNA, 19 bp, Homo sapiens
ggcatagatgcaggtgagc

SEQ ID NO: 1850366 - DNA, 14 bp, Homo sapiens
ggcatgaagctgca

SEQ ID NO: 1850367 - DNA, 21 bp, Homo sapiens
ggcatgggtcgggagagggga

SEQ ID NO: 1850368 - DNA, 19 bp, Homo sapiens
ggcattccccaggaggcca

SEQ ID NO: 1850369 - DNA, 20 bp, Homo sapiens
ggcatttggtctcaggcagc

SEQ ID NO: 1850370 - DNA, 20 bp, Homo sapiens
ggccacacttcaaactactt

SEQ ID NO: 1850371 - DNA, 21 bp, Homo sapiens
ggccagagagcctggtgctgc

SEQ ID NO: 1850372 - DNA, 22 bp, Homo sapiens
ggccagagagcctggtgctgct

SEQ ID NO: 1850373 - DNA, 19 bp, Homo sapiens
ggccagagtattggtctcc

SEQ ID NO: 1850374 - DNA, 22 bp, Homo sapiens
ggccagccttgaccattctcca

SEQ ID NO: 1850375 - DNA, 12 bp, Homo sapiens
ggccagggcctg

SEQ ID NO: 1850376 - DNA, 23 bp, Homo sapiens
ggccagggcctggaagacagaga

SEQ ID NO: 1850377 - DNA, 14 bp, Homo sapiens
ggccagttggtccc

SEQ ID NO: 1850378 - DNA, 17 bp, Homo sapiens
ggccagttggtccccct

SEQ ID NO: 1850379 - DNA, 12 bp, Homo sapiens
ggccatgcagac

SEQ ID NO: 1850380 - DNA, 23 bp, Homo sapiens
ggccatgcaggaggtggagaaaa

SEQ ID NO: 1850381 - DNA, 14 bp, Homo sapiens
ggccatggagagct

SEQ ID NO: 1850382 - DNA, 17 bp, Homo sapiens
ggccccactttgaaggg

SEQ ID NO: 1850383 - DNA, 15 bp, Homo sapiens
ggccctctgcccact

SEQ ID NO: 1850384 - DNA, 19 bp, Homo sapiens
ggccctctgcccactccct

SEQ ID NO: 1850385 - DNA, 20 bp, Homo sapiens
ggccctctgcccactccctg

SEQ ID NO: 1850386 - DNA, 13 bp, Homo sapiens
ggccctgcctcct

SEQ ID NO: 1850387 - DNA, 15 bp, Homo sapiens
ggccctgcctccttt

SEQ ID NO: 1850388 - DNA, 14 bp, Homo sapiens
ggcccttccttttc

SEQ ID NO: 1850389 - DNA, 20 bp, Homo sapiens
ggcccttctctccagcccct

SEQ ID NO: 1850390 - DNA, 21 bp, Homo sapiens
ggcccttctctccagcccctg

SEQ ID NO: 1850391 - DNA, 22 bp, Homo sapiens
ggcccttctctccagcccctgg

SEQ ID NO: 1850392 - DNA, 21 bp, Homo sapiens
ggccgttgatgttggctggga

SEQ ID NO: 1850393 - DNA, 13 bp, Homo sapiens
ggcctcccaactc

SEQ ID NO: 1850394 - DNA, 17 bp, Homo sapiens
ggcctcccaactcaccc

SEQ ID NO: 1850395 - DNA, 19 bp, Homo sapiens
ggcctctccttgtggcctg

SEQ ID NO: 1850396 - DNA, 18 bp, Homo sapiens
ggcctcttatgggctggg

SEQ ID NO: 1850397 - DNA, 22 bp, Homo sapiens
ggcctgaatgcttataggtggc

SEQ ID NO: 1850398 - DNA, 15 bp, Homo sapiens
ggcctgagctgggat

SEQ ID NO: 1850399 - DNA, 13 bp, Homo sapiens
ggcctggcccctc

SEQ ID NO: 1850400 - DNA, 18 bp, Homo sapiens
ggcctggcccctcagggt

SEQ ID NO: 1850401 - DNA, 10 bp, Homo sapiens
ggcctggcct

SEQ ID NO: 1850402 - DNA, 13 bp, Homo sapiens
ggcctggcctgag

SEQ ID NO: 1850403 - DNA, 14 bp, Homo sapiens
ggcctggcctgagc

SEQ ID NO: 1850404 - DNA, 22 bp, Homo sapiens
ggcctgtccacaggcttctgag

SEQ ID NO: 1850405 - DNA, 14 bp, Homo sapiens
ggcctttggcttca

SEQ ID NO: 1850406 - DNA, 15 bp, Homo sapiens
ggcgcaaagggcatg

SEQ ID NO: 1850407 - DNA, 15 bp, Homo sapiens
ggcgcggtggctcac

SEQ ID NO: 1850408 - DNA, 19 bp, Homo sapiens
ggcggctggggtcccagca

SEQ ID NO: 1850409 - DNA, 19 bp, Homo sapiens
ggctaaggcgtggagctgc

SEQ ID NO: 1850410 - DNA, 22 bp, Homo sapiens
ggctacaccttagcctgccctc

SEQ ID NO: 1850411 - DNA, 16 bp, Homo sapiens
ggctccaggagcagcc

SEQ ID NO: 1850412 - DNA, 18 bp, Homo sapiens
ggctcgagcatgcctgga

SEQ ID NO: 1850413 - DNA, 13 bp, Homo sapiens
ggctctgaccagt

SEQ ID NO: 1850414 - DNA, 14 bp, Homo sapiens
ggctctgcccttgg

SEQ ID NO: 1850415 - DNA, 13 bp, Homo sapiens
ggctctgcctccc

SEQ ID NO: 1850416 - DNA, 16 bp, Homo sapiens
ggctctgtccccagcc

SEQ ID NO: 1850417 - DNA, 14 bp, Homo sapiens
ggctcttccaggct

SEQ ID NO: 1850418 - DNA, 15 bp, Homo sapiens
ggctcttccaggctg

SEQ ID NO: 1850419 - DNA, 17 bp, Homo sapiens
ggctcttccaggctggg

SEQ ID NO: 1850420 - DNA, 14 bp, Homo sapiens
ggctgagaacactg

SEQ ID NO: 1850421 - DNA, 21 bp, Homo sapiens
ggctgatgccaagttgtttga

SEQ ID NO: 1850422 - DNA, 19 bp, Homo sapiens
ggctgcaccggctggcctg

SEQ ID NO: 1850423 - DNA, 14 bp, Homo sapiens
ggctgctgaaggct

SEQ ID NO: 1850424 - DNA, 14 bp, Homo sapiens
ggctggcctggccc

SEQ ID NO: 1850425 - DNA, 22 bp, Homo sapiens
ggctggcctggcccctcagggt

SEQ ID NO: 1850426 - DNA, 19 bp, Homo sapiens
ggctgggaactcacctggg

SEQ ID NO: 1850427 - DNA, 16 bp, Homo sapiens
ggctgggagagccttc

SEQ ID NO: 1850428 - DNA, 20 bp, Homo sapiens
ggctgggagagccttccagg

SEQ ID NO: 1850429 - DNA, 17 bp, Homo sapiens
ggctgggcaaggaggcc

SEQ ID NO: 1850430 - DNA, 17 bp, Homo sapiens
ggctgggctcccttccc

SEQ ID NO: 1850431 - DNA, 18 bp, Homo sapiens
ggctgggctcccttccca

SEQ ID NO: 1850432 - DNA, 17 bp, Homo sapiens
ggctggggaagtcctct

SEQ ID NO: 1850433 - DNA, 21 bp, Homo sapiens
ggctggggaagtcctctgggt

SEQ ID NO: 1850434 - DNA, 21 bp, Homo sapiens
ggcttagtcactgagacagcc

SEQ ID NO: 1850435 - DNA, 20 bp, Homo sapiens
ggcttcacggaagagccttg

SEQ ID NO: 1850436 - DNA, 22 bp, Homo sapiens
gggaaaatggccatgcaggagg

SEQ ID NO: 1850437 - DNA, 23 bp, Homo sapiens
gggaactcacctggggctgctgg

SEQ ID NO: 1850438 - DNA, 14 bp, Homo sapiens
gggaagggggctgg

SEQ ID NO: 1850439 - DNA, 16 bp, Homo sapiens
gggaagggggctggga

SEQ ID NO: 1850440 - DNA, 17 bp, Homo sapiens
gggaagggggctgggac

SEQ ID NO: 1850441 - DNA, 19 bp, Homo sapiens
gggacatgcttagcagtcc

SEQ ID NO: 1850442 - DNA, 16 bp, Homo sapiens
gggaccccgagcctgg

SEQ ID NO: 1850443 - DNA, 20 bp, Homo sapiens
gggaccccgagcctggctcc

SEQ ID NO: 1850444 - DNA, 21 bp, Homo sapiens
gggacgcaggcccctctcctc

SEQ ID NO: 1850445 - DNA, 23 bp, Homo sapiens
gggaggatctcttgagcctggga

SEQ ID NO: 1850446 - DNA, 23 bp, Homo sapiens
gggaggattgcttgagctcagga

SEQ ID NO: 1850447 - DNA, 16 bp, Homo sapiens
gggagggagggctcca

SEQ ID NO: 1850448 - DNA, 13 bp, Homo sapiens
gggagggctccag

SEQ ID NO: 1850449 - DNA, 17 bp, Homo sapiens
gggagggctccagacac

SEQ ID NO: 1850450 - DNA, 15 bp, Homo sapiens
gggaggtcgaggcag

SEQ ID NO: 1850451 - DNA, 17 bp, Homo sapiens
gggaggtcgaggcagga

SEQ ID NO: 1850452 - DNA, 11 bp, Homo sapiens
gggatgaaaga

SEQ ID NO: 1850453 - DNA, 15 bp, Homo sapiens
gggatgaaagagaag

SEQ ID NO: 1850454 - DNA, 12 bp, Homo sapiens
gggatggggagg

SEQ ID NO: 1850455 - DNA, 16 bp, Homo sapiens
gggcacagggtctcta

SEQ ID NO: 1850456 - DNA, 11 bp, Homo sapiens
gggcagagcag

SEQ ID NO: 1850457 - DNA, 12 bp, Homo sapiens
gggcagagcaga

SEQ ID NO: 1850458 - DNA, 17 bp, Homo sapiens
gggcagagcagagacca

SEQ ID NO: 1850459 - DNA, 21 bp, Homo sapiens
gggcagaggcagtacctgggc

SEQ ID NO: 1850460 - DNA, 14 bp, Homo sapiens
gggcaggcttgggg

SEQ ID NO: 1850461 - DNA, 22 bp, Homo sapiens
gggcatagatgcaggtgagccc

SEQ ID NO: 1850462 - DNA, 17 bp, Homo sapiens
gggcatgggtcgggaga

SEQ ID NO: 1850463 - DNA, 12 bp, Homo sapiens
gtggcactgcca

SEQ ID NO: 1850464 - DNA, 15 bp, Homo sapiens
gtggcagagcttgga

SEQ ID NO: 1850465 - DNA, 16 bp, Homo sapiens
gtggcagctcacctct

SEQ ID NO: 1850466 - DNA, 14 bp, Homo sapiens
gtggccacggccac

SEQ ID NO: 1850467 - DNA, 20 bp, Homo sapiens
gtggccccatattaacaaat

SEQ ID NO: 1850468 - DNA, 22 bp, Homo sapiens
gtggcctctccttgtggcctgg

SEQ ID NO: 1850469 - DNA, 23 bp, Homo sapiens
gtggcctctccttgtggcctggg

SEQ ID NO: 1850470 - DNA, 15 bp, Homo sapiens
gtggcctgggcctcc

SEQ ID NO: 1850471 - DNA, 22 bp, Homo sapiens
gtggcgcagcatattcaggaag

SEQ ID NO: 1850472 - DNA, 16 bp, Homo sapiens
gtggctgctgcccagg

SEQ ID NO: 1850473 - DNA, 22 bp, Homo sapiens
gtggcttaagtgagcagaacag

SEQ ID NO: 1850474 - DNA, 19 bp, Homo sapiens
gtggcttcattagagcagg

SEQ ID NO: 1850475 - DNA, 20 bp, Homo sapiens
gtggcttcattagagcaggc

SEQ ID NO: 1850476 - DNA, 15 bp, Homo sapiens
gtgggacaccctgtg

SEQ ID NO: 1850477 - DNA, 12 bp, Homo sapiens
gtgggagctgag

SEQ ID NO: 1850478 - DNA, 13 bp, Homo sapiens
gtgggagtgggcc

SEQ ID NO: 1850479 - DNA, 16 bp, Homo sapiens
gtgggcttcccagtgg

SEQ ID NO: 1850480 - DNA, 18 bp, Homo sapiens
gtggggctaggggctggg

SEQ ID NO: 1850481 - DNA, 21 bp, Homo sapiens
gtggggctaggggctggggcc

SEQ ID NO: 1850482 - DNA, 17 bp, Homo sapiens
gtggggtcactctggca

SEQ ID NO: 1850483 - DNA, 15 bp, Homo sapiens
gtggtcccaccccac

SEQ ID NO: 1850484 - DNA, 19 bp, Homo sapiens
gtggtgtttcctggcactg

SEQ ID NO: 1850485 - DNA, 18 bp, Homo sapiens
gtggttatggagagggtg

SEQ ID NO: 1850486 - DNA, 17 bp, Homo sapiens
gtgtataaacaagaaaa

SEQ ID NO: 1850487 - DNA, 16 bp, Homo sapiens
gtgtcagcatagaagt

SEQ ID NO: 1850488 - DNA, 21 bp, Homo sapiens
gtgtcatgattcacccccaaa

SEQ ID NO: 1850489 - DNA, 14 bp, Homo sapiens
gtgtccggtccctg

SEQ ID NO: 1850490 - DNA, 14 bp, Homo sapiens
gtgtctcttggtcc

SEQ ID NO: 1850491 - DNA, 19 bp, Homo sapiens
gtgtctcttggtcctgctg

SEQ ID NO: 1850492 - DNA, 21 bp, Homo sapiens
gtgtctcttggtcctgctgca

SEQ ID NO: 1850493 - DNA, 17 bp, Homo sapiens
gtgtctggattcccagg

SEQ ID NO: 1850494 - DNA, 21 bp, Homo sapiens
gtgtctggattcccaggatga

SEQ ID NO: 1850495 - DNA, 15 bp, Homo sapiens
gtgtgcaacagacaa

SEQ ID NO: 1850496 - DNA, 21 bp, Homo sapiens
gtgtggagaagcggctggcag

SEQ ID NO: 1850497 - DNA, 16 bp, Homo sapiens
gtgtgttaagctctgc

SEQ ID NO: 1850498 - DNA, 19 bp, Homo sapiens
gtgttcacactgtaaacat

SEQ ID NO: 1850499 - DNA, 20 bp, Homo sapiens
gtgttctcatgaagcaggag

SEQ ID NO: 1850500 - DNA, 21 bp, Homo sapiens
gtgttctcatgaagcaggagg

SEQ ID NO: 1850501 - DNA, 23 bp, Homo sapiens
gtgtttcctggcactgcttccag

SEQ ID NO: 1850502 - DNA, 18 bp, Homo sapiens
gttaaactggcttaactt

SEQ ID NO: 1850503 - DNA, 15 bp, Homo sapiens
gttaagctctgctat

SEQ ID NO: 1850504 - DNA, 13 bp, Homo sapiens
gttatatataaat

SEQ ID NO: 1850505 - DNA, 14 bp, Homo sapiens
gttatatataaata

SEQ ID NO: 1850506 - DNA, 16 bp, Homo sapiens
gttatatataaatata

SEQ ID NO: 1850507 - DNA, 15 bp, Homo sapiens
gttatgaacagctgt

SEQ ID NO: 1850508 - DNA, 17 bp, Homo sapiens
gttatgaacagctgtgt

SEQ ID NO: 1850509 - DNA, 18 bp, Homo sapiens
gttatgaacagctgtgtc

SEQ ID NO: 1850510 - DNA, 21 bp, Homo sapiens
gttatgaacagctgtgtctgc

SEQ ID NO: 1850511 - DNA, 14 bp, Homo sapiens
gttatttataatca

SEQ ID NO: 1850512 - DNA, 23 bp, Homo sapiens
gttcaatctggattcatatttaa

SEQ ID NO: 1850513 - DNA, 14 bp, Homo sapiens
gttcaccttggaag

SEQ ID NO: 1850514 - DNA, 22 bp, Homo sapiens
gttcagcagaacctgcacacag

SEQ ID NO: 1850515 - DNA, 20 bp, Homo sapiens
gttcattaaacgtcattcag

SEQ ID NO: 1850516 - DNA, 14 bp, Homo sapiens
gttccccatgcaga

SEQ ID NO: 1850517 - DNA, 16 bp, Homo sapiens
gttctacccaggtgct

SEQ ID NO: 1850518 - DNA, 12 bp, Homo sapiens
gttctcatgaag

SEQ ID NO: 1850519 - DNA, 19 bp, Homo sapiens
gttctcatgaagcaggagg

SEQ ID NO: 1850520 - DNA, 18 bp, Homo sapiens
gttctccagtcattatgt

SEQ ID NO: 1850521 - DNA, 20 bp, Homo sapiens
gttctccagtcattatgtta

SEQ ID NO: 1850522 - DNA, 15 bp, Homo sapiens
gttctctcttctcca

SEQ ID NO: 1850523 - DNA, 11 bp, Homo sapiens
gttctctgccc

SEQ ID NO: 1850524 - DNA, 19 bp, Homo sapiens
gttctgatcctagttccac

SEQ ID NO: 1850525 - DNA, 12 bp, Homo sapiens
gttctgttttgt

SEQ ID NO: 1850526 - DNA, 17 bp, Homo sapiens
gttcttagctcaatgag

SEQ ID NO: 1850527 - DNA, 21 bp, Homo sapiens
gttcttgtattaagaatgaaa

SEQ ID NO: 1850528 - DNA, 17 bp, Homo sapiens
gttgaaaaacagctgag

SEQ ID NO: 1850529 - DNA, 13 bp, Homo sapiens
gttgaagcctttg

SEQ ID NO: 1850530 - DNA, 22 bp, Homo sapiens
gttgatagcacagaccctgccc

SEQ ID NO: 1850531 - DNA, 16 bp, Homo sapiens
gttgatgttggctggg

SEQ ID NO: 1850532 - DNA, 17 bp, Homo sapiens
gttgatgttggctggga

SEQ ID NO: 1850533 - DNA, 22 bp, Homo sapiens
gttgcaatagaacagagaaaga

SEQ ID NO: 1850534 - DNA, 15 bp, Homo sapiens
gttgcaggacctcag

SEQ ID NO: 1850535 - DNA, 13 bp, Homo sapiens
gttgccagtcacc

SEQ ID NO: 1850536 - DNA, 14 bp, Homo sapiens
gttgccagtcaccc

SEQ ID NO: 1850537 - DNA, 17 bp, Homo sapiens
gttgccagtcaccccgg

SEQ ID NO: 1850538 - DNA, 23 bp, Homo sapiens
gttgccagtcaccccggccacct

SEQ ID NO: 1850539 - DNA, 13 bp, Homo sapiens
gttggctggcctt

SEQ ID NO: 1850540 - DNA, 17 bp, Homo sapiens
gttggctgggaactcac

SEQ ID NO: 1850541 - DNA, 14 bp, Homo sapiens
gttggttggttttc

SEQ ID NO: 1850542 - DNA, 13 bp, Homo sapiens
gttgtgagctgga

SEQ ID NO: 1850543 - DNA, 23 bp, Homo sapiens
gttgtttgattcagacagctgcc

SEQ ID NO: 1850544 - DNA, 11 bp, Homo sapiens
gtttaaatgaa

SEQ ID NO: 1850545 - DNA, 14 bp, Homo sapiens
gtttaaatgaacaa

SEQ ID NO: 1850546 - DNA, 17 bp, Homo sapiens
gtttaatggtagtttta

SEQ ID NO: 1850547 - DNA, 18 bp, Homo sapiens
gtttagatgaatgtcagt

SEQ ID NO: 1850548 - DNA, 15 bp, Homo sapiens
gtttatacctttgcc

SEQ ID NO: 1850549 - DNA, 20 bp, Homo sapiens
gtttcctggcactgcttcca

SEQ ID NO: 1850550 - DNA, 22 bp, Homo sapiens
gtttcctggcactgcttccagt

SEQ ID NO: 1850551 - DNA, 16 bp, Homo sapiens
gtttctgtcctgctgg

SEQ ID NO: 1850552 - DNA, 17 bp, Homo sapiens
gtttgagatcagcctgg

SEQ ID NO: 1850553 - DNA, 22 bp, Homo sapiens
gtttgattcagacagctgcctg

SEQ ID NO: 1850554 - DNA, 15 bp, Homo sapiens
gtttggccatctctg

SEQ ID NO: 1850555 - DNA, 18 bp, Homo sapiens
gtttgttccccaagacat

SEQ ID NO: 1850556 - DNA, 14 bp, Homo sapiens
gttttacagtgttt

SEQ ID NO: 1850557 - DNA, 22 bp, Homo sapiens
gttttataagcatcattattta

SEQ ID NO: 1850558 - DNA, 14 bp, Homo sapiens
gttttcatcaagac

SEQ ID NO: 1850559 - DNA, 12 bp, Homo sapiens
gttttctcttga

SEQ ID NO: 1850560 - DNA, 13 bp, Homo sapiens
gttttctgaaaca

SEQ ID NO: 1850561 - DNA, 17 bp, Homo sapiens
gttttgaagattctatg

SEQ ID NO: 1850562 - DNA, 17 bp, Homo sapiens
gttttgtctgtctccct

SEQ ID NO: 1850563 - DNA, 20 bp, Homo sapiens
gttttgtttcgctctttgag

SEQ ID NO: 1850564 - DNA, 13 bp, Homo sapiens
gtttttctaaagg

SEQ ID NO: 1850565 - DNA, 20 bp, Homo sapiens
gtttttctaaaggagtttat

SEQ ID NO: 1850566 - DNA, 21 bp, Homo sapiens
gtttttcttaaataataaaga

SEQ ID NO: 1850567 - DNA, 15 bp, Homo sapiens
gtttttcttctccct

SEQ ID NO: 1850568 - DNA, 12 bp, Homo sapiens
gtttttttctat

SEQ ID NO: 1850569 - DNA, 12 bp, Homo sapiens
taaaaaagataa

SEQ ID NO: 1850570 - DNA, 16 bp, Homo sapiens
taaaacaaaagctcat

SEQ ID NO: 1850571 - DNA, 11 bp, Homo sapiens
taaaagacaaa

SEQ ID NO: 1850572 - DNA, 20 bp, Homo sapiens
taaaagacaaatcaaagcag

SEQ ID NO: 1850573 - DNA, 18 bp, Homo sapiens
taaaagaggtttttctta

SEQ ID NO: 1850574 - DNA, 14 bp, Homo sapiens
taaaatgaaatgca

SEQ ID NO: 1850575 - DNA, 18 bp, Homo sapiens
taaaatgaaatgcatttt

SEQ ID NO: 1850576 - DNA, 14 bp, Homo sapiens
taaaattattcctt

SEQ ID NO: 1850577 - DNA, 19 bp, Homo sapiens
taaacaagaaaaataaaga

SEQ ID NO: 1850578 - DNA, 20 bp, Homo sapiens
taaacacaagattggtgttt

SEQ ID NO: 1850579 - DNA, 19 bp, Homo sapiens
taaacattggttcttgtat

SEQ ID NO: 1850580 - DNA, 19 bp, Homo sapiens
taaacgatttttaaaatgt

SEQ ID NO: 1850581 - DNA, 20 bp, Homo sapiens
taaacgatttttaaaatgta

SEQ ID NO: 1850582 - DNA, 23 bp, Homo sapiens
taaacgtgatttttaaattaaat

SEQ ID NO: 1850583 - DNA, 22 bp, Homo sapiens
taaacttggtttttaaaaaact

SEQ ID NO: 1850584 - DNA, 12 bp, Homo sapiens
taaagaaaaaaa

SEQ ID NO: 1850585 - DNA, 24 bp, Homo sapiens
tccagcctgggtgacagagcaagt

SEQ ID NO: 1850586 - DNA, 18 bp, Homo sapiens
tccagctcctcatccagg

SEQ ID NO: 1850587 - DNA, 15 bp, Homo sapiens
tccaggagcagccac

SEQ ID NO: 1850588 - DNA, 14 bp, Homo sapiens
tccaggcaggctaa

SEQ ID NO: 1850589 - DNA, 17 bp, Homo sapiens
tccaggctgggagagcc

SEQ ID NO: 1850590 - DNA, 18 bp, Homo sapiens
tccaggctgggagagcct

SEQ ID NO: 1850591 - DNA, 19 bp, Homo sapiens
tccaggggtgggacaccct

SEQ ID NO: 1850592 - DNA, 20 bp, Homo sapiens
tccaggggtgggacaccctg

SEQ ID NO: 1850593 - DNA, 22 bp, Homo sapiens
tccaggggtgggacaccctgtg

SEQ ID NO: 1850594 - DNA, 23 bp, Homo sapiens
tccaggggtgggacaccctgtga

SEQ ID NO: 1850595 - DNA, 21 bp, Homo sapiens
tccaggtgcacaagctccaag

SEQ ID NO: 1850596 - DNA, 15 bp, Homo sapiens
tccagtcattatgtt

SEQ ID NO: 1850597 - DNA, 18 bp, Homo sapiens
tccagtgaacattcccag

SEQ ID NO: 1850598 - DNA, 23 bp, Homo sapiens
tccagtgaacattcccagcccag

SEQ ID NO: 1850599 - DNA, 18 bp, Homo sapiens
tccagtgaggctctgccc

SEQ ID NO: 1850600 - DNA, 14 bp, Homo sapiens
tccatagagagcaa

SEQ ID NO: 1850601 - DNA, 17 bp, Homo sapiens
tccatagagagcaagac

SEQ ID NO: 1850602 - DNA, 18 bp, Homo sapiens
tccatcagttagagctga

SEQ ID NO: 1850603 - DNA, 18 bp, Homo sapiens
tccatctttcctgatggc

SEQ ID NO: 1850604 - DNA, 15 bp, Homo sapiens
tccatgatgctggga

SEQ ID NO: 1850605 - DNA, 21 bp, Homo sapiens
tccatgcaccctcatacacag

SEQ ID NO: 1850606 - DNA, 13 bp, Homo sapiens
tccatggactttg

SEQ ID NO: 1850607 - DNA, 12 bp, Homo sapiens
tccattctggaa

SEQ ID NO: 1850608 - DNA, 20 bp, Homo sapiens
tcccaaaagcccattcattc

SEQ ID NO: 1850609 - DNA, 21 bp, Homo sapiens
tcccaaagtgctgggaattac

SEQ ID NO: 1850610 - DNA, 16 bp, Homo sapiens
tcccaactcaccccag

SEQ ID NO: 1850611 - DNA, 18 bp, Homo sapiens
tcccaagggatggtgccc

SEQ ID NO: 1850612 - DNA, 16 bp, Homo sapiens
tcccacaaaggagagc

SEQ ID NO: 1850613 - DNA, 13 bp, Homo sapiens
tcccacagcgctg

SEQ ID NO: 1850614 - DNA, 11 bp, Homo sapiens
tcccaccccac

SEQ ID NO: 1850615 - DNA, 15 bp, Homo sapiens
tcccaccccacacac

SEQ ID NO: 1850616 - DNA, 14 bp, Homo sapiens
tcccacctctctca

SEQ ID NO: 1850617 - DNA, 18 bp, Homo sapiens
tcccacctctctcactcc

SEQ ID NO: 1850618 - DNA, 12 bp, Homo sapiens
tcccagccccaa

SEQ ID NO: 1850619 - DNA, 22 bp, Homo sapiens
tcccaggactagagcacaacat

SEQ ID NO: 1850620 - DNA, 24 bp, Homo sapiens
tcccaggatgagcatcccaggatc

SEQ ID NO: 1850621 - DNA, 16 bp, Homo sapiens
tcccaggatgtacaag

SEQ ID NO: 1850622 - DNA, 20 bp, Homo sapiens
tcccaggcattccccaggag

SEQ ID NO: 1850623 - DNA, 22 bp, Homo sapiens
tcccaggcattccccaggaggc

SEQ ID NO: 1850624 - DNA, 17 bp, Homo sapiens
tcccagtacctcctgtc

SEQ ID NO: 1850625 - DNA, 23 bp, Homo sapiens
tcccagtacctcctgtctctggc

SEQ ID NO: 1850626 - DNA, 19 bp, Homo sapiens
tcccagtgccgagaaggaa

SEQ ID NO: 1850627 - DNA, 15 bp, Homo sapiens
tcccagtggctgctg

SEQ ID NO: 1850628 - DNA, 22 bp, Homo sapiens
tcccagtggctgctgcccaggc

SEQ ID NO: 1850629 - DNA, 18 bp, Homo sapiens
tcccataaccgctgattc

SEQ ID NO: 1850630 - DNA, 15 bp, Homo sapiens
tcccataggcccagt

SEQ ID NO: 1850631 - DNA, 14 bp, Homo sapiens
tcccatcctgtgtg

SEQ ID NO: 1850632 - DNA, 13 bp, Homo sapiens
tcccatctcacac

SEQ ID NO: 1850633 - DNA, 15 bp, Homo sapiens
tcccatgacccaggc

SEQ ID NO: 1850634 - DNA, 16 bp, Homo sapiens
tcccatgacccaggct

SEQ ID NO: 1850635 - DNA, 16 bp, Homo sapiens
tcccattagcaaaaat

SEQ ID NO: 1850636 - DNA, 16 bp, Homo sapiens
tccccaccgcagacag

SEQ ID NO: 1850637 - DNA, 21 bp, Homo sapiens
tccccaccgcagacaggacca

SEQ ID NO: 1850638 - DNA, 22 bp, Homo sapiens
tccccaccgcagacaggaccag

SEQ ID NO: 1850639 - DNA, 22 bp, Homo sapiens
tccccacttgagaattaccctt

SEQ ID NO: 1850640 - DNA, 17 bp, Homo sapiens
tccccagagttccccat

SEQ ID NO: 1850641 - DNA, 20 bp, Homo sapiens
tccccagagttccccatgca

SEQ ID NO: 1850642 - DNA, 13 bp, Homo sapiens
tccccaggaggcc

SEQ ID NO: 1850643 - DNA, 21 bp, Homo sapiens
tccccaggaggccagccttga

SEQ ID NO: 1850644 - DNA, 14 bp, Homo sapiens
tccccaggccaccc

SEQ ID NO: 1850645 - DNA, 11 bp, Homo sapiens
tcccccagccc

SEQ ID NO: 1850646 - DNA, 16 bp, Homo sapiens
tcccccagccccatcc

SEQ ID NO: 1850647 - DNA, 18 bp, Homo sapiens
tccccgcttctgcctgca

SEQ ID NO: 1850648 - DNA, 23 bp, Homo sapiens
tcccctctcagaacatactgatt

SEQ ID NO: 1850649 - DNA, 18 bp, Homo sapiens
tcccctgcctgccctggt

SEQ ID NO: 1850650 - DNA, 19 bp, Homo sapiens
tcccctgtagagtgggagc

SEQ ID NO: 1850651 - DNA, 22 bp, Homo sapiens
tcccctgtagagtgggagctga

SEQ ID NO: 1850652 - DNA, 16 bp, Homo sapiens
tccctattagagaaga

SEQ ID NO: 1850653 - DNA, 18 bp, Homo sapiens
tccctattagagaagaga

SEQ ID NO: 1850654 - DNA, 22 bp, Homo sapiens
tccctattttttttctgttata

SEQ ID NO: 1850655 - DNA, 18 bp, Homo sapiens
tccctcagtctggccctt

SEQ ID NO: 1850656 - DNA, 21 bp, Homo sapiens
tccctcagtctggcccttcct

SEQ ID NO: 1850657 - DNA, 22 bp, Homo sapiens
tccctcatcctcatacccaccc

SEQ ID NO: 1850658 - DNA, 15 bp, Homo sapiens
tccctcatttcagga

SEQ ID NO: 1850659 - DNA, 15 bp, Homo sapiens
tccctccctctttcc

SEQ ID NO: 1850660 - DNA, 14 bp, Homo sapiens
tccctctttccctc

SEQ ID NO: 1850661 - DNA, 15 bp, Homo sapiens
tccctgaaggccccg

SEQ ID NO: 1850662 - DNA, 18 bp, Homo sapiens
tccctggaaggacatcca

SEQ ID NO: 1850663 - DNA, 15 bp, Homo sapiens
tccctggcctttcat

SEQ ID NO: 1850664 - DNA, 24 bp, Homo sapiens
tccctggcctttcatattttagct

SEQ ID NO: 1850665 - DNA, 23 bp, Homo sapiens
tccctgggagggacatgcttagc

SEQ ID NO: 1850666 - DNA, 15 bp, Homo sapiens
tccctggtggcagct

SEQ ID NO: 1850667 - DNA, 17 bp, Homo sapiens
tccctggtggcagctca

SEQ ID NO: 1850668 - DNA, 20 bp, Homo sapiens
tccctggtggcagctcacct

SEQ ID NO: 1850669 - DNA, 12 bp, Homo sapiens
tccctggttctg

SEQ ID NO: 1850670 - DNA, 16 bp, Homo sapiens
tccctggttctgatga

SEQ ID NO: 1850671 - DNA, 21 bp, Homo sapiens
tcccttgaccaggcctgggcc

SEQ ID NO: 1850672 - DNA, 15 bp, Homo sapiens
tcccttggacatttt

SEQ ID NO: 1850673 - DNA, 23 bp, Homo sapiens
tccctttgacgccatcccagccc

SEQ ID NO: 1850674 - DNA, 17 bp, Homo sapiens
tcccttttttggctgct

SEQ ID NO: 1850675 - DNA, 20 bp, Homo sapiens
tcccttttttggctgctgaa

SEQ ID NO: 1850676 - DNA, 22 bp, Homo sapiens
tcccttttttggctgctgaagg

SEQ ID NO: 1850677 - DNA, 23 bp, Homo sapiens
tcctaaaataagggcagagtcac

SEQ ID NO: 1850678 - DNA, 22 bp, Homo sapiens
tcctagaaattccccaccctga

SEQ ID NO: 1850679 - DNA, 18 bp, Homo sapiens
tcctagcacacacttttg

SEQ ID NO: 1850680 - DNA, 20 bp, Homo sapiens
tcctagcactttgggaggcc

SEQ ID NO: 1850681 - DNA, 19 bp, Homo sapiens
tcctaggcaggacatgctg

SEQ ID NO: 1850682 - DNA, 12 bp, Homo sapiens
tcctagttccac

SEQ ID NO: 1850683 - DNA, 14 bp, Homo sapiens
tcctagttccacca

SEQ ID NO: 1850684 - DNA, 15 bp, Homo sapiens
tcctcaaacactgca

SEQ ID NO: 1850685 - DNA, 20 bp, Homo sapiens
tcctcacaacatggtgtctg

SEQ ID NO: 1850686 - DNA, 22 bp, Homo sapiens
tcctcagtaacatttctgttct

SEQ ID NO: 1850687 - DNA, 12 bp, Homo sapiens
tcctcatttgtt

SEQ ID NO: 1850688 - DNA, 22 bp, Homo sapiens
tcctcatttgttcattaaacgt

SEQ ID NO: 1850689 - DNA, 10 bp, Homo sapiens
tcctccaggt

SEQ ID NO: 1850690 - DNA, 18 bp, Homo sapiens
tcctccaggtgcacaagc

SEQ ID NO: 1850691 - DNA, 19 bp, Homo sapiens
tcctccccaaggagacaca

SEQ ID NO: 1850692 - DNA, 15 bp, Homo sapiens
tcctccctccctctt

SEQ ID NO: 1850693 - DNA, 17 bp, Homo sapiens
tcctccctccctctttc

SEQ ID NO: 1850694 - DNA, 15 bp, Homo sapiens
tcctccgtggcacat

SEQ ID NO: 1850695 - DNA, 13 bp, Homo sapiens
tcctcctggactc

SEQ ID NO: 1850696 - DNA, 13 bp, Homo sapiens
tcctcgtttgtgt

SEQ ID NO: 1850697 - DNA, 15 bp, Homo sapiens
tcctcgtttgtgttc

SEQ ID NO: 1850698 - DNA, 14 bp, Homo sapiens
tcctctgaggctga

SEQ ID NO: 1850699 - DNA, 17 bp, Homo sapiens
tcctctgctgctggctg

SEQ ID NO: 1850700 - DNA, 13 bp, Homo sapiens
tcctctgtacaga

SEQ ID NO: 1850701 - DNA, 19 bp, Homo sapiens
tcctctttggtctacactg

SEQ ID NO: 1850702 - DNA, 21 bp, Homo sapiens
tcctctttggtctacactgtg

SEQ ID NO: 1850703 - DNA, 19 bp, Homo sapiens
tcctgatgcttcttcagag

SEQ ID NO: 1850704 - DNA, 21 bp, Homo sapiens
tcctgatgcttcttcagagac

SEQ ID NO: 1850705 - DNA, 15 bp, Homo sapiens
tcctgcaatgaagtc

SEQ ID NO: 1850706 - DNA, 17 bp, Homo sapiens
tgccaagcactgtgctc

SEQ ID NO: 1850707 - DNA, 18 bp, Homo sapiens
tgccaagctcaggaccag

SEQ ID NO: 1850708 - DNA, 15 bp, Homo sapiens
tgccacagagcgggg

SEQ ID NO: 1850709 - DNA, 16 bp, Homo sapiens
tgccacagagcgggga

SEQ ID NO: 1850710 - DNA, 16 bp, Homo sapiens
tgccaccctcatgctg

SEQ ID NO: 1850711 - DNA, 22 bp, Homo sapiens
tgccagggacagagggggtggc

SEQ ID NO: 1850712 - DNA, 15 bp, Homo sapiens
tgccagtcaccccgg

SEQ ID NO: 1850713 - DNA, 23 bp, Homo sapiens
tgccagtcaccccggccacctgc

SEQ ID NO: 1850714 - DNA, 23 bp, Homo sapiens
tgccatcctcaaacactgcaggc

SEQ ID NO: 1850715 - DNA, 20 bp, Homo sapiens
tgccattgtagcgtctttct

SEQ ID NO: 1850716 - DNA, 15 bp, Homo sapiens
tgcccacctggcctc

SEQ ID NO: 1850717 - DNA, 20 bp, Homo sapiens
tgcccacctggcctctgcac

SEQ ID NO: 1850718 - DNA, 14 bp, Homo sapiens
tgcccactccctgc

SEQ ID NO: 1850719 - DNA, 11 bp, Homo sapiens
tgcccagcccc

SEQ ID NO: 1850720 - DNA, 12 bp, Homo sapiens
tgcccagcccct

SEQ ID NO: 1850721 - DNA, 20 bp, Homo sapiens
tgcccagccccttctgaccc

SEQ ID NO: 1850722 - DNA, 21 bp, Homo sapiens
tgcccagccccttctgaccca

SEQ ID NO: 1850723 - DNA, 15 bp, Homo sapiens
tgcccagctctctga

SEQ ID NO: 1850724 - DNA, 16 bp, Homo sapiens
tgccctgcccacctgg

SEQ ID NO: 1850725 - DNA, 21 bp, Homo sapiens
tgccctgcccacctggcctct

SEQ ID NO: 1850726 - DNA, 23 bp, Homo sapiens
tgccctgcccacctggcctctgc

SEQ ID NO: 1850727 - DNA, 19 bp, Homo sapiens
tgccctgttctctaccaag

SEQ ID NO: 1850728 - DNA, 16 bp, Homo sapiens
tgccgccagctgccgc

SEQ ID NO: 1850729 - DNA, 20 bp, Homo sapiens
tgccgccagctgccgcacca

SEQ ID NO: 1850730 - DNA, 15 bp, Homo sapiens
tgccgccccacccag

SEQ ID NO: 1850731 - DNA, 17 bp, Homo sapiens
tgccgtctacctgaggg

SEQ ID NO: 1850732 - DNA, 19 bp, Homo sapiens
tgccgtctacctgaggggc

SEQ ID NO: 1850733 - DNA, 17 bp, Homo sapiens
tgcctcctttgtgagga

SEQ ID NO: 1850734 - DNA, 20 bp, Homo sapiens
tgcctcctttgtgaggaagc

SEQ ID NO: 1850735 - DNA, 21 bp, Homo sapiens
tgcctcctttgtgaggaagcc

SEQ ID NO: 1850736 - DNA, 19 bp, Homo sapiens
tgcctgcacaaactcacca

SEQ ID NO: 1850737 - DNA, 14 bp, Homo sapiens
tgcctgccaaattt

SEQ ID NO: 1850738 - DNA, 13 bp, Homo sapiens
tgcctgccctggt

SEQ ID NO: 1850739 - DNA, 14 bp, Homo sapiens
tgcctgctcccatc

SEQ ID NO: 1850740 - DNA, 20 bp, Homo sapiens
tgcctgctcccatcctgtgt

SEQ ID NO: 1850741 - DNA, 22 bp, Homo sapiens
tgcctgctcccatcctgtgtgt

SEQ ID NO: 1850742 - DNA, 15 bp, Homo sapiens
tgcctggatggggct

SEQ ID NO: 1850743 - DNA, 16 bp, Homo sapiens
tgcctggatggggctg

SEQ ID NO: 1850744 - DNA, 21 bp, Homo sapiens
tgcctggatggggctgcaccg

SEQ ID NO: 1850745 - DNA, 22 bp, Homo sapiens
tgcctgggtttaaggggagagg

SEQ ID NO: 1850746 - DNA, 15 bp, Homo sapiens
tgcggagaacaaatg

SEQ ID NO: 1850747 - DNA, 17 bp, Homo sapiens
tgcggcctttggcttca

SEQ ID NO: 1850748 - DNA, 23 bp, Homo sapiens
tgcggtgctatctcccccagccc

SEQ ID NO: 1850749 - DNA, 13 bp, Homo sapiens
tgctaaagccagg

SEQ ID NO: 1850750 - DNA, 13 bp, Homo sapiens
tgctaaataaaca

SEQ ID NO: 1850751 - DNA, 19 bp, Homo sapiens
tgctaggaacactccttca

SEQ ID NO: 1850752 - DNA, 16 bp, Homo sapiens
tgctatgtatttgcaa

SEQ ID NO: 1850753 - DNA, 18 bp, Homo sapiens
tgctcaatacctggcctc

SEQ ID NO: 1850754 - DNA, 14 bp, Homo sapiens
tgctcacccagtgc

SEQ ID NO: 1850755 - DNA, 19 bp, Homo sapiens
tgctcacccagtgccctct

SEQ ID NO: 1850756 - DNA, 18 bp, Homo sapiens
tgctcagttcagaatcac

SEQ ID NO: 1850757 - DNA, 13 bp, Homo sapiens
tgctccagattct

SEQ ID NO: 1850758 - DNA, 15 bp, Homo sapiens
tgctccagattctga

SEQ ID NO: 1850759 - DNA, 16 bp, Homo sapiens
tgctccagctgttcag

SEQ ID NO: 1850760 - DNA, 19 bp, Homo sapiens
tgctccagctgttcagctg

SEQ ID NO: 1850761 - DNA, 20 bp, Homo sapiens
tgctccagctgttcagctgg

SEQ ID NO: 1850762 - DNA, 12 bp, Homo sapiens
tgctccaggcag

SEQ ID NO: 1850763 - DNA, 14 bp, Homo sapiens
tgctccaggcaggc

SEQ ID NO: 1850764 - DNA, 19 bp, Homo sapiens
tgctccattttttcttccc

SEQ ID NO: 1850765 - DNA, 16 bp, Homo sapiens
tgctccccaggccacc

SEQ ID NO: 1850766 - DNA, 22 bp, Homo sapiens
tgctctggtggcttaagtgagc

SEQ ID NO: 1850767 - DNA, 15 bp, Homo sapiens
tgctctttgttttgt

SEQ ID NO: 1850768 - DNA, 15 bp, Homo sapiens
tgctgaggcccagtg

SEQ ID NO: 1850769 - DNA, 17 bp, Homo sapiens
tgctgagtctgaaggct

SEQ ID NO: 1850770 - DNA, 18 bp, Homo sapiens
tgctgagtctgaaggctg

SEQ ID NO: 1850771 - DNA, 17 bp, Homo sapiens
tgctgatgtcctcacca

SEQ ID NO: 1850772 - DNA, 18 bp, Homo sapiens
tgctgcagttgccagtca

SEQ ID NO: 1850773 - DNA, 10 bp, Homo sapiens
tgctgccctg

SEQ ID NO: 1850774 - DNA, 19 bp, Homo sapiens
tgctgccctgcccacctgg

SEQ ID NO: 1850775 - DNA, 11 bp, Homo sapiens
tgctgccctgt

SEQ ID NO: 1850776 - DNA, 12 bp, Homo sapiens
tgctgccctgtg

SEQ ID NO: 1850777 - DNA, 13 bp, Homo sapiens
tgctgccctgtga

SEQ ID NO: 1850778 - DNA, 19 bp, Homo sapiens
tgctgctaatattttcctc

SEQ ID NO: 1850779 - DNA, 13 bp, Homo sapiens
tgctgctggctgg

SEQ ID NO: 1850780 - DNA, 12 bp, Homo sapiens
tgctgcttgagg

SEQ ID NO: 1850781 - DNA, 19 bp, Homo sapiens
tgctgcttgaggcaactca

SEQ ID NO: 1850782 - DNA, 13 bp, Homo sapiens
tgcttcttcagag

SEQ ID NO: 1850783 - DNA, 16 bp, Homo sapiens
tgcttcttcagagact

SEQ ID NO: 1850784 - DNA, 14 bp, Homo sapiens
tgcttgtttcctag

SEQ ID NO: 1850785 - DNA, 12 bp, Homo sapiens
tgctttaaacat

SEQ ID NO: 1850786 - DNA, 13 bp, Homo sapiens
tgctttaatataa

SEQ ID NO: 1850787 - DNA, 18 bp, Homo sapiens
tgctttaatataaatgca

SEQ ID NO: 1850788 - DNA, 15 bp, Homo sapiens
tgctttaatatcatc

SEQ ID NO: 1850789 - DNA, 15 bp, Homo sapiens
tgctttgagagagaa

SEQ ID NO: 1850790 - DNA, 22 bp, Homo sapiens
tggaaaatacctaattgtggat

SEQ ID NO: 1850791 - DNA, 24 bp, Homo sapiens
tggaaaatacctaattgtggatga

SEQ ID NO: 1850792 - DNA, 20 bp, Homo sapiens
tggaaagagtaggaagactt

SEQ ID NO: 1850793 - DNA, 18 bp, Homo sapiens
tggaaatgggcagagcag

SEQ ID NO: 1850794 - DNA, 18 bp, Homo sapiens
tggaaattcccttcatct

SEQ ID NO: 1850795 - DNA, 18 bp, Homo sapiens
tggaaatttagcattgta

SEQ ID NO: 1850796 - DNA, 19 bp, Homo sapiens
tggaacagattcacactgt

SEQ ID NO: 1850797 - DNA, 23 bp, Homo sapiens
tggaacagattcacactgtctgg

SEQ ID NO: 1850798 - DNA, 23 bp, Homo sapiens
tggaacatcatcaaggcactgcc

SEQ ID NO: 1850799 - DNA, 14 bp, Homo sapiens
tggaacatccttgg

SEQ ID NO: 1850800 - DNA, 16 bp, Homo sapiens
tggaagaaggggcagg

SEQ ID NO: 1850801 - DNA, 20 bp, Homo sapiens
tggaagacagagacctcctg

SEQ ID NO: 1850802 - DNA, 23 bp, Homo sapiens
tggaagacagagacctcctgcct

SEQ ID NO: 1850803 - DNA, 20 bp, Homo sapiens
tggaaggatctgctgaggcc

SEQ ID NO: 1850804 - DNA, 19 bp, Homo sapiens
tggaagggcgttctaggta

SEQ ID NO: 1850805 - DNA, 21 bp, Homo sapiens
tggaagggcgttctaggtagg

SEQ ID NO: 1850806 - DNA, 17 bp, Homo sapiens
tggaagtgactttggct

SEQ ID NO: 1850807 - DNA, 16 bp, Homo sapiens
tggaagttgcatggca

SEQ ID NO: 1850808 - DNA, 18 bp, Homo sapiens
tggaatctagccgatgga

SEQ ID NO: 1850809 - DNA, 22 bp, Homo sapiens
tggaatctagccgatggaaaat

SEQ ID NO: 1850810 - DNA, 15 bp, Homo sapiens
tggacagaagcagct

SEQ ID NO: 1850811 - DNA, 12 bp, Homo sapiens
tggaccctgagg

SEQ ID NO: 1850812 - DNA, 19 bp, Homo sapiens
tggacggtgctccaggcag

SEQ ID NO: 1850813 - DNA, 22 bp, Homo sapiens
tggacggtgctccaggcaggct

SEQ ID NO: 1850814 - DNA, 19 bp, Homo sapiens
tggactcagccttgcaaat

SEQ ID NO: 1850815 - DNA, 15 bp, Homo sapiens
tggactcctgcacac

SEQ ID NO: 1850816 - DNA, 11 bp, Homo sapiens
tggactttgtt

SEQ ID NO: 1850817 - DNA, 17 bp, Homo sapiens
tggagagctggagcctg

SEQ ID NO: 1850818 - DNA, 16 bp, Homo sapiens
tggagatagggaaaga

SEQ ID NO: 1850819 - DNA, 21 bp, Homo sapiens
tggagatcccacatatttcaa

SEQ ID NO: 1850820 - DNA, 13 bp, Homo sapiens
tggagccccacct

SEQ ID NO: 1850821 - DNA, 18 bp, Homo sapiens
tggagctcagagagggca

SEQ ID NO: 1850822 - DNA, 16 bp, Homo sapiens
tggagcttgaaatagt

SEQ ID NO: 1850823 - DNA, 22 bp, Homo sapiens
tggagcttgaaatagtgtctga

SEQ ID NO: 1850824 - DNA, 20 bp, Homo sapiens
tggaggagcaaaggctgaga

SEQ ID NO: 1850825 - DNA, 20 bp, Homo sapiens
tggaggagcagtgcaggcac

SEQ ID NO: 1850826 - DNA, 23 bp, Homo sapiens
tggaggggggaggtgggatcctc

SEQ ID NO: 1850827 - DNA, 15 bp, Homo sapiens
tggatagacttggga

SEQ ID NO: 1850828 - DNA, 19 bp, Homo sapiens
aacacaaacgggctcagca

SEQ ID NO: 1850829 - DNA, 18 bp, Homo sapiens
aacacaagattggtgttt

SEQ ID NO: 1850830 - DNA, 21 bp, Homo sapiens
aacacaagattggtgtttttt

SEQ ID NO: 1850831 - DNA, 19 bp, Homo sapiens
aacacctctgcacaagctg

SEQ ID NO: 1850832 - DNA, 21 bp, Homo sapiens
aacactcattgacctgaggcc

SEQ ID NO: 1850833 - DNA, 12 bp, Homo sapiens
aacactccttca

SEQ ID NO: 1850834 - DNA, 15 bp, Homo sapiens
aacactgttctctgc

SEQ ID NO: 1850835 - DNA, 18 bp, Homo sapiens
aacactgttctctgccct

SEQ ID NO: 1850836 - DNA, 21 bp, Homo sapiens
aacactgttctctgccctcca

SEQ ID NO: 1850837 - DNA, 11 bp, Homo sapiens
aacagacaagt

SEQ ID NO: 1850838 - DNA, 17 bp, Homo sapiens
aacagacaagtgactgt

SEQ ID NO: 1850839 - DNA, 16 bp, Homo sapiens
aacagattcacactgt

SEQ ID NO: 1850840 - DNA, 16 bp, Homo sapiens
aacagtcatcatttat

SEQ ID NO: 1850841 - DNA, 20 bp, Homo sapiens
aacataagctatttttctaa

SEQ ID NO: 1850842 - DNA, 20 bp, Homo sapiens
aacataatttttatttttgg

SEQ ID NO: 1850843 - DNA, 20 bp, Homo sapiens
aacatactcccatctgtgaa

SEQ ID NO: 1850844 - DNA, 16 bp, Homo sapiens
aacatgcttttccaaa

SEQ ID NO: 1850845 - DNA, 18 bp, Homo sapiens
aacatgtgccttttctga

SEQ ID NO: 1850846 - DNA, 22 bp, Homo sapiens
aacattacagggaatgcctgag

SEQ ID NO: 1850847 - DNA, 13 bp, Homo sapiens
aacattccatcct

SEQ ID NO: 1850848 - DNA, 22 bp, Homo sapiens
aacattggttcttgtattaaga

SEQ ID NO: 1850849 - DNA, 17 bp, Homo sapiens
aaccaattcctcatttg

SEQ ID NO: 1850850 - DNA, 22 bp, Homo sapiens
aaccagaaacacccctctgtct

SEQ ID NO: 1850851 - DNA, 21 bp, Homo sapiens
aaccagcatcccttgaccagg

SEQ ID NO: 1850852 - DNA, 17 bp, Homo sapiens
aaccagctcagcactgc

SEQ ID NO: 1850853 - DNA, 22 bp, Homo sapiens
aaccagctcagcactgcctgct

SEQ ID NO: 1850854 - DNA, 13 bp, Homo sapiens
aaccaggaaaagg

SEQ ID NO: 1850855 - DNA, 22 bp, Homo sapiens
aacccagaggtggatgttatga

SEQ ID NO: 1850856 - DNA, 13 bp, Homo sapiens
aacccagctctgg

SEQ ID NO: 1850857 - DNA, 16 bp, Homo sapiens
aaccccaagttagttc

SEQ ID NO: 1850858 - DNA, 15 bp, Homo sapiens
aaccctggcatttgg

SEQ ID NO: 1850859 - DNA, 20 bp, Homo sapiens
aacctagcatcttacaaaaa

SEQ ID NO: 1850860 - DNA, 21 bp, Homo sapiens
aacctgagatttattaaagaa

SEQ ID NO: 1850861 - DNA, 19 bp, Homo sapiens
aacgatttttaaaatgtac

SEQ ID NO: 1850862 - DNA, 12 bp, Homo sapiens
aacgtcattcag

SEQ ID NO: 1850863 - DNA, 21 bp, Homo sapiens
aacgtgatttttaaattaaat

SEQ ID NO: 1850864 - DNA, 17 bp, Homo sapiens
aacgtgctctttgtttt

SEQ ID NO: 1850865 - DNA, 19 bp, Homo sapiens
aacgtgctctttgttttgt

SEQ ID NO: 1850866 - DNA, 20 bp, Homo sapiens
aacgtgctctttgttttgtg

SEQ ID NO: 1850867 - DNA, 13 bp, Homo sapiens
aactaaactttca

SEQ ID NO: 1850868 - DNA, 16 bp, Homo sapiens
aactacaaaggtttaa

SEQ ID NO: 1850869 - DNA, 15 bp, Homo sapiens
aactcaccccagccc

SEQ ID NO: 1850870 - DNA, 15 bp, Homo sapiens
aactcacctggggct

SEQ ID NO: 1850871 - DNA, 21 bp, Homo sapiens
aactcatccctaatgctgcag

SEQ ID NO: 1850872 - DNA, 17 bp, Homo sapiens
aactctcctctgctgct

SEQ ID NO: 1850873 - DNA, 19 bp, Homo sapiens
aactctcctctgctgctgg

SEQ ID NO: 1850874 - DNA, 19 bp, Homo sapiens
aactgaactctgacaacag

SEQ ID NO: 1850875 - DNA, 17 bp, Homo sapiens
aactgcttgtttcctag

SEQ ID NO: 1850876 - DNA, 14 bp, Homo sapiens
aactgggttcctgc

SEQ ID NO: 1850877 - DNA, 17 bp, Homo sapiens
aactgttatttataatc

SEQ ID NO: 1850878 - DNA, 22 bp, Homo sapiens
aactgttatttataatcacttt

SEQ ID NO: 1850879 - DNA, 22 bp, Homo sapiens
aacttttaattaaatgctcatc

SEQ ID NO: 1850880 - DNA, 19 bp, Homo sapiens
aagaaaaaatattttccct

SEQ ID NO: 1850881 - DNA, 18 bp, Homo sapiens
aagaaaaatgagcctggc

SEQ ID NO: 1850882 - DNA, 23 bp, Homo sapiens
aagaaaagatgcactttgcttta

SEQ ID NO: 1850883 - DNA, 20 bp, Homo sapiens
aagaaatggcgtctgctctg

SEQ ID NO: 1850884 - DNA, 22 bp, Homo sapiens
aagaaatggcgtctgctctggt

SEQ ID NO: 1850885 - DNA, 19 bp, Homo sapiens
aagaagatcctaaaacaaa

SEQ ID NO: 1850886 - DNA, 19 bp, Homo sapiens
aagaagcaggctacactga

SEQ ID NO: 1850887 - DNA, 17 bp, Homo sapiens
aagaagcccaggaaagg

SEQ ID NO: 1850888 - DNA, 14 bp, Homo sapiens
aagaagctctctcc

SEQ ID NO: 1850889 - DNA, 12 bp, Homo sapiens
aagaattgttgg

SEQ ID NO: 1850890 - DNA, 20 bp, Homo sapiens
aagacaatgtgaaaagaaaa

SEQ ID NO: 1850891 - DNA, 14 bp, Homo sapiens
aagacccagacagg

SEQ ID NO: 1850892 - DNA, 23 bp, Homo sapiens
aagaccccttaccactgctctga

SEQ ID NO: 1850893 - DNA, 21 bp, Homo sapiens
aagacctggcaaggacacaga

SEQ ID NO: 1850894 - DNA, 15 bp, Homo sapiens
aagaccttctccttc

SEQ ID NO: 1850895 - DNA, 18 bp, Homo sapiens
aagaccttctccttcacc

SEQ ID NO: 1850896 - DNA, 19 bp, Homo sapiens
aagaccttctccttcacct

SEQ ID NO: 1850897 - DNA, 17 bp, Homo sapiens
aagacgctgtgctgccc

SEQ ID NO: 1850898 - DNA, 18 bp, Homo sapiens
aagacgctgtgctgccct

SEQ ID NO: 1850899 - DNA, 23 bp, Homo sapiens
aagacgctgtgctgccctgccca

SEQ ID NO: 1850900 - DNA, 15 bp, Homo sapiens
aagacgttttataag

SEQ ID NO: 1850901 - DNA, 17 bp, Homo sapiens
aagacgttttataagca

SEQ ID NO: 1850902 - DNA, 18 bp, Homo sapiens
aagacgttttataagcat

SEQ ID NO: 1850903 - DNA, 16 bp, Homo sapiens
aagactttggaaagac

SEQ ID NO: 1850904 - DNA, 14 bp, Homo sapiens
aagagacagtcacc

SEQ ID NO: 1850905 - DNA, 14 bp, Homo sapiens
aagagcttgctcca

SEQ ID NO: 1850906 - DNA, 17 bp, Homo sapiens
aagagcttgctccagat

SEQ ID NO: 1850907 - DNA, 22 bp, Homo sapiens
aagagggagggagggctccaga

SEQ ID NO: 1850908 - DNA, 23 bp, Homo sapiens
aagagggagggagggctccagac

SEQ ID NO: 1850909 - DNA, 17 bp, Homo sapiens
aagagggcacacactgt

SEQ ID NO: 1850910 - DNA, 14 bp, Homo sapiens
aagaggtggcccca

SEQ ID NO: 1850911 - DNA, 20 bp, Homo sapiens
aagaggtggccccatattaa

SEQ ID NO: 1850912 - DNA, 18 bp, Homo sapiens
aagaggttttaaaaaaat

SEQ ID NO: 1850913 - DNA, 16 bp, Homo sapiens
aagaggtttttcttaa

SEQ ID NO: 1850914 - DNA, 17 bp, Homo sapiens
aagagtaacagtcatca

SEQ ID NO: 1850915 - DNA, 12 bp, Homo sapiens
aagagtaggaag

SEQ ID NO: 1850916 - DNA, 19 bp, Homo sapiens
aagagtaggaagactttgg

SEQ ID NO: 1850917 - DNA, 23 bp, Homo sapiens
aagagtgctaagcattagcttta

SEQ ID NO: 1850918 - DNA, 18 bp, Homo sapiens
aagatgcactttgcttta

SEQ ID NO: 1850919 - DNA, 16 bp, Homo sapiens
aagatgcttctcactg

SEQ ID NO: 1850920 - DNA, 19 bp, Homo sapiens
aagatgcttctcactgcca

SEQ ID NO: 1850921 - DNA, 17 bp, Homo sapiens
aagattggtgttttttt

SEQ ID NO: 1850922 - DNA, 22 bp, Homo sapiens
aagcaagtgattgggacagagg

SEQ ID NO: 1850923 - DNA, 15 bp, Homo sapiens
aagcaattagacaag

SEQ ID NO: 1850924 - DNA, 14 bp, Homo sapiens
aagcagaggaagga

SEQ ID NO: 1850925 - DNA, 21 bp, Homo sapiens
aagcagaggaaggagaggaga

SEQ ID NO: 1850926 - DNA, 11 bp, Homo sapiens
aagcagctctt

SEQ ID NO: 1850927 - DNA, 14 bp, Homo sapiens
aagcatcattattt

SEQ ID NO: 1850928 - DNA, 21 bp, Homo sapiens
aagcatcattatttatgtatt

SEQ ID NO: 1850929 - DNA, 22 bp, Homo sapiens
aagcattctcattggaaattta

SEQ ID NO: 1850930 - DNA, 14 bp, Homo sapiens
aagcattttataaa

SEQ ID NO: 1850931 - DNA, 21 bp, Homo sapiens
aagcattttataaatcgcttt

SEQ ID NO: 1850932 - DNA, 17 bp, Homo sapiens
aagccaaacctctgtga

SEQ ID NO: 1850933 - DNA, 20 bp, Homo sapiens
aagccaataacacacagcta

SEQ ID NO: 1850934 - DNA, 14 bp, Homo sapiens
aagcccaggaaagg

SEQ ID NO: 1850935 - DNA, 16 bp, Homo sapiens
aagcccattcattcca

SEQ ID NO: 1850936 - DNA, 23 bp, Homo sapiens
aagcccattcattccattctgga

SEQ ID NO: 1850937 - DNA, 17 bp, Homo sapiens
aagcctttgagactgtt

SEQ ID NO: 1850938 - DNA, 19 bp, Homo sapiens
aagcctttgagactgttcc

SEQ ID NO: 1850939 - DNA, 14 bp, Homo sapiens
aagcggctggcagc

SEQ ID NO: 1850940 - DNA, 14 bp, Homo sapiens
aagcggtgtctctc

SEQ ID NO: 1850941 - DNA, 17 bp, Homo sapiens
aagctatcctggctctt

SEQ ID NO: 1850942 - DNA, 13 bp, Homo sapiens
aagctatttttct

SEQ ID NO: 1850943 - DNA, 16 bp, Homo sapiens
aagctatttttctaac

SEQ ID NO: 1850944 - DNA, 17 bp, Homo sapiens
aagctcaggaccaggca

SEQ ID NO: 1850945 - DNA, 19 bp, Homo sapiens
aagctcccaagggatggtg

SEQ ID NO: 1850946 - DNA, 12 bp, Homo sapiens
aagctcccaggc

SEQ ID NO: 1850947 - DNA, 23 bp, Homo sapiens
aagctcccaggcattccccagga

SEQ ID NO: 1850948 - DNA, 18 bp, Homo sapiens
aagctctcatagctcata

SEQ ID NO: 1850949 - DNA, 14 bp, Homo sapiens
aagctgaagaaaat

SEQ ID NO: 1850950 - DNA, 13 bp, Homo sapiens
aagctgcaccctc

SEQ ID NO: 1850951 - DNA, 19 bp, Homo sapiens
aagctgcaccctcaggcag

SEQ ID NO: 1850952 - DNA, 13 bp, Homo sapiens
aagctgggcaggt

SEQ ID NO: 1850953 - DNA, 16 bp, Homo sapiens
aaggaaaccacagctg

SEQ ID NO: 1850954 - DNA, 15 bp, Homo sapiens
aaggaaacccagctc

SEQ ID NO: 1850955 - DNA, 20 bp, Homo sapiens
aaggaaactgggttcctgca

SEQ ID NO: 1850956 - DNA, 21 bp, Homo sapiens
aaggaaggctcttctccccag

SEQ ID NO: 1850957 - DNA, 21 bp, Homo sapiens
aaggaatccactcccaggcag

SEQ ID NO: 1850958 - DNA, 18 bp, Homo sapiens
aaggacacagatgaaaca

SEQ ID NO: 1850959 - DNA, 13 bp, Homo sapiens
aaggacagcccct

SEQ ID NO: 1850960 - DNA, 15 bp, Homo sapiens
aaggactcctgaaaa

SEQ ID NO: 1850961 - DNA, 20 bp, Homo sapiens
aaggactgtgacaggcagca

SEQ ID NO: 1850962 - DNA, 11 bp, Homo sapiens
aaggagagcta

SEQ ID NO: 1850963 - DNA, 14 bp, Homo sapiens
aaggagaggaggca

SEQ ID NO: 1850964 - DNA, 17 bp, Homo sapiens
aaggagataagaaagca

SEQ ID NO: 1850965 - DNA, 19 bp, Homo sapiens
aaggagataagaaagcagg

SEQ ID NO: 1850966 - DNA, 17 bp, Homo sapiens
aaggagtttatgttcca

SEQ ID NO: 1850967 - DNA, 18 bp, Homo sapiens
aaggatgatctaggaaga

SEQ ID NO: 1850968 - DNA, 12 bp, Homo sapiens
aaggattttatg

SEQ ID NO: 1850969 - DNA, 13 bp, Homo sapiens
aaggattttatgc

SEQ ID NO: 1850970 - DNA, 16 bp, Homo sapiens
aaggattttatgcttt

SEQ ID NO: 1850971 - DNA, 23 bp, Homo sapiens
aaggattttatgctttaaacatt

SEQ ID NO: 1850972 - DNA, 15 bp, Homo sapiens
aaggcacaatatggg

SEQ ID NO: 1850973 - DNA, 14 bp, Homo sapiens
aaggcactgcctga

SEQ ID NO: 1850974 - DNA, 16 bp, Homo sapiens
aaggcatatttaacaa

SEQ ID NO: 1850975 - DNA, 23 bp, Homo sapiens
aaggcgatcccatcttgataaga

SEQ ID NO: 1850976 - DNA, 15 bp, Homo sapiens
aaggctccaggagca

SEQ ID NO: 1850977 - DNA, 18 bp, Homo sapiens
aaggctcgagcatgcctg

SEQ ID NO: 1850978 - DNA, 20 bp, Homo sapiens
aaggctcgagcatgcctgga

SEQ ID NO: 1850979 - DNA, 17 bp, Homo sapiens
aaggctcttctccccag

SEQ ID NO: 1850980 - DNA, 14 bp, Homo sapiens
aaggctgatttatg

SEQ ID NO: 1850981 - DNA, 14 bp, Homo sapiens
aaggctgggggaag

SEQ ID NO: 1850982 - DNA, 19 bp, Homo sapiens
aaggctgggggaagaagct

SEQ ID NO: 1850983 - DNA, 22 bp, Homo sapiens
aaggctgggggaagaagctctc

SEQ ID NO: 1850984 - DNA, 18 bp, Homo sapiens
aagggacgctacccggga

SEQ ID NO: 1850985 - DNA, 22 bp, Homo sapiens
aagggattttagtcacacgtgg

SEQ ID NO: 1850986 - DNA, 15 bp, Homo sapiens
aagggcaagaaatgg

SEQ ID NO: 1850987 - DNA, 23 bp, Homo sapiens
aagggcaagaaatggcgtctgct

SEQ ID NO: 1850988 - DNA, 18 bp, Homo sapiens
aagggcatgggtcgggag

SEQ ID NO: 1850989 - DNA, 20 bp, Homo sapiens
aagggcatgggtcgggagag

SEQ ID NO: 1850990 - DNA, 21 bp, Homo sapiens
aagggcatgggtcgggagagg

SEQ ID NO: 1850991 - DNA, 22 bp, Homo sapiens
aagggcatgggtcgggagaggg

SEQ ID NO: 1850992 - DNA, 17 bp, Homo sapiens
aagggcctggcctgagc

SEQ ID NO: 1850993 - DNA, 19 bp, Homo sapiens
aagggcctggcctgagctg

SEQ ID NO: 1850994 - DNA, 18 bp, Homo sapiens
aaggggaagcactcgtgt

SEQ ID NO: 1850995 - DNA, 16 bp, Homo sapiens
aagggtatctggtgac

SEQ ID NO: 1850996 - DNA, 18 bp, Homo sapiens
aaggttctggtgtgaact

SEQ ID NO: 1850997 - DNA, 21 bp, Homo sapiens
aaggtttaaatgaacaagaga

SEQ ID NO: 1850998 - DNA, 16 bp, Homo sapiens
aagtaatcctagggaa

SEQ ID NO: 1850999 - DNA, 18 bp, Homo sapiens
aagtaatctcacagcatt

SEQ ID NO: 1851000 - DNA, 20 bp, Homo sapiens
aagtctcccaatatccaatt

SEQ ID NO: 1851001 - DNA, 23 bp, Homo sapiens
aagtctgttttatgacttcatta

SEQ ID NO: 1851002 - DNA, 11 bp, Homo sapiens
aagtgagcaga

SEQ ID NO: 1851003 - DNA, 14 bp, Homo sapiens
aagtgagcagaaca

SEQ ID NO: 1851004 - DNA, 17 bp, Homo sapiens
aagtgttctcatgaagc

SEQ ID NO: 1851005 - DNA, 19 bp, Homo sapiens
aagtgttctcatgaagcag

SEQ ID NO: 1851006 - DNA, 21 bp, Homo sapiens
aagtgttctcatgaagcagga

SEQ ID NO: 1851007 - DNA, 14 bp, Homo sapiens
aagttgaagaagct

SEQ ID NO: 1851008 - DNA, 22 bp, Homo sapiens
aagttgtttgagaaattaagta

SEQ ID NO: 1851009 - DNA, 13 bp, Homo sapiens
aataaagaaaaga

SEQ ID NO: 1851010 - DNA, 14 bp, Homo sapiens
aataaagaaaagat

SEQ ID NO: 1851011 - DNA, 16 bp, Homo sapiens
aataaagaaaagatgc

SEQ ID NO: 1851012 - DNA, 14 bp, Homo sapiens
aataaagatcatgt

SEQ ID NO: 1851013 - DNA, 18 bp, Homo sapiens
aataaagtctcttcctcc

SEQ ID NO: 1851014 - DNA, 19 bp, Homo sapiens
aataaagttaaactgatta

SEQ ID NO: 1851015 - DNA, 22 bp, Homo sapiens
aataacaaatgccaaattaaaa

SEQ ID NO: 1851016 - DNA, 17 bp, Homo sapiens
aataatagcacatgatt

SEQ ID NO: 1851017 - DNA, 19 bp, Homo sapiens
aataatgggcttagagcag

SEQ ID NO: 1851018 - DNA, 24 bp, Homo sapiens
aataatgtagttttgtgatgcatt

SEQ ID NO: 1851019 - DNA, 17 bp, Homo sapiens
aatacaaacacctggac

SEQ ID NO: 1851020 - DNA, 20 bp, Homo sapiens
aatacagtatctcagggcct

SEQ ID NO: 1851021 - DNA, 19 bp, Homo sapiens
aatacagtttgtcacatga

SEQ ID NO: 1851022 - DNA, 20 bp, Homo sapiens
aatacctggcctcatttaaa

SEQ ID NO: 1851023 - DNA, 15 bp, Homo sapiens
aatacctgtccccct

SEQ ID NO: 1851024 - DNA, 21 bp, Homo sapiens
aatacctgtccccctgacaac

SEQ ID NO: 1851025 - DNA, 12 bp, Homo sapiens
aatactgtttga

SEQ ID NO: 1851026 - DNA, 19 bp, Homo sapiens
aatatagctttcataacat

SEQ ID NO: 1851027 - DNA, 15 bp, Homo sapiens
aatatattattactt

SEQ ID NO: 1851028 - DNA, 22 bp, Homo sapiens
aatatattattacttgtaaata

SEQ ID NO: 1851029 - DNA, 16 bp, Homo sapiens
aatatcatcagtattg

SEQ ID NO: 1851030 - DNA, 20 bp, Homo sapiens
aatatcccttggacatttta

SEQ ID NO: 1851031 - DNA, 12 bp, Homo sapiens
aatatggactca

SEQ ID NO: 1851032 - DNA, 21 bp, Homo sapiens
aatattttaggtgtaaaataa

SEQ ID NO: 1851033 - DNA, 12 bp, Homo sapiens
aatattttcctc

SEQ ID NO: 1851034 - DNA, 18 bp, Homo sapiens
aatcagcctgctccagct

SEQ ID NO: 1851035 - DNA, 18 bp, Homo sapiens
aatcatctgcattcctga

SEQ ID NO: 1851036 - DNA, 15 bp, Homo sapiens
aatccactcccaggc

SEQ ID NO: 1851037 - DNA, 17 bp, Homo sapiens
aatccactcccaggcag

SEQ ID NO: 1851038 - DNA, 21 bp, Homo sapiens
aatcctctcaaccacctttca

SEQ ID NO: 1851039 - DNA, 17 bp, Homo sapiens
aatctcaattcttccct

SEQ ID NO: 1851040 - DNA, 14 bp, Homo sapiens
aatctcacagcatt

SEQ ID NO: 1851041 - DNA, 19 bp, Homo sapiens
aatctctccaccttccaaa

SEQ ID NO: 1851042 - DNA, 20 bp, Homo sapiens
aatctctccaccttccaaag

SEQ ID NO: 1851043 - DNA, 16 bp, Homo sapiens
aatctggattcatatt

SEQ ID NO: 1851044 - DNA, 18 bp, Homo sapiens
aatctggattcatattta

SEQ ID NO: 1851045 - DNA, 17 bp, Homo sapiens
aatctgggccagaattt

SEQ ID NO: 1851046 - DNA, 13 bp, Homo sapiens
aatgaaatactgt

SEQ ID NO: 1851047 - DNA, 12 bp, Homo sapiens
aatgaacaagag

SEQ ID NO: 1851048 - DNA, 16 bp, Homo sapiens
aatgaacaagagaagc

SEQ ID NO: 1851049 - DNA, 22 bp, Homo sapiens
aatgaacaagagaagcattctc

SEQ ID NO: 1851050 - DNA, 24 bp, Homo sapiens
aatgacggtaagtgttctcatgaa

SEQ ID NO: 1851051 - DNA, 12 bp, Homo sapiens
aatgagcctggc

SEQ ID NO: 1851052 - DNA, 12 bp, Homo sapiens
aatgataatgct

SEQ ID NO: 1851053 - DNA, 23 bp, Homo sapiens
aatgataatgctaattttattat

SEQ ID NO: 1851054 - DNA, 16 bp, Homo sapiens
aatgcactttgttctg

SEQ ID NO: 1851055 - DNA, 19 bp, Homo sapiens
aatgcactttgttctggct

SEQ ID NO: 1851056 - DNA, 14 bp, Homo sapiens
aatgcagcgtgaag

SEQ ID NO: 1851057 - DNA, 23 bp, Homo sapiens
aatgcattttgctagacagttaa

SEQ ID NO: 1851058 - DNA, 15 bp, Homo sapiens
aatgcccagcccctt

SEQ ID NO: 1851059 - DNA, 16 bp, Homo sapiens
aatgcctgagtgcctg

SEQ ID NO: 1851060 - DNA, 19 bp, Homo sapiens
aatgcctgagtgcctggcc

SEQ ID NO: 1851061 - DNA, 20 bp, Homo sapiens
aatggaaatgggcagagcag

SEQ ID NO: 1851062 - DNA, 20 bp, Homo sapiens
aatggactaacttgtctttg

SEQ ID NO: 1851063 - DNA, 21 bp, Homo sapiens
aatggccatgcaggaggtgga

SEQ ID NO: 1851064 - DNA, 17 bp, Homo sapiens
aatggcgtctgctctgg

SEQ ID NO: 1851065 - DNA, 20 bp, Homo sapiens
aatggctacatctccaaata

SEQ ID NO: 1851066 - DNA, 21 bp, Homo sapiens
aatggcttatccagctggtga

SEQ ID NO: 1851067 - DNA, 17 bp, Homo sapiens
aatgggcttagagcagt

SEQ ID NO: 1851068 - DNA, 18 bp, Homo sapiens
aatgtaatagaagcttaa

SEQ ID NO: 1851069 - DNA, 20 bp, Homo sapiens
aatgtattttatgttatata

SEQ ID NO: 1851070 - DNA, 22 bp, Homo sapiens
aatgtctagttgtaacaccatg

SEQ ID NO: 1851071 - DNA, 14 bp, Homo sapiens
aatgtgggcagaga

SEQ ID NO: 1851072 - DNA, 15 bp, Homo sapiens
aatgtgtataaacaa

SEQ ID NO: 1851073 - DNA, 14 bp, Homo sapiens
aatgtttttctaaa

SEQ ID NO: 1851074 - DNA, 13 bp, Homo sapiens
aattaaaaaagat

SEQ ID NO: 1851075 - DNA, 18 bp, Homo sapiens
aattaaaaaagataaaca

SEQ ID NO: 1851076 - DNA, 20 bp, Homo sapiens
aattaaaaaagataaacaca

SEQ ID NO: 1851077 - DNA, 20 bp, Homo sapiens
aattaaggattttatgcttt

SEQ ID NO: 1851078 - DNA, 14 bp, Homo sapiens
aattaagtatctga

SEQ ID NO: 1851079 - DNA, 22 bp, Homo sapiens
aattaatctgggccagaatttc

SEQ ID NO: 1851080 - DNA, 15 bp, Homo sapiens
aattagccaagtgtg

SEQ ID NO: 1851081 - DNA, 19 bp, Homo sapiens
aattatttgaagatttaat

SEQ ID NO: 1851082 - DNA, 14 bp, Homo sapiens
aattccccaccctg

SEQ ID NO: 1851083 - DNA, 21 bp, Homo sapiens
aattcttccctatctttgcca

SEQ ID NO: 1851084 - DNA, 17 bp, Homo sapiens
aattctttgttctgttt

SEQ ID NO: 1851085 - DNA, 13 bp, Homo sapiens
aattgcatttgtg

SEQ ID NO: 1851086 - DNA, 13 bp, Homo sapiens
aatttaaaagtct

SEQ ID NO: 1851087 - DNA, 16 bp, Homo sapiens
aatttagcattgtagt

SEQ ID NO: 1851088 - DNA, 16 bp, Homo sapiens
aatttccctctgatat

SEQ ID NO: 1851089 - DNA, 16 bp, Homo sapiens
aattttgtgcccccat

SEQ ID NO: 1851090 - DNA, 22 bp, Homo sapiens
aatttttatttttggcaaagcc

SEQ ID NO: 1851091 - DNA, 12 bp, Homo sapiens
acaaacctgcct

SEQ ID NO: 1851092 - DNA, 15 bp, Homo sapiens
acaaacgggctcagc

SEQ ID NO: 1851093 - DNA, 17 bp, Homo sapiens
acaaaggggcttaatta

SEQ ID NO: 1851094 - DNA, 15 bp, Homo sapiens
acaaaggtttaaatg

SEQ ID NO: 1851095 - DNA, 22 bp, Homo sapiens
acaaaggtttaaatgaacaaga

SEQ ID NO: 1851096 - DNA, 23 bp, Homo sapiens
acaaaggtttaaatgaacaagag

SEQ ID NO: 1851097 - DNA, 18 bp, Homo sapiens
acaaagtgagacagtcca

SEQ ID NO: 1851098 - DNA, 14 bp, Homo sapiens
acaaattgcatttg

SEQ ID NO: 1851099 - DNA, 19 bp, Homo sapiens
acaagattggtgttttttt

SEQ ID NO: 1851100 - DNA, 22 bp, Homo sapiens
acaagattggtgtttttttcta

SEQ ID NO: 1851101 - DNA, 24 bp, Homo sapiens
acaagattggtgtttttttctatg

SEQ ID NO: 1851102 - DNA, 15 bp, Homo sapiens
acaagcaagctccca

SEQ ID NO: 1851103 - DNA, 16 bp, Homo sapiens
acaagctccaagctcc

SEQ ID NO: 1851104 - DNA, 19 bp, Homo sapiens
acaaggagataagaaagca

SEQ ID NO: 1851105 - DNA, 17 bp, Homo sapiens
acaatgtgaaaagaaaa

SEQ ID NO: 1851106 - DNA, 21 bp, Homo sapiens
acaatttgagatgtatttcaa

SEQ ID NO: 1851107 - DNA, 17 bp, Homo sapiens
acacaaacctgcctggg

SEQ ID NO: 1851108 - DNA, 19 bp, Homo sapiens
acacaagattggtgttttt

SEQ ID NO: 1851109 - DNA, 12 bp, Homo sapiens
acacacagctcc

SEQ ID NO: 1851110 - DNA, 20 bp, Homo sapiens
acacacgagcaaacccagag

SEQ ID NO: 1851111 - DNA, 21 bp, Homo sapiens
acacagatgaaacacaaacaa

SEQ ID NO: 1851112 - DNA, 14 bp, Homo sapiens
acacagtgtctggc

SEQ ID NO: 1851113 - DNA, 21 bp, Homo sapiens
acacatgagcatcaggccagg

SEQ ID NO: 1851114 - DNA, 16 bp, Homo sapiens
acacccaagtccaggc

SEQ ID NO: 1851115 - DNA, 21 bp, Homo sapiens
acaccccagacgatgtcttca

SEQ ID NO: 1851116 - DNA, 14 bp, Homo sapiens
acacccctctgtct

SEQ ID NO: 1851117 - DNA, 13 bp, Homo sapiens
acaccctcacact

SEQ ID NO: 1851118 - DNA, 16 bp, Homo sapiens
acaccctcacactggg

SEQ ID NO: 1851119 - DNA, 19 bp, Homo sapiens
acacctctgcacaagctgc

SEQ ID NO: 1851120 - DNA, 21 bp, Homo sapiens
acacctctgcacaagctgcac

SEQ ID NO: 1851121 - DNA, 21 bp, Homo sapiens
acaccttagcctgccctcctt

SEQ ID NO: 1851122 - DNA, 13 bp, Homo sapiens
acacgagcaaacc

SEQ ID NO: 1851123 - DNA, 14 bp, Homo sapiens
acacgctccttcct

SEQ ID NO: 1851124 - DNA, 22 bp, Homo sapiens
acacggtttgaagcctggaaca

SEQ ID NO: 1851125 - DNA, 15 bp, Homo sapiens
acactcaaaagctgg

SEQ ID NO: 1851126 - DNA, 17 bp, Homo sapiens
acactcaagaagcaggc

SEQ ID NO: 1851127 - DNA, 23 bp, Homo sapiens
acactcattgacctgaggccctt

SEQ ID NO: 1851128 - DNA, 21 bp, Homo sapiens
acactccaattaaggatttta

SEQ ID NO: 1851129 - DNA, 20 bp, Homo sapiens
acactgcaggcatcacagct

SEQ ID NO: 1851130 - DNA, 21 bp, Homo sapiens
acactgctgctccagtgcagg

SEQ ID NO: 1851131 - DNA, 13 bp, Homo sapiens
acactgggacttg

SEQ ID NO: 1851132 - DNA, 14 bp, Homo sapiens
acactgttctctgc

SEQ ID NO: 1851133 - DNA, 17 bp, Homo sapiens
acactgttctctgccct

SEQ ID NO: 1851134 - DNA, 22 bp, Homo sapiens
acactgttctctgccctccaag

SEQ ID NO: 1851135 - DNA, 23 bp, Homo sapiens
acactgttctctgccctccaaga

SEQ ID NO: 1851136 - DNA, 15 bp, Homo sapiens
acactgttcttagct

SEQ ID NO: 1851137 - DNA, 23 bp, Homo sapiens
acactgttcttagctcaatgagc

SEQ ID NO: 1851138 - DNA, 22 bp, Homo sapiens
acacttggcccaagtggcagag

SEQ ID NO: 1851139 - DNA, 14 bp, Homo sapiens
acagaagcagctct

SEQ ID NO: 1851140 - DNA, 15 bp, Homo sapiens
acagaagcagctctt

SEQ ID NO: 1851141 - DNA, 13 bp, Homo sapiens
acagaccctgccc

SEQ ID NO: 1851142 - DNA, 21 bp, Homo sapiens
acagagcaagtgagaccctgt

SEQ ID NO: 1851143 - DNA, 15 bp, Homo sapiens
acagagcccacgccc

SEQ ID NO: 1851144 - DNA, 19 bp, Homo sapiens
acagagcccacgcccccac

SEQ ID NO: 1851145 - DNA, 20 bp, Homo sapiens
acagagcccacgcccccact

SEQ ID NO: 1851146 - DNA, 22 bp, Homo sapiens
acagaggatgctgacatcattt

SEQ ID NO: 1851147 - DNA, 18 bp, Homo sapiens
acagagggggtggcctcc

SEQ ID NO: 1851148 - DNA, 19 bp, Homo sapiens
acagagggggtggcctccc

SEQ ID NO: 1851149 - DNA, 19 bp, Homo sapiens
acagatgaaacacaaacaa

SEQ ID NO: 1851150 - DNA, 15 bp, Homo sapiens
acagattcacactgt

SEQ ID NO: 1851151 - DNA, 16 bp, Homo sapiens
acagattcacactgtc

SEQ ID NO: 1851152 - DNA, 17 bp, Homo sapiens
acagcaattcctcaggc

SEQ ID NO: 1851153 - DNA, 19 bp, Homo sapiens
acagcaattcctcaggcta

SEQ ID NO: 1851154 - DNA, 14 bp, Homo sapiens
acagcatttgccaa

SEQ ID NO: 1851155 - DNA, 16 bp, Homo sapiens
acagcccgggctctgc

SEQ ID NO: 1851156 - DNA, 19 bp, Homo sapiens
acagcccgggctctgcctc

SEQ ID NO: 1851157 - DNA, 18 bp, Homo sapiens
acagccgtttgttcccca

SEQ ID NO: 1851158 - DNA, 13 bp, Homo sapiens
acagctgcctggg

SEQ ID NO: 1851159 - DNA, 23 bp, Homo sapiens
acagctgcctgggatccctcatc

SEQ ID NO: 1851160 - DNA, 20 bp, Homo sapiens
acagctgggtggcactgcca

SEQ ID NO: 1851161 - DNA, 21 bp, Homo sapiens
acagctttctgggatgtcaca

SEQ ID NO: 1851162 - DNA, 15 bp, Homo sapiens
acaggaagtgaagaa

SEQ ID NO: 1851163 - DNA, 18 bp, Homo sapiens
acaggcttctgagcagcg

SEQ ID NO: 1851164 - DNA, 23 bp, Homo sapiens
acagggatgagcatggagctggc

SEQ ID NO: 1851165 - DNA, 19 bp, Homo sapiens
acagtaacgcaggggaaac

SEQ ID NO: 1851166 - DNA, 16 bp, Homo sapiens
acagtattgctcaccc

SEQ ID NO: 1851167 - DNA, 15 bp, Homo sapiens
acagtcatcatttat

SEQ ID NO: 1851168 - DNA, 18 bp, Homo sapiens
acagtccagcctggagat

SEQ ID NO: 1851169 - DNA, 13 bp, Homo sapiens
acagtccctgcca

SEQ ID NO: 1851170 - DNA, 14 bp, Homo sapiens
acagtcctcccatc

SEQ ID NO: 1851171 - DNA, 21 bp, Homo sapiens
acagtccttaccagcagagca

SEQ ID NO: 1851172 - DNA, 22 bp, Homo sapiens
acagtgcctcttccagtgaaca

SEQ ID NO: 1851173 - DNA, 20 bp, Homo sapiens
acagtgctgaccagacagcc

SEQ ID NO: 1851174 - DNA, 21 bp, Homo sapiens
acagtggccaagatcacagtg

SEQ ID NO: 1851175 - DNA, 22 bp, Homo sapiens
acagtgtgtggtcaacatttct

SEQ ID NO: 1851176 - DNA, 21 bp, Homo sapiens
acagttaaactggcttaactt

SEQ ID NO: 1851177 - DNA, 14 bp, Homo sapiens
acagtttgtcacat

SEQ ID NO: 1851178 - DNA, 19 bp, Homo sapiens
acagttttggttgctttaa

SEQ ID NO: 1851179 - DNA, 12 bp, Homo sapiens
acataagctatt

SEQ ID NO: 1851180 - DNA, 16 bp, Homo sapiens
acataatttttatttt

SEQ ID NO: 1851181 - DNA, 22 bp, Homo sapiens
acatcaatgataatgctaattt

SEQ ID NO: 1851182 - DNA, 15 bp, Homo sapiens
acatcaggtttttcc

SEQ ID NO: 1851183 - DNA, 16 bp, Homo sapiens
acatcaggtttttccc

SEQ ID NO: 1851184 - DNA, 20 bp, Homo sapiens
acatcatcaaggcactgcct

SEQ ID NO: 1851185 - DNA, 12 bp, Homo sapiens
acatcatttgta

SEQ ID NO: 1851186 - DNA, 13 bp, Homo sapiens
acatcatttgtat

SEQ ID NO: 1851187 - DNA, 23 bp, Homo sapiens
acatcatttgtattatgttccaa

SEQ ID NO: 1851188 - DNA, 23 bp, Homo sapiens
acatctccaaatatcagtgggct

SEQ ID NO: 1851189 - DNA, 13 bp, Homo sapiens
acatctgttttgt

SEQ ID NO: 1851190 - DNA, 13 bp, Homo sapiens
acatgagcatcag

SEQ ID NO: 1851191 - DNA, 23 bp, Homo sapiens
acatgagcatcaggccaggccct

SEQ ID NO: 1851192 - DNA, 18 bp, Homo sapiens
acatgccaagcactgtgc

SEQ ID NO: 1851193 - DNA, 16 bp, Homo sapiens
acatgtatttgtttgc

SEQ ID NO: 1851194 - DNA, 21 bp, Homo sapiens
acatgtcttttcttgcatgag

SEQ ID NO: 1851195 - DNA, 14 bp, Homo sapiens
acatgtgccctcag

SEQ ID NO: 1851196 - DNA, 15 bp, Homo sapiens
acatgtttttatatg

SEQ ID NO: 1851197 - DNA, 19 bp, Homo sapiens
acatgtttttcttctccct

SEQ ID NO: 1851198 - DNA, 19 bp, Homo sapiens
acattatctcacttgtgcc

SEQ ID NO: 1851199 - DNA, 16 bp, Homo sapiens
acattcccagcccagc

SEQ ID NO: 1851200 - DNA, 17 bp, Homo sapiens
acattccttgcctgcac

SEQ ID NO: 1851201 - DNA, 14 bp, Homo sapiens
acattggttcttgt

SEQ ID NO: 1851202 - DNA, 21 bp, Homo sapiens
acattggttcttgtattaaga

SEQ ID NO: 1851203 - DNA, 12 bp, Homo sapiens
acatttctgttc

SEQ ID NO: 1851204 - DNA, 15 bp, Homo sapiens
acatttctgttctca

SEQ ID NO: 1851205 - DNA, 21 bp, Homo sapiens
accaacatactcccatctgtg

SEQ ID NO: 1851206 - DNA, 21 bp, Homo sapiens
accaacgtctgtgccattttg

SEQ ID NO: 1851207 - DNA, 14 bp, Homo sapiens
accacagctgctgg

SEQ ID NO: 1851208 - DNA, 14 bp, Homo sapiens
accaccggccccct

SEQ ID NO: 1851209 - DNA, 23 bp, Homo sapiens
accaccggccccctccccccaga

SEQ ID NO: 1851210 - DNA, 17 bp, Homo sapiens
accactgcactccagcc

SEQ ID NO: 1851211 - DNA, 20 bp, Homo sapiens
accactgcactccagcctgg

SEQ ID NO: 1851212 - DNA, 17 bp, Homo sapiens
accactgctctgatgaa

SEQ ID NO: 1851213 - DNA, 23 bp, Homo sapiens
accagactacttgggagcaccgc

SEQ ID NO: 1851214 - DNA, 17 bp, Homo sapiens
accagcccgaacaccat

SEQ ID NO: 1851215 - DNA, 13 bp, Homo sapiens
accagctcagcac

SEQ ID NO: 1851216 - DNA, 21 bp, Homo sapiens
accagggagatttgctcaata

SEQ ID NO: 1851217 - DNA, 15 bp, Homo sapiens
accatcaagccacca

SEQ ID NO: 1851218 - DNA, 23 bp, Homo sapiens
accatcagaaacaccctcacact

SEQ ID NO: 1851219 - DNA, 18 bp, Homo sapiens
accatccctgaaggcccc

SEQ ID NO: 1851220 - DNA, 22 bp, Homo sapiens
accatccctgaaggccccgccc

SEQ ID NO: 1851221 - DNA, 18 bp, Homo sapiens
accatcctaggctgacac

SEQ ID NO: 1851222 - DNA, 18 bp, Homo sapiens
accattctccacctgcca

SEQ ID NO: 1851223 - DNA, 20 bp, Homo sapiens
accattctccacctgccagg

SEQ ID NO: 1851224 - DNA, 13 bp, Homo sapiens
acccaagggcctg

SEQ ID NO: 1851225 - DNA, 22 bp, Homo sapiens
acccaagggcctggcctgagct

SEQ ID NO: 1851226 - DNA, 17 bp, Homo sapiens
acccaggagtgtggcca

SEQ ID NO: 1851227 - DNA, 13 bp, Homo sapiens
acccaggctgggc

SEQ ID NO: 1851228 - DNA, 11 bp, Homo sapiens
acccaggtgct

SEQ ID NO: 1851229 - DNA, 17 bp, Homo sapiens
acccatgcagctgctcc

SEQ ID NO: 1851230 - DNA, 22 bp, Homo sapiens
acccatgttgagacctcagctt

SEQ ID NO: 1851231 - DNA, 17 bp, Homo sapiens
acccattgttgtcaagg

SEQ ID NO: 1851232 - DNA, 18 bp, Homo sapiens
acccattgttgtcaagga

SEQ ID NO: 1851233 - DNA, 18 bp, Homo sapiens
accccgctgatggagccc

SEQ ID NO: 1851234 - DNA, 15 bp, Homo sapiens
accccggccacctgc

SEQ ID NO: 1851235 - DNA, 12 bp, Homo sapiens
acccgggaaggg

SEQ ID NO: 1851236 - DNA, 13 bp, Homo sapiens
acccgggaagggg

SEQ ID NO: 1851237 - DNA, 20 bp, Homo sapiens
acccgggaagggggctggga

SEQ ID NO: 1851238 - DNA, 22 bp, Homo sapiens
acccgggaagggggctgggaca

SEQ ID NO: 1851239 - DNA, 13 bp, Homo sapiens
accctcaggcagg

SEQ ID NO: 1851240 - DNA, 16 bp, Homo sapiens
accctcaggcaggtgg

SEQ ID NO: 1851241 - DNA, 13 bp, Homo sapiens
accctcatgctgt

SEQ ID NO: 1851242 - DNA, 20 bp, Homo sapiens
accctcatgctgtgtgactc

SEQ ID NO: 1851243 - DNA, 14 bp, Homo sapiens
accctcgaggcgga

SEQ ID NO: 1851244 - DNA, 18 bp, Homo sapiens
accctcgaggcggatctt

SEQ ID NO: 1851245 - DNA, 19 bp, Homo sapiens
accctcgaggcggatcttt

SEQ ID NO: 1851246 - DNA, 16 bp, Homo sapiens
accctgaaagccctga

SEQ ID NO: 1851247 - DNA, 15 bp, Homo sapiens
accctgaggcccaga

SEQ ID NO: 1851248 - DNA, 17 bp, Homo sapiens
accctgaggcccagagg

SEQ ID NO: 1851249 - DNA, 23 bp, Homo sapiens
accctgaggcccagagggcctgc

SEQ ID NO: 1851250 - DNA, 12 bp, Homo sapiens
accctgccctgt

SEQ ID NO: 1851251 - DNA, 14 bp, Homo sapiens
accctgccctgtgg

SEQ ID NO: 1851252 - DNA, 22 bp, Homo sapiens
accctgccctgtgggcccccaa

SEQ ID NO: 1851253 - DNA, 13 bp, Homo sapiens
accctggagccca

SEQ ID NO: 1851254 - DNA, 22 bp, Homo sapiens
accctgtgatggggccctgcct

SEQ ID NO: 1851255 - DNA, 16 bp, Homo sapiens
acccttgtggtcccac

SEQ ID NO: 1851256 - DNA, 19 bp, Homo sapiens
acccttgtggtcccacccc

SEQ ID NO: 1851257 - DNA, 20 bp, Homo sapiens
acccttgtggtcccacccca

SEQ ID NO: 1851258 - DNA, 15 bp, Homo sapiens
accgaggacatgaaa

SEQ ID NO: 1851259 - DNA, 12 bp, Homo sapiens
accgcagacagg

SEQ ID NO: 1851260 - DNA, 20 bp, Homo sapiens
accgcagacaggaccaggga

SEQ ID NO: 1851261 - DNA, 17 bp, Homo sapiens
acctaactcttctttca

SEQ ID NO: 1851262 - DNA, 14 bp, Homo sapiens
acctacatgtattt

SEQ ID NO: 1851263 - DNA, 15 bp, Homo sapiens
acctacatgtatttg

SEQ ID NO: 1851264 - DNA, 21 bp, Homo sapiens
acctagctgaatgtttttcta

SEQ ID NO: 1851265 - DNA, 21 bp, Homo sapiens
acctcatgcccagctctctga

SEQ ID NO: 1851266 - DNA, 20 bp, Homo sapiens
acctcccacaaaggagagct

SEQ ID NO: 1851267 - DNA, 17 bp, Homo sapiens
acctcctgtctctggcc

SEQ ID NO: 1851268 - DNA, 15 bp, Homo sapiens
acctctcccttggat

SEQ ID NO: 1851269 - DNA, 18 bp, Homo sapiens
acctctgcacaagctgca

SEQ ID NO: 1851270 - DNA, 15 bp, Homo sapiens
acctgagatttatta

SEQ ID NO: 1851271 - DNA, 19 bp, Homo sapiens
acctgagatttattaaaga

SEQ ID NO: 1851272 - DNA, 22 bp, Homo sapiens
acctgaggcccttctctccagc

SEQ ID NO: 1851273 - DNA, 15 bp, Homo sapiens
acctgattgtgtctc

SEQ ID NO: 1851274 - DNA, 16 bp, Homo sapiens
acctgcacacaggaca

SEQ ID NO: 1851275 - DNA, 12 bp, Homo sapiens
acctgcaggcgt

SEQ ID NO: 1851276 - DNA, 15 bp, Homo sapiens
acctgccagggacag

SEQ ID NO: 1851277 - DNA, 16 bp, Homo sapiens
acctgccagggacaga

SEQ ID NO: 1851278 - DNA, 23 bp, Homo sapiens
acctgcctcccttcatgcatgga

SEQ ID NO: 1851279 - DNA, 18 bp, Homo sapiens
acctgcggtgctatctcc

SEQ ID NO: 1851280 - DNA, 11 bp, Homo sapiens
acctggcctca

SEQ ID NO: 1851281 - DNA, 20 bp, Homo sapiens
acctggcctctgcactcccc

SEQ ID NO: 1851282 - DNA, 23 bp, Homo sapiens
acctggcctctgcactcccctgc

SEQ ID NO: 1851283 - DNA, 16 bp, Homo sapiens
acctgtccccctgaca

SEQ ID NO: 1851284 - DNA, 19 bp, Homo sapiens
acctgttttctgaaacaca

SEQ ID NO: 1851285 - DNA, 21 bp, Homo sapiens
acctgttttctgaaacacacg

SEQ ID NO: 1851286 - DNA, 17 bp, Homo sapiens
accttagacagtccctg

SEQ ID NO: 1851287 - DNA, 12 bp, Homo sapiens
accttctccttc

SEQ ID NO: 1851288 - DNA, 22 bp, Homo sapiens
accttgtctgctaaataaacat

SEQ ID NO: 1851289 - DNA, 14 bp, Homo sapiens
acctttgtccccac

SEQ ID NO: 1851290 - DNA, 15 bp, Homo sapiens
acctttgtccccacc

SEQ ID NO: 1851291 - DNA, 19 bp, Homo sapiens
acgacaaggaaaggcaaat

SEQ ID NO: 1851292 - DNA, 15 bp, Homo sapiens
acgactgcccggcag

SEQ ID NO: 1851293 - DNA, 11 bp, Homo sapiens
acgcaggcccc

SEQ ID NO: 1851294 - DNA, 17 bp, Homo sapiens
acgcaggcccctctcct

SEQ ID NO: 1851295 - DNA, 20 bp, Homo sapiens
acgcaggcccctctcctccg

SEQ ID NO: 1851296 - DNA, 23 bp, Homo sapiens
acgcaggcccctctcctccgtgg

SEQ ID NO: 1851297 - DNA, 14 bp, Homo sapiens
acgcagtggccttc

SEQ ID NO: 1851298 - DNA, 12 bp, Homo sapiens
acgccacccagc

SEQ ID NO: 1851299 - DNA, 18 bp, Homo sapiens
acgccaggggaaaatcag

SEQ ID NO: 1851300 - DNA, 11 bp, Homo sapiens
acgccatccca

SEQ ID NO: 1851301 - DNA, 14 bp, Homo sapiens
acgccatcccagcc

SEQ ID NO: 1851302 - DNA, 16 bp, Homo sapiens
acgccatcccagcccc

SEQ ID NO: 1851303 - DNA, 17 bp, Homo sapiens
acgctacccgggaaggg

SEQ ID NO: 1851304 - DNA, 21 bp, Homo sapiens
acgctacccgggaagggggct

SEQ ID NO: 1851305 - DNA, 12 bp, Homo sapiens
acgctgtgctgc

SEQ ID NO: 1851306 - DNA, 15 bp, Homo sapiens
acggaagagccttgc

SEQ ID NO: 1851307 - DNA, 16 bp, Homo sapiens
acggaagagccttgcg

SEQ ID NO: 1851308 - DNA, 17 bp, Homo sapiens
acggacactcaaaagct

SEQ ID NO: 1851309 - DNA, 19 bp, Homo sapiens
acggacactcaaaagctgg

SEQ ID NO: 1851310 - DNA, 17 bp, Homo sapiens
acggccacggccacagt

SEQ ID NO: 1851311 - DNA, 15 bp, Homo sapiens
acggtaagtgttctc

SEQ ID NO: 1851312 - DNA, 21 bp, Homo sapiens
acggtggtcactggaactcag

SEQ ID NO: 1851313 - DNA, 15 bp, Homo sapiens
acggttttactgcag

SEQ ID NO: 1851314 - DNA, 12 bp, Homo sapiens
acgtctgtgcca

SEQ ID NO: 1851315 - DNA, 22 bp, Homo sapiens
acgtgattcaattcaacactcc

SEQ ID NO: 1851316 - DNA, 16 bp, Homo sapiens
acgtgggcaaacaggc

SEQ ID NO: 1851317 - DNA, 20 bp, Homo sapiens
acgttttataagcatcatta

SEQ ID NO: 1851318 - DNA, 15 bp, Homo sapiens
actaaactttcacac

SEQ ID NO: 1851319 - DNA, 22 bp, Homo sapiens
actaagtaatctcacagcattt

SEQ ID NO: 1851320 - DNA, 20 bp, Homo sapiens
actacaaaggtttaaatgaa

SEQ ID NO: 1851321 - DNA, 21 bp, Homo sapiens
actacaaaggtttaaatgaac

SEQ ID NO: 1851322 - DNA, 23 bp, Homo sapiens
actacaaaggtttaaatgaacaa

SEQ ID NO: 1851323 - DNA, 15 bp, Homo sapiens
actacagtcctccca

SEQ ID NO: 1851324 - DNA, 16 bp, Homo sapiens
actacagtcctcccat

SEQ ID NO: 1851325 - DNA, 14 bp, Homo sapiens
ataaatgcaaataa

SEQ ID NO: 1851326 - DNA, 14 bp, Homo sapiens
ataaattatttatt

SEQ ID NO: 1851327 - DNA, 20 bp, Homo sapiens
ataacaaatgccaaattaaa

SEQ ID NO: 1851328 - DNA, 21 bp, Homo sapiens
ataacaaatgccaaattaaaa

SEQ ID NO: 1851329 - DNA, 13 bp, Homo sapiens
ataacacacagct

SEQ ID NO: 1851330 - DNA, 23 bp, Homo sapiens
ataacatcgaaaagttattttgt

SEQ ID NO: 1851331 - DNA, 15 bp, Homo sapiens
ataaccacatttcta

SEQ ID NO: 1851332 - DNA, 22 bp, Homo sapiens
ataagaccaccacctcagagta

SEQ ID NO: 1851333 - DNA, 19 bp, Homo sapiens
ataagagggcacacactgt

SEQ ID NO: 1851334 - DNA, 17 bp, Homo sapiens
ataagcatcattattta

SEQ ID NO: 1851335 - DNA, 22 bp, Homo sapiens
ataagcccaacaagttgaagaa

SEQ ID NO: 1851336 - DNA, 22 bp, Homo sapiens
ataagtatactgggggcaaaat

SEQ ID NO: 1851337 - DNA, 13 bp, Homo sapiens
atgagcctggcaa

SEQ ID NO: 1851338 - DNA, 15 bp, Homo sapiens
atgagcgccacctct

SEQ ID NO: 1851339 - DNA, 20 bp, Homo sapiens
atgagggtatcaaataaaat

SEQ ID NO: 1851340 - DNA, 17 bp, Homo sapiens
atgagtgcgtgctcagt

SEQ ID NO: 1851341 - DNA, 16 bp, Homo sapiens
atgatacttcgacact

SEQ ID NO: 1851342 - DNA, 16 bp, Homo sapiens
atgatcctaggcattt

SEQ ID NO: 1851343 - DNA, 23 bp, Homo sapiens
atgatgtatgttgaagcctttgt

SEQ ID NO: 1851344 - DNA, 16 bp, Homo sapiens
atgatgtgcctgggtg

SEQ ID NO: 1851345 - DNA, 23 bp, Homo sapiens
atgattcacatgctaaagccagg

SEQ ID NO: 1851346 - DNA, 16 bp, Homo sapiens
atgatttttttttcca

SEQ ID NO: 1851347 - DNA, 14 bp, Homo sapiens
atgcacatccctgg

SEQ ID NO: 1851348 - DNA, 22 bp, Homo sapiens
atgcagacatgagtgcgtgctc

SEQ ID NO: 1851349 - DNA, 21 bp, Homo sapiens
atgcagacctcatgcccagct

SEQ ID NO: 1851350 - DNA, 18 bp, Homo sapiens
atgcagcctcacagtcct

SEQ ID NO: 1851351 - DNA, 13 bp, Homo sapiens
atgcagcgtgaag

SEQ ID NO: 1851352 - DNA, 19 bp, Homo sapiens
atgcaggaggtggagaaaa

SEQ ID NO: 1851353 - DNA, 16 bp, Homo sapiens
atgcatggaaattccc

SEQ ID NO: 1851354 - DNA, 18 bp, Homo sapiens
atgccaaattaaaaaaga

SEQ ID NO: 1851355 - DNA, 22 bp, Homo sapiens
atgccaaattaaaaaagataaa

SEQ ID NO: 1851356 - DNA, 16 bp, Homo sapiens
atgccaagttgtttga

SEQ ID NO: 1851357 - DNA, 23 bp, Homo sapiens
atgccatcctcaaacactgcagg

SEQ ID NO: 1851358 - DNA, 12 bp, Homo sapiens
atgcccaaggga

SEQ ID NO: 1851359 - DNA, 15 bp, Homo sapiens
atgcccaagggaaag

SEQ ID NO: 1851360 - DNA, 12 bp, Homo sapiens
atgcccagcccc

SEQ ID NO: 1851361 - DNA, 16 bp, Homo sapiens
atgcccagccccttct

SEQ ID NO: 1851362 - DNA, 19 bp, Homo sapiens
atgcctgagtgcctggcca

SEQ ID NO: 1851363 - DNA, 13 bp, Homo sapiens
atgcctggcttcg

SEQ ID NO: 1851364 - DNA, 14 bp, Homo sapiens
atgctcctggccca

SEQ ID NO: 1851365 - DNA, 20 bp, Homo sapiens
atgctgcagatttgggctgg

SEQ ID NO: 1851366 - DNA, 16 bp, Homo sapiens
atgctgccctgtgagt

SEQ ID NO: 1851367 - DNA, 13 bp, Homo sapiens
atgctttaaacat

SEQ ID NO: 1851368 - DNA, 14 bp, Homo sapiens
atgcttttccaaac

SEQ ID NO: 1851369 - DNA, 10 bp, Homo sapiens
atggaagtgt

SEQ ID NO: 1851370 - DNA, 21 bp, Homo sapiens
atggacccaatatttaccaga

SEQ ID NO: 1851371 - DNA, 21 bp, Homo sapiens
atggacggtgctccaggcagg

SEQ ID NO: 1851372 - DNA, 19 bp, Homo sapiens
atggactaacttgtctttg

SEQ ID NO: 1851373 - DNA, 17 bp, Homo sapiens
atggactcagccttgca

SEQ ID NO: 1851374 - DNA, 12 bp, Homo sapiens
atggactttgtt

SEQ ID NO: 1851375 - DNA, 23 bp, Homo sapiens
atggagagctggagcctggtgcc

SEQ ID NO: 1851376 - DNA, 13 bp, Homo sapiens
atggagccccacc

SEQ ID NO: 1851377 - DNA, 21 bp, Homo sapiens
atggagccccaccttgtctgc

SEQ ID NO: 1851378 - DNA, 17 bp, Homo sapiens
atggatgtccccagcag

SEQ ID NO: 1851379 - DNA, 17 bp, Homo sapiens
atggcaggatggcctgg

SEQ ID NO: 1851380 - DNA, 22 bp, Homo sapiens
atggcaggatggcctggccagg

SEQ ID NO: 1851381 - DNA, 12 bp, Homo sapiens
atggcctggcca

SEQ ID NO: 1851382 - DNA, 15 bp, Homo sapiens
atggcgtctgctctg

SEQ ID NO: 1851383 - DNA, 17 bp, Homo sapiens
atggcgtctgctctggt

SEQ ID NO: 1851384 - DNA, 18 bp, Homo sapiens
atggcttatccagctggt

SEQ ID NO: 1851385 - DNA, 14 bp, Homo sapiens
atgggcagagcaga

SEQ ID NO: 1851386 - DNA, 16 bp, Homo sapiens
atggggagggagggag

SEQ ID NO: 1851387 - DNA, 12 bp, Homo sapiens
atggggctgcac

SEQ ID NO: 1851388 - DNA, 11 bp, Homo sapiens
atgggggaaag

SEQ ID NO: 1851389 - DNA, 18 bp, Homo sapiens
atgggtcgggagagggga

SEQ ID NO: 1851390 - DNA, 15 bp, Homo sapiens
atgggtgcttggagg

SEQ ID NO: 1851391 - DNA, 21 bp, Homo sapiens
atgggtgcttggaggaaggaa

SEQ ID NO: 1851392 - DNA, 22 bp, Homo sapiens
atgggttagggaaaacattcca

SEQ ID NO: 1851393 - DNA, 13 bp, Homo sapiens
atggtaggggagg

SEQ ID NO: 1851394 - DNA, 17 bp, Homo sapiens
atgtaatagaagcttaa

SEQ ID NO: 1851395 - DNA, 22 bp, Homo sapiens
atgtagttttgtgatgcatttt

SEQ ID NO: 1851396 - DNA, 17 bp, Homo sapiens
atgtattgtgcaatgtg

SEQ ID NO: 1851397 - DNA, 19 bp, Homo sapiens
atgtattgtgcaatgtgta

SEQ ID NO: 1851398 - DNA, 22 bp, Homo sapiens
atgtatttgcaaggctgattta

SEQ ID NO: 1851399 - DNA, 13 bp, Homo sapiens
atgtattttatgt

SEQ ID NO: 1851400 - DNA, 18 bp, Homo sapiens
atgtattttatgttatat

SEQ ID NO: 1851401 - DNA, 23 bp, Homo sapiens
atgtcacagtccaaccagaaaca

SEQ ID NO: 1851402 - DNA, 16 bp, Homo sapiens
atgtccaagaagccca

SEQ ID NO: 1851403 - DNA, 23 bp, Homo sapiens
atgtccaagaagcccaggaaagg

SEQ ID NO: 1851404 - DNA, 15 bp, Homo sapiens
atgtcctcaccacat

SEQ ID NO: 1851405 - DNA, 21 bp, Homo sapiens
atgtcttcatacctacatgta

SEQ ID NO: 1851406 - DNA, 21 bp, Homo sapiens
atgtgacttggattcaatttt

SEQ ID NO: 1851407 - DNA, 19 bp, Homo sapiens
atgtgcatttaattagaaa

SEQ ID NO: 1851408 - DNA, 14 bp, Homo sapiens
atgtgccttttctg

SEQ ID NO: 1851409 - DNA, 14 bp, Homo sapiens
atgtgtataaacaa

SEQ ID NO: 1851410 - DNA, 15 bp, Homo sapiens
atgtgtataaacaag

SEQ ID NO: 1851411 - DNA, 22 bp, Homo sapiens
atgttaatattttaggtgtaaa

SEQ ID NO: 1851412 - DNA, 14 bp, Homo sapiens
atgttatatataaa

SEQ ID NO: 1851413 - DNA, 18 bp, Homo sapiens
atgttatatataaatata

SEQ ID NO: 1851414 - DNA, 22 bp, Homo sapiens
atgttatgaacagctgtgtctg

SEQ ID NO: 1851415 - DNA, 15 bp, Homo sapiens
atgttccattaaacg

SEQ ID NO: 1851416 - DNA, 17 bp, Homo sapiens
atgttctctcttctcca

SEQ ID NO: 1851417 - DNA, 15 bp, Homo sapiens
atgttgaagcctttg

SEQ ID NO: 1851418 - DNA, 16 bp, Homo sapiens
atgttgaagcctttgt

SEQ ID NO: 1851419 - DNA, 12 bp, Homo sapiens
atgttggctggg

SEQ ID NO: 1851420 - DNA, 13 bp, Homo sapiens
atgttggctggga

SEQ ID NO: 1851421 - DNA, 18 bp, Homo sapiens
atgtttagactttaacat

SEQ ID NO: 1851422 - DNA, 19 bp, Homo sapiens
atgttttccagctcctcat

SEQ ID NO: 1851423 - DNA, 18 bp, Homo sapiens
atgtttttcttctccctc

SEQ ID NO: 1851424 - DNA, 13 bp, Homo sapiens
attaaaaaagata

SEQ ID NO: 1851425 - DNA, 17 bp, Homo sapiens
attaaaaaagataaaca

SEQ ID NO: 1851426 - DNA, 15 bp, Homo sapiens
attaaacgattttta

SEQ ID NO: 1851427 - DNA, 21 bp, Homo sapiens
attaaacgatttttaaaatgt

SEQ ID NO: 1851428 - DNA, 16 bp, Homo sapiens
attaaagaaaaaaatg

SEQ ID NO: 1851429 - DNA, 13 bp, Homo sapiens
attaaataaaatt

SEQ ID NO: 1851430 - DNA, 20 bp, Homo sapiens
attaaataaaatttttatgt

SEQ ID NO: 1851431 - DNA, 17 bp, Homo sapiens
attaaatgcccagcccc

SEQ ID NO: 1851432 - DNA, 15 bp, Homo sapiens
attaacaaattgcat

SEQ ID NO: 1851433 - DNA, 13 bp, Homo sapiens
attaaggaagaca

SEQ ID NO: 1851434 - DNA, 17 bp, Homo sapiens
attaagtatctgacatc

SEQ ID NO: 1851435 - DNA, 21 bp, Homo sapiens
attacaccaccggccccctcc

SEQ ID NO: 1851436 - DNA, 13 bp, Homo sapiens
attacttgtaaat

SEQ ID NO: 1851437 - DNA, 21 bp, Homo sapiens
attatatttcacccatctctc

SEQ ID NO: 1851438 - DNA, 20 bp, Homo sapiens
attatcacattaatctcaaa

SEQ ID NO: 1851439 - DNA, 17 bp, Homo sapiens
attatctcacttgtgcc

SEQ ID NO: 1851440 - DNA, 13 bp, Homo sapiens
attatgttaatat

SEQ ID NO: 1851441 - DNA, 14 bp, Homo sapiens
attatgttaatatt

SEQ ID NO: 1851442 - DNA, 16 bp, Homo sapiens
attatgttaatatttc

SEQ ID NO: 1851443 - DNA, 17 bp, Homo sapiens
attatgttaatatttct

SEQ ID NO: 1851444 - DNA, 22 bp, Homo sapiens
attattacttgtaaatataaag

SEQ ID NO: 1851445 - DNA, 15 bp, Homo sapiens
attattattaattac

SEQ ID NO: 1851446 - DNA, 17 bp, Homo sapiens
attattgatgttttcat

SEQ ID NO: 1851447 - DNA, 11 bp, Homo sapiens
attcacactgt

SEQ ID NO: 1851448 - DNA, 21 bp, Homo sapiens
attcactcatacatctggccg

SEQ ID NO: 1851449 - DNA, 13 bp, Homo sapiens
attcagacagctg

SEQ ID NO: 1851450 - DNA, 17 bp, Homo sapiens
attcagacagctgcctg

SEQ ID NO: 1851451 - DNA, 18 bp, Homo sapiens
attcagacagctgcctgg

SEQ ID NO: 1851452 - DNA, 18 bp, Homo sapiens
attcagctctgcaagaat

SEQ ID NO: 1851453 - DNA, 22 bp, Homo sapiens
attcaggaagcagctttcccca

SEQ ID NO: 1851454 - DNA, 13 bp, Homo sapiens
attcaggaagctc

SEQ ID NO: 1851455 - DNA, 21 bp, Homo sapiens
attcattctttttgaaatgtc

SEQ ID NO: 1851456 - DNA, 17 bp, Homo sapiens
attccagtcccctttct

SEQ ID NO: 1851457 - DNA, 21 bp, Homo sapiens
attccattctggaagtgactt

SEQ ID NO: 1851458 - DNA, 18 bp, Homo sapiens
attccccactcagccttt

SEQ ID NO: 1851459 - DNA, 19 bp, Homo sapiens
attccccaggaggccagcc

SEQ ID NO: 1851460 - DNA, 22 bp, Homo sapiens
attccccaggaggccagccttg

SEQ ID NO: 1851461 - DNA, 23 bp, Homo sapiens
attccccgtctctggttcctccc

SEQ ID NO: 1851462 - DNA, 19 bp, Homo sapiens
attcctcatttgttcatta

SEQ ID NO: 1851463 - DNA, 16 bp, Homo sapiens
attctaacgcaaaaat

SEQ ID NO: 1851464 - DNA, 20 bp, Homo sapiens
attctaacgcaaaaatagct

SEQ ID NO: 1851465 - DNA, 18 bp, Homo sapiens
attctccacctgccaggg

SEQ ID NO: 1851466 - DNA, 21 bp, Homo sapiens
attctccacctgccagggaca

SEQ ID NO: 1851467 - DNA, 20 bp, Homo sapiens
attcttggttggctggcctt

SEQ ID NO: 1851468 - DNA, 11 bp, Homo sapiens
attctttcctg

SEQ ID NO: 1851469 - DNA, 13 bp, Homo sapiens
attctttcctgag

SEQ ID NO: 1851470 - DNA, 17 bp, Homo sapiens
attctttcctgaggctg

SEQ ID NO: 1851471 - DNA, 16 bp, Homo sapiens
attctttgttctgttt

SEQ ID NO: 1851472 - DNA, 21 bp, Homo sapiens
attgctactacttacctacca

SEQ ID NO: 1851473 - DNA, 18 bp, Homo sapiens
attgcttgagctcaggag

SEQ ID NO: 1851474 - DNA, 22 bp, Homo sapiens
attggctgaactcatgagaagt

SEQ ID NO: 1851475 - DNA, 23 bp, Homo sapiens
attggctttgggttgcaggacct

SEQ ID NO: 1851476 - DNA, 14 bp, Homo sapiens
attggtctcctctc

SEQ ID NO: 1851477 - DNA, 18 bp, Homo sapiens
attggtgtttttttctat

SEQ ID NO: 1851478 - DNA, 20 bp, Homo sapiens
attgtagcgtctttcttttt

SEQ ID NO: 1851479 - DNA, 15 bp, Homo sapiens
attgtcatcaggaga

SEQ ID NO: 1851480 - DNA, 20 bp, Homo sapiens
attgtccccgacccttgccg

SEQ ID NO: 1851481 - DNA, 18 bp, Homo sapiens
attgtgcaatgtgtataa

SEQ ID NO: 1851482 - DNA, 15 bp, Homo sapiens
attgtggaaaaccag

SEQ ID NO: 1851483 - DNA, 14 bp, Homo sapiens
attgtggtgccaca

SEQ ID NO: 1851484 - DNA, 18 bp, Homo sapiens
atttaaaacaagacttca

SEQ ID NO: 1851485 - DNA, 20 bp, Homo sapiens
atttagcacccttctgctgt

SEQ ID NO: 1851486 - DNA, 20 bp, Homo sapiens
atttagcattgtagtgcttt

SEQ ID NO: 1851487 - DNA, 21 bp, Homo sapiens
atttagggaaaggtagtgtat

SEQ ID NO: 1851488 - DNA, 19 bp, Homo sapiens
atttatgtattgtgcaatg

SEQ ID NO: 1851489 - DNA, 12 bp, Homo sapiens
atttattaaaga

SEQ ID NO: 1851490 - DNA, 14 bp, Homo sapiens
atttattaaagaaa

SEQ ID NO: 1851491 - DNA, 16 bp, Homo sapiens
atttattaaagaaaaa

SEQ ID NO: 1851492 - DNA, 14 bp, Homo sapiens
atttattcattagt

SEQ ID NO: 1851493 - DNA, 22 bp, Homo sapiens
atttcaaaaacatgcttttcca

SEQ ID NO: 1851494 - DNA, 16 bp, Homo sapiens
atttcaaacggcctca

SEQ ID NO: 1851495 - DNA, 20 bp, Homo sapiens
atttccagtgaaatcagtta

SEQ ID NO: 1851496 - DNA, 15 bp, Homo sapiens
atttccctctgatat

SEQ ID NO: 1851497 - DNA, 22 bp, Homo sapiens
atttcctcatgtgatcacaatt

SEQ ID NO: 1851498 - DNA, 14 bp, Homo sapiens
atttctaagccttt

SEQ ID NO: 1851499 - DNA, 17 bp, Homo sapiens
atttgaagatttaatta

SEQ ID NO: 1851500 - DNA, 18 bp, Homo sapiens
atttgaaggtagaatgtt

SEQ ID NO: 1851501 - DNA, 21 bp, Homo sapiens
atttgagatgtatttcaactt

SEQ ID NO: 1851502 - DNA, 21 bp, Homo sapiens
atttgtattatgttccaaggc

SEQ ID NO: 1851503 - DNA, 12 bp, Homo sapiens
atttgtttgcat

SEQ ID NO: 1851504 - DNA, 18 bp, Homo sapiens
attttagctactatatat

SEQ ID NO: 1851505 - DNA, 20 bp, Homo sapiens
attttataaatcgcttttga

SEQ ID NO: 1851506 - DNA, 23 bp, Homo sapiens
attttataaatcgcttttgataa

SEQ ID NO: 1851507 - DNA, 17 bp, Homo sapiens
attttatgctttaaaca

SEQ ID NO: 1851508 - DNA, 18 bp, Homo sapiens
attttatgctttaaacat

SEQ ID NO: 1851509 - DNA, 15 bp, Homo sapiens
attttatgttatata

SEQ ID NO: 1851510 - DNA, 17 bp, Homo sapiens
attttatgttatatata

SEQ ID NO: 1851511 - DNA, 18 bp, Homo sapiens
attttatgttatatataa

SEQ ID NO: 1851512 - DNA, 12 bp, Homo sapiens
atttttctaact

SEQ ID NO: 1851513 - DNA, 15 bp, Homo sapiens
atttttggcaaagcc

SEQ ID NO: 1851514 - DNA, 16 bp, Homo sapiens
caaaaatagctcttgc

SEQ ID NO: 1851515 - DNA, 19 bp, Homo sapiens
caaaaatttgcttcactca

SEQ ID NO: 1851516 - DNA, 15 bp, Homo sapiens
caaaacggttttact

SEQ ID NO: 1851517 - DNA, 16 bp, Homo sapiens
caaaactctcctctgc

SEQ ID NO: 1851518 - DNA, 19 bp, Homo sapiens
caaaactctcctctgctgc

SEQ ID NO: 1851519 - DNA, 21 bp, Homo sapiens
caaacccagaggtggatgtta

SEQ ID NO: 1851520 - DNA, 12 bp, Homo sapiens
caaacctgcctg

SEQ ID NO: 1851521 - DNA, 13 bp, Homo sapiens
caaacctgcctgg

SEQ ID NO: 1851522 - DNA, 19 bp, Homo sapiens
caaactctttggtcgtttt

SEQ ID NO: 1851523 - DNA, 15 bp, Homo sapiens
caaagcagggtctgg

SEQ ID NO: 1851524 - DNA, 17 bp, Homo sapiens
caaagcctcctccagcc

SEQ ID NO: 1851525 - DNA, 19 bp, Homo sapiens
caaaggccatggagagctg

SEQ ID NO: 1851526 - DNA, 20 bp, Homo sapiens
caaaggccatggagagctgg

SEQ ID NO: 1851527 - DNA, 23 bp, Homo sapiens
caaaggctgagaacactgtgaaa

SEQ ID NO: 1851528 - DNA, 13 bp, Homo sapiens
caaaggtttaaat

SEQ ID NO: 1851529 - DNA, 16 bp, Homo sapiens
caaaggtttaaatgaa

SEQ ID NO: 1851530 - DNA, 22 bp, Homo sapiens
caaagtcatgcaaaggctggga

SEQ ID NO: 1851531 - DNA, 14 bp, Homo sapiens
caaatcaaagcaga

SEQ ID NO: 1851532 - DNA, 15 bp, Homo sapiens
caaatcaaagcagat

SEQ ID NO: 1851533 - DNA, 15 bp, Homo sapiens
caaatcactgaactt

SEQ ID NO: 1851534 - DNA, 18 bp, Homo sapiens
caaatgcccaagggaaag

SEQ ID NO: 1851535 - DNA, 21 bp, Homo sapiens
caaatgctgacccatgcaata

SEQ ID NO: 1851536 - DNA, 15 bp, Homo sapiens
caaatggaagacaca

SEQ ID NO: 1851537 - DNA, 15 bp, Homo sapiens
caaatgtcttcctgg

SEQ ID NO: 1851538 - DNA, 18 bp, Homo sapiens
caacaagttgaagaagct

SEQ ID NO: 1851539 - DNA, 18 bp, Homo sapiens
caacactcattgacctga

SEQ ID NO: 1851540 - DNA, 22 bp, Homo sapiens
caacactcattgacctgaggcc

SEQ ID NO: 1851541 - DNA, 14 bp, Homo sapiens
caacatactcccat

SEQ ID NO: 1851542 - DNA, 19 bp, Homo sapiens
caacatactcccatctgtg

SEQ ID NO: 1851543 - DNA, 20 bp, Homo sapiens
caacatactcccatctgtga

SEQ ID NO: 1851544 - DNA, 22 bp, Homo sapiens
caaccagcatcccttgaccagg

SEQ ID NO: 1851545 - DNA, 19 bp, Homo sapiens
caaccagggccccggggcc

SEQ ID NO: 1851546 - DNA, 22 bp, Homo sapiens
caacccattgttgtcaaggaag

SEQ ID NO: 1851547 - DNA, 17 bp, Homo sapiens
caaccctggcacccagg

SEQ ID NO: 1851548 - DNA, 19 bp, Homo sapiens
caacctgattgtgtctctt

SEQ ID NO: 1851549 - DNA, 14 bp, Homo sapiens
caacgtctgtgcca

SEQ ID NO: 1851550 - DNA, 18 bp, Homo sapiens
caactcaccccagcccca

SEQ ID NO: 1851551 - DNA, 23 bp, Homo sapiens
caactgaaggggtgcacccacct

SEQ ID NO: 1851552 - DNA, 18 bp, Homo sapiens
caacttcttcagagctga

SEQ ID NO: 1851553 - DNA, 19 bp, Homo sapiens
caagaaaaataaagaaaag

SEQ ID NO: 1851554 - DNA, 22 bp, Homo sapiens
caagaaaaataaagaaaagatg

SEQ ID NO: 1851555 - DNA, 12 bp, Homo sapiens
caagaaatggcg

SEQ ID NO: 1851556 - DNA, 15 bp, Homo sapiens
caagaagcccaggaa

SEQ ID NO: 1851557 - DNA, 12 bp, Homo sapiens
caagaaggattt

SEQ ID NO: 1851558 - DNA, 22 bp, Homo sapiens
caagaattgaagcaggactaaa

SEQ ID NO: 1851559 - DNA, 13 bp, Homo sapiens
caagacacccaag

SEQ ID NO: 1851560 - DNA, 23 bp, Homo sapiens
caagaccttctccttcacctttg

SEQ ID NO: 1851561 - DNA, 16 bp, Homo sapiens
caagacgctgtgctgc

SEQ ID NO: 1851562 - DNA, 21 bp, Homo sapiens
caagacgctgtgctgccctgc

SEQ ID NO: 1851563 - DNA, 13 bp, Homo sapiens
caagacttcagat

SEQ ID NO: 1851564 - DNA, 14 bp, Homo sapiens
caagagaagcattc

SEQ ID NO: 1851565 - DNA, 22 bp, Homo sapiens
caagagaagcattctcattgga

SEQ ID NO: 1851566 - DNA, 13 bp, Homo sapiens
caagagcacactt

SEQ ID NO: 1851567 - DNA, 14 bp, Homo sapiens
caagagcacacttg

SEQ ID NO: 1851568 - DNA, 14 bp, Homo sapiens
caagaggagatcca

SEQ ID NO: 1851569 - DNA, 13 bp, Homo sapiens
caagcactgtgct

SEQ ID NO: 1851570 - DNA, 22 bp, Homo sapiens
caagccaccaacatactcccat

SEQ ID NO: 1851571 - DNA, 12 bp, Homo sapiens
caagctccaagc

SEQ ID NO: 1851572 - DNA, 13 bp, Homo sapiens
caagctcccaagg

SEQ ID NO: 1851573 - DNA, 22 bp, Homo sapiens
caagctcccaagggatggtgcc

SEQ ID NO: 1851574 - DNA, 21 bp, Homo sapiens
caagctgcaccctcaggcagg

SEQ ID NO: 1851575 - DNA, 22 bp, Homo sapiens
caagctgcaccctcaggcaggt

SEQ ID NO: 1851576 - DNA, 18 bp, Homo sapiens
caaggaaaccacagctgc

SEQ ID NO: 1851577 - DNA, 17 bp, Homo sapiens
caaggctgtgctccctg

SEQ ID NO: 1851578 - DNA, 16 bp, Homo sapiens
caagggcctggcctga

SEQ ID NO: 1851579 - DNA, 12 bp, Homo sapiens
caaggtgggagg

SEQ ID NO: 1851580 - DNA, 13 bp, Homo sapiens
caagtcaagtgaa

SEQ ID NO: 1851581 - DNA, 22 bp, Homo sapiens
caagtgaaaaaggaggaagaga

SEQ ID NO: 1851582 - DNA, 19 bp, Homo sapiens
caagtgagaccctgtctca

SEQ ID NO: 1851583 - DNA, 19 bp, Homo sapiens
caagtgattgggacagagg

SEQ ID NO: 1851584 - DNA, 18 bp, Homo sapiens
caagtggcagagcttgga

SEQ ID NO: 1851585 - DNA, 13 bp, Homo sapiens
caagttgaagaag

SEQ ID NO: 1851586 - DNA, 17 bp, Homo sapiens
caagttgtttgagaaat

SEQ ID NO: 1851587 - DNA, 15 bp, Homo sapiens
caataacacacagct

SEQ ID NO: 1851588 - DNA, 19 bp, Homo sapiens
caatacctggcctcattta

SEQ ID NO: 1851589 - DNA, 23 bp, Homo sapiens
caatactaggaagtaaagtgaag

SEQ ID NO: 1851590 - DNA, 18 bp, Homo sapiens
caatagtaattctcaggc

SEQ ID NO: 1851591 - DNA, 14 bp, Homo sapiens
caatatttcctcat

SEQ ID NO: 1851592 - DNA, 16 bp, Homo sapiens
caatctggattcatat

SEQ ID NO: 1851593 - DNA, 12 bp, Homo sapiens
caatgagcatgt

SEQ ID NO: 1851594 - DNA, 14 bp, Homo sapiens
caatgagcatgttt

SEQ ID NO: 1851595 - DNA, 18 bp, Homo sapiens
caatgagcatgtttagac

SEQ ID NO: 1851596 - DNA, 18 bp, Homo sapiens
caatgccatcctcaaaca

SEQ ID NO: 1851597 - DNA, 15 bp, Homo sapiens
caatgtgataaaacc

SEQ ID NO: 1851598 - DNA, 14 bp, Homo sapiens
caatgttctctctt

SEQ ID NO: 1851599 - DNA, 23 bp, Homo sapiens
caattaaggattttatgctttaa

SEQ ID NO: 1851600 - DNA, 22 bp, Homo sapiens
caattatttgaagatttaatta

SEQ ID NO: 1851601 - DNA, 17 bp, Homo sapiens
caattcttccctatctt

SEQ ID NO: 1851602 - DNA, 17 bp, Homo sapiens
caattttaaaatgaaat

SEQ ID NO: 1851603 - DNA, 22 bp, Homo sapiens
caattttaaaatgaaatgcatt

SEQ ID NO: 1851604 - DNA, 24 bp, Homo sapiens
caattttaaaatgaaatgcatttt

SEQ ID NO: 1851605 - DNA, 15 bp, Homo sapiens
cacaaacctgcctgg

SEQ ID NO: 1851606 - DNA, 16 bp, Homo sapiens
cacaagacccttgtgg

SEQ ID NO: 1851607 - DNA, 22 bp, Homo sapiens
cacaagattggtgtttttttct

SEQ ID NO: 1851608 - DNA, 14 bp, Homo sapiens
cacaagctccaagc

SEQ ID NO: 1851609 - DNA, 15 bp, Homo sapiens
cacaagctccaagct

SEQ ID NO: 1851610 - DNA, 23 bp, Homo sapiens
cacaagctccaagctcccaggca

SEQ ID NO: 1851611 - DNA, 23 bp, Homo sapiens
cacaagctgcaccctcaggcagg

SEQ ID NO: 1851612 - DNA, 14 bp, Homo sapiens
cacacaggacagcg

SEQ ID NO: 1851613 - DNA, 19 bp, Homo sapiens
cacacggtttgaagcctgg

SEQ ID NO: 1851614 - DNA, 19 bp, Homo sapiens
cacactgggacttgcaaaa

SEQ ID NO: 1851615 - DNA, 21 bp, Homo sapiens
cacactgggtgcgtctccagt

SEQ ID NO: 1851616 - DNA, 15 bp, Homo sapiens
cacactgtggcctga

SEQ ID NO: 1851617 - DNA, 13 bp, Homo sapiens
cacagaccctgcc

SEQ ID NO: 1851618 - DNA, 14 bp, Homo sapiens
cacagaccctgccc

SEQ ID NO: 1851619 - DNA, 17 bp, Homo sapiens
cacagaccctgccctgt

SEQ ID NO: 1851620 - DNA, 17 bp, Homo sapiens
cacagatgaaacacaaa

SEQ ID NO: 1851621 - DNA, 20 bp, Homo sapiens
cacagatgggtgcttggagg

SEQ ID NO: 1851622 - DNA, 23 bp, Homo sapiens
cacagatgggtgcttggaggaag

SEQ ID NO: 1851623 - DNA, 11 bp, Homo sapiens
cacagcctctg

SEQ ID NO: 1851624 - DNA, 12 bp, Homo sapiens
cacagctgctgg

SEQ ID NO: 1851625 - DNA, 15 bp, Homo sapiens
cacagctgctggaga

SEQ ID NO: 1851626 - DNA, 17 bp, Homo sapiens
cacaggctccaaactgg

SEQ ID NO: 1851627 - DNA, 19 bp, Homo sapiens
cacaggctccaaactggag

SEQ ID NO: 1851628 - DNA, 17 bp, Homo sapiens
cacaggcttctgagcag

SEQ ID NO: 1851629 - DNA, 19 bp, Homo sapiens
cacagtattgctcacccag

SEQ ID NO: 1851630 - DNA, 19 bp, Homo sapiens
cacagtcatggtggccacg

SEQ ID NO: 1851631 - DNA, 22 bp, Homo sapiens
cacagtccttaccagcagagca

SEQ ID NO: 1851632 - DNA, 19 bp, Homo sapiens
cacatcacccatgttgaga

SEQ ID NO: 1851633 - DNA, 17 bp, Homo sapiens
cacatgagcatcaggcc

SEQ ID NO: 1851634 - DNA, 18 bp, Homo sapiens
cacatgagcatcaggcca

SEQ ID NO: 1851635 - DNA, 19 bp, Homo sapiens
cacatgagcatcaggccag

SEQ ID NO: 1851636 - DNA, 20 bp, Homo sapiens
cacatgagcatcaggccagg

SEQ ID NO: 1851637 - DNA, 17 bp, Homo sapiens
cacatgatttgggctct

SEQ ID NO: 1851638 - DNA, 18 bp, Homo sapiens
cacatgcggagaacaaat

SEQ ID NO: 1851639 - DNA, 18 bp, Homo sapiens
cacatgctaaagccagga

SEQ ID NO: 1851640 - DNA, 19 bp, Homo sapiens
cacatgtccaagaagccca

SEQ ID NO: 1851641 - DNA, 21 bp, Homo sapiens
cacatgtccaagaagcccagg

SEQ ID NO: 1851642 - DNA, 23 bp, Homo sapiens
cacatgtccaagaagcccaggaa

SEQ ID NO: 1851643 - DNA, 15 bp, Homo sapiens
cacattaatctcaaa

SEQ ID NO: 1851644 - DNA, 16 bp, Homo sapiens
cacattaatctcaaag

SEQ ID NO: 1851645 - DNA, 17 bp, Homo sapiens
cacattaatctcaaaga

SEQ ID NO: 1851646 - DNA, 19 bp, Homo sapiens
cacattaatctcaaagaga

SEQ ID NO: 1851647 - DNA, 19 bp, Homo sapiens
cacattccttgcctgcaca

SEQ ID NO: 1851648 - DNA, 16 bp, Homo sapiens
cacatttaagagacag

SEQ ID NO: 1851649 - DNA, 15 bp, Homo sapiens
cacatttctaagcct

SEQ ID NO: 1851650 - DNA, 16 bp, Homo sapiens
cacatttctaagcctt

SEQ ID NO: 1851651 - DNA, 17 bp, Homo sapiens
caccaacgtctgtgcca

SEQ ID NO: 1851652 - DNA, 16 bp, Homo sapiens
caccaagctcaaagcg

SEQ ID NO: 1851653 - DNA, 23 bp, Homo sapiens
caccaagttggaacatccttgga

SEQ ID NO: 1851654 - DNA, 14 bp, Homo sapiens
caccaccacccttg

SEQ ID NO: 1851655 - DNA, 12 bp, Homo sapiens
caccagcagcct

SEQ ID NO: 1851656 - DNA, 15 bp, Homo sapiens
caccagcagcctgga

SEQ ID NO: 1851657 - DNA, 17 bp, Homo sapiens
caccagggcctggctgg

SEQ ID NO: 1851658 - DNA, 18 bp, Homo sapiens
caccataggtcaccttta

SEQ ID NO: 1851659 - DNA, 14 bp, Homo sapiens
caccatcaagccac

SEQ ID NO: 1851660 - DNA, 19 bp, Homo sapiens
caccatcaagccaccaaca

SEQ ID NO: 1851661 - DNA, 17 bp, Homo sapiens
cacccaagggcctggcc

SEQ ID NO: 1851662 - DNA, 18 bp, Homo sapiens
cacccaagggcctggcct

SEQ ID NO: 1851663 - DNA, 19 bp, Homo sapiens
cacccaagggcctggcctg

SEQ ID NO: 1851664 - DNA, 20 bp, Homo sapiens
cacccaagggcctggcctga

SEQ ID NO: 1851665 - DNA, 21 bp, Homo sapiens
cacccaagggcctggcctgag

SEQ ID NO: 1851666 - DNA, 19 bp, Homo sapiens
cacccacctgttttctgaa

SEQ ID NO: 1851667 - DNA, 23 bp, Homo sapiens
cacccagtgccctctcccctcag

SEQ ID NO: 1851668 - DNA, 17 bp, Homo sapiens
cacccatgcagctgctc

SEQ ID NO: 1851669 - DNA, 22 bp, Homo sapiens
cacccatgttgagacctcagct

SEQ ID NO: 1851670 - DNA, 22 bp, Homo sapiens
cacccccacccaagggcctggc

SEQ ID NO: 1851671 - DNA, 15 bp, Homo sapiens
caccccggccacctg

SEQ ID NO: 1851672 - DNA, 17 bp, Homo sapiens
caccccggccacctgcg

SEQ ID NO: 1851673 - DNA, 20 bp, Homo sapiens
cacccctcaacacctctgca

SEQ ID NO: 1851674 - DNA, 16 bp, Homo sapiens
caccctcatgctgtgt

SEQ ID NO: 1851675 - DNA, 11 bp, Homo sapiens
caccctgtgat

SEQ ID NO: 1851676 - DNA, 18 bp, Homo sapiens
caccctgtgatggggccc

SEQ ID NO: 1851677 - DNA, 15 bp, Homo sapiens
caccgcagacaggac

SEQ ID NO: 1851678 - DNA, 17 bp, Homo sapiens
caccgcagacaggacca

SEQ ID NO: 1851679 - DNA, 21 bp, Homo sapiens
caccgcagacaggaccaggga

SEQ ID NO: 1851680 - DNA, 15 bp, Homo sapiens
cacctaagtctctgt

SEQ ID NO: 1851681 - DNA, 16 bp, Homo sapiens
cacctaagtctctgtg

SEQ ID NO: 1851682 - DNA, 17 bp, Homo sapiens
cacctaagtctctgtga

SEQ ID NO: 1851683 - DNA, 21 bp, Homo sapiens
cacctacaaggagataagaaa

SEQ ID NO: 1851684 - DNA, 13 bp, Homo sapiens
cacctagctgaat

SEQ ID NO: 1851685 - DNA, 23 bp, Homo sapiens
cacctagctgaatgtttttctaa

SEQ ID NO: 1851686 - DNA, 15 bp, Homo sapiens
cacctctctcactcc

SEQ ID NO: 1851687 - DNA, 18 bp, Homo sapiens
cacctctctcactccttg

SEQ ID NO: 1851688 - DNA, 18 bp, Homo sapiens
cacctctgcacaagctgc

SEQ ID NO: 1851689 - DNA, 11 bp, Homo sapiens
cacctgccagg

SEQ ID NO: 1851690 - DNA, 12 bp, Homo sapiens
cacctgccaggg

SEQ ID NO: 1851691 - DNA, 20 bp, Homo sapiens
cacctgcggtgctatctccc

SEQ ID NO: 1851692 - DNA, 23 bp, Homo sapiens
cacctggcctctgcactcccctg

SEQ ID NO: 1851693 - DNA, 16 bp, Homo sapiens
cacctgttttctgaaa

SEQ ID NO: 1851694 - DNA, 23 bp, Homo sapiens
caccttagacagtccctgccaat

SEQ ID NO: 1851695 - DNA, 12 bp, Homo sapiens
caccttggaagg

SEQ ID NO: 1851696 - DNA, 13 bp, Homo sapiens
caccttggaaggg

SEQ ID NO: 1851697 - DNA, 22 bp, Homo sapiens
caccttgtctgctaaataaaca

SEQ ID NO: 1851698 - DNA, 14 bp, Homo sapiens
cacctttattctgg

SEQ ID NO: 1851699 - DNA, 22 bp, Homo sapiens
cacctttcagataactgttatt

SEQ ID NO: 1851700 - DNA, 17 bp, Homo sapiens
cacctttgtccccaccg

SEQ ID NO: 1851701 - DNA, 17 bp, Homo sapiens
cacgactgcccggcagg

SEQ ID NO: 1851702 - DNA, 19 bp, Homo sapiens
cacgagcaaacccagaggt

SEQ ID NO: 1851703 - DNA, 21 bp, Homo sapiens
cacgagcaaacccagaggtgg

SEQ ID NO: 1851704 - DNA, 22 bp, Homo sapiens
cacgagcaaacccagaggtgga

SEQ ID NO: 1851705 - DNA, 20 bp, Homo sapiens
cacgccagattctttcctga

SEQ ID NO: 1851706 - DNA, 12 bp, Homo sapiens
cacggctgctga

SEQ ID NO: 1851707 - DNA, 13 bp, Homo sapiens
cacggctgctgag

SEQ ID NO: 1851708 - DNA, 18 bp, Homo sapiens
cacgtggaggagcagtgc

SEQ ID NO: 1851709 - DNA, 20 bp, Homo sapiens
cacgtggaggagcagtgcag

SEQ ID NO: 1851710 - DNA, 15 bp, Homo sapiens
cactcaaaagctggg

SEQ ID NO: 1851711 - DNA, 20 bp, Homo sapiens
cactcaagaagcaggctaca

SEQ ID NO: 1851712 - DNA, 22 bp, Homo sapiens
cactcattgacctgaggccctt

SEQ ID NO: 1851713 - DNA, 15 bp, Homo sapiens
cactcccctgctggg

SEQ ID NO: 1851714 - DNA, 12 bp, Homo sapiens
cactccctgcaa

SEQ ID NO: 1851715 - DNA, 17 bp, Homo sapiens
cactccctgcaacctga

SEQ ID NO: 1851716 - DNA, 22 bp, Homo sapiens
cactcccttcccatgacccagg

SEQ ID NO: 1851717 - DNA, 21 bp, Homo sapiens
cactccttcacagatgggtgc

SEQ ID NO: 1851718 - DNA, 22 bp, Homo sapiens
cactcgtgtgcaacagacaagt

SEQ ID NO: 1851719 - DNA, 14 bp, Homo sapiens
cactctggcagctc

SEQ ID NO: 1851720 - DNA, 19 bp, Homo sapiens
cactctggcagctcagaga

SEQ ID NO: 1851721 - DNA, 23 bp, Homo sapiens
cactgacactggtattcctgcct

SEQ ID NO: 1851722 - DNA, 19 bp, Homo sapiens
cactgagacagcccgggct

SEQ ID NO: 1851723 - DNA, 15 bp, Homo sapiens
cactgagctgtcatg

SEQ ID NO: 1851724 - DNA, 17 bp, Homo sapiens
cactgccatgcagggcc

SEQ ID NO: 1851725 - DNA, 17 bp, Homo sapiens
cactgccatgccagctt

SEQ ID NO: 1851726 - DNA, 13 bp, Homo sapiens
cactgcctgctcc

SEQ ID NO: 1851727 - DNA, 14 bp, Homo sapiens
cactgcctgctccc

SEQ ID NO: 1851728 - DNA, 21 bp, Homo sapiens
cactgcctgctcccatcctgt

SEQ ID NO: 1851729 - DNA, 15 bp, Homo sapiens
cactgcttccagtga

SEQ ID NO: 1851730 - DNA, 16 bp, Homo sapiens
cactgcttccagtgag

SEQ ID NO: 1851731 - DNA, 19 bp, Homo sapiens
cactgcttccagtgaggct

SEQ ID NO: 1851732 - DNA, 13 bp, Homo sapiens
cactggaactcag

SEQ ID NO: 1851733 - DNA, 19 bp, Homo sapiens
cactgggtgcgtctccagt

SEQ ID NO: 1851734 - DNA, 16 bp, Homo sapiens
cactggtattcctgcc

SEQ ID NO: 1851735 - DNA, 16 bp, Homo sapiens
cactgtcctattatat

SEQ ID NO: 1851736 - DNA, 13 bp, Homo sapiens
cactgtgctcagg

SEQ ID NO: 1851737 - DNA, 16 bp, Homo sapiens
cactgtgctcagggct

SEQ ID NO: 1851738 - DNA, 19 bp, Homo sapiens
cactgttctctgccctcca

SEQ ID NO: 1851739 - DNA, 16 bp, Homo sapiens
cactgttcttagctca

SEQ ID NO: 1851740 - DNA, 21 bp, Homo sapiens
cactgttcttagctcaatgag

SEQ ID NO: 1851741 - DNA, 23 bp, Homo sapiens
cactgttcttagctcaatgagca

SEQ ID NO: 1851742 - DNA, 17 bp, Homo sapiens
cacttacgtttgtcctt

SEQ ID NO: 1851743 - DNA, 20 bp, Homo sapiens
cacttatttatgaacctgcc

SEQ ID NO: 1851744 - DNA, 14 bp, Homo sapiens
cacttcaccctgga

SEQ ID NO: 1851745 - DNA, 21 bp, Homo sapiens
cacttcgggaggtcgaggcag

SEQ ID NO: 1851746 - DNA, 20 bp, Homo sapiens
cacttgagaattaccctttt

SEQ ID NO: 1851747 - DNA, 19 bp, Homo sapiens
cacttggcccaagtggcag

SEQ ID NO: 1851748 - DNA, 14 bp, Homo sapiens
cactttgaaaagtt

SEQ ID NO: 1851749 - DNA, 17 bp, Homo sapiens
cactttgaaaagttgga

SEQ ID NO: 1851750 - DNA, 20 bp, Homo sapiens
cactttgaaaagttggaagg

SEQ ID NO: 1851751 - DNA, 12 bp, Homo sapiens
cactttgggagg

SEQ ID NO: 1851752 - DNA, 16 bp, Homo sapiens
cactttgggaggccaa

SEQ ID NO: 1851753 - DNA, 18 bp, Homo sapiens
cagaaacacccctctgtc

SEQ ID NO: 1851754 - DNA, 19 bp, Homo sapiens
cagaaacacccctctgtct

SEQ ID NO: 1851755 - DNA, 20 bp, Homo sapiens
cagaaacaccctcacactgg

SEQ ID NO: 1851756 - DNA, 21 bp, Homo sapiens
cagaaacaccctcacactggg

SEQ ID NO: 1851757 - DNA, 23 bp, Homo sapiens
cagaaacaccctcacactgggac

SEQ ID NO: 1851758 - DNA, 13 bp, Homo sapiens
cagaacaggtagt

SEQ ID NO: 1851759 - DNA, 22 bp, Homo sapiens
cagaacatactgattgggaggt

SEQ ID NO: 1851760 - DNA, 15 bp, Homo sapiens
cagaaccaattattt

SEQ ID NO: 1851761 - DNA, 20 bp, Homo sapiens
cagaaccaattattttcatc

SEQ ID NO: 1851762 - DNA, 17 bp, Homo sapiens
cagaacctgcacacagg

SEQ ID NO: 1851763 - DNA, 22 bp, Homo sapiens
cagaacctgcacacaggacagc

SEQ ID NO: 1851764 - DNA, 14 bp, Homo sapiens
cagaagcagctctt

SEQ ID NO: 1851765 - DNA, 22 bp, Homo sapiens
cagaatattagtgacctcagct

SEQ ID NO: 1851766 - DNA, 22 bp, Homo sapiens
cagaatgatgcaggttcaggtc

SEQ ID NO: 1851767 - DNA, 15 bp, Homo sapiens
cagacagctgcctgg

SEQ ID NO: 1851768 - DNA, 13 bp, Homo sapiens
cagacaggaccag

SEQ ID NO: 1851769 - DNA, 17 bp, Homo sapiens
cagacaggaccagggat

SEQ ID NO: 1851770 - DNA, 20 bp, Homo sapiens
cagaccacaaaacttttcta

SEQ ID NO: 1851771 - DNA, 13 bp, Homo sapiens
cagaccctgccct

SEQ ID NO: 1851772 - DNA, 13 bp, Homo sapiens
cagacctcatgcc

SEQ ID NO: 1851773 - DNA, 15 bp, Homo sapiens
cagacctcatgccca

SEQ ID NO: 1851774 - DNA, 16 bp, Homo sapiens
cagacctcatgcccag

SEQ ID NO: 1851775 - DNA, 21 bp, Homo sapiens
cagaccttctaggacgccacc

SEQ ID NO: 1851776 - DNA, 21 bp, Homo sapiens
cagactgtgtaaaaagagagc

SEQ ID NO: 1851777 - DNA, 16 bp, Homo sapiens
cagagacctcctgcct

SEQ ID NO: 1851778 - DNA, 18 bp, Homo sapiens
cagagacctcctgcctcc

SEQ ID NO: 1851779 - DNA, 20 bp, Homo sapiens
cagagacttgggacattgcc

SEQ ID NO: 1851780 - DNA, 15 bp, Homo sapiens
cagagagggcaggca

SEQ ID NO: 1851781 - DNA, 16 bp, Homo sapiens
cagagagggcaggcat

SEQ ID NO: 1851782 - DNA, 16 bp, Homo sapiens
cagagagggtgggagt

SEQ ID NO: 1851783 - DNA, 20 bp, Homo sapiens
cagagagggtgggagtgggc

SEQ ID NO: 1851784 - DNA, 20 bp, Homo sapiens
cagagatataataagcccaa

SEQ ID NO: 1851785 - DNA, 16 bp, Homo sapiens
cagagcaccttagaca

SEQ ID NO: 1851786 - DNA, 18 bp, Homo sapiens
cagagcaccttagacagt

SEQ ID NO: 1851787 - DNA, 22 bp, Homo sapiens
cagagcaccttagacagtccct

SEQ ID NO: 1851788 - DNA, 11 bp, Homo sapiens
cagagcagaga

SEQ ID NO: 1851789 - DNA, 17 bp, Homo sapiens
cagagcagagaccatcc

SEQ ID NO: 1851790 - DNA, 18 bp, Homo sapiens
cagagcagagaccatccc

SEQ ID NO: 1851791 - DNA, 20 bp, Homo sapiens
cagagcccacgcccccactg

SEQ ID NO: 1851792 - DNA, 19 bp, Homo sapiens
cagagcgtgagctgagcag

SEQ ID NO: 1851793 - DNA, 15 bp, Homo sapiens
cagagctgacacagg

SEQ ID NO: 1851794 - DNA, 16 bp, Homo sapiens
cagagcttggactgga

SEQ ID NO: 1851795 - DNA, 13 bp, Homo sapiens
cagaggaaggaga

SEQ ID NO: 1851796 - DNA, 22 bp, Homo sapiens
cagagggcctgcaagggagtga

SEQ ID NO: 1851797 - DNA, 22 bp, Homo sapiens
cagagggggtggcctcccaact

SEQ ID NO: 1851798 - DNA, 19 bp, Homo sapiens
cagaggttatctgtcccag

SEQ ID NO: 1851799 - DNA, 19 bp, Homo sapiens
cagataactgttatttata

SEQ ID NO: 1851800 - DNA, 15 bp, Homo sapiens
cagataatccctgta

SEQ ID NO: 1851801 - DNA, 15 bp, Homo sapiens
cagatgctgtgcaaa

SEQ ID NO: 1851802 - DNA, 14 bp, Homo sapiens
cagattcacactgt

SEQ ID NO: 1851803 - DNA, 19 bp, Homo sapiens
cagattcacactgtctggt

SEQ ID NO: 1851804 - DNA, 14 bp, Homo sapiens
cagatttgggctgg

SEQ ID NO: 1851805 - DNA, 14 bp, Homo sapiens
cagcaccacactgg

SEQ ID NO: 1851806 - DNA, 15 bp, Homo sapiens
cagcaccacactggg

SEQ ID NO: 1851807 - DNA, 18 bp, Homo sapiens
cagcactgcctgctccca

SEQ ID NO: 1851808 - DNA, 23 bp, Homo sapiens
cagcactgcctgctcccatcctg

SEQ ID NO: 1851809 - DNA, 16 bp, Homo sapiens
cagcagaacctgcaca

SEQ ID NO: 1851810 - DNA, 17 bp, Homo sapiens
cagcagaacctgcacac

SEQ ID NO: 1851811 - DNA, 11 bp, Homo sapiens
cagcagagcac

SEQ ID NO: 1851812 - DNA, 14 bp, Homo sapiens
cagcagcctggacc

SEQ ID NO: 1851813 - DNA, 20 bp, Homo sapiens
cagcagggagggcttctgcc

SEQ ID NO: 1851814 - DNA, 18 bp, Homo sapiens
cagcatattcaggaagct

SEQ ID NO: 1851815 - DNA, 23 bp, Homo sapiens
cagcatattcaggaagctcaggg

SEQ ID NO: 1851816 - DNA, 18 bp, Homo sapiens
cagccaaagcctcctcca

SEQ ID NO: 1851817 - DNA, 21 bp, Homo sapiens
cagccaagcaaatgcctgcca

SEQ ID NO: 1851818 - DNA, 20 bp, Homo sapiens
cagccaagggatgaaagaga

SEQ ID NO: 1851819 - DNA, 15 bp, Homo sapiens
cagccacattcctga

SEQ ID NO: 1851820 - DNA, 19 bp, Homo sapiens
cagccacattcctgatgct

SEQ ID NO: 1851821 - DNA, 13 bp, Homo sapiens
cagccactgattc

SEQ ID NO: 1851822 - DNA, 21 bp, Homo sapiens
cagccactgattctctcttgt

SEQ ID NO: 1851823 - DNA, 20 bp, Homo sapiens
cagccccaaaactctcctct

SEQ ID NO: 1851824 - DNA, 21 bp, Homo sapiens
cagccccaaaactctcctctg

SEQ ID NO: 1851825 - DNA, 22 bp, Homo sapiens
cagccccaaaactctcctctgc

SEQ ID NO: 1851826 - DNA, 11 bp, Homo sapiens
cagccccatcc

SEQ ID NO: 1851827 - DNA, 14 bp, Homo sapiens
cagccccatcctct

SEQ ID NO: 1851828 - DNA, 17 bp, Homo sapiens
cagccccgggagtggcg

SEQ ID NO: 1851829 - DNA, 14 bp, Homo sapiens
cagcccctgatcct

SEQ ID NO: 1851830 - DNA, 20 bp, Homo sapiens
cagcccctgatcctgtgaag

SEQ ID NO: 1851831 - DNA, 12 bp, Homo sapiens
cagcccctggat

SEQ ID NO: 1851832 - DNA, 13 bp, Homo sapiens
cagcccctggatg

SEQ ID NO: 1851833 - DNA, 17 bp, Homo sapiens
cagcccctggatgcagc

SEQ ID NO: 1851834 - DNA, 21 bp, Homo sapiens
cagcccctggatgcagcctca

SEQ ID NO: 1851835 - DNA, 16 bp, Homo sapiens
cagccccttctgaccc

SEQ ID NO: 1851836 - DNA, 14 bp, Homo sapiens
cagcccgggctctg

SEQ ID NO: 1851837 - DNA, 18 bp, Homo sapiens
cagcccgggctctgcctc

SEQ ID NO: 1851838 - DNA, 20 bp, Homo sapiens
cagcccgggctctgcctccc

SEQ ID NO: 1851839 - DNA, 23 bp, Homo sapiens
cagccgccatgctcctggcccac

SEQ ID NO: 1851840 - DNA, 15 bp, Homo sapiens
cagcctcacagtcct

SEQ ID NO: 1851841 - DNA, 21 bp, Homo sapiens
cagcctccctattttttttct

SEQ ID NO: 1851842 - DNA, 17 bp, Homo sapiens
cagcctgctccagctgt

SEQ ID NO: 1851843 - DNA, 20 bp, Homo sapiens
cagcctgctccagctgttca

SEQ ID NO: 1851844 - DNA, 15 bp, Homo sapiens
cagcctggaccctgt

SEQ ID NO: 1851845 - DNA, 19 bp, Homo sapiens
cagcctggaccctgtggat

SEQ ID NO: 1851846 - DNA, 24 bp, Homo sapiens
cagccttgaccattctccacctgc

SEQ ID NO: 1851847 - DNA, 16 bp, Homo sapiens
cagctaacacacagct

SEQ ID NO: 1851848 - DNA, 20 bp, Homo sapiens
cagctaacacacagctccca

SEQ ID NO: 1851849 - DNA, 16 bp, Homo sapiens
cagctcacctctccct

SEQ ID NO: 1851850 - DNA, 17 bp, Homo sapiens
cagctcacctctccctt

SEQ ID NO: 1851851 - DNA, 19 bp, Homo sapiens
cagctcacctctcccttgg

SEQ ID NO: 1851852 - DNA, 13 bp, Homo sapiens
cagctcagagagg

SEQ ID NO: 1851853 - DNA, 19 bp, Homo sapiens
cagctcagagagggtggga

SEQ ID NO: 1851854 - DNA, 21 bp, Homo sapiens
cagctcagcactgcctgctcc

SEQ ID NO: 1851855 - DNA, 24 bp, Homo sapiens
cagctccccagagtcctctatgaa

SEQ ID NO: 1851856 - DNA, 15 bp, Homo sapiens
cagctctgcaagaat

SEQ ID NO: 1851857 - DNA, 17 bp, Homo sapiens
cagctctggtccataga

SEQ ID NO: 1851858 - DNA, 19 bp, Homo sapiens
cagctgccaggagcacggc

SEQ ID NO: 1851859 - DNA, 18 bp, Homo sapiens
cagctgcctgggatccct

SEQ ID NO: 1851860 - DNA, 14 bp, Homo sapiens
cagctgctccccag

SEQ ID NO: 1851861 - DNA, 15 bp, Homo sapiens
cagctgctggagact

SEQ ID NO: 1851862 - DNA, 18 bp, Homo sapiens
cagctgctggagactcct

SEQ ID NO: 1851863 - DNA, 23 bp, Homo sapiens
cagctgctggagactcctaggca

SEQ ID NO: 1851864 - DNA, 23 bp, Homo sapiens
cagctgggatcacatgtggactt

SEQ ID NO: 1851865 - DNA, 22 bp, Homo sapiens
cagctgggtggcactgccatgc

SEQ ID NO: 1851866 - DNA, 11 bp, Homo sapiens
cagctgtgtct

SEQ ID NO: 1851867 - DNA, 22 bp, Homo sapiens
cagctttaaaaaattaatctgg

SEQ ID NO: 1851868 - DNA, 21 bp, Homo sapiens
cagctttgtttgttgtcagct

SEQ ID NO: 1851869 - DNA, 14 bp, Homo sapiens
caggaagcagcttt

SEQ ID NO: 1851870 - DNA, 14 bp, Homo sapiens
caggaagctcaggg

SEQ ID NO: 1851871 - DNA, 16 bp, Homo sapiens
caggaagctcagggcc

SEQ ID NO: 1851872 - DNA, 17 bp, Homo sapiens
caggaagctcagggcct

SEQ ID NO: 1851873 - DNA, 19 bp, Homo sapiens
caggaagctcagggcctgg

SEQ ID NO: 1851874 - DNA, 21 bp, Homo sapiens
caggaagctcagggcctggct

SEQ ID NO: 1851875 - DNA, 17 bp, Homo sapiens
caggacatgctgaagcc

SEQ ID NO: 1851876 - DNA, 15 bp, Homo sapiens
caggactagagcaca

SEQ ID NO: 1851877 - DNA, 19 bp, Homo sapiens
caggagcacggctctgtcc

SEQ ID NO: 1851878 - DNA, 13 bp, Homo sapiens
caggagcagccac

SEQ ID NO: 1851879 - DNA, 19 bp, Homo sapiens
caggagcagccacattcct

SEQ ID NO: 1851880 - DNA, 23 bp, Homo sapiens
caggagcagcctcagaacaaagt

SEQ ID NO: 1851881 - DNA, 19 bp, Homo sapiens
caggaggatcacttgagtc

SEQ ID NO: 1851882 - DNA, 12 bp, Homo sapiens
caggaggccagc

SEQ ID NO: 1851883 - DNA, 13 bp, Homo sapiens
caggaggccagcc

SEQ ID NO: 1851884 - DNA, 16 bp, Homo sapiens
caggaggccagccttg

SEQ ID NO: 1851885 - DNA, 19 bp, Homo sapiens
caggaggccagccttgacc

SEQ ID NO: 1851886 - DNA, 22 bp, Homo sapiens
caggaggccagccttgaccatt

SEQ ID NO: 1851887 - DNA, 13 bp, Homo sapiens
caggatagacttt

SEQ ID NO: 1851888 - DNA, 17 bp, Homo sapiens
caggatagagtgggaca

SEQ ID NO: 1851889 - DNA, 24 bp, Homo sapiens
caggatggcctggccagggcctgg

SEQ ID NO: 1851890 - DNA, 19 bp, Homo sapiens
caggatgtacaaggacagc

SEQ ID NO: 1851891 - DNA, 20 bp, Homo sapiens
caggattcttcctccctccc

SEQ ID NO: 1851892 - DNA, 22 bp, Homo sapiens
caggcaacgcacaaaacagaaa

SEQ ID NO: 1851893 - DNA, 12 bp, Homo sapiens
caggcagcacca

SEQ ID NO: 1851894 - DNA, 14 bp, Homo sapiens
caggcagcagagac

SEQ ID NO: 1851895 - DNA, 15 bp, Homo sapiens
caggcagccaggcca

SEQ ID NO: 1851896 - DNA, 18 bp, Homo sapiens
caggccacaagacccttg

SEQ ID NO: 1851897 - DNA, 20 bp, Homo sapiens
caggccacaagacccttgtg

SEQ ID NO: 1851898 - DNA, 18 bp, Homo sapiens
caggccaccccgctgatg

SEQ ID NO: 1851899 - DNA, 17 bp, Homo sapiens
caggccaccctgcctct

SEQ ID NO: 1851900 - DNA, 22 bp, Homo sapiens
caggccaggccctctgcccact

SEQ ID NO: 1851901 - DNA, 21 bp, Homo sapiens
caggccattccccgtctctgg

SEQ ID NO: 1851902 - DNA, 12 bp, Homo sapiens
caggcccctctc

SEQ ID NO: 1851903 - DNA, 14 bp, Homo sapiens
caggcccctctcct

SEQ ID NO: 1851904 - DNA, 14 bp, Homo sapiens
caggccctctgccc

SEQ ID NO: 1851905 - DNA, 16 bp, Homo sapiens
caggccctctgcccac

SEQ ID NO: 1851906 - DNA, 20 bp, Homo sapiens
caggccctctgcccactccc

SEQ ID NO: 1851907 - DNA, 21 bp, Homo sapiens
caggccctctgcccactccct

SEQ ID NO: 1851908 - DNA, 16 bp, Homo sapiens
caggcgtgagccacca

SEQ ID NO: 1851909 - DNA, 19 bp, Homo sapiens
caggcgttcagctcactgt

SEQ ID NO: 1851910 - DNA, 22 bp, Homo sapiens
caggcgttcagctcactgttct

SEQ ID NO: 1851911 - DNA, 12 bp, Homo sapiens
caggctgggaga

SEQ ID NO: 1851912 - DNA, 18 bp, Homo sapiens
caggctgggagagccttc

SEQ ID NO: 1851913 - DNA, 22 bp, Homo sapiens
caggctgggagagccttccagg

SEQ ID NO: 1851914 - DNA, 14 bp, Homo sapiens
caggctggtctcga

SEQ ID NO: 1851915 - DNA, 17 bp, Homo sapiens
caggcttagtcactgag

SEQ ID NO: 1851916 - DNA, 23 bp, Homo sapiens
caggcttctgagcagcgagcctg

SEQ ID NO: 1851917 - DNA, 11 bp, Homo sapiens
caggcttgggg

SEQ ID NO: 1851918 - DNA, 13 bp, Homo sapiens
caggcttggggaa

SEQ ID NO: 1851919 - DNA, 14 bp, Homo sapiens
cagggacagagggg

SEQ ID NO: 1851920 - DNA, 23 bp, Homo sapiens
cagggacagagggggtggcctcc

SEQ ID NO: 1851921 - DNA, 16 bp, Homo sapiens
cagggagggcttctgc

SEQ ID NO: 1851922 - DNA, 23 bp, Homo sapiens
cagggatgagcatggagctggcc

SEQ ID NO: 1851923 - DNA, 18 bp, Homo sapiens
cagggatgtacaaggcga

SEQ ID NO: 1851924 - DNA, 12 bp, Homo sapiens
cagggccatgca

SEQ ID NO: 1851925 - DNA, 16 bp, Homo sapiens
cagggcctcacacggt

SEQ ID NO: 1851926 - DNA, 15 bp, Homo sapiens
cagggctctgaccag

SEQ ID NO: 1851927 - DNA, 15 bp, Homo sapiens
caggggtgggacacc

SEQ ID NO: 1851928 - DNA, 20 bp, Homo sapiens
caggggtgggacaccctgtg

SEQ ID NO: 1851929 - DNA, 15 bp, Homo sapiens
cagggtccctggtgg

SEQ ID NO: 1851930 - DNA, 18 bp, Homo sapiens
cagggtccctggtggcag

SEQ ID NO: 1851931 - DNA, 22 bp, Homo sapiens
cagggtccctggtggcagctca

SEQ ID NO: 1851932 - DNA, 21 bp, Homo sapiens
cagggtctctaccatcccctg

SEQ ID NO: 1851933 - DNA, 13 bp, Homo sapiens
cagggtctctgct

SEQ ID NO: 1851934 - DNA, 17 bp, Homo sapiens
cagggtctctgctgccg

SEQ ID NO: 1851935 - DNA, 20 bp, Homo sapiens
caggtgaagcaccaagctca

SEQ ID NO: 1851936 - DNA, 21 bp, Homo sapiens
caggtgagaagcagaggaagg

SEQ ID NO: 1851937 - DNA, 24 bp, Homo sapiens
caggtgcaacactcaagtctattg

SEQ ID NO: 1851938 - DNA, 20 bp, Homo sapiens
caggtgcagcccccactgcc

SEQ ID NO: 1851939 - DNA, 19 bp, Homo sapiens
caggtgccgccagctgccg

SEQ ID NO: 1851940 - DNA, 14 bp, Homo sapiens
caggtgcgaaagga

SEQ ID NO: 1851941 - DNA, 18 bp, Homo sapiens
caggtgctaggaacactc

SEQ ID NO: 1851942 - DNA, 18 bp, Homo sapiens
caggtggggtcactctgg

SEQ ID NO: 1851943 - DNA, 19 bp, Homo sapiens
caggtggggtcactctggc

SEQ ID NO: 1851944 - DNA, 20 bp, Homo sapiens
caggtggggtcactctggca

SEQ ID NO: 1851945 - DNA, 22 bp, Homo sapiens
caggtggggtcactctggcagc

SEQ ID NO: 1851946 - DNA, 18 bp, Homo sapiens
caggtgtgccgacagaag

SEQ ID NO: 1851947 - DNA, 16 bp, Homo sapiens
caggtttaagctgtta

SEQ ID NO: 1851948 - DNA, 20 bp, Homo sapiens
catgctgaagccaaagccaa

SEQ ID NO: 1851949 - DNA, 19 bp, Homo sapiens
catgctgaaggctgaaaga

SEQ ID NO: 1851950 - DNA, 12 bp, Homo sapiens
catgctgccctg

SEQ ID NO: 1851951 - DNA, 14 bp, Homo sapiens
catgctgccctgtg

SEQ ID NO: 1851952 - DNA, 18 bp, Homo sapiens
catgctgccctgtgagta

SEQ ID NO: 1851953 - DNA, 14 bp, Homo sapiens
catgctgtgtgact

SEQ ID NO: 1851954 - DNA, 11 bp, Homo sapiens
catggactttg

SEQ ID NO: 1851955 - DNA, 13 bp, Homo sapiens
catggactttgtt

SEQ ID NO: 1851956 - DNA, 13 bp, Homo sapiens
catggagagctgg

SEQ ID NO: 1851957 - DNA, 14 bp, Homo sapiens
catggagagctgga

SEQ ID NO: 1851958 - DNA, 17 bp, Homo sapiens
catggagagctggagcc

SEQ ID NO: 1851959 - DNA, 18 bp, Homo sapiens
catggcatcacctccacc

SEQ ID NO: 1851960 - DNA, 19 bp, Homo sapiens
catggcatcacctccacca

SEQ ID NO: 1851961 - DNA, 15 bp, Homo sapiens
catggcccctgtgag

SEQ ID NO: 1851962 - DNA, 22 bp, Homo sapiens
catggccctcccagtacctcct

SEQ ID NO: 1851963 - DNA, 14 bp, Homo sapiens
catgggtcgggaga

SEQ ID NO: 1851964 - DNA, 16 bp, Homo sapiens
catgggtcgggagagg

SEQ ID NO: 1851965 - DNA, 18 bp, Homo sapiens
catgggtcgggagagggg

SEQ ID NO: 1851966 - DNA, 19 bp, Homo sapiens
catgtagaagctgcatctt

SEQ ID NO: 1851967 - DNA, 20 bp, Homo sapiens
catgtccaagaagcccagga

SEQ ID NO: 1851968 - DNA, 18 bp, Homo sapiens
catgtgattaccctctgg

SEQ ID NO: 1851969 - DNA, 15 bp, Homo sapiens
catgtttagacttta

SEQ ID NO: 1851970 - DNA, 22 bp, Homo sapiens
cattaaacgatttttaaaatgt

SEQ ID NO: 1851971 - DNA, 14 bp, Homo sapiens
cattaataataaat

SEQ ID NO: 1851972 - DNA, 11 bp, Homo sapiens
cattagagcag

SEQ ID NO: 1851973 - DNA, 15 bp, Homo sapiens
cattagctttaatta

SEQ ID NO: 1851974 - DNA, 14 bp, Homo sapiens
cattagttttgaag

SEQ ID NO: 1851975 - DNA, 16 bp, Homo sapiens
cattagttttgaagat

SEQ ID NO: 1851976 - DNA, 14 bp, Homo sapiens
cattatgttaatat

SEQ ID NO: 1851977 - DNA, 15 bp, Homo sapiens
cattcattccattct

SEQ ID NO: 1851978 - DNA, 12 bp, Homo sapiens
cattccatcctt

SEQ ID NO: 1851979 - DNA, 18 bp, Homo sapiens
cattccccaggaggccag

SEQ ID NO: 1851980 - DNA, 19 bp, Homo sapiens
cattccccaggaggccagc

SEQ ID NO: 1851981 - DNA, 19 bp, Homo sapiens
cattcctgatgcttcttca

SEQ ID NO: 1851982 - DNA, 22 bp, Homo sapiens
cattctcattggaaatttagca

SEQ ID NO: 1851983 - DNA, 17 bp, Homo sapiens
cattctccacctgccag

SEQ ID NO: 1851984 - DNA, 12 bp, Homo sapiens
cattctggaagt

SEQ ID NO: 1851985 - DNA, 21 bp, Homo sapiens
cattcttggttggctggcctt

SEQ ID NO: 1851986 - DNA, 15 bp, Homo sapiens
cattgacctgaggcc

SEQ ID NO: 1851987 - DNA, 19 bp, Homo sapiens
cattggaaatttagcattg

SEQ ID NO: 1851988 - DNA, 19 bp, Homo sapiens
cattgtagcgtctttcttt

SEQ ID NO: 1851989 - DNA, 18 bp, Homo sapiens
cattgtagtgctttgaga

SEQ ID NO: 1851990 - DNA, 13 bp, Homo sapiens
cattgtgggaagg

SEQ ID NO: 1851991 - DNA, 13 bp, Homo sapiens
cattgttgtcaag

SEQ ID NO: 1851992 - DNA, 17 bp, Homo sapiens
catttaagagacagtca

SEQ ID NO: 1851993 - DNA, 20 bp, Homo sapiens
catttctagcgcatggcctg

SEQ ID NO: 1851994 - DNA, 16 bp, Homo sapiens
catttggcctcttgta

SEQ ID NO: 1851995 - DNA, 14 bp, Homo sapiens
catttggtctcagg

SEQ ID NO: 1851996 - DNA, 18 bp, Homo sapiens
catttggtctcaggcagc

SEQ ID NO: 1851997 - DNA, 18 bp, Homo sapiens
cattttataaatcgcttt

SEQ ID NO: 1851998 - DNA, 21 bp, Homo sapiens
cattttataaatcgcttttga

SEQ ID NO: 1851999 - DNA, 16 bp, Homo sapiens
cattttgcacctgcag

SEQ ID NO: 1852000 - DNA, 17 bp, Homo sapiens
cattttgcacctgcagc

SEQ ID NO: 1852001 - DNA, 24 bp, Homo sapiens
cattttgctaaatgtgaatgatga

SEQ ID NO: 1852002 - DNA, 21 bp, Homo sapiens
ccaaaactctcctctgctgct

SEQ ID NO: 1852003 - DNA, 13 bp, Homo sapiens
ccaaacagtgaca

SEQ ID NO: 1852004 - DNA, 20 bp, Homo sapiens
ccaaagccaataacacacag

SEQ ID NO: 1852005 - DNA, 18 bp, Homo sapiens
ccaaatgcagctttaaaa

SEQ ID NO: 1852006 - DNA, 13 bp, Homo sapiens
ccaaattaaaaaa

SEQ ID NO: 1852007 - DNA, 17 bp, Homo sapiens
ccaacatactcccatct

SEQ ID NO: 1852008 - DNA, 18 bp, Homo sapiens
ccaacatactcccatctg

SEQ ID NO: 1852009 - DNA, 21 bp, Homo sapiens
ccaacatactcccatctgtga

SEQ ID NO: 1852010 - DNA, 22 bp, Homo sapiens
ccaacatactcccatctgtgaa

SEQ ID NO: 1852011 - DNA, 12 bp, Homo sapiens
ccaaccctcatc

SEQ ID NO: 1852012 - DNA, 16 bp, Homo sapiens
ccaacgtctgtgccat

SEQ ID NO: 1852013 - DNA, 13 bp, Homo sapiens
ccaactcacccca

SEQ ID NO: 1852014 - DNA, 14 bp, Homo sapiens
ccaactcaccccag

SEQ ID NO: 1852015 - DNA, 17 bp, Homo sapiens
ccaactcaccccagccc

SEQ ID NO: 1852016 - DNA, 23 bp, Homo sapiens
ccaacttgtattaaagacagagg

SEQ ID NO: 1852017 - DNA, 13 bp, Homo sapiens
ccaagaagcccag

SEQ ID NO: 1852018 - DNA, 20 bp, Homo sapiens
ccaagagaaggggaagcact

SEQ ID NO: 1852019 - DNA, 24 bp, Homo sapiens
ccaagagactccttgagagaccag

SEQ ID NO: 1852020 - DNA, 22 bp, Homo sapiens
ccaagcactgtgctcagggcta

SEQ ID NO: 1852021 - DNA, 20 bp, Homo sapiens
ccaagctcaggaccaggcaa

SEQ ID NO: 1852022 - DNA, 12 bp, Homo sapiens
ccaagctcccag

SEQ ID NO: 1852023 - DNA, 14 bp, Homo sapiens
ccaagctcccaggc

SEQ ID NO: 1852024 - DNA, 21 bp, Homo sapiens
ccaaggaaaccacagctgctg

SEQ ID NO: 1852025 - DNA, 19 bp, Homo sapiens
ccaagggatgaaagagaag

SEQ ID NO: 1852026 - DNA, 19 bp, Homo sapiens
ccaagggcctggcctgagc

SEQ ID NO: 1852027 - DNA, 13 bp, Homo sapiens
ccaaggtgggagg

SEQ ID NO: 1852028 - DNA, 13 bp, Homo sapiens
ccaagtggcagag

SEQ ID NO: 1852029 - DNA, 17 bp, Homo sapiens
ccaatgctgatgtcctc

SEQ ID NO: 1852030 - DNA, 21 bp, Homo sapiens
ccaatgtattgataagagggc

SEQ ID NO: 1852031 - DNA, 20 bp, Homo sapiens
ccaatgttctctcttctcca

SEQ ID NO: 1852032 - DNA, 18 bp, Homo sapiens
ccaattaaggattttatg

SEQ ID NO: 1852033 - DNA, 22 bp, Homo sapiens
ccaattattttcatccttgtct

SEQ ID NO: 1852034 - DNA, 14 bp, Homo sapiens
ccaattcctcattt

SEQ ID NO: 1852035 - DNA, 23 bp, Homo sapiens
ccaattcctcatttgttcattaa

SEQ ID NO: 1852036 - DNA, 22 bp, Homo sapiens
ccacaaatgggaaaaccagact

SEQ ID NO: 1852037 - DNA, 14 bp, Homo sapiens
ccacacttcaaact

SEQ ID NO: 1852038 - DNA, 23 bp, Homo sapiens
ccacagaggatgctgacatcatt

SEQ ID NO: 1852039 - DNA, 14 bp, Homo sapiens
ccacagctgctgga

SEQ ID NO: 1852040 - DNA, 12 bp, Homo sapiens
ccacatatttca

SEQ ID NO: 1852041 - DNA, 19 bp, Homo sapiens
ccacatgccaagcactgtg

SEQ ID NO: 1852042 - DNA, 13 bp, Homo sapiens
ccaccatcaagcc

SEQ ID NO: 1852043 - DNA, 14 bp, Homo sapiens
ccaccatcaagcca

SEQ ID NO: 1852044 - DNA, 17 bp, Homo sapiens
ccaccatcaagccacca

SEQ ID NO: 1852045 - DNA, 16 bp, Homo sapiens
ccacccaagggcctgg

SEQ ID NO: 1852046 - DNA, 19 bp, Homo sapiens
ccacccctcaacacctctg

SEQ ID NO: 1852047 - DNA, 13 bp, Homo sapiens
ccaccgcagacag

SEQ ID NO: 1852048 - DNA, 14 bp, Homo sapiens
ccaccgcagacagg

SEQ ID NO: 1852049 - DNA, 17 bp, Homo sapiens
ccaccgcagacaggacc

SEQ ID NO: 1852050 - DNA, 20 bp, Homo sapiens
ccacctctctcactccttga

SEQ ID NO: 1852051 - DNA, 13 bp, Homo sapiens
ccacctgccaggg

SEQ ID NO: 1852052 - DNA, 14 bp, Homo sapiens
ccacctggcctctg

SEQ ID NO: 1852053 - DNA, 16 bp, Homo sapiens
ccacctggcctctgca

SEQ ID NO: 1852054 - DNA, 18 bp, Homo sapiens
ccacctggcctctgcact

SEQ ID NO: 1852055 - DNA, 16 bp, Homo sapiens
ccacctgttttctgaa

SEQ ID NO: 1852056 - DNA, 12 bp, Homo sapiens
ccaccttctggg

SEQ ID NO: 1852057 - DNA, 14 bp, Homo sapiens
ccaccttgtctgct

SEQ ID NO: 1852058 - DNA, 23 bp, Homo sapiens
ccacctttcagataactgttatt

SEQ ID NO: 1852059 - DNA, 16 bp, Homo sapiens
ccacgcccccactggt

SEQ ID NO: 1852060 - DNA, 17 bp, Homo sapiens
ccacgcccccactggtg

SEQ ID NO: 1852061 - DNA, 23 bp, Homo sapiens
ccactgcactccagcctgggtga

SEQ ID NO: 1852062 - DNA, 22 bp, Homo sapiens
ccactgcctttgacctgcctcc

SEQ ID NO: 1852063 - DNA, 13 bp, Homo sapiens
ccacttcagctga

SEQ ID NO: 1852064 - DNA, 13 bp, Homo sapiens
ccactttgaaggg

SEQ ID NO: 1852065 - DNA, 23 bp, Homo sapiens
ccagaagtttgagatcagcctgg

SEQ ID NO: 1852066 - DNA, 20 bp, Homo sapiens
ccagacacatgtccaagaag

SEQ ID NO: 1852067 - DNA, 16 bp, Homo sapiens
cgtgttcagcagaacc

SEQ ID NO: 1852068 - DNA, 20 bp, Homo sapiens
cgtttgttccccaagacatt

SEQ ID NO: 1852069 - DNA, 20 bp, Homo sapiens
cgttttttttttgtttgttg

SEQ ID NO: 1852070 - DNA, 20 bp, Homo sapiens
ctaaaacaaaagctcatcca

SEQ ID NO: 1852071 - DNA, 12 bp, Homo sapiens
ctaaataaacat

SEQ ID NO: 1852072 - DNA, 17 bp, Homo sapiens
ctaaataaacatgtgcc

SEQ ID NO: 1852073 - DNA, 15 bp, Homo sapiens
ctaacacacagctcc

SEQ ID NO: 1852074 - DNA, 18 bp, Homo sapiens
ctaacgcaaaaatagctc

SEQ ID NO: 1852075 - DNA, 23 bp, Homo sapiens
ctaacgcaaaaatagctcttgct

SEQ ID NO: 1852076 - DNA, 17 bp, Homo sapiens
ctaactcttctttcatt

SEQ ID NO: 1852077 - DNA, 16 bp, Homo sapiens
ctaactttccttcatt

SEQ ID NO: 1852078 - DNA, 16 bp, Homo sapiens
ctaagcattagcttta

SEQ ID NO: 1852079 - DNA, 19 bp, Homo sapiens
ctaaggcgtggagctgcct

SEQ ID NO: 1852080 - DNA, 21 bp, Homo sapiens
ctaaggcgtggagctgcctga

SEQ ID NO: 1852081 - DNA, 22 bp, Homo sapiens
ctaaggcgtggagctgcctgat

SEQ ID NO: 1852082 - DNA, 12 bp, Homo sapiens
ctaagtctctgt

SEQ ID NO: 1852083 - DNA, 14 bp, Homo sapiens
ctaagtctctgtga

SEQ ID NO: 1852084 - DNA, 14 bp, Homo sapiens
ctaattaataaatt

SEQ ID NO: 1852085 - DNA, 12 bp, Homo sapiens
ctaattgtggat

SEQ ID NO: 1852086 - DNA, 19 bp, Homo sapiens
ctacaaaaagcataaaaat

SEQ ID NO: 1852087 - DNA, 17 bp, Homo sapiens
ctacaaaggtttaaatg

SEQ ID NO: 1852088 - DNA, 21 bp, Homo sapiens
ctacaaaggtttaaatgaaca

SEQ ID NO: 1852089 - DNA, 17 bp, Homo sapiens
ctacaattgtaaactag

SEQ ID NO: 1852090 - DNA, 16 bp, Homo sapiens
ctacactgacactggt

SEQ ID NO: 1852091 - DNA, 20 bp, Homo sapiens
ctacagagaaggctgcctgc

SEQ ID NO: 1852092 - DNA, 17 bp, Homo sapiens
ctacagtcctcccatct

SEQ ID NO: 1852093 - DNA, 13 bp, Homo sapiens
ctacagttgaaaa

SEQ ID NO: 1852094 - DNA, 19 bp, Homo sapiens
ctaccaagctatcctggct

SEQ ID NO: 1852095 - DNA, 15 bp, Homo sapiens
ctacccgggaagggg

SEQ ID NO: 1852096 - DNA, 20 bp, Homo sapiens
ctacccgggaagggggctgg

SEQ ID NO: 1852097 - DNA, 17 bp, Homo sapiens
ctaccctccatgtgaga

SEQ ID NO: 1852098 - DNA, 17 bp, Homo sapiens
ctaccctcttagaaaaa

SEQ ID NO: 1852099 - DNA, 15 bp, Homo sapiens
ctacctgaggggcct

SEQ ID NO: 1852100 - DNA, 17 bp, Homo sapiens
ctagcactttgggaggc

SEQ ID NO: 1852101 - DNA, 18 bp, Homo sapiens
ctagctgaatgtttttct

SEQ ID NO: 1852102 - DNA, 13 bp, Homo sapiens
ctaggcaggacat

SEQ ID NO: 1852103 - DNA, 13 bp, Homo sapiens
ctaggcctgggga

SEQ ID NO: 1852104 - DNA, 14 bp, Homo sapiens
ctagggaagataat

SEQ ID NO: 1852105 - DNA, 12 bp, Homo sapiens
ctaggggctggg

SEQ ID NO: 1852106 - DNA, 13 bp, Homo sapiens
ctaggggctgggg

SEQ ID NO: 1852107 - DNA, 15 bp, Homo sapiens
ctaggtaggaagagc

SEQ ID NO: 1852108 - DNA, 17 bp, Homo sapiens
ctaggtggcaaggctgt

SEQ ID NO: 1852109 - DNA, 21 bp, Homo sapiens
ctagtgtggtgtttcctggca

SEQ ID NO: 1852110 - DNA, 22 bp, Homo sapiens
ctagtgtggtgtttcctggcac

SEQ ID NO: 1852111 - DNA, 18 bp, Homo sapiens
ctatatatgtgatgatct

SEQ ID NO: 1852112 - DNA, 23 bp, Homo sapiens
ctatatatgtgatgatctaccag

SEQ ID NO: 1852113 - DNA, 17 bp, Homo sapiens
ctatatttttgtactga

SEQ ID NO: 1852114 - DNA, 21 bp, Homo sapiens
ctatcagaggtgaaagctata

SEQ ID NO: 1852115 - DNA, 20 bp, Homo sapiens
ctatctcccccagccccatc

SEQ ID NO: 1852116 - DNA, 12 bp, Homo sapiens
ctatctttgcca

SEQ ID NO: 1852117 - DNA, 18 bp, Homo sapiens
ctatctttgccaccctca

SEQ ID NO: 1852118 - DNA, 21 bp, Homo sapiens
ctatctttgccaccctcatgc

SEQ ID NO: 1852119 - DNA, 14 bp, Homo sapiens
ctatgttaatattt

SEQ ID NO: 1852120 - DNA, 15 bp, Homo sapiens
ctattaaaggaataa

SEQ ID NO: 1852121 - DNA, 17 bp, Homo sapiens
ctattgaataatgtagt

SEQ ID NO: 1852122 - DNA, 19 bp, Homo sapiens
ctatttattccctgttaaa

SEQ ID NO: 1852123 - DNA, 19 bp, Homo sapiens
ctatttgcttatttaataa

SEQ ID NO: 1852124 - DNA, 20 bp, Homo sapiens
ctatttttctaactacaaag

SEQ ID NO: 1852125 - DNA, 18 bp, Homo sapiens
ctcaaacactgcaggcat

SEQ ID NO: 1852126 - DNA, 13 bp, Homo sapiens
ctcaactgaaggg

SEQ ID NO: 1852127 - DNA, 23 bp, Homo sapiens
ctcaactgaaggggtgcacccac

SEQ ID NO: 1852128 - DNA, 14 bp, Homo sapiens
ctcaagaagcaggc

SEQ ID NO: 1852129 - DNA, 23 bp, Homo sapiens
ctcaaggaataatgggcttagag

SEQ ID NO: 1852130 - DNA, 14 bp, Homo sapiens
ctcaatgagcatgt

SEQ ID NO: 1852131 - DNA, 23 bp, Homo sapiens
ctcaatgtttagcagatttaaga

SEQ ID NO: 1852132 - DNA, 23 bp, Homo sapiens
ctcacacggacactcaaaagctg

SEQ ID NO: 1852133 - DNA, 15 bp, Homo sapiens
ctcacagtccttacc

SEQ ID NO: 1852134 - DNA, 17 bp, Homo sapiens
ctcacagtccttaccag

SEQ ID NO: 1852135 - DNA, 22 bp, Homo sapiens
ctcacccagtgccctctcccct

SEQ ID NO: 1852136 - DNA, 12 bp, Homo sapiens
ctcaccccagcc

SEQ ID NO: 1852137 - DNA, 13 bp, Homo sapiens
ctcaccccagccc

SEQ ID NO: 1852138 - DNA, 15 bp, Homo sapiens
ctcaccccagcccca

SEQ ID NO: 1852139 - DNA, 17 bp, Homo sapiens
ctcacctctcccttgga

SEQ ID NO: 1852140 - DNA, 21 bp, Homo sapiens
ctcacctggggctgctggcct

SEQ ID NO: 1852141 - DNA, 10 bp, Homo sapiens
ctcagaacat

SEQ ID NO: 1852142 - DNA, 14 bp, Homo sapiens
ctcagaacatactg

SEQ ID NO: 1852143 - DNA, 16 bp, Homo sapiens
ctcagaacatactgat

SEQ ID NO: 1852144 - DNA, 18 bp, Homo sapiens
ctcagagagggtgggagt

SEQ ID NO: 1852145 - DNA, 23 bp, Homo sapiens
ctcagagagggtgggagtgggcc

SEQ ID NO: 1852146 - DNA, 20 bp, Homo sapiens
ctcagcaaaagatgcttctc

SEQ ID NO: 1852147 - DNA, 22 bp, Homo sapiens
ctctggattggagatagggaaa

SEQ ID NO: 1852148 - DNA, 16 bp, Homo sapiens
ctctggcagctcagag

SEQ ID NO: 1852149 - DNA, 18 bp, Homo sapiens
ctctggcagctcagagag

SEQ ID NO: 1852150 - DNA, 20 bp, Homo sapiens
ctctggcagctcagagaggg

SEQ ID NO: 1852151 - DNA, 18 bp, Homo sapiens
ctctgggtctcagtgtcc

SEQ ID NO: 1852152 - DNA, 19 bp, Homo sapiens
ctctggtccatagagagca

SEQ ID NO: 1852153 - DNA, 18 bp, Homo sapiens
ctctggtggcttaagtga

SEQ ID NO: 1852154 - DNA, 14 bp, Homo sapiens
ctctggttcctccc

SEQ ID NO: 1852155 - DNA, 17 bp, Homo sapiens
ctctgtacagagcccac

SEQ ID NO: 1852156 - DNA, 20 bp, Homo sapiens
ctctgtctaggactgcagtg

SEQ ID NO: 1852157 - DNA, 21 bp, Homo sapiens
ctctgtctaggactgcagtgt

SEQ ID NO: 1852158 - DNA, 18 bp, Homo sapiens
ctctgtgagcatcacagt

SEQ ID NO: 1852159 - DNA, 13 bp, Homo sapiens
ctcttagaaaaac

SEQ ID NO: 1852160 - DNA, 21 bp, Homo sapiens
ctcttatggatgtccccagca

SEQ ID NO: 1852161 - DNA, 22 bp, Homo sapiens
ctcttccaggctgggagagcct

SEQ ID NO: 1852162 - DNA, 23 bp, Homo sapiens
ctcttccaggctgggagagcctt

SEQ ID NO: 1852163 - DNA, 22 bp, Homo sapiens
ctcttccagtgaacattcccag

SEQ ID NO: 1852164 - DNA, 13 bp, Homo sapiens
ctcttctccccag

SEQ ID NO: 1852165 - DNA, 16 bp, Homo sapiens
ctcttctccccagagt

SEQ ID NO: 1852166 - DNA, 19 bp, Homo sapiens
ctcttctttcatttcttct

SEQ ID NO: 1852167 - DNA, 15 bp, Homo sapiens
ctcttgagcctggga

SEQ ID NO: 1852168 - DNA, 15 bp, Homo sapiens
ctcttggtcctgctg

SEQ ID NO: 1852169 - DNA, 18 bp, Homo sapiens
ctcttggtcctgctgcag

SEQ ID NO: 1852170 - DNA, 15 bp, Homo sapiens
ctctttaaaaactca

SEQ ID NO: 1852171 - DNA, 17 bp, Homo sapiens
ctctttaaaaactcact

SEQ ID NO: 1852172 - DNA, 17 bp, Homo sapiens
ctctttccatctaccct

SEQ ID NO: 1852173 - DNA, 17 bp, Homo sapiens
ctctttccctcccttcc

SEQ ID NO: 1852174 - DNA, 12 bp, Homo sapiens
ctctttgagaaa

SEQ ID NO: 1852175 - DNA, 23 bp, Homo sapiens
ctctttggtctacactgtgctga

SEQ ID NO: 1852176 - DNA, 22 bp, Homo sapiens
ctctttttttgagtgacagctt

SEQ ID NO: 1852177 - DNA, 23 bp, Homo sapiens
ctgaaacacacgagcaaacccag

SEQ ID NO: 1852178 - DNA, 15 bp, Homo sapiens
ctgaaagccctgagc

SEQ ID NO: 1852179 - DNA, 17 bp, Homo sapiens
ctgaaagccctgagctt

SEQ ID NO: 1852180 - DNA, 18 bp, Homo sapiens
ctgaaagccctgagcttt

SEQ ID NO: 1852181 - DNA, 23 bp, Homo sapiens
ctgaaagggacgctacccgggaa

SEQ ID NO: 1852182 - DNA, 22 bp, Homo sapiens
ctgaaatagacccacaagaggc

SEQ ID NO: 1852183 - DNA, 17 bp, Homo sapiens
ctgaactctgacaacag

SEQ ID NO: 1852184 - DNA, 14 bp, Homo sapiens
ctgaactttgctga

SEQ ID NO: 1852185 - DNA, 15 bp, Homo sapiens
ctgaagaaaatgaag

SEQ ID NO: 1852186 - DNA, 23 bp, Homo sapiens
ctgaagacaccgttcattcaggc

SEQ ID NO: 1852187 - DNA, 23 bp, Homo sapiens
ctgaagatataactattgcccag

SEQ ID NO: 1852188 - DNA, 16 bp, Homo sapiens
ctgaagccaaagccaa

SEQ ID NO: 1852189 - DNA, 14 bp, Homo sapiens
ctgaaggactgtga

SEQ ID NO: 1852190 - DNA, 17 bp, Homo sapiens
ctgaaggccccgcccag

SEQ ID NO: 1852191 - DNA, 21 bp, Homo sapiens
ctgaaggccccgcccaggctt

SEQ ID NO: 1852192 - DNA, 19 bp, Homo sapiens
ctgaagtgaaactgcttgt

SEQ ID NO: 1852193 - DNA, 12 bp, Homo sapiens
ctgaatctcata

SEQ ID NO: 1852194 - DNA, 22 bp, Homo sapiens
ctgaatgcttataggtggcctc

SEQ ID NO: 1852195 - DNA, 18 bp, Homo sapiens
ctggcggctggggtccca

SEQ ID NO: 1852196 - DNA, 19 bp, Homo sapiens
ctggctccaaaccctcgag

SEQ ID NO: 1852197 - DNA, 14 bp, Homo sapiens
ctggctcttccagg

SEQ ID NO: 1852198 - DNA, 17 bp, Homo sapiens
ctggctcttccaggctg

SEQ ID NO: 1852199 - DNA, 18 bp, Homo sapiens
ctggctcttccaggctgg

SEQ ID NO: 1852200 - DNA, 20 bp, Homo sapiens
ctggctcttccaggctggga

SEQ ID NO: 1852201 - DNA, 22 bp, Homo sapiens
ctggctcttccaggctgggaga

SEQ ID NO: 1852202 - DNA, 15 bp, Homo sapiens
ctggctgaaggactg

SEQ ID NO: 1852203 - DNA, 17 bp, Homo sapiens
ctggctgaaggactgtg

SEQ ID NO: 1852204 - DNA, 21 bp, Homo sapiens
ctggctgggtggcaccagcag

SEQ ID NO: 1852205 - DNA, 22 bp, Homo sapiens
ctggctgggtggcaccagcagc

SEQ ID NO: 1852206 - DNA, 18 bp, Homo sapiens
ctgggaaagcccctgccc

SEQ ID NO: 1852207 - DNA, 19 bp, Homo sapiens
ctgggaacaccataggtca

SEQ ID NO: 1852208 - DNA, 16 bp, Homo sapiens
ctgggaccacgtgaga

SEQ ID NO: 1852209 - DNA, 18 bp, Homo sapiens
ctgggacttgcaaaaagg

SEQ ID NO: 1852210 - DNA, 18 bp, Homo sapiens
ctgggagagccttccagg

SEQ ID NO: 1852211 - DNA, 20 bp, Homo sapiens
ctgggagagccttccagggg

SEQ ID NO: 1852212 - DNA, 20 bp, Homo sapiens
ctgggcaggttggtgggggc

SEQ ID NO: 1852213 - DNA, 16 bp, Homo sapiens
ctgggcatagatgcag

SEQ ID NO: 1852214 - DNA, 12 bp, Homo sapiens
ctgggccagaat

SEQ ID NO: 1852215 - DNA, 18 bp, Homo sapiens
ctgggcttgtctgtagat

SEQ ID NO: 1852216 - DNA, 12 bp, Homo sapiens
ctggggctgctg

SEQ ID NO: 1852217 - DNA, 14 bp, Homo sapiens
ctggggctgctggc

SEQ ID NO: 1852218 - DNA, 22 bp, Homo sapiens
ctggggtcccagcagctgccag

SEQ ID NO: 1852219 - DNA, 20 bp, Homo sapiens
ctgggtaactagggaagata

SEQ ID NO: 1852220 - DNA, 16 bp, Homo sapiens
ctgggtctcagtgtcc

SEQ ID NO: 1852221 - DNA, 16 bp, Homo sapiens
ctgggtgcgtctccag

SEQ ID NO: 1852222 - DNA, 17 bp, Homo sapiens
ctgggtgcgtctccagt

SEQ ID NO: 1852223 - DNA, 19 bp, Homo sapiens
ctgggtgcgtctccagtca

SEQ ID NO: 1852224 - DNA, 23 bp, Homo sapiens
ctgggtggacatggcccctgtga

SEQ ID NO: 1852225 - DNA, 16 bp, Homo sapiens
ctgggtggcactgcca

SEQ ID NO: 1852226 - DNA, 15 bp, Homo sapiens
ctgggtgtggcgcag

SEQ ID NO: 1852227 - DNA, 13 bp, Homo sapiens
ctgggttcctgca

SEQ ID NO: 1852228 - DNA, 16 bp, Homo sapiens
ctgggttctacccagg

SEQ ID NO: 1852229 - DNA, 17 bp, Homo sapiens
ctgggttctacccaggt

SEQ ID NO: 1852230 - DNA, 22 bp, Homo sapiens
ctgggtttaaggggagaggaaa

SEQ ID NO: 1852231 - DNA, 17 bp, Homo sapiens
ctggtattcctgcctcc

SEQ ID NO: 1852232 - DNA, 15 bp, Homo sapiens
ctggtccatagagag

SEQ ID NO: 1852233 - DNA, 18 bp, Homo sapiens
ctggtctctaggctgggg

SEQ ID NO: 1852234 - DNA, 20 bp, Homo sapiens
ctggtgacatcaggtttttc

SEQ ID NO: 1852235 - DNA, 22 bp, Homo sapiens
ctggtgacatgtcttttcttgc

SEQ ID NO: 1852236 - DNA, 23 bp, Homo sapiens
ctggtgactttcctctttggtct

SEQ ID NO: 1852237 - DNA, 20 bp, Homo sapiens
ctggtgccctaacctctgag

SEQ ID NO: 1852238 - DNA, 23 bp, Homo sapiens
ctggtgccctaacctctgagtca

SEQ ID NO: 1852239 - DNA, 14 bp, Homo sapiens
ctggtggcagctca

SEQ ID NO: 1852240 - DNA, 17 bp, Homo sapiens
ctggtggcagctcacct

SEQ ID NO: 1852241 - DNA, 20 bp, Homo sapiens
ctggtggcttaagtgagcag

SEQ ID NO: 1852242 - DNA, 23 bp, Homo sapiens
ctggtggcttaagtgagcagaac

SEQ ID NO: 1852243 - DNA, 13 bp, Homo sapiens
ctggttcctcccc

SEQ ID NO: 1852244 - DNA, 23 bp, Homo sapiens
ctggttctgatgatgtgcctggg

SEQ ID NO: 1852245 - DNA, 17 bp, Homo sapiens
ctgtaaaataaaaggtc

SEQ ID NO: 1852246 - DNA, 13 bp, Homo sapiens
ctgtaagagcttg

SEQ ID NO: 1852247 - DNA, 19 bp, Homo sapiens
ctgtaatcctagcactttg

SEQ ID NO: 1852248 - DNA, 13 bp, Homo sapiens
ctgtacagagccc

SEQ ID NO: 1852249 - DNA, 20 bp, Homo sapiens
ctgtattttgtttttgtctt

SEQ ID NO: 1852250 - DNA, 22 bp, Homo sapiens
ctgtccacaggcttctgagcag

SEQ ID NO: 1852251 - DNA, 22 bp, Homo sapiens
ctgtcccaggttatctgggcat

SEQ ID NO: 1852252 - DNA, 22 bp, Homo sapiens
ctgtcccagtgccgagaaggaa

SEQ ID NO: 1852253 - DNA, 14 bp, Homo sapiens
ctgtccccctgaca

SEQ ID NO: 1852254 - DNA, 14 bp, Homo sapiens
ctgtccgagctttg

SEQ ID NO: 1852255 - DNA, 21 bp, Homo sapiens
ctgtcctattatattcattct

SEQ ID NO: 1852256 - DNA, 13 bp, Homo sapiens
ctgtcctgctggt

SEQ ID NO: 1852257 - DNA, 15 bp, Homo sapiens
ctgtctaggactgca

SEQ ID NO: 1852258 - DNA, 18 bp, Homo sapiens
ctgtctaggactgcagtg

SEQ ID NO: 1852259 - DNA, 21 bp, Homo sapiens
ctgtctccctcccctctcaga

SEQ ID NO: 1852260 - DNA, 23 bp, Homo sapiens
ctgtctggtttcaccgaggacat

SEQ ID NO: 1852261 - DNA, 14 bp, Homo sapiens
cttgtttgttttct

SEQ ID NO: 1852262 - DNA, 14 bp, Homo sapiens
cttgttttctggga

SEQ ID NO: 1852263 - DNA, 22 bp, Homo sapiens
ctttaaaaaattaatctgggcc

SEQ ID NO: 1852264 - DNA, 15 bp, Homo sapiens
ctttaaccctttctg

SEQ ID NO: 1852265 - DNA, 14 bp, Homo sapiens
ctttaatataaatg

SEQ ID NO: 1852266 - DNA, 20 bp, Homo sapiens
ctttaatataaatgcaaata

SEQ ID NO: 1852267 - DNA, 19 bp, Homo sapiens
ctttaatatcatcagtatt

SEQ ID NO: 1852268 - DNA, 21 bp, Homo sapiens
ctttaatatcatcagtattga

SEQ ID NO: 1852269 - DNA, 14 bp, Homo sapiens
ctttagtggcttca

SEQ ID NO: 1852270 - DNA, 14 bp, Homo sapiens
ctttcatattttag

SEQ ID NO: 1852271 - DNA, 15 bp, Homo sapiens
ctttccatctaccct

SEQ ID NO: 1852272 - DNA, 21 bp, Homo sapiens
ctttccccatgtctcgactca

SEQ ID NO: 1852273 - DNA, 13 bp, Homo sapiens
ctttccctccctt

SEQ ID NO: 1852274 - DNA, 14 bp, Homo sapiens
ctttccctcccttc

SEQ ID NO: 1852275 - DNA, 13 bp, Homo sapiens
ctttcctgaggct

SEQ ID NO: 1852276 - DNA, 15 bp, Homo sapiens
ctttcctgaggctgg

SEQ ID NO: 1852277 - DNA, 19 bp, Homo sapiens
ctttctccctcaactgaag

SEQ ID NO: 1852278 - DNA, 21 bp, Homo sapiens
ctttctccctcaactgaaggg

SEQ ID NO: 1852279 - DNA, 22 bp, Homo sapiens
ctttctgggatgtcacagtcca

SEQ ID NO: 1852280 - DNA, 17 bp, Homo sapiens
ctttgaaaagttggaag

SEQ ID NO: 1852281 - DNA, 18 bp, Homo sapiens
ctttgaaaagttggaagg

SEQ ID NO: 1852282 - DNA, 19 bp, Homo sapiens
ctttgaaaagttggaagga

SEQ ID NO: 1852283 - DNA, 14 bp, Homo sapiens
ctttgaagggcaag

SEQ ID NO: 1852284 - DNA, 14 bp, Homo sapiens
ctttgacctgcctc

SEQ ID NO: 1852285 - DNA, 20 bp, Homo sapiens
ctttgacctgcctcccttca

SEQ ID NO: 1852286 - DNA, 17 bp, Homo sapiens
ctttgacgccatcccag

SEQ ID NO: 1852287 - DNA, 18 bp, Homo sapiens
ctttgacgccatcccagc

SEQ ID NO: 1852288 - DNA, 21 bp, Homo sapiens
ctttgacttaggtgtgaagac

SEQ ID NO: 1852289 - DNA, 15 bp, Homo sapiens
ctttgagagagaaag

SEQ ID NO: 1852290 - DNA, 18 bp, Homo sapiens
ctttgagagagaaaggac

SEQ ID NO: 1852291 - DNA, 18 bp, Homo sapiens
ctttgccaccctcatgct

SEQ ID NO: 1852292 - DNA, 16 bp, Homo sapiens
ctttgctttaatataa

SEQ ID NO: 1852293 - DNA, 18 bp, Homo sapiens
ctttgctttaatataaat

SEQ ID NO: 1852294 - DNA, 16 bp, Homo sapiens
ctttgctttgcccagc

SEQ ID NO: 1852295 - DNA, 12 bp, Homo sapiens
ctttggaaagac

SEQ ID NO: 1852296 - DNA, 23 bp, Homo sapiens
ctttggaaagagtaggaagactt

SEQ ID NO: 1852297 - DNA, 18 bp, Homo sapiens
ctttggacagaagcagct

SEQ ID NO: 1852298 - DNA, 21 bp, Homo sapiens
ctttggacagaagcagctctt

SEQ ID NO: 1852299 - DNA, 17 bp, Homo sapiens
ctttggccccactttga

SEQ ID NO: 1852300 - DNA, 14 bp, Homo sapiens
ctttggctgcatgc

SEQ ID NO: 1852301 - DNA, 16 bp, Homo sapiens
ctttggtctacactgt

SEQ ID NO: 1852302 - DNA, 20 bp, Homo sapiens
ctttgtatttttacttttaa

SEQ ID NO: 1852303 - DNA, 15 bp, Homo sapiens
ctttgtgaggaagcc

SEQ ID NO: 1852304 - DNA, 19 bp, Homo sapiens
ctttgtgaggaagccgctg

SEQ ID NO: 1852305 - DNA, 23 bp, Homo sapiens
ctttgtgaggaagccgctggggc

SEQ ID NO: 1852306 - DNA, 16 bp, Homo sapiens
ctttgttctggctctt

SEQ ID NO: 1852307 - DNA, 13 bp, Homo sapiens
ctttgttctgttt

SEQ ID NO: 1852308 - DNA, 17 bp, Homo sapiens
ctttgttttgtgtctct

SEQ ID NO: 1852309 - DNA, 18 bp, Homo sapiens
cttttaatgctccaaatg

SEQ ID NO: 1852310 - DNA, 19 bp, Homo sapiens
cttttaatgctccaaatgc

SEQ ID NO: 1852311 - DNA, 20 bp, Homo sapiens
cttttcatgcaaactctttg

SEQ ID NO: 1852312 - DNA, 21 bp, Homo sapiens
cttttcgcaggattcttcctc

SEQ ID NO: 1852313 - DNA, 18 bp, Homo sapiens
cttttcttgcatgaggct

SEQ ID NO: 1852314 - DNA, 23 bp, Homo sapiens
cttttcttgcatgaggctagtgt

SEQ ID NO: 1852315 - DNA, 13 bp, Homo sapiens
cttttggttaagt

SEQ ID NO: 1852316 - DNA, 16 bp, Homo sapiens
cttttggttaagtctg

SEQ ID NO: 1852317 - DNA, 16 bp, Homo sapiens
ctttttcactttgaaa

SEQ ID NO: 1852318 - DNA, 14 bp, Homo sapiens
cttttttggctgct

SEQ ID NO: 1852319 - DNA, 23 bp, Homo sapiens
cttttttggctgctgaaggctcg

SEQ ID NO: 1852320 - DNA, 20 bp, Homo sapiens
ctttttttgagtgacagctt

SEQ ID NO: 1852321 - DNA, 16 bp, Homo sapiens
ctttttttttttttcc

SEQ ID NO: 1852322 - DNA, 21 bp, Homo sapiens
gaaaaaaaacctgagatttat

SEQ ID NO: 1852323 - DNA, 14 bp, Homo sapiens
gaaaaaaatgtatt

SEQ ID NO: 1852324 - DNA, 14 bp, Homo sapiens
gaaaaagatctttc

SEQ ID NO: 1852325 - DNA, 14 bp, Homo sapiens
gaaaaataaagaaa

SEQ ID NO: 1852326 - DNA, 17 bp, Homo sapiens
gaaaaataaagaaaaga

SEQ ID NO: 1852327 - DNA, 13 bp, Homo sapiens
gaaaacattccat

SEQ ID NO: 1852328 - DNA, 23 bp, Homo sapiens
gaaaagaaaaatgagcctggcaa

SEQ ID NO: 1852329 - DNA, 22 bp, Homo sapiens
gaaaagaattgttgggggtttt

SEQ ID NO: 1852330 - DNA, 22 bp, Homo sapiens
gaaaagatgcactttgctttaa

SEQ ID NO: 1852331 - DNA, 19 bp, Homo sapiens
gaaaatacctaattgtgga

SEQ ID NO: 1852332 - DNA, 14 bp, Homo sapiens
gaaaatcagcctgc

SEQ ID NO: 1852333 - DNA, 18 bp, Homo sapiens
gaaaatggccatgcagga

SEQ ID NO: 1852334 - DNA, 16 bp, Homo sapiens
gaaacacccctctgtc

SEQ ID NO: 1852335 - DNA, 18 bp, Homo sapiens
gaaacaccctcacactgg

SEQ ID NO: 1852336 - DNA, 17 bp, Homo sapiens
gaaaccacagctgctgg

SEQ ID NO: 1852337 - DNA, 15 bp, Homo sapiens
gaaacccagctctgg

SEQ ID NO: 1852338 - DNA, 23 bp, Homo sapiens
gaaacccagctctggtccataga

SEQ ID NO: 1852339 - DNA, 22 bp, Homo sapiens
gaaactttattcaagtaaaaat

SEQ ID NO: 1852340 - DNA, 19 bp, Homo sapiens
gaaagacttttccaaccct

SEQ ID NO: 1852341 - DNA, 14 bp, Homo sapiens
gaaagagaaggtgg

SEQ ID NO: 1852342 - DNA, 15 bp, Homo sapiens
gaaagagtaggaaga

SEQ ID NO: 1852343 - DNA, 15 bp, Homo sapiens
gaaagcacaggtggg

SEQ ID NO: 1852344 - DNA, 21 bp, Homo sapiens
gaaagcactgcatgaataaaa

SEQ ID NO: 1852345 - DNA, 17 bp, Homo sapiens
gaaagccctgagctttc

SEQ ID NO: 1852346 - DNA, 22 bp, Homo sapiens
gaaagccctgagctttctgcta

SEQ ID NO: 1852347 - DNA, 14 bp, Homo sapiens
gaaaggctccagga

SEQ ID NO: 1852348 - DNA, 15 bp, Homo sapiens
gaaaggctccaggag

SEQ ID NO: 1852349 - DNA, 21 bp, Homo sapiens
gaaaggctccaggagcagcca

SEQ ID NO: 1852350 - DNA, 18 bp, Homo sapiens
gaaagttgcacggctgct

SEQ ID NO: 1852351 - DNA, 19 bp, Homo sapiens
gaaatactgtttgaggttt

SEQ ID NO: 1852352 - DNA, 15 bp, Homo sapiens
gaaatagcttatgaa

SEQ ID NO: 1852353 - DNA, 19 bp, Homo sapiens
gaaatcttacagctgggtg

SEQ ID NO: 1852354 - DNA, 12 bp, Homo sapiens
gaaatgcatttt

SEQ ID NO: 1852355 - DNA, 23 bp, Homo sapiens
gaaatgcattttgctagacagtt

SEQ ID NO: 1852356 - DNA, 15 bp, Homo sapiens
gaaatgggcagagca

SEQ ID NO: 1852357 - DNA, 16 bp, Homo sapiens
gaaatgggcagagcag

SEQ ID NO: 1852358 - DNA, 22 bp, Homo sapiens
gaaattcccttcatctggaacc

SEQ ID NO: 1852359 - DNA, 14 bp, Homo sapiens
gaaatttagcattg

SEQ ID NO: 1852360 - DNA, 15 bp, Homo sapiens
gaacaaagtgagaca

SEQ ID NO: 1852361 - DNA, 15 bp, Homo sapiens
gaacaagagaagcat

SEQ ID NO: 1852362 - DNA, 18 bp, Homo sapiens
gaacactccaattaagga

SEQ ID NO: 1852363 - DNA, 16 bp, Homo sapiens
gaacactccttcacag

SEQ ID NO: 1852364 - DNA, 17 bp, Homo sapiens
gaacactccttcacaga

SEQ ID NO: 1852365 - DNA, 17 bp, Homo sapiens
gaacagataatccctgt

SEQ ID NO: 1852366 - DNA, 18 bp, Homo sapiens
gaacagataatccctgta

SEQ ID NO: 1852367 - DNA, 11 bp, Homo sapiens
gaacagctgtg

SEQ ID NO: 1852368 - DNA, 13 bp, Homo sapiens
gaacagctgtgtc

SEQ ID NO: 1852369 - DNA, 14 bp, Homo sapiens
gaacagctgtgtct

SEQ ID NO: 1852370 - DNA, 19 bp, Homo sapiens
gaacagctgtgtctgccaa

SEQ ID NO: 1852371 - DNA, 21 bp, Homo sapiens
gaacatcatcaaggcactgcc

SEQ ID NO: 1852372 - DNA, 12 bp, Homo sapiens
gaaccatcagaa

SEQ ID NO: 1852373 - DNA, 12 bp, Homo sapiens
gaactaaacttt

SEQ ID NO: 1852374 - DNA, 21 bp, Homo sapiens
gaactatggacggtgctccag

SEQ ID NO: 1852375 - DNA, 17 bp, Homo sapiens
gaactctactcaaccca

SEQ ID NO: 1852376 - DNA, 20 bp, Homo sapiens
gaagaaatctttctccctca

SEQ ID NO: 1852377 - DNA, 23 bp, Homo sapiens
gaagaaatctttctccctcaact

SEQ ID NO: 1852378 - DNA, 17 bp, Homo sapiens
gaagagcccgcagggcc

SEQ ID NO: 1852379 - DNA, 20 bp, Homo sapiens
gaagataatattaaggaaga

SEQ ID NO: 1852380 - DNA, 17 bp, Homo sapiens
gacagttcctgagacca

SEQ ID NO: 1852381 - DNA, 15 bp, Homo sapiens
gacatgctgaagcca

SEQ ID NO: 1852382 - DNA, 18 bp, Homo sapiens
gacatgggaaaggggaag

SEQ ID NO: 1852383 - DNA, 17 bp, Homo sapiens
gacatgtttttatatgt

SEQ ID NO: 1852384 - DNA, 16 bp, Homo sapiens
gaccacactccagctg

SEQ ID NO: 1852385 - DNA, 18 bp, Homo sapiens
gaccagggatttccatga

SEQ ID NO: 1852386 - DNA, 14 bp, Homo sapiens
gaccatccctgaag

SEQ ID NO: 1852387 - DNA, 21 bp, Homo sapiens
gaccattctccacctgccagg

SEQ ID NO: 1852388 - DNA, 13 bp, Homo sapiens
gacccaggctggg

SEQ ID NO: 1852389 - DNA, 14 bp, Homo sapiens
gacccatgctgccc

SEQ ID NO: 1852390 - DNA, 20 bp, Homo sapiens
gaccctgaggcccagagggc

SEQ ID NO: 1852391 - DNA, 21 bp, Homo sapiens
gaccctgaggcccagagggcc

SEQ ID NO: 1852392 - DNA, 12 bp, Homo sapiens
gaccctgccctg

SEQ ID NO: 1852393 - DNA, 16 bp, Homo sapiens
gaccctgccctgtggg

SEQ ID NO: 1852394 - DNA, 19 bp, Homo sapiens
gacccttgccgtctacctg

SEQ ID NO: 1852395 - DNA, 19 bp, Homo sapiens
gacctcaggtgagaagcag

SEQ ID NO: 1852396 - DNA, 21 bp, Homo sapiens
gacctcaggtgagaagcagag

SEQ ID NO: 1852397 - DNA, 16 bp, Homo sapiens
gacctcatgcccagct

SEQ ID NO: 1852398 - DNA, 17 bp, Homo sapiens
gacctcatgcccagctc

SEQ ID NO: 1852399 - DNA, 19 bp, Homo sapiens
gacctcatgcccagctctc

SEQ ID NO: 1852400 - DNA, 23 bp, Homo sapiens
gacctcatgcccagctctctgac

SEQ ID NO: 1852401 - DNA, 12 bp, Homo sapiens
gacctcctgcct

SEQ ID NO: 1852402 - DNA, 13 bp, Homo sapiens
gacctgaggccct

SEQ ID NO: 1852403 - DNA, 22 bp, Homo sapiens
gacctgcctcccttcatgcatg

SEQ ID NO: 1852404 - DNA, 23 bp, Homo sapiens
gaccttctaggacgccacccagc

SEQ ID NO: 1852405 - DNA, 20 bp, Homo sapiens
gacgcaggcccctctcctcc

SEQ ID NO: 1852406 - DNA, 14 bp, Homo sapiens
gacgccacccagca

SEQ ID NO: 1852407 - DNA, 12 bp, Homo sapiens
gacgccatccca

SEQ ID NO: 1852408 - DNA, 19 bp, Homo sapiens
gacgccatcccagccccaa

SEQ ID NO: 1852409 - DNA, 18 bp, Homo sapiens
gacgctacccgggaaggg

SEQ ID NO: 1852410 - DNA, 13 bp, Homo sapiens
gacgctgtgctgc

SEQ ID NO: 1852411 - DNA, 15 bp, Homo sapiens
gacgctgtgctgccc

SEQ ID NO: 1852412 - DNA, 16 bp, Homo sapiens
gacgctgtgctgccct

SEQ ID NO: 1852413 - DNA, 22 bp, Homo sapiens
gacgctgtgctgccctgcccac

SEQ ID NO: 1852414 - DNA, 16 bp, Homo sapiens
gacgcttgtgacagtg

SEQ ID NO: 1852415 - DNA, 21 bp, Homo sapiens
gacgcttgtgacagtgcctct

SEQ ID NO: 1852416 - DNA, 17 bp, Homo sapiens
gacggtgctccaggcag

SEQ ID NO: 1852417 - DNA, 18 bp, Homo sapiens
gactacttgggagcaccg

SEQ ID NO: 1852418 - DNA, 13 bp, Homo sapiens
gactatcagccca

SEQ ID NO: 1852419 - DNA, 20 bp, Homo sapiens
gactcagctccccagagtcc

SEQ ID NO: 1852420 - DNA, 12 bp, Homo sapiens
gactcctgcagg

SEQ ID NO: 1852421 - DNA, 14 bp, Homo sapiens
gactcctgcaggca

SEQ ID NO: 1852422 - DNA, 21 bp, Homo sapiens
gactcctgcaggcagccaggc

SEQ ID NO: 1852423 - DNA, 16 bp, Homo sapiens
gactctttttttgagt

SEQ ID NO: 1852424 - DNA, 13 bp, Homo sapiens
gactgcagagggc

SEQ ID NO: 1852425 - DNA, 16 bp, Homo sapiens
gactgcagtgtggagt

SEQ ID NO: 1852426 - DNA, 19 bp, Homo sapiens
gactgtatctgtgtagact

SEQ ID NO: 1852427 - DNA, 16 bp, Homo sapiens
gactgttttctcttga

SEQ ID NO: 1852428 - DNA, 23 bp, Homo sapiens
gacttagaaaaccagctcagcac

SEQ ID NO: 1852429 - DNA, 22 bp, Homo sapiens
gacttcagattccccactcagc

SEQ ID NO: 1852430 - DNA, 12 bp, Homo sapiens
gacttgggatgg

SEQ ID NO: 1852431 - DNA, 19 bp, Homo sapiens
gactttaacataagctatt

SEQ ID NO: 1852432 - DNA, 14 bp, Homo sapiens
gactttggaaagac

SEQ ID NO: 1852433 - DNA, 19 bp, Homo sapiens
gactttggctgcatgcgag

SEQ ID NO: 1852434 - DNA, 18 bp, Homo sapiens
gacttttatttccagtga

SEQ ID NO: 1852435 - DNA, 15 bp, Homo sapiens
gaggcccagagggcc

SEQ ID NO: 1852436 - DNA, 18 bp, Homo sapiens
gaggcccttgtcgtggga

SEQ ID NO: 1852437 - DNA, 23 bp, Homo sapiens
gaggcccttgtcgtgggatggca

SEQ ID NO: 1852438 - DNA, 18 bp, Homo sapiens
gaggcctactcttccatc

SEQ ID NO: 1852439 - DNA, 16 bp, Homo sapiens
gaggctgggctccctt

SEQ ID NO: 1852440 - DNA, 23 bp, Homo sapiens
gagggacatgcttagcagtcccc

SEQ ID NO: 1852441 - DNA, 13 bp, Homo sapiens
gagggagctggga

SEQ ID NO: 1852442 - DNA, 14 bp, Homo sapiens
gagggagggagggc

SEQ ID NO: 1852443 - DNA, 15 bp, Homo sapiens
gagggagggctccag

SEQ ID NO: 1852444 - DNA, 16 bp, Homo sapiens
gagggagggctccaga

SEQ ID NO: 1852445 - DNA, 21 bp, Homo sapiens
gagggagttttgtctgtctcc

SEQ ID NO: 1852446 - DNA, 22 bp, Homo sapiens
gagggagttttgtctgtctccc

SEQ ID NO: 1852447 - DNA, 15 bp, Homo sapiens
gagggcacacactgt

SEQ ID NO: 1852448 - DNA, 13 bp, Homo sapiens
gagggcaggcttg

SEQ ID NO: 1852449 - DNA, 18 bp, Homo sapiens
gagggcaggcttggggaa

SEQ ID NO: 1852450 - DNA, 17 bp, Homo sapiens
gagggcctgcaagggag

SEQ ID NO: 1852451 - DNA, 13 bp, Homo sapiens
gagggctccagac

SEQ ID NO: 1852452 - DNA, 12 bp, Homo sapiens
gaggggcctctt

SEQ ID NO: 1852453 - DNA, 22 bp, Homo sapiens
gaggggggaggtgggatcctcc

SEQ ID NO: 1852454 - DNA, 19 bp, Homo sapiens
gaggggggatttccagcca

SEQ ID NO: 1852455 - DNA, 24 bp, Homo sapiens
gaggtaaggaatacctgtccccct

SEQ ID NO: 1852456 - DNA, 20 bp, Homo sapiens
gaggtccagccctggctgaa

SEQ ID NO: 1852457 - DNA, 12 bp, Homo sapiens
gaggtctatttt

SEQ ID NO: 1852458 - DNA, 24 bp, Homo sapiens
gaggtgcgtgttcagcagaacctg

SEQ ID NO: 1852459 - DNA, 13 bp, Homo sapiens
gaggtggagaaaa

SEQ ID NO: 1852460 - DNA, 15 bp, Homo sapiens
gaggtggagaaaatt

SEQ ID NO: 1852461 - DNA, 12 bp, Homo sapiens
gaggtgggatcc

SEQ ID NO: 1852462 - DNA, 17 bp, Homo sapiens
gagtaacagtcatcatt

SEQ ID NO: 1852463 - DNA, 19 bp, Homo sapiens
gagtaacagtcatcattta

SEQ ID NO: 1852464 - DNA, 18 bp, Homo sapiens
gagtaggaagactttgga

SEQ ID NO: 1852465 - DNA, 23 bp, Homo sapiens
gagtcccctgtttgtttctgaaa

SEQ ID NO: 1852466 - DNA, 12 bp, Homo sapiens
gagtctgaaggc

SEQ ID NO: 1852467 - DNA, 14 bp, Homo sapiens
gagtctgaaggctg

SEQ ID NO: 1852468 - DNA, 15 bp, Homo sapiens
gagtctgaaggctgg

SEQ ID NO: 1852469 - DNA, 16 bp, Homo sapiens
gagtgacagctttctg

SEQ ID NO: 1852470 - DNA, 17 bp, Homo sapiens
gagtgacagctttctgg

SEQ ID NO: 1852471 - DNA, 22 bp, Homo sapiens
gagtgcagtggcgcaatcttaa

SEQ ID NO: 1852472 - DNA, 19 bp, Homo sapiens
gagtgcttgcttttcatgc

SEQ ID NO: 1852473 - DNA, 12 bp, Homo sapiens
gagtgggcccaa

SEQ ID NO: 1852474 - DNA, 23 bp, Homo sapiens
gagtgggggatcacagcctctga

SEQ ID NO: 1852475 - DNA, 13 bp, Homo sapiens
gagtgggtgaata

SEQ ID NO: 1852476 - DNA, 14 bp, Homo sapiens
gagttcaccttgga

SEQ ID NO: 1852477 - DNA, 16 bp, Homo sapiens
gagttgattcagctct

SEQ ID NO: 1852478 - DNA, 18 bp, Homo sapiens
gagtttatgttccattaa

SEQ ID NO: 1852479 - DNA, 22 bp, Homo sapiens
gataaacacaagattggtgttt

SEQ ID NO: 1852480 - DNA, 19 bp, Homo sapiens
gatacttcgacactgttct

SEQ ID NO: 1852481 - DNA, 13 bp, Homo sapiens
gatagacttggga

SEQ ID NO: 1852482 - DNA, 19 bp, Homo sapiens
gatataactattgcccagg

SEQ ID NO: 1852483 - DNA, 12 bp, Homo sapiens
gatatagaacag

SEQ ID NO: 1852484 - DNA, 22 bp, Homo sapiens
gatatttccctcccctggggac

SEQ ID NO: 1852485 - DNA, 22 bp, Homo sapiens
gctctgctattaggccagcaag

SEQ ID NO: 1852486 - DNA, 16 bp, Homo sapiens
gctctggtccatagag

SEQ ID NO: 1852487 - DNA, 23 bp, Homo sapiens
gctctggtccatagagagcaaga

SEQ ID NO: 1852488 - DNA, 22 bp, Homo sapiens
gctctggtggcttaagtgagca

SEQ ID NO: 1852489 - DNA, 17 bp, Homo sapiens
gctctgtccccagcctg

SEQ ID NO: 1852490 - DNA, 16 bp, Homo sapiens
gctcttccaggctggg

SEQ ID NO: 1852491 - DNA, 18 bp, Homo sapiens
gctcttccaggctgggag

SEQ ID NO: 1852492 - DNA, 19 bp, Homo sapiens
gctcttccaggctgggaga

SEQ ID NO: 1852493 - DNA, 22 bp, Homo sapiens
gctcttccaggctgggagagcc

SEQ ID NO: 1852494 - DNA, 23 bp, Homo sapiens
gctgaacactccaattaaggatt

SEQ ID NO: 1852495 - DNA, 20 bp, Homo sapiens
gctgaacttgttttctggga

SEQ ID NO: 1852496 - DNA, 12 bp, Homo sapiens
gctgaaggactg

SEQ ID NO: 1852497 - DNA, 13 bp, Homo sapiens
gctgaaggactgt

SEQ ID NO: 1852498 - DNA, 21 bp, Homo sapiens
gctgaaggactgtgacaggca

SEQ ID NO: 1852499 - DNA, 22 bp, Homo sapiens
gctgaaggactgtgacaggcag

SEQ ID NO: 1852500 - DNA, 23 bp, Homo sapiens
gctgaaggctcgagcatgcctgg

SEQ ID NO: 1852501 - DNA, 13 bp, Homo sapiens
gctgaatgttttt

SEQ ID NO: 1852502 - DNA, 15 bp, Homo sapiens
gctgaatgtttttct

SEQ ID NO: 1852503 - DNA, 18 bp, Homo sapiens
gctgacacaaacctgcct

SEQ ID NO: 1852504 - DNA, 13 bp, Homo sapiens
gctgacatcattt

SEQ ID NO: 1852505 - DNA, 16 bp, Homo sapiens
gctgacatcatttgta

SEQ ID NO: 1852506 - DNA, 14 bp, Homo sapiens
gctgagaacactgt

SEQ ID NO: 1852507 - DNA, 23 bp, Homo sapiens
gctgagggtgagtgggtgaataa

SEQ ID NO: 1852508 - DNA, 22 bp, Homo sapiens
gctgagtgggggatcacagcct

SEQ ID NO: 1852509 - DNA, 19 bp, Homo sapiens
gctgcaccctcaggcaggt

SEQ ID NO: 1852510 - DNA, 13 bp, Homo sapiens
gctgcaccggctg

SEQ ID NO: 1852511 - DNA, 16 bp, Homo sapiens
gctgcaccggctggcc

SEQ ID NO: 1852512 - DNA, 14 bp, Homo sapiens
gctgcccaggccca

SEQ ID NO: 1852513 - DNA, 20 bp, Homo sapiens
gctgccctgcccacctggcc

SEQ ID NO: 1852514 - DNA, 22 bp, Homo sapiens
gctgccctgcccacctggcctc

SEQ ID NO: 1852515 - DNA, 17 bp, Homo sapiens
gctgccgccccacccag

SEQ ID NO: 1852516 - DNA, 21 bp, Homo sapiens
gctgcctgggatccctcatcc

SEQ ID NO: 1852517 - DNA, 22 bp, Homo sapiens
gctgctaatattttcctcctga

SEQ ID NO: 1852518 - DNA, 13 bp, Homo sapiens
gctgctgaaggct

SEQ ID NO: 1852519 - DNA, 14 bp, Homo sapiens
gctgctgaaggctc

SEQ ID NO: 1852520 - DNA, 13 bp, Homo sapiens
gctgctgcccagg

SEQ ID NO: 1852521 - DNA, 12 bp, Homo sapiens
gctgctgctgct

SEQ ID NO: 1852522 - DNA, 13 bp, Homo sapiens
gctgctggagact

SEQ ID NO: 1852523 - DNA, 13 bp, Homo sapiens
gctgctggctggt

SEQ ID NO: 1852524 - DNA, 20 bp, Homo sapiens
gctggagactcctaggcagg

SEQ ID NO: 1852525 - DNA, 17 bp, Homo sapiens
gctggagcctggtgccc

SEQ ID NO: 1852526 - DNA, 14 bp, Homo sapiens
gctggatagacttg

SEQ ID NO: 1852527 - DNA, 16 bp, Homo sapiens
gctggatagacttggg

SEQ ID NO: 1852528 - DNA, 13 bp, Homo sapiens
gctggcctggccc

SEQ ID NO: 1852529 - DNA, 14 bp, Homo sapiens
gctggcctggcccc

SEQ ID NO: 1852530 - DNA, 15 bp, Homo sapiens
gctggcctggcccct

SEQ ID NO: 1852531 - DNA, 16 bp, Homo sapiens
gctggcctggcccctc

SEQ ID NO: 1852532 - DNA, 18 bp, Homo sapiens
gctggcctggcccctcag

SEQ ID NO: 1852533 - DNA, 18 bp, Homo sapiens
gctgggaattacaggcgt

SEQ ID NO: 1852534 - DNA, 20 bp, Homo sapiens
gctgggacatgggaaagggg

SEQ ID NO: 1852535 - DNA, 17 bp, Homo sapiens
gctgggagagccttcca

SEQ ID NO: 1852536 - DNA, 19 bp, Homo sapiens
gctgggatgattggagggg

SEQ ID NO: 1852537 - DNA, 14 bp, Homo sapiens
gctgggcaggttgg

SEQ ID NO: 1852538 - DNA, 20 bp, Homo sapiens
gctgggctcccttcccacct

SEQ ID NO: 1852539 - DNA, 21 bp, Homo sapiens
gctgggctcccttcccacctc

SEQ ID NO: 1852540 - DNA, 16 bp, Homo sapiens
gctggggccaaataaa

SEQ ID NO: 1852541 - DNA, 23 bp, Homo sapiens
gctgggggaagaagctctctcct

SEQ ID NO: 1852542 - DNA, 14 bp, Homo sapiens
gctggggtcccagc

SEQ ID NO: 1852543 - DNA, 17 bp, Homo sapiens
gctggggtcccagcagc

SEQ ID NO: 1852544 - DNA, 19 bp, Homo sapiens
gctggggtcccagcagctg

SEQ ID NO: 1852545 - DNA, 22 bp, Homo sapiens
gctgggtggcaccagcagcctg

SEQ ID NO: 1852546 - DNA, 17 bp, Homo sapiens
gctgggtggcactgcca

SEQ ID NO: 1852547 - DNA, 15 bp, Homo sapiens
gctgggttctaccca

SEQ ID NO: 1852548 - DNA, 18 bp, Homo sapiens
gctggtgagtgatgcggc

SEQ ID NO: 1852549 - DNA, 22 bp, Homo sapiens
gctgtgacaatggcaacaattt

SEQ ID NO: 1852550 - DNA, 16 bp, Homo sapiens
gctgtgctgccctgcc

SEQ ID NO: 1852551 - DNA, 19 bp, Homo sapiens
gctgtgctgccctgcccac

SEQ ID NO: 1852552 - DNA, 14 bp, Homo sapiens
gctgtgtctgccaa

SEQ ID NO: 1852553 - DNA, 19 bp, Homo sapiens
gcttaagtgagcagaacag

SEQ ID NO: 1852554 - DNA, 19 bp, Homo sapiens
gcttagctttgctctgcca

SEQ ID NO: 1852555 - DNA, 15 bp, Homo sapiens
gcttagtcactgaga

SEQ ID NO: 1852556 - DNA, 21 bp, Homo sapiens
gcttagtcactgagacagccc

SEQ ID NO: 1852557 - DNA, 19 bp, Homo sapiens
gcttatctcaggggtgtgc

SEQ ID NO: 1852558 - DNA, 15 bp, Homo sapiens
gcttatgaaaagaat

SEQ ID NO: 1852559 - DNA, 18 bp, Homo sapiens
gcttcacggaagagcctt

SEQ ID NO: 1852560 - DNA, 19 bp, Homo sapiens
gcttcacggaagagccttg

SEQ ID NO: 1852561 - DNA, 20 bp, Homo sapiens
gcttcacggaagagccttgc

SEQ ID NO: 1852562 - DNA, 17 bp, Homo sapiens
gcttcattagagcaggc

SEQ ID NO: 1852563 - DNA, 21 bp, Homo sapiens
gcttccagtgaggctctgccc

SEQ ID NO: 1852564 - DNA, 18 bp, Homo sapiens
gcttcccaagggctgccg

SEQ ID NO: 1852565 - DNA, 21 bp, Homo sapiens
gcttcccagtggctgctgccc

SEQ ID NO: 1852566 - DNA, 21 bp, Homo sapiens
gcttctgagcagcgagcctgc

SEQ ID NO: 1852567 - DNA, 12 bp, Homo sapiens
gcttctgcctgc

SEQ ID NO: 1852568 - DNA, 12 bp, Homo sapiens
gcttcttcagag

SEQ ID NO: 1852569 - DNA, 15 bp, Homo sapiens
gcttcttcagagact

SEQ ID NO: 1852570 - DNA, 17 bp, Homo sapiens
gcttgaagtaaccttat

SEQ ID NO: 1852571 - DNA, 14 bp, Homo sapiens
gcttgagctcagga

SEQ ID NO: 1852572 - DNA, 13 bp, Homo sapiens
gcttggaggaagg

SEQ ID NO: 1852573 - DNA, 20 bp, Homo sapiens
gggctgggttctacccaggt

SEQ ID NO: 1852574 - DNA, 22 bp, Homo sapiens
gggctgggttctacccaggtgc

SEQ ID NO: 1852575 - DNA, 21 bp, Homo sapiens
gggcttcccagtggctgctgc

SEQ ID NO: 1852576 - DNA, 22 bp, Homo sapiens
gggcttcccagtggctgctgcc

SEQ ID NO: 1852577 - DNA, 19 bp, Homo sapiens
ggggaaaatcagcctgctc

SEQ ID NO: 1852578 - DNA, 16 bp, Homo sapiens
ggggaagtcctctggg

SEQ ID NO: 1852579 - DNA, 15 bp, Homo sapiens
ggggacgcaggcccc

SEQ ID NO: 1852580 - DNA, 16 bp, Homo sapiens
ggggacgcaggcccct

SEQ ID NO: 1852581 - DNA, 17 bp, Homo sapiens
ggggacgcaggcccctc

SEQ ID NO: 1852582 - DNA, 21 bp, Homo sapiens
ggggagcaaatcatctgcatt

SEQ ID NO: 1852583 - DNA, 22 bp, Homo sapiens
ggggaggcctctttgccccgac

SEQ ID NO: 1852584 - DNA, 17 bp, Homo sapiens
ggggcagaggcagtacc

SEQ ID NO: 1852585 - DNA, 17 bp, Homo sapiens
ggggccagttggtcccc

SEQ ID NO: 1852586 - DNA, 19 bp, Homo sapiens
ggggccagttggtccccct

SEQ ID NO: 1852587 - DNA, 15 bp, Homo sapiens
ggggccctgcctcct

SEQ ID NO: 1852588 - DNA, 19 bp, Homo sapiens
ggggctgaggtgggaggat

SEQ ID NO: 1852589 - DNA, 21 bp, Homo sapiens
ggggctgcaccggctggcctg

SEQ ID NO: 1852590 - DNA, 23 bp, Homo sapiens
ggggctgcaccggctggcctggc

SEQ ID NO: 1852591 - DNA, 12 bp, Homo sapiens
ggggctgtggat

SEQ ID NO: 1852592 - DNA, 13 bp, Homo sapiens
gggggtggcctcc

SEQ ID NO: 1852593 - DNA, 22 bp, Homo sapiens
ggggtaaagggcgcaaagggca

SEQ ID NO: 1852594 - DNA, 14 bp, Homo sapiens
ggggtcccagcagc

SEQ ID NO: 1852595 - DNA, 15 bp, Homo sapiens
gggtcgggagagggg

SEQ ID NO: 1852596 - DNA, 15 bp, Homo sapiens
gggtctcagtgtcct

SEQ ID NO: 1852597 - DNA, 15 bp, Homo sapiens
gggtggcaccagcag

SEQ ID NO: 1852598 - DNA, 19 bp, Homo sapiens
gggtggcaccagcagcctg

SEQ ID NO: 1852599 - DNA, 19 bp, Homo sapiens
gggtgggacaccctgtgat

SEQ ID NO: 1852600 - DNA, 17 bp, Homo sapiens
gggtgtggcgcagcata

SEQ ID NO: 1852601 - DNA, 11 bp, Homo sapiens
gggttcctgca

SEQ ID NO: 1852602 - DNA, 12 bp, Homo sapiens
gggttctaccca

SEQ ID NO: 1852603 - DNA, 16 bp, Homo sapiens
ggtaagtgttctcatg

SEQ ID NO: 1852604 - DNA, 23 bp, Homo sapiens
ggtaagtgttctcatgaagcagg

SEQ ID NO: 1852605 - DNA, 20 bp, Homo sapiens
ggtagaaagagatacagagg

SEQ ID NO: 1852606 - DNA, 12 bp, Homo sapiens
ggtcactctggc

SEQ ID NO: 1852607 - DNA, 20 bp, Homo sapiens
ggtcactctggcagctcaga

SEQ ID NO: 1852608 - DNA, 22 bp, Homo sapiens
ggtcactctggcagctcagaga

SEQ ID NO: 1852609 - DNA, 15 bp, Homo sapiens
ggtccatagagagca

SEQ ID NO: 1852610 - DNA, 12 bp, Homo sapiens
ggtcccacccca

SEQ ID NO: 1852611 - DNA, 16 bp, Homo sapiens
ggtcccaccccacaca

SEQ ID NO: 1852612 - DNA, 12 bp, Homo sapiens
ggtcccagcagc

SEQ ID NO: 1852613 - DNA, 18 bp, Homo sapiens
ggtcccccttccatggac

SEQ ID NO: 1852614 - DNA, 12 bp, Homo sapiens
ggtcgggagagg

SEQ ID NO: 1852615 - DNA, 15 bp, Homo sapiens
ggtctctaggctggg

SEQ ID NO: 1852616 - DNA, 17 bp, Homo sapiens
ggtctctaggctgggga

SEQ ID NO: 1852617 - DNA, 18 bp, Homo sapiens
ggtctctaggctggggaa

SEQ ID NO: 1852618 - DNA, 13 bp, Homo sapiens
ggtctctgctgcc

SEQ ID NO: 1852619 - DNA, 22 bp, Homo sapiens
ggtgagcccatggccctcccag

SEQ ID NO: 1852620 - DNA, 16 bp, Homo sapiens
ggtgcacaagctccaa

SEQ ID NO: 1852621 - DNA, 14 bp, Homo sapiens
ggtgcgtctccagt

SEQ ID NO: 1852622 - DNA, 17 bp, Homo sapiens
ggtgcgtctccagtcat

SEQ ID NO: 1852623 - DNA, 21 bp, Homo sapiens
ggtgcgtgttcagcagaacct

SEQ ID NO: 1852624 - DNA, 17 bp, Homo sapiens
ggtgctatctcccccag

SEQ ID NO: 1852625 - DNA, 20 bp, Homo sapiens
ggtgctatctcccccagccc

SEQ ID NO: 1852626 - DNA, 21 bp, Homo sapiens
ggtggagaaaattggaactct

SEQ ID NO: 1852627 - DNA, 18 bp, Homo sapiens
ggtggatgttatgaacag

SEQ ID NO: 1852628 - DNA, 16 bp, Homo sapiens
ggtgggacaccctgtg

SEQ ID NO: 1852629 - DNA, 17 bp, Homo sapiens
ggtgggacaccctgtga

SEQ ID NO: 1852630 - DNA, 19 bp, Homo sapiens
ggtgggatcctccaggtgc

SEQ ID NO: 1852631 - DNA, 13 bp, Homo sapiens
ggtgggggcctcg

SEQ ID NO: 1852632 - DNA, 20 bp, Homo sapiens
ggtggggtgagggcttgagg

SEQ ID NO: 1852633 - DNA, 19 bp, Homo sapiens
ggtggtcactggaactcag

SEQ ID NO: 1852634 - DNA, 14 bp, Homo sapiens
ggtgtggagaagcg

SEQ ID NO: 1852635 - DNA, 16 bp, Homo sapiens
ggttaagtctgtttta

SEQ ID NO: 1852636 - DNA, 18 bp, Homo sapiens
ggttctggtgtgaactaa

SEQ ID NO: 1852637 - DNA, 22 bp, Homo sapiens
ggttcttgtattaagaatgaaa

SEQ ID NO: 1852638 - DNA, 21 bp, Homo sapiens
ggttgaggtccagccctggct

SEQ ID NO: 1852639 - DNA, 23 bp, Homo sapiens
ggttgaggtccagccctggctga

SEQ ID NO: 1852640 - DNA, 11 bp, Homo sapiens
ggttggctggc

SEQ ID NO: 1852641 - DNA, 13 bp, Homo sapiens
ggtttaagctgtt

SEQ ID NO: 1852642 - DNA, 20 bp, Homo sapiens
ggtttatgtagtcagttgca

SEQ ID NO: 1852643 - DNA, 23 bp, Homo sapiens
ggtttggccatctctggatgcct

SEQ ID NO: 1852644 - DNA, 17 bp, Homo sapiens
gtaaaatggagacacca

SEQ ID NO: 1852645 - DNA, 11 bp, Homo sapiens
gtaaatataaa

SEQ ID NO: 1852646 - DNA, 22 bp, Homo sapiens
gtaaatggcttatccagctggt

SEQ ID NO: 1852647 - DNA, 13 bp, Homo sapiens
gtaacaacaatta

SEQ ID NO: 1852648 - DNA, 15 bp, Homo sapiens
gtaacaacaattatt

SEQ ID NO: 1852649 - DNA, 18 bp, Homo sapiens
gtaacagtcatcatttat

SEQ ID NO: 1852650 - DNA, 14 bp, Homo sapiens
gtaactgtgtcatg

SEQ ID NO: 1852651 - DNA, 16 bp, Homo sapiens
gtaatctgatggcttc

SEQ ID NO: 1852652 - DNA, 17 bp, Homo sapiens
gtacaaggcgatcccat

SEQ ID NO: 1852653 - DNA, 22 bp, Homo sapiens
gtagacaagcaattagacaaga

SEQ ID NO: 1852654 - DNA, 18 bp, Homo sapiens
gtagcgtctttctttttt

SEQ ID NO: 1852655 - DNA, 18 bp, Homo sapiens
gtaggggagggcaggctt

SEQ ID NO: 1852656 - DNA, 20 bp, Homo sapiens
gtagtcttggctaaggaaat

SEQ ID NO: 1852657 - DNA, 18 bp, Homo sapiens
gtagttgcaatagaacag

SEQ ID NO: 1852658 - DNA, 16 bp, Homo sapiens
gtatcagctacaattg

SEQ ID NO: 1852659 - DNA, 12 bp, Homo sapiens
gtatctggtgac

SEQ ID NO: 1852660 - DNA, 15 bp, Homo sapiens
gtatggagctcagag

SEQ ID NO: 1852661 - DNA, 18 bp, Homo sapiens
gtatggagctcagagagg

SEQ ID NO: 1852662 - DNA, 22 bp, Homo sapiens
gtatggtaggggagggcaggct

SEQ ID NO: 1852663 - DNA, 16 bp, Homo sapiens
gtattaagaatgaaat

SEQ ID NO: 1852664 - DNA, 13 bp, Homo sapiens
gtattgaagcatt

SEQ ID NO: 1852665 - DNA, 18 bp, Homo sapiens
gtattgaagcattttata

SEQ ID NO: 1852666 - DNA, 14 bp, Homo sapiens
gtattgtgcaatgt

SEQ ID NO: 1852667 - DNA, 17 bp, Homo sapiens
gtattgtgcaatgtgta

SEQ ID NO: 1852668 - DNA, 23 bp, Homo sapiens
gtattgtgcaatgtgtataaaca

SEQ ID NO: 1852669 - DNA, 13 bp, Homo sapiens
gtattttatgtta

SEQ ID NO: 1852670 - DNA, 19 bp, Homo sapiens
gtattttgtttttgtctta

SEQ ID NO: 1852671 - DNA, 13 bp, Homo sapiens
gtcacatgaaaca

SEQ ID NO: 1852672 - DNA, 12 bp, Homo sapiens
gtcactctggca

SEQ ID NO: 1852673 - DNA, 13 bp, Homo sapiens
gtcactctggcag

SEQ ID NO: 1852674 - DNA, 14 bp, Homo sapiens
gtcactctggcagc

SEQ ID NO: 1852675 - DNA, 17 bp, Homo sapiens
gtcactctggcagctca

SEQ ID NO: 1852676 - DNA, 19 bp, Homo sapiens
gtcactctggcagctcaga

SEQ ID NO: 1852677 - DNA, 22 bp, Homo sapiens
gtcactctggcagctcagagag

SEQ ID NO: 1852678 - DNA, 21 bp, Homo sapiens
gtcactgagacagcccgggct

SEQ ID NO: 1852679 - DNA, 22 bp, Homo sapiens
gtcagatgctgtgcaaatgtta

SEQ ID NO: 1852680 - DNA, 14 bp, Homo sapiens
gtcagtagactgtg

SEQ ID NO: 1852681 - DNA, 17 bp, Homo sapiens
gtcagtgtccaaagcag

SEQ ID NO: 1852682 - DNA, 20 bp, Homo sapiens
gtcagtgtccaaagcagggt

SEQ ID NO: 1852683 - DNA, 16 bp, Homo sapiens
gtcagttgttatttat

SEQ ID NO: 1852684 - DNA, 17 bp, Homo sapiens
gtcatcaggagaaaaag

SEQ ID NO: 1852685 - DNA, 19 bp, Homo sapiens
gtcatctgtaagagcttgc

SEQ ID NO: 1852686 - DNA, 17 bp, Homo sapiens
gtcatgcaaaggctggg

SEQ ID NO: 1852687 - DNA, 20 bp, Homo sapiens
gtcatggtggccacggccac

SEQ ID NO: 1852688 - DNA, 19 bp, Homo sapiens
gtcattatgttaatatttc

SEQ ID NO: 1852689 - DNA, 16 bp, Homo sapiens
gtccaagaagcccagg

SEQ ID NO: 1852690 - DNA, 17 bp, Homo sapiens
gtccaagaagcccagga

SEQ ID NO: 1852691 - DNA, 20 bp, Homo sapiens
gtccaagaagcccaggaaag

SEQ ID NO: 1852692 - DNA, 16 bp, Homo sapiens
gtccagccctggctga

SEQ ID NO: 1852693 - DNA, 13 bp, Homo sapiens
gtccatagagagc

SEQ ID NO: 1852694 - DNA, 12 bp, Homo sapiens
gtcccagcagct

SEQ ID NO: 1852695 - DNA, 16 bp, Homo sapiens
gtcccataggcccagt

SEQ ID NO: 1852696 - DNA, 14 bp, Homo sapiens
gtccccagcagaga

SEQ ID NO: 1852697 - DNA, 13 bp, Homo sapiens
gtccccctgacaa

SEQ ID NO: 1852698 - DNA, 18 bp, Homo sapiens
gtccccctgacaacactc

SEQ ID NO: 1852699 - DNA, 14 bp, Homo sapiens
gtcccccttccatg

SEQ ID NO: 1852700 - DNA, 18 bp, Homo sapiens
gtcccccttccatggact

SEQ ID NO: 1852701 - DNA, 18 bp, Homo sapiens
gtcccctgtttgtttctg

SEQ ID NO: 1852702 - DNA, 22 bp, Homo sapiens
gtcccctgtttgtttctgaaag

SEQ ID NO: 1852703 - DNA, 15 bp, Homo sapiens
gtccctgccaatgga

SEQ ID NO: 1852704 - DNA, 16 bp, Homo sapiens
gtccctggtggcagct

SEQ ID NO: 1852705 - DNA, 13 bp, Homo sapiens
gtccgagctttga

SEQ ID NO: 1852706 - DNA, 21 bp, Homo sapiens
gtccggtccctgtcccagtgc

SEQ ID NO: 1852707 - DNA, 23 bp, Homo sapiens
gtcctagaaattccccaccctga

SEQ ID NO: 1852708 - DNA, 13 bp, Homo sapiens
gtcctcccatctc

SEQ ID NO: 1852709 - DNA, 13 bp, Homo sapiens
gtcctgctgcagt

SEQ ID NO: 1852710 - DNA, 21 bp, Homo sapiens
gtccttaccagcagagcacct

SEQ ID NO: 1852711 - DNA, 19 bp, Homo sapiens
gtcctttttcactttgaaa

SEQ ID NO: 1852712 - DNA, 12 bp, Homo sapiens
gtcgaggcagga

SEQ ID NO: 1852713 - DNA, 11 bp, Homo sapiens
gtcgggagagg

SEQ ID NO: 1852714 - DNA, 20 bp, Homo sapiens
gtcgggagaggggacgcagg

SEQ ID NO: 1852715 - DNA, 20 bp, Homo sapiens
gtctacctgaggggcctctt

SEQ ID NO: 1852716 - DNA, 17 bp, Homo sapiens
gtctcaaaaaaagaaaa

SEQ ID NO: 1852717 - DNA, 12 bp, Homo sapiens
gtctcaggcagc

SEQ ID NO: 1852718 - DNA, 16 bp, Homo sapiens
gtctcaggcagcacca

SEQ ID NO: 1852719 - DNA, 23 bp, Homo sapiens
gtctcaggcagcaccacactggg

SEQ ID NO: 1852720 - DNA, 20 bp, Homo sapiens
gtctccctcccctctcagaa

SEQ ID NO: 1852721 - DNA, 13 bp, Homo sapiens
gtctctaggctgg

SEQ ID NO: 1852722 - DNA, 17 bp, Homo sapiens
gtctctaggctggggaa

SEQ ID NO: 1852723 - DNA, 21 bp, Homo sapiens
gtctctgaagtgaaactgctt

SEQ ID NO: 1852724 - DNA, 16 bp, Homo sapiens
gtctctggttcctccc

SEQ ID NO: 1852725 - DNA, 17 bp, Homo sapiens
gtctctggttcctcccc

SEQ ID NO: 1852726 - DNA, 20 bp, Homo sapiens
gtctcttggtcctgctgcag

SEQ ID NO: 1852727 - DNA, 19 bp, Homo sapiens
gtctgaaggctgggttctg

SEQ ID NO: 1852728 - DNA, 15 bp, Homo sapiens
gtctgccaaacacat

SEQ ID NO: 1852729 - DNA, 22 bp, Homo sapiens
gtctggtttcaccgaggacatg

SEQ ID NO: 1852730 - DNA, 23 bp, Homo sapiens
gtctgtctccctcccctctcaga

SEQ ID NO: 1852731 - DNA, 24 bp, Homo sapiens
gtctgtctccctcccctctcagaa

SEQ ID NO: 1852732 - DNA, 15 bp, Homo sapiens
gtctgttttatgact

SEQ ID NO: 1852733 - DNA, 17 bp, Homo sapiens
gtctttggaccctgagg

SEQ ID NO: 1852734 - DNA, 14 bp, Homo sapiens
gtcttttcttgcat

SEQ ID NO: 1852735 - DNA, 19 bp, Homo sapiens
gtcttttcttgcatgaggc

SEQ ID NO: 1852736 - DNA, 23 bp, Homo sapiens
gtgaaaagaaaaatgagcctggc

SEQ ID NO: 1852737 - DNA, 21 bp, Homo sapiens
gtgaaactgcttgtttcctag

SEQ ID NO: 1852738 - DNA, 22 bp, Homo sapiens
gtgaaataccaacctgaagaca

SEQ ID NO: 1852739 - DNA, 17 bp, Homo sapiens
gtgaagcaccaagctca

SEQ ID NO: 1852740 - DNA, 18 bp, Homo sapiens
gtgaagcaccaagctcaa

SEQ ID NO: 1852741 - DNA, 19 bp, Homo sapiens
gtgacatgtcttttcttgc

SEQ ID NO: 1852742 - DNA, 16 bp, Homo sapiens
gtgacctcagctttga

SEQ ID NO: 1852743 - DNA, 15 bp, Homo sapiens
gtgactgtatctgtg

SEQ ID NO: 1852744 - DNA, 12 bp, Homo sapiens
gtgagcagaaca

SEQ ID NO: 1852745 - DNA, 18 bp, Homo sapiens
gtgagcccatggccctcc

SEQ ID NO: 1852746 - DNA, 14 bp, Homo sapiens
gtgagctgagcagg

SEQ ID NO: 1852747 - DNA, 11 bp, Homo sapiens
gtgaggaagcc

SEQ ID NO: 1852748 - DNA, 14 bp, Homo sapiens
gtgaggctctgccc

SEQ ID NO: 1852749 - DNA, 17 bp, Homo sapiens
gtgagtactacagtcct

SEQ ID NO: 1852750 - DNA, 12 bp, Homo sapiens
gtgatgcatttt

SEQ ID NO: 1852751 - DNA, 14 bp, Homo sapiens
gtgatggggccctg

SEQ ID NO: 1852752 - DNA, 16 bp, Homo sapiens
gtgatggggccctgcc

SEQ ID NO: 1852753 - DNA, 15 bp, Homo sapiens
gtgcaatgtgtataa

SEQ ID NO: 1852754 - DNA, 16 bp, Homo sapiens
gtgcacaagctccaag

SEQ ID NO: 1852755 - DNA, 15 bp, Homo sapiens
gtgcacccacctgtt

SEQ ID NO: 1852756 - DNA, 17 bp, Homo sapiens
gtgcagatgaggttgct

SEQ ID NO: 1852757 - DNA, 19 bp, Homo sapiens
gtgcagcccccactgcctt

SEQ ID NO: 1852758 - DNA, 14 bp, Homo sapiens
gtgcatttaattag

SEQ ID NO: 1852759 - DNA, 22 bp, Homo sapiens
gtgccaacactcaagaagcagg

SEQ ID NO: 1852760 - DNA, 23 bp, Homo sapiens
gtgccacccatgcagctgctccc

SEQ ID NO: 1852761 - DNA, 15 bp, Homo sapiens
gtgcctcttccagtg

SEQ ID NO: 1852762 - DNA, 19 bp, Homo sapiens
gtgcctcttccagtgaaca

SEQ ID NO: 1852763 - DNA, 14 bp, Homo sapiens
gtgccttttctgaa

SEQ ID NO: 1852764 - DNA, 13 bp, Homo sapiens
gtgcgtctccagt

SEQ ID NO: 1852765 - DNA, 15 bp, Homo sapiens
gtgctatctccccca

SEQ ID NO: 1852766 - DNA, 19 bp, Homo sapiens
gtgctatctcccccagccc

SEQ ID NO: 1852767 - DNA, 21 bp, Homo sapiens
gtgctatctcccccagcccca

SEQ ID NO: 1852768 - DNA, 15 bp, Homo sapiens
gtgctctttgttttg

SEQ ID NO: 1852769 - DNA, 16 bp, Homo sapiens
gtgctgagtctgaagg

SEQ ID NO: 1852770 - DNA, 14 bp, Homo sapiens
gtgctgccctgccc

SEQ ID NO: 1852771 - DNA, 15 bp, Homo sapiens
gtgcttggaggaagg

SEQ ID NO: 1852772 - DNA, 12 bp, Homo sapiens
gtggaggagcag

SEQ ID NO: 1852773 - DNA, 15 bp, Homo sapiens
gtggaggagcagtgc

SEQ ID NO: 1852774 - DNA, 17 bp, Homo sapiens
gtggaggagcagtgcag

SEQ ID NO: 1852775 - DNA, 19 bp, Homo sapiens
gtggagttcaccttggaag

SEQ ID NO: 1852776 - DNA, 15 bp, Homo sapiens
gtggatgttatgaac

SEQ ID NO: 1852777 - DNA, 16 bp, Homo sapiens
gtggatgttatgaaca

SEQ ID NO: 1852778 - DNA, 17 bp, Homo sapiens
gtggatgttatgaacag

SEQ ID NO: 1852779 - DNA, 15 bp, Homo sapiens
gtggcaaggctgtgc

SEQ ID NO: 1852780 - DNA, 13 bp, Homo sapiens
gtggcaccagcag

SEQ ID NO: 1852781 - DNA, 14 bp, Homo sapiens
gtggcaccagcagc

SEQ ID NO: 1852782 - DNA, 23 bp, Homo sapiens
gtggcagagcttggactggatgc

SEQ ID NO: 1852783 - DNA, 13 bp, Homo sapiens
gtggcctcccaac

SEQ ID NO: 1852784 - DNA, 14 bp, Homo sapiens
gtggcctcccaact

SEQ ID NO: 1852785 - DNA, 21 bp, Homo sapiens
gtggcctcccaactcacccca

SEQ ID NO: 1852786 - DNA, 23 bp, Homo sapiens
gtggcgcagcatattcaggaagc

SEQ ID NO: 1852787 - DNA, 20 bp, Homo sapiens
gtggcttaagtgagcagaac

SEQ ID NO: 1852788 - DNA, 22 bp, Homo sapiens
gtgggacagttcctgagaccag

SEQ ID NO: 1852789 - DNA, 23 bp, Homo sapiens
gtgggaggatctcttgagcctgg

SEQ ID NO: 1852790 - DNA, 14 bp, Homo sapiens
gtgggagtgggccc

SEQ ID NO: 1852791 - DNA, 13 bp, Homo sapiens
gtggggcagaggc

SEQ ID NO: 1852792 - DNA, 17 bp, Homo sapiens
gtgggggaagacctggc

SEQ ID NO: 1852793 - DNA, 20 bp, Homo sapiens
gtgggggatcacagcctctg

SEQ ID NO: 1852794 - DNA, 20 bp, Homo sapiens
gtggggtcactctggcagct

SEQ ID NO: 1852795 - DNA, 16 bp, Homo sapiens
gtggtcccaccccaca

SEQ ID NO: 1852796 - DNA, 17 bp, Homo sapiens
gtggtcccaccccacac

SEQ ID NO: 1852797 - DNA, 19 bp, Homo sapiens
gtgtcacactgtggcctga

SEQ ID NO: 1852798 - DNA, 18 bp, Homo sapiens
gtgtctcttggtcctgct

SEQ ID NO: 1852799 - DNA, 16 bp, Homo sapiens
gtgtctgccaaacaca

SEQ ID NO: 1852800 - DNA, 17 bp, Homo sapiens
gtgtgactactccccca

SEQ ID NO: 1852801 - DNA, 16 bp, Homo sapiens
gtgtgcaacagacaag

SEQ ID NO: 1852802 - DNA, 19 bp, Homo sapiens
gtgtgcacgcgtgtgcagg

SEQ ID NO: 1852803 - DNA, 16 bp, Homo sapiens
gtgtgcggctgtgtgt

SEQ ID NO: 1852804 - DNA, 13 bp, Homo sapiens
gtgtggagaagcg

SEQ ID NO: 1852805 - DNA, 19 bp, Homo sapiens
gtgtggagttcaccttgga

SEQ ID NO: 1852806 - DNA, 22 bp, Homo sapiens
gtgtggagttcaccttggaagg

SEQ ID NO: 1852807 - DNA, 16 bp, Homo sapiens
gtgtggtagagtgtgc

SEQ ID NO: 1852808 - DNA, 19 bp, Homo sapiens
gtgtggtgtttcctggcac

SEQ ID NO: 1852809 - DNA, 23 bp, Homo sapiens
gtgtgtggtcaacatttctcatg

SEQ ID NO: 1852810 - DNA, 17 bp, Homo sapiens
gtgtgttaagctctgct

SEQ ID NO: 1852811 - DNA, 15 bp, Homo sapiens
gtgttaagctctgct

SEQ ID NO: 1852812 - DNA, 18 bp, Homo sapiens
gtgttctcatgaagcagg

SEQ ID NO: 1852813 - DNA, 13 bp, Homo sapiens
gtgttctgttttg

SEQ ID NO: 1852814 - DNA, 15 bp, Homo sapiens
gtgttctgttttgtt

SEQ ID NO: 1852815 - DNA, 21 bp, Homo sapiens
gttaaaagaggtttttcttaa

SEQ ID NO: 1852816 - DNA, 16 bp, Homo sapiens
gttaagcctttggaaa

SEQ ID NO: 1852817 - DNA, 12 bp, Homo sapiens
gttaagctctgc

SEQ ID NO: 1852818 - DNA, 20 bp, Homo sapiens
gttaatgtaatctgatggct

SEQ ID NO: 1852819 - DNA, 20 bp, Homo sapiens
gttaggcattgtgggaaggg

SEQ ID NO: 1852820 - DNA, 15 bp, Homo sapiens
gttagggaaaacatt

SEQ ID NO: 1852821 - DNA, 20 bp, Homo sapiens
gttagggaaaacattccatc

SEQ ID NO: 1852822 - DNA, 23 bp, Homo sapiens
gttagggaaaacattccatcctt

SEQ ID NO: 1852823 - DNA, 24 bp, Homo sapiens
gttagttcaatctggattcatatt

SEQ ID NO: 1852824 - DNA, 12 bp, Homo sapiens
gttatataaatg

SEQ ID NO: 1852825 - DNA, 13 bp, Homo sapiens
gttatataaatgg

SEQ ID NO: 1852826 - DNA, 19 bp, Homo sapiens
gttatatataaatatatta

SEQ ID NO: 1852827 - DNA, 13 bp, Homo sapiens
gttatgaacagct

SEQ ID NO: 1852828 - DNA, 16 bp, Homo sapiens
gttatgaacagctgtg

SEQ ID NO: 1852829 - DNA, 22 bp, Homo sapiens
gttcaccttggaagggcgttct

SEQ ID NO: 1852830 - DNA, 10 bp, Homo sapiens
gttcattaaa

SEQ ID NO: 1852831 - DNA, 17 bp, Homo sapiens
gttccattaaacgattt

SEQ ID NO: 1852832 - DNA, 20 bp, Homo sapiens
gttccctttgacgccatccc

SEQ ID NO: 1852833 - DNA, 22 bp, Homo sapiens
gttccctttgacgccatcccag

SEQ ID NO: 1852834 - DNA, 21 bp, Homo sapiens
gttcccttttttggctgctga

SEQ ID NO: 1852835 - DNA, 15 bp, Homo sapiens
gttcctgcaatgaag

SEQ ID NO: 1852836 - DNA, 15 bp, Homo sapiens
gttctcatttgatca

SEQ ID NO: 1852837 - DNA, 16 bp, Homo sapiens
gttctctcctccccaa

SEQ ID NO: 1852838 - DNA, 12 bp, Homo sapiens
gttctctgccct

SEQ ID NO: 1852839 - DNA, 13 bp, Homo sapiens
gttctctgccctc

SEQ ID NO: 1852840 - DNA, 15 bp, Homo sapiens
gttctctgccctcca

SEQ ID NO: 1852841 - DNA, 17 bp, Homo sapiens
gttctctgccctccaag

SEQ ID NO: 1852842 - DNA, 18 bp, Homo sapiens
gttctgatgatgtgcctg

SEQ ID NO: 1852843 - DNA, 19 bp, Homo sapiens
gttcttagctcaatgagca

SEQ ID NO: 1852844 - DNA, 17 bp, Homo sapiens
gttcttgtattaagaat

SEQ ID NO: 1852845 - DNA, 22 bp, Homo sapiens
gttgaggtccagccctggctga

SEQ ID NO: 1852846 - DNA, 21 bp, Homo sapiens
gttgatgcctgtgaactgaac

SEQ ID NO: 1852847 - DNA, 16 bp, Homo sapiens
gttgccagtcaccccg

SEQ ID NO: 1852848 - DNA, 18 bp, Homo sapiens
gttggaaggatctgctga

SEQ ID NO: 1852849 - DNA, 14 bp, Homo sapiens
gttggcaaaaaggc

SEQ ID NO: 1852850 - DNA, 18 bp, Homo sapiens
gttggcaaaaaggcagga

SEQ ID NO: 1852851 - DNA, 12 bp, Homo sapiens
gttggttttctt

SEQ ID NO: 1852852 - DNA, 15 bp, Homo sapiens
gttgtcaaggaagaa

SEQ ID NO: 1852853 - DNA, 20 bp, Homo sapiens
gtttaagacatttttggaag

SEQ ID NO: 1852854 - DNA, 20 bp, Homo sapiens
gtttaatggtagttttacag

SEQ ID NO: 1852855 - DNA, 16 bp, Homo sapiens
gtttagcagatttaag

SEQ ID NO: 1852856 - DNA, 14 bp, Homo sapiens
gtttctggtctcta

SEQ ID NO: 1852857 - DNA, 20 bp, Homo sapiens
gtttctggtctctaggctgg

SEQ ID NO: 1852858 - DNA, 16 bp, Homo sapiens
gtttgaggtttttaag

SEQ ID NO: 1852859 - DNA, 20 bp, Homo sapiens
gtttgattcagacagctgcc

SEQ ID NO: 1852860 - DNA, 21 bp, Homo sapiens
gtttgattcagacagctgcct

SEQ ID NO: 1852861 - DNA, 14 bp, Homo sapiens
gtttgcataggtga

SEQ ID NO: 1852862 - DNA, 21 bp, Homo sapiens
gtttggaggagcaaaggctga

SEQ ID NO: 1852863 - DNA, 21 bp, Homo sapiens
gtttgtcctttttcactttga

SEQ ID NO: 1852864 - DNA, 17 bp, Homo sapiens
gtttgtgttctgttttg

SEQ ID NO: 1852865 - DNA, 15 bp, Homo sapiens
gttttactgcagctt

SEQ ID NO: 1852866 - DNA, 16 bp, Homo sapiens
gttttagaaggttctc

SEQ ID NO: 1852867 - DNA, 12 bp, Homo sapiens
gttttataagca

SEQ ID NO: 1852868 - DNA, 23 bp, Homo sapiens
gttttataagcatcattatttat

SEQ ID NO: 1852869 - DNA, 18 bp, Homo sapiens
gttttatgacttcattaa

SEQ ID NO: 1852870 - DNA, 20 bp, Homo sapiens
gttttccaggtttaagctgt

SEQ ID NO: 1852871 - DNA, 16 bp, Homo sapiens
gttttctgaaacacac

SEQ ID NO: 1852872 - DNA, 20 bp, Homo sapiens
gttttgaagattctatgtta

SEQ ID NO: 1852873 - DNA, 16 bp, Homo sapiens
gttttggttgctttaa

SEQ ID NO: 1852874 - DNA, 20 bp, Homo sapiens
gttttgtgatgcattttata

SEQ ID NO: 1852875 - DNA, 14 bp, Homo sapiens
gttttgtgtctctt

SEQ ID NO: 1852876 - DNA, 16 bp, Homo sapiens
gttttgtgtctcttat

SEQ ID NO: 1852877 - DNA, 16 bp, Homo sapiens
gtttttgtcttaaaaa

SEQ ID NO: 1852878 - DNA, 13 bp, Homo sapiens
taaaaaagataaa

SEQ ID NO: 1852879 - DNA, 16 bp, Homo sapiens
taaaaaagataaacac

SEQ ID NO: 1852880 - DNA, 15 bp, Homo sapiens
taaaaagtggaaaaa

SEQ ID NO: 1852881 - DNA, 12 bp, Homo sapiens
taaaagacaaat

SEQ ID NO: 1852882 - DNA, 22 bp, Homo sapiens
taaaagacaaatcaaagcagat

SEQ ID NO: 1852883 - DNA, 17 bp, Homo sapiens
taaaatgaaatgcattt

SEQ ID NO: 1852884 - DNA, 17 bp, Homo sapiens
taaacaagaaaaataaa

SEQ ID NO: 1852885 - DNA, 22 bp, Homo sapiens
taaacacaagattggtgttttt

SEQ ID NO: 1852886 - DNA, 14 bp, Homo sapiens
taaacatgtatgta

SEQ ID NO: 1852887 - DNA, 18 bp, Homo sapiens
taaaccgccaaggctggg

SEQ ID NO: 1852888 - DNA, 16 bp, Homo sapiens
taaacgatttttaaaa

SEQ ID NO: 1852889 - DNA, 18 bp, Homo sapiens
taaacgtgatttttaaat

SEQ ID NO: 1852890 - DNA, 21 bp, Homo sapiens
taaacgtgatttttaaattaa

SEQ ID NO: 1852891 - DNA, 9 bp, Homo sapiens
taaagaaaa

SEQ ID NO: 1852892 - DNA, 23 bp, Homo sapiens
taaagaaaaaaatgtattttatg

SEQ ID NO: 1852893 - DNA, 12 bp, Homo sapiens
taaagaaaagat

SEQ ID NO: 1852894 - DNA, 23 bp, Homo sapiens
taaagacgttttataagcatcat

SEQ ID NO: 1852895 - DNA, 15 bp, Homo sapiens
taaaggagtttatgt

SEQ ID NO: 1852896 - DNA, 19 bp, Homo sapiens
taaaggagtttatgttcca

SEQ ID NO: 1852897 - DNA, 13 bp, Homo sapiens
taaagtgaagaat

SEQ ID NO: 1852898 - DNA, 18 bp, Homo sapiens
taaagttaaactgattat

SEQ ID NO: 1852899 - DNA, 19 bp, Homo sapiens
taaatcagccgtgtaacca

SEQ ID NO: 1852900 - DNA, 16 bp, Homo sapiens
taaatgaacaagagaa

SEQ ID NO: 1852901 - DNA, 15 bp, Homo sapiens
taaatgcaaataaca

SEQ ID NO: 1852902 - DNA, 17 bp, Homo sapiens
taacaaattgcatttgt

SEQ ID NO: 1852903 - DNA, 19 bp, Homo sapiens
taacaacaattatttgaag

SEQ ID NO: 1852904 - DNA, 12 bp, Homo sapiens
taacacacagct

SEQ ID NO: 1852905 - DNA, 14 bp, Homo sapiens
taacataagctatt

SEQ ID NO: 1852906 - DNA, 15 bp, Homo sapiens
taacataagctattt

SEQ ID NO: 1852907 - DNA, 15 bp, Homo sapiens
taaccacatttctaa

SEQ ID NO: 1852908 - DNA, 15 bp, Homo sapiens
taaccacctacaagg

SEQ ID NO: 1852909 - DNA, 22 bp, Homo sapiens
taaccctttctgggatgcaata

SEQ ID NO: 1852910 - DNA, 16 bp, Homo sapiens
taacctactagacaat

SEQ ID NO: 1852911 - DNA, 19 bp, Homo sapiens
taacgcaaaaatagctctt

SEQ ID NO: 1852912 - DNA, 20 bp, Homo sapiens
taacgcaaaaatagctcttg

SEQ ID NO: 1852913 - DNA, 21 bp, Homo sapiens
taacgcaaaaatagctcttgc

SEQ ID NO: 1852914 - DNA, 23 bp, Homo sapiens
taactacaaaggtttaaatgaac

SEQ ID NO: 1852915 - DNA, 13 bp, Homo sapiens
taagaatgaaata

SEQ ID NO: 1852916 - DNA, 15 bp, Homo sapiens
taagaatgaaatact

SEQ ID NO: 1852917 - DNA, 18 bp, Homo sapiens
taagaccaccacctcaga

SEQ ID NO: 1852918 - DNA, 22 bp, Homo sapiens
taagagggagggagggctccag

SEQ ID NO: 1852919 - DNA, 23 bp, Homo sapiens
taagagggagggagggctccaga

SEQ ID NO: 1852920 - DNA, 14 bp, Homo sapiens
taagcctttggaaa

SEQ ID NO: 1852921 - DNA, 14 bp, Homo sapiens
taagctatttttct

SEQ ID NO: 1852922 - DNA, 14 bp, Homo sapiens
taaggaaattctaa

SEQ ID NO: 1852923 - DNA, 13 bp, Homo sapiens
taaggaagacaat

SEQ ID NO: 1852924 - DNA, 19 bp, Homo sapiens
taaggattttatgctttaa

SEQ ID NO: 1852925 - DNA, 17 bp, Homo sapiens
taaggcgtggagctgcc

SEQ ID NO: 1852926 - DNA, 13 bp, Homo sapiens
taagggcagagtc

SEQ ID NO: 1852927 - DNA, 12 bp, Homo sapiens
taagtaatctca

SEQ ID NO: 1852928 - DNA, 19 bp, Homo sapiens
taagtctgttttatgactt

SEQ ID NO: 1852929 - DNA, 20 bp, Homo sapiens
taagtcttatcaagcagcca

SEQ ID NO: 1852930 - DNA, 16 bp, Homo sapiens
taagtgagcagaacag

SEQ ID NO: 1852931 - DNA, 14 bp, Homo sapiens
taagtgttctcatg

SEQ ID NO: 1852932 - DNA, 20 bp, Homo sapiens
taagtgttctcatgaagcag

SEQ ID NO: 1852933 - DNA, 21 bp, Homo sapiens
taatagaagcttaaaataaag

SEQ ID NO: 1852934 - DNA, 20 bp, Homo sapiens
taatattttcctcctgagtg

SEQ ID NO: 1852935 - DNA, 21 bp, Homo sapiens
taatattttcctcctgagtgc

SEQ ID NO: 1852936 - DNA, 21 bp, Homo sapiens
taatcaactgggctgaacact

SEQ ID NO: 1852937 - DNA, 18 bp, Homo sapiens
taatcacttttttccaca

SEQ ID NO: 1852938 - DNA, 21 bp, Homo sapiens
taatctgatggcttctccagg

SEQ ID NO: 1852939 - DNA, 18 bp, Homo sapiens
taatctgggccagaattt

SEQ ID NO: 1852940 - DNA, 23 bp, Homo sapiens
taatctgggccagaatttcaaac

SEQ ID NO: 1852941 - DNA, 18 bp, Homo sapiens
taatgggcttagagcagt

SEQ ID NO: 1852942 - DNA, 13 bp, Homo sapiens
taattaaatgctc

SEQ ID NO: 1852943 - DNA, 18 bp, Homo sapiens
taattattgatgttttca

SEQ ID NO: 1852944 - DNA, 20 bp, Homo sapiens
taatttgaaggtagaatgtt

SEQ ID NO: 1852945 - DNA, 15 bp, Homo sapiens
tacaaaaagcataaa

SEQ ID NO: 1852946 - DNA, 19 bp, Homo sapiens
tacaaaggtttaaatgaac

SEQ ID NO: 1852947 - DNA, 23 bp, Homo sapiens
tacactgtgctgagtctgaaggc

SEQ ID NO: 1852948 - DNA, 15 bp, Homo sapiens
ttacttttaaatgtc

SEQ ID NO: 1852949 - DNA, 18 bp, Homo sapiens
ttagaaggttctctcctc

SEQ ID NO: 1852950 - DNA, 21 bp, Homo sapiens
ttagactttaacataagctat

SEQ ID NO: 1852951 - DNA, 22 bp, Homo sapiens
ttagactttaacataagctatt

SEQ ID NO: 1852952 - DNA, 15 bp, Homo sapiens
ttagcaaaaaatgaa

SEQ ID NO: 1852953 - DNA, 20 bp, Homo sapiens
ttagcacccttctgctgtat

SEQ ID NO: 1852954 - DNA, 22 bp, Homo sapiens
ttagcattgtagtgctttgaga

SEQ ID NO: 1852955 - DNA, 15 bp, Homo sapiens
ttagctttgctctgc

SEQ ID NO: 1852956 - DNA, 19 bp, Homo sapiens
ttagctttgctctgccaac

SEQ ID NO: 1852957 - DNA, 17 bp, Homo sapiens
ttagggaaaacattcca

SEQ ID NO: 1852958 - DNA, 13 bp, Homo sapiens
ttaggtgtgaaga

SEQ ID NO: 1852959 - DNA, 13 bp, Homo sapiens
ttagtatgtgcat

SEQ ID NO: 1852960 - DNA, 15 bp, Homo sapiens
ttagtttctccaagc

SEQ ID NO: 1852961 - DNA, 14 bp, Homo sapiens
ttataaatcgcttt

SEQ ID NO: 1852962 - DNA, 17 bp, Homo sapiens
ttataaatcgcttttga

SEQ ID NO: 1852963 - DNA, 21 bp, Homo sapiens
ttataagcatcattatttatg

SEQ ID NO: 1852964 - DNA, 19 bp, Homo sapiens
ttataggtggcctctcctt

SEQ ID NO: 1852965 - DNA, 11 bp, Homo sapiens
ttatgaacagc

SEQ ID NO: 1852966 - DNA, 15 bp, Homo sapiens
ttatgaacagctgtg

SEQ ID NO: 1852967 - DNA, 14 bp, Homo sapiens
ttatgtattgtgca

SEQ ID NO: 1852968 - DNA, 20 bp, Homo sapiens
ttatgtattgtgcaatgtgt

SEQ ID NO: 1852969 - DNA, 13 bp, Homo sapiens
ttatgttaatatt

SEQ ID NO: 1852970 - DNA, 18 bp, Homo sapiens
ttatgttatatataaata

SEQ ID NO: 1852971 - DNA, 14 bp, Homo sapiens
ttattaaagaaaaa

SEQ ID NO: 1852972 - DNA, 20 bp, Homo sapiens
ttattaaagaaaaaaatgta

SEQ ID NO: 1852973 - DNA, 16 bp, Homo sapiens
ttattacttgtaaata

SEQ ID NO: 1852974 - DNA, 18 bp, Homo sapiens
ttattacttgtaaatata

SEQ ID NO: 1852975 - DNA, 20 bp, Homo sapiens
ttattacttgtaaatataaa

SEQ ID NO: 1852976 - DNA, 17 bp, Homo sapiens
ttatttataatcacttt

SEQ ID NO: 1852977 - DNA, 21 bp, Homo sapiens
ttatttatgtattgtgcaatg

SEQ ID NO: 1852978 - DNA, 21 bp, Homo sapiens
ttatttgaagatttaattact

SEQ ID NO: 1852979 - DNA, 22 bp, Homo sapiens
ttcaaaaacatgcttttccaaa

SEQ ID NO: 1852980 - DNA, 13 bp, Homo sapiens
ttcaaactacttt

SEQ ID NO: 1852981 - DNA, 15 bp, Homo sapiens
ttcaaagcaaatgtc

SEQ ID NO: 1852982 - DNA, 19 bp, Homo sapiens
ttcacctaagtctctgtga

SEQ ID NO: 1852983 - DNA, 21 bp, Homo sapiens
ttcacctaagtctctgtgaat

SEQ ID NO: 1852984 - DNA, 12 bp, Homo sapiens
ttcaccttggaa

SEQ ID NO: 1852985 - DNA, 14 bp, Homo sapiens
ttcaccttggaagg

SEQ ID NO: 1852986 - DNA, 15 bp, Homo sapiens
ttcaccttggaaggg

SEQ ID NO: 1852987 - DNA, 12 bp, Homo sapiens
ttcactttgaaa

SEQ ID NO: 1852988 - DNA, 14 bp, Homo sapiens
ttcactttgaaaag

SEQ ID NO: 1852989 - DNA, 15 bp, Homo sapiens
ttcagaatcacttct

SEQ ID NO: 1852990 - DNA, 19 bp, Homo sapiens
ttcagaatcacttctgaga

SEQ ID NO: 1852991 - DNA, 21 bp, Homo sapiens
ttcagaatcacttctgagaac

SEQ ID NO: 1852992 - DNA, 15 bp, Homo sapiens
ttcagagactcctgc

SEQ ID NO: 1852993 - DNA, 19 bp, Homo sapiens
ttcagagactcctgcaggc

SEQ ID NO: 1852994 - DNA, 13 bp, Homo sapiens
ttcagctcactgt

SEQ ID NO: 1852995 - DNA, 24 bp, Homo sapiens
ttcagctctgcaagaattgaagca

SEQ ID NO: 1852996 - DNA, 11 bp, Homo sapiens
ttcaggaagct

SEQ ID NO: 1852997 - DNA, 16 bp, Homo sapiens
ttcaggaagctcaggg

SEQ ID NO: 1852998 - DNA, 17 bp, Homo sapiens
ttcaggaagctcagggc

SEQ ID NO: 1852999 - DNA, 22 bp, Homo sapiens
ttcaggagcagcctcagaacaa

SEQ ID NO: 1853000 - DNA, 16 bp, Homo sapiens
ttcatacctacatgta

SEQ ID NO: 1853001 - DNA, 19 bp, Homo sapiens
ttcatacctacatgtattt

SEQ ID NO: 1853002 - DNA, 20 bp, Homo sapiens
ttcatatttaatttgaaggt

SEQ ID NO: 1853003 - DNA, 14 bp, Homo sapiens
ttcatcaagactgg

SEQ ID NO: 1853004 - DNA, 23 bp, Homo sapiens
ttcatctggaaccatcagaaaca

SEQ ID NO: 1853005 - DNA, 20 bp, Homo sapiens
ttcatcttccaactcaaact

SEQ ID NO: 1853006 - DNA, 16 bp, Homo sapiens
ttcatgcaaactcttt

SEQ ID NO: 1853007 - DNA, 16 bp, Homo sapiens
ttcatgcatggaaatt

SEQ ID NO: 1853008 - DNA, 16 bp, Homo sapiens
ttcatgcctggcttcg

SEQ ID NO: 1853009 - DNA, 15 bp, Homo sapiens
ttcattaataataaa

SEQ ID NO: 1853010 - DNA, 21 bp, Homo sapiens
ttcattttgcacctgcagcca

SEQ ID NO: 1853011 - DNA, 15 bp, Homo sapiens
ttccaaacccaggct

SEQ ID NO: 1853012 - DNA, 18 bp, Homo sapiens
ttccaaacccaggctatt

SEQ ID NO: 1853013 - DNA, 15 bp, Homo sapiens
ttccagccagggctg

SEQ ID NO: 1853014 - DNA, 15 bp, Homo sapiens
ttccaggctgggaga

SEQ ID NO: 1853015 - DNA, 17 bp, Homo sapiens
ttccaggggtgggacac

SEQ ID NO: 1853016 - DNA, 15 bp, Homo sapiens
ttccagtgaggctct

SEQ ID NO: 1853017 - DNA, 19 bp, Homo sapiens
ttccagtgaggctctgccc

SEQ ID NO: 1853018 - DNA, 14 bp, Homo sapiens
ttccatggactttg

SEQ ID NO: 1853019 - DNA, 15 bp, Homo sapiens
ttccattctggaagt

SEQ ID NO: 1853020 - DNA, 21 bp, Homo sapiens
ttcccaaaagcccattcattc

SEQ ID NO: 1853021 - DNA, 16 bp, Homo sapiens
ttcccaagggctgccg

SEQ ID NO: 1853022 - DNA, 22 bp, Homo sapiens
ttcccacctctctcactccttg

SEQ ID NO: 1853023 - DNA, 20 bp, Homo sapiens
ttcccaggatgagcatccca

SEQ ID NO: 1853024 - DNA, 15 bp, Homo sapiens
ttcccagtggctgct

SEQ ID NO: 1853025 - DNA, 16 bp, Homo sapiens
ttcccagtggctgctg

SEQ ID NO: 1853026 - DNA, 18 bp, Homo sapiens
ttcccagtggctgctgcc

SEQ ID NO: 1853027 - DNA, 20 bp, Homo sapiens
ttcccagtggctgctgccca

SEQ ID NO: 1853028 - DNA, 18 bp, Homo sapiens
ttcccatgacccaggctg

SEQ ID NO: 1853029 - DNA, 14 bp, Homo sapiens
ttccccaagacatt

SEQ ID NO: 1853030 - DNA, 17 bp, Homo sapiens
ttccccactcagccttt

SEQ ID NO: 1853031 - DNA, 16 bp, Homo sapiens
ttccctatctttgcca

SEQ ID NO: 1853032 - DNA, 20 bp, Homo sapiens
ttccctcccttcctctttcc

SEQ ID NO: 1853033 - DNA, 12 bp, Homo sapiens
ttccctggcctt

SEQ ID NO: 1853034 - DNA, 16 bp, Homo sapiens
ttccctggcctttcat

SEQ ID NO: 1853035 - DNA, 15 bp, Homo sapiens
ttcccttcatctgga

SEQ ID NO: 1853036 - DNA, 20 bp, Homo sapiens
ttccctttgacgccatccca

SEQ ID NO: 1853037 - DNA, 22 bp, Homo sapiens
ttccctttgacgccatcccagc

SEQ ID NO: 1853038 - DNA, 20 bp, Homo sapiens
ttcccttttccctcccagtt

SEQ ID NO: 1853039 - DNA, 19 bp, Homo sapiens
ttcccttttttggctgctg

SEQ ID NO: 1853040 - DNA, 11 bp, Homo sapiens
ttcctctttcc

SEQ ID NO: 1853041 - DNA, 14 bp, Homo sapiens
ttcctgaaccgatg

SEQ ID NO: 1853042 - DNA, 15 bp, Homo sapiens
ttcctgccagcccct

SEQ ID NO: 1853043 - DNA, 20 bp, Homo sapiens
ttcctgccagcccctgccat

SEQ ID NO: 1853044 - DNA, 21 bp, Homo sapiens
ttccttgagttgattcagctc

SEQ ID NO: 1853045 - DNA, 14 bp, Homo sapiens
ttcgacactgttct

SEQ ID NO: 1853046 - DNA, 19 bp, Homo sapiens
ttctaaaggagtttatgtt

SEQ ID NO: 1853047 - DNA, 21 bp, Homo sapiens
ttctaacgcaaaaatagctct

SEQ ID NO: 1853048 - DNA, 21 bp, Homo sapiens
ttctacaactcatacactcgt

SEQ ID NO: 1853049 - DNA, 14 bp, Homo sapiens
ttctacccaggtgc

SEQ ID NO: 1853050 - DNA, 18 bp, Homo sapiens
ttctagcccgaatacaaa

SEQ ID NO: 1853051 - DNA, 13 bp, Homo sapiens
ttctaggcctggg

SEQ ID NO: 1853052 - DNA, 15 bp, Homo sapiens
ttctatgggtgttat

SEQ ID NO: 1853053 - DNA, 17 bp, Homo sapiens
ttctcaggccatcatca

SEQ ID NO: 1853054 - DNA, 21 bp, Homo sapiens
ttctcattggaaatttagcat

SEQ ID NO: 1853055 - DNA, 15 bp, Homo sapiens
ttctccacctgccag

SEQ ID NO: 1853056 - DNA, 18 bp, Homo sapiens
ttctccacctgccaggga

SEQ ID NO: 1853057 - DNA, 17 bp, Homo sapiens
ttctctactctagggaa

SEQ ID NO: 1853058 - DNA, 14 bp, Homo sapiens
ttctctccagcccc

SEQ ID NO: 1853059 - DNA, 15 bp, Homo sapiens
ttctgaaagggacgc

SEQ ID NO: 1853060 - DNA, 23 bp, Homo sapiens
ttctgacccatgctgccctgtga

SEQ ID NO: 1853061 - DNA, 20 bp, Homo sapiens
ttctgagcagcgagcctgct

SEQ ID NO: 1853062 - DNA, 20 bp, Homo sapiens
ttctggattttgtcaagcag

SEQ ID NO: 1853063 - DNA, 16 bp, Homo sapiens
ttctgggatgtcacag

SEQ ID NO: 1853064 - DNA, 19 bp, Homo sapiens
ttctgggatgtcacagtcc

SEQ ID NO: 1853065 - DNA, 21 bp, Homo sapiens
ttctggtctctaggctgggga

SEQ ID NO: 1853066 - DNA, 14 bp, Homo sapiens
ttctggtgtgaact

SEQ ID NO: 1853067 - DNA, 21 bp, Homo sapiens
ttctggtgtgaactaaacttt

SEQ ID NO: 1853068 - DNA, 13 bp, Homo sapiens
ttctgttctcatt

SEQ ID NO: 1853069 - DNA, 16 bp, Homo sapiens
ttctgtttggaggagc

SEQ ID NO: 1853070 - DNA, 23 bp, Homo sapiens
ttcttcctccctccctctttccc

SEQ ID NO: 1853071 - DNA, 15 bp, Homo sapiens
ttctttttgaaatgt

SEQ ID NO: 1853072 - DNA, 23 bp, Homo sapiens
ttgaaaacactgttctctgccct

SEQ ID NO: 1853073 - DNA, 13 bp, Homo sapiens
ttgaagattctat

SEQ ID NO: 1853074 - DNA, 17 bp, Homo sapiens
ttgaagcattttataaa

SEQ ID NO: 1853075 - DNA, 22 bp, Homo sapiens
ttgaagcattttataaatcgct

SEQ ID NO: 1853076 - DNA, 23 bp, Homo sapiens
ttgaagcattttataaatcgctt

SEQ ID NO: 1853077 - DNA, 13 bp, Homo sapiens
ttgaagcctttgt

SEQ ID NO: 1853078 - DNA, 19 bp, Homo sapiens
ttgaagggcaagaaatggc

SEQ ID NO: 1853079 - DNA, 11 bp, Homo sapiens
ttgaccaggcc

SEQ ID NO: 1853080 - DNA, 17 bp, Homo sapiens
ttgaccattctccacct

SEQ ID NO: 1853081 - DNA, 14 bp, Homo sapiens
ttgacgccatccca

SEQ ID NO: 1853082 - DNA, 15 bp, Homo sapiens
ttgacgccatcccag

SEQ ID NO: 1853083 - DNA, 23 bp, Homo sapiens
ttgagacctcagcttggcactca

SEQ ID NO: 1853084 - DNA, 16 bp, Homo sapiens
ttgagagaccaggcaa

SEQ ID NO: 1853085 - DNA, 15 bp, Homo sapiens
ttgagatcagcctgg

SEQ ID NO: 1853086 - DNA, 17 bp, Homo sapiens
ttgagatgtatttcaac

SEQ ID NO: 1853087 - DNA, 20 bp, Homo sapiens
ttgagcgtgaatctgtatct

SEQ ID NO: 1853088 - DNA, 16 bp, Homo sapiens
ttgagtcaaaaaatct

SEQ ID NO: 1853089 - DNA, 21 bp, Homo sapiens
ttgagtgacagctttctggga

SEQ ID NO: 1853090 - DNA, 20 bp, Homo sapiens
ttgagttgattcagctctgc

SEQ ID NO: 1853091 - DNA, 19 bp, Homo sapiens
ttgatagcacagaccctgc

SEQ ID NO: 1853092 - DNA, 16 bp, Homo sapiens
ttgattcagacagctg

SEQ ID NO: 1853093 - DNA, 16 bp, Homo sapiens
ttgattcagctctgca

SEQ ID NO: 1853094 - DNA, 16 bp, Homo sapiens
ttgcaaatagccagtg

SEQ ID NO: 1853095 - DNA, 16 bp, Homo sapiens
ttgcaccactgcactc

SEQ ID NO: 1853096 - DNA, 14 bp, Homo sapiens
ttgcacctgcagcc

SEQ ID NO: 1853097 - DNA, 16 bp, Homo sapiens
ttgcagaatgatgcag

SEQ ID NO: 1853098 - DNA, 13 bp, Homo sapiens
ttgcagtcccaag

SEQ ID NO: 1853099 - DNA, 19 bp, Homo sapiens
ttgcatggcatcacctcca

SEQ ID NO: 1853100 - DNA, 15 bp, Homo sapiens
ttgccaagctcagga

SEQ ID NO: 1853101 - DNA, 22 bp, Homo sapiens
ttgcccagcattttactgattc

SEQ ID NO: 1853102 - DNA, 19 bp, Homo sapiens
ttgccgtctacctgagggg

SEQ ID NO: 1853103 - DNA, 22 bp, Homo sapiens
ttgcctttagtgatcacagcag

SEQ ID NO: 1853104 - DNA, 18 bp, Homo sapiens
ttgccttttctagcccga

SEQ ID NO: 1853105 - DNA, 12 bp, Homo sapiens
ttgctcacccag

SEQ ID NO: 1853106 - DNA, 20 bp, Homo sapiens
ttgctccagattctgatgca

SEQ ID NO: 1853107 - DNA, 19 bp, Homo sapiens
ttgctgaatacagaggcaa

SEQ ID NO: 1853108 - DNA, 11 bp, Homo sapiens
ttgctgagcct

SEQ ID NO: 1853109 - DNA, 14 bp, Homo sapiens
ttgctgcttgaggc

SEQ ID NO: 1853110 - DNA, 16 bp, Homo sapiens
ttgctgcttgaggcaa

SEQ ID NO: 1853111 - DNA, 16 bp, Homo sapiens
ttgctttaatataaat

SEQ ID NO: 1853112 - DNA, 17 bp, Homo sapiens
ttgctttaatataaatg

SEQ ID NO: 1853113 - DNA, 18 bp, Homo sapiens
ttgctttaatataaatgc

SEQ ID NO: 1853114 - DNA, 19 bp, Homo sapiens
ttgctttaatataaatgca

SEQ ID NO: 1853115 - DNA, 17 bp, Homo sapiens
ttggaaagagtaggaag

SEQ ID NO: 1853116 - DNA, 18 bp, Homo sapiens
ttggaaatttagcattgt

SEQ ID NO: 1853117 - DNA, 14 bp, Homo sapiens
ttggaactctactc

SEQ ID NO: 1853118 - DNA, 22 bp, Homo sapiens
ttggaactctactcaacccatt

SEQ ID NO: 1853119 - DNA, 13 bp, Homo sapiens
ttggaaggatctg

SEQ ID NO: 1853120 - DNA, 17 bp, Homo sapiens
ttggaaggatctgctga

SEQ ID NO: 1853121 - DNA, 18 bp, Homo sapiens
ttggaaggatctgctgag

SEQ ID NO: 1853122 - DNA, 20 bp, Homo sapiens
ttggaaggatctgctgaggc

SEQ ID NO: 1853123 - DNA, 22 bp, Homo sapiens
ttggaatctagccgatggaaaa

SEQ ID NO: 1853124 - DNA, 19 bp, Homo sapiens
ttggacagaagcagctctt

SEQ ID NO: 1853125 - DNA, 16 bp, Homo sapiens
ttggacattttatgtc

SEQ ID NO: 1853126 - DNA, 17 bp, Homo sapiens
ttggcaaaaaggcagga

SEQ ID NO: 1853127 - DNA, 15 bp, Homo sapiens
ttggcatcagctggc

SEQ ID NO: 1853128 - DNA, 12 bp, Homo sapiens
ttggccatctgc

SEQ ID NO: 1853129 - DNA, 20 bp, Homo sapiens
ttggccccactttgaagggc

SEQ ID NO: 1853130 - DNA, 20 bp, Homo sapiens
ttggcctcttgtagtcttgg

SEQ ID NO: 1853131 - DNA, 11 bp, Homo sapiens
ttgggaggtgc

SEQ ID NO: 1853132 - DNA, 19 bp, Homo sapiens
ttgggctggaacagattca

SEQ ID NO: 1853133 - DNA, 13 bp, Homo sapiens
ttggtcctgctgc

SEQ ID NO: 1853134 - DNA, 16 bp, Homo sapiens
ttggttaagtctgttt

SEQ ID NO: 1853135 - DNA, 18 bp, Homo sapiens
ttggttaagtctgtttta

SEQ ID NO: 1853136 - DNA, 13 bp, Homo sapiens
ttggttttcttct

SEQ ID NO: 1853137 - DNA, 11 bp, Homo sapiens
ttgtaaatata

SEQ ID NO: 1853138 - DNA, 13 bp, Homo sapiens
ttgtaaattgtca

SEQ ID NO: 1853139 - DNA, 22 bp, Homo sapiens
ttgtaactgtttagatgaatgt

SEQ ID NO: 1853140 - DNA, 17 bp, Homo sapiens
ttgtagtgctttgagag

SEQ ID NO: 1853141 - DNA, 16 bp, Homo sapiens
ttgtattaaagacaga

SEQ ID NO: 1853142 - DNA, 12 bp, Homo sapiens
ttgtattaagaa

SEQ ID NO: 1853143 - DNA, 18 bp, Homo sapiens
ttgtattaagaatgaaat

SEQ ID NO: 1853144 - DNA, 22 bp, Homo sapiens
ttgtcacatgaaacatttgcaa

SEQ ID NO: 1853145 - DNA, 18 bp, Homo sapiens
ttgtccccaccgcagaca

SEQ ID NO: 1853146 - DNA, 14 bp, Homo sapiens
ttgtcttattccct

SEQ ID NO: 1853147 - DNA, 12 bp, Homo sapiens
ttgtgacagtgc

SEQ ID NO: 1853148 - DNA, 19 bp, Homo sapiens
ttgtgacagtgcctcttcc

SEQ ID NO: 1853149 - DNA, 11 bp, Homo sapiens
ttgtgcagaga

SEQ ID NO: 1853150 - DNA, 21 bp, Homo sapiens
ttgtgccagaatgctttagga

SEQ ID NO: 1853151 - DNA, 19 bp, Homo sapiens
ttgttctggctcttccagg

SEQ ID NO: 1853152 - DNA, 18 bp, Homo sapiens
ttgtttatacctttgcct

SEQ ID NO: 1853153 - DNA, 15 bp, Homo sapiens
ttgtttgagaaatta

SEQ ID NO: 1853154 - DNA, 19 bp, Homo sapiens
ttgttttgtgtctcttatg

SEQ ID NO: 1853155 - DNA, 17 bp, Homo sapiens
tttaaaaaattaatctg

SEQ ID NO: 1853156 - DNA, 19 bp, Homo sapiens
tttaaaatgaaatgcattt

SEQ ID NO: 1853157 - DNA, 14 bp, Homo sapiens
tttaaccctttctg

SEQ ID NO: 1853158 - DNA, 17 bp, Homo sapiens
tttaagaactaaaatgt

SEQ ID NO: 1853159 - DNA, 11 bp, Homo sapiens
tttaaggaaaa

SEQ ID NO: 1853160 - DNA, 18 bp, Homo sapiens
tttaatataaatgcaaat

SEQ ID NO: 1853161 - DNA, 20 bp, Homo sapiens
tttaattaaatgctcatctg

SEQ ID NO: 1853162 - DNA, 22 bp, Homo sapiens
tttaatttgaaggtagaatgtt

SEQ ID NO: 1853163 - DNA, 16 bp, Homo sapiens
tttactgcagctttgt

SEQ ID NO: 1853164 - DNA, 19 bp, Homo sapiens
tttagaccctattgctgct

SEQ ID NO: 1853165 - DNA, 20 bp, Homo sapiens
tttagacttaatagaaacat

SEQ ID NO: 1853166 - DNA, 22 bp, Homo sapiens
tttagatgaatgtcagttgtta

SEQ ID NO: 1853167 - DNA, 17 bp, Homo sapiens
tttagcagatttaagat

SEQ ID NO: 1853168 - DNA, 22 bp, Homo sapiens
tttaggtcagtagactgtgatt

SEQ ID NO: 1853169 - DNA, 18 bp, Homo sapiens
tttataaatcgcttttga

SEQ ID NO: 1853170 - DNA, 22 bp, Homo sapiens
tttataaatcgcttttgataat

SEQ ID NO: 1853171 - DNA, 13 bp, Homo sapiens
tttataagcatca

SEQ ID NO: 1853172 - DNA, 18 bp, Homo sapiens
tttataagcatcattatt

SEQ ID NO: 1853173 - DNA, 20 bp, Homo sapiens
tttataagcatcattattta

SEQ ID NO: 1853174 - DNA, 21 bp, Homo sapiens
tttataagcatcattatttat

SEQ ID NO: 1853175 - DNA, 20 bp, Homo sapiens
tttatgacttcattaataat

SEQ ID NO: 1853176 - DNA, 12 bp, Homo sapiens
tttatgctttaa

SEQ ID NO: 1853177 - DNA, 12 bp, Homo sapiens
tttatgtaatta

SEQ ID NO: 1853178 - DNA, 15 bp, Homo sapiens
tttatgtaattatat

SEQ ID NO: 1853179 - DNA, 17 bp, Homo sapiens
tttatgttatatataaa

SEQ ID NO: 1853180 - DNA, 19 bp, Homo sapiens
tttatgttccattaaacga

SEQ ID NO: 1853181 - DNA, 12 bp, Homo sapiens
tttattaaagaa

SEQ ID NO: 1853182 - DNA, 19 bp, Homo sapiens
tttatttagttccttgagt

SEQ ID NO: 1853183 - DNA, 16 bp, Homo sapiens
tttatttatttattca

SEQ ID NO: 1853184 - DNA, 13 bp, Homo sapiens
tttatttccagtg

SEQ ID NO: 1853185 - DNA, 16 bp, Homo sapiens
tttatttttggcaaag

SEQ ID NO: 1853186 - DNA, 20 bp, Homo sapiens
tttcacagcacttacaattt

SEQ ID NO: 1853187 - DNA, 22 bp, Homo sapiens
tttcacagtgtgtggtcaacat

SEQ ID NO: 1853188 - DNA, 20 bp, Homo sapiens
tttcacccatctctcaggaa

SEQ ID NO: 1853189 - DNA, 13 bp, Homo sapiens
tttcactttgaaa

SEQ ID NO: 1853190 - DNA, 15 bp, Homo sapiens
tttcactttgaaaag

SEQ ID NO: 1853191 - DNA, 13 bp, Homo sapiens
tttcatattttag

SEQ ID NO: 1853192 - DNA, 15 bp, Homo sapiens
tttcatccttgtctt

SEQ ID NO: 1853193 - DNA, 13 bp, Homo sapiens
tttcatgcaaact

SEQ ID NO: 1853194 - DNA, 18 bp, Homo sapiens
tttcatgcaaactctttg

SEQ ID NO: 1853195 - DNA, 21 bp, Homo sapiens
tttcatgcaaactctttggtc

SEQ ID NO: 1853196 - DNA, 22 bp, Homo sapiens
tttcattgctgggcttgtctgt

SEQ ID NO: 1853197 - DNA, 23 bp, Homo sapiens
tttccacataaggaaactgggtt

SEQ ID NO: 1853198 - DNA, 21 bp, Homo sapiens
tttcccaggactagagcacaa

SEQ ID NO: 1853199 - DNA, 15 bp, Homo sapiens
tttcccccttgagga

SEQ ID NO: 1853200 - DNA, 23 bp, Homo sapiens
tttccctcccttcctctttccat

SEQ ID NO: 1853201 - DNA, 18 bp, Homo sapiens
tttcctagcacacacttt

SEQ ID NO: 1853202 - DNA, 19 bp, Homo sapiens
tttcctggcactgcttcca

SEQ ID NO: 1853203 - DNA, 23 bp, Homo sapiens
tttccttcattcaacccacctgc

SEQ ID NO: 1853204 - DNA, 18 bp, Homo sapiens
tttctaactacaaaggtt

SEQ ID NO: 1853205 - DNA, 20 bp, Homo sapiens
tttctaactacaaaggttta

SEQ ID NO: 1853206 - DNA, 22 bp, Homo sapiens
tttctaactacaaaggtttaaa

SEQ ID NO: 1853207 - DNA, 13 bp, Homo sapiens
tttctcatgttga

SEQ ID NO: 1853208 - DNA, 13 bp, Homo sapiens
tttctgaaacaca

SEQ ID NO: 1853209 - DNA, 21 bp, Homo sapiens
tttctgaattatgcttccaca

SEQ ID NO: 1853210 - DNA, 12 bp, Homo sapiens
tttcttctccct

SEQ ID NO: 1853211 - DNA, 17 bp, Homo sapiens
tttgaaaagttggaagg

SEQ ID NO: 1853212 - DNA, 17 bp, Homo sapiens
tttgaagggcaagaaat

SEQ ID NO: 1853213 - DNA, 13 bp, Homo sapiens
tttgagacaggag

SEQ ID NO: 1853214 - DNA, 17 bp, Homo sapiens
tttgagatcagcctggg

SEQ ID NO: 1853215 - DNA, 17 bp, Homo sapiens
tttgagggcatgaagct

SEQ ID NO: 1853216 - DNA, 20 bp, Homo sapiens
tttgataatcaactgggctg

SEQ ID NO: 1853217 - DNA, 15 bp, Homo sapiens
tttgattcagacagc

SEQ ID NO: 1853218 - DNA, 21 bp, Homo sapiens
tttgattcagacagctgcctg

SEQ ID NO: 1853219 - DNA, 22 bp, Homo sapiens
tttgattcagacagctgcctgg

SEQ ID NO: 1853220 - DNA, 22 bp, Homo sapiens
tttgcataggtgatctcattta

SEQ ID NO: 1853221 - DNA, 18 bp, Homo sapiens
tttgccaccctcatgctg

SEQ ID NO: 1853222 - DNA, 12 bp, Homo sapiens
tttgctctgcca

SEQ ID NO: 1853223 - DNA, 20 bp, Homo sapiens
tttgctgctaatattttcct

SEQ ID NO: 1853224 - DNA, 12 bp, Homo sapiens
tttgcttcctca

SEQ ID NO: 1853225 - DNA, 21 bp, Homo sapiens
tttggaattttgtgcccccat

SEQ ID NO: 1853226 - DNA, 23 bp, Homo sapiens
tttggccatctctggatgcctga

SEQ ID NO: 1853227 - DNA, 14 bp, Homo sapiens
tttggcctcttgta

SEQ ID NO: 1853228 - DNA, 16 bp, Homo sapiens
tttggctagtccttgt

SEQ ID NO: 1853229 - DNA, 17 bp, Homo sapiens
tttggtctacactgtgc

SEQ ID NO: 1853230 - DNA, 20 bp, Homo sapiens
tttggttaagtctgttttat

SEQ ID NO: 1853231 - DNA, 17 bp, Homo sapiens
tttggttgctttaatat

SEQ ID NO: 1853232 - DNA, 14 bp, Homo sapiens
tttgtactgaatct

SEQ ID NO: 1853233 - DNA, 17 bp, Homo sapiens
tttgtcctttttcactt

SEQ ID NO: 1853234 - DNA, 23 bp, Homo sapiens
tttgtcttaaaaagtggaaaaat

SEQ ID NO: 1853235 - DNA, 16 bp, Homo sapiens
tttgtgagcaggctgt

SEQ ID NO: 1853236 - DNA, 14 bp, Homo sapiens
tttgtgatgcattt

SEQ ID NO: 1853237 - DNA, 16 bp, Homo sapiens
tttgttgtcagctgaa

SEQ ID NO: 1853238 - DNA, 15 bp, Homo sapiens
tttgttttgtgtctc

SEQ ID NO: 1853239 - DNA, 21 bp, Homo sapiens
ttttaaaaaactgctgactgt

SEQ ID NO: 1853240 - DNA, 13 bp, Homo sapiens
ttttaaaatgaaa

SEQ ID NO: 1853241 - DNA, 19 bp, Homo sapiens
ttttaaaatgaaatgcatt

SEQ ID NO: 1853242 - DNA, 21 bp, Homo sapiens
ttttaaaatgaaatgcatttt

SEQ ID NO: 1853243 - DNA, 17 bp, Homo sapiens
ttttaatgctccaaatg

SEQ ID NO: 1853244 - DNA, 20 bp, Homo sapiens
ttttatgacttcattaataa

SEQ ID NO: 1853245 - DNA, 17 bp, Homo sapiens
ttttatgtaattatata

SEQ ID NO: 1853246 - DNA, 22 bp, Homo sapiens
ttttatttttggcaaagccaga

SEQ ID NO: 1853247 - DNA, 20 bp, Homo sapiens
ttttctaaaggagtttatgt

SEQ ID NO: 1853248 - DNA, 12 bp, Homo sapiens
ttttctgttata

SEQ ID NO: 1853249 - DNA, 23 bp, Homo sapiens
ttttcttaaataataaagatcat

SEQ ID NO: 1853250 - DNA, 13 bp, Homo sapiens
ttttcttctccct

SEQ ID NO: 1853251 - DNA, 18 bp, Homo sapiens
ttttgagggcatgaagct

SEQ ID NO: 1853252 - DNA, 15 bp, Homo sapiens
ttttgtactgaatct

SEQ ID NO: 1853253 - DNA, 16 bp, Homo sapiens
ttttgtttttgtctta

SEQ ID NO: 1853254 - DNA, 17 bp, Homo sapiens
tttttatgtaattatat

SEQ ID NO: 1853255 - DNA, 16 bp, Homo sapiens
tttttatttttggcaa

SEQ ID NO: 1853256 - DNA, 17 bp, Homo sapiens
tttttggcaaagccaga

SEQ ID NO: 1853257 - DNA, 13 bp, Homo sapiens
tttttttgtttgt

SEQ ID NO: 1853258 - DNA, 14 bp, Homo sapiens
ttttttttgtttgt

SEQ ID NO: 1853259 - DNA, 13 bp, Homo sapiens
aaaaaaatgtatt

SEQ ID NO: 1853260 - DNA, 15 bp, Homo sapiens
aaaaaatattttcct

SEQ ID NO: 1853261 - DNA, 14 bp, Homo sapiens
aaaaaatgaacagt

SEQ ID NO: 1853262 - DNA, 18 bp, Homo sapiens
aaaaacctgagatttatt

SEQ ID NO: 1853263 - DNA, 22 bp, Homo sapiens
aaaaacctgagatttattaaag

SEQ ID NO: 1853264 - DNA, 13 bp, Homo sapiens
aaaaagataaaca

SEQ ID NO: 1853265 - DNA, 14 bp, Homo sapiens
aaaaaggaggaaga

SEQ ID NO: 1853266 - DNA, 19 bp, Homo sapiens
aaaacactgttctctgccc

SEQ ID NO: 1853267 - DNA, 16 bp, Homo sapiens
aaaacatgcttttcca

SEQ ID NO: 1853268 - DNA, 18 bp, Homo sapiens
aaaacctgagatttatta

SEQ ID NO: 1853269 - DNA, 11 bp, Homo sapiens
aaaagaaaaag

SEQ ID NO: 1853270 - DNA, 17 bp, Homo sapiens
aaaagaggtttttctta

SEQ ID NO: 1853271 - DNA, 14 bp, Homo sapiens
aaaagatctttcat

SEQ ID NO: 1853272 - DNA, 18 bp, Homo sapiens
aaaagatgcactttgctt

SEQ ID NO: 1853273 - DNA, 22 bp, Homo sapiens
aaaagatgcactttgctttaat

SEQ ID NO: 1853274 - DNA, 13 bp, Homo sapiens
aaaagatgcttct

SEQ ID NO: 1853275 - DNA, 11 bp, Homo sapiens
aaaaggcagga

SEQ ID NO: 1853276 - DNA, 13 bp, Homo sapiens
aaaagttggaagg

SEQ ID NO: 1853277 - DNA, 20 bp, Homo sapiens
aaaagttggaaggatctgct

SEQ ID NO: 1853278 - DNA, 22 bp, Homo sapiens
aaaagttggaaggatctgctga

SEQ ID NO: 1853279 - DNA, 16 bp, Homo sapiens
aaaataaagaaaagat

SEQ ID NO: 1853280 - DNA, 19 bp, Homo sapiens
aaaatacctaattgtggat

SEQ ID NO: 1853281 - DNA, 14 bp, Homo sapiens
aaattaatctgggc

SEQ ID NO: 1853282 - DNA, 21 bp, Homo sapiens
aaattcatcaaatggaagaca

SEQ ID NO: 1853283 - DNA, 13 bp, Homo sapiens
aaattgcatttgt

SEQ ID NO: 1853284 - DNA, 21 bp, Homo sapiens
aaatttagcattgtagtgctt

SEQ ID NO: 1853285 - DNA, 14 bp, Homo sapiens
aacaaaatttgaat

SEQ ID NO: 1853286 - DNA, 19 bp, Homo sapiens
aacaaatgccaaattaaaa

SEQ ID NO: 1853287 - DNA, 22 bp, Homo sapiens
aacaaattcatcaaatggaaga

SEQ ID NO: 1853288 - DNA, 15 bp, Homo sapiens
aacaaattgcatttg

SEQ ID NO: 1853289 - DNA, 17 bp, Homo sapiens
aacaagaaaaataaaga

SEQ ID NO: 1853290 - DNA, 19 bp, Homo sapiens
aacaagaaaaataaagaaa

SEQ ID NO: 1853291 - DNA, 15 bp, Homo sapiens
aacaagagaagcatt

SEQ ID NO: 1853292 - DNA, 21 bp, Homo sapiens
aacaagagaagcattctcatt

SEQ ID NO: 1853293 - DNA, 19 bp, Homo sapiens
aacaagcaagctcccaagg

SEQ ID NO: 1853294 - DNA, 14 bp, Homo sapiens
aacaagttgaagaa

SEQ ID NO: 1853295 - DNA, 20 bp, Homo sapiens
aacaatttgagatgtatttc

SEQ ID NO: 1853296 - DNA, 19 bp, Homo sapiens
aacacaagattggtgtttt

SEQ ID NO: 1853297 - DNA, 20 bp, Homo sapiens
aacacaagattggtgttttt

SEQ ID NO: 1853298 - DNA, 20 bp, Homo sapiens
aacacacgagcaaacccaga

SEQ ID NO: 1853299 - DNA, 18 bp, Homo sapiens
aacacagcaattcctcag

SEQ ID NO: 1853300 - DNA, 13 bp, Homo sapiens
aacacccctctgt

SEQ ID NO: 1853301 - DNA, 17 bp, Homo sapiens
aacactcaagaagcagg

SEQ ID NO: 1853302 - DNA, 14 bp, Homo sapiens
aacactgcaggcat

SEQ ID NO: 1853303 - DNA, 17 bp, Homo sapiens
aacactgttctctgccc

SEQ ID NO: 1853304 - DNA, 15 bp, Homo sapiens
aacagattcacactg

SEQ ID NO: 1853305 - DNA, 18 bp, Homo sapiens
aacagattcacactgtct

SEQ ID NO: 1853306 - DNA, 13 bp, Homo sapiens
aacagctcgactt

SEQ ID NO: 1853307 - DNA, 16 bp, Homo sapiens
aacagctgtgtctgcc

SEQ ID NO: 1853308 - DNA, 22 bp, Homo sapiens
aacataagctatttttctaact

SEQ ID NO: 1853309 - DNA, 16 bp, Homo sapiens
aacatactcccatctg

SEQ ID NO: 1853310 - DNA, 14 bp, Homo sapiens
aacatactgattgg

SEQ ID NO: 1853311 - DNA, 21 bp, Homo sapiens
aacatcatcaaggcactgcct

SEQ ID NO: 1853312 - DNA, 19 bp, Homo sapiens
aacatgtgccttttctgaa

SEQ ID NO: 1853313 - DNA, 20 bp, Homo sapiens
aacattacagggaatgcctg

SEQ ID NO: 1853314 - DNA, 14 bp, Homo sapiens
aacattccatcctt

SEQ ID NO: 1853315 - DNA, 14 bp, Homo sapiens
aacattcccagccc

SEQ ID NO: 1853316 - DNA, 18 bp, Homo sapiens
aacattggttcttgtatt

SEQ ID NO: 1853317 - DNA, 19 bp, Homo sapiens
aacattggttcttgtatta

SEQ ID NO: 1853318 - DNA, 15 bp, Homo sapiens
aaccacagctgctgg

SEQ ID NO: 1853319 - DNA, 16 bp, Homo sapiens
aaccacagctgctgga

SEQ ID NO: 1853320 - DNA, 19 bp, Homo sapiens
aaccagaaacacccctctg

SEQ ID NO: 1853321 - DNA, 21 bp, Homo sapiens
aaccagggccccggggcctgt

SEQ ID NO: 1853322 - DNA, 13 bp, Homo sapiens
aaccattactgta

SEQ ID NO: 1853323 - DNA, 19 bp, Homo sapiens
aacccaaggtaccatccta

SEQ ID NO: 1853324 - DNA, 15 bp, Homo sapiens
aacctactagacaat

SEQ ID NO: 1853325 - DNA, 18 bp, Homo sapiens
aacctctcacttcaccct

SEQ ID NO: 1853326 - DNA, 22 bp, Homo sapiens
aacctgagatttattaaagaaa

SEQ ID NO: 1853327 - DNA, 17 bp, Homo sapiens
aacctgatgcagtcacg

SEQ ID NO: 1853328 - DNA, 15 bp, Homo sapiens
aacgatttttaaaat

SEQ ID NO: 1853329 - DNA, 18 bp, Homo sapiens
aacgatttttaaaatgta

SEQ ID NO: 1853330 - DNA, 18 bp, Homo sapiens
aacgtcattcagtactta

SEQ ID NO: 1853331 - DNA, 17 bp, Homo sapiens
aacgtccacagagtata

SEQ ID NO: 1853332 - DNA, 19 bp, Homo sapiens
aacgtgatttttaaattaa

SEQ ID NO: 1853333 - DNA, 15 bp, Homo sapiens
aactaaaatgttcta

SEQ ID NO: 1853334 - DNA, 20 bp, Homo sapiens
aactacaaagctgaagaaaa

SEQ ID NO: 1853335 - DNA, 18 bp, Homo sapiens
aactacaaaggtttaaat

SEQ ID NO: 1853336 - DNA, 19 bp, Homo sapiens
aactactttgctgctaata

SEQ ID NO: 1853337 - DNA, 17 bp, Homo sapiens
aactcaaactcttaaaa

SEQ ID NO: 1853338 - DNA, 21 bp, Homo sapiens
aactcagtagagatctatatt

SEQ ID NO: 1853339 - DNA, 19 bp, Homo sapiens
aactctactcaacccattg

SEQ ID NO: 1853340 - DNA, 16 bp, Homo sapiens
aactctcctctgctgc

SEQ ID NO: 1853341 - DNA, 22 bp, Homo sapiens
aactctcctctgctgctggctg

SEQ ID NO: 1853342 - DNA, 23 bp, Homo sapiens
aactctcctctgctgctggctgg

SEQ ID NO: 1853343 - DNA, 23 bp, Homo sapiens
aactctgacaacagacttctgaa

SEQ ID NO: 1853344 - DNA, 20 bp, Homo sapiens
aactgaactctgacaacaga

SEQ ID NO: 1853345 - DNA, 21 bp, Homo sapiens
aactgaaggggtgcacccacc

SEQ ID NO: 1853346 - DNA, 23 bp, Homo sapiens
aactgctgactgttttctcttga

SEQ ID NO: 1853347 - DNA, 14 bp, Homo sapiens
aactgggctgaaca

SEQ ID NO: 1853348 - DNA, 11 bp, Homo sapiens
aacttcttcag

SEQ ID NO: 1853349 - DNA, 19 bp, Homo sapiens
aacttcttcagagctgaca

SEQ ID NO: 1853350 - DNA, 16 bp, Homo sapiens
aagaaaaaaatgtatt

SEQ ID NO: 1853351 - DNA, 17 bp, Homo sapiens
aagaaaaaaatgtattt

SEQ ID NO: 1853352 - DNA, 18 bp, Homo sapiens
aagaaaaagaaaaagaaa

SEQ ID NO: 1853353 - DNA, 17 bp, Homo sapiens
aagaaaaatgagcctgg

SEQ ID NO: 1853354 - DNA, 12 bp, Homo sapiens
aagaagcaggct

SEQ ID NO: 1853355 - DNA, 15 bp, Homo sapiens
aagaagctctctcct

SEQ ID NO: 1853356 - DNA, 21 bp, Homo sapiens
aagaattgttgggggtttttt

SEQ ID NO: 1853357 - DNA, 15 bp, Homo sapiens
aagaatttatctctt

SEQ ID NO: 1853358 - DNA, 18 bp, Homo sapiens
aagacaccgttcattcag

SEQ ID NO: 1853359 - DNA, 12 bp, Homo sapiens
aagacctggcaa

SEQ ID NO: 1853360 - DNA, 15 bp, Homo sapiens
aagacgctgtgctgc

SEQ ID NO: 1853361 - DNA, 19 bp, Homo sapiens
aagacgctgtgctgccctg

SEQ ID NO: 1853362 - DNA, 15 bp, Homo sapiens
aagacttcagattcc

SEQ ID NO: 1853363 - DNA, 21 bp, Homo sapiens
aagacttttccaaccctcatc

SEQ ID NO: 1853364 - DNA, 13 bp, Homo sapiens
aagagaaaaaata

SEQ ID NO: 1853365 - DNA, 13 bp, Homo sapiens
aagagattcgaat

SEQ ID NO: 1853366 - DNA, 21 bp, Homo sapiens
aagagattcgaatgacggtaa

SEQ ID NO: 1853367 - DNA, 22 bp, Homo sapiens
aagagcccgcagggccatgcag

SEQ ID NO: 1853368 - DNA, 20 bp, Homo sapiens
aagagcttgctccagattct

SEQ ID NO: 1853369 - DNA, 22 bp, Homo sapiens
aagagcttgctccagattctga

SEQ ID NO: 1853370 - DNA, 23 bp, Homo sapiens
aagagcttgctccagattctgat

SEQ ID NO: 1853371 - DNA, 21 bp, Homo sapiens
aagagggagggagggctccag

SEQ ID NO: 1853372 - DNA, 14 bp, Homo sapiens
aagagtaggaagac

SEQ ID NO: 1853373 - DNA, 16 bp, Homo sapiens
aagagtaggaagactt

SEQ ID NO: 1853374 - DNA, 14 bp, Homo sapiens
aagagtgctaagca

SEQ ID NO: 1853375 - DNA, 17 bp, Homo sapiens
aagagtgctaagcatta

SEQ ID NO: 1853376 - DNA, 17 bp, Homo sapiens
aagataaacacaagatt

SEQ ID NO: 1853377 - DNA, 21 bp, Homo sapiens
aagataatattaaggaagaca

SEQ ID NO: 1853378 - DNA, 23 bp, Homo sapiens
aagatatgtaacaacaattattt

SEQ ID NO: 1853379 - DNA, 22 bp, Homo sapiens
aagatctttcattttgcacctg

SEQ ID NO: 1853380 - DNA, 16 bp, Homo sapiens
aagatgcactttgctt

SEQ ID NO: 1853381 - DNA, 11 bp, Homo sapiens
aagattctatg

SEQ ID NO: 1853382 - DNA, 18 bp, Homo sapiens
aagcaaatgcctgccaaa

SEQ ID NO: 1853383 - DNA, 17 bp, Homo sapiens
aagcactttaacacagt

SEQ ID NO: 1853384 - DNA, 21 bp, Homo sapiens
aagcactttaacacagtgtct

SEQ ID NO: 1853385 - DNA, 17 bp, Homo sapiens
aagcaggaggcccttgt

SEQ ID NO: 1853386 - DNA, 22 bp, Homo sapiens
aagcaggctacactgacactgg

SEQ ID NO: 1853387 - DNA, 18 bp, Homo sapiens
aagcaggtgcaacactca

SEQ ID NO: 1853388 - DNA, 15 bp, Homo sapiens
aagcatcattattta

SEQ ID NO: 1853389 - DNA, 17 bp, Homo sapiens
aagcatcattatttatg

SEQ ID NO: 1853390 - DNA, 22 bp, Homo sapiens
aagcatcattatttatgtattg

SEQ ID NO: 1853391 - DNA, 19 bp, Homo sapiens
aagcattttataaatcgct

SEQ ID NO: 1853392 - DNA, 19 bp, Homo sapiens
aagccaccaacatactccc

SEQ ID NO: 1853393 - DNA, 18 bp, Homo sapiens
aagcccctgcccctcctc

SEQ ID NO: 1853394 - DNA, 20 bp, Homo sapiens
aagccgctggggccagttgg

SEQ ID NO: 1853395 - DNA, 21 bp, Homo sapiens
aagccgtgattttcattgctg

SEQ ID NO: 1853396 - DNA, 21 bp, Homo sapiens
aagcggtgtctctcctgcccc

SEQ ID NO: 1853397 - DNA, 22 bp, Homo sapiens
aagctatatcaatctctcttag

SEQ ID NO: 1853398 - DNA, 21 bp, Homo sapiens
aagctatttttctaactacaa

SEQ ID NO: 1853399 - DNA, 16 bp, Homo sapiens
aagctcagggcctggc

SEQ ID NO: 1853400 - DNA, 20 bp, Homo sapiens
aagctcagggcctggctcag

SEQ ID NO: 1853401 - DNA, 17 bp, Homo sapiens
aagctccaagctcccag

SEQ ID NO: 1853402 - DNA, 22 bp, Homo sapiens
aattaaggattttatgctttaa

SEQ ID NO: 1853403 - DNA, 18 bp, Homo sapiens
aattatttattattaaga

SEQ ID NO: 1853404 - DNA, 13 bp, Homo sapiens
aattattttcatc

SEQ ID NO: 1853405 - DNA, 20 bp, Homo sapiens
aattccctggcctttcatat

SEQ ID NO: 1853406 - DNA, 20 bp, Homo sapiens
aattcctcatttgttcatta

SEQ ID NO: 1853407 - DNA, 23 bp, Homo sapiens
aattcctcatttgttcattaaac

SEQ ID NO: 1853408 - DNA, 21 bp, Homo sapiens
aattctaacgcaaaaatagct

SEQ ID NO: 1853409 - DNA, 18 bp, Homo sapiens
aattctgtttttctaggc

SEQ ID NO: 1853410 - DNA, 23 bp, Homo sapiens
aattcttcacctaagtctctgtg

SEQ ID NO: 1853411 - DNA, 14 bp, Homo sapiens
aattctttgttctg

SEQ ID NO: 1853412 - DNA, 13 bp, Homo sapiens
aattgcagactgt

SEQ ID NO: 1853413 - DNA, 12 bp, Homo sapiens
aattgcatttgt

SEQ ID NO: 1853414 - DNA, 14 bp, Homo sapiens
aatttagcattgta

SEQ ID NO: 1853415 - DNA, 24 bp, Homo sapiens
aatttatctctttagttagtgatt

SEQ ID NO: 1853416 - DNA, 21 bp, Homo sapiens
aattttaaggcatatttaaca

SEQ ID NO: 1853417 - DNA, 14 bp, Homo sapiens
acaaacctgcctgg

SEQ ID NO: 1853418 - DNA, 18 bp, Homo sapiens
acaaacctgcctgggttt

SEQ ID NO: 1853419 - DNA, 17 bp, Homo sapiens
acaaaggtttaaatgaa

SEQ ID NO: 1853420 - DNA, 18 bp, Homo sapiens
acaaaggtttaaatgaac

SEQ ID NO: 1853421 - DNA, 19 bp, Homo sapiens
acaaaggtttaaatgaaca

SEQ ID NO: 1853422 - DNA, 12 bp, Homo sapiens
acaaattgcatt

SEQ ID NO: 1853423 - DNA, 22 bp, Homo sapiens
acaacgtgctctttgttttgtg

SEQ ID NO: 1853424 - DNA, 20 bp, Homo sapiens
acaactcctagggccactga

SEQ ID NO: 1853425 - DNA, 16 bp, Homo sapiens
acaagaaaaataaaga

SEQ ID NO: 1853426 - DNA, 17 bp, Homo sapiens
acaagaaaaataaagaa

SEQ ID NO: 1853427 - DNA, 18 bp, Homo sapiens
acaagaaaaataaagaaa

SEQ ID NO: 1853428 - DNA, 14 bp, Homo sapiens
acaagagaagcatt

SEQ ID NO: 1853429 - DNA, 17 bp, Homo sapiens
acaagagaagcattctc

SEQ ID NO: 1853430 - DNA, 23 bp, Homo sapiens
acaagattggtgtttttttctat

SEQ ID NO: 1853431 - DNA, 22 bp, Homo sapiens
acaagcaattagacaagaactt

SEQ ID NO: 1853432 - DNA, 19 bp, Homo sapiens
acaagctccaagctcccag

SEQ ID NO: 1853433 - DNA, 13 bp, Homo sapiens
acaagctgcaccc

SEQ ID NO: 1853434 - DNA, 17 bp, Homo sapiens
acaaggaaggtggtggg

SEQ ID NO: 1853435 - DNA, 21 bp, Homo sapiens
acaaggacagcccctcctcca

SEQ ID NO: 1853436 - DNA, 22 bp, Homo sapiens
acaaggacagcccctcctccat

SEQ ID NO: 1853437 - DNA, 16 bp, Homo sapiens
acaaggagataagaaa

SEQ ID NO: 1853438 - DNA, 18 bp, Homo sapiens
acaaggagataagaaagc

SEQ ID NO: 1853439 - DNA, 18 bp, Homo sapiens
acaagtgactgtatctgt

SEQ ID NO: 1853440 - DNA, 14 bp, Homo sapiens
acaagttgaagaag

SEQ ID NO: 1853441 - DNA, 18 bp, Homo sapiens
acaatagtaacctgggta

SEQ ID NO: 1853442 - DNA, 19 bp, Homo sapiens
acaatgtgaaaagaaaaat

SEQ ID NO: 1853443 - DNA, 22 bp, Homo sapiens
acaattatttgaagatttaatt

SEQ ID NO: 1853444 - DNA, 16 bp, Homo sapiens
acacaagattggtgtt

SEQ ID NO: 1853445 - DNA, 18 bp, Homo sapiens
acacaagattggtgtttt

SEQ ID NO: 1853446 - DNA, 21 bp, Homo sapiens
acacaagattggtgttttttt

SEQ ID NO: 1853447 - DNA, 23 bp, Homo sapiens
acacaagattggtgtttttttct

SEQ ID NO: 1853448 - DNA, 20 bp, Homo sapiens
acacacagctaacacacagc

SEQ ID NO: 1853449 - DNA, 14 bp, Homo sapiens
acacagaaaccaat

SEQ ID NO: 1853450 - DNA, 14 bp, Homo sapiens
acacagatgaaaca

SEQ ID NO: 1853451 - DNA, 18 bp, Homo sapiens
acacaggctccaaactgg

SEQ ID NO: 1853452 - DNA, 22 bp, Homo sapiens
acacagtgctgaccagacagcc

SEQ ID NO: 1853453 - DNA, 13 bp, Homo sapiens
acacatgtccaag

SEQ ID NO: 1853454 - DNA, 19 bp, Homo sapiens
acacatgtccaagaagccc

SEQ ID NO: 1853455 - DNA, 17 bp, Homo sapiens
acaccaccggccccctc

SEQ ID NO: 1853456 - DNA, 13 bp, Homo sapiens
acacccctctgtc

SEQ ID NO: 1853457 - DNA, 21 bp, Homo sapiens
acacccctctgtctaggactg

SEQ ID NO: 1853458 - DNA, 11 bp, Homo sapiens
acaccctgtga

SEQ ID NO: 1853459 - DNA, 18 bp, Homo sapiens
acaccgttcattcaggca

SEQ ID NO: 1853460 - DNA, 18 bp, Homo sapiens
acacctctgcacaagctg

SEQ ID NO: 1853461 - DNA, 18 bp, Homo sapiens
acacgagcaaacccagag

SEQ ID NO: 1853462 - DNA, 19 bp, Homo sapiens
acacgctccttcctctgag

SEQ ID NO: 1853463 - DNA, 19 bp, Homo sapiens
acacggtttgaagcctgga

SEQ ID NO: 1853464 - DNA, 21 bp, Homo sapiens
acactcattgacctgaggccc

SEQ ID NO: 1853465 - DNA, 15 bp, Homo sapiens
acactccaattaagg

SEQ ID NO: 1853466 - DNA, 16 bp, Homo sapiens
acactccaattaagga

SEQ ID NO: 1853467 - DNA, 18 bp, Homo sapiens
acactccaattaaggatt

SEQ ID NO: 1853468 - DNA, 14 bp, Homo sapiens
acactgagctgtca

SEQ ID NO: 1853469 - DNA, 21 bp, Homo sapiens
acactgcaggcatcacagcta

SEQ ID NO: 1853470 - DNA, 18 bp, Homo sapiens
acactgggacttgcaaaa

SEQ ID NO: 1853471 - DNA, 19 bp, Homo sapiens
acactgggacttgcaaaaa

SEQ ID NO: 1853472 - DNA, 15 bp, Homo sapiens
acactgggtgcgtct

SEQ ID NO: 1853473 - DNA, 19 bp, Homo sapiens
acactgggtgcgtctccag

SEQ ID NO: 1853474 - DNA, 21 bp, Homo sapiens
acactggtattcctgcctcca

SEQ ID NO: 1853475 - DNA, 15 bp, Homo sapiens
acactgttctctgcc

SEQ ID NO: 1853476 - DNA, 12 bp, Homo sapiens
acactgttctta

SEQ ID NO: 1853477 - DNA, 21 bp, Homo sapiens
acactgttcttagctcaatga

SEQ ID NO: 1853478 - DNA, 22 bp, Homo sapiens
acactgttcttagctcaatgag

SEQ ID NO: 1853479 - DNA, 22 bp, Homo sapiens
acacttttggttaagtctgttt

SEQ ID NO: 1853480 - DNA, 21 bp, Homo sapiens
acagaacacataattcaggaa

SEQ ID NO: 1853481 - DNA, 12 bp, Homo sapiens
acagaagcagct

SEQ ID NO: 1853482 - DNA, 18 bp, Homo sapiens
acagaccctgccctgtgg

SEQ ID NO: 1853483 - DNA, 14 bp, Homo sapiens
acagacttctgaaa

SEQ ID NO: 1853484 - DNA, 19 bp, Homo sapiens
acagagaaagaggaagctt

SEQ ID NO: 1853485 - DNA, 14 bp, Homo sapiens
acagagcccacgcc

SEQ ID NO: 1853486 - DNA, 18 bp, Homo sapiens
acagagcccacgccccca

SEQ ID NO: 1853487 - DNA, 23 bp, Homo sapiens
acagaggatgctgacatcatttg

SEQ ID NO: 1853488 - DNA, 17 bp, Homo sapiens
acagagggggtggcctc

SEQ ID NO: 1853489 - DNA, 20 bp, Homo sapiens
acagatgaaacacaaacaat

SEQ ID NO: 1853490 - DNA, 15 bp, Homo sapiens
acagcccgggctctg

SEQ ID NO: 1853491 - DNA, 18 bp, Homo sapiens
acagcccgggctctgcct

SEQ ID NO: 1853492 - DNA, 18 bp, Homo sapiens
acagctaacacacagctc

SEQ ID NO: 1853493 - DNA, 19 bp, Homo sapiens
acagctaacacacagctcc

SEQ ID NO: 1853494 - DNA, 11 bp, Homo sapiens
acagctgctgg

SEQ ID NO: 1853495 - DNA, 18 bp, Homo sapiens
acagctgggtggcactgc

SEQ ID NO: 1853496 - DNA, 23 bp, Homo sapiens
acagctgggtggcactgccatgc

SEQ ID NO: 1853497 - DNA, 12 bp, Homo sapiens
acagctgtgtct

SEQ ID NO: 1853498 - DNA, 13 bp, Homo sapiens
acagctgtgtctg

SEQ ID NO: 1853499 - DNA, 22 bp, Homo sapiens
acagctgtgtctgccaaacaca

SEQ ID NO: 1853500 - DNA, 13 bp, Homo sapiens
acagctttctggg

SEQ ID NO: 1853501 - DNA, 12 bp, Homo sapiens
acaggcagcaga

SEQ ID NO: 1853502 - DNA, 13 bp, Homo sapiens
acaggcagcagag

SEQ ID NO: 1853503 - DNA, 14 bp, Homo sapiens
acaggcagcagaga

SEQ ID NO: 1853504 - DNA, 16 bp, Homo sapiens
acaggcttctgagcag

SEQ ID NO: 1853505 - DNA, 23 bp, Homo sapiens
acaggcttctgagcagcgagcct

SEQ ID NO: 1853506 - DNA, 13 bp, Homo sapiens
acagggatgagca

SEQ ID NO: 1853507 - DNA, 21 bp, Homo sapiens
acagggcctttggcaggtgca

SEQ ID NO: 1853508 - DNA, 22 bp, Homo sapiens
acaggtgggcttcccagtggct

SEQ ID NO: 1853509 - DNA, 12 bp, Homo sapiens
acagtattgctc

SEQ ID NO: 1853510 - DNA, 15 bp, Homo sapiens
acagtattgctcacc

SEQ ID NO: 1853511 - DNA, 22 bp, Homo sapiens
acagtattgctcacccagtgcc

SEQ ID NO: 1853512 - DNA, 16 bp, Homo sapiens
acagtcatggtggcca

SEQ ID NO: 1853513 - DNA, 21 bp, Homo sapiens
acagtcatggtggccacggcc

SEQ ID NO: 1853514 - DNA, 17 bp, Homo sapiens
acagtccaaccagaaac

SEQ ID NO: 1853515 - DNA, 15 bp, Homo sapiens
acagtccagcctgga

SEQ ID NO: 1853516 - DNA, 12 bp, Homo sapiens
acagtccctgcc

SEQ ID NO: 1853517 - DNA, 15 bp, Homo sapiens
acagtcctcccatct

SEQ ID NO: 1853518 - DNA, 17 bp, Homo sapiens
acagtcctcccatctca

SEQ ID NO: 1853519 - DNA, 18 bp, Homo sapiens
acagtccttaccagcaga

SEQ ID NO: 1853520 - DNA, 22 bp, Homo sapiens
acagtccttaccagcagagcac

SEQ ID NO: 1853521 - DNA, 12 bp, Homo sapiens
acagtgccaccc

SEQ ID NO: 1853522 - DNA, 12 bp, Homo sapiens
acagtgcctctt

SEQ ID NO: 1853523 - DNA, 20 bp, Homo sapiens
acagttgaaaaacagctgag

SEQ ID NO: 1853524 - DNA, 22 bp, Homo sapiens
catatttaacaaaatttgaata

SEQ ID NO: 1853525 - DNA, 21 bp, Homo sapiens
catatttcaaaaacatgcttt

SEQ ID NO: 1853526 - DNA, 17 bp, Homo sapiens
catcaaatggaagacac

SEQ ID NO: 1853527 - DNA, 15 bp, Homo sapiens
catcaagactggaag

SEQ ID NO: 1853528 - DNA, 15 bp, Homo sapiens
catcacaaatggcta

SEQ ID NO: 1853529 - DNA, 13 bp, Homo sapiens
catcacagttttg

SEQ ID NO: 1853530 - DNA, 14 bp, Homo sapiens
catcacctccacca

SEQ ID NO: 1853531 - DNA, 18 bp, Homo sapiens
catcagaggtttgcttcc

SEQ ID NO: 1853532 - DNA, 21 bp, Homo sapiens
catcaggccaggccctctgcc

SEQ ID NO: 1853533 - DNA, 22 bp, Homo sapiens
catcaggccaggccctctgccc

SEQ ID NO: 1853534 - DNA, 22 bp, Homo sapiens
catcagtattgaagcattttat

SEQ ID NO: 1853535 - DNA, 12 bp, Homo sapiens
catcatttatca

SEQ ID NO: 1853536 - DNA, 15 bp, Homo sapiens
catcatttcacttgt

SEQ ID NO: 1853537 - DNA, 18 bp, Homo sapiens
catccatgttccgagaag

SEQ ID NO: 1853538 - DNA, 19 bp, Homo sapiens
catccatgttccgagaaga

SEQ ID NO: 1853539 - DNA, 14 bp, Homo sapiens
catcccagccccaa

SEQ ID NO: 1853540 - DNA, 14 bp, Homo sapiens
catcccctgtagag

SEQ ID NO: 1853541 - DNA, 17 bp, Homo sapiens
catccctgaaggccccg

SEQ ID NO: 1853542 - DNA, 19 bp, Homo sapiens
catccctgaaggccccgcc

SEQ ID NO: 1853543 - DNA, 17 bp, Homo sapiens
catcctaggctgacacc

SEQ ID NO: 1853544 - DNA, 17 bp, Homo sapiens
catcctcaaacactgca

SEQ ID NO: 1853545 - DNA, 15 bp, Homo sapiens
catcctcatacccac

SEQ ID NO: 1853546 - DNA, 17 bp, Homo sapiens
catcctcatacccaccc

SEQ ID NO: 1853547 - DNA, 21 bp, Homo sapiens
catctccaaatatcagtgggc

SEQ ID NO: 1853548 - DNA, 21 bp, Homo sapiens
catctccgtctcccaaagtgc

SEQ ID NO: 1853549 - DNA, 15 bp, Homo sapiens
catctcctttgcaga

SEQ ID NO: 1853550 - DNA, 21 bp, Homo sapiens
catctcctttgcagaatgatg

SEQ ID NO: 1853551 - DNA, 16 bp, Homo sapiens
catctgcattcctgat

SEQ ID NO: 1853552 - DNA, 11 bp, Homo sapiens
catctgggctc

SEQ ID NO: 1853553 - DNA, 16 bp, Homo sapiens
catctgtaaaatggag

SEQ ID NO: 1853554 - DNA, 23 bp, Homo sapiens
catctgtaagagcttgctccaga

SEQ ID NO: 1853555 - DNA, 22 bp, Homo sapiens
catcttaggttggcaaaaaggc

SEQ ID NO: 1853556 - DNA, 15 bp, Homo sapiens
catgaaactccacct

SEQ ID NO: 1853557 - DNA, 13 bp, Homo sapiens
catgacccaggct

SEQ ID NO: 1853558 - DNA, 15 bp, Homo sapiens
catgacccaggctgg

SEQ ID NO: 1853559 - DNA, 17 bp, Homo sapiens
catgagcatcaggccag

SEQ ID NO: 1853560 - DNA, 21 bp, Homo sapiens
catgagcatcaggccaggccc

SEQ ID NO: 1853561 - DNA, 23 bp, Homo sapiens
catgagtcccctgtttgtttctg

SEQ ID NO: 1853562 - DNA, 22 bp, Homo sapiens
catgattaaccacttcagctga

SEQ ID NO: 1853563 - DNA, 24 bp, Homo sapiens
catgattaaccacttcagctgact

SEQ ID NO: 1853564 - DNA, 15 bp, Homo sapiens
catgcaaaggctggg

SEQ ID NO: 1853565 - DNA, 16 bp, Homo sapiens
catgcaaaggctggga

SEQ ID NO: 1853566 - DNA, 17 bp, Homo sapiens
catgcagctgctcccca

SEQ ID NO: 1853567 - DNA, 18 bp, Homo sapiens
catgcagctgctccccag

SEQ ID NO: 1853568 - DNA, 23 bp, Homo sapiens
catgcagctgctccccaggccac

SEQ ID NO: 1853569 - DNA, 17 bp, Homo sapiens
catgcatggaaattccc

SEQ ID NO: 1853570 - DNA, 18 bp, Homo sapiens
catgccaagcactgtgct

SEQ ID NO: 1853571 - DNA, 14 bp, Homo sapiens
catgcccagctctc

SEQ ID NO: 1853572 - DNA, 15 bp, Homo sapiens
catgcccagctctct

SEQ ID NO: 1853573 - DNA, 17 bp, Homo sapiens
catgcccagctctctga

SEQ ID NO: 1853574 - DNA, 23 bp, Homo sapiens
catgcctggatggggctgcaccg

SEQ ID NO: 1853575 - DNA, 16 bp, Homo sapiens
catgcggagaacaaat

SEQ ID NO: 1853576 - DNA, 14 bp, Homo sapiens
catgctcctggccc

SEQ ID NO: 1853577 - DNA, 15 bp, Homo sapiens
catgctgaagccaaa

SEQ ID NO: 1853578 - DNA, 17 bp, Homo sapiens
catgcttagcagtcccc

SEQ ID NO: 1853579 - DNA, 23 bp, Homo sapiens
catgcttagcagtccccttccct

SEQ ID NO: 1853580 - DNA, 14 bp, Homo sapiens
catgcttttccaaa

SEQ ID NO: 1853581 - DNA, 20 bp, Homo sapiens
catggagagctggagcctgg

SEQ ID NO: 1853582 - DNA, 15 bp, Homo sapiens
catgggtcgggagag

SEQ ID NO: 1853583 - DNA, 15 bp, Homo sapiens
catgtagaagctgca

SEQ ID NO: 1853584 - DNA, 18 bp, Homo sapiens
catgtatttgtttgcata

SEQ ID NO: 1853585 - DNA, 15 bp, Homo sapiens
catgtccaagaagcc

SEQ ID NO: 1853586 - DNA, 16 bp, Homo sapiens
catgtccaagaagccc

SEQ ID NO: 1853587 - DNA, 18 bp, Homo sapiens
catgtccaagaagcccag

SEQ ID NO: 1853588 - DNA, 19 bp, Homo sapiens
catgtccaagaagcccagg

SEQ ID NO: 1853589 - DNA, 21 bp, Homo sapiens
catgtcttttcttgcatgagg

SEQ ID NO: 1853590 - DNA, 23 bp, Homo sapiens
catgtcttttcttgcatgaggct

SEQ ID NO: 1853591 - DNA, 20 bp, Homo sapiens
catgtgattaccctctgggt

SEQ ID NO: 1853592 - DNA, 18 bp, Homo sapiens
catgtttttcttctccct

SEQ ID NO: 1853593 - DNA, 12 bp, Homo sapiens
cattaaagccat

SEQ ID NO: 1853594 - DNA, 13 bp, Homo sapiens
cattaatctcaaa

SEQ ID NO: 1853595 - DNA, 17 bp, Homo sapiens
cattaatctcaaagaga

SEQ ID NO: 1853596 - DNA, 19 bp, Homo sapiens
cattacagtttggaagtgt

SEQ ID NO: 1853597 - DNA, 13 bp, Homo sapiens
cattagagcaggc

SEQ ID NO: 1853598 - DNA, 14 bp, Homo sapiens
cattagagcaggcg

SEQ ID NO: 1853599 - DNA, 17 bp, Homo sapiens
cattagctttaattaag

SEQ ID NO: 1853600 - DNA, 16 bp, Homo sapiens
cattatgttaatattt

SEQ ID NO: 1853601 - DNA, 15 bp, Homo sapiens
cattatttatgtatt

SEQ ID NO: 1853602 - DNA, 14 bp, Homo sapiens
cattcatgcctggc

SEQ ID NO: 1853603 - DNA, 14 bp, Homo sapiens
cattccattctgga

SEQ ID NO: 1853604 - DNA, 13 bp, Homo sapiens
cattccccaggag

SEQ ID NO: 1853605 - DNA, 15 bp, Homo sapiens
cattccccaggaggc

SEQ ID NO: 1853606 - DNA, 20 bp, Homo sapiens
cattccccaggaggccagcc

SEQ ID NO: 1853607 - DNA, 22 bp, Homo sapiens
cattcctgatgcttcttcagag

SEQ ID NO: 1853608 - DNA, 18 bp, Homo sapiens
cattctaggtttgcaaga

SEQ ID NO: 1853609 - DNA, 16 bp, Homo sapiens
cattctccacctgcca

SEQ ID NO: 1853610 - DNA, 21 bp, Homo sapiens
cattctccacctgccagggac

SEQ ID NO: 1853611 - DNA, 13 bp, Homo sapiens
cattctttttgaa

SEQ ID NO: 1853612 - DNA, 16 bp, Homo sapiens
cattctttttgaaatg

SEQ ID NO: 1853613 - DNA, 13 bp, Homo sapiens
cattgacctgagg

SEQ ID NO: 1853614 - DNA, 14 bp, Homo sapiens
cattgacctgaggc

SEQ ID NO: 1853615 - DNA, 17 bp, Homo sapiens
cattgacctgaggccct

SEQ ID NO: 1853616 - DNA, 18 bp, Homo sapiens
cattgacctgaggccctt

SEQ ID NO: 1853617 - DNA, 22 bp, Homo sapiens
cattgacctgaggcccttctct

SEQ ID NO: 1853618 - DNA, 14 bp, Homo sapiens
cattgcaacctcca

SEQ ID NO: 1853619 - DNA, 13 bp, Homo sapiens
cattgccttttct

SEQ ID NO: 1853620 - DNA, 18 bp, Homo sapiens
cattggaaatttagcatt

SEQ ID NO: 1853621 - DNA, 20 bp, Homo sapiens
cattggaaatttagcattgt

SEQ ID NO: 1853622 - DNA, 21 bp, Homo sapiens
cattggaaatttagcattgta

SEQ ID NO: 1853623 - DNA, 15 bp, Homo sapiens
cattggttcttgtat

SEQ ID NO: 1853624 - DNA, 22 bp, Homo sapiens
cattggttcttgtattaagaat

SEQ ID NO: 1853625 - DNA, 24 bp, Homo sapiens
cattgtagtgctttgagagagaaa

SEQ ID NO: 1853626 - DNA, 15 bp, Homo sapiens
catttaaaaaaaatc

SEQ ID NO: 1853627 - DNA, 18 bp, Homo sapiens
catttatttttctcatga

SEQ ID NO: 1853628 - DNA, 22 bp, Homo sapiens
catttcaggagcagcctcagaa

SEQ ID NO: 1853629 - DNA, 21 bp, Homo sapiens
catttctaagcctttgagact

SEQ ID NO: 1853630 - DNA, 20 bp, Homo sapiens
catttggcctcttgtagtct

SEQ ID NO: 1853631 - DNA, 20 bp, Homo sapiens
catttggtgcacttttctgt

SEQ ID NO: 1853632 - DNA, 17 bp, Homo sapiens
catttgttcattaaacg

SEQ ID NO: 1853633 - DNA, 15 bp, Homo sapiens
cattttatagaatgt

SEQ ID NO: 1853634 - DNA, 22 bp, Homo sapiens
cattttgctagacagttaaact

SEQ ID NO: 1853635 - DNA, 17 bp, Homo sapiens
ccaaacctctgtgagca

SEQ ID NO: 1853636 - DNA, 14 bp, Homo sapiens
ccaaagagtgctaa

SEQ ID NO: 1853637 - DNA, 16 bp, Homo sapiens
ccaaagcagggtctgg

SEQ ID NO: 1853638 - DNA, 15 bp, Homo sapiens
cagaccctgccctgt

SEQ ID NO: 1853639 - DNA, 16 bp, Homo sapiens
cagaccctgccctgtg

SEQ ID NO: 1853640 - DNA, 17 bp, Homo sapiens
cagacctcatgcccagc

SEQ ID NO: 1853641 - DNA, 17 bp, Homo sapiens
cagagaaagaggaagct

SEQ ID NO: 1853642 - DNA, 14 bp, Homo sapiens
cagagaccatccct

SEQ ID NO: 1853643 - DNA, 21 bp, Homo sapiens
cagagaccatccctgaaggcc

SEQ ID NO: 1853644 - DNA, 14 bp, Homo sapiens
cagagactcctgca

SEQ ID NO: 1853645 - DNA, 15 bp, Homo sapiens
cagagactcctgcag

SEQ ID NO: 1853646 - DNA, 19 bp, Homo sapiens
cagagactcctgcaggcag

SEQ ID NO: 1853647 - DNA, 22 bp, Homo sapiens
cagagactcctgcaggcagcca

SEQ ID NO: 1853648 - DNA, 15 bp, Homo sapiens
cagagacttgggaca

SEQ ID NO: 1853649 - DNA, 19 bp, Homo sapiens
cagagagcctggtgctgct

SEQ ID NO: 1853650 - DNA, 13 bp, Homo sapiens
cagagagggtggg

SEQ ID NO: 1853651 - DNA, 23 bp, Homo sapiens
cagagaggtttgcagtcccaagc

SEQ ID NO: 1853652 - DNA, 14 bp, Homo sapiens
cagagcaagtgaga

SEQ ID NO: 1853653 - DNA, 19 bp, Homo sapiens
cagagcaccttagacagtc

SEQ ID NO: 1853654 - DNA, 12 bp, Homo sapiens
cagagcagagac

SEQ ID NO: 1853655 - DNA, 14 bp, Homo sapiens
cagagcagagacca

SEQ ID NO: 1853656 - DNA, 16 bp, Homo sapiens
cagagcccacgccccc

SEQ ID NO: 1853657 - DNA, 17 bp, Homo sapiens
cagagcccacgccccca

SEQ ID NO: 1853658 - DNA, 19 bp, Homo sapiens
cagagcccacgcccccact

SEQ ID NO: 1853659 - DNA, 22 bp, Homo sapiens
cagagcgtgagctgagcaggcc

SEQ ID NO: 1853660 - DNA, 19 bp, Homo sapiens
cagagctgacacaggatga

SEQ ID NO: 1853661 - DNA, 17 bp, Homo sapiens
cagaggagtacaggtga

SEQ ID NO: 1853662 - DNA, 21 bp, Homo sapiens
cagaggagtacaggtgaagca

SEQ ID NO: 1853663 - DNA, 15 bp, Homo sapiens
cagagggcctgcaag

SEQ ID NO: 1853664 - DNA, 19 bp, Homo sapiens
cagagggcctgcaagggag

SEQ ID NO: 1853665 - DNA, 14 bp, Homo sapiens
cagagggggtggcc

SEQ ID NO: 1853666 - DNA, 16 bp, Homo sapiens
cagagggggtggcctc

SEQ ID NO: 1853667 - DNA, 17 bp, Homo sapiens
cagagggggtggcctcc

SEQ ID NO: 1853668 - DNA, 19 bp, Homo sapiens
cagagggggtggcctccca

SEQ ID NO: 1853669 - DNA, 20 bp, Homo sapiens
cagagggggtggcctcccaa

SEQ ID NO: 1853670 - DNA, 20 bp, Homo sapiens
cagaggtggatgttatgaac

SEQ ID NO: 1853671 - DNA, 18 bp, Homo sapiens
cagaggtttgcttcctca

SEQ ID NO: 1853672 - DNA, 14 bp, Homo sapiens
cagataactgttat

SEQ ID NO: 1853673 - DNA, 16 bp, Homo sapiens
cagataactgttattt

SEQ ID NO: 1853674 - DNA, 19 bp, Homo sapiens
cagatacttggggggctga

SEQ ID NO: 1853675 - DNA, 19 bp, Homo sapiens
cagatatattaagtgactg

SEQ ID NO: 1853676 - DNA, 21 bp, Homo sapiens
cagattccccactcagccttt

SEQ ID NO: 1853677 - DNA, 19 bp, Homo sapiens
cagattctttcctgaggct

SEQ ID NO: 1853678 - DNA, 17 bp, Homo sapiens
cagcaccacactgggtg

SEQ ID NO: 1853679 - DNA, 16 bp, Homo sapiens
cagcacttacaatttt

SEQ ID NO: 1853680 - DNA, 18 bp, Homo sapiens
cagcagaacctgcacaca

SEQ ID NO: 1853681 - DNA, 19 bp, Homo sapiens
cagcagaacctgcacacag

SEQ ID NO: 1853682 - DNA, 24 bp, Homo sapiens
cagcagaacctgcacacaggacag

SEQ ID NO: 1853683 - DNA, 18 bp, Homo sapiens
cagcagagacttgggaca

SEQ ID NO: 1853684 - DNA, 19 bp, Homo sapiens
cagcagagacttgggacat

SEQ ID NO: 1853685 - DNA, 21 bp, Homo sapiens
cagcagagacttgggacattg

SEQ ID NO: 1853686 - DNA, 23 bp, Homo sapiens
cagcagagaggtttgcagtccca

SEQ ID NO: 1853687 - DNA, 19 bp, Homo sapiens
cagcagcctggaccctgtg

SEQ ID NO: 1853688 - DNA, 18 bp, Homo sapiens
cagcagggagggcttctg

SEQ ID NO: 1853689 - DNA, 19 bp, Homo sapiens
cagcatattcaggaagctc

SEQ ID NO: 1853690 - DNA, 17 bp, Homo sapiens
cagcatttgccaagtct

SEQ ID NO: 1853691 - DNA, 12 bp, Homo sapiens
cagccagggctg

SEQ ID NO: 1853692 - DNA, 15 bp, Homo sapiens
cagccagggctgcta

SEQ ID NO: 1853693 - DNA, 15 bp, Homo sapiens
cagcccacccctcaa

SEQ ID NO: 1853694 - DNA, 22 bp, Homo sapiens
cagccccatcctctgtacagag

SEQ ID NO: 1853695 - DNA, 17 bp, Homo sapiens
cagccccgccccgttgt

SEQ ID NO: 1853696 - DNA, 19 bp, Homo sapiens
cagcccctgatcctgtgaa

SEQ ID NO: 1853697 - DNA, 14 bp, Homo sapiens
cagcccctggatgc

SEQ ID NO: 1853698 - DNA, 17 bp, Homo sapiens
cagccccttctgaccca

SEQ ID NO: 1853699 - DNA, 19 bp, Homo sapiens
cagccccttctgacccatg

SEQ ID NO: 1853700 - DNA, 24 bp, Homo sapiens
cagccccttctgacccatgctgcc

SEQ ID NO: 1853701 - DNA, 13 bp, Homo sapiens
cagcccgggctct

SEQ ID NO: 1853702 - DNA, 15 bp, Homo sapiens
cagcccgggctctgc

SEQ ID NO: 1853703 - DNA, 16 bp, Homo sapiens
cagcccgggctctgcc

SEQ ID NO: 1853704 - DNA, 21 bp, Homo sapiens
cagcccgggctctgcctccca

SEQ ID NO: 1853705 - DNA, 22 bp, Homo sapiens
cagcccgggctctgcctcccat

SEQ ID NO: 1853706 - DNA, 23 bp, Homo sapiens
cagcctccccctgtcccctctat

SEQ ID NO: 1853707 - DNA, 17 bp, Homo sapiens
cagcctctgaaaaccaa

SEQ ID NO: 1853708 - DNA, 16 bp, Homo sapiens
cagcctgctccagctg

SEQ ID NO: 1853709 - DNA, 19 bp, Homo sapiens
cagcctgctccagctgttc

SEQ ID NO: 1853710 - DNA, 16 bp, Homo sapiens
cagcctggagatgaaa

SEQ ID NO: 1853711 - DNA, 12 bp, Homo sapiens
cagcctgggaaa

SEQ ID NO: 1853712 - DNA, 20 bp, Homo sapiens
cagcctgggaaagcccctgc

SEQ ID NO: 1853713 - DNA, 16 bp, Homo sapiens
cagcctgggcaatgtg

SEQ ID NO: 1853714 - DNA, 20 bp, Homo sapiens
cagccttgaccattctccac

SEQ ID NO: 1853715 - DNA, 21 bp, Homo sapiens
cagccttgaccattctccacc

SEQ ID NO: 1853716 - DNA, 21 bp, Homo sapiens
cagccttgcaaatagccagtg

SEQ ID NO: 1853717 - DNA, 13 bp, Homo sapiens
cagcgagcctgct

SEQ ID NO: 1853718 - DNA, 17 bp, Homo sapiens
cagctaacaattgtgaa

SEQ ID NO: 1853719 - DNA, 15 bp, Homo sapiens
cagctaacacacagc

SEQ ID NO: 1853720 - DNA, 17 bp, Homo sapiens
cagctaacacacagctc

SEQ ID NO: 1853721 - DNA, 18 bp, Homo sapiens
cagctaacacacagctcc

SEQ ID NO: 1853722 - DNA, 13 bp, Homo sapiens
cagctcacctctc

SEQ ID NO: 1853723 - DNA, 12 bp, Homo sapiens
cagctcagcact

SEQ ID NO: 1853724 - DNA, 15 bp, Homo sapiens
cagctccccagagtc

SEQ ID NO: 1853725 - DNA, 19 bp, Homo sapiens
cagctcctcatccagggct

SEQ ID NO: 1853726 - DNA, 16 bp, Homo sapiens
cagctctctgacgctt

SEQ ID NO: 1853727 - DNA, 18 bp, Homo sapiens
cagctctctgacgcttgt

SEQ ID NO: 1853728 - DNA, 16 bp, Homo sapiens
cagctctgcaagaatt

SEQ ID NO: 1853729 - DNA, 16 bp, Homo sapiens
cagctctggtccatag

SEQ ID NO: 1853730 - DNA, 18 bp, Homo sapiens
cagctctggtccatagag

SEQ ID NO: 1853731 - DNA, 23 bp, Homo sapiens
cagctctggtccatagagagcaa

SEQ ID NO: 1853732 - DNA, 19 bp, Homo sapiens
cagctgagggtgagtgggt

SEQ ID NO: 1853733 - DNA, 15 bp, Homo sapiens
cagctgatacaaatt

SEQ ID NO: 1853734 - DNA, 23 bp, Homo sapiens
cagctgatacaaattgcagactg

SEQ ID NO: 1853735 - DNA, 12 bp, Homo sapiens
cagctgcctggg

SEQ ID NO: 1853736 - DNA, 13 bp, Homo sapiens
cagctgcctggga

SEQ ID NO: 1853737 - DNA, 13 bp, Homo sapiens
cagctgctcccca

SEQ ID NO: 1853738 - DNA, 18 bp, Homo sapiens
cagctgctccccaggcca

SEQ ID NO: 1853739 - DNA, 14 bp, Homo sapiens
cagctgctggagac

SEQ ID NO: 1853740 - DNA, 16 bp, Homo sapiens
cagctgggtggcactg

SEQ ID NO: 1853741 - DNA, 17 bp, Homo sapiens
cagctgggtggcactgc

SEQ ID NO: 1853742 - DNA, 20 bp, Homo sapiens
cagctgggtggcactgccat

SEQ ID NO: 1853743 - DNA, 19 bp, Homo sapiens
actctttggtcgttttttt

SEQ ID NO: 1853744 - DNA, 15 bp, Homo sapiens
actctttttttgagt

SEQ ID NO: 1853745 - DNA, 23 bp, Homo sapiens
actctttttttgagtgacagctt

SEQ ID NO: 1853746 - DNA, 13 bp, Homo sapiens
actgcagagggct

SEQ ID NO: 1853747 - DNA, 17 bp, Homo sapiens
actgcagccactgattc

SEQ ID NO: 1853748 - DNA, 20 bp, Homo sapiens
actgcagccactgattctct

SEQ ID NO: 1853749 - DNA, 19 bp, Homo sapiens
actgcaggcatcacagcta

SEQ ID NO: 1853750 - DNA, 22 bp, Homo sapiens
actgcccggcagggtcctagaa

SEQ ID NO: 1853751 - DNA, 20 bp, Homo sapiens
actgcctgatggacctgtca

SEQ ID NO: 1853752 - DNA, 15 bp, Homo sapiens
actgcctgctcccat

SEQ ID NO: 1853753 - DNA, 12 bp, Homo sapiens
actgctctgatg

SEQ ID NO: 1853754 - DNA, 17 bp, Homo sapiens
actgcttccagtgaggc

SEQ ID NO: 1853755 - DNA, 17 bp, Homo sapiens
actggatgcagaaacag

SEQ ID NO: 1853756 - DNA, 18 bp, Homo sapiens
actggatgcagaaacagt

SEQ ID NO: 1853757 - DNA, 14 bp, Homo sapiens
actggcctctgctg

SEQ ID NO: 1853758 - DNA, 23 bp, Homo sapiens
actggcctctgctgatcctccca

SEQ ID NO: 1853759 - DNA, 16 bp, Homo sapiens
actgggctgaacactc

SEQ ID NO: 1853760 - DNA, 22 bp, Homo sapiens
actgtactgagacattacagtt

SEQ ID NO: 1853761 - DNA, 14 bp, Homo sapiens
actgtatctgtgta

SEQ ID NO: 1853762 - DNA, 15 bp, Homo sapiens
actgtcctattatat

SEQ ID NO: 1853763 - DNA, 18 bp, Homo sapiens
actgtcctattatattca

SEQ ID NO: 1853764 - DNA, 21 bp, Homo sapiens
actgtcttggctgtggggcta

SEQ ID NO: 1853765 - DNA, 16 bp, Homo sapiens
actgtgaagagaacca

SEQ ID NO: 1853766 - DNA, 19 bp, Homo sapiens
actgtgacaggcagcagag

SEQ ID NO: 1853767 - DNA, 14 bp, Homo sapiens
actgtgctcagggc

SEQ ID NO: 1853768 - DNA, 20 bp, Homo sapiens
actgtgctgagtctgaaggc

SEQ ID NO: 1853769 - DNA, 15 bp, Homo sapiens
actgttatttataat

SEQ ID NO: 1853770 - DNA, 21 bp, Homo sapiens
actgttatttataatcacttt

SEQ ID NO: 1853771 - DNA, 15 bp, Homo sapiens
actgttcaagagcac

SEQ ID NO: 1853772 - DNA, 20 bp, Homo sapiens
actgttctctgccctccaag

SEQ ID NO: 1853773 - DNA, 21 bp, Homo sapiens
actgttctctgccctccaaga

SEQ ID NO: 1853774 - DNA, 19 bp, Homo sapiens
actgttcttagctcaatga

SEQ ID NO: 1853775 - DNA, 14 bp, Homo sapiens
actgtttagatgaa

SEQ ID NO: 1853776 - DNA, 23 bp, Homo sapiens
actgtttgaggtttttaagcctt

SEQ ID NO: 1853777 - DNA, 15 bp, Homo sapiens
acttaatagaaacat

SEQ ID NO: 1853778 - DNA, 13 bp, Homo sapiens
acttaatgaatga

SEQ ID NO: 1853779 - DNA, 13 bp, Homo sapiens
acttacaattttc

SEQ ID NO: 1853780 - DNA, 15 bp, Homo sapiens
acttaggtgtggggg

SEQ ID NO: 1853781 - DNA, 16 bp, Homo sapiens
acttcagctgactttt

SEQ ID NO: 1853782 - DNA, 17 bp, Homo sapiens
acttcattaataataaa

SEQ ID NO: 1853783 - DNA, 14 bp, Homo sapiens
acttcgacactgtt

SEQ ID NO: 1853784 - DNA, 16 bp, Homo sapiens
acttcgacactgttct

SEQ ID NO: 1853785 - DNA, 17 bp, Homo sapiens
acttcgggaggtcgagg

SEQ ID NO: 1853786 - DNA, 21 bp, Homo sapiens
acttgagcgtgaatctgtatc

SEQ ID NO: 1853787 - DNA, 17 bp, Homo sapiens
acttgcaaaaagggtca

SEQ ID NO: 1853788 - DNA, 13 bp, Homo sapiens
acttgggacattg

SEQ ID NO: 1853789 - DNA, 14 bp, Homo sapiens
acttgggccactgt

SEQ ID NO: 1853790 - DNA, 15 bp, Homo sapiens
acttgggccactgtg

SEQ ID NO: 1853791 - DNA, 16 bp, Homo sapiens
acttgtaaatataaag

SEQ ID NO: 1853792 - DNA, 14 bp, Homo sapiens
acttgtctttggac

SEQ ID NO: 1853793 - DNA, 20 bp, Homo sapiens
acttgtctttggaccctgag

SEQ ID NO: 1853794 - DNA, 21 bp, Homo sapiens
acttgtctttggaccctgagg

SEQ ID NO: 1853795 - DNA, 18 bp, Homo sapiens
actttaacataagctatt

SEQ ID NO: 1853796 - DNA, 16 bp, Homo sapiens
actttactaagtaatc

SEQ ID NO: 1853797 - DNA, 16 bp, Homo sapiens
actttgaaaagttgga

SEQ ID NO: 1853798 - DNA, 14 bp, Homo sapiens
atgagcctggcaag

SEQ ID NO: 1853799 - DNA, 22 bp, Homo sapiens
atgataatgctaattttattat

SEQ ID NO: 1853800 - DNA, 17 bp, Homo sapiens
atgatcggcaggacacc

SEQ ID NO: 1853801 - DNA, 15 bp, Homo sapiens
atgatgatcctaggc

SEQ ID NO: 1853802 - DNA, 14 bp, Homo sapiens
atgatgtgcctggg

SEQ ID NO: 1853803 - DNA, 20 bp, Homo sapiens
atgattaaccacttcagctg

SEQ ID NO: 1853804 - DNA, 13 bp, Homo sapiens
atgcaaactcttt

SEQ ID NO: 1853805 - DNA, 16 bp, Homo sapiens
atgcaaactctttggt

SEQ ID NO: 1853806 - DNA, 13 bp, Homo sapiens
atgcaaaggctgg

SEQ ID NO: 1853807 - DNA, 18 bp, Homo sapiens
atgcaatgtatagtgtct

SEQ ID NO: 1853808 - DNA, 20 bp, Homo sapiens
atgcaccctcatacacagaa

SEQ ID NO: 1853809 - DNA, 13 bp, Homo sapiens
atgcactttgctt

SEQ ID NO: 1853810 - DNA, 15 bp, Homo sapiens
atgcactttgcttta

SEQ ID NO: 1853811 - DNA, 16 bp, Homo sapiens
atgcactttgctttaa

SEQ ID NO: 1853812 - DNA, 18 bp, Homo sapiens
atgcactttgctttaata

SEQ ID NO: 1853813 - DNA, 19 bp, Homo sapiens
atgcactttgctttaatat

SEQ ID NO: 1853814 - DNA, 20 bp, Homo sapiens
atgcactttgctttaatata

SEQ ID NO: 1853815 - DNA, 20 bp, Homo sapiens
atgcactttgttctggctct

SEQ ID NO: 1853816 - DNA, 21 bp, Homo sapiens
atgcactttgttctggctctt

SEQ ID NO: 1853817 - DNA, 20 bp, Homo sapiens
atgcagacctcatgcccagc

SEQ ID NO: 1853818 - DNA, 23 bp, Homo sapiens
atgcagacctcatgcccagctct

SEQ ID NO: 1853819 - DNA, 15 bp, Homo sapiens
atgcagcctcacagt

SEQ ID NO: 1853820 - DNA, 22 bp, Homo sapiens
atgcaggaggtggagaaaattg

SEQ ID NO: 1853821 - DNA, 23 bp, Homo sapiens
atgcaggttcaggtcccctttca

SEQ ID NO: 1853822 - DNA, 13 bp, Homo sapiens
atgccaaattaaa

SEQ ID NO: 1853823 - DNA, 15 bp, Homo sapiens
atgccaaattaaaaa

SEQ ID NO: 1853824 - DNA, 17 bp, Homo sapiens
atgccaagcactgtgct

SEQ ID NO: 1853825 - DNA, 18 bp, Homo sapiens
atgccaagcactgtgctc

SEQ ID NO: 1853826 - DNA, 19 bp, Homo sapiens
atgccaagcactgtgctca

SEQ ID NO: 1853827 - DNA, 12 bp, Homo sapiens
atgccatcctca

SEQ ID NO: 1853828 - DNA, 13 bp, Homo sapiens
atgcccagcccct

SEQ ID NO: 1853829 - DNA, 15 bp, Homo sapiens
atgcccagccccttc

SEQ ID NO: 1853830 - DNA, 12 bp, Homo sapiens
atgcccagctct

SEQ ID NO: 1853831 - DNA, 15 bp, Homo sapiens
atgcccagctctctg

SEQ ID NO: 1853832 - DNA, 21 bp, Homo sapiens
atgcctgattgccaagctcag

SEQ ID NO: 1853833 - DNA, 21 bp, Homo sapiens
atgcctggatggggctgcacc

SEQ ID NO: 1853834 - DNA, 23 bp, Homo sapiens
atgcctggatggggctgcaccgg

SEQ ID NO: 1853835 - DNA, 15 bp, Homo sapiens
atgctccaaatgctg

SEQ ID NO: 1853836 - DNA, 19 bp, Homo sapiens
atgctgaagccaaagccaa

SEQ ID NO: 1853837 - DNA, 16 bp, Homo sapiens
atgctgatgtcctcac

SEQ ID NO: 1853838 - DNA, 11 bp, Homo sapiens
atgctgccctg

SEQ ID NO: 1853839 - DNA, 14 bp, Homo sapiens
atgctgccctgtga

SEQ ID NO: 1853840 - DNA, 13 bp, Homo sapiens
atgcttctcactg

SEQ ID NO: 1853841 - DNA, 20 bp, Homo sapiens
atgcttctcactgccatgcc

SEQ ID NO: 1853842 - DNA, 14 bp, Homo sapiens
atgcttcttcagag

SEQ ID NO: 1853843 - DNA, 20 bp, Homo sapiens
atgcttcttcagagactcct

SEQ ID NO: 1853844 - DNA, 20 bp, Homo sapiens
atggaaaatacctaattgtg

SEQ ID NO: 1853845 - DNA, 20 bp, Homo sapiens
atggaaattcccttcatctg

SEQ ID NO: 1853846 - DNA, 14 bp, Homo sapiens
atggacctgtcacg

SEQ ID NO: 1853847 - DNA, 13 bp, Homo sapiens
atggacggtgctc

SEQ ID NO: 1853848 - DNA, 17 bp, Homo sapiens
atggacggtgctccagg

SEQ ID NO: 1853849 - DNA, 22 bp, Homo sapiens
atggacggtgctccaggcaggc

SEQ ID NO: 1853850 - DNA, 13 bp, Homo sapiens
atggagacaccac

SEQ ID NO: 1853851 - DNA, 22 bp, Homo sapiens
atggagctcagagagggcaggc

SEQ ID NO: 1853852 - DNA, 13 bp, Homo sapiens
atggagctggccg

SEQ ID NO: 1853853 - DNA, 15 bp, Homo sapiens
atggatttccagcca

SEQ ID NO: 1853854 - DNA, 18 bp, Homo sapiens
atggatttccagccaaag

SEQ ID NO: 1853855 - DNA, 16 bp, Homo sapiens
atggcaggatggcctg

SEQ ID NO: 1853856 - DNA, 15 bp, Homo sapiens
atggcatcacctcca

SEQ ID NO: 1853857 - DNA, 20 bp, Homo sapiens
atggcatttggtctcaggca

SEQ ID NO: 1853858 - DNA, 21 bp, Homo sapiens
atggcatttggtctcaggcag

SEQ ID NO: 1853859 - DNA, 22 bp, Homo sapiens
atggcatttggtctcaggcagc

SEQ ID NO: 1853860 - DNA, 17 bp, Homo sapiens
atggccatgcaggaggt

SEQ ID NO: 1853861 - DNA, 20 bp, Homo sapiens
atggccatgcaggaggtgga

SEQ ID NO: 1853862 - DNA, 13 bp, Homo sapiens
atggcgtctgctc

SEQ ID NO: 1853863 - DNA, 16 bp, Homo sapiens
atgggcttagagcagt

SEQ ID NO: 1853864 - DNA, 24 bp, Homo sapiens
atggggctgcaccggctggcctgg

SEQ ID NO: 1853865 - DNA, 16 bp, Homo sapiens
atgggggaaagcacag

SEQ ID NO: 1853866 - DNA, 23 bp, Homo sapiens
atgggtgcttggaggaaggaaac

SEQ ID NO: 1853867 - DNA, 22 bp, Homo sapiens
atggtagttttacagtgtttct

SEQ ID NO: 1853868 - DNA, 18 bp, Homo sapiens
atgtaaatagctaagata

SEQ ID NO: 1853869 - DNA, 15 bp, Homo sapiens
atgtaacaacaatta

SEQ ID NO: 1853870 - DNA, 16 bp, Homo sapiens
atgtaacaacaattat

SEQ ID NO: 1853871 - DNA, 14 bp, Homo sapiens
atgtatagtgtcta

SEQ ID NO: 1853872 - DNA, 14 bp, Homo sapiens
atgtattgataaga

SEQ ID NO: 1853873 - DNA, 16 bp, Homo sapiens
atgtattttatgttat

SEQ ID NO: 1853874 - DNA, 13 bp, Homo sapiens
atgtcacagtcca

SEQ ID NO: 1853875 - DNA, 19 bp, Homo sapiens
atgtccaagaagcccagga

SEQ ID NO: 1853876 - DNA, 14 bp, Homo sapiens
atgtcttttcttgc

SEQ ID NO: 1853877 - DNA, 23 bp, Homo sapiens
atgtgagtacccaggatgatttc

SEQ ID NO: 1853878 - DNA, 19 bp, Homo sapiens
atgtgcacatctgttttgt

SEQ ID NO: 1853879 - DNA, 14 bp, Homo sapiens
atgtgcatttaatt

SEQ ID NO: 1853880 - DNA, 14 bp, Homo sapiens
atgtgcctgggtgg

SEQ ID NO: 1853881 - DNA, 15 bp, Homo sapiens
atgttatatataaat

SEQ ID NO: 1853882 - DNA, 22 bp, Homo sapiens
atgttatatataaatatattat

SEQ ID NO: 1853883 - DNA, 18 bp, Homo sapiens
atgttgagacctcagctt

SEQ ID NO: 1853884 - DNA, 19 bp, Homo sapiens
atgtttagactttaacata

SEQ ID NO: 1853885 - DNA, 12 bp, Homo sapiens
atgttttcaaat

SEQ ID NO: 1853886 - DNA, 18 bp, Homo sapiens
atgttttcaaatgttctc

SEQ ID NO: 1853887 - DNA, 16 bp, Homo sapiens
atgttttccagctcct

SEQ ID NO: 1853888 - DNA, 14 bp, Homo sapiens
atgtttttctaaag

SEQ ID NO: 1853889 - DNA, 14 bp, Homo sapiens
attaaaaaagataa

SEQ ID NO: 1853890 - DNA, 14 bp, Homo sapiens
attaaacgattttt

SEQ ID NO: 1853891 - DNA, 18 bp, Homo sapiens
attaaagaaaaaaatgta

SEQ ID NO: 1853892 - DNA, 19 bp, Homo sapiens
attaaagaaaaaaatgtat

SEQ ID NO: 1853893 - DNA, 14 bp, Homo sapiens
attaaaggaataaa

SEQ ID NO: 1853894 - DNA, 19 bp, Homo sapiens
attaaatgcccagcccctt

SEQ ID NO: 1853895 - DNA, 19 bp, Homo sapiens
attaagctctcatagctca

SEQ ID NO: 1853896 - DNA, 21 bp, Homo sapiens
attacaggcgtgagccaccaa

SEQ ID NO: 1853897 - DNA, 12 bp, Homo sapiens
attaccttctcc

SEQ ID NO: 1853898 - DNA, 15 bp, Homo sapiens
attacttgtaaatat

SEQ ID NO: 1853899 - DNA, 17 bp, Homo sapiens
attacttgtaaatataa

SEQ ID NO: 1853900 - DNA, 20 bp, Homo sapiens
attacttgtaaatataaaga

SEQ ID NO: 1853901 - DNA, 13 bp, Homo sapiens
attagagaagaga

SEQ ID NO: 1853902 - DNA, 16 bp, Homo sapiens
attatattcattcttt

SEQ ID NO: 1853903 - DNA, 20 bp, Homo sapiens
attatgcttccacaggcaaa

SEQ ID NO: 1853904 - DNA, 13 bp, Homo sapiens
attattacttgta

SEQ ID NO: 1853905 - DNA, 14 bp, Homo sapiens
attattacttgtaa

SEQ ID NO: 1853906 - DNA, 20 bp, Homo sapiens
attattacttgtaaatataa

SEQ ID NO: 1853907 - DNA, 12 bp, Homo sapiens
attatttatgta

SEQ ID NO: 1853908 - DNA, 18 bp, Homo sapiens
attatttgaagatttaat

SEQ ID NO: 1853909 - DNA, 23 bp, Homo sapiens
attattttcatccttgtcttatt

SEQ ID NO: 1853910 - DNA, 16 bp, Homo sapiens
attcacccccaaacag

SEQ ID NO: 1853911 - DNA, 12 bp, Homo sapiens
attcagacagct

SEQ ID NO: 1853912 - DNA, 15 bp, Homo sapiens
attcagacagctgcc

SEQ ID NO: 1853913 - DNA, 14 bp, Homo sapiens
attcagctctgcaa

SEQ ID NO: 1853914 - DNA, 19 bp, Homo sapiens
attcaggaagctcagggcc

SEQ ID NO: 1853915 - DNA, 20 bp, Homo sapiens
attcaggaagctcagggcct

SEQ ID NO: 1853916 - DNA, 21 bp, Homo sapiens
attcaggaagctcagggcctg

SEQ ID NO: 1853917 - DNA, 12 bp, Homo sapiens
attcattccatt

SEQ ID NO: 1853918 - DNA, 17 bp, Homo sapiens
attcattccattctgga

SEQ ID NO: 1853919 - DNA, 15 bp, Homo sapiens
attcattctttttga

SEQ ID NO: 1853920 - DNA, 22 bp, Homo sapiens
attccccaccctgaaagccctg

SEQ ID NO: 1853921 - DNA, 17 bp, Homo sapiens
caactcaccccagcccc

SEQ ID NO: 1853922 - DNA, 14 bp, Homo sapiens
caacttcttcagag

SEQ ID NO: 1853923 - DNA, 23 bp, Homo sapiens
caacttgtattaaagacagaggc

SEQ ID NO: 1853924 - DNA, 17 bp, Homo sapiens
caagaaaaataaagaaa

SEQ ID NO: 1853925 - DNA, 18 bp, Homo sapiens
caagaaaaataaagaaaa

SEQ ID NO: 1853926 - DNA, 22 bp, Homo sapiens
caagaaatggcgtctgctctgg

SEQ ID NO: 1853927 - DNA, 14 bp, Homo sapiens
caagaagcaggcta

SEQ ID NO: 1853928 - DNA, 20 bp, Homo sapiens
caagaagcaggctacactga

SEQ ID NO: 1853929 - DNA, 22 bp, Homo sapiens
caagacccttgtggtcccaccc

SEQ ID NO: 1853930 - DNA, 13 bp, Homo sapiens
caagaccttctcc

SEQ ID NO: 1853931 - DNA, 17 bp, Homo sapiens
caagaccttctccttca

SEQ ID NO: 1853932 - DNA, 15 bp, Homo sapiens
caagacgctgtgctg

SEQ ID NO: 1853933 - DNA, 17 bp, Homo sapiens
caagacgctgtgctgcc

SEQ ID NO: 1853934 - DNA, 22 bp, Homo sapiens
caagacgctgtgctgccctgcc

SEQ ID NO: 1853935 - DNA, 22 bp, Homo sapiens
caagactggaaggtggggacag

SEQ ID NO: 1853936 - DNA, 19 bp, Homo sapiens
caagagaaggggaagcact

SEQ ID NO: 1853937 - DNA, 20 bp, Homo sapiens
caagagccatgtagaagctg

SEQ ID NO: 1853938 - DNA, 23 bp, Homo sapiens
caagcaagctcccaagggatggt

SEQ ID NO: 1853939 - DNA, 14 bp, Homo sapiens
caagcaggacatgg

SEQ ID NO: 1853940 - DNA, 16 bp, Homo sapiens
caagcagtagacaagc

SEQ ID NO: 1853941 - DNA, 13 bp, Homo sapiens
caagcggtgtctc

SEQ ID NO: 1853942 - DNA, 15 bp, Homo sapiens
caagcggtgtctctc

SEQ ID NO: 1853943 - DNA, 16 bp, Homo sapiens
caagcggtgtctctcc

SEQ ID NO: 1853944 - DNA, 16 bp, Homo sapiens
caagctatcctggctc

SEQ ID NO: 1853945 - DNA, 16 bp, Homo sapiens
caagctcaaagcgtgg

SEQ ID NO: 1853946 - DNA, 21 bp, Homo sapiens
caagctccaagctcccaggca

SEQ ID NO: 1853947 - DNA, 18 bp, Homo sapiens
caagctcccaagggatgg

SEQ ID NO: 1853948 - DNA, 14 bp, Homo sapiens
caagctcccaggca

SEQ ID NO: 1853949 - DNA, 15 bp, Homo sapiens
caagctcccaggcat

SEQ ID NO: 1853950 - DNA, 14 bp, Homo sapiens
caaggaaaccacag

SEQ ID NO: 1853951 - DNA, 22 bp, Homo sapiens
caaggaaaccacagctgctgga

SEQ ID NO: 1853952 - DNA, 15 bp, Homo sapiens
caaggaaaggcaaat

SEQ ID NO: 1853953 - DNA, 19 bp, Homo sapiens
caaggaagaagaaatcttt

SEQ ID NO: 1853954 - DNA, 18 bp, Homo sapiens
caaggacagcccctcctc

SEQ ID NO: 1853955 - DNA, 15 bp, Homo sapiens
caaggagaggaggca

SEQ ID NO: 1853956 - DNA, 16 bp, Homo sapiens
caaggagataagaaag

SEQ ID NO: 1853957 - DNA, 18 bp, Homo sapiens
caaggagtaagtacaaat

SEQ ID NO: 1853958 - DNA, 21 bp, Homo sapiens
caaggatgatctaggaagact

SEQ ID NO: 1853959 - DNA, 13 bp, Homo sapiens
caaggcactgcct

SEQ ID NO: 1853960 - DNA, 14 bp, Homo sapiens
caaggcactgcctg

SEQ ID NO: 1853961 - DNA, 16 bp, Homo sapiens
caaggcactgcctgat

SEQ ID NO: 1853962 - DNA, 18 bp, Homo sapiens
caaggcactgcctgatgg

SEQ ID NO: 1853963 - DNA, 17 bp, Homo sapiens
caaggctactacagaga

SEQ ID NO: 1853964 - DNA, 22 bp, Homo sapiens
caaggctgcagtgagccgagat

SEQ ID NO: 1853965 - DNA, 18 bp, Homo sapiens
caaggctgtgctccctgg

SEQ ID NO: 1853966 - DNA, 13 bp, Homo sapiens
caagggcctggcc

SEQ ID NO: 1853967 - DNA, 23 bp, Homo sapiens
caaggtgggaggattgcttgagc

SEQ ID NO: 1853968 - DNA, 22 bp, Homo sapiens
caagtatggtaggggagggcag

SEQ ID NO: 1853969 - DNA, 19 bp, Homo sapiens
caagtgaaaaaggaggaag

SEQ ID NO: 1853970 - DNA, 23 bp, Homo sapiens
caagtgaaaaaggaggaagagaa

SEQ ID NO: 1853971 - DNA, 14 bp, Homo sapiens
caagtgagaccctg

SEQ ID NO: 1853972 - DNA, 15 bp, Homo sapiens
caagtgagaccctgt

SEQ ID NO: 1853973 - DNA, 16 bp, Homo sapiens
caagttagttcaatct

SEQ ID NO: 1853974 - DNA, 13 bp, Homo sapiens
caagttgtttgag

SEQ ID NO: 1853975 - DNA, 21 bp, Homo sapiens
caagttgtttgagaaattaag

SEQ ID NO: 1853976 - DNA, 15 bp, Homo sapiens
caatacctggcctca

SEQ ID NO: 1853977 - DNA, 17 bp, Homo sapiens
caatatccaattttaaa

SEQ ID NO: 1853978 - DNA, 20 bp, Homo sapiens
caatatccaattttaaaatg

SEQ ID NO: 1853979 - DNA, 17 bp, Homo sapiens
caatatcccttacttta

SEQ ID NO: 1853980 - DNA, 15 bp, Homo sapiens
caatgataatgctaa

SEQ ID NO: 1853981 - DNA, 13 bp, Homo sapiens
caatgcactttgt

SEQ ID NO: 1853982 - DNA, 20 bp, Homo sapiens
caatgcactttgttctggct

SEQ ID NO: 1853983 - DNA, 20 bp, Homo sapiens
caatgccatcctcaaacact

SEQ ID NO: 1853984 - DNA, 13 bp, Homo sapiens
caatgctgatgtc

SEQ ID NO: 1853985 - DNA, 20 bp, Homo sapiens
caatgctgatgtcctcacca

SEQ ID NO: 1853986 - DNA, 23 bp, Homo sapiens
caatgtaatagaagcttaaaata

SEQ ID NO: 1853987 - DNA, 19 bp, Homo sapiens
caatgtgaaaagaaaaatg

SEQ ID NO: 1853988 - DNA, 16 bp, Homo sapiens
caatgtgtataaacaa

SEQ ID NO: 1853989 - DNA, 17 bp, Homo sapiens
caatgtgtataaacaag

SEQ ID NO: 1853990 - DNA, 18 bp, Homo sapiens
caatgtgtataaacaaga

SEQ ID NO: 1853991 - DNA, 22 bp, Homo sapiens
caatgtttagcagatttaagat

SEQ ID NO: 1853992 - DNA, 13 bp, Homo sapiens
caattaaggattt

SEQ ID NO: 1853993 - DNA, 22 bp, Homo sapiens
caattaaggattttatgcttta

SEQ ID NO: 1853994 - DNA, 21 bp, Homo sapiens
caattatttgaagatttaatt

SEQ ID NO: 1853995 - DNA, 21 bp, Homo sapiens
caattcctcatttgttcatta

SEQ ID NO: 1853996 - DNA, 21 bp, Homo sapiens
caattcttccctatctttgcc

SEQ ID NO: 1853997 - DNA, 18 bp, Homo sapiens
caattttaaaatgaaatg

SEQ ID NO: 1853998 - DNA, 20 bp, Homo sapiens
caattttaaaatgaaatgca

SEQ ID NO: 1853999 - DNA, 22 bp, Homo sapiens
caattttaaggcatatttaaca

SEQ ID NO: 1854000 - DNA, 17 bp, Homo sapiens
cacaagctccaagctcc

SEQ ID NO: 1854001 - DNA, 18 bp, Homo sapiens
cacaagctccaagctccc

SEQ ID NO: 1854002 - DNA, 19 bp, Homo sapiens
cacaagctccaagctccca

SEQ ID NO: 1854003 - DNA, 12 bp, Homo sapiens
cacacacttttg

SEQ ID NO: 1854004 - DNA, 22 bp, Homo sapiens
cacacggacactcaaaagctgg

SEQ ID NO: 1854005 - DNA, 14 bp, Homo sapiens
cacactccagctgg

SEQ ID NO: 1854006 - DNA, 13 bp, Homo sapiens
cacacttcaaact

SEQ ID NO: 1854007 - DNA, 16 bp, Homo sapiens
cacagaaaccaatttt

SEQ ID NO: 1854008 - DNA, 19 bp, Homo sapiens
cacagaccctgccctgtgg

SEQ ID NO: 1854009 - DNA, 20 bp, Homo sapiens
cacagaccctgccctgtggg

SEQ ID NO: 1854010 - DNA, 21 bp, Homo sapiens
cacagaccctgccctgtgggc

SEQ ID NO: 1854011 - DNA, 18 bp, Homo sapiens
cacagatgggtgcttgga

SEQ ID NO: 1854012 - DNA, 22 bp, Homo sapiens
cacagcgctggccgggaccccg

SEQ ID NO: 1854013 - DNA, 20 bp, Homo sapiens
cacagctaacaattgtgaag

SEQ ID NO: 1854014 - DNA, 14 bp, Homo sapiens
cacagctgctggag

SEQ ID NO: 1854015 - DNA, 20 bp, Homo sapiens
cacagctgctggagactcct

SEQ ID NO: 1854016 - DNA, 13 bp, Homo sapiens
cacaggacagcgg

SEQ ID NO: 1854017 - DNA, 15 bp, Homo sapiens
cacaggacagcggga

SEQ ID NO: 1854018 - DNA, 20 bp, Homo sapiens
ccttgagttgattcagctct

SEQ ID NO: 1854019 - DNA, 23 bp, Homo sapiens
ccttgagttgattcagctctgca

SEQ ID NO: 1854020 - DNA, 11 bp, Homo sapiens
ccttggaaggg

SEQ ID NO: 1854021 - DNA, 18 bp, Homo sapiens
ccttggacattttatgtc

SEQ ID NO: 1854022 - DNA, 14 bp, Homo sapiens
ccttggctggtgca

SEQ ID NO: 1854023 - DNA, 21 bp, Homo sapiens
ccttggttaggcattgtggga

SEQ ID NO: 1854024 - DNA, 21 bp, Homo sapiens
ccttgtcttattcccttcctg

SEQ ID NO: 1854025 - DNA, 16 bp, Homo sapiens
ccttgtggcctgggcc

SEQ ID NO: 1854026 - DNA, 16 bp, Homo sapiens
ccttgtggtcccaccc

SEQ ID NO: 1854027 - DNA, 19 bp, Homo sapiens
ccttgtggtcccaccccac

SEQ ID NO: 1854028 - DNA, 20 bp, Homo sapiens
ccttgtggtcccaccccaca

SEQ ID NO: 1854029 - DNA, 13 bp, Homo sapiens
ccttgtttaatgg

SEQ ID NO: 1854030 - DNA, 14 bp, Homo sapiens
cctttattctggca

SEQ ID NO: 1854031 - DNA, 12 bp, Homo sapiens
cctttcatattt

SEQ ID NO: 1854032 - DNA, 21 bp, Homo sapiens
cctttctcggggtcaggttct

SEQ ID NO: 1854033 - DNA, 17 bp, Homo sapiens
cctttgacgccatccca

SEQ ID NO: 1854034 - DNA, 22 bp, Homo sapiens
cctttgacgccatcccagcccc

SEQ ID NO: 1854035 - DNA, 19 bp, Homo sapiens
cctttggcaggtgcagccc

SEQ ID NO: 1854036 - DNA, 23 bp, Homo sapiens
cctttgtaaattgtcagatgctg

SEQ ID NO: 1854037 - DNA, 15 bp, Homo sapiens
cctttgtgaggaagc

SEQ ID NO: 1854038 - DNA, 16 bp, Homo sapiens
cctttgtgaggaagcc

SEQ ID NO: 1854039 - DNA, 22 bp, Homo sapiens
ccttttctagcccgaatacaaa

SEQ ID NO: 1854040 - DNA, 21 bp, Homo sapiens
cgaacatgtttttcttctccc

SEQ ID NO: 1854041 - DNA, 19 bp, Homo sapiens
cgacccttgccgtctacct

SEQ ID NO: 1854042 - DNA, 20 bp, Homo sapiens
cgacccttgccgtctacctg

SEQ ID NO: 1854043 - DNA, 20 bp, Homo sapiens
cgagcaaacccagaggtgga

SEQ ID NO: 1854044 - DNA, 21 bp, Homo sapiens
cgaggacatgaaactccacct

SEQ ID NO: 1854045 - DNA, 23 bp, Homo sapiens
cgcacttcgggaggtcgaggcag

SEQ ID NO: 1854046 - DNA, 13 bp, Homo sapiens
cgcagacaggacc

SEQ ID NO: 1854047 - DNA, 16 bp, Homo sapiens
cgcagacaggaccagg

SEQ ID NO: 1854048 - DNA, 19 bp, Homo sapiens
cgcagcatattcaggaagc

SEQ ID NO: 1854049 - DNA, 20 bp, Homo sapiens
cgcagcatattcaggaagct

SEQ ID NO: 1854050 - DNA, 13 bp, Homo sapiens
cgccaaggctggg

SEQ ID NO: 1854051 - DNA, 16 bp, Homo sapiens
cgccaaggctggggga

SEQ ID NO: 1854052 - DNA, 20 bp, Homo sapiens
cgccagattctttcctgagg

SEQ ID NO: 1854053 - DNA, 21 bp, Homo sapiens
cgccagattctttcctgaggc

SEQ ID NO: 1854054 - DNA, 15 bp, Homo sapiens
cgccagctgccgcac

SEQ ID NO: 1854055 - DNA, 20 bp, Homo sapiens
cgccagctgccgcaccagcc

SEQ ID NO: 1854056 - DNA, 23 bp, Homo sapiens
cgccagctgccgcaccagcccga

SEQ ID NO: 1854057 - DNA, 22 bp, Homo sapiens
cgccaggggaaaatcagcctgc

SEQ ID NO: 1854058 - DNA, 23 bp, Homo sapiens
cgccaggggaaaatcagcctgct

SEQ ID NO: 1854059 - DNA, 17 bp, Homo sapiens
cgccatcccagccccaa

SEQ ID NO: 1854060 - DNA, 15 bp, Homo sapiens
cgccatgctcctggc

SEQ ID NO: 1854061 - DNA, 19 bp, Homo sapiens
cgcggtggctcacgcctgt

SEQ ID NO: 1854062 - DNA, 16 bp, Homo sapiens
cgctgattctcagggt

SEQ ID NO: 1854063 - DNA, 17 bp, Homo sapiens
cgctggggccagttggt

SEQ ID NO: 1854064 - DNA, 17 bp, Homo sapiens
cgctgtgctgccctgcc

SEQ ID NO: 1854065 - DNA, 19 bp, Homo sapiens
cgctgtgctgccctgccca

SEQ ID NO: 1854066 - DNA, 14 bp, Homo sapiens
cgcttctgcctgca

SEQ ID NO: 1854067 - DNA, 22 bp, Homo sapiens
cggacttagaaaaccagctcag

SEQ ID NO: 1854068 - DNA, 16 bp, Homo sapiens
cggatctttggacaga

SEQ ID NO: 1854069 - DNA, 11 bp, Homo sapiens
cggcaggacac

SEQ ID NO: 1854070 - DNA, 15 bp, Homo sapiens
cggccacctgcggtg

SEQ ID NO: 1854071 - DNA, 18 bp, Homo sapiens
cggccacggccacagtca

SEQ ID NO: 1854072 - DNA, 16 bp, Homo sapiens
cggctctgtccccagc

SEQ ID NO: 1854073 - DNA, 23 bp, Homo sapiens
cggctggcctggcccctcagggt

SEQ ID NO: 1854074 - DNA, 18 bp, Homo sapiens
cggctggggtcccagcag

SEQ ID NO: 1854075 - DNA, 13 bp, Homo sapiens
cggctgtgtgtgc

SEQ ID NO: 1854076 - DNA, 16 bp, Homo sapiens
cgggaagggggctggg

SEQ ID NO: 1854077 - DNA, 20 bp, Homo sapiens
cgggaagggggctgggacat

SEQ ID NO: 1854078 - DNA, 19 bp, Homo sapiens
cgggagaggggacgcaggc

SEQ ID NO: 1854079 - DNA, 22 bp, Homo sapiens
cgggcctgtccacaggcttctg

SEQ ID NO: 1854080 - DNA, 11 bp, Homo sapiens
cgggctcagca

SEQ ID NO: 1854081 - DNA, 19 bp, Homo sapiens
cgggctcagcaaaagatgc

SEQ ID NO: 1854082 - DNA, 14 bp, Homo sapiens
cgggctctgcctcc

SEQ ID NO: 1854083 - DNA, 17 bp, Homo sapiens
cgggctctgcctcccat

SEQ ID NO: 1854084 - DNA, 19 bp, Homo sapiens
cggggcagccccctcacag

SEQ ID NO: 1854085 - DNA, 13 bp, Homo sapiens
cgggggcagctga

SEQ ID NO: 1854086 - DNA, 13 bp, Homo sapiens
cggtaagtgttct

SEQ ID NO: 1854087 - DNA, 15 bp, Homo sapiens
cggtaagtgttctca

SEQ ID NO: 1854088 - DNA, 20 bp, Homo sapiens
cggtaagtgttctcatgaag

SEQ ID NO: 1854089 - DNA, 20 bp, Homo sapiens
cggtgctatctcccccagcc

SEQ ID NO: 1854090 - DNA, 21 bp, Homo sapiens
cggtgctatctcccccagccc

SEQ ID NO: 1854091 - DNA, 15 bp, Homo sapiens
cggtttgaagcctgg

SEQ ID NO: 1854092 - DNA, 16 bp, Homo sapiens
cgtctccagtcatctg

SEQ ID NO: 1854093 - DNA, 14 bp, Homo sapiens
cgtgagctgagcag

SEQ ID NO: 1854094 - DNA, 16 bp, Homo sapiens
cgtgctctttgttttg

SEQ ID NO: 1854095 - DNA, 16 bp, Homo sapiens
cgtggacaggtgtgcc

SEQ ID NO: 1854096 - DNA, 13 bp, Homo sapiens
cgtgtgcaggagc

SEQ ID NO: 1854097 - DNA, 13 bp, Homo sapiens
cgtgttcagcaga

SEQ ID NO: 1854098 - DNA, 20 bp, Homo sapiens
cgtgttcagcagaacctgca

SEQ ID NO: 1854099 - DNA, 22 bp, Homo sapiens
cgttccttcaaagcaaatgtct

SEQ ID NO: 1854100 - DNA, 17 bp, Homo sapiens
cgttgatgttggctggg

SEQ ID NO: 1854101 - DNA, 18 bp, Homo sapiens
cgttgatgttggctggga

SEQ ID NO: 1854102 - DNA, 19 bp, Homo sapiens
cgtttgtgttctgttttgt

SEQ ID NO: 1854103 - DNA, 16 bp, Homo sapiens
cgttttataagcatca

SEQ ID NO: 1854104 - DNA, 23 bp, Homo sapiens
ctaaacatgtatgtaaatagcta

SEQ ID NO: 1854105 - DNA, 13 bp, Homo sapiens
ctaaactttcaca

SEQ ID NO: 1854106 - DNA, 16 bp, Homo sapiens
ctaaaggagtttatgt

SEQ ID NO: 1854107 - DNA, 20 bp, Homo sapiens
ctaactacaaaggtttaaat

SEQ ID NO: 1854108 - DNA, 22 bp, Homo sapiens
ctaacttgtctttggaccctga

SEQ ID NO: 1854109 - DNA, 13 bp, Homo sapiens
ctaagagggaggg

SEQ ID NO: 1854110 - DNA, 16 bp, Homo sapiens
ctaaggcgtggagctg

SEQ ID NO: 1854111 - DNA, 20 bp, Homo sapiens
ctaagtaatctcacagcatt

SEQ ID NO: 1854112 - DNA, 23 bp, Homo sapiens
ctaagtaatctcacagcatttgc

SEQ ID NO: 1854113 - DNA, 21 bp, Homo sapiens
ctaagtggtactaactttcct

SEQ ID NO: 1854114 - DNA, 20 bp, Homo sapiens
ctaataaaatttaaaagtct

SEQ ID NO: 1854115 - DNA, 13 bp, Homo sapiens
ctaatattttcct

SEQ ID NO: 1854116 - DNA, 17 bp, Homo sapiens
ctaattttattatagta

SEQ ID NO: 1854117 - DNA, 15 bp, Homo sapiens
ctacaaaggtttaaa

SEQ ID NO: 1854118 - DNA, 20 bp, Homo sapiens
ctacaaaggtttaaatgaac

SEQ ID NO: 1854119 - DNA, 22 bp, Homo sapiens
ctacaaaggtttaaatgaacaa

SEQ ID NO: 1854120 - DNA, 20 bp, Homo sapiens
ctacagtcctcccatctcac

SEQ ID NO: 1854121 - DNA, 19 bp, Homo sapiens
ctacagttgaaaaacagct

SEQ ID NO: 1854122 - DNA, 18 bp, Homo sapiens
ctaccacatgccaagcac

SEQ ID NO: 1854123 - DNA, 16 bp, Homo sapiens
ctacccaaccagggcc

SEQ ID NO: 1854124 - DNA, 12 bp, Homo sapiens
ctacccaggtgc

SEQ ID NO: 1854125 - DNA, 14 bp, Homo sapiens
ctacccgggaaggg

SEQ ID NO: 1854126 - DNA, 16 bp, Homo sapiens
ctacctgaggggcctc

SEQ ID NO: 1854127 - DNA, 19 bp, Homo sapiens
ctagaaattccccaccctg

SEQ ID NO: 1854128 - DNA, 19 bp, Homo sapiens
ctagagaatgttagaggat

SEQ ID NO: 1854129 - DNA, 19 bp, Homo sapiens
ctagagcacaacataattt

SEQ ID NO: 1854130 - DNA, 21 bp, Homo sapiens
ctagagtgaacttgggccact

SEQ ID NO: 1854131 - DNA, 12 bp, Homo sapiens
ctagcagcaggg

SEQ ID NO: 1854132 - DNA, 23 bp, Homo sapiens
ctagcagcagggagggcttctgc

SEQ ID NO: 1854133 - DNA, 17 bp, Homo sapiens
ctagctgaatgtttttc

SEQ ID NO: 1854134 - DNA, 19 bp, Homo sapiens
ctagctgaatgtttttcta

SEQ ID NO: 1854135 - DNA, 20 bp, Homo sapiens
ctagctgaatgtttttctaa

SEQ ID NO: 1854136 - DNA, 15 bp, Homo sapiens
ctaggaacactcctt

SEQ ID NO: 1854137 - DNA, 15 bp, Homo sapiens
ctaggaagactttgg

SEQ ID NO: 1854138 - DNA, 21 bp, Homo sapiens
ctaggaagtaaagtgaagaat

SEQ ID NO: 1854139 - DNA, 18 bp, Homo sapiens
ctaggacgccacccagca

SEQ ID NO: 1854140 - DNA, 15 bp, Homo sapiens
ctaggactgcagtgt

SEQ ID NO: 1854141 - DNA, 11 bp, Homo sapiens
ctaggctgggg

SEQ ID NO: 1854142 - DNA, 18 bp, Homo sapiens
cctctcccctcagcctct

SEQ ID NO: 1854143 - DNA, 15 bp, Homo sapiens
cctctcccctgcctg

SEQ ID NO: 1854144 - DNA, 13 bp, Homo sapiens
cctctcctccgtg

SEQ ID NO: 1854145 - DNA, 19 bp, Homo sapiens
cctctcctccgtggcacat

SEQ ID NO: 1854146 - DNA, 21 bp, Homo sapiens
cctctccttgtggcctgggcc

SEQ ID NO: 1854147 - DNA, 12 bp, Homo sapiens
cctctctcactc

SEQ ID NO: 1854148 - DNA, 17 bp, Homo sapiens
cctctctcactccttga

SEQ ID NO: 1854149 - DNA, 19 bp, Homo sapiens
cctctgcactcccctgctg

SEQ ID NO: 1854150 - DNA, 21 bp, Homo sapiens
cctctgcactcccctgctggg

SEQ ID NO: 1854151 - DNA, 18 bp, Homo sapiens
cctctgctgatcctccca

SEQ ID NO: 1854152 - DNA, 15 bp, Homo sapiens
cctctgctgctggct

SEQ ID NO: 1854153 - DNA, 17 bp, Homo sapiens
cctctgctgctggctgg

SEQ ID NO: 1854154 - DNA, 14 bp, Homo sapiens
cctctgggtctcag

SEQ ID NO: 1854155 - DNA, 19 bp, Homo sapiens
cctctgggtctcagtgtcc

SEQ ID NO: 1854156 - DNA, 16 bp, Homo sapiens
cctctgtacagagccc

SEQ ID NO: 1854157 - DNA, 23 bp, Homo sapiens
cctctgtacagagcccacgcccc

SEQ ID NO: 1854158 - DNA, 15 bp, Homo sapiens
cctctgtctaggact

SEQ ID NO: 1854159 - DNA, 16 bp, Homo sapiens
cctcttgtagtcttgg

SEQ ID NO: 1854160 - DNA, 16 bp, Homo sapiens
cctctttccctccctt

SEQ ID NO: 1854161 - DNA, 14 bp, Homo sapiens
cctgaaagccctga

SEQ ID NO: 1854162 - DNA, 19 bp, Homo sapiens
cctgaaggccccgcccagg

SEQ ID NO: 1854163 - DNA, 12 bp, Homo sapiens
cctgacaacact

SEQ ID NO: 1854164 - DNA, 21 bp, Homo sapiens
cctgagatgggcttcccaagg

SEQ ID NO: 1854165 - DNA, 19 bp, Homo sapiens
cctgagatttattaaagaa

SEQ ID NO: 1854166 - DNA, 16 bp, Homo sapiens
cctgagctttctgcta

SEQ ID NO: 1854167 - DNA, 13 bp, Homo sapiens
cctgaggcccaga

SEQ ID NO: 1854168 - DNA, 18 bp, Homo sapiens
cctgaggcccagagggcc

SEQ ID NO: 1854169 - DNA, 11 bp, Homo sapiens
cctgaggccct

SEQ ID NO: 1854170 - DNA, 16 bp, Homo sapiens
cctgaggcccttctct

SEQ ID NO: 1854171 - DNA, 22 bp, Homo sapiens
cctgaggcccttctctccagcc

SEQ ID NO: 1854172 - DNA, 23 bp, Homo sapiens
cctgaggcccttctctccagccc

SEQ ID NO: 1854173 - DNA, 17 bp, Homo sapiens
cctgaggctgggctccc

SEQ ID NO: 1854174 - DNA, 14 bp, Homo sapiens
cctgagtgcctggc

SEQ ID NO: 1854175 - DNA, 17 bp, Homo sapiens
cctgagtgcttgctttt

SEQ ID NO: 1854176 - DNA, 15 bp, Homo sapiens
cctgattgtgtctct

SEQ ID NO: 1854177 - DNA, 17 bp, Homo sapiens
cctgattgtgtctcttg

SEQ ID NO: 1854178 - DNA, 23 bp, Homo sapiens
cctgattgtgtctcttggtcctg

SEQ ID NO: 1854179 - DNA, 22 bp, Homo sapiens
cctgcaacctgattgtgtctct

SEQ ID NO: 1854180 - DNA, 11 bp, Homo sapiens
cctgcacacag

SEQ ID NO: 1854181 - DNA, 18 bp, Homo sapiens
cctgcacacaggacagcg

SEQ ID NO: 1854182 - DNA, 19 bp, Homo sapiens
cctgcaggcagccaggcca

SEQ ID NO: 1854183 - DNA, 20 bp, Homo sapiens
cctgcaggcagccaggccac

SEQ ID NO: 1854184 - DNA, 23 bp, Homo sapiens
cctgcaggcagccaggccacaag

SEQ ID NO: 1854185 - DNA, 13 bp, Homo sapiens
cctgccagcccct

SEQ ID NO: 1854186 - DNA, 14 bp, Homo sapiens
cctgccagcccctg

SEQ ID NO: 1854187 - DNA, 11 bp, Homo sapiens
cctgccaggga

SEQ ID NO: 1854188 - DNA, 15 bp, Homo sapiens
cctgccagggacaga

SEQ ID NO: 1854189 - DNA, 12 bp, Homo sapiens
cctgcccacctg

SEQ ID NO: 1854190 - DNA, 19 bp, Homo sapiens
cctgcccacctggcctctg

SEQ ID NO: 1854191 - DNA, 20 bp, Homo sapiens
cctgcccacctggcctctgc

SEQ ID NO: 1854192 - DNA, 12 bp, Homo sapiens
cctgccctgtgg

SEQ ID NO: 1854193 - DNA, 16 bp, Homo sapiens
cctgcctcccttcatg

SEQ ID NO: 1854194 - DNA, 20 bp, Homo sapiens
cctgcctcctttgtgaggaa

SEQ ID NO: 1854195 - DNA, 15 bp, Homo sapiens
cctgcctctacccaa

SEQ ID NO: 1854196 - DNA, 20 bp, Homo sapiens
cctgctcccatcctgtgtgt

SEQ ID NO: 1854197 - DNA, 12 bp, Homo sapiens
cctgctgcagtt

SEQ ID NO: 1854198 - DNA, 19 bp, Homo sapiens
cctgctgcagttgccagtc

SEQ ID NO: 1854199 - DNA, 22 bp, Homo sapiens
cctgctgcagttgccagtcacc

SEQ ID NO: 1854200 - DNA, 12 bp, Homo sapiens
cctgctggatgt

SEQ ID NO: 1854201 - DNA, 22 bp, Homo sapiens
cctggaacatcatcaaggcact

SEQ ID NO: 1854202 - DNA, 13 bp, Homo sapiens
cctggaagacaga

SEQ ID NO: 1854203 - DNA, 15 bp, Homo sapiens
cctggaagacagaga

SEQ ID NO: 1854204 - DNA, 22 bp, Homo sapiens
cctggaaggacatccatgttcc

SEQ ID NO: 1854205 - DNA, 13 bp, Homo sapiens
cctggaccctgtg

SEQ ID NO: 1854206 - DNA, 12 bp, Homo sapiens
cctggcactgct

SEQ ID NO: 1854207 - DNA, 16 bp, Homo sapiens
cctggcactgcttcca

SEQ ID NO: 1854208 - DNA, 17 bp, Homo sapiens
cctggcactgcttccag

SEQ ID NO: 1854209 - DNA, 21 bp, Homo sapiens
cctggcactgcttccagtgag

SEQ ID NO: 1854210 - DNA, 14 bp, Homo sapiens
cctggccagggcct

SEQ ID NO: 1854211 - DNA, 19 bp, Homo sapiens
cctggccagggcctggaag

SEQ ID NO: 1854212 - DNA, 13 bp, Homo sapiens
cctggcccactgc

SEQ ID NO: 1854213 - DNA, 20 bp, Homo sapiens
cctggcctctgcactcccct

SEQ ID NO: 1854214 - DNA, 13 bp, Homo sapiens
cctggcctgagct

SEQ ID NO: 1854215 - DNA, 15 bp, Homo sapiens
cctggcctgagctgg

SEQ ID NO: 1854216 - DNA, 22 bp, Homo sapiens
cctggctccaaaccctcgaggc

SEQ ID NO: 1854217 - DNA, 13 bp, Homo sapiens
cctggctgaagga

SEQ ID NO: 1854218 - DNA, 16 bp, Homo sapiens
cctggctgaaggactg

SEQ ID NO: 1854219 - DNA, 20 bp, Homo sapiens
cctggctgaaggactgtgac

SEQ ID NO: 1854220 - DNA, 20 bp, Homo sapiens
cctgggatccctcatcctca

SEQ ID NO: 1854221 - DNA, 15 bp, Homo sapiens
cctggggctgctggc

SEQ ID NO: 1854222 - DNA, 17 bp, Homo sapiens
cctggggctgctggcct

SEQ ID NO: 1854223 - DNA, 16 bp, Homo sapiens
cctgggtttaagggga

SEQ ID NO: 1854224 - DNA, 23 bp, Homo sapiens
cctggtgacatcaggtttttccc

SEQ ID NO: 1854225 - DNA, 22 bp, Homo sapiens
cctggtggcagctcacctctcc

SEQ ID NO: 1854226 - DNA, 20 bp, Homo sapiens
cctgtaatcctagcactttg

SEQ ID NO: 1854227 - DNA, 18 bp, Homo sapiens
cctgtccacaggcttctg

SEQ ID NO: 1854228 - DNA, 21 bp, Homo sapiens
cctgtccacaggcttctgagc

SEQ ID NO: 1854229 - DNA, 13 bp, Homo sapiens
cctgtccccctga

SEQ ID NO: 1854230 - DNA, 14 bp, Homo sapiens
cctgtccccctgac

SEQ ID NO: 1854231 - DNA, 17 bp, Homo sapiens
cctgtgatggggccctg

SEQ ID NO: 1854232 - DNA, 20 bp, Homo sapiens
cctgtggatgataaaacaca

SEQ ID NO: 1854233 - DNA, 20 bp, Homo sapiens
cctgtgggcccccaaatgga

SEQ ID NO: 1854234 - DNA, 16 bp, Homo sapiens
cctgtgtgttaagctc

SEQ ID NO: 1854235 - DNA, 12 bp, Homo sapiens
cctgttttctga

SEQ ID NO: 1854236 - DNA, 14 bp, Homo sapiens
cctgttttctgaaa

SEQ ID NO: 1854237 - DNA, 15 bp, Homo sapiens
cctgttttctgaaac

SEQ ID NO: 1854238 - DNA, 12 bp, Homo sapiens
ccttaaaggaag

SEQ ID NO: 1854239 - DNA, 14 bp, Homo sapiens
ccttaccagcagag

SEQ ID NO: 1854240 - DNA, 16 bp, Homo sapiens
ccttagacagtccctg

SEQ ID NO: 1854241 - DNA, 17 bp, Homo sapiens
ccttagacagtccctgc

SEQ ID NO: 1854242 - DNA, 19 bp, Homo sapiens
ccttcaaagcaaatgtctt

SEQ ID NO: 1854243 - DNA, 21 bp, Homo sapiens
ccttcacctttgtccccaccg

SEQ ID NO: 1854244 - DNA, 13 bp, Homo sapiens
ccttcatctggaa

SEQ ID NO: 1854245 - DNA, 12 bp, Homo sapiens
ccttcatgcatg

SEQ ID NO: 1854246 - DNA, 21 bp, Homo sapiens
ccttcatgcatggaaattccc

SEQ ID NO: 1854247 - DNA, 17 bp, Homo sapiens
ccttccatggactttgt

SEQ ID NO: 1854248 - DNA, 12 bp, Homo sapiens
ccttcccacctc

SEQ ID NO: 1854249 - DNA, 19 bp, Homo sapiens
ccttcccacctctctcact

SEQ ID NO: 1854250 - DNA, 18 bp, Homo sapiens
ccttcccatgacccaggc

SEQ ID NO: 1854251 - DNA, 21 bp, Homo sapiens
ccttcccatgacccaggctgg

SEQ ID NO: 1854252 - DNA, 23 bp, Homo sapiens
ccttcccatgacccaggctgggc

SEQ ID NO: 1854253 - DNA, 13 bp, Homo sapiens
ccttcctctgagg

SEQ ID NO: 1854254 - DNA, 16 bp, Homo sapiens
ccttcctgccagcccc

SEQ ID NO: 1854255 - DNA, 15 bp, Homo sapiens
ccttctccttcacct

SEQ ID NO: 1854256 - DNA, 19 bp, Homo sapiens
ccttctccttcacctttgt

SEQ ID NO: 1854257 - DNA, 12 bp, Homo sapiens
ccttctctccag

SEQ ID NO: 1854258 - DNA, 17 bp, Homo sapiens
ccttctctccagcccct

SEQ ID NO: 1854259 - DNA, 18 bp, Homo sapiens
ccttctctccagcccctg

SEQ ID NO: 1854260 - DNA, 19 bp, Homo sapiens
ccttctctccagcccctgg

SEQ ID NO: 1854261 - DNA, 20 bp, Homo sapiens
ccttctgacccatgctgccc

SEQ ID NO: 1854262 - DNA, 22 bp, Homo sapiens
ccttctgacccatgctgccctg

SEQ ID NO: 1854263 - DNA, 23 bp, Homo sapiens
ccttctgacccatgctgccctgt

SEQ ID NO: 1854264 - DNA, 21 bp, Homo sapiens
ccttgaaaacactgttctctg

SEQ ID NO: 1854265 - DNA, 22 bp, Homo sapiens
ccttgaccattctccacctgcc

SEQ ID NO: 1854266 - DNA, 23 bp, Homo sapiens
ccttgaccattctccacctgcca

SEQ ID NO: 1854267 - DNA, 15 bp, Homo sapiens
ccagggcctggctgg

SEQ ID NO: 1854268 - DNA, 17 bp, Homo sapiens
ctccacctgccagggac

SEQ ID NO: 1854269 - DNA, 16 bp, Homo sapiens
ctccagacacatgtcc

SEQ ID NO: 1854270 - DNA, 14 bp, Homo sapiens
ctccagattctgat

SEQ ID NO: 1854271 - DNA, 16 bp, Homo sapiens
ctccagattctgatgc

SEQ ID NO: 1854272 - DNA, 17 bp, Homo sapiens
ctccagattctgatgca

SEQ ID NO: 1854273 - DNA, 20 bp, Homo sapiens
ctccagcccctggatgcagc

SEQ ID NO: 1854274 - DNA, 19 bp, Homo sapiens
ctccatcagttagagctga

SEQ ID NO: 1854275 - DNA, 22 bp, Homo sapiens
ctcccaactcaccccagcccca

SEQ ID NO: 1854276 - DNA, 17 bp, Homo sapiens
ctcccaatatccaattt

SEQ ID NO: 1854277 - DNA, 21 bp, Homo sapiens
ctcccaggcattccccaggag

SEQ ID NO: 1854278 - DNA, 16 bp, Homo sapiens
ctcccagtacctcctg

SEQ ID NO: 1854279 - DNA, 17 bp, Homo sapiens
ctcccataaccgctgat

SEQ ID NO: 1854280 - DNA, 20 bp, Homo sapiens
ctcccataaccgctgattct

SEQ ID NO: 1854281 - DNA, 15 bp, Homo sapiens
ctcccatctgtgaaa

SEQ ID NO: 1854282 - DNA, 23 bp, Homo sapiens
ctcccatctgtgaaaggaaagag

SEQ ID NO: 1854283 - DNA, 14 bp, Homo sapiens
ctccccacagtgcc

SEQ ID NO: 1854284 - DNA, 17 bp, Homo sapiens
ctccccacagtgccacc

SEQ ID NO: 1854285 - DNA, 20 bp, Homo sapiens
ctccccagagttccccatgc

SEQ ID NO: 1854286 - DNA, 15 bp, Homo sapiens
ctccccaggccaccc

SEQ ID NO: 1854287 - DNA, 20 bp, Homo sapiens
ctcccccagccccatcctct

SEQ ID NO: 1854288 - DNA, 13 bp, Homo sapiens
ctcccctcagcct

SEQ ID NO: 1854289 - DNA, 16 bp, Homo sapiens
ctcccctcagcctctc

SEQ ID NO: 1854290 - DNA, 23 bp, Homo sapiens
ctgacaacactcattgacctgag

SEQ ID NO: 1854291 - DNA, 18 bp, Homo sapiens
ctgacaacagacttctga

SEQ ID NO: 1854292 - DNA, 14 bp, Homo sapiens
ctgacacaaacctg

SEQ ID NO: 1854293 - DNA, 18 bp, Homo sapiens
ctgacacaaacctgcctg

SEQ ID NO: 1854294 - DNA, 19 bp, Homo sapiens
ctgacacaaacctgcctgg

SEQ ID NO: 1854295 - DNA, 16 bp, Homo sapiens
ctgacacctaactctt

SEQ ID NO: 1854296 - DNA, 16 bp, Homo sapiens
ctgacatcatttgtat

SEQ ID NO: 1854297 - DNA, 14 bp, Homo sapiens
ctgacatctctgca

SEQ ID NO: 1854298 - DNA, 15 bp, Homo sapiens
ctgacatctctgcaa

SEQ ID NO: 1854299 - DNA, 16 bp, Homo sapiens
ctgacatctctgcaat

SEQ ID NO: 1854300 - DNA, 23 bp, Homo sapiens
ctgaccagtttaacctgatgcag

SEQ ID NO: 1854301 - DNA, 13 bp, Homo sapiens
ctgacccatgctg

SEQ ID NO: 1854302 - DNA, 18 bp, Homo sapiens
ctgacgcttgtgacagtg

SEQ ID NO: 1854303 - DNA, 23 bp, Homo sapiens
ctgacgcttgtgacagtgcctct

SEQ ID NO: 1854304 - DNA, 18 bp, Homo sapiens
ctgactgttttctcttga

SEQ ID NO: 1854305 - DNA, 15 bp, Homo sapiens
ctgagaacactgtga

SEQ ID NO: 1854306 - DNA, 17 bp, Homo sapiens
ctgagacagcccgggct

SEQ ID NO: 1854307 - DNA, 19 bp, Homo sapiens
ctgagacagcccgggctct

SEQ ID NO: 1854308 - DNA, 21 bp, Homo sapiens
ctgagacagcccgggctctgc

SEQ ID NO: 1854309 - DNA, 23 bp, Homo sapiens
ctgagatgaaccctggcatttgg

SEQ ID NO: 1854310 - DNA, 13 bp, Homo sapiens
ctgagcaggccac

SEQ ID NO: 1854311 - DNA, 12 bp, Homo sapiens
ctgagctgggat

SEQ ID NO: 1854312 - DNA, 12 bp, Homo sapiens
ctgaggcccaga

SEQ ID NO: 1854313 - DNA, 19 bp, Homo sapiens
ctgaggcccagagggcctg

SEQ ID NO: 1854314 - DNA, 13 bp, Homo sapiens
ctgaggcccagtg

SEQ ID NO: 1854315 - DNA, 14 bp, Homo sapiens
ctgaggcccagtgc

SEQ ID NO: 1854316 - DNA, 20 bp, Homo sapiens
ctgaggcccttctctccagc

SEQ ID NO: 1854317 - DNA, 16 bp, Homo sapiens
tcccagatacttgggg

SEQ ID NO: 1854318 - DNA, 18 bp, Homo sapiens
tcccaggcattccccagg

SEQ ID NO: 1854319 - DNA, 19 bp, Homo sapiens
tcccaggcattccccagga

SEQ ID NO: 1854320 - DNA, 24 bp, Homo sapiens
tcccaggcattccccaggaggcca

SEQ ID NO: 1854321 - DNA, 22 bp, Homo sapiens
tcccagtgccgagaaggaagcc

SEQ ID NO: 1854322 - DNA, 14 bp, Homo sapiens
tcccataccaccca

SEQ ID NO: 1854323 - DNA, 15 bp, Homo sapiens
tcccatcacccgcta

SEQ ID NO: 1854324 - DNA, 23 bp, Homo sapiens
tcccatctcacacatgagcatca

SEQ ID NO: 1854325 - DNA, 21 bp, Homo sapiens
tcccatctgtgaaaggaaaga

SEQ ID NO: 1854326 - DNA, 19 bp, Homo sapiens
tcccatgacccaggctggg

SEQ ID NO: 1854327 - DNA, 20 bp, Homo sapiens
tcccatgacccaggctgggc

SEQ ID NO: 1854328 - DNA, 15 bp, Homo sapiens
tccccacagtgccac

SEQ ID NO: 1854329 - DNA, 19 bp, Homo sapiens
tccccacagtgccacccat

SEQ ID NO: 1854330 - DNA, 15 bp, Homo sapiens
tccccaggaggccag

SEQ ID NO: 1854331 - DNA, 17 bp, Homo sapiens
tccccaggaggccagcc

SEQ ID NO: 1854332 - DNA, 18 bp, Homo sapiens
tccccaggaggccagcct

SEQ ID NO: 1854333 - DNA, 20 bp, Homo sapiens
tccccaggaggccagccttg

SEQ ID NO: 1854334 - DNA, 23 bp, Homo sapiens
tccccaggaggccagccttgacc

SEQ ID NO: 1854335 - DNA, 18 bp, Homo sapiens
tccccatcatctgtggaa

SEQ ID NO: 1854336 - DNA, 16 bp, Homo sapiens
tccccatgcagacatg

SEQ ID NO: 1854337 - DNA, 13 bp, Homo sapiens
tcccccagcccca

SEQ ID NO: 1854338 - DNA, 21 bp, Homo sapiens
tcccccagccccatcctctgt

SEQ ID NO: 1854339 - DNA, 18 bp, Homo sapiens
tataaatcgcttttgata

SEQ ID NO: 1854340 - DNA, 15 bp, Homo sapiens
tataaatgcaaataa

SEQ ID NO: 1854341 - DNA, 18 bp, Homo sapiens
tataaccacatttctaag

SEQ ID NO: 1854342 - DNA, 21 bp, Homo sapiens
tataagcatcattatttatgt

SEQ ID NO: 1854343 - DNA, 17 bp, Homo sapiens
tataggttactcataag

SEQ ID NO: 1854344 - DNA, 14 bp, Homo sapiens
tatatatacatcat

SEQ ID NO: 1854345 - DNA, 19 bp, Homo sapiens
tatattattacttgtaaat

SEQ ID NO: 1854346 - DNA, 20 bp, Homo sapiens
tatattcattctttttgaaa

SEQ ID NO: 1854347 - DNA, 15 bp, Homo sapiens
tatcaagcagccaag

SEQ ID NO: 1854348 - DNA, 20 bp, Homo sapiens
tatcacattaatctcaaaga

SEQ ID NO: 1854349 - DNA, 22 bp, Homo sapiens
tatcacattaatctcaaagaga

SEQ ID NO: 1854350 - DNA, 16 bp, Homo sapiens
tatctcacttgtgcca

SEQ ID NO: 1854351 - DNA, 17 bp, Homo sapiens
tatctcccccagcccca

SEQ ID NO: 1854352 - DNA, 22 bp, Homo sapiens
tatctttgccaccctcatgctg

SEQ ID NO: 1854353 - DNA, 13 bp, Homo sapiens
tatgaacagctgt

SEQ ID NO: 1854354 - DNA, 14 bp, Homo sapiens
tatgaacagctgtg

SEQ ID NO: 1854355 - DNA, 15 bp, Homo sapiens
tatgaacagctgtgt

SEQ ID NO: 1854356 - DNA, 17 bp, Homo sapiens
tatgaacagctgtgtct

SEQ ID NO: 1854357 - DNA, 20 bp, Homo sapiens
tatgacattcatgcctggct

SEQ ID NO: 1854358 - DNA, 19 bp, Homo sapiens
tatgaccacactccagctg

SEQ ID NO: 1854359 - DNA, 20 bp, Homo sapiens
tatgcaatgtatagtgtcta

SEQ ID NO: 1854360 - DNA, 18 bp, Homo sapiens
tatgcttccacaggcaaa

SEQ ID NO: 1854361 - DNA, 15 bp, Homo sapiens
tatggactcagcctt

SEQ ID NO: 1854362 - DNA, 21 bp, Homo sapiens
tatggactcagccttgcaaat

SEQ ID NO: 1854363 - DNA, 18 bp, Homo sapiens
tatggagctcagagaggg

SEQ ID NO: 1854364 - DNA, 23 bp, Homo sapiens
tatgtaacaacaattatttgaag

SEQ ID NO: 1854365 - DNA, 21 bp, Homo sapiens
tatgtattgtgcaatgtgtat

SEQ ID NO: 1854366 - DNA, 16 bp, Homo sapiens
tatgttaatatttctg

SEQ ID NO: 1854367 - DNA, 14 bp, Homo sapiens
tatgttccaaggct

SEQ ID NO: 1854368 - DNA, 15 bp, Homo sapiens
tatgttccattaaac

SEQ ID NO: 1854369 - DNA, 20 bp, Homo sapiens
tatgttccattaaacgattt

SEQ ID NO: 1854370 - DNA, 20 bp, Homo sapiens
tattaaagaaaaaaatgtat

SEQ ID NO: 1854371 - DNA, 17 bp, Homo sapiens
tattaaatgcccagccc

SEQ ID NO: 1854372 - DNA, 19 bp, Homo sapiens
tattaaatgcccagcccct

SEQ ID NO: 1854373 - DNA, 19 bp, Homo sapiens
tattagtgacctcagcttt

SEQ ID NO: 1854374 - DNA, 21 bp, Homo sapiens
tattagtgacctcagctttga

SEQ ID NO: 1854375 - DNA, 14 bp, Homo sapiens
tattattacttgta

SEQ ID NO: 1854376 - DNA, 17 bp, Homo sapiens
tattattacttgtaaat

SEQ ID NO: 1854377 - DNA, 15 bp, Homo sapiens
tattcatctcaagga

SEQ ID NO: 1854378 - DNA, 16 bp, Homo sapiens
tattgaaatgatttca

SEQ ID NO: 1854379 - DNA, 17 bp, Homo sapiens
tattgaagcattttata

SEQ ID NO: 1854380 - DNA, 11 bp, Homo sapiens
tattgctgggg

SEQ ID NO: 1854381 - DNA, 16 bp, Homo sapiens
tattgtgcaatgtgta

SEQ ID NO: 1854382 - DNA, 18 bp, Homo sapiens
tattgtgcaatgtgtata

SEQ ID NO: 1854383 - DNA, 13 bp, Homo sapiens
tatttatgtattg

SEQ ID NO: 1854384 - DNA, 19 bp, Homo sapiens
tatttcctcatgtgatcac

SEQ ID NO: 1854385 - DNA, 22 bp, Homo sapiens
tatttgaacatgtgccttttct

SEQ ID NO: 1854386 - DNA, 23 bp, Homo sapiens
tatttgaacatgtgccttttctg

SEQ ID NO: 1854387 - DNA, 17 bp, Homo sapiens
tatttgaagatttaatt

SEQ ID NO: 1854388 - DNA, 18 bp, Homo sapiens
tatttgcaaggctgattt

SEQ ID NO: 1854389 - DNA, 15 bp, Homo sapiens
tatttgtttgcatag

SEQ ID NO: 1854390 - DNA, 20 bp, Homo sapiens
tcaaaccaaatcactgaact

SEQ ID NO: 1854391 - DNA, 23 bp, Homo sapiens
tcaaagaggttttaaaaaaatcc

SEQ ID NO: 1854392 - DNA, 18 bp, Homo sapiens
tcaaatgggctgctgctt

SEQ ID NO: 1854393 - DNA, 17 bp, Homo sapiens
tcaacatttctcatgtt

SEQ ID NO: 1854394 - DNA, 21 bp, Homo sapiens
tcaactgaaggggtgcaccca

SEQ ID NO: 1854395 - DNA, 12 bp, Homo sapiens
tcaactgggctg

SEQ ID NO: 1854396 - DNA, 19 bp, Homo sapiens
tcaagactggaaggtgggg

SEQ ID NO: 1854397 - DNA, 18 bp, Homo sapiens
tcaaggaataatgggctt

SEQ ID NO: 1854398 - DNA, 21 bp, Homo sapiens
tcaaggacacgggcctgtcca

SEQ ID NO: 1854399 - DNA, 23 bp, Homo sapiens
tcaagtgaaaaaggaggaagaga

SEQ ID NO: 1854400 - DNA, 16 bp, Homo sapiens
tcaatacctggcctca

SEQ ID NO: 1854401 - DNA, 15 bp, Homo sapiens
tcaatctctcttaga

SEQ ID NO: 1854402 - DNA, 14 bp, Homo sapiens
tcaatgagcatgtt

SEQ ID NO: 1854403 - DNA, 21 bp, Homo sapiens
tcaatgagcatgtttagactt

SEQ ID NO: 1854404 - DNA, 17 bp, Homo sapiens
tcaattcaacactccct

SEQ ID NO: 1854405 - DNA, 17 bp, Homo sapiens
tcaattcttccctatct

SEQ ID NO: 1854406 - DNA, 23 bp, Homo sapiens
tcacacatgagcatcaggccagg

SEQ ID NO: 1854407 - DNA, 18 bp, Homo sapiens
tcacacgggggcagctga

SEQ ID NO: 1854408 - DNA, 11 bp, Homo sapiens
tcacactggga

SEQ ID NO: 1854409 - DNA, 14 bp, Homo sapiens
tcacagatgggtgc

SEQ ID NO: 1854410 - DNA, 13 bp, Homo sapiens
tcacagcctctga

SEQ ID NO: 1854411 - DNA, 22 bp, Homo sapiens
tcacagtccttaccagcagagc

SEQ ID NO: 1854412 - DNA, 21 bp, Homo sapiens
tcacagttttggttgctttaa

SEQ ID NO: 1854413 - DNA, 15 bp, Homo sapiens
tcacatcttggcaca

SEQ ID NO: 1854414 - DNA, 18 bp, Homo sapiens
tcacatgctaaagccagg

SEQ ID NO: 1854415 - DNA, 14 bp, Homo sapiens
tcaccatctgtgca

SEQ ID NO: 1854416 - DNA, 13 bp, Homo sapiens
tcaccccagcccc

SEQ ID NO: 1854417 - DNA, 15 bp, Homo sapiens
tcaccccggccacct

SEQ ID NO: 1854418 - DNA, 17 bp, Homo sapiens
tcacctaagtctctgtg

SEQ ID NO: 1854419 - DNA, 17 bp, Homo sapiens
tcacctggggctgctgg

SEQ ID NO: 1854420 - DNA, 22 bp, Homo sapiens
tcacctggggctgctggcctga

SEQ ID NO: 1854421 - DNA, 16 bp, Homo sapiens
tcaccttggaagggcg

SEQ ID NO: 1854422 - DNA, 12 bp, Homo sapiens
tcacctttgtcc

SEQ ID NO: 1854423 - DNA, 14 bp, Homo sapiens
tcactctggcagct

SEQ ID NO: 1854424 - DNA, 14 bp, Homo sapiens
tcactgagacagcc

SEQ ID NO: 1854425 - DNA, 21 bp, Homo sapiens
tcactgagacagcccgggctc

SEQ ID NO: 1854426 - DNA, 17 bp, Homo sapiens
tcacttatatgttctaa

SEQ ID NO: 1854427 - DNA, 22 bp, Homo sapiens
tcacttgtcaggagtgtgtgtg

SEQ ID NO: 1854428 - DNA, 21 bp, Homo sapiens
tcacttgtgccaacactcaag

SEQ ID NO: 1854429 - DNA, 14 bp, Homo sapiens
tcactttgaaaagt

SEQ ID NO: 1854430 - DNA, 19 bp, Homo sapiens
tcactttttttttttttcc

SEQ ID NO: 1854431 - DNA, 17 bp, Homo sapiens
tgcagcccccactgcct

SEQ ID NO: 1854432 - DNA, 15 bp, Homo sapiens
tgcagcctcacagtc

SEQ ID NO: 1854433 - DNA, 21 bp, Homo sapiens
tgcagcctcacagtccttacc

SEQ ID NO: 1854434 - DNA, 15 bp, Homo sapiens
tgcagctgctcccca

SEQ ID NO: 1854435 - DNA, 13 bp, Homo sapiens
tgcagctttaaaa

SEQ ID NO: 1854436 - DNA, 15 bp, Homo sapiens
tgcaggacctcaggt

SEQ ID NO: 1854437 - DNA, 16 bp, Homo sapiens
tgcaggaggtggagaa

SEQ ID NO: 1854438 - DNA, 12 bp, Homo sapiens
tgcagtgtggag

SEQ ID NO: 1854439 - DNA, 15 bp, Homo sapiens
tgcagtgtggagttc

SEQ ID NO: 1854440 - DNA, 15 bp, Homo sapiens
tgcagttgccagtca

SEQ ID NO: 1854441 - DNA, 16 bp, Homo sapiens
tgcagttgccagtcac

SEQ ID NO: 1854442 - DNA, 15 bp, Homo sapiens
tgcattttatagaat

SEQ ID NO: 1854443 - DNA, 17 bp, Homo sapiens
tgccaaattaaaaaaga

SEQ ID NO: 1854444 - DNA, 15 bp, Homo sapiens
tgccaagcactgtgc

SEQ ID NO: 1854445 - DNA, 19 bp, Homo sapiens
tgccaagttgtttgagaaa

SEQ ID NO: 1854446 - DNA, 14 bp, Homo sapiens
tgccacagagcggg

SEQ ID NO: 1854447 - DNA, 17 bp, Homo sapiens
tgccagccactgtgata

SEQ ID NO: 1854448 - DNA, 18 bp, Homo sapiens
tgccagcttatctcaggg

SEQ ID NO: 1854449 - DNA, 19 bp, Homo sapiens
tgccaggagcacggctctg

SEQ ID NO: 1854450 - DNA, 16 bp, Homo sapiens
tgccagtcaccccggc

SEQ ID NO: 1854451 - DNA, 20 bp, Homo sapiens
tgccagtcaccccggccacc

SEQ ID NO: 1854452 - DNA, 11 bp, Homo sapiens
tgccatcctca

SEQ ID NO: 1854453 - DNA, 16 bp, Homo sapiens
tgccatgcagggcctc

SEQ ID NO: 1854454 - DNA, 11 bp, Homo sapiens
tgccattgtag

SEQ ID NO: 1854455 - DNA, 14 bp, Homo sapiens
tgcccaagggaaag

SEQ ID NO: 1854456 - DNA, 13 bp, Homo sapiens
tgcccacctggcc

SEQ ID NO: 1854457 - DNA, 18 bp, Homo sapiens
tgcccacctggcctctgc

SEQ ID NO: 1854458 - DNA, 10 bp, Homo sapiens
tgcccagccc

SEQ ID NO: 1854459 - DNA, 17 bp, Homo sapiens
tgcccagccccttctga

SEQ ID NO: 1854460 - DNA, 21 bp, Homo sapiens
tgcccagctctctgacgcttg

SEQ ID NO: 1854461 - DNA, 14 bp, Homo sapiens
tgcccaggcccaga

SEQ ID NO: 1854462 - DNA, 23 bp, Homo sapiens
tgccccgaacatgtttttcttct

SEQ ID NO: 1854463 - DNA, 22 bp, Homo sapiens
tgccctaacctctgagtcacca

SEQ ID NO: 1854464 - DNA, 22 bp, Homo sapiens
tgccctccaagaccttctcctt

SEQ ID NO: 1854465 - DNA, 16 bp, Homo sapiens
tgccctctcccctcag

SEQ ID NO: 1854466 - DNA, 20 bp, Homo sapiens
tgccctgcccacctggcctc

SEQ ID NO: 1854467 - DNA, 17 bp, Homo sapiens
tgccctgttctctacca

SEQ ID NO: 1854468 - DNA, 15 bp, Homo sapiens
tgccgacagaaggaa

SEQ ID NO: 1854469 - DNA, 17 bp, Homo sapiens
tgccgcaccagcccgaa

SEQ ID NO: 1854470 - DNA, 17 bp, Homo sapiens
tgccgccagctgccgca

SEQ ID NO: 1854471 - DNA, 21 bp, Homo sapiens
tgccgccagctgccgcaccag

SEQ ID NO: 1854472 - DNA, 23 bp, Homo sapiens
tgccgccagctgccgcaccagcc

SEQ ID NO: 1854473 - DNA, 14 bp, Homo sapiens
tgccgccccaccca

SEQ ID NO: 1854474 - DNA, 16 bp, Homo sapiens
tgccggggcagccccc

SEQ ID NO: 1854475 - DNA, 16 bp, Homo sapiens
tgccgtctacctgagg

SEQ ID NO: 1854476 - DNA, 19 bp, Homo sapiens
tgcctcccatcacccgcta

SEQ ID NO: 1854477 - DNA, 22 bp, Homo sapiens
tgcctcctttgtgaggaagccg

SEQ ID NO: 1854478 - DNA, 22 bp, Homo sapiens
tgcctgatatttccctcccctg

SEQ ID NO: 1854479 - DNA, 16 bp, Homo sapiens
tgcctgctatgtattt

SEQ ID NO: 1854480 - DNA, 17 bp, Homo sapiens
tgcctggatggggctgc

SEQ ID NO: 1854481 - DNA, 20 bp, Homo sapiens
tgcctggatggggctgcacc

SEQ ID NO: 1854482 - DNA, 22 bp, Homo sapiens
tgcctggcttcgcaaaatgttt

SEQ ID NO: 1854483 - DNA, 21 bp, Homo sapiens
tgcctgggtggacatggcccc

SEQ ID NO: 1854484 - DNA, 17 bp, Homo sapiens
tgcctgtgaactgaact

SEQ ID NO: 1854485 - DNA, 17 bp, Homo sapiens
tgcctttgacctgcctc

SEQ ID NO: 1854486 - DNA, 15 bp, Homo sapiens
tgccttttctagccc

SEQ ID NO: 1854487 - DNA, 13 bp, Homo sapiens
tgccttttctgaa

SEQ ID NO: 1854488 - DNA, 17 bp, Homo sapiens
tgcggcattaaagccat

SEQ ID NO: 1854489 - DNA, 12 bp, Homo sapiens
tgcggctgtgtg

SEQ ID NO: 1854490 - DNA, 13 bp, Homo sapiens
tgcggctgtgtgt

SEQ ID NO: 1854491 - DNA, 17 bp, Homo sapiens
tgcgtctccagtcatct

SEQ ID NO: 1854492 - DNA, 20 bp, Homo sapiens
tgcgtctccagtcatctgta

SEQ ID NO: 1854493 - DNA, 20 bp, Homo sapiens
tgcgtgttcagcagaacctg

SEQ ID NO: 1854494 - DNA, 24 bp, Homo sapiens
tgctaaataaacatgtgccctcag

SEQ ID NO: 1854495 - DNA, 20 bp, Homo sapiens
tgctaatattttcctcctga

SEQ ID NO: 1854496 - DNA, 17 bp, Homo sapiens
tgctaggaacactcctt

SEQ ID NO: 1854497 - DNA, 13 bp, Homo sapiens
tgctatctccccc

SEQ ID NO: 1854498 - DNA, 18 bp, Homo sapiens
tgctatctcccccagccc

SEQ ID NO: 1854499 - DNA, 22 bp, Homo sapiens
tgctcaatacctggcctcattt

SEQ ID NO: 1854500 - DNA, 17 bp, Homo sapiens
tgctcagttcagaatca

SEQ ID NO: 1854501 - DNA, 23 bp, Homo sapiens
tgctcagttcagaatcacttctg

SEQ ID NO: 1854502 - DNA, 14 bp, Homo sapiens
tgctccccaggcca

SEQ ID NO: 1854503 - DNA, 19 bp, Homo sapiens
tgctctgatgaagaggagt

SEQ ID NO: 1854504 - DNA, 16 bp, Homo sapiens
tgctgaggcccagtgc

SEQ ID NO: 1854505 - DNA, 18 bp, Homo sapiens
tgctgaggcccagtgcat

SEQ ID NO: 1854506 - DNA, 15 bp, Homo sapiens
tgctgagtctgaagg

SEQ ID NO: 1854507 - DNA, 16 bp, Homo sapiens
tgctgagtctgaaggc

SEQ ID NO: 1854508 - DNA, 21 bp, Homo sapiens
tgctgagtctgaaggctgggt

SEQ ID NO: 1854509 - DNA, 22 bp, Homo sapiens
tgctgagtctgaaggctgggtt

SEQ ID NO: 1854510 - DNA, 15 bp, Homo sapiens
tgctgcagttgccag

SEQ ID NO: 1854511 - DNA, 23 bp, Homo sapiens
tgctgcagttgccagtcaccccg

SEQ ID NO: 1854512 - DNA, 16 bp, Homo sapiens
tgctgcccaggcccag

SEQ ID NO: 1854513 - DNA, 13 bp, Homo sapiens
tgctgccctgccc

SEQ ID NO: 1854514 - DNA, 16 bp, Homo sapiens
tgctgccctgcccacc

SEQ ID NO: 1854515 - DNA, 18 bp, Homo sapiens
tgctgccctgcccacctg

SEQ ID NO: 1854516 - DNA, 14 bp, Homo sapiens
tgctgccctgtgag

SEQ ID NO: 1854517 - DNA, 19 bp, Homo sapiens
tgctgccgccccacccaga

SEQ ID NO: 1854518 - DNA, 12 bp, Homo sapiens
tgctgctgctgc

SEQ ID NO: 1854519 - DNA, 13 bp, Homo sapiens
tgctggagactcc

SEQ ID NO: 1854520 - DNA, 16 bp, Homo sapiens
tgctggctggttagag

SEQ ID NO: 1854521 - DNA, 17 bp, Homo sapiens
tgctgggcttgtctgta

SEQ ID NO: 1854522 - DNA, 13 bp, Homo sapiens
tgctgtgcaaatg

SEQ ID NO: 1854523 - DNA, 18 bp, Homo sapiens
tgcttataggtggcctct

SEQ ID NO: 1854524 - DNA, 19 bp, Homo sapiens
tgcttccagtgaggctctg

SEQ ID NO: 1854525 - DNA, 21 bp, Homo sapiens
tgcttgaggcaactcatctta

SEQ ID NO: 1854526 - DNA, 23 bp, Homo sapiens
tgcttgcttttcatgcaaactct

SEQ ID NO: 1854527 - DNA, 15 bp, Homo sapiens
tgcttggaggaagga

SEQ ID NO: 1854528 - DNA, 16 bp, Homo sapiens
tgcttggaggaaggaa

SEQ ID NO: 1854529 - DNA, 16 bp, Homo sapiens
tgcttgttaactgagt

SEQ ID NO: 1854530 - DNA, 18 bp, Homo sapiens
tgcttgttaactgagtgc

SEQ ID NO: 1854531 - DNA, 20 bp, Homo sapiens
tgctttaatataaatgcaaa

SEQ ID NO: 1854532 - DNA, 14 bp, Homo sapiens
tgctttgcccagca

SEQ ID NO: 1854533 - DNA, 17 bp, Homo sapiens
tggaaaaatagcctgcc

SEQ ID NO: 1854534 - DNA, 17 bp, Homo sapiens
tggaaacagctcgactt

SEQ ID NO: 1854535 - DNA, 19 bp, Homo sapiens
tggaactctactcaaccca

SEQ ID NO: 1854536 - DNA, 18 bp, Homo sapiens
tggaagggcgttctaggt

SEQ ID NO: 1854537 - DNA, 23 bp, Homo sapiens
tggaaggggacacgtgacagccg

SEQ ID NO: 1854538 - DNA, 18 bp, Homo sapiens
tggaagttgcatggcatc

SEQ ID NO: 1854539 - DNA, 16 bp, Homo sapiens
tggaatctagccgatg

SEQ ID NO: 1854540 - DNA, 17 bp, Homo sapiens
tggaatgggcagctcat

SEQ ID NO: 1854541 - DNA, 15 bp, Homo sapiens
tggacacgctcagtg

SEQ ID NO: 1854542 - DNA, 11 bp, Homo sapiens
tggacatttta

SEQ ID NO: 1854543 - DNA, 17 bp, Homo sapiens
tggacattttatgtctt

SEQ ID NO: 1854544 - DNA, 14 bp, Homo sapiens
tggaccctgaggcc

SEQ ID NO: 1854545 - DNA, 16 bp, Homo sapiens
tggaccctgaggccca

SEQ ID NO: 1854546 - DNA, 23 bp, Homo sapiens
tggaccctgtggatgataaaaca

SEQ ID NO: 1854547 - DNA, 14 bp, Homo sapiens
tggactcagccttg

SEQ ID NO: 1854548 - DNA, 24 bp, Homo sapiens
tggactttgttagtttctccaagc

SEQ ID NO: 1854549 - DNA, 22 bp, Homo sapiens
cttgtctttggaccctgaggcc

SEQ ID NO: 1854550 - DNA, 14 bp, Homo sapiens
cttgtgacagtgcc

SEQ ID NO: 1854551 - DNA, 15 bp, Homo sapiens
cttgtgacagtgcct

SEQ ID NO: 1854552 - DNA, 20 bp, Homo sapiens
cttgtgacagtgcctcttcc

SEQ ID NO: 1854553 - DNA, 21 bp, Homo sapiens
ctttaaacattggttcttgta

SEQ ID NO: 1854554 - DNA, 17 bp, Homo sapiens
ctttaagtgcacaacat

SEQ ID NO: 1854555 - DNA, 12 bp, Homo sapiens
ctttaatataaa

SEQ ID NO: 1854556 - DNA, 19 bp, Homo sapiens
ctttaatataaatgcaaat

SEQ ID NO: 1854557 - DNA, 19 bp, Homo sapiens
ctttaattaagctctcata

SEQ ID NO: 1854558 - DNA, 16 bp, Homo sapiens
ctttattcaagtaaaa

SEQ ID NO: 1854559 - DNA, 20 bp, Homo sapiens
ctttcagataactgttattt

SEQ ID NO: 1854560 - DNA, 15 bp, Homo sapiens
ctttcatttcttcta

SEQ ID NO: 1854561 - DNA, 14 bp, Homo sapiens
ctttcattttgcac

SEQ ID NO: 1854562 - DNA, 17 bp, Homo sapiens
ctttcattttgcacctg

SEQ ID NO: 1854563 - DNA, 16 bp, Homo sapiens
ctttccaaatgcccag

SEQ ID NO: 1854564 - DNA, 18 bp, Homo sapiens
ctttccaaatgcccagct

SEQ ID NO: 1854565 - DNA, 19 bp, Homo sapiens
ctttccaaatgcccagctt

SEQ ID NO: 1854566 - DNA, 22 bp, Homo sapiens
ctttccaaatgcccagcttaaa

SEQ ID NO: 1854567 - DNA, 12 bp, Homo sapiens
ctttcctgaggc

SEQ ID NO: 1854568 - DNA, 20 bp, Homo sapiens
ctttcctgaggctgggctcc

SEQ ID NO: 1854569 - DNA, 22 bp, Homo sapiens
ctttcctgaggctgggctccct

SEQ ID NO: 1854570 - DNA, 22 bp, Homo sapiens
ctttctccctcaactgaagggg

SEQ ID NO: 1854571 - DNA, 21 bp, Homo sapiens
ctttctgggatgtcacagtcc

SEQ ID NO: 1854572 - DNA, 20 bp, Homo sapiens
ctttgaaaagttggaaggat

SEQ ID NO: 1854573 - DNA, 13 bp, Homo sapiens
ctttgaagggcaa

SEQ ID NO: 1854574 - DNA, 22 bp, Homo sapiens
ctttgacgccatcccagcccca

SEQ ID NO: 1854575 - DNA, 12 bp, Homo sapiens
ctttgagagaga

SEQ ID NO: 1854576 - DNA, 16 bp, Homo sapiens
ctttgccaccctcatg

SEQ ID NO: 1854577 - DNA, 21 bp, Homo sapiens
ctttgccaccctcatgctgtg

SEQ ID NO: 1854578 - DNA, 23 bp, Homo sapiens
ctttgggaggccaaggtgggagg

SEQ ID NO: 1854579 - DNA, 20 bp, Homo sapiens
ctttggtctacactgtgctg

SEQ ID NO: 1854580 - DNA, 23 bp, Homo sapiens
ctttgtatttttacttttaaatg

SEQ ID NO: 1854581 - DNA, 18 bp, Homo sapiens
ctttgtccccaccgcaga

SEQ ID NO: 1854582 - DNA, 20 bp, Homo sapiens
ctttgtttgttgtcagctga

SEQ ID NO: 1854583 - DNA, 14 bp, Homo sapiens
ctttgttttgtgtc

SEQ ID NO: 1854584 - DNA, 15 bp, Homo sapiens
cttttaattaaatgc

SEQ ID NO: 1854585 - DNA, 15 bp, Homo sapiens
cttttcatgcaaact

SEQ ID NO: 1854586 - DNA, 17 bp, Homo sapiens
cttttcatgcaaactct

SEQ ID NO: 1854587 - DNA, 20 bp, Homo sapiens
cttttcgcaggattcttcct

SEQ ID NO: 1854588 - DNA, 21 bp, Homo sapiens
cttttctagcccgaatacaaa

SEQ ID NO: 1854589 - DNA, 13 bp, Homo sapiens
cttttgccattga

SEQ ID NO: 1854590 - DNA, 18 bp, Homo sapiens
tctcccttggattgtccc

SEQ ID NO: 1854591 - DNA, 18 bp, Homo sapiens
tctccgtctcccaaagtg

SEQ ID NO: 1854592 - DNA, 13 bp, Homo sapiens
tctcctccgtggc

SEQ ID NO: 1854593 - DNA, 14 bp, Homo sapiens
tctcctctgctgct

SEQ ID NO: 1854594 - DNA, 20 bp, Homo sapiens
tctcctgcctgtgctgtgac

SEQ ID NO: 1854595 - DNA, 15 bp, Homo sapiens
tctccttcacctttg

SEQ ID NO: 1854596 - DNA, 16 bp, Homo sapiens
tctccttcacctttgt

SEQ ID NO: 1854597 - DNA, 19 bp, Homo sapiens
tctccttgtggcctgggcc

SEQ ID NO: 1854598 - DNA, 20 bp, Homo sapiens
tctccttgtggcctgggcct

SEQ ID NO: 1854599 - DNA, 15 bp, Homo sapiens
tctctccagcccctg

SEQ ID NO: 1854600 - DNA, 16 bp, Homo sapiens
tctctccagcccctgg

SEQ ID NO: 1854601 - DNA, 19 bp, Homo sapiens
tctctccagcccctggatg

SEQ ID NO: 1854602 - DNA, 19 bp, Homo sapiens
tctctgcaatcttctcaga

SEQ ID NO: 1854603 - DNA, 11 bp, Homo sapiens
tctctgctgcc

SEQ ID NO: 1854604 - DNA, 12 bp, Homo sapiens
tctctgctgccg

SEQ ID NO: 1854605 - DNA, 16 bp, Homo sapiens
tctcttatggatgtcc

SEQ ID NO: 1854606 - DNA, 18 bp, Homo sapiens
tctcttgagcctgggagg

SEQ ID NO: 1854607 - DNA, 17 bp, Homo sapiens
tctcttggtcctgctgc

SEQ ID NO: 1854608 - DNA, 15 bp, Homo sapiens
tgaatgtttttctaa

SEQ ID NO: 1854609 - DNA, 17 bp, Homo sapiens
tgacacaaacctgcctg

SEQ ID NO: 1854610 - DNA, 21 bp, Homo sapiens
tgacactggtattcctgcctc

SEQ ID NO: 1854611 - DNA, 22 bp, Homo sapiens
tgacagagcaagtgagaccctg

SEQ ID NO: 1854612 - DNA, 20 bp, Homo sapiens
tgacagctttctgggatgtc

SEQ ID NO: 1854613 - DNA, 19 bp, Homo sapiens
tgacaggcagcagagactt

SEQ ID NO: 1854614 - DNA, 19 bp, Homo sapiens
tgaccaatgggatgaggtc

SEQ ID NO: 1854615 - DNA, 18 bp, Homo sapiens
tgaccagatatatagaag

SEQ ID NO: 1854616 - DNA, 20 bp, Homo sapiens
tgaccagtttaacctgatgc

SEQ ID NO: 1854617 - DNA, 23 bp, Homo sapiens
tgaccagtttaacctgatgcagt

SEQ ID NO: 1854618 - DNA, 14 bp, Homo sapiens
tgaccattctccac

SEQ ID NO: 1854619 - DNA, 18 bp, Homo sapiens
tgaccattctccacctgc

SEQ ID NO: 1854620 - DNA, 19 bp, Homo sapiens
tgaccattctccacctgcc

SEQ ID NO: 1854621 - DNA, 20 bp, Homo sapiens
tgaccattctccacctgcca

SEQ ID NO: 1854622 - DNA, 21 bp, Homo sapiens
tgaccattctccacctgccag

SEQ ID NO: 1854623 - DNA, 12 bp, Homo sapiens
tgacccaggctg

SEQ ID NO: 1854624 - DNA, 17 bp, Homo sapiens
tgacccaggctgggcaa

SEQ ID NO: 1854625 - DNA, 12 bp, Homo sapiens
tgacccatgctg

SEQ ID NO: 1854626 - DNA, 16 bp, Homo sapiens
tgacccatgctgccct

SEQ ID NO: 1854627 - DNA, 19 bp, Homo sapiens
tgacccatgctgccctgtg

SEQ ID NO: 1854628 - DNA, 19 bp, Homo sapiens
tgacctgcctcccttcatg

SEQ ID NO: 1854629 - DNA, 18 bp, Homo sapiens
tgacgcttgtgacagtgc

SEQ ID NO: 1854630 - DNA, 19 bp, Homo sapiens
tgacgcttgtgacagtgcc

SEQ ID NO: 1854631 - DNA, 17 bp, Homo sapiens
tgactgtatctgtgtag

SEQ ID NO: 1854632 - DNA, 18 bp, Homo sapiens
tgactgttcaagagcaca

SEQ ID NO: 1854633 - DNA, 16 bp, Homo sapiens
tgactttggctgcatg

SEQ ID NO: 1854634 - DNA, 22 bp, Homo sapiens
tgacttttctgtccgagctttg

SEQ ID NO: 1854635 - DNA, 13 bp, Homo sapiens
tgagaaattaagt

SEQ ID NO: 1854636 - DNA, 12 bp, Homo sapiens
tgagaacactgt

SEQ ID NO: 1854637 - DNA, 13 bp, Homo sapiens
tgagacagcccgg

SEQ ID NO: 1854638 - DNA, 20 bp, Homo sapiens
tgagacagcccgggctctgc

SEQ ID NO: 1854639 - DNA, 13 bp, Homo sapiens
tgagaccagccaa

SEQ ID NO: 1854640 - DNA, 14 bp, Homo sapiens
tgagacctcagctt

SEQ ID NO: 1854641 - DNA, 24 bp, Homo sapiens
tgagagaccaggcaaagcaagtga

SEQ ID NO: 1854642 - DNA, 14 bp, Homo sapiens
tgagatcagcctgg

SEQ ID NO: 1854643 - DNA, 12 bp, Homo sapiens
tgagcagaacag

SEQ ID NO: 1854644 - DNA, 22 bp, Homo sapiens
tgagcaggccacacttcaaact

SEQ ID NO: 1854645 - DNA, 13 bp, Homo sapiens
tgagcatcaggcc

SEQ ID NO: 1854646 - DNA, 15 bp, Homo sapiens
tgagcatggagctgg

SEQ ID NO: 1854647 - DNA, 18 bp, Homo sapiens
tgagccctgtcctgccta

SEQ ID NO: 1854648 - DNA, 10 bp, Homo sapiens
tgagcctggc

SEQ ID NO: 1854649 - DNA, 16 bp, Homo sapiens
tgagcctggcaagaat

SEQ ID NO: 1854650 - DNA, 22 bp, Homo sapiens
tgagcctgggaggtcaaggctg

SEQ ID NO: 1854651 - DNA, 13 bp, Homo sapiens
tgagcgccacctc

SEQ ID NO: 1854652 - DNA, 14 bp, Homo sapiens
tgagcgccacctct

SEQ ID NO: 1854653 - DNA, 11 bp, Homo sapiens
tgagctcagga

SEQ ID NO: 1854654 - DNA, 20 bp, Homo sapiens
tgagctggatagacttggga

SEQ ID NO: 1854655 - DNA, 21 bp, Homo sapiens
tgagctggatagacttgggat

SEQ ID NO: 1854656 - DNA, 19 bp, Homo sapiens
tgaggaagccgctggggcc

SEQ ID NO: 1854657 - DNA, 15 bp, Homo sapiens
tgaggcccagtgcat

SEQ ID NO: 1854658 - DNA, 17 bp, Homo sapiens
tgaggctagtgtggtgt

SEQ ID NO: 1854659 - DNA, 14 bp, Homo sapiens
tgaggctctgccct

SEQ ID NO: 1854660 - DNA, 18 bp, Homo sapiens
tgaggctctgcccttggt

SEQ ID NO: 1854661 - DNA, 15 bp, Homo sapiens
tgaggctgggctccc

SEQ ID NO: 1854662 - DNA, 21 bp, Homo sapiens
tgaggctgggctcccttccca

SEQ ID NO: 1854663 - DNA, 12 bp, Homo sapiens
tgaggggcctct

SEQ ID NO: 1854664 - DNA, 12 bp, Homo sapiens
tgaggtgggagg

SEQ ID NO: 1854665 - DNA, 16 bp, Homo sapiens
tgaggttgctagagaa

SEQ ID NO: 1854666 - DNA, 15 bp, Homo sapiens
tgaggtttttaagcc

SEQ ID NO: 1854667 - DNA, 15 bp, Homo sapiens
tgagtactacagtcc

SEQ ID NO: 1854668 - DNA, 17 bp, Homo sapiens
tgagtactacagtcctc

SEQ ID NO: 1854669 - DNA, 21 bp, Homo sapiens
tgagtactacagtcctcccat

SEQ ID NO: 1854670 - DNA, 23 bp, Homo sapiens
tgagtactacagtcctcccatct

SEQ ID NO: 1854671 - DNA, 15 bp, Homo sapiens
tgagtctgaaggctg

SEQ ID NO: 1854672 - DNA, 17 bp, Homo sapiens
tgagtctgaaggctggg

SEQ ID NO: 1854673 - DNA, 17 bp, Homo sapiens
tgagtgacagctttctg

SEQ ID NO: 1854674 - DNA, 21 bp, Homo sapiens
tgagtgggtgaataatacagt

SEQ ID NO: 1854675 - DNA, 17 bp, Homo sapiens
tgagttttcttctgtga

SEQ ID NO: 1854676 - DNA, 18 bp, Homo sapiens
tgagttttcttctgtgat

SEQ ID NO: 1854677 - DNA, 14 bp, Homo sapiens
tgataatcaactgg

SEQ ID NO: 1854678 - DNA, 17 bp, Homo sapiens
tgatacttcgacactgt

SEQ ID NO: 1854679 - DNA, 18 bp, Homo sapiens
tgatacttcgacactgtt

SEQ ID NO: 1854680 - DNA, 18 bp, Homo sapiens
tgatagcacagaccctgc

SEQ ID NO: 1854681 - DNA, 21 bp, Homo sapiens
tgatagcacagaccctgccct

SEQ ID NO: 1854682 - DNA, 22 bp, Homo sapiens
tgatagcacagaccctgccctg

SEQ ID NO: 1854683 - DNA, 14 bp, Homo sapiens
tgatcacagcagct

SEQ ID NO: 1854684 - DNA, 19 bp, Homo sapiens
tgatgccaagttgtttgag

SEQ ID NO: 1854685 - DNA, 17 bp, Homo sapiens
tgatgcttcttcagaga

SEQ ID NO: 1854686 - DNA, 21 bp, Homo sapiens
tgatgcttcttcagagactcc

SEQ ID NO: 1854687 - DNA, 22 bp, Homo sapiens
tgatggagccccaccttgtctg

SEQ ID NO: 1854688 - DNA, 15 bp, Homo sapiens
tgatggcttctccag

SEQ ID NO: 1854689 - DNA, 13 bp, Homo sapiens
tgatggggccctg

SEQ ID NO: 1854690 - DNA, 14 bp, Homo sapiens
tgatggggccctgc

SEQ ID NO: 1854691 - DNA, 15 bp, Homo sapiens
tgatggggccctgcc

SEQ ID NO: 1854692 - DNA, 22 bp, Homo sapiens
tgatggggccctgcctcctttg

SEQ ID NO: 1854693 - DNA, 14 bp, Homo sapiens
tgatgttggctggg

SEQ ID NO: 1854694 - DNA, 16 bp, Homo sapiens
tgatgttggctgggaa

SEQ ID NO: 1854695 - DNA, 19 bp, Homo sapiens
tgattaaccacttcagctg

SEQ ID NO: 1854696 - DNA, 13 bp, Homo sapiens
tgattatatttca

SEQ ID NO: 1854697 - DNA, 12 bp, Homo sapiens
tgattcaattca

SEQ ID NO: 1854698 - DNA, 21 bp, Homo sapiens
tgattcaattcaacactccct

SEQ ID NO: 1854699 - DNA, 22 bp, Homo sapiens
tgattcacatgctaaagccagg

SEQ ID NO: 1854700 - DNA, 13 bp, Homo sapiens
tgattcagacagc

SEQ ID NO: 1854701 - DNA, 18 bp, Homo sapiens
tgattcagacagctgcct

SEQ ID NO: 1854702 - DNA, 13 bp, Homo sapiens
tgattcagctctg

SEQ ID NO: 1854703 - DNA, 11 bp, Homo sapiens
tgattctcagg

SEQ ID NO: 1854704 - DNA, 15 bp, Homo sapiens
tgattctcagggtct

SEQ ID NO: 1854705 - DNA, 23 bp, Homo sapiens
tgattctcagggtctctgctgcc

SEQ ID NO: 1854706 - DNA, 18 bp, Homo sapiens
tgattgggaggtgcgtgt

SEQ ID NO: 1854707 - DNA, 16 bp, Homo sapiens
tgatttcacagtgtgt

SEQ ID NO: 1854708 - DNA, 15 bp, Homo sapiens
tgattttcattgctg

SEQ ID NO: 1854709 - DNA, 14 bp, Homo sapiens
tgcaaaaagggtca

SEQ ID NO: 1854710 - DNA, 22 bp, Homo sapiens
tgcaatgaagtctctgaagtga

SEQ ID NO: 1854711 - DNA, 17 bp, Homo sapiens
tgcaatgtatagtgtct

SEQ ID NO: 1854712 - DNA, 15 bp, Homo sapiens
tgcacaaactcacca

SEQ ID NO: 1854713 - DNA, 15 bp, Homo sapiens
tgcacaagctccaag

SEQ ID NO: 1854714 - DNA, 18 bp, Homo sapiens
tgcacaagctccaagctc

SEQ ID NO: 1854715 - DNA, 20 bp, Homo sapiens
tgcacaagctccaagctccc

SEQ ID NO: 1854716 - DNA, 22 bp, Homo sapiens
tgcacaggtgccgccagctgcc

SEQ ID NO: 1854717 - DNA, 20 bp, Homo sapiens
tgcacccacctgttttctga

SEQ ID NO: 1854718 - DNA, 14 bp, Homo sapiens
tgcaccggctggcc

SEQ ID NO: 1854719 - DNA, 19 bp, Homo sapiens
tgcaccggctggcctggcc

SEQ ID NO: 1854720 - DNA, 16 bp, Homo sapiens
tgcactccagcctggg

SEQ ID NO: 1854721 - DNA, 12 bp, Homo sapiens
ttggtgtttttt

SEQ ID NO: 1854722 - DNA, 19 bp, Homo sapiens
ttggttaggcattgtggga

SEQ ID NO: 1854723 - DNA, 17 bp, Homo sapiens
ttggttcttgtactcta

SEQ ID NO: 1854724 - DNA, 15 bp, Homo sapiens
ttggttggctggcct

SEQ ID NO: 1854725 - DNA, 12 bp, Homo sapiens
ttgtaaatataa

SEQ ID NO: 1854726 - DNA, 13 bp, Homo sapiens
ttgtaaatataaa

SEQ ID NO: 1854727 - DNA, 16 bp, Homo sapiens
ttgtaaatataaagac

SEQ ID NO: 1854728 - DNA, 13 bp, Homo sapiens
ttgtattaagaat

SEQ ID NO: 1854729 - DNA, 20 bp, Homo sapiens
ttgtccccaccgcagacagg

SEQ ID NO: 1854730 - DNA, 21 bp, Homo sapiens
ttgtcctttttcactttgaaa

SEQ ID NO: 1854731 - DNA, 11 bp, Homo sapiens
ttgtctgtctc

SEQ ID NO: 1854732 - DNA, 22 bp, Homo sapiens
ttgtcttaaaaagtggaaaaat

SEQ ID NO: 1854733 - DNA, 24 bp, Homo sapiens
ttgtctttggaccctgaggcccag

SEQ ID NO: 1854734 - DNA, 21 bp, Homo sapiens
ttgtgaggaagccgctggggc

SEQ ID NO: 1854735 - DNA, 14 bp, Homo sapiens
ttgtgatgcatttt

SEQ ID NO: 1854736 - DNA, 19 bp, Homo sapiens
ttgtgcaatgtgtataaac

SEQ ID NO: 1854737 - DNA, 18 bp, Homo sapiens
tggagaaaattggaactc

SEQ ID NO: 1854738 - DNA, 19 bp, Homo sapiens
tggagaaaattggaactct

SEQ ID NO: 1854739 - DNA, 12 bp, Homo sapiens
tggagacaccac

SEQ ID NO: 1854740 - DNA, 16 bp, Homo sapiens
tggagacaccaccacc

SEQ ID NO: 1854741 - DNA, 18 bp, Homo sapiens
tggagactcctaggcagg

SEQ ID NO: 1854742 - DNA, 18 bp, Homo sapiens
tggagagctggagcctgg

SEQ ID NO: 1854743 - DNA, 14 bp, Homo sapiens
tggagcctggtgcc

SEQ ID NO: 1854744 - DNA, 11 bp, Homo sapiens
tggaggagcaa

SEQ ID NO: 1854745 - DNA, 18 bp, Homo sapiens
tggaggagcaaaggctga

SEQ ID NO: 1854746 - DNA, 13 bp, Homo sapiens
tggaggagcagtg

SEQ ID NO: 1854747 - DNA, 22 bp, Homo sapiens
tggaggagcagtgcaggcacag

SEQ ID NO: 1854748 - DNA, 14 bp, Homo sapiens
tggagttcaccttg

SEQ ID NO: 1854749 - DNA, 18 bp, Homo sapiens
tggatagacttgggatgg

SEQ ID NO: 1854750 - DNA, 13 bp, Homo sapiens
tggatgcagcctc

SEQ ID NO: 1854751 - DNA, 13 bp, Homo sapiens
tggatgcctgatt

SEQ ID NO: 1854752 - DNA, 14 bp, Homo sapiens
tggatgtccccagc

SEQ ID NO: 1854753 - DNA, 19 bp, Homo sapiens
tggatgttatgaacagctg

SEQ ID NO: 1854754 - DNA, 13 bp, Homo sapiens
tggattgtccccg

SEQ ID NO: 1854755 - DNA, 19 bp, Homo sapiens
tggcaaggacacagatgaa

SEQ ID NO: 1854756 - DNA, 20 bp, Homo sapiens
tggcaaggctgtgctccctg

SEQ ID NO: 1854757 - DNA, 18 bp, Homo sapiens
tggcaccagcagcctgga

SEQ ID NO: 1854758 - DNA, 14 bp, Homo sapiens
tggcactgcttcca

SEQ ID NO: 1854759 - DNA, 22 bp, Homo sapiens
tggcactgcttccagtgaggct

SEQ ID NO: 1854760 - DNA, 15 bp, Homo sapiens
tggcagcctcttcaa

SEQ ID NO: 1854761 - DNA, 15 bp, Homo sapiens
tggcagctcagagag

SEQ ID NO: 1854762 - DNA, 16 bp, Homo sapiens
tggcagctcagagagg

SEQ ID NO: 1854763 - DNA, 18 bp, Homo sapiens
tggcaggatggcctggcc

SEQ ID NO: 1854764 - DNA, 19 bp, Homo sapiens
tggcaggatggcctggcca

SEQ ID NO: 1854765 - DNA, 20 bp, Homo sapiens
tggcaggatggcctggccag

SEQ ID NO: 1854766 - DNA, 15 bp, Homo sapiens
tggcatcagctggcg

SEQ ID NO: 1854767 - DNA, 17 bp, Homo sapiens
tggcatttggcctcttg

SEQ ID NO: 1854768 - DNA, 20 bp, Homo sapiens
tggccaagatcacagtggcc

SEQ ID NO: 1854769 - DNA, 13 bp, Homo sapiens
tggccagagagcc

SEQ ID NO: 1854770 - DNA, 23 bp, Homo sapiens
tggccagagagcctggtgctgct

SEQ ID NO: 1854771 - DNA, 14 bp, Homo sapiens
tggccatctctgga

SEQ ID NO: 1854772 - DNA, 16 bp, Homo sapiens
tggccatctctggatg

SEQ ID NO: 1854773 - DNA, 15 bp, Homo sapiens
tggccatctgctcct

SEQ ID NO: 1854774 - DNA, 15 bp, Homo sapiens
tggccatgcaggagg

SEQ ID NO: 1854775 - DNA, 16 bp, Homo sapiens
tggccatgcaggaggt

SEQ ID NO: 1854776 - DNA, 19 bp, Homo sapiens
tggccatgcaggaggtgga

SEQ ID NO: 1854777 - DNA, 14 bp, Homo sapiens
tggcccactgcatc

SEQ ID NO: 1854778 - DNA, 13 bp, Homo sapiens
tggcccctcaggg

SEQ ID NO: 1854779 - DNA, 22 bp, Homo sapiens
tggcccctcagggtccctggtg

SEQ ID NO: 1854780 - DNA, 21 bp, Homo sapiens
tggccctcccagtacctcctg

SEQ ID NO: 1854781 - DNA, 17 bp, Homo sapiens
tggccgggaccccgagc

SEQ ID NO: 1854782 - DNA, 23 bp, Homo sapiens
tggccgggcgcggtggctcacgc

SEQ ID NO: 1854783 - DNA, 19 bp, Homo sapiens
tggcctcccaactcacccc

SEQ ID NO: 1854784 - DNA, 17 bp, Homo sapiens
tggcctctgcactcccc

SEQ ID NO: 1854785 - DNA, 21 bp, Homo sapiens
tggcctctgctgatcctccca

SEQ ID NO: 1854786 - DNA, 17 bp, Homo sapiens
tggcctcttgtagtctt

SEQ ID NO: 1854787 - DNA, 18 bp, Homo sapiens
tggcctggcccctcaggg

SEQ ID NO: 1854788 - DNA, 23 bp, Homo sapiens
tggcctgttttagaaggttctct

SEQ ID NO: 1854789 - DNA, 23 bp, Homo sapiens
tggcgcagcatattcaggaagct

SEQ ID NO: 1854790 - DNA, 21 bp, Homo sapiens
tggcggctggggtcccagcag

SEQ ID NO: 1854791 - DNA, 14 bp, Homo sapiens
tggcgtctgctctg

SEQ ID NO: 1854792 - DNA, 20 bp, Homo sapiens
tggcgtctgctctggtggct

SEQ ID NO: 1854793 - DNA, 13 bp, Homo sapiens
tggctacatctcc

SEQ ID NO: 1854794 - DNA, 17 bp, Homo sapiens
tggctagtgtctatcag

SEQ ID NO: 1854795 - DNA, 13 bp, Homo sapiens
tggctcacgcctg

SEQ ID NO: 1854796 - DNA, 19 bp, Homo sapiens
tggctctttggagatcaag

SEQ ID NO: 1854797 - DNA, 13 bp, Homo sapiens
tggctgaactcat

SEQ ID NO: 1854798 - DNA, 13 bp, Homo sapiens
tggctgaaggact

SEQ ID NO: 1854799 - DNA, 13 bp, Homo sapiens
tggctgctgaagg

SEQ ID NO: 1854800 - DNA, 15 bp, Homo sapiens
tggctgggaactcac

SEQ ID NO: 1854801 - DNA, 22 bp, Homo sapiens
tggctggttagaggttcccttt

SEQ ID NO: 1854802 - DNA, 17 bp, Homo sapiens
tggcttaagtgagcaga

SEQ ID NO: 1854803 - DNA, 20 bp, Homo sapiens
tgggaaagcccctgcccctc

SEQ ID NO: 1854804 - DNA, 16 bp, Homo sapiens
tgggaaaggggaagtt

SEQ ID NO: 1854805 - DNA, 22 bp, Homo sapiens
tgggaataatagcacatgattt

SEQ ID NO: 1854806 - DNA, 12 bp, Homo sapiens
tgggacaccctg

SEQ ID NO: 1854807 - DNA, 13 bp, Homo sapiens
tgggactggcctc

SEQ ID NO: 1854808 - DNA, 16 bp, Homo sapiens
tgggagagccttccag

SEQ ID NO: 1854809 - DNA, 18 bp, Homo sapiens
tgggaggatctcttgagc

SEQ ID NO: 1854810 - DNA, 22 bp, Homo sapiens
tgggaggattgcttgagctcag

SEQ ID NO: 1854811 - DNA, 19 bp, Homo sapiens
tgggaggccaaggtgggag

SEQ ID NO: 1854812 - DNA, 20 bp, Homo sapiens
tgggaggccaaggtgggagg

SEQ ID NO: 1854813 - DNA, 14 bp, Homo sapiens
tgggaggtgcgtgt

SEQ ID NO: 1854814 - DNA, 21 bp, Homo sapiens
tgggaggtgcgtgttcagcag

SEQ ID NO: 1854815 - DNA, 23 bp, Homo sapiens
tgggaggtgcgtgttcagcagaa

SEQ ID NO: 1854816 - DNA, 13 bp, Homo sapiens
tgggatcctccag

SEQ ID NO: 1854817 - DNA, 15 bp, Homo sapiens
tgggatcctccaggt

SEQ ID NO: 1854818 - DNA, 18 bp, Homo sapiens
tgggatcctccaggtgca

SEQ ID NO: 1854819 - DNA, 14 bp, Homo sapiens
tgggatgaggtcac

SEQ ID NO: 1854820 - DNA, 18 bp, Homo sapiens
tgggatgtcacagtccaa

SEQ ID NO: 1854821 - DNA, 11 bp, Homo sapiens
tgggcagagca

SEQ ID NO: 1854822 - DNA, 14 bp, Homo sapiens
tgggcagagcagag

SEQ ID NO: 1854823 - DNA, 10 bp, Homo sapiens
tgggcagctc

SEQ ID NO: 1854824 - DNA, 23 bp, Homo sapiens
tgggcaggactcagctccccaga

SEQ ID NO: 1854825 - DNA, 22 bp, Homo sapiens
tgggcatagatgcaggtgagcc

SEQ ID NO: 1854826 - DNA, 18 bp, Homo sapiens
tgggccagaatttcaaac

SEQ ID NO: 1854827 - DNA, 14 bp, Homo sapiens
tgggctcccttccc

SEQ ID NO: 1854828 - DNA, 18 bp, Homo sapiens
tgggctcccttcccacct

SEQ ID NO: 1854829 - DNA, 21 bp, Homo sapiens
tgggctcccttcccacctctc

SEQ ID NO: 1854830 - DNA, 17 bp, Homo sapiens
tgggctgaacactccaa

SEQ ID NO: 1854831 - DNA, 18 bp, Homo sapiens
tgggctgggttctaccca

SEQ ID NO: 1854832 - DNA, 19 bp, Homo sapiens
tgggctgggttctacccag

SEQ ID NO: 1854833 - DNA, 14 bp, Homo sapiens
tgggcttcccaagg

SEQ ID NO: 1854834 - DNA, 19 bp, Homo sapiens
tgggcttcccagtggctgc

SEQ ID NO: 1854835 - DNA, 21 bp, Homo sapiens
tgggcttcccagtggctgctg

SEQ ID NO: 1854836 - DNA, 22 bp, Homo sapiens
tggggaaaatggccatgcagga

SEQ ID NO: 1854837 - DNA, 23 bp, Homo sapiens
tggggaaaatggccatgcaggag

SEQ ID NO: 1854838 - DNA, 12 bp, Homo sapiens
tggggccctgcc

SEQ ID NO: 1854839 - DNA, 14 bp, Homo sapiens
tggggccctgcctc

SEQ ID NO: 1854840 - DNA, 15 bp, Homo sapiens
tggggccctgcctcc

SEQ ID NO: 1854841 - DNA, 16 bp, Homo sapiens
tggggccctgcctcct

SEQ ID NO: 1854842 - DNA, 18 bp, Homo sapiens
tggggctaggggctgggg

SEQ ID NO: 1854843 - DNA, 20 bp, Homo sapiens
tggggctgcaccggctggcc

SEQ ID NO: 1854844 - DNA, 22 bp, Homo sapiens
tggggctgtcgggggctgtgga

SEQ ID NO: 1854845 - DNA, 19 bp, Homo sapiens
tggggggctgaggtgggag

SEQ ID NO: 1854846 - DNA, 21 bp, Homo sapiens
tggggtaccaagagactcctt

SEQ ID NO: 1854847 - DNA, 18 bp, Homo sapiens
tggggtcactctggcagc

SEQ ID NO: 1854848 - DNA, 15 bp, Homo sapiens
tggggtcccagcagc

SEQ ID NO: 1854849 - DNA, 19 bp, Homo sapiens
tgggtcgggagaggggacg

SEQ ID NO: 1854850 - DNA, 15 bp, Homo sapiens
tgggtctcagtgtcc

SEQ ID NO: 1854851 - DNA, 16 bp, Homo sapiens
tgggtctcagtgtcct

SEQ ID NO: 1854852 - DNA, 15 bp, Homo sapiens
tgggtgcgtctccag

SEQ ID NO: 1854853 - DNA, 19 bp, Homo sapiens
tgggtgcgtctccagtcat

SEQ ID NO: 1854854 - DNA, 17 bp, Homo sapiens
tgggtggcaccagcagc

SEQ ID NO: 1854855 - DNA, 15 bp, Homo sapiens
tgggtggcactgcca

SEQ ID NO: 1854856 - DNA, 16 bp, Homo sapiens
tgggttagggaaaaca

SEQ ID NO: 1854857 - DNA, 19 bp, Homo sapiens
tgggttttctatttgaaca

SEQ ID NO: 1854858 - DNA, 16 bp, Homo sapiens
tggtaggggagggcag

SEQ ID NO: 1854859 - DNA, 17 bp, Homo sapiens
tggtaggggagggcagg

SEQ ID NO: 1854860 - DNA, 19 bp, Homo sapiens
tggtccatagagagcaaga

SEQ ID NO: 1854861 - DNA, 18 bp, Homo sapiens
tggtcccccttccatgga

SEQ ID NO: 1854862 - DNA, 23 bp, Homo sapiens
tggtcctgctgcagttgccagtc

SEQ ID NO: 1854863 - DNA, 15 bp, Homo sapiens
tggtctacactgtgc

SEQ ID NO: 1854864 - DNA, 16 bp, Homo sapiens
tggtctacactgtgct

SEQ ID NO: 1854865 - DNA, 17 bp, Homo sapiens
tggtctcaggcagcacc

SEQ ID NO: 1854866 - DNA, 16 bp, Homo sapiens
tggtctctaggctggg

SEQ ID NO: 1854867 - DNA, 20 bp, Homo sapiens
tggtgccacaaataaaatgg

SEQ ID NO: 1854868 - DNA, 19 bp, Homo sapiens
tggtggcttaagtgagcag

SEQ ID NO: 1854869 - DNA, 16 bp, Homo sapiens
tggtgggggcctcggt

SEQ ID NO: 1854870 - DNA, 18 bp, Homo sapiens
tggtgggggcctcggtgt

SEQ ID NO: 1854871 - DNA, 23 bp, Homo sapiens
tggtgtgaactaaactttcacac

SEQ ID NO: 1854872 - DNA, 18 bp, Homo sapiens
tggttaggcattgtggga

SEQ ID NO: 1854873 - DNA, 19 bp, Homo sapiens
tggtttggccatctctgga

SEQ ID NO: 1854874 - DNA, 13 bp, Homo sapiens
tgtaaatataaag

SEQ ID NO: 1854875 - DNA, 12 bp, Homo sapiens
tgtaacaacaat

SEQ ID NO: 1854876 - DNA, 19 bp, Homo sapiens
tgtaagagcttgctccaga

SEQ ID NO: 1854877 - DNA, 12 bp, Homo sapiens
tgtaattatata

SEQ ID NO: 1854878 - DNA, 20 bp, Homo sapiens
tgtacaaggacagcccctcc

SEQ ID NO: 1854879 - DNA, 12 bp, Homo sapiens
tgtacagagccc

SEQ ID NO: 1854880 - DNA, 16 bp, Homo sapiens
tgtacagagcccacgc

SEQ ID NO: 1854881 - DNA, 16 bp, Homo sapiens
tgtagcgtctttcttt

SEQ ID NO: 1854882 - DNA, 20 bp, Homo sapiens
tgtaggcataaagtcagggg

SEQ ID NO: 1854883 - DNA, 21 bp, Homo sapiens
tgtagtcttggctaaggaaat

SEQ ID NO: 1854884 - DNA, 20 bp, Homo sapiens
tgtagttttgtgatgcattt

SEQ ID NO: 1854885 - DNA, 23 bp, Homo sapiens
tgtataaacaagaaaaataaaga

SEQ ID NO: 1854886 - DNA, 16 bp, Homo sapiens
tgtattaagaatgaaa

SEQ ID NO: 1854887 - DNA, 15 bp, Homo sapiens
tgtatttgtttgcat

SEQ ID NO: 1854888 - DNA, 19 bp, Homo sapiens
tgtcacagtccaaccagaa

SEQ ID NO: 1854889 - DNA, 20 bp, Homo sapiens
tgtcacagtccaaccagaaa

SEQ ID NO: 1854890 - DNA, 22 bp, Homo sapiens
tgtcacagtccaaccagaaaca

SEQ ID NO: 1854891 - DNA, 16 bp, Homo sapiens
tgtcacgattgtcatc

SEQ ID NO: 1854892 - DNA, 15 bp, Homo sapiens
tgtcagcatagaagt

SEQ ID NO: 1854893 - DNA, 18 bp, Homo sapiens
tgtcagttgttatttatt

SEQ ID NO: 1854894 - DNA, 17 bp, Homo sapiens
tgtccaagaagcccagg

SEQ ID NO: 1854895 - DNA, 18 bp, Homo sapiens
tgtccacaggcttctgag

SEQ ID NO: 1854896 - DNA, 19 bp, Homo sapiens
tgtccccaccgcagacagg

SEQ ID NO: 1854897 - DNA, 16 bp, Homo sapiens
tgtccccgacccttgc

SEQ ID NO: 1854898 - DNA, 20 bp, Homo sapiens
tgtcctttttcactttgaaa

SEQ ID NO: 1854899 - DNA, 13 bp, Homo sapiens
tgtcgtgggatgg

SEQ ID NO: 1854900 - DNA, 18 bp, Homo sapiens
tgtctaggactgcagtgt

SEQ ID NO: 1854901 - DNA, 18 bp, Homo sapiens
tgtctagggtgtgattta

SEQ ID NO: 1854902 - DNA, 15 bp, Homo sapiens
tgtctagttgtttga

SEQ ID NO: 1854903 - DNA, 18 bp, Homo sapiens
tgtctccctcccctctca

SEQ ID NO: 1854904 - DNA, 21 bp, Homo sapiens
tgtctccctcccctctcagaa

SEQ ID NO: 1854905 - DNA, 17 bp, Homo sapiens
tgtctccttaacactga

SEQ ID NO: 1854906 - DNA, 20 bp, Homo sapiens
tgtctcttatggatgtcccc

SEQ ID NO: 1854907 - DNA, 19 bp, Homo sapiens
tgtctcttggtcctgctgc

SEQ ID NO: 1854908 - DNA, 20 bp, Homo sapiens
tgtctcttggtcctgctgca

SEQ ID NO: 1854909 - DNA, 18 bp, Homo sapiens
tgtctgctaaataaacat

SEQ ID NO: 1854910 - DNA, 15 bp, Homo sapiens
tgtctggattcccag

SEQ ID NO: 1854911 - DNA, 21 bp, Homo sapiens
tgtctgtctccctcccctctc

SEQ ID NO: 1854912 - DNA, 22 bp, Homo sapiens
tgtcttcatacctacatgtatt

SEQ ID NO: 1854913 - DNA, 21 bp, Homo sapiens
tgtcttttcttgcatgaggct

SEQ ID NO: 1854914 - DNA, 23 bp, Homo sapiens
tgtgaaaagaaaaatgagcctgg

SEQ ID NO: 1854915 - DNA, 14 bp, Homo sapiens
tgtgaaaggaaaga

SEQ ID NO: 1854916 - DNA, 14 bp, Homo sapiens
tgtgaagagaacca

SEQ ID NO: 1854917 - DNA, 15 bp, Homo sapiens
tgtgacaggcagcag

SEQ ID NO: 1854918 - DNA, 16 bp, Homo sapiens
tgtgacaggcagcaga

SEQ ID NO: 1854919 - DNA, 15 bp, Homo sapiens
tgtgacagtgcctct

SEQ ID NO: 1854920 - DNA, 18 bp, Homo sapiens
tgtgagcatcacagtttt

SEQ ID NO: 1854921 - DNA, 18 bp, Homo sapiens
tgtgagctggatagactt

SEQ ID NO: 1854922 - DNA, 20 bp, Homo sapiens
tgtgaggaagccgctggggc

SEQ ID NO: 1854923 - DNA, 17 bp, Homo sapiens
tgtgatgcattttatag

SEQ ID NO: 1854924 - DNA, 15 bp, Homo sapiens
tgtgatggggccctg

SEQ ID NO: 1854925 - DNA, 17 bp, Homo sapiens
tgtgatggggccctgcc

SEQ ID NO: 1854926 - DNA, 18 bp, Homo sapiens
tgtgatggggccctgcct

SEQ ID NO: 1854927 - DNA, 20 bp, Homo sapiens
tgtgatggggccctgcctcc

SEQ ID NO: 1854928 - DNA, 11 bp, Homo sapiens
tgtgcaatgtg

SEQ ID NO: 1854929 - DNA, 14 bp, Homo sapiens
tgtgcaatgtgtat

SEQ ID NO: 1854930 - DNA, 15 bp, Homo sapiens
tgtgcacatctgttt

SEQ ID NO: 1854931 - DNA, 21 bp, Homo sapiens
tgtgcccccatgtaagcaccc

SEQ ID NO: 1854932 - DNA, 14 bp, Homo sapiens
tgtgcctaatgtgt

SEQ ID NO: 1854933 - DNA, 19 bp, Homo sapiens
tgtgctgagtctgaaggct

SEQ ID NO: 1854934 - DNA, 14 bp, Homo sapiens
tgtgctgccctgcc

SEQ ID NO: 1854935 - DNA, 21 bp, Homo sapiens
tgtgctgccctgcccacctgg

SEQ ID NO: 1854936 - DNA, 19 bp, Homo sapiens
tgtggaaaaccaggaaaag

SEQ ID NO: 1854937 - DNA, 22 bp, Homo sapiens
tgtggagttcaccttggaaggg

SEQ ID NO: 1854938 - DNA, 15 bp, Homo sapiens
tgtggcctgggcctc

SEQ ID NO: 1854939 - DNA, 16 bp, Homo sapiens
tgtggtcccaccccac

SEQ ID NO: 1854940 - DNA, 14 bp, Homo sapiens
tgtggtgtttcctg

SEQ ID NO: 1854941 - DNA, 16 bp, Homo sapiens
tgtggtgtttcctggc

SEQ ID NO: 1854942 - DNA, 20 bp, Homo sapiens
tgtggtgtttcctggcactg

SEQ ID NO: 1854943 - DNA, 12 bp, Homo sapiens
tgtggtttcatt

SEQ ID NO: 1854944 - DNA, 22 bp, Homo sapiens
tgtgtataaacaagaaaaataa

SEQ ID NO: 1854945 - DNA, 17 bp, Homo sapiens
tgtgtctcttggtcctg

SEQ ID NO: 1854946 - DNA, 15 bp, Homo sapiens
tgtgtctgccaaaca

SEQ ID NO: 1854947 - DNA, 14 bp, Homo sapiens
tgtgtggtcaacat

SEQ ID NO: 1854948 - DNA, 22 bp, Homo sapiens
tgttagaggatccctctctgga

SEQ ID NO: 1854949 - DNA, 15 bp, Homo sapiens
tgttatatataaata

SEQ ID NO: 1854950 - DNA, 18 bp, Homo sapiens
tgttatatataaatatat

SEQ ID NO: 1854951 - DNA, 13 bp, Homo sapiens
tgttatgaacagc

SEQ ID NO: 1854952 - DNA, 22 bp, Homo sapiens
tgttatgtcaaactgtcttggc

SEQ ID NO: 1854953 - DNA, 19 bp, Homo sapiens
tgttatttattgaaatgat

SEQ ID NO: 1854954 - DNA, 15 bp, Homo sapiens
tgttctctcttctcc

SEQ ID NO: 1854955 - DNA, 12 bp, Homo sapiens
tgttctctgccc

SEQ ID NO: 1854956 - DNA, 13 bp, Homo sapiens
tgttctctgccct

SEQ ID NO: 1854957 - DNA, 15 bp, Homo sapiens
tgttctctgccctcc

SEQ ID NO: 1854958 - DNA, 13 bp, Homo sapiens
tgttctggctctt

SEQ ID NO: 1854959 - DNA, 20 bp, Homo sapiens
tgttctggctcttccaggct

SEQ ID NO: 1854960 - DNA, 10 bp, Homo sapiens
tgttctgttt

SEQ ID NO: 1854961 - DNA, 18 bp, Homo sapiens
tgttcttagctcaatgag

SEQ ID NO: 1854962 - DNA, 20 bp, Homo sapiens
tgttctttggaaatacacag

SEQ ID NO: 1854963 - DNA, 17 bp, Homo sapiens
tgttgagacctcagctt

SEQ ID NO: 1854964 - DNA, 14 bp, Homo sapiens
tgttggcagcctct

SEQ ID NO: 1854965 - DNA, 22 bp, Homo sapiens
tgttggctgggaactcacctgg

SEQ ID NO: 1854966 - DNA, 15 bp, Homo sapiens
tgttggttggttttc

SEQ ID NO: 1854967 - DNA, 13 bp, Homo sapiens
tgttgtcagctga

SEQ ID NO: 1854968 - DNA, 14 bp, Homo sapiens
tgttgtcagctgaa

SEQ ID NO: 1854969 - DNA, 13 bp, Homo sapiens
tgtttagacttta

SEQ ID NO: 1854970 - DNA, 19 bp, Homo sapiens
tgtttagactttaacataa

SEQ ID NO: 1854971 - DNA, 15 bp, Homo sapiens
tgtttcctggcactg

SEQ ID NO: 1854972 - DNA, 20 bp, Homo sapiens
tgtttcctggcactgcttcc

SEQ ID NO: 1854973 - DNA, 22 bp, Homo sapiens
tgtttcctggcactgcttccag

SEQ ID NO: 1854974 - DNA, 23 bp, Homo sapiens
tgtttcctggcactgcttccagt

SEQ ID NO: 1854975 - DNA, 14 bp, Homo sapiens
tgtttgagaaatta

SEQ ID NO: 1854976 - DNA, 22 bp, Homo sapiens
tgtttgagcatcgcttaggaga

SEQ ID NO: 1854977 - DNA, 17 bp, Homo sapiens
tgtttgattcagacagc

SEQ ID NO: 1854978 - DNA, 15 bp, Homo sapiens
tgtttggaggagcaa

SEQ ID NO: 1854979 - DNA, 18 bp, Homo sapiens
tgttttatgacttcatta

SEQ ID NO: 1854980 - DNA, 14 bp, Homo sapiens
tgttttcaaatgtt

SEQ ID NO: 1854981 - DNA, 15 bp, Homo sapiens
tgttttctcttgaga

SEQ ID NO: 1854982 - DNA, 17 bp, Homo sapiens
tgttttctgaaacacac

SEQ ID NO: 1854983 - DNA, 22 bp, Homo sapiens
tgttttctgaaacacacgagca

SEQ ID NO: 1854984 - DNA, 17 bp, Homo sapiens
ttaaaaaagataaacac

SEQ ID NO: 1854985 - DNA, 16 bp, Homo sapiens
ttaaaaactcacttac

SEQ ID NO: 1854986 - DNA, 14 bp, Homo sapiens
ttaaaacccaagtg

SEQ ID NO: 1854987 - DNA, 13 bp, Homo sapiens
ttaaaaaaaatcc

SEQ ID NO: 1854988 - DNA, 15 bp, Homo sapiens
ttaaaaaagataaac

SEQ ID NO: 1854989 - DNA, 18 bp, Homo sapiens
ttaaaaaagataaacaca

SEQ ID NO: 1854990 - DNA, 19 bp, Homo sapiens
ttaaaatgaaatgcatttt

SEQ ID NO: 1854991 - DNA, 20 bp, Homo sapiens
ttaaacattggttcttgtat

SEQ ID NO: 1854992 - DNA, 22 bp, Homo sapiens
ttaaacattggttcttgtatta

SEQ ID NO: 1854993 - DNA, 19 bp, Homo sapiens
ttaaacgtgatttttaaat

SEQ ID NO: 1854994 - DNA, 21 bp, Homo sapiens
ttaaagaaaaaaatgtatttt

SEQ ID NO: 1854995 - DNA, 20 bp, Homo sapiens
ttaaataaaatttttatgta

SEQ ID NO: 1854996 - DNA, 13 bp, Homo sapiens
ttaacataagcta

SEQ ID NO: 1854997 - DNA, 13 bp, Homo sapiens
ttaacctgatgca

SEQ ID NO: 1854998 - DNA, 17 bp, Homo sapiens
tggagttcaccttggaa

SEQ ID NO: 1854999 - DNA, 19 bp, Homo sapiens
tggagttcaccttggaagg

SEQ ID NO: 1855000 - DNA, 22 bp, Homo sapiens
tggatagacttgggatggggag

SEQ ID NO: 1855001 - DNA, 22 bp, Homo sapiens
tggatctccctgagatgggctt

SEQ ID NO: 1855002 - DNA, 21 bp, Homo sapiens
tggatgcagcctcacagtcct

SEQ ID NO: 1855003 - DNA, 15 bp, Homo sapiens
tggatgtccccagca

SEQ ID NO: 1855004 - DNA, 16 bp, Homo sapiens
tggatgttatgaacag

SEQ ID NO: 1855005 - DNA, 17 bp, Homo sapiens
tggatgttatgaacagc

SEQ ID NO: 1855006 - DNA, 14 bp, Homo sapiens
tggattcatattta

SEQ ID NO: 1855007 - DNA, 17 bp, Homo sapiens
tggattcatatttaatt

SEQ ID NO: 1855008 - DNA, 21 bp, Homo sapiens
tggattgtccccgacccttgc

SEQ ID NO: 1855009 - DNA, 19 bp, Homo sapiens
tggattgtgcctaatgtgt

SEQ ID NO: 1855010 - DNA, 23 bp, Homo sapiens
tggattgtgcctaatgtgtttga

SEQ ID NO: 1855011 - DNA, 12 bp, Homo sapiens
tggcaaaaaggc

SEQ ID NO: 1855012 - DNA, 13 bp, Homo sapiens
tggcaaagccaga

SEQ ID NO: 1855013 - DNA, 15 bp, Homo sapiens
tggcaaggctgtgct

SEQ ID NO: 1855014 - DNA, 18 bp, Homo sapiens
tggcactgcttccagtga

SEQ ID NO: 1855015 - DNA, 15 bp, Homo sapiens
tggcactggatgcag

SEQ ID NO: 1855016 - DNA, 18 bp, Homo sapiens
tggcactggatgcagaaa

SEQ ID NO: 1855017 - DNA, 12 bp, Homo sapiens
tggcagaggagg

SEQ ID NO: 1855018 - DNA, 23 bp, Homo sapiens
tggcagctcacctctcccttgga

SEQ ID NO: 1855019 - DNA, 14 bp, Homo sapiens
tggcatcagctggc

SEQ ID NO: 1855020 - DNA, 17 bp, Homo sapiens
tggcatttggtctcagg

SEQ ID NO: 1855021 - DNA, 22 bp, Homo sapiens
tggcatttggtctcaggcagca

SEQ ID NO: 1855022 - DNA, 20 bp, Homo sapiens
tggccacggccacggccaca

SEQ ID NO: 1855023 - DNA, 14 bp, Homo sapiens
tggccatctgctcc

SEQ ID NO: 1855024 - DNA, 18 bp, Homo sapiens
tggccatctgctcctgga

SEQ ID NO: 1855025 - DNA, 19 bp, Homo sapiens
tggcccaagtggcagagct

SEQ ID NO: 1855026 - DNA, 20 bp, Homo sapiens
tggcccctcagggtccctgg

SEQ ID NO: 1855027 - DNA, 21 bp, Homo sapiens
tggcccctcagggtccctggt

SEQ ID NO: 1855028 - DNA, 14 bp, Homo sapiens
tggccgtgggcctg

SEQ ID NO: 1855029 - DNA, 19 bp, Homo sapiens
tggccgtgggcctggggta

SEQ ID NO: 1855030 - DNA, 22 bp, Homo sapiens
tggccgttgatgttggctggga

SEQ ID NO: 1855031 - DNA, 20 bp, Homo sapiens
tggcctcccaactcacccca

SEQ ID NO: 1855032 - DNA, 22 bp, Homo sapiens
tggcctcccaactcaccccagc

SEQ ID NO: 1855033 - DNA, 15 bp, Homo sapiens
tggcctctgcactcc

SEQ ID NO: 1855034 - DNA, 19 bp, Homo sapiens
tggcctctgcactcccctg

SEQ ID NO: 1855035 - DNA, 20 bp, Homo sapiens
tggcctctgcactcccctgc

SEQ ID NO: 1855036 - DNA, 18 bp, Homo sapiens
tggcctcttgtagtcttg

SEQ ID NO: 1855037 - DNA, 18 bp, Homo sapiens
tggcctgagctgggatga

SEQ ID NO: 1855038 - DNA, 12 bp, Homo sapiens
tggcctggcccc

SEQ ID NO: 1855039 - DNA, 15 bp, Homo sapiens
tggcgtctgctctgg

SEQ ID NO: 1855040 - DNA, 17 bp, Homo sapiens
tggctacatctccaaat

SEQ ID NO: 1855041 - DNA, 15 bp, Homo sapiens
tggctagtccttgtt

SEQ ID NO: 1855042 - DNA, 22 bp, Homo sapiens
tggctcaggtggggtcactctg

SEQ ID NO: 1855043 - DNA, 16 bp, Homo sapiens
tggctccaaaccctcg

SEQ ID NO: 1855044 - DNA, 16 bp, Homo sapiens
tggctcttccaggctg

SEQ ID NO: 1855045 - DNA, 19 bp, Homo sapiens
tggctcttccaggctggga

SEQ ID NO: 1855046 - DNA, 21 bp, Homo sapiens
tggctcttccaggctgggaga

SEQ ID NO: 1855047 - DNA, 12 bp, Homo sapiens
tggctgaaggac

SEQ ID NO: 1855048 - DNA, 14 bp, Homo sapiens
tggctgaaggactg

SEQ ID NO: 1855049 - DNA, 16 bp, Homo sapiens
tggctgaaggactgtg

SEQ ID NO: 1855050 - DNA, 11 bp, Homo sapiens
tggctgctgaa

SEQ ID NO: 1855051 - DNA, 11 bp, Homo sapiens
tggctgctgcc

SEQ ID NO: 1855052 - DNA, 12 bp, Homo sapiens
tggctgctgccc

SEQ ID NO: 1855053 - DNA, 21 bp, Homo sapiens
tggctggccttccacttggct

SEQ ID NO: 1855054 - DNA, 23 bp, Homo sapiens
tggctgggaactcacctggggct

SEQ ID NO: 1855055 - DNA, 16 bp, Homo sapiens
tggcttaagtgagcag

SEQ ID NO: 1855056 - DNA, 19 bp, Homo sapiens
tggcttaagtgagcagaac

SEQ ID NO: 1855057 - DNA, 15 bp, Homo sapiens
tggcttatccagctg

SEQ ID NO: 1855058 - DNA, 22 bp, Homo sapiens
tggcttcacggaagagccttgc

SEQ ID NO: 1855059 - DNA, 18 bp, Homo sapiens
tggcttcattagagcagg

SEQ ID NO: 1855060 - DNA, 14 bp, Homo sapiens
tggcttctccaggg

SEQ ID NO: 1855061 - DNA, 17 bp, Homo sapiens
tgggaactcacctgggg

SEQ ID NO: 1855062 - DNA, 14 bp, Homo sapiens
tgggactggcctct

SEQ ID NO: 1855063 - DNA, 16 bp, Homo sapiens
tgggaggatctcttga

SEQ ID NO: 1855064 - DNA, 20 bp, Homo sapiens
tgggaggatctcttgagcct

SEQ ID NO: 1855065 - DNA, 19 bp, Homo sapiens
tgggaggtcaaggctgcag

SEQ ID NO: 1855066 - DNA, 23 bp, Homo sapiens
tgggaggtcaaggctgcagtgag

SEQ ID NO: 1855067 - DNA, 16 bp, Homo sapiens
tgggagtgggcccaat

SEQ ID NO: 1855068 - DNA, 14 bp, Homo sapiens
tgggatcctccagg

SEQ ID NO: 1855069 - DNA, 18 bp, Homo sapiens
tgggatgattggaggggg

SEQ ID NO: 1855070 - DNA, 12 bp, Homo sapiens
tgggatggggag

SEQ ID NO: 1855071 - DNA, 17 bp, Homo sapiens
tgggatgtcacagtcca

SEQ ID NO: 1855072 - DNA, 22 bp, Homo sapiens
tgggcaagctggcggctggggt

SEQ ID NO: 1855073 - DNA, 14 bp, Homo sapiens
tgggcaaggaggcc

SEQ ID NO: 1855074 - DNA, 12 bp, Homo sapiens
tgggcagagcag

SEQ ID NO: 1855075 - DNA, 17 bp, Homo sapiens
tgggcagagcagagacc

SEQ ID NO: 1855076 - DNA, 23 bp, Homo sapiens
tgggcagagcagagaccatccct

SEQ ID NO: 1855077 - DNA, 17 bp, Homo sapiens
tgggcaggactcagctc

SEQ ID NO: 1855078 - DNA, 18 bp, Homo sapiens
tgggcaggactcagctcc

SEQ ID NO: 1855079 - DNA, 20 bp, Homo sapiens
tgggcccaatgcactttgtt

SEQ ID NO: 1855080 - DNA, 20 bp, Homo sapiens
tgggcctcctcacaacatgg

SEQ ID NO: 1855081 - DNA, 14 bp, Homo sapiens
tgggcgggacacag

SEQ ID NO: 1855082 - DNA, 15 bp, Homo sapiens
tgggctcccttccca

SEQ ID NO: 1855083 - DNA, 18 bp, Homo sapiens
tgggctggaacagattca

SEQ ID NO: 1855084 - DNA, 12 bp, Homo sapiens
tgggcttcccag

SEQ ID NO: 1855085 - DNA, 17 bp, Homo sapiens
tgggcttgtctgtagat

SEQ ID NO: 1855086 - DNA, 21 bp, Homo sapiens
tgggcttgtctgtagatttta

SEQ ID NO: 1855087 - DNA, 21 bp, Homo sapiens
tggggccagttggtccccctt

SEQ ID NO: 1855088 - DNA, 17 bp, Homo sapiens
tggggctaggggctggg

SEQ ID NO: 1855089 - DNA, 20 bp, Homo sapiens
tggggctaggggctggggcc

SEQ ID NO: 1855090 - DNA, 23 bp, Homo sapiens
tggggctgcaccggctggcctgg

SEQ ID NO: 1855091 - DNA, 17 bp, Homo sapiens
tgggggaagacctggca

SEQ ID NO: 1855092 - DNA, 14 bp, Homo sapiens
tggggtcactctgg

SEQ ID NO: 1855093 - DNA, 21 bp, Homo sapiens
tggggtcccagcagctgccag

SEQ ID NO: 1855094 - DNA, 15 bp, Homo sapiens
tgggtaaatgcagcg

SEQ ID NO: 1855095 - DNA, 16 bp, Homo sapiens
tgggtaactagggaag

SEQ ID NO: 1855096 - DNA, 21 bp, Homo sapiens
tgggtagaaagagatacagag

SEQ ID NO: 1855097 - DNA, 13 bp, Homo sapiens
tgggtcgggagag

SEQ ID NO: 1855098 - DNA, 21 bp, Homo sapiens
tgggtcgggagaggggacgca

SEQ ID NO: 1855099 - DNA, 20 bp, Homo sapiens
tgggtggcaccagcagcctg

SEQ ID NO: 1855100 - DNA, 14 bp, Homo sapiens
tgggtgtggcgcag

SEQ ID NO: 1855101 - DNA, 19 bp, Homo sapiens
tgggttagggaaaacattc

SEQ ID NO: 1855102 - DNA, 16 bp, Homo sapiens
tgggttctacccaggt

SEQ ID NO: 1855103 - DNA, 22 bp, Homo sapiens
tgggttctacccaggtgctagg

SEQ ID NO: 1855104 - DNA, 16 bp, Homo sapiens
tggtactaactttcct

SEQ ID NO: 1855105 - DNA, 20 bp, Homo sapiens
tggtagagtgtgcctgaagt

SEQ ID NO: 1855106 - DNA, 21 bp, Homo sapiens
tggtaggggagggcaggcttg

SEQ ID NO: 1855107 - DNA, 15 bp, Homo sapiens
tggtagttttacagt

SEQ ID NO: 1855108 - DNA, 16 bp, Homo sapiens
tggtccatagagagca

SEQ ID NO: 1855109 - DNA, 14 bp, Homo sapiens
tggtcccccttcca

SEQ ID NO: 1855110 - DNA, 15 bp, Homo sapiens
tggtcccccttccat

SEQ ID NO: 1855111 - DNA, 15 bp, Homo sapiens
tggtcctgctgcagt

SEQ ID NO: 1855112 - DNA, 18 bp, Homo sapiens
tggtctacactgtgctga

SEQ ID NO: 1855113 - DNA, 19 bp, Homo sapiens
tggtctacactgtgctgag

SEQ ID NO: 1855114 - DNA, 17 bp, Homo sapiens
tggtctatataaccaca

SEQ ID NO: 1855115 - DNA, 14 bp, Homo sapiens
tggtctcaggcagc

SEQ ID NO: 1855116 - DNA, 18 bp, Homo sapiens
tggtctctaggctgggga

SEQ ID NO: 1855117 - DNA, 22 bp, Homo sapiens
tggtgacatcaggtttttcccg

SEQ ID NO: 1855118 - DNA, 20 bp, Homo sapiens
tggtgccctgttctctacca

SEQ ID NO: 1855119 - DNA, 16 bp, Homo sapiens
tggtggcagctcacct

SEQ ID NO: 1855120 - DNA, 22 bp, Homo sapiens
tggtggcttaagtgagcagaac

SEQ ID NO: 1855121 - DNA, 15 bp, Homo sapiens
tggtgtttcctggca

SEQ ID NO: 1855122 - DNA, 16 bp, Homo sapiens
cccaagggcctggcct

SEQ ID NO: 1855123 - DNA, 17 bp, Homo sapiens
cccaagggcctggcctg

SEQ ID NO: 1855124 - DNA, 23 bp, Homo sapiens
cccaagggcctggcctgagctgg

SEQ ID NO: 1855125 - DNA, 16 bp, Homo sapiens
cccaatgcactttgtt

SEQ ID NO: 1855126 - DNA, 13 bp, Homo sapiens
cccacagcgctgg

SEQ ID NO: 1855127 - DNA, 14 bp, Homo sapiens
cccacagtgccacc

SEQ ID NO: 1855128 - DNA, 15 bp, Homo sapiens
cccacccaagggcct

SEQ ID NO: 1855129 - DNA, 12 bp, Homo sapiens
cccacccccacc

SEQ ID NO: 1855130 - DNA, 15 bp, Homo sapiens
cccacccccacccaa

SEQ ID NO: 1855131 - DNA, 18 bp, Homo sapiens
cccaccctgaaagccctg

SEQ ID NO: 1855132 - DNA, 20 bp, Homo sapiens
cccaccgcagacaggaccag

SEQ ID NO: 1855133 - DNA, 17 bp, Homo sapiens
cccacctctctcactcc

SEQ ID NO: 1855134 - DNA, 12 bp, Homo sapiens
cccacctggcct

SEQ ID NO: 1855135 - DNA, 15 bp, Homo sapiens
cccacctggcctctg

SEQ ID NO: 1855136 - DNA, 19 bp, Homo sapiens
cccacctggcctctgcact

SEQ ID NO: 1855137 - DNA, 21 bp, Homo sapiens
cccacctggcctctgcactcc

SEQ ID NO: 1855138 - DNA, 20 bp, Homo sapiens
cccacgactgcccggcaggg

SEQ ID NO: 1855139 - DNA, 13 bp, Homo sapiens
cccacgcccccac

SEQ ID NO: 1855140 - DNA, 15 bp, Homo sapiens
cccacgcccccactg

SEQ ID NO: 1855141 - DNA, 17 bp, Homo sapiens
cccagacgatgtcttca

SEQ ID NO: 1855142 - DNA, 13 bp, Homo sapiens
cccagactctttt

SEQ ID NO: 1855143 - DNA, 14 bp, Homo sapiens
cccagcagctgcca

SEQ ID NO: 1855144 - DNA, 20 bp, Homo sapiens
cccagcattttactgattca

SEQ ID NO: 1855145 - DNA, 21 bp, Homo sapiens
cccagccccaaaactctcctc

SEQ ID NO: 1855146 - DNA, 13 bp, Homo sapiens
cccagccccaatg

SEQ ID NO: 1855147 - DNA, 11 bp, Homo sapiens
cccagcccctt

SEQ ID NO: 1855148 - DNA, 14 bp, Homo sapiens
cccagctctctgac

SEQ ID NO: 1855149 - DNA, 13 bp, Homo sapiens
cccagctctggtc

SEQ ID NO: 1855150 - DNA, 19 bp, Homo sapiens
ccagaccgtcgcacccaca

SEQ ID NO: 1855151 - DNA, 20 bp, Homo sapiens
ccagacgatgtcttcatacc

SEQ ID NO: 1855152 - DNA, 16 bp, Homo sapiens
ccagactacttgggag

SEQ ID NO: 1855153 - DNA, 17 bp, Homo sapiens
ccagactctttttttga

SEQ ID NO: 1855154 - DNA, 18 bp, Homo sapiens
ccagactctttttttgag

SEQ ID NO: 1855155 - DNA, 16 bp, Homo sapiens
ccagagggcctgcaag

SEQ ID NO: 1855156 - DNA, 20 bp, Homo sapiens
ccagagggcctgcaagggag

SEQ ID NO: 1855157 - DNA, 16 bp, Homo sapiens
ccagatgggggaaagc

SEQ ID NO: 1855158 - DNA, 20 bp, Homo sapiens
ccagattctttcctgaggct

SEQ ID NO: 1855159 - DNA, 15 bp, Homo sapiens
ccagcaaaaggttgt

SEQ ID NO: 1855160 - DNA, 19 bp, Homo sapiens
ccagcagagcaccttagac

SEQ ID NO: 1855161 - DNA, 11 bp, Homo sapiens
ccagcagcctg

SEQ ID NO: 1855162 - DNA, 14 bp, Homo sapiens
ccagcagcctggac

SEQ ID NO: 1855163 - DNA, 15 bp, Homo sapiens
ccagcagcctggacc

SEQ ID NO: 1855164 - DNA, 20 bp, Homo sapiens
ccagcagcctggaccctgtg

SEQ ID NO: 1855165 - DNA, 15 bp, Homo sapiens
ccagcatcccttgac

SEQ ID NO: 1855166 - DNA, 14 bp, Homo sapiens
ccagccagggctgc

SEQ ID NO: 1855167 - DNA, 11 bp, Homo sapiens
ccagcccctgg

SEQ ID NO: 1855168 - DNA, 12 bp, Homo sapiens
ccagcccctgga

SEQ ID NO: 1855169 - DNA, 15 bp, Homo sapiens
ccagcccctggatgc

SEQ ID NO: 1855170 - DNA, 15 bp, Homo sapiens
ccagccccttctgac

SEQ ID NO: 1855171 - DNA, 24 bp, Homo sapiens
ccagccccttctgacccatgctgc

SEQ ID NO: 1855172 - DNA, 17 bp, Homo sapiens
ccagccctggctgaagg

SEQ ID NO: 1855173 - DNA, 14 bp, Homo sapiens
ccagccgccatgct

SEQ ID NO: 1855174 - DNA, 15 bp, Homo sapiens
ccctgatcctgtgaa

SEQ ID NO: 1855175 - DNA, 22 bp, Homo sapiens
ccctgcaacctgattgtgtctc

SEQ ID NO: 1855176 - DNA, 20 bp, Homo sapiens
ccctgcccacctggcctctg

SEQ ID NO: 1855177 - DNA, 16 bp, Homo sapiens
ccctgcctcctttgtg

SEQ ID NO: 1855178 - DNA, 19 bp, Homo sapiens
ccctgcctctacccaacca

SEQ ID NO: 1855179 - DNA, 21 bp, Homo sapiens
ccctgctgggtgtggcgcagc

SEQ ID NO: 1855180 - DNA, 22 bp, Homo sapiens
ccctgctgggtgtggcgcagca

SEQ ID NO: 1855181 - DNA, 18 bp, Homo sapiens
ccctggcatttggcctct

SEQ ID NO: 1855182 - DNA, 17 bp, Homo sapiens
ccctggcctttcatatt

SEQ ID NO: 1855183 - DNA, 17 bp, Homo sapiens
ccctggggacagcaagg

SEQ ID NO: 1855184 - DNA, 19 bp, Homo sapiens
ccctggggacagcaagggc

SEQ ID NO: 1855185 - DNA, 14 bp, Homo sapiens
ccctggtggcagct

SEQ ID NO: 1855186 - DNA, 15 bp, Homo sapiens
ccctggtggcagctc

SEQ ID NO: 1855187 - DNA, 17 bp, Homo sapiens
ccctggtggcagctcac

SEQ ID NO: 1855188 - DNA, 20 bp, Homo sapiens
ccctggtggcagctcacctc

SEQ ID NO: 1855189 - DNA, 21 bp, Homo sapiens
ccctggtggcagctcacctct

SEQ ID NO: 1855190 - DNA, 23 bp, Homo sapiens
ccctgtgagtactacagtcctcc

SEQ ID NO: 1855191 - DNA, 15 bp, Homo sapiens
ccctgtgatggggcc

SEQ ID NO: 1855192 - DNA, 21 bp, Homo sapiens
ccctgtgatggggccctgcct

SEQ ID NO: 1855193 - DNA, 23 bp, Homo sapiens
ccctgtgatggggccctgcctcc

SEQ ID NO: 1855194 - DNA, 14 bp, Homo sapiens
cccttcatctggaa

SEQ ID NO: 1855195 - DNA, 12 bp, Homo sapiens
cccttccatgga

SEQ ID NO: 1855196 - DNA, 22 bp, Homo sapiens
cccttctgacccatgctgccct

SEQ ID NO: 1855197 - DNA, 14 bp, Homo sapiens
cccttggacacgct

SEQ ID NO: 1855198 - DNA, 16 bp, Homo sapiens
cccttggacacgctca

SEQ ID NO: 1855199 - DNA, 20 bp, Homo sapiens
cccttgtggtcccaccccac

SEQ ID NO: 1855200 - DNA, 18 bp, Homo sapiens
cccttttttggctgctga

SEQ ID NO: 1855201 - DNA, 22 bp, Homo sapiens
cccttttttggctgctgaaggc

SEQ ID NO: 1855202 - DNA, 15 bp, Homo sapiens
ccgagattgcaccac

SEQ ID NO: 1855203 - DNA, 14 bp, Homo sapiens
ccgcagggccatgc

SEQ ID NO: 1855204 - DNA, 17 bp, Homo sapiens
ccgcagggccatgcaga

SEQ ID NO: 1855205 - DNA, 14 bp, Homo sapiens
ccgccagctgccgc

SEQ ID NO: 1855206 - DNA, 17 bp, Homo sapiens
cctgaggcccagagggc

SEQ ID NO: 1855207 - DNA, 12 bp, Homo sapiens
cctgaggccctt

SEQ ID NO: 1855208 - DNA, 14 bp, Homo sapiens
cctgaggcccttct

SEQ ID NO: 1855209 - DNA, 17 bp, Homo sapiens
cctgaggcccttctctc

SEQ ID NO: 1855210 - DNA, 20 bp, Homo sapiens
cctgaggcccttctctccag

SEQ ID NO: 1855211 - DNA, 15 bp, Homo sapiens
cctgagtgcttgctt

SEQ ID NO: 1855212 - DNA, 19 bp, Homo sapiens
cctgagtgcttgcttttca

SEQ ID NO: 1855213 - DNA, 18 bp, Homo sapiens
cctgatgcttcttcagag

SEQ ID NO: 1855214 - DNA, 19 bp, Homo sapiens
cctgatgcttcttcagaga

SEQ ID NO: 1855215 - DNA, 17 bp, Homo sapiens
cctgatggacctgtcac

SEQ ID NO: 1855216 - DNA, 23 bp, Homo sapiens
cctgatggcaggatggcctggcc

SEQ ID NO: 1855217 - DNA, 17 bp, Homo sapiens
cctgattgccaagctca

SEQ ID NO: 1855218 - DNA, 21 bp, Homo sapiens
cctgcaacctgattgtgtctc

SEQ ID NO: 1855219 - DNA, 17 bp, Homo sapiens
cctgcacacaggacagc

SEQ ID NO: 1855220 - DNA, 20 bp, Homo sapiens
cctgcacacaggacagcggg

SEQ ID NO: 1855221 - DNA, 20 bp, Homo sapiens
cctgcagccaagcaaatgcc

SEQ ID NO: 1855222 - DNA, 12 bp, Homo sapiens
cctgcaggcagc

SEQ ID NO: 1855223 - DNA, 18 bp, Homo sapiens
cctgcaggcagccaggcc

SEQ ID NO: 1855224 - DNA, 18 bp, Homo sapiens
cctgcaggcgtgacctga

SEQ ID NO: 1855225 - DNA, 12 bp, Homo sapiens
cctgccaaattt

SEQ ID NO: 1855226 - DNA, 19 bp, Homo sapiens
cctgccaatggactaactt

SEQ ID NO: 1855227 - DNA, 22 bp, Homo sapiens
cctgccagggacagagggggtg

SEQ ID NO: 1855228 - DNA, 22 bp, Homo sapiens
cctgccattgtagcgtctttct

SEQ ID NO: 1855229 - DNA, 15 bp, Homo sapiens
cctgcccacctggcc

SEQ ID NO: 1855230 - DNA, 17 bp, Homo sapiens
cctgcccacctggcctc

SEQ ID NO: 1855231 - DNA, 14 bp, Homo sapiens
cctgccctgtgggc

SEQ ID NO: 1855232 - DNA, 15 bp, Homo sapiens
cctgccctgtgggcc

SEQ ID NO: 1855233 - DNA, 13 bp, Homo sapiens
cctgcctcctttg

SEQ ID NO: 1855234 - DNA, 19 bp, Homo sapiens
cctgcctcctttgtgagga

SEQ ID NO: 1855235 - DNA, 12 bp, Homo sapiens
cctgcctgtgct

SEQ ID NO: 1855236 - DNA, 16 bp, Homo sapiens
cctgcggtgctatctc

SEQ ID NO: 1855237 - DNA, 17 bp, Homo sapiens
cctgcggtgctatctcc

SEQ ID NO: 1855238 - DNA, 22 bp, Homo sapiens
cctgcggtgctatctcccccag

SEQ ID NO: 1855239 - DNA, 13 bp, Homo sapiens
cctgctccagctg

SEQ ID NO: 1855240 - DNA, 21 bp, Homo sapiens
cctgctgcagttgccagtcac

SEQ ID NO: 1855241 - DNA, 17 bp, Homo sapiens
cctgctggatgtggagg

SEQ ID NO: 1855242 - DNA, 15 bp, Homo sapiens
ctcagcactgcctgc

SEQ ID NO: 1855243 - DNA, 16 bp, Homo sapiens
ctcagcactgcctgct

SEQ ID NO: 1855244 - DNA, 18 bp, Homo sapiens
ctcagcactgcctgctcc

SEQ ID NO: 1855245 - DNA, 23 bp, Homo sapiens
ctcagcccctgatcctgtgaagt

SEQ ID NO: 1855246 - DNA, 15 bp, Homo sapiens
ctcagcctctcccct

SEQ ID NO: 1855247 - DNA, 21 bp, Homo sapiens
ctcagcctctcccctgcctgc

SEQ ID NO: 1855248 - DNA, 20 bp, Homo sapiens
ctcagcttggcactcaggtg

SEQ ID NO: 1855249 - DNA, 23 bp, Homo sapiens
ctcaggagtttgagaccaacctg

SEQ ID NO: 1855250 - DNA, 14 bp, Homo sapiens
ctcaggcagcacca

SEQ ID NO: 1855251 - DNA, 13 bp, Homo sapiens
ctcagggcctggc

SEQ ID NO: 1855252 - DNA, 12 bp, Homo sapiens
ctcagggtccct

SEQ ID NO: 1855253 - DNA, 24 bp, Homo sapiens
ctcagggtccctggtggcagctca

SEQ ID NO: 1855254 - DNA, 18 bp, Homo sapiens
ctcagggtctctgctgcc

SEQ ID NO: 1855255 - DNA, 20 bp, Homo sapiens
ctcaggtgagaagcagagga

SEQ ID NO: 1855256 - DNA, 19 bp, Homo sapiens
ctcagtaacatttctgttc

SEQ ID NO: 1855257 - DNA, 21 bp, Homo sapiens
ctcagtaagacgacaaggaaa

SEQ ID NO: 1855258 - DNA, 15 bp, Homo sapiens
ctcagttcagaatca

SEQ ID NO: 1855259 - DNA, 20 bp, Homo sapiens
ctcataagagtaacagtcat

SEQ ID NO: 1855260 - DNA, 14 bp, Homo sapiens
ctcataattggaat

SEQ ID NO: 1855261 - DNA, 16 bp, Homo sapiens
ctcatacccaccccca

SEQ ID NO: 1855262 - DNA, 14 bp, Homo sapiens
ctcatactcacctc

SEQ ID NO: 1855263 - DNA, 22 bp, Homo sapiens
ctcatcaccaacgtctgtgcca

SEQ ID NO: 1855264 - DNA, 18 bp, Homo sapiens
ctcatccctaatgctgca

SEQ ID NO: 1855265 - DNA, 14 bp, Homo sapiens
ctcatgaagcagga

SEQ ID NO: 1855266 - DNA, 13 bp, Homo sapiens
ctcatgaatctgc

SEQ ID NO: 1855267 - DNA, 19 bp, Homo sapiens
ctcatgcccagctctctga

SEQ ID NO: 1855268 - DNA, 22 bp, Homo sapiens
ctcattggaaatttagcattgt

SEQ ID NO: 1855269 - DNA, 16 bp, Homo sapiens
ctcatttcaggagcag

SEQ ID NO: 1855270 - DNA, 13 bp, Homo sapiens
ctcatttcaggat

SEQ ID NO: 1855271 - DNA, 17 bp, Homo sapiens
ctcatttgttcattaaa

SEQ ID NO: 1855272 - DNA, 15 bp, Homo sapiens
ctccaccttgcgggg

SEQ ID NO: 1855273 - DNA, 17 bp, Homo sapiens
ctccagacacatgtcca

SEQ ID NO: 1855274 - DNA, 11 bp, Homo sapiens
ctccagcccct

SEQ ID NO: 1855275 - DNA, 14 bp, Homo sapiens
ctccagcccctgga

SEQ ID NO: 1855276 - DNA, 15 bp, Homo sapiens
ctccagcccctggat

SEQ ID NO: 1855277 - DNA, 16 bp, Homo sapiens
ctccagcccctggatg

SEQ ID NO: 1855278 - DNA, 17 bp, Homo sapiens
ctccagcccctggatgc

SEQ ID NO: 1855279 - DNA, 12 bp, Homo sapiens
ctccagcctggg

SEQ ID NO: 1855280 - DNA, 18 bp, Homo sapiens
ctccagctgttcagctgg

SEQ ID NO: 1855281 - DNA, 14 bp, Homo sapiens
ctccaggagcagcc

SEQ ID NO: 1855282 - DNA, 15 bp, Homo sapiens
ctccaggagcagcca

SEQ ID NO: 1855283 - DNA, 17 bp, Homo sapiens
ctccaggagcagccaca

SEQ ID NO: 1855284 - DNA, 15 bp, Homo sapiens
ctccaggcaggctaa

SEQ ID NO: 1855285 - DNA, 11 bp, Homo sapiens
ctccaggtgca

SEQ ID NO: 1855286 - DNA, 22 bp, Homo sapiens
ctccagtcattatgttaatatt

SEQ ID NO: 1855287 - DNA, 15 bp, Homo sapiens
ctgaatgtttttcta

SEQ ID NO: 1855288 - DNA, 16 bp, Homo sapiens
ctgaatgtttttctaa

SEQ ID NO: 1855289 - DNA, 18 bp, Homo sapiens
ctgaatgtttttctaaag

SEQ ID NO: 1855290 - DNA, 20 bp, Homo sapiens
ctgaatgtttttctaaagga

SEQ ID NO: 1855291 - DNA, 20 bp, Homo sapiens
ctgacacaaacctgcctggg

SEQ ID NO: 1855292 - DNA, 15 bp, Homo sapiens
ctgacccatgctgcc

SEQ ID NO: 1855293 - DNA, 16 bp, Homo sapiens
ctgactgttttctctt

SEQ ID NO: 1855294 - DNA, 11 bp, Homo sapiens
ctgagaacact

SEQ ID NO: 1855295 - DNA, 18 bp, Homo sapiens
ctgagacagcccgggctc

SEQ ID NO: 1855296 - DNA, 23 bp, Homo sapiens
ctgagacagcccgggctctgcct

SEQ ID NO: 1855297 - DNA, 15 bp, Homo sapiens
ctgagatttattaaa

SEQ ID NO: 1855298 - DNA, 16 bp, Homo sapiens
ctgagcagcgagcctg

SEQ ID NO: 1855299 - DNA, 22 bp, Homo sapiens
ctgagctgggatgattggaggg

SEQ ID NO: 1855300 - DNA, 14 bp, Homo sapiens
ctgagctttctgct

SEQ ID NO: 1855301 - DNA, 15 bp, Homo sapiens
ctgagctttctgcta

SEQ ID NO: 1855302 - DNA, 13 bp, Homo sapiens
ctgaggcccagag

SEQ ID NO: 1855303 - DNA, 14 bp, Homo sapiens
ctgaggcccagagg

SEQ ID NO: 1855304 - DNA, 18 bp, Homo sapiens
ctgaggcccagagggcct

SEQ ID NO: 1855305 - DNA, 23 bp, Homo sapiens
ctgaggcccagagggcctgcaag

SEQ ID NO: 1855306 - DNA, 15 bp, Homo sapiens
ctgaggcccttctct

SEQ ID NO: 1855307 - DNA, 22 bp, Homo sapiens
ctgaggcccttctctccagccc

SEQ ID NO: 1855308 - DNA, 16 bp, Homo sapiens
ctgaggctgggctccc

SEQ ID NO: 1855309 - DNA, 22 bp, Homo sapiens
ctgaggtgggaggatctcttga

SEQ ID NO: 1855310 - DNA, 16 bp, Homo sapiens
ctgagtctgaaggctg

SEQ ID NO: 1855311 - DNA, 19 bp, Homo sapiens
ctgagtctgaaggctgggt

SEQ ID NO: 1855312 - DNA, 15 bp, Homo sapiens
ctgagtgccttttgg

SEQ ID NO: 1855313 - DNA, 17 bp, Homo sapiens
ctgagtgcttgcttttc

SEQ ID NO: 1855314 - DNA, 23 bp, Homo sapiens
ctgatatgtctagggtgtgattt

SEQ ID NO: 1855315 - DNA, 20 bp, Homo sapiens
ctgatcctagttccaccatc

SEQ ID NO: 1855316 - DNA, 21 bp, Homo sapiens
ctgatcctagttccaccatca

SEQ ID NO: 1855317 - DNA, 17 bp, Homo sapiens
ctgatgatgtgcctggg

SEQ ID NO: 1855318 - DNA, 20 bp, Homo sapiens
ctgatgatttcttgaaaagg

SEQ ID NO: 1855319 - DNA, 23 bp, Homo sapiens
ctgatgcagtcacgtggaggagc

SEQ ID NO: 1855320 - DNA, 16 bp, Homo sapiens
ctgatgcttcttcaga

SEQ ID NO: 1855321 - DNA, 18 bp, Homo sapiens
ctgatggagccccacctt

SEQ ID NO: 1855322 - DNA, 22 bp, Homo sapiens
ctgatggcaggatggcctggcc

SEQ ID NO: 1855323 - DNA, 18 bp, Homo sapiens
ctgatggcttctccaggg

SEQ ID NO: 1855324 - DNA, 22 bp, Homo sapiens
ctgcaacctgattgtgtctctt

SEQ ID NO: 1855325 - DNA, 12 bp, Homo sapiens
ctgcaagggagt

SEQ ID NO: 1855326 - DNA, 18 bp, Homo sapiens
ctgcaatgtgggcagaga

SEQ ID NO: 1855327 - DNA, 16 bp, Homo sapiens
ctgcacaaactcacca

SEQ ID NO: 1855328 - DNA, 13 bp, Homo sapiens
ctgcacaagctgc

SEQ ID NO: 1855329 - DNA, 18 bp, Homo sapiens
ctgcacacaggacagcgg

SEQ ID NO: 1855330 - DNA, 20 bp, Homo sapiens
ctgcacacaggacagcggga

SEQ ID NO: 1855331 - DNA, 16 bp, Homo sapiens
ctgcaccggctggcct

SEQ ID NO: 1855332 - DNA, 17 bp, Homo sapiens
ctgcaccggctggcctg

SEQ ID NO: 1855333 - DNA, 18 bp, Homo sapiens
ctgcactccagcctgggt

SEQ ID NO: 1855334 - DNA, 16 bp, Homo sapiens
ctgcactcccctgctg

SEQ ID NO: 1855335 - DNA, 21 bp, Homo sapiens
ctgcactcccctgctgggtgt

SEQ ID NO: 1855336 - DNA, 19 bp, Homo sapiens
ctgcagatttgggctggaa

SEQ ID NO: 1855337 - DNA, 18 bp, Homo sapiens
ctgcaggcagccaggcca

SEQ ID NO: 1855338 - DNA, 16 bp, Homo sapiens
ctgcagttgccagtca

SEQ ID NO: 1855339 - DNA, 17 bp, Homo sapiens
ctgcagttgccagtcac

SEQ ID NO: 1855340 - DNA, 13 bp, Homo sapiens
ctgcattggcttt

SEQ ID NO: 1855341 - DNA, 20 bp, Homo sapiens
ctgccaggagcacggctctg

SEQ ID NO: 1855342 - DNA, 22 bp, Homo sapiens
ctgccagggacagagggggtgg

SEQ ID NO: 1855343 - DNA, 16 bp, Homo sapiens
ctgccatgcagggcct

SEQ ID NO: 1855344 - DNA, 17 bp, Homo sapiens
ctgccatgcagggcctc

SEQ ID NO: 1855345 - DNA, 17 bp, Homo sapiens
ctgccatgccagcttat

SEQ ID NO: 1855346 - DNA, 13 bp, Homo sapiens
ctgcccacctggc

SEQ ID NO: 1855347 - DNA, 17 bp, Homo sapiens
ctgcccacctggcctct

SEQ ID NO: 1855348 - DNA, 18 bp, Homo sapiens
ctgcccacctggcctctg

SEQ ID NO: 1855349 - DNA, 14 bp, Homo sapiens
ctgcccactccctg

SEQ ID NO: 1855350 - DNA, 18 bp, Homo sapiens
ctgcccactccctgcaac

SEQ ID NO: 1855351 - DNA, 13 bp, Homo sapiens
ctgcccggcaggg

SEQ ID NO: 1855352 - DNA, 17 bp, Homo sapiens
ctgccctgcccacctgg

SEQ ID NO: 1855353 - DNA, 16 bp, Homo sapiens
ctgccgccccacccag

SEQ ID NO: 1855354 - DNA, 15 bp, Homo sapiens
ctgcctcccttcatg

SEQ ID NO: 1855355 - DNA, 19 bp, Homo sapiens
ctgcctcccttcatgcatg

SEQ ID NO: 1855356 - DNA, 23 bp, Homo sapiens
ctgcctcccttcatgcatggaaa

SEQ ID NO: 1855357 - DNA, 21 bp, Homo sapiens
ctgcctcctttgtgaggaagc

SEQ ID NO: 1855358 - DNA, 23 bp, Homo sapiens
ctgcctcctttgtgaggaagccg

SEQ ID NO: 1855359 - DNA, 21 bp, Homo sapiens
cgcccctcccacagcgctggc

SEQ ID NO: 1855360 - DNA, 14 bp, Homo sapiens
cgcgcgccaccacg

SEQ ID NO: 1855361 - DNA, 14 bp, Homo sapiens
cgctaagagggagg

SEQ ID NO: 1855362 - DNA, 21 bp, Homo sapiens
cgctaagagggagggagggct

SEQ ID NO: 1855363 - DNA, 16 bp, Homo sapiens
cgctacccgggaaggg

SEQ ID NO: 1855364 - DNA, 17 bp, Homo sapiens
cgctacccgggaagggg

SEQ ID NO: 1855365 - DNA, 15 bp, Homo sapiens
cgctgatggagcccc

SEQ ID NO: 1855366 - DNA, 16 bp, Homo sapiens
cgctgatggagcccca

SEQ ID NO: 1855367 - DNA, 13 bp, Homo sapiens
cgctgtgctgccc

SEQ ID NO: 1855368 - DNA, 14 bp, Homo sapiens
cgctgtgctgccct

SEQ ID NO: 1855369 - DNA, 16 bp, Homo sapiens
cgctgtgctgccctgc

SEQ ID NO: 1855370 - DNA, 18 bp, Homo sapiens
cgctgtgctgccctgccc

SEQ ID NO: 1855371 - DNA, 23 bp, Homo sapiens
cgctgtgctgccctgcccacctg

SEQ ID NO: 1855372 - DNA, 14 bp, Homo sapiens
cgcttgtgacagtg

SEQ ID NO: 1855373 - DNA, 15 bp, Homo sapiens
cgcttgtgacagtgc

SEQ ID NO: 1855374 - DNA, 13 bp, Homo sapiens
cggaagagccttg

SEQ ID NO: 1855375 - DNA, 21 bp, Homo sapiens
cggacttagaaaaccagctca

SEQ ID NO: 1855376 - DNA, 23 bp, Homo sapiens
cggacttagaaaaccagctcagc

SEQ ID NO: 1855377 - DNA, 19 bp, Homo sapiens
cggatctttggacagaagc

SEQ ID NO: 1855378 - DNA, 22 bp, Homo sapiens
cggccccctccccccagactct

SEQ ID NO: 1855379 - DNA, 14 bp, Homo sapiens
cggctctgtcccca

SEQ ID NO: 1855380 - DNA, 17 bp, Homo sapiens
cggctctgtccccagcc

SEQ ID NO: 1855381 - DNA, 11 bp, Homo sapiens
cggctgctgag

SEQ ID NO: 1855382 - DNA, 23 bp, Homo sapiens
cggctggcagcccacccctcaac

SEQ ID NO: 1855383 - DNA, 23 bp, Homo sapiens
cggctggggtcccagcagctgcc

SEQ ID NO: 1855384 - DNA, 22 bp, Homo sapiens
cggctgtgtgtgcacgcgtgtg

SEQ ID NO: 1855385 - DNA, 23 bp, Homo sapiens
cgggaccccgagcctggctccaa

SEQ ID NO: 1855386 - DNA, 13 bp, Homo sapiens
cgggagaggggac

SEQ ID NO: 1855387 - DNA, 16 bp, Homo sapiens
cgggagaggggacgca

SEQ ID NO: 1855388 - DNA, 23 bp, Homo sapiens
cgggagaggggacgcaggcccct

SEQ ID NO: 1855389 - DNA, 16 bp, Homo sapiens
cgggctctgcctccca

SEQ ID NO: 1855390 - DNA, 15 bp, Homo sapiens
cggtgctccaggcag

SEQ ID NO: 1855391 - DNA, 11 bp, Homo sapiens
cggtgtctctc

SEQ ID NO: 1855392 - DNA, 13 bp, Homo sapiens
cggtgtggagaag

SEQ ID NO: 1855393 - DNA, 17 bp, Homo sapiens
cgtgagctgagcaggcc

SEQ ID NO: 1855394 - DNA, 17 bp, Homo sapiens
cgtgctctttgttttgt

SEQ ID NO: 1855395 - DNA, 22 bp, Homo sapiens
cgtgctctttgttttgtgtctc

SEQ ID NO: 1855396 - DNA, 23 bp, Homo sapiens
cgtgctctttgttttgtgtctct

SEQ ID NO: 1855397 - DNA, 15 bp, Homo sapiens
cgtggagctgcctga

SEQ ID NO: 1855398 - DNA, 10 bp, Homo sapiens
cgtggcacat

SEQ ID NO: 1855399 - DNA, 20 bp, Homo sapiens
cgtgtaaccatggacccaat

SEQ ID NO: 1855400 - DNA, 21 bp, Homo sapiens
gaagatataactattgcccag

SEQ ID NO: 1855401 - DNA, 17 bp, Homo sapiens
gaagattctatgttaat

SEQ ID NO: 1855402 - DNA, 23 bp, Homo sapiens
gaagattctatgttaatatttta

SEQ ID NO: 1855403 - DNA, 12 bp, Homo sapiens
gaagcagctctt

SEQ ID NO: 1855404 - DNA, 19 bp, Homo sapiens
gaagcaggctacactgaca

SEQ ID NO: 1855405 - DNA, 17 bp, Homo sapiens
gaagcattttataaatc

SEQ ID NO: 1855406 - DNA, 21 bp, Homo sapiens
gaagcccaggaaaggctccag

SEQ ID NO: 1855407 - DNA, 21 bp, Homo sapiens
gaagccgctggggccagttgg

SEQ ID NO: 1855408 - DNA, 10 bp, Homo sapiens
gaagcctttg

SEQ ID NO: 1855409 - DNA, 14 bp, Homo sapiens
gaagcggctggcag

SEQ ID NO: 1855410 - DNA, 14 bp, Homo sapiens
gaagctcagggcct

SEQ ID NO: 1855411 - DNA, 15 bp, Homo sapiens
gaagctcagggcctg

SEQ ID NO: 1855412 - DNA, 16 bp, Homo sapiens
gaagctcagggcctgg

SEQ ID NO: 1855413 - DNA, 18 bp, Homo sapiens
gaagcttaaaataaagtt

SEQ ID NO: 1855414 - DNA, 21 bp, Homo sapiens
gaaggaaacccagctctggtc

SEQ ID NO: 1855415 - DNA, 15 bp, Homo sapiens
gaaggactgcagcca

SEQ ID NO: 1855416 - DNA, 18 bp, Homo sapiens
gaaggactgtgacaggca

SEQ ID NO: 1855417 - DNA, 22 bp, Homo sapiens
gaaggactgtgacaggcagcag

SEQ ID NO: 1855418 - DNA, 14 bp, Homo sapiens
gaaggcaaatgact

SEQ ID NO: 1855419 - DNA, 15 bp, Homo sapiens
gaaggcaaatgactt

SEQ ID NO: 1855420 - DNA, 15 bp, Homo sapiens
gaaggccccgcccag

SEQ ID NO: 1855421 - DNA, 15 bp, Homo sapiens
gaaggctgggttctg

SEQ ID NO: 1855422 - DNA, 19 bp, Homo sapiens
gaaggctgggttctgatcc

SEQ ID NO: 1855423 - DNA, 22 bp, Homo sapiens
gaaggctgggttctgatcctag

SEQ ID NO: 1855424 - DNA, 22 bp, Homo sapiens
gaaggggagataagggtatctg

SEQ ID NO: 1855425 - DNA, 20 bp, Homo sapiens
gaaggtagaatgttttcaaa

SEQ ID NO: 1855426 - DNA, 23 bp, Homo sapiens
gaaggtggtgggggtgcagatga

SEQ ID NO: 1855427 - DNA, 17 bp, Homo sapiens
gaagtaaagtgaagaat

SEQ ID NO: 1855428 - DNA, 14 bp, Homo sapiens
gaagtaacagtaac

SEQ ID NO: 1855429 - DNA, 21 bp, Homo sapiens
gaagtttccttggctggtgca

SEQ ID NO: 1855430 - DNA, 17 bp, Homo sapiens
gaatacaaacacctgga

SEQ ID NO: 1855431 - DNA, 13 bp, Homo sapiens
gaatacctgtccc

SEQ ID NO: 1855432 - DNA, 17 bp, Homo sapiens
gaatcatctcctttgca

SEQ ID NO: 1855433 - DNA, 15 bp, Homo sapiens
gaatgaaatactgtt

SEQ ID NO: 1855434 - DNA, 20 bp, Homo sapiens
gaatgacggtaagtgttctc

SEQ ID NO: 1855435 - DNA, 13 bp, Homo sapiens
gaatgctttagga

SEQ ID NO: 1855436 - DNA, 17 bp, Homo sapiens
gaatgtcagttgttatt

SEQ ID NO: 1855437 - DNA, 14 bp, Homo sapiens
gaatttatctcttt

SEQ ID NO: 1855438 - DNA, 20 bp, Homo sapiens
gaattttgtgcccccatgta

SEQ ID NO: 1855439 - DNA, 21 bp, Homo sapiens
gaattttgtgcccccatgtaa

SEQ ID NO: 1855440 - DNA, 15 bp, Homo sapiens
gacaacgtgctcttt

SEQ ID NO: 1855441 - DNA, 19 bp, Homo sapiens
gacaagcaattagacaaga

SEQ ID NO: 1855442 - DNA, 17 bp, Homo sapiens
gacaaggaaaggcaaat

SEQ ID NO: 1855443 - DNA, 21 bp, Homo sapiens
gacaaggatgatctaggaaga

SEQ ID NO: 1855444 - DNA, 20 bp, Homo sapiens
gacaagtgactgtatctgtg

SEQ ID NO: 1855445 - DNA, 19 bp, Homo sapiens
gacaatgtgaaaagaaaaa

SEQ ID NO: 1855446 - DNA, 18 bp, Homo sapiens
gacacaaacctgcctggg

SEQ ID NO: 1855447 - DNA, 14 bp, Homo sapiens
gacacaacaactcc

SEQ ID NO: 1855448 - DNA, 22 bp, Homo sapiens
gacactgttcttagctcaatga

SEQ ID NO: 1855449 - DNA, 15 bp, Homo sapiens
gacagagggggtggc

SEQ ID NO: 1855450 - DNA, 18 bp, Homo sapiens
gacagagggggtggcctc

SEQ ID NO: 1855451 - DNA, 19 bp, Homo sapiens
gacagagggggtggcctcc

SEQ ID NO: 1855452 - DNA, 23 bp, Homo sapiens
gacagcccgggctctgcctccca

SEQ ID NO: 1855453 - DNA, 13 bp, Homo sapiens
gacagctgcctgg

SEQ ID NO: 1855454 - DNA, 16 bp, Homo sapiens
gacagctgcctgggat

SEQ ID NO: 1855455 - DNA, 14 bp, Homo sapiens
gacagctttctggg

SEQ ID NO: 1855456 - DNA, 18 bp, Homo sapiens
gacagctttctgggatgt

SEQ ID NO: 1855457 - DNA, 14 bp, Homo sapiens
gacaggaccaggga

SEQ ID NO: 1855458 - DNA, 16 bp, Homo sapiens
gacaggtgtgccgaca

SEQ ID NO: 1855459 - DNA, 14 bp, Homo sapiens
gacagtcaccccag

SEQ ID NO: 1855460 - DNA, 15 bp, Homo sapiens
gacagtccagcctgg

SEQ ID NO: 1855461 - DNA, 19 bp, Homo sapiens
gacagtccagcctggagat

SEQ ID NO: 1855462 - DNA, 12 bp, Homo sapiens
gacagtccctgc

SEQ ID NO: 1855463 - DNA, 15 bp, Homo sapiens
gacagtccctgccaa

SEQ ID NO: 1855464 - DNA, 16 bp, Homo sapiens
gacagtccctgccaat

SEQ ID NO: 1855465 - DNA, 13 bp, Homo sapiens
gacagtgcctctt

SEQ ID NO: 1855466 - DNA, 14 bp, Homo sapiens
gacttttccaaccc

SEQ ID NO: 1855467 - DNA, 20 bp, Homo sapiens
gacttttccaaccctcatca

SEQ ID NO: 1855468 - DNA, 16 bp, Homo sapiens
gagaaagaggaagctt

SEQ ID NO: 1855469 - DNA, 17 bp, Homo sapiens
gagaagcggctggcagc

SEQ ID NO: 1855470 - DNA, 20 bp, Homo sapiens
gagaagtcttctatttattt

SEQ ID NO: 1855471 - DNA, 12 bp, Homo sapiens
gagacagcccgg

SEQ ID NO: 1855472 - DNA, 14 bp, Homo sapiens
gagacagcccgggc

SEQ ID NO: 1855473 - DNA, 23 bp, Homo sapiens
gagacagcccgggctctgcctcc

SEQ ID NO: 1855474 - DNA, 15 bp, Homo sapiens
gagaccagccaacct

SEQ ID NO: 1855475 - DNA, 21 bp, Homo sapiens
gagaccatccctgaaggcccc

SEQ ID NO: 1855476 - DNA, 14 bp, Homo sapiens
gagaccctccccac

SEQ ID NO: 1855477 - DNA, 13 bp, Homo sapiens
gagacctcctgcc

SEQ ID NO: 1855478 - DNA, 15 bp, Homo sapiens
gagactcctgcaggc

SEQ ID NO: 1855479 - DNA, 14 bp, Homo sapiens
gagagaaaaacaaa

SEQ ID NO: 1855480 - DNA, 16 bp, Homo sapiens
gagagaaaggactcct

SEQ ID NO: 1855481 - DNA, 16 bp, Homo sapiens
gagagaccaggcaaag

SEQ ID NO: 1855482 - DNA, 13 bp, Homo sapiens
gagagcctggtgc

SEQ ID NO: 1855483 - DNA, 13 bp, Homo sapiens
gagagctggagcc

SEQ ID NO: 1855484 - DNA, 21 bp, Homo sapiens
gagagctggagcctggtgccc

SEQ ID NO: 1855485 - DNA, 16 bp, Homo sapiens
gagagggcaggcatga

SEQ ID NO: 1855486 - DNA, 21 bp, Homo sapiens
gagagggtgggagtgggccca

SEQ ID NO: 1855487 - DNA, 14 bp, Homo sapiens
gagatcagcctggg

SEQ ID NO: 1855488 - DNA, 16 bp, Homo sapiens
gagatcagcctgggca

SEQ ID NO: 1855489 - DNA, 18 bp, Homo sapiens
gagatccagggcaaggcc

SEQ ID NO: 1855490 - DNA, 18 bp, Homo sapiens
gagatcccacatatttca

SEQ ID NO: 1855491 - DNA, 21 bp, Homo sapiens
gagatgaaatcttacagctgg

SEQ ID NO: 1855492 - DNA, 17 bp, Homo sapiens
gagatgggcttcccaag

SEQ ID NO: 1855493 - DNA, 19 bp, Homo sapiens
gagcaaacccagaggtgga

SEQ ID NO: 1855494 - DNA, 13 bp, Homo sapiens
gagcaaaggctga

SEQ ID NO: 1855495 - DNA, 18 bp, Homo sapiens
gagcacacttggcccaag

SEQ ID NO: 1855496 - DNA, 22 bp, Homo sapiens
gagcaccgcctgtgaaatacca

SEQ ID NO: 1855497 - DNA, 21 bp, Homo sapiens
gagcaccttagacagtccctg

SEQ ID NO: 1855498 - DNA, 13 bp, Homo sapiens
gagcacggctctg

SEQ ID NO: 1855499 - DNA, 12 bp, Homo sapiens
gagcagaacagg

SEQ ID NO: 1855500 - DNA, 15 bp, Homo sapiens
gagcagaacaggtag

SEQ ID NO: 1855501 - DNA, 21 bp, Homo sapiens
gagcagccacattcctgatgc

SEQ ID NO: 1855502 - DNA, 17 bp, Homo sapiens
gagcagcctcagaacaa

SEQ ID NO: 1855503 - DNA, 17 bp, Homo sapiens
gagcagtgcaggcacag

SEQ ID NO: 1855504 - DNA, 22 bp, Homo sapiens
gagcagtttctgtcctgctggt

SEQ ID NO: 1855505 - DNA, 12 bp, Homo sapiens
gagcatcaggcc

SEQ ID NO: 1855506 - DNA, 17 bp, Homo sapiens
gagcatcaggccaggcc

SEQ ID NO: 1855507 - DNA, 20 bp, Homo sapiens
gagcatcaggccaggccctc

SEQ ID NO: 1855508 - DNA, 22 bp, Homo sapiens
gagcatcaggccaggccctctg

SEQ ID NO: 1855509 - DNA, 22 bp, Homo sapiens
gagcatgcctggatggggctgc

SEQ ID NO: 1855510 - DNA, 17 bp, Homo sapiens
gagcatggagctggccg

SEQ ID NO: 1855511 - DNA, 21 bp, Homo sapiens
gagccatgtagaagctgcatc

SEQ ID NO: 1855512 - DNA, 12 bp, Homo sapiens
gagcccacgccc

SEQ ID NO: 1855513 - DNA, 14 bp, Homo sapiens
gagcccgcagggcc

SEQ ID NO: 1855514 - DNA, 19 bp, Homo sapiens
gagcccgcagggccatgca

SEQ ID NO: 1855515 - DNA, 20 bp, Homo sapiens
gagcccgcagggccatgcag

SEQ ID NO: 1855516 - DNA, 10 bp, Homo sapiens
gagcctggca

SEQ ID NO: 1855517 - DNA, 15 bp, Homo sapiens
gagcctggcaagaat

SEQ ID NO: 1855518 - DNA, 12 bp, Homo sapiens
gagcctggtgcc

SEQ ID NO: 1855519 - DNA, 12 bp, Homo sapiens
gagccttcagca

SEQ ID NO: 1855520 - DNA, 12 bp, Homo sapiens
gagccttccagg

SEQ ID NO: 1855521 - DNA, 13 bp, Homo sapiens
gagccttccaggg

SEQ ID NO: 1855522 - DNA, 12 bp, Homo sapiens
gagcgccacctc

SEQ ID NO: 1855523 - DNA, 16 bp, Homo sapiens
gagcgtgaatctgtat

SEQ ID NO: 1855524 - DNA, 21 bp, Homo sapiens
gagctcagagagggcaggcat

SEQ ID NO: 1855525 - DNA, 17 bp, Homo sapiens
gagctgacacaggatga

SEQ ID NO: 1855526 - DNA, 21 bp, Homo sapiens
gagctggatagacttgggatg

SEQ ID NO: 1855527 - DNA, 22 bp, Homo sapiens
gagctggatagacttgggatgg

SEQ ID NO: 1855528 - DNA, 18 bp, Homo sapiens
gagcttgaaatagtgtct

SEQ ID NO: 1855529 - DNA, 14 bp, Homo sapiens
gagcttgctccaga

SEQ ID NO: 1855530 - DNA, 22 bp, Homo sapiens
gagcttgctccagattctgatg

SEQ ID NO: 1855531 - DNA, 20 bp, Homo sapiens
gaggaaggaaacccagctct

SEQ ID NO: 1855532 - DNA, 13 bp, Homo sapiens
gaggatctcttga

SEQ ID NO: 1855533 - DNA, 19 bp, Homo sapiens
gaggatctcttgagcctgg

SEQ ID NO: 1855534 - DNA, 20 bp, Homo sapiens
gaggattgcttgagctcagg

SEQ ID NO: 1855535 - DNA, 14 bp, Homo sapiens
gaggattgtggaaa

SEQ ID NO: 1855536 - DNA, 17 bp, Homo sapiens
gaggccaaggtgggagg

SEQ ID NO: 1855537 - DNA, 14 bp, Homo sapiens
gcagctcagagagg

SEQ ID NO: 1855538 - DNA, 14 bp, Homo sapiens
gcagctcatctctg

SEQ ID NO: 1855539 - DNA, 19 bp, Homo sapiens
gcagctcatctctgtccca

SEQ ID NO: 1855540 - DNA, 21 bp, Homo sapiens
gcagctgccaggagcacggct

SEQ ID NO: 1855541 - DNA, 19 bp, Homo sapiens
gcaggactcagctccccag

SEQ ID NO: 1855542 - DNA, 15 bp, Homo sapiens
gcaggaggtggagaa

SEQ ID NO: 1855543 - DNA, 16 bp, Homo sapiens
gcaggatggcctggcc

SEQ ID NO: 1855544 - DNA, 20 bp, Homo sapiens
gcaggattcttcctccctcc

SEQ ID NO: 1855545 - DNA, 18 bp, Homo sapiens
gcaggcagccaggccaca

SEQ ID NO: 1855546 - DNA, 16 bp, Homo sapiens
gcaggcccctctcctc

SEQ ID NO: 1855547 - DNA, 18 bp, Homo sapiens
gcaggcccctctcctccg

SEQ ID NO: 1855548 - DNA, 21 bp, Homo sapiens
gcaggcccctctcctccgtgg

SEQ ID NO: 1855549 - DNA, 20 bp, Homo sapiens
gcaggctacactgacactgg

SEQ ID NO: 1855550 - DNA, 13 bp, Homo sapiens
gcaggcttgggga

SEQ ID NO: 1855551 - DNA, 15 bp, Homo sapiens
gcaggcttggggaaa

SEQ ID NO: 1855552 - DNA, 21 bp, Homo sapiens
gcaggcttggggaaaatggcc

SEQ ID NO: 1855553 - DNA, 21 bp, Homo sapiens
gcagggccatgcagacctcat

SEQ ID NO: 1855554 - DNA, 16 bp, Homo sapiens
gcagggcctcacacgg

SEQ ID NO: 1855555 - DNA, 21 bp, Homo sapiens
gcagtccccttccctccaaga

SEQ ID NO: 1855556 - DNA, 23 bp, Homo sapiens
gcagtccccttccctccaagaag

SEQ ID NO: 1855557 - DNA, 15 bp, Homo sapiens
gcagtgcaggcacag

SEQ ID NO: 1855558 - DNA, 18 bp, Homo sapiens
gcagtgcaggcacagtat

SEQ ID NO: 1855559 - DNA, 12 bp, Homo sapiens
gcagtgtggagt

SEQ ID NO: 1855560 - DNA, 21 bp, Homo sapiens
gcagtgtggagttcaccttgg

SEQ ID NO: 1855561 - DNA, 22 bp, Homo sapiens
gcatactgccttgtttaatggt

SEQ ID NO: 1855562 - DNA, 19 bp, Homo sapiens
gcatcagaggtttgcttcc

SEQ ID NO: 1855563 - DNA, 21 bp, Homo sapiens
gcatcagctggcgtcatgcaa

SEQ ID NO: 1855564 - DNA, 13 bp, Homo sapiens
gcatcaggccagg

SEQ ID NO: 1855565 - DNA, 23 bp, Homo sapiens
gcatcaggccaggccctctgccc

SEQ ID NO: 1855566 - DNA, 23 bp, Homo sapiens
gcatcagtgccctccaggataga

SEQ ID NO: 1855567 - DNA, 20 bp, Homo sapiens
gcatcattatttatgtattg

SEQ ID NO: 1855568 - DNA, 22 bp, Homo sapiens
gcatcccttgaccaggcctggg

SEQ ID NO: 1855569 - DNA, 17 bp, Homo sapiens
gcatgcctggatggggc

SEQ ID NO: 1855570 - DNA, 12 bp, Homo sapiens
gcatggagctgg

SEQ ID NO: 1855571 - DNA, 16 bp, Homo sapiens
gcatgggtcgggagag

SEQ ID NO: 1855572 - DNA, 19 bp, Homo sapiens
gcatgggtcgggagagggg

SEQ ID NO: 1855573 - DNA, 16 bp, Homo sapiens
gcatgtatgacgtgac

SEQ ID NO: 1855574 - DNA, 17 bp, Homo sapiens
gcattagctttaattaa

SEQ ID NO: 1855575 - DNA, 14 bp, Homo sapiens
gcattccccaggag

SEQ ID NO: 1855576 - DNA, 21 bp, Homo sapiens
gcattccccaggaggccagcc

SEQ ID NO: 1855577 - DNA, 20 bp, Homo sapiens
gcattctcattggaaattta

SEQ ID NO: 1855578 - DNA, 13 bp, Homo sapiens
gcattgtgggaag

SEQ ID NO: 1855579 - DNA, 16 bp, Homo sapiens
gcattgtgggaagggg

SEQ ID NO: 1855580 - DNA, 18 bp, Homo sapiens
gcattgtgggaaggggag

SEQ ID NO: 1855581 - DNA, 14 bp, Homo sapiens
gcatttgccaagtc

SEQ ID NO: 1855582 - DNA, 13 bp, Homo sapiens
gcatttgctgaat

SEQ ID NO: 1855583 - DNA, 23 bp, Homo sapiens
gcatttgctgaatacagaggcaa

SEQ ID NO: 1855584 - DNA, 19 bp, Homo sapiens
gcatttggtctcaggcagc

SEQ ID NO: 1855585 - DNA, 13 bp, Homo sapiens
gcattttataaat

SEQ ID NO: 1855586 - DNA, 16 bp, Homo sapiens
gccaaagcctcctcca

SEQ ID NO: 1855587 - DNA, 12 bp, Homo sapiens
gccaaattaaaa

SEQ ID NO: 1855588 - DNA, 22 bp, Homo sapiens
gccaaattaaaaaagataaaca

SEQ ID NO: 1855589 - DNA, 17 bp, Homo sapiens
gccaaattttagattta

SEQ ID NO: 1855590 - DNA, 20 bp, Homo sapiens
gccaacactcaagaagcagg

SEQ ID NO: 1855591 - DNA, 18 bp, Homo sapiens
gccaagcactgtgctcag

SEQ ID NO: 1855592 - DNA, 23 bp, Homo sapiens
gccaagcactgtgctcagggcta

SEQ ID NO: 1855593 - DNA, 22 bp, Homo sapiens
gccaatgtattgataagagggc

SEQ ID NO: 1855594 - DNA, 14 bp, Homo sapiens
gccacagtcatggt

SEQ ID NO: 1855595 - DNA, 17 bp, Homo sapiens
gccacagtcatggtggc

SEQ ID NO: 1855596 - DNA, 20 bp, Homo sapiens
gccaccaacatactcccatc

SEQ ID NO: 1855597 - DNA, 21 bp, Homo sapiens
gccaccaacatactcccatct

SEQ ID NO: 1855598 - DNA, 17 bp, Homo sapiens
gccacctctttaaaaac

SEQ ID NO: 1855599 - DNA, 14 bp, Homo sapiens
gccacctgcggtgc

SEQ ID NO: 1855600 - DNA, 21 bp, Homo sapiens
gccacgtgggcaaacaggcag

SEQ ID NO: 1855601 - DNA, 17 bp, Homo sapiens
gccagagccttaataaa

SEQ ID NO: 1855602 - DNA, 20 bp, Homo sapiens
gccagattctttcctgaggc

SEQ ID NO: 1855603 - DNA, 14 bp, Homo sapiens
gccagcccctgcca

SEQ ID NO: 1855604 - DNA, 13 bp, Homo sapiens
gccagctgccgca

SEQ ID NO: 1855605 - DNA, 17 bp, Homo sapiens
gccagctgccgcaccag

SEQ ID NO: 1855606 - DNA, 19 bp, Homo sapiens
gccagctgccgcaccagcc

SEQ ID NO: 1855607 - DNA, 19 bp, Homo sapiens
gccaggagcacggctctgt

SEQ ID NO: 1855608 - DNA, 17 bp, Homo sapiens
gccaggccctctgccca

SEQ ID NO: 1855609 - DNA, 20 bp, Homo sapiens
gccaggccctctgcccactc

SEQ ID NO: 1855610 - DNA, 21 bp, Homo sapiens
gccaggccctctgcccactcc

SEQ ID NO: 1855611 - DNA, 23 bp, Homo sapiens
gccagggacagagggggtggcct

SEQ ID NO: 1855612 - DNA, 15 bp, Homo sapiens
gccagggcctggaag

SEQ ID NO: 1855613 - DNA, 16 bp, Homo sapiens
gccagggcctggaaga

SEQ ID NO: 1855614 - DNA, 22 bp, Homo sapiens
gccaggggaaaatcagcctgct

SEQ ID NO: 1855615 - DNA, 23 bp, Homo sapiens
gccaggggaaaatcagcctgctc

SEQ ID NO: 1855616 - DNA, 18 bp, Homo sapiens
gccccgttgtgagctgga

SEQ ID NO: 1855617 - DNA, 21 bp, Homo sapiens
gcccctctcctccgtggcaca

SEQ ID NO: 1855618 - DNA, 22 bp, Homo sapiens
gcccctctcctccgtggcacat

SEQ ID NO: 1855619 - DNA, 15 bp, Homo sapiens
gcccctggatgcagc

SEQ ID NO: 1855620 - DNA, 16 bp, Homo sapiens
gcccctggatgcagcc

SEQ ID NO: 1855621 - DNA, 22 bp, Homo sapiens
gcccctggatgcagcctcacag

SEQ ID NO: 1855622 - DNA, 23 bp, Homo sapiens
gccccttctaggtggcaaggctg

SEQ ID NO: 1855623 - DNA, 20 bp, Homo sapiens
gccccttctgacccatgctg

SEQ ID NO: 1855624 - DNA, 19 bp, Homo sapiens
gcccgggctctgcctccca

SEQ ID NO: 1855625 - DNA, 23 bp, Homo sapiens
gcccgggctctgcctcccatcac

SEQ ID NO: 1855626 - DNA, 21 bp, Homo sapiens
gccctccaagaccttctcctt

SEQ ID NO: 1855627 - DNA, 11 bp, Homo sapiens
gccctgcctcc

SEQ ID NO: 1855628 - DNA, 22 bp, Homo sapiens
gccctgcctcctttgtgaggaa

SEQ ID NO: 1855629 - DNA, 15 bp, Homo sapiens
gccctggctgaagga

SEQ ID NO: 1855630 - DNA, 19 bp, Homo sapiens
gccctggctgaaggactgt

SEQ ID NO: 1855631 - DNA, 17 bp, Homo sapiens
gccctgtgggcccccaa

SEQ ID NO: 1855632 - DNA, 21 bp, Homo sapiens
gcccttctctccagcccctgg

SEQ ID NO: 1855633 - DNA, 22 bp, Homo sapiens
gcccttctctccagcccctgga

SEQ ID NO: 1855634 - DNA, 16 bp, Homo sapiens
gccgccagctgccgca

SEQ ID NO: 1855635 - DNA, 12 bp, Homo sapiens
gccggtcatttt

SEQ ID NO: 1855636 - DNA, 15 bp, Homo sapiens
gccgtctacctgagg

SEQ ID NO: 1855637 - DNA, 17 bp, Homo sapiens
gccgtctacctgagggg

SEQ ID NO: 1855638 - DNA, 20 bp, Homo sapiens
gccgtctacctgaggggcct

SEQ ID NO: 1855639 - DNA, 17 bp, Homo sapiens
gccgttgatgttggctg

SEQ ID NO: 1855640 - DNA, 13 bp, Homo sapiens
gcctcacagtcct

SEQ ID NO: 1855641 - DNA, 16 bp, Homo sapiens
gcctcccaactcaccc

SEQ ID NO: 1855642 - DNA, 22 bp, Homo sapiens
gcctcccaactcaccccagccc

SEQ ID NO: 1855643 - DNA, 23 bp, Homo sapiens
gcctcccaactcaccccagcccc

SEQ ID NO: 1855644 - DNA, 18 bp, Homo sapiens
gcctcccttcatgcatgg

SEQ ID NO: 1855645 - DNA, 20 bp, Homo sapiens
gcctcccttcatgcatggaa

SEQ ID NO: 1855646 - DNA, 23 bp, Homo sapiens
gcctcccttcatgcatggaaatt

SEQ ID NO: 1855647 - DNA, 22 bp, Homo sapiens
gcctcctttgtgaggaagccgc

SEQ ID NO: 1855648 - DNA, 18 bp, Homo sapiens
gcctctcccctgcctgcc

SEQ ID NO: 1855649 - DNA, 22 bp, Homo sapiens
gcctctccttgtggcctgggcc

SEQ ID NO: 1855650 - DNA, 14 bp, Homo sapiens
gcctctgcactccc

SEQ ID NO: 1855651 - DNA, 18 bp, Homo sapiens
gcctctgctgatcctccc

SEQ ID NO: 1855652 - DNA, 19 bp, Homo sapiens
gcctctgctgatcctccca

SEQ ID NO: 1855653 - DNA, 21 bp, Homo sapiens
gcctcttatgggctgggttct

SEQ ID NO: 1855654 - DNA, 14 bp, Homo sapiens
gcctcttccagtga

SEQ ID NO: 1855655 - DNA, 23 bp, Homo sapiens
gcctcttctctactctagggaaa

SEQ ID NO: 1855656 - DNA, 12 bp, Homo sapiens
gcctgagctggg

SEQ ID NO: 1855657 - DNA, 14 bp, Homo sapiens
gcctgatcagcagg

SEQ ID NO: 1855658 - DNA, 21 bp, Homo sapiens
gcctgattgccaagctcagga

SEQ ID NO: 1855659 - DNA, 14 bp, Homo sapiens
gcctgccctggtga

SEQ ID NO: 1855660 - DNA, 16 bp, Homo sapiens
gcctgcctcttctcta

SEQ ID NO: 1855661 - DNA, 20 bp, Homo sapiens
gcctgctatgtatttgcaag

SEQ ID NO: 1855662 - DNA, 22 bp, Homo sapiens
gcctggaagacagagacctcct

SEQ ID NO: 1855663 - DNA, 14 bp, Homo sapiens
gcctggaccctgtg

SEQ ID NO: 1855664 - DNA, 15 bp, Homo sapiens
gcctggccaaaggga

SEQ ID NO: 1855665 - DNA, 17 bp, Homo sapiens
gcctggccagggcctgg

SEQ ID NO: 1855666 - DNA, 13 bp, Homo sapiens
gcctggcccctca

SEQ ID NO: 1855667 - DNA, 16 bp, Homo sapiens
gcctggcccctcaggg

SEQ ID NO: 1855668 - DNA, 18 bp, Homo sapiens
gcctgggaaagcccctgc

SEQ ID NO: 1855669 - DNA, 13 bp, Homo sapiens
gcctgggccagag

SEQ ID NO: 1855670 - DNA, 15 bp, Homo sapiens
gcctgggtggacatg

SEQ ID NO: 1855671 - DNA, 20 bp, Homo sapiens
gcctgggtttaaggggagag

SEQ ID NO: 1855672 - DNA, 23 bp, Homo sapiens
gcctgtccacaggcttctgagca

SEQ ID NO: 1855673 - DNA, 15 bp, Homo sapiens
gccttccaggggtgg

SEQ ID NO: 1855674 - DNA, 17 bp, Homo sapiens
gccttgaccattctcca

SEQ ID NO: 1855675 - DNA, 19 bp, Homo sapiens
gccttgaccattctccacc

SEQ ID NO: 1855676 - DNA, 22 bp, Homo sapiens
gccttgaccattctccacctgc

SEQ ID NO: 1855677 - DNA, 19 bp, Homo sapiens
gccttgcaaatagccagtg

SEQ ID NO: 1855678 - DNA, 16 bp, Homo sapiens
gcctttgacctgcctc

SEQ ID NO: 1855679 - DNA, 13 bp, Homo sapiens
gcctttggcaggt

SEQ ID NO: 1855680 - DNA, 15 bp, Homo sapiens
gcctttggcaggtgc

SEQ ID NO: 1855681 - DNA, 15 bp, Homo sapiens
gcgcaaagggcatgg

SEQ ID NO: 1855682 - DNA, 11 bp, Homo sapiens
gcgccaccacg

SEQ ID NO: 1855683 - DNA, 16 bp, Homo sapiens
gcggcattaaagccat

SEQ ID NO: 1855684 - DNA, 15 bp, Homo sapiens
gcggctggcagccca

SEQ ID NO: 1855685 - DNA, 19 bp, Homo sapiens
gcggggactcggtaagcac

SEQ ID NO: 1855686 - DNA, 22 bp, Homo sapiens
gcggtgctatctcccccagccc

SEQ ID NO: 1855687 - DNA, 13 bp, Homo sapiens
gcgtctccagtca

SEQ ID NO: 1855688 - DNA, 21 bp, Homo sapiens
gcgtgctcagttcagaatcac

SEQ ID NO: 1855689 - DNA, 12 bp, Homo sapiens
gctaaataaaca

SEQ ID NO: 1855690 - DNA, 13 bp, Homo sapiens
gctaaatgtgaat

SEQ ID NO: 1855691 - DNA, 16 bp, Homo sapiens
gctaaatgtgaatgat

SEQ ID NO: 1855692 - DNA, 20 bp, Homo sapiens
gctaacacacagctcccata

SEQ ID NO: 1855693 - DNA, 21 bp, Homo sapiens
gctaagagggagggagggctc

SEQ ID NO: 1855694 - DNA, 17 bp, Homo sapiens
gctaagcattagcttta

SEQ ID NO: 1855695 - DNA, 16 bp, Homo sapiens
gctaaggaaattctaa

SEQ ID NO: 1855696 - DNA, 23 bp, Homo sapiens
gctaatattttcctcctgagtgc

SEQ ID NO: 1855697 - DNA, 16 bp, Homo sapiens
gctacatctccaaata

SEQ ID NO: 1855698 - DNA, 16 bp, Homo sapiens
gctaggaacactcctt

SEQ ID NO: 1855699 - DNA, 16 bp, Homo sapiens
gcttgtgacagtgcct

SEQ ID NO: 1855700 - DNA, 22 bp, Homo sapiens
gctttaaacattggttcttgta

SEQ ID NO: 1855701 - DNA, 15 bp, Homo sapiens
gctttaatataaatg

SEQ ID NO: 1855702 - DNA, 16 bp, Homo sapiens
gctttaatataaatgc

SEQ ID NO: 1855703 - DNA, 17 bp, Homo sapiens
gctttaatataaatgca

SEQ ID NO: 1855704 - DNA, 21 bp, Homo sapiens
gctttaatataaatgcaaata

SEQ ID NO: 1855705 - DNA, 20 bp, Homo sapiens
gctttaatatcatcagtatt

SEQ ID NO: 1855706 - DNA, 22 bp, Homo sapiens
gctttaatatcatcagtattga

SEQ ID NO: 1855707 - DNA, 21 bp, Homo sapiens
gctttctgggatgtcacagtc

SEQ ID NO: 1855708 - DNA, 22 bp, Homo sapiens
gctttgagagagaaaggactcc

SEQ ID NO: 1855709 - DNA, 12 bp, Homo sapiens
gctttgcccagc

SEQ ID NO: 1855710 - DNA, 13 bp, Homo sapiens
gctttgctctgcc

SEQ ID NO: 1855711 - DNA, 21 bp, Homo sapiens
ggaaaatacctaattgtggat

SEQ ID NO: 1855712 - DNA, 19 bp, Homo sapiens
ggaaaatcagcctgctcca

SEQ ID NO: 1855713 - DNA, 23 bp, Homo sapiens
ggaaaatcagcctgctccagctg

SEQ ID NO: 1855714 - DNA, 15 bp, Homo sapiens
ggaaaccacagctgc

SEQ ID NO: 1855715 - DNA, 19 bp, Homo sapiens
ggaaaccacagctgctgga

SEQ ID NO: 1855716 - DNA, 21 bp, Homo sapiens
ggaaaccacagctgctggaga

SEQ ID NO: 1855717 - DNA, 15 bp, Homo sapiens
ggaaacccagctctg

SEQ ID NO: 1855718 - DNA, 22 bp, Homo sapiens
ggaaacttaaccacctacaagg

SEQ ID NO: 1855719 - DNA, 20 bp, Homo sapiens
ggaaagacttttccaaccct

SEQ ID NO: 1855720 - DNA, 13 bp, Homo sapiens
ggaaaggctccag

SEQ ID NO: 1855721 - DNA, 17 bp, Homo sapiens
ggaaatattgctggggt

SEQ ID NO: 1855722 - DNA, 22 bp, Homo sapiens
ggaaatgggcagagcagagacc

SEQ ID NO: 1855723 - DNA, 19 bp, Homo sapiens
ggaaattcccttcatctgg

SEQ ID NO: 1855724 - DNA, 20 bp, Homo sapiens
ggaaattcccttcatctgga

SEQ ID NO: 1855725 - DNA, 14 bp, Homo sapiens
ggaaatttagcatt

SEQ ID NO: 1855726 - DNA, 17 bp, Homo sapiens
ggaactcacctggggct

SEQ ID NO: 1855727 - DNA, 16 bp, Homo sapiens
ggaagacaatgtgaaa

SEQ ID NO: 1855728 - DNA, 22 bp, Homo sapiens
ggaagacaatgtgaaaagaaaa

SEQ ID NO: 1855729 - DNA, 18 bp, Homo sapiens
ggaagactttggaaagag

SEQ ID NO: 1855730 - DNA, 17 bp, Homo sapiens
ggcagccaggccacaag

SEQ ID NO: 1855731 - DNA, 21 bp, Homo sapiens
ggcagctcacctctcccttgg

SEQ ID NO: 1855732 - DNA, 13 bp, Homo sapiens
ggcagctcagaga

SEQ ID NO: 1855733 - DNA, 16 bp, Homo sapiens
ggcaggactcagctcc

SEQ ID NO: 1855734 - DNA, 21 bp, Homo sapiens
ggcaggctaaggcgtggagct

SEQ ID NO: 1855735 - DNA, 17 bp, Homo sapiens
ggcaggcttggggaaaa

SEQ ID NO: 1855736 - DNA, 15 bp, Homo sapiens
ggcaggttggtgggg

SEQ ID NO: 1855737 - DNA, 17 bp, Homo sapiens
ggcaggttggtgggggc

SEQ ID NO: 1855738 - DNA, 17 bp, Homo sapiens
ggcagtacctgggcaag

SEQ ID NO: 1855739 - DNA, 16 bp, Homo sapiens
ggcatcagctggcgtc

SEQ ID NO: 1855740 - DNA, 22 bp, Homo sapiens
ggcatgaagtttccttggctgg

SEQ ID NO: 1855741 - DNA, 16 bp, Homo sapiens
ggcattccccaggagg

SEQ ID NO: 1855742 - DNA, 17 bp, Homo sapiens
ggcattccccaggaggc

SEQ ID NO: 1855743 - DNA, 13 bp, Homo sapiens
ggccaaataaagt

SEQ ID NO: 1855744 - DNA, 16 bp, Homo sapiens
ggccacaagacccttg

SEQ ID NO: 1855745 - DNA, 11 bp, Homo sapiens
ggccactgtga

SEQ ID NO: 1855746 - DNA, 23 bp, Homo sapiens
ggccagagagcctggtgctgctg

SEQ ID NO: 1855747 - DNA, 21 bp, Homo sapiens
ggccagatgcacatccctgga

SEQ ID NO: 1855748 - DNA, 14 bp, Homo sapiens
ggccatctgctcct

SEQ ID NO: 1855749 - DNA, 13 bp, Homo sapiens
ggccatgcagacc

SEQ ID NO: 1855750 - DNA, 13 bp, Homo sapiens
ggccatgcaggag

SEQ ID NO: 1855751 - DNA, 16 bp, Homo sapiens
ggccatggagagctgg

SEQ ID NO: 1855752 - DNA, 17 bp, Homo sapiens
ggccatggagagctgga

SEQ ID NO: 1855753 - DNA, 22 bp, Homo sapiens
ggccatggagagctggagcctg

SEQ ID NO: 1855754 - DNA, 11 bp, Homo sapiens
ggccccacttt

SEQ ID NO: 1855755 - DNA, 21 bp, Homo sapiens
ggcccctcagggtccctggtg

SEQ ID NO: 1855756 - DNA, 13 bp, Homo sapiens
ggcccctctcctc

SEQ ID NO: 1855757 - DNA, 24 bp, Homo sapiens
tacagctgggtggcactgccatgc

SEQ ID NO: 1855758 - DNA, 18 bp, Homo sapiens
tacagtatctcagggcct

SEQ ID NO: 1855759 - DNA, 15 bp, Homo sapiens
tacagtcctcccatc

SEQ ID NO: 1855760 - DNA, 17 bp, Homo sapiens
tacagtcctcccatctc

SEQ ID NO: 1855761 - DNA, 13 bp, Homo sapiens
tacatctccaaat

SEQ ID NO: 1855762 - DNA, 14 bp, Homo sapiens
tacatctccaaata

SEQ ID NO: 1855763 - DNA, 14 bp, Homo sapiens
taccagcagagcac

SEQ ID NO: 1855764 - DNA, 21 bp, Homo sapiens
taccagggagatttgctcaat

SEQ ID NO: 1855765 - DNA, 23 bp, Homo sapiens
tacccaaccagggccccggggcc

SEQ ID NO: 1855766 - DNA, 23 bp, Homo sapiens
tacccacccccacccaagggcct

SEQ ID NO: 1855767 - DNA, 13 bp, Homo sapiens
taccctctgggtc

SEQ ID NO: 1855768 - DNA, 18 bp, Homo sapiens
tacctactgtgtcttgga

SEQ ID NO: 1855769 - DNA, 13 bp, Homo sapiens
tacctgaggggcc

SEQ ID NO: 1855770 - DNA, 15 bp, Homo sapiens
tacctgaggggcctc

SEQ ID NO: 1855771 - DNA, 16 bp, Homo sapiens
tacctgaggggcctct

SEQ ID NO: 1855772 - DNA, 10 bp, Homo sapiens
tacctgtccc

SEQ ID NO: 1855773 - DNA, 14 bp, Homo sapiens
tacctgtccccctg

SEQ ID NO: 1855774 - DNA, 14 bp, Homo sapiens
taccttctccctca

SEQ ID NO: 1855775 - DNA, 13 bp, Homo sapiens
tacgctagttatc

SEQ ID NO: 1855776 - DNA, 21 bp, Homo sapiens
tacggctatattggtttatgt

SEQ ID NO: 1855777 - DNA, 13 bp, Homo sapiens
tactaaacatgta

SEQ ID NO: 1855778 - DNA, 14 bp, Homo sapiens
tactaaacatgtat

SEQ ID NO: 1855779 - DNA, 13 bp, Homo sapiens
tactaactttcct

SEQ ID NO: 1855780 - DNA, 22 bp, Homo sapiens
tactaataaaatttaaaagtct

SEQ ID NO: 1855781 - DNA, 22 bp, Homo sapiens
tactacagtcctcccatctcac

SEQ ID NO: 1855782 - DNA, 12 bp, Homo sapiens
tactcacctcac

SEQ ID NO: 1855783 - DNA, 14 bp, Homo sapiens
tactcacctcaccc

SEQ ID NO: 1855784 - DNA, 19 bp, Homo sapiens
tactctacaaaatatagct

SEQ ID NO: 1855785 - DNA, 16 bp, Homo sapiens
tactctaccctcttag

SEQ ID NO: 1855786 - DNA, 22 bp, Homo sapiens
tactcttcagttaagcctttgg

SEQ ID NO: 1855787 - DNA, 16 bp, Homo sapiens
tactgattgggaggtg

SEQ ID NO: 1855788 - DNA, 16 bp, Homo sapiens
tacttctttgctttgc

SEQ ID NO: 1855789 - DNA, 20 bp, Homo sapiens
tacttgtaaatataaagacg

SEQ ID NO: 1855790 - DNA, 23 bp, Homo sapiens
tagaacagagaaagaggaagctt

SEQ ID NO: 1855791 - DNA, 20 bp, Homo sapiens
tagaagaggtggccccatat

SEQ ID NO: 1855792 - DNA, 19 bp, Homo sapiens
tagaatgttttcaaatgtt

SEQ ID NO: 1855793 - DNA, 18 bp, Homo sapiens
tagacttaatagaaacat

SEQ ID NO: 1855794 - DNA, 22 bp, Homo sapiens
tagacttgggatggggagggag

SEQ ID NO: 1855795 - DNA, 11 bp, Homo sapiens
tagagcaggcg

SEQ ID NO: 1855796 - DNA, 22 bp, Homo sapiens
tagattttagaccctattgctg

SEQ ID NO: 1855797 - DNA, 17 bp, Homo sapiens
tagcacagaccctgccc

SEQ ID NO: 1855798 - DNA, 22 bp, Homo sapiens
tagcacagaccctgccctgtgg

SEQ ID NO: 1855799 - DNA, 13 bp, Homo sapiens
tagcacatgattt

SEQ ID NO: 1855800 - DNA, 21 bp, Homo sapiens
tagctccccgcttctgcctgc

SEQ ID NO: 1855801 - DNA, 16 bp, Homo sapiens
tagcttatgaaaagaa

SEQ ID NO: 1855802 - DNA, 15 bp, Homo sapiens
tagctttaattaagc

SEQ ID NO: 1855803 - DNA, 14 bp, Homo sapiens
taggaacactcctt

SEQ ID NO: 1855804 - DNA, 13 bp, Homo sapiens
taggaagactttg

SEQ ID NO: 1855805 - DNA, 14 bp, Homo sapiens
taggaagactttgg

SEQ ID NO: 1855806 - DNA, 17 bp, Homo sapiens
taggaagactttggaaa

SEQ ID NO: 1855807 - DNA, 21 bp, Homo sapiens
taggaagagcccgcagggcca

SEQ ID NO: 1855808 - DNA, 12 bp, Homo sapiens
taggaatcagca

SEQ ID NO: 1855809 - DNA, 15 bp, Homo sapiens
taggaatcagcaaga

SEQ ID NO: 1855810 - DNA, 16 bp, Homo sapiens
taggcaggacatgctg

SEQ ID NO: 1855811 - DNA, 17 bp, Homo sapiens
taggcaggacatgctga

SEQ ID NO: 1855812 - DNA, 13 bp, Homo sapiens
taggccagcaagc

SEQ ID NO: 1855813 - DNA, 23 bp, Homo sapiens
taggccagcaagcggggatgtcc

SEQ ID NO: 1855814 - DNA, 21 bp, Homo sapiens
taggggctggggccaaataaa

SEQ ID NO: 1855815 - DNA, 17 bp, Homo sapiens
taggtcagtagactgtg

SEQ ID NO: 1855816 - DNA, 21 bp, Homo sapiens
taggttggcaaaaaggcagga

SEQ ID NO: 1855817 - DNA, 12 bp, Homo sapiens
tagtgctttgag

SEQ ID NO: 1855818 - DNA, 15 bp, Homo sapiens
tagtgctttgagaga

SEQ ID NO: 1855819 - DNA, 16 bp, Homo sapiens
tagttagtgattatat

SEQ ID NO: 1855820 - DNA, 13 bp, Homo sapiens
tagtttctccaag

SEQ ID NO: 1855821 - DNA, 15 bp, Homo sapiens
tataaacaagaaaaa

SEQ ID NO: 1855822 - DNA, 15 bp, Homo sapiens
tataaatatattatt

SEQ ID NO: 1855823 - DNA, 20 bp, Homo sapiens
tataaatcgcttttgataat

SEQ ID NO: 1855824 - DNA, 23 bp, Homo sapiens
tataaatcgcttttgataatcaa

SEQ ID NO: 1855825 - DNA, 16 bp, Homo sapiens
tataagcatcattatt

SEQ ID NO: 1855826 - DNA, 16 bp, Homo sapiens
tatacctttgccttgg

SEQ ID NO: 1855827 - DNA, 15 bp, Homo sapiens
tatactatatttttc

SEQ ID NO: 1855828 - DNA, 21 bp, Homo sapiens
tataggttactcataaggcat

SEQ ID NO: 1855829 - DNA, 19 bp, Homo sapiens
tatataaatatattattac

SEQ ID NO: 1855830 - DNA, 18 bp, Homo sapiens
tatataaccacatttcta

SEQ ID NO: 1855831 - DNA, 12 bp, Homo sapiens
tatatataaata

SEQ ID NO: 1855832 - DNA, 20 bp, Homo sapiens
tatatgttctaattaataaa

SEQ ID NO: 1855833 - DNA, 18 bp, Homo sapiens
tatcacctagctgaatgt

SEQ ID NO: 1855834 - DNA, 13 bp, Homo sapiens
tatcagaggtcta

SEQ ID NO: 1855835 - DNA, 16 bp, Homo sapiens
tatcagaggtctattt

SEQ ID NO: 1855836 - DNA, 22 bp, Homo sapiens
tatcagaggtctatttttacct

SEQ ID NO: 1855837 - DNA, 13 bp, Homo sapiens
tatctcagggcct

SEQ ID NO: 1855838 - DNA, 18 bp, Homo sapiens
tatctcccccagccccat

SEQ ID NO: 1855839 - DNA, 18 bp, Homo sapiens
tatctgacatctctgcaa

SEQ ID NO: 1855840 - DNA, 14 bp, Homo sapiens
tatgacattcatgc

SEQ ID NO: 1855841 - DNA, 14 bp, Homo sapiens
tatgaccacactcc

SEQ ID NO: 1855842 - DNA, 17 bp, Homo sapiens
tatgatttttttttcca

SEQ ID NO: 1855843 - DNA, 16 bp, Homo sapiens
tatggacggtgctcca

SEQ ID NO: 1855844 - DNA, 19 bp, Homo sapiens
tatggactcagccttgcaa

SEQ ID NO: 1855845 - DNA, 17 bp, Homo sapiens
tatggagctcagagagg

SEQ ID NO: 1855846 - DNA, 18 bp, Homo sapiens
tatggtaggggagggcag

SEQ ID NO: 1855847 - DNA, 15 bp, Homo sapiens
tatgtaacaacaatt

SEQ ID NO: 1855848 - DNA, 19 bp, Homo sapiens
tatgtaacaacaattattt

SEQ ID NO: 1855849 - DNA, 20 bp, Homo sapiens
tatgtgcacatctgttttgt

SEQ ID NO: 1855850 - DNA, 14 bp, Homo sapiens
tatgtgcatttaat

SEQ ID NO: 1855851 - DNA, 21 bp, Homo sapiens
tatgttatatataaatatatt

SEQ ID NO: 1855852 - DNA, 14 bp, Homo sapiens
tatgttccattaaa

SEQ ID NO: 1855853 - DNA, 13 bp, Homo sapiens
tattaaagaaaaa

SEQ ID NO: 1855854 - DNA, 18 bp, Homo sapiens
tattaaagaaaaaaatgt

SEQ ID NO: 1855855 - DNA, 16 bp, Homo sapiens
tattaacaaattgcat

SEQ ID NO: 1855856 - DNA, 20 bp, Homo sapiens
tattaacaaattgcatttgt

SEQ ID NO: 1855857 - DNA, 13 bp, Homo sapiens
tattaagaatgaa

SEQ ID NO: 1855858 - DNA, 14 bp, Homo sapiens
tattaaggaagaca

SEQ ID NO: 1855859 - DNA, 12 bp, Homo sapiens
tattaattacaa

SEQ ID NO: 1855860 - DNA, 23 bp, Homo sapiens
tattacttgtaaatataaagacg

SEQ ID NO: 1855861 - DNA, 12 bp, Homo sapiens
tattagagaaga

SEQ ID NO: 1855862 - DNA, 17 bp, Homo sapiens
tattatattcattcttt

SEQ ID NO: 1855863 - DNA, 18 bp, Homo sapiens
tattattacttgtaaata

SEQ ID NO: 1855864 - DNA, 14 bp, Homo sapiens
tattcaggaagctc

SEQ ID NO: 1855865 - DNA, 18 bp, Homo sapiens
tattccctgttaaaattt

SEQ ID NO: 1855866 - DNA, 14 bp, Homo sapiens
tattcggcaaggaa

SEQ ID NO: 1855867 - DNA, 15 bp, Homo sapiens
tattgaagcatttta

SEQ ID NO: 1855868 - DNA, 19 bp, Homo sapiens
tattgaagcattttataaa

SEQ ID NO: 1855869 - DNA, 14 bp, Homo sapiens
tattgtgcaatgtg

SEQ ID NO: 1855870 - DNA, 14 bp, Homo sapiens
tatttaacaaaatt

SEQ ID NO: 1855871 - DNA, 23 bp, Homo sapiens
tatttaatttgaaggtagaatgt

SEQ ID NO: 1855872 - DNA, 17 bp, Homo sapiens
tatttataatcactttt

SEQ ID NO: 1855873 - DNA, 19 bp, Homo sapiens
tatttcaaaaacatgcttt

SEQ ID NO: 1855874 - DNA, 18 bp, Homo sapiens
tatttcacccatctctca

SEQ ID NO: 1855875 - DNA, 21 bp, Homo sapiens
tatttgaacatgtgccttttc

SEQ ID NO: 1855876 - DNA, 16 bp, Homo sapiens
tatttgaagatttaat

SEQ ID NO: 1855877 - DNA, 13 bp, Homo sapiens
tatttgcaaggct

SEQ ID NO: 1855878 - DNA, 22 bp, Homo sapiens
tattttaggtgtaaaataatta

SEQ ID NO: 1855879 - DNA, 14 bp, Homo sapiens
tattttatgttata

SEQ ID NO: 1855880 - DNA, 21 bp, Homo sapiens
tattttatgttatatataaat

SEQ ID NO: 1855881 - DNA, 19 bp, Homo sapiens
tattttcatccttgtctta

SEQ ID NO: 1855882 - DNA, 22 bp, Homo sapiens
tattttccctattagagaagag

SEQ ID NO: 1855883 - DNA, 16 bp, Homo sapiens
tatttttctaactaca

SEQ ID NO: 1855884 - DNA, 16 bp, Homo sapiens
tatttttggcaaagcc

SEQ ID NO: 1855885 - DNA, 14 bp, Homo sapiens
tcaaaaaaagaaaa

SEQ ID NO: 1855886 - DNA, 21 bp, Homo sapiens
tcaaaaacatgcttttccaaa

SEQ ID NO: 1855887 - DNA, 19 bp, Homo sapiens
tcaaaacccatctgggctc

SEQ ID NO: 1855888 - DNA, 16 bp, Homo sapiens
tcaaaagctgggcagg

SEQ ID NO: 1855889 - DNA, 12 bp, Homo sapiens
tcaaacactgca

SEQ ID NO: 1855890 - DNA, 23 bp, Homo sapiens
tcaaacggcctcactaggcttct

SEQ ID NO: 1855891 - DNA, 16 bp, Homo sapiens
tcaaactactttgctg

SEQ ID NO: 1855892 - DNA, 20 bp, Homo sapiens
tcaaactactttgctgctaa

SEQ ID NO: 1855893 - DNA, 15 bp, Homo sapiens
tcaaagagattcgaa

SEQ ID NO: 1855894 - DNA, 15 bp, Homo sapiens
tcaaagcaaatgtct

SEQ ID NO: 1855895 - DNA, 23 bp, Homo sapiens
tcaaagcaaatgtcttcctggat

SEQ ID NO: 1855896 - DNA, 10 bp, Homo sapiens
tcaaagcaga

SEQ ID NO: 1855897 - DNA, 22 bp, Homo sapiens
tcaatacctggcctcatttaaa

SEQ ID NO: 1855898 - DNA, 19 bp, Homo sapiens
tcaatctggattcatattt

SEQ ID NO: 1855899 - DNA, 12 bp, Homo sapiens
tcaatgagcatg

SEQ ID NO: 1855900 - DNA, 17 bp, Homo sapiens
tcaatgagcatgtttag

SEQ ID NO: 1855901 - DNA, 13 bp, Homo sapiens
tcaattcaacact

SEQ ID NO: 1855902 - DNA, 21 bp, Homo sapiens
tcacacatgagcatcaggcca

SEQ ID NO: 1855903 - DNA, 22 bp, Homo sapiens
tcacacatgagcatcaggccag

SEQ ID NO: 1855904 - DNA, 15 bp, Homo sapiens
tcacagatgggtgct

SEQ ID NO: 1855905 - DNA, 15 bp, Homo sapiens
tcacagcagcttcta

SEQ ID NO: 1855906 - DNA, 13 bp, Homo sapiens
tcacagcatttgc

SEQ ID NO: 1855907 - DNA, 15 bp, Homo sapiens
tcacagtccaaccag

SEQ ID NO: 1855908 - DNA, 19 bp, Homo sapiens
tcacagtccttaccagcag

SEQ ID NO: 1855909 - DNA, 20 bp, Homo sapiens
tcacagttttggttgcttta

SEQ ID NO: 1855910 - DNA, 23 bp, Homo sapiens
tcacagttttggttgctttaata

SEQ ID NO: 1855911 - DNA, 18 bp, Homo sapiens
tcacattaatctcaaaga

SEQ ID NO: 1855912 - DNA, 17 bp, Homo sapiens
tcaccaacgtctgtgcc

SEQ ID NO: 1855913 - DNA, 22 bp, Homo sapiens
tcaccccggccacctgcggtgc

SEQ ID NO: 1855914 - DNA, 18 bp, Homo sapiens
tcacccgctaagagggag

SEQ ID NO: 1855915 - DNA, 19 bp, Homo sapiens
tcacccgctaagagggagg

SEQ ID NO: 1855916 - DNA, 16 bp, Homo sapiens
tcacctagctgaatgt

SEQ ID NO: 1855917 - DNA, 20 bp, Homo sapiens
tcacctagctgaatgttttt

SEQ ID NO: 1855918 - DNA, 15 bp, Homo sapiens
tcacctctcccttgg

SEQ ID NO: 1855919 - DNA, 16 bp, Homo sapiens
tcacctggggctgctg

SEQ ID NO: 1855920 - DNA, 13 bp, Homo sapiens
tcacctttattct

SEQ ID NO: 1855921 - DNA, 14 bp, Homo sapiens
tcacctttgtcccc

SEQ ID NO: 1855922 - DNA, 15 bp, Homo sapiens
tcacctttgtcccca

SEQ ID NO: 1855923 - DNA, 17 bp, Homo sapiens
tcacctttgtccccacc

SEQ ID NO: 1855924 - DNA, 14 bp, Homo sapiens
tcacggaagagcct

SEQ ID NO: 1855925 - DNA, 13 bp, Homo sapiens
tcactccttgaaa

SEQ ID NO: 1855926 - DNA, 16 bp, Homo sapiens
tcactctggcagctca

SEQ ID NO: 1855927 - DNA, 15 bp, Homo sapiens
tcactgagacagccc

SEQ ID NO: 1855928 - DNA, 18 bp, Homo sapiens
tcactgccatgccagctt

SEQ ID NO: 1855929 - DNA, 14 bp, Homo sapiens
tcactggaactcag

SEQ ID NO: 1855930 - DNA, 18 bp, Homo sapiens
tcacttacgtttgtcctt

SEQ ID NO: 1855931 - DNA, 21 bp, Homo sapiens
tcacttgtcaggagtgtgtgt

SEQ ID NO: 1855932 - DNA, 21 bp, Homo sapiens
tcactttgaaaagttggaagg

SEQ ID NO: 1855933 - DNA, 19 bp, Homo sapiens
tcagaaacaccctcacact

SEQ ID NO: 1855934 - DNA, 21 bp, Homo sapiens
tcagaaacaccctcacactgg

SEQ ID NO: 1855935 - DNA, 16 bp, Homo sapiens
tcagaacatactgatt

SEQ ID NO: 1855936 - DNA, 19 bp, Homo sapiens
tcagaaggcaaatgacttt

SEQ ID NO: 1855937 - DNA, 17 bp, Homo sapiens
tcagaatcacttctgag

SEQ ID NO: 1855938 - DNA, 19 bp, Homo sapiens
tcagaatcacttctgagaa

SEQ ID NO: 1855939 - DNA, 18 bp, Homo sapiens
tcagaatggaatgctctg

SEQ ID NO: 1855940 - DNA, 16 bp, Homo sapiens
tcagacagctgcctgg

SEQ ID NO: 1855941 - DNA, 17 bp, Homo sapiens
tcagacagctgcctggg

SEQ ID NO: 1855942 - DNA, 18 bp, Homo sapiens
tcagacagctgcctggga

SEQ ID NO: 1855943 - DNA, 16 bp, Homo sapiens
tcagagactcctgcag

SEQ ID NO: 1855944 - DNA, 17 bp, Homo sapiens
tcagagactcctgcagg

SEQ ID NO: 1855945 - DNA, 20 bp, Homo sapiens
tcagagactcctgcaggcag

SEQ ID NO: 1855946 - DNA, 21 bp, Homo sapiens
tcagagactcctgcaggcagc

SEQ ID NO: 1855947 - DNA, 17 bp, Homo sapiens
tcagagatataataagc

SEQ ID NO: 1855948 - DNA, 20 bp, Homo sapiens
tcagagatataataagccca

SEQ ID NO: 1855949 - DNA, 21 bp, Homo sapiens
tcagaggggaataaactgttg

SEQ ID NO: 1855950 - DNA, 15 bp, Homo sapiens
tcagagtatggagct

SEQ ID NO: 1855951 - DNA, 13 bp, Homo sapiens
tcagataactgtt

SEQ ID NO: 1855952 - DNA, 15 bp, Homo sapiens
tcagcagagacgggg

SEQ ID NO: 1855953 - DNA, 19 bp, Homo sapiens
tcagcctgctccagctgtt

SEQ ID NO: 1855954 - DNA, 12 bp, Homo sapiens
tcagcctgggca

SEQ ID NO: 1855955 - DNA, 13 bp, Homo sapiens
tcagccttgcaaa

SEQ ID NO: 1855956 - DNA, 17 bp, Homo sapiens
tcagctacaattgtaaa

SEQ ID NO: 1855957 - DNA, 13 bp, Homo sapiens
tcagctccccaga

SEQ ID NO: 1855958 - DNA, 15 bp, Homo sapiens
tcagctccccagagt

SEQ ID NO: 1855959 - DNA, 23 bp, Homo sapiens
tcagctctgcaagaattgaagca

SEQ ID NO: 1855960 - DNA, 19 bp, Homo sapiens
tcaggaagctcagggcctg

SEQ ID NO: 1855961 - DNA, 22 bp, Homo sapiens
tcaggcagcaccacactgggtg

SEQ ID NO: 1855962 - DNA, 18 bp, Homo sapiens
tcaggcaggtgggatgga

SEQ ID NO: 1855963 - DNA, 12 bp, Homo sapiens
tcaggccaggcc

SEQ ID NO: 1855964 - DNA, 22 bp, Homo sapiens
tcaggccatcatcagtggagcc

SEQ ID NO: 1855965 - DNA, 16 bp, Homo sapiens
tcagggcctggctcag

SEQ ID NO: 1855966 - DNA, 23 bp, Homo sapiens
tcagggctaaacgggcattgcct

SEQ ID NO: 1855967 - DNA, 23 bp, Homo sapiens
tcaggggtgtgcggcctttggct

SEQ ID NO: 1855968 - DNA, 13 bp, Homo sapiens
tcagggtccctgg

SEQ ID NO: 1855969 - DNA, 16 bp, Homo sapiens
tcagggtctctgctgc

SEQ ID NO: 1855970 - DNA, 18 bp, Homo sapiens
tcagggtctctgctgccg

SEQ ID NO: 1855971 - DNA, 15 bp, Homo sapiens
tcaggtgagaagcag

SEQ ID NO: 1855972 - DNA, 16 bp, Homo sapiens
tcaggtgagaagcaga

SEQ ID NO: 1855973 - DNA, 17 bp, Homo sapiens
tcagtaacatttctgtt

SEQ ID NO: 1855974 - DNA, 18 bp, Homo sapiens
tcagtattgaagcatttt

SEQ ID NO: 1855975 - DNA, 19 bp, Homo sapiens
tcagtattgaagcatttta

SEQ ID NO: 1855976 - DNA, 20 bp, Homo sapiens
tcagtgccctccaggataga

SEQ ID NO: 1855977 - DNA, 16 bp, Homo sapiens
tcagtgtccaaagcag

SEQ ID NO: 1855978 - DNA, 22 bp, Homo sapiens
tcagttagagctgacacaaacc

SEQ ID NO: 1855979 - DNA, 20 bp, Homo sapiens
tcagttgttatttattgaaa

SEQ ID NO: 1855980 - DNA, 13 bp, Homo sapiens
tcatacacagaaa

SEQ ID NO: 1855981 - DNA, 19 bp, Homo sapiens
tcatcaaatggaagacaca

SEQ ID NO: 1855982 - DNA, 17 bp, Homo sapiens
tcatcaaggcactgcct

SEQ ID NO: 1855983 - DNA, 18 bp, Homo sapiens
tcatcaaggcactgcctg

SEQ ID NO: 1855984 - DNA, 19 bp, Homo sapiens
tcatcaaggcactgcctga

SEQ ID NO: 1855985 - DNA, 20 bp, Homo sapiens
tcatcaccaacgtctgtgcc

SEQ ID NO: 1855986 - DNA, 17 bp, Homo sapiens
tcatccctaatgctgca

SEQ ID NO: 1855987 - DNA, 13 bp, Homo sapiens
tcatccttgtctt

SEQ ID NO: 1855988 - DNA, 19 bp, Homo sapiens
tcatctcctttgcagaatg

SEQ ID NO: 1855989 - DNA, 14 bp, Homo sapiens
tcatctctgtccca

SEQ ID NO: 1855990 - DNA, 12 bp, Homo sapiens
tcatctggaacc

SEQ ID NO: 1855991 - DNA, 16 bp, Homo sapiens
tcatgaagcaggaggc

SEQ ID NO: 1855992 - DNA, 14 bp, Homo sapiens
tcatgcaaactctt

SEQ ID NO: 1855993 - DNA, 14 bp, Homo sapiens
tcatgcatggaaat

SEQ ID NO: 1855994 - DNA, 16 bp, Homo sapiens
tcatgcccagctctct

SEQ ID NO: 1855995 - DNA, 17 bp, Homo sapiens
tcatgcctggcttcgca

SEQ ID NO: 1855996 - DNA, 14 bp, Homo sapiens
tcattaaacgtcat

SEQ ID NO: 1855997 - DNA, 13 bp, Homo sapiens
tcattagagcagg

SEQ ID NO: 1855998 - DNA, 23 bp, Homo sapiens
tcattagttttgaagattctatg

SEQ ID NO: 1855999 - DNA, 16 bp, Homo sapiens
tcattatgttaatatt

SEQ ID NO: 1856000 - DNA, 15 bp, Homo sapiens
tcattccattctgga

SEQ ID NO: 1856001 - DNA, 16 bp, Homo sapiens
tcattccattctggaa

SEQ ID NO: 1856002 - DNA, 21 bp, Homo sapiens
tcattctttttgaaatgtcaa

SEQ ID NO: 1856003 - DNA, 20 bp, Homo sapiens
tcattgcaacctccaccttc

SEQ ID NO: 1856004 - DNA, 14 bp, Homo sapiens
tcattggaaattta

SEQ ID NO: 1856005 - DNA, 15 bp, Homo sapiens
tcattggaaatttag

SEQ ID NO: 1856006 - DNA, 22 bp, Homo sapiens
tcatttatcatcacaaatggct

SEQ ID NO: 1856007 - DNA, 16 bp, Homo sapiens
tcatttcaggagcagc

SEQ ID NO: 1856008 - DNA, 13 bp, Homo sapiens
tcatttgttcatt

SEQ ID NO: 1856009 - DNA, 23 bp, Homo sapiens
tccaaaggccatggagagctgga

SEQ ID NO: 1856010 - DNA, 12 bp, Homo sapiens
tccaagaagccc

SEQ ID NO: 1856011 - DNA, 14 bp, Homo sapiens
tccaagaagcccag

SEQ ID NO: 1856012 - DNA, 19 bp, Homo sapiens
tccaagaagcccaggaaag

SEQ ID NO: 1856013 - DNA, 22 bp, Homo sapiens
tccaagaagcccaggaaaggct

SEQ ID NO: 1856014 - DNA, 20 bp, Homo sapiens
tccaagaccttctccttcac

SEQ ID NO: 1856015 - DNA, 16 bp, Homo sapiens
tccaagagtctgatga

SEQ ID NO: 1856016 - DNA, 14 bp, Homo sapiens
tccaagcaggacat

SEQ ID NO: 1856017 - DNA, 22 bp, Homo sapiens
tccaagcaggacatggacaagg

SEQ ID NO: 1856018 - DNA, 14 bp, Homo sapiens
tccaagctcccagg

SEQ ID NO: 1856019 - DNA, 20 bp, Homo sapiens
tccaaggaaaccacagctgc

SEQ ID NO: 1856020 - DNA, 15 bp, Homo sapiens
tccaattaaggattt

SEQ ID NO: 1856021 - DNA, 17 bp, Homo sapiens
tccaattaaggatttta

SEQ ID NO: 1856022 - DNA, 14 bp, Homo sapiens
tccacagagtataa

SEQ ID NO: 1856023 - DNA, 22 bp, Homo sapiens
tccacataaggaaactgggttc

SEQ ID NO: 1856024 - DNA, 12 bp, Homo sapiens
tccacctgccag

SEQ ID NO: 1856025 - DNA, 13 bp, Homo sapiens
tccacctgccagg

SEQ ID NO: 1856026 - DNA, 17 bp, Homo sapiens
tccacctgccagggaca

SEQ ID NO: 1856027 - DNA, 21 bp, Homo sapiens
tccacctgccagggacagagg

SEQ ID NO: 1856028 - DNA, 19 bp, Homo sapiens
tccactcccaggcagccct

SEQ ID NO: 1856029 - DNA, 15 bp, Homo sapiens
tccagattctgatgc

SEQ ID NO: 1856030 - DNA, 18 bp, Homo sapiens
tccagattctgatgcata

SEQ ID NO: 1856031 - DNA, 23 bp, Homo sapiens
tccagccaaagcctcctccagcc

SEQ ID NO: 1856032 - DNA, 14 bp, Homo sapiens
tccagcccctggat

SEQ ID NO: 1856033 - DNA, 17 bp, Homo sapiens
tccagcccctggatgca

SEQ ID NO: 1856034 - DNA, 19 bp, Homo sapiens
tccagcccctggatgcagc

SEQ ID NO: 1856035 - DNA, 22 bp, Homo sapiens
tccagcccctggatgcagcctc

SEQ ID NO: 1856036 - DNA, 17 bp, Homo sapiens
tccagccctggctgaag

SEQ ID NO: 1856037 - DNA, 14 bp, Homo sapiens
tccagcctggagat

SEQ ID NO: 1856038 - DNA, 17 bp, Homo sapiens
tccaggagcagccacat

SEQ ID NO: 1856039 - DNA, 20 bp, Homo sapiens
tccaggctgggagagccttc

SEQ ID NO: 1856040 - DNA, 22 bp, Homo sapiens
tccaggtgcacaagctccaagc

SEQ ID NO: 1856041 - DNA, 18 bp, Homo sapiens
tccaggtttaagctgtta

SEQ ID NO: 1856042 - DNA, 20 bp, Homo sapiens
tccaggtttaagctgttact

SEQ ID NO: 1856043 - DNA, 23 bp, Homo sapiens
tccagtcatctgtaagagcttgc

SEQ ID NO: 1856044 - DNA, 19 bp, Homo sapiens
tccagtgaggctctgccct

SEQ ID NO: 1856045 - DNA, 20 bp, Homo sapiens
tccagtgaggctctgccctt

SEQ ID NO: 1856046 - DNA, 23 bp, Homo sapiens
tccagtgaggctctgcccttggt

SEQ ID NO: 1856047 - DNA, 20 bp, Homo sapiens
tccatagagagcaagacgct

SEQ ID NO: 1856048 - DNA, 16 bp, Homo sapiens
tccatccaggccattc

SEQ ID NO: 1856049 - DNA, 15 bp, Homo sapiens
tccatgagtcccctg

SEQ ID NO: 1856050 - DNA, 16 bp, Homo sapiens
tccatgagtcccctgt

SEQ ID NO: 1856051 - DNA, 14 bp, Homo sapiens
tccatgatgctggg

SEQ ID NO: 1856052 - DNA, 18 bp, Homo sapiens
tccatgtgagaatatttt

SEQ ID NO: 1856053 - DNA, 18 bp, Homo sapiens
tcccaactcaccccagcc

SEQ ID NO: 1856054 - DNA, 19 bp, Homo sapiens
tcccaactcaccccagccc

SEQ ID NO: 1856055 - DNA, 22 bp, Homo sapiens
tcccaagagaaggggaagcact

SEQ ID NO: 1856056 - DNA, 16 bp, Homo sapiens
tcccaagcggtgtctc

SEQ ID NO: 1856057 - DNA, 17 bp, Homo sapiens
tcccaagcggtgtctct

SEQ ID NO: 1856058 - DNA, 14 bp, Homo sapiens
tcccaccccacaca

SEQ ID NO: 1856059 - DNA, 21 bp, Homo sapiens
tcccacttggcatcagctggc

SEQ ID NO: 1856060 - DNA, 18 bp, Homo sapiens
tcccagatacttgggggg

SEQ ID NO: 1856061 - DNA, 22 bp, Homo sapiens
tcccaggatgagcatcccagga

SEQ ID NO: 1856062 - DNA, 23 bp, Homo sapiens
tcccaggcattccccaggaggcc

SEQ ID NO: 1856063 - DNA, 16 bp, Homo sapiens
tcccagtggctgctgc

SEQ ID NO: 1856064 - DNA, 18 bp, Homo sapiens
tcccagtggctgctgccc

SEQ ID NO: 1856065 - DNA, 19 bp, Homo sapiens
tcccagtggctgctgccca

SEQ ID NO: 1856066 - DNA, 21 bp, Homo sapiens
tcccagtggctgctgcccagg

SEQ ID NO: 1856067 - DNA, 15 bp, Homo sapiens
tcccatcctgtgtgt

SEQ ID NO: 1856068 - DNA, 14 bp, Homo sapiens
tcccatctcacaca

SEQ ID NO: 1856069 - DNA, 19 bp, Homo sapiens
tcccatctcacacatgagc

SEQ ID NO: 1856070 - DNA, 17 bp, Homo sapiens
tccccacagtgccaccc

SEQ ID NO: 1856071 - DNA, 15 bp, Homo sapiens
tccccaccgcagaca

SEQ ID NO: 1856072 - DNA, 18 bp, Homo sapiens
tccccaccgcagacagga

SEQ ID NO: 1856073 - DNA, 18 bp, Homo sapiens
tccccagagttccccatg

SEQ ID NO: 1856074 - DNA, 14 bp, Homo sapiens
tccccaggaggcca

SEQ ID NO: 1856075 - DNA, 16 bp, Homo sapiens
tccccaggaggccagc

SEQ ID NO: 1856076 - DNA, 17 bp, Homo sapiens
tccccatgtctcgactc

SEQ ID NO: 1856077 - DNA, 17 bp, Homo sapiens
tcccccagccccatcct

SEQ ID NO: 1856078 - DNA, 20 bp, Homo sapiens
tcccccagccccatcctctg

SEQ ID NO: 1856079 - DNA, 13 bp, Homo sapiens
tccccccagactc

SEQ ID NO: 1856080 - DNA, 15 bp, Homo sapiens
tcccccttccatgga

SEQ ID NO: 1856081 - DNA, 13 bp, Homo sapiens
tcccctctcagaa

SEQ ID NO: 1856082 - DNA, 15 bp, Homo sapiens
tcccctctcagaaca

SEQ ID NO: 1856083 - DNA, 15 bp, Homo sapiens
tcccctgctgggtgt

SEQ ID NO: 1856084 - DNA, 24 bp, Homo sapiens
tcccctgctgggtgtggcgcagca

SEQ ID NO: 1856085 - DNA, 19 bp, Homo sapiens
tcccctggggacagcaagg

SEQ ID NO: 1856086 - DNA, 17 bp, Homo sapiens
tccctagtctattcatt

SEQ ID NO: 1856087 - DNA, 21 bp, Homo sapiens
tccctattttttttctgttat

SEQ ID NO: 1856088 - DNA, 18 bp, Homo sapiens
tccctcaactgaaggggt

SEQ ID NO: 1856089 - DNA, 19 bp, Homo sapiens
tccctcatttcaggagcag

SEQ ID NO: 1856090 - DNA, 16 bp, Homo sapiens
tccctcccctctcaga

SEQ ID NO: 1856091 - DNA, 21 bp, Homo sapiens
tccctcccctctcagaacata

SEQ ID NO: 1856092 - DNA, 22 bp, Homo sapiens
tccctcccctggggacagcaag

SEQ ID NO: 1856093 - DNA, 20 bp, Homo sapiens
tccctctttccctcccttcc

SEQ ID NO: 1856094 - DNA, 11 bp, Homo sapiens
tccctgaaggc

SEQ ID NO: 1856095 - DNA, 21 bp, Homo sapiens
tccctgaaggccccgcccagg

SEQ ID NO: 1856096 - DNA, 22 bp, Homo sapiens
tccctgaaggccccgcccaggc

SEQ ID NO: 1856097 - DNA, 23 bp, Homo sapiens
tccctgaaggccccgcccaggct

SEQ ID NO: 1856098 - DNA, 16 bp, Homo sapiens
tccctggcctttcata

SEQ ID NO: 1856099 - DNA, 19 bp, Homo sapiens
tccctggtggcagctcacc

SEQ ID NO: 1856100 - DNA, 21 bp, Homo sapiens
tccctggtggcagctcacctc

SEQ ID NO: 1856101 - DNA, 23 bp, Homo sapiens
tccctggtggcagctcacctctc

SEQ ID NO: 1856102 - DNA, 18 bp, Homo sapiens
tcccttcatgcatggaaa

SEQ ID NO: 1856103 - DNA, 13 bp, Homo sapiens
tcccttcccacct

SEQ ID NO: 1856104 - DNA, 22 bp, Homo sapiens
tcccttcccatgacccaggctg

SEQ ID NO: 1856105 - DNA, 16 bp, Homo sapiens
tcccttcctctttcca

SEQ ID NO: 1856106 - DNA, 19 bp, Homo sapiens
tcccttggacattttatgt

SEQ ID NO: 1856107 - DNA, 18 bp, Homo sapiens
tccctttgacgccatccc

SEQ ID NO: 1856108 - DNA, 22 bp, Homo sapiens
tccctttgacgccatcccagcc

SEQ ID NO: 1856109 - DNA, 17 bp, Homo sapiens
tccggtccctgtcccag

SEQ ID NO: 1856110 - DNA, 18 bp, Homo sapiens
tccggtgtttaagacatt

SEQ ID NO: 1856111 - DNA, 12 bp, Homo sapiens
tccgtggcacat

SEQ ID NO: 1856112 - DNA, 17 bp, Homo sapiens
tcctaaaataagggcag

SEQ ID NO: 1856113 - DNA, 21 bp, Homo sapiens
tcctagaaattccccaccctg

SEQ ID NO: 1856114 - DNA, 19 bp, Homo sapiens
tcctaggcatttgctgaat

SEQ ID NO: 1856115 - DNA, 19 bp, Homo sapiens
tcctagggaagggtggtgg

SEQ ID NO: 1856116 - DNA, 21 bp, Homo sapiens
tcctagttccaccatcaagcc

SEQ ID NO: 1856117 - DNA, 12 bp, Homo sapiens
tcctattatatt

SEQ ID NO: 1856118 - DNA, 14 bp, Homo sapiens
tcctcatacccacc

SEQ ID NO: 1856119 - DNA, 23 bp, Homo sapiens
tcctcatacccacccccacccaa

SEQ ID NO: 1856120 - DNA, 18 bp, Homo sapiens
tcctcattagcattttgc

SEQ ID NO: 1856121 - DNA, 18 bp, Homo sapiens
tcctcatttgttcattaa

SEQ ID NO: 1856122 - DNA, 13 bp, Homo sapiens
tcctccaggtgca

SEQ ID NO: 1856123 - DNA, 14 bp, Homo sapiens
tcctccaggtgcac

SEQ ID NO: 1856124 - DNA, 18 bp, Homo sapiens
tcctcccctcctcctgga

SEQ ID NO: 1856125 - DNA, 19 bp, Homo sapiens
tcctccctccctctttccc

SEQ ID NO: 1856126 - DNA, 14 bp, Homo sapiens
tcctccgtggcaca

SEQ ID NO: 1856127 - DNA, 18 bp, Homo sapiens
tcctctcaaccacctttc

SEQ ID NO: 1856128 - DNA, 20 bp, Homo sapiens
tcctctcaaccacctttcag

SEQ ID NO: 1856129 - DNA, 14 bp, Homo sapiens
tcctctcagcccct

SEQ ID NO: 1856130 - DNA, 15 bp, Homo sapiens
tcctctgtacagagc

SEQ ID NO: 1856131 - DNA, 17 bp, Homo sapiens
tcctctgtacagagccc

SEQ ID NO: 1856132 - DNA, 18 bp, Homo sapiens
tcctctgtacagagccca

SEQ ID NO: 1856133 - DNA, 23 bp, Homo sapiens
tcctctttggtctacactgtgct

SEQ ID NO: 1856134 - DNA, 15 bp, Homo sapiens
tcctgaggctgggct

SEQ ID NO: 1856135 - DNA, 16 bp, Homo sapiens
tcctgaggctgggctc

SEQ ID NO: 1856136 - DNA, 19 bp, Homo sapiens
tcctgatgaccaatgggat

SEQ ID NO: 1856137 - DNA, 20 bp, Homo sapiens
tcctgatgcttcttcagaga

SEQ ID NO: 1856138 - DNA, 18 bp, Homo sapiens
tcctgcaatgaagtctct

SEQ ID NO: 1856139 - DNA, 22 bp, Homo sapiens
tcctgcaggcagccaggccaca

SEQ ID NO: 1856140 - DNA, 12 bp, Homo sapiens
tcctgcctgtgc

SEQ ID NO: 1856141 - DNA, 14 bp, Homo sapiens
tcctgcctgtgctg

SEQ ID NO: 1856142 - DNA, 18 bp, Homo sapiens
tcctgctaagttaatgtt

SEQ ID NO: 1856143 - DNA, 13 bp, Homo sapiens
tcctggcactgct

SEQ ID NO: 1856144 - DNA, 17 bp, Homo sapiens
tcctggcactgcttcca

SEQ ID NO: 1856145 - DNA, 22 bp, Homo sapiens
tcctggcactgcttccagtgag

SEQ ID NO: 1856146 - DNA, 17 bp, Homo sapiens
tcctggcccactgcatc

SEQ ID NO: 1856147 - DNA, 15 bp, Homo sapiens
tcctgtctctggcct

SEQ ID NO: 1856148 - DNA, 12 bp, Homo sapiens
tcctgtgtgtta

SEQ ID NO: 1856149 - DNA, 21 bp, Homo sapiens
tcctgtgtgttaagctctgct

SEQ ID NO: 1856150 - DNA, 14 bp, Homo sapiens
tccttaccagcaga

SEQ ID NO: 1856151 - DNA, 18 bp, Homo sapiens
tccttaccagcagagcac

SEQ ID NO: 1856152 - DNA, 16 bp, Homo sapiens
tccttcaaagcaaatg

SEQ ID NO: 1856153 - DNA, 18 bp, Homo sapiens
tccttcacagatgggtgc

SEQ ID NO: 1856154 - DNA, 23 bp, Homo sapiens
tccttgaaaacactgttctctgc

SEQ ID NO: 1856155 - DNA, 15 bp, Homo sapiens
tccttggctggtgca

SEQ ID NO: 1856156 - DNA, 18 bp, Homo sapiens
tccttgtggcctgggcct

SEQ ID NO: 1856157 - DNA, 19 bp, Homo sapiens
tccttgtggcctgggcctc

SEQ ID NO: 1856158 - DNA, 22 bp, Homo sapiens
tcctttgtgaggaagccgctgg

SEQ ID NO: 1856159 - DNA, 22 bp, Homo sapiens
tccttttcgcaggattcttcct

SEQ ID NO: 1856160 - DNA, 15 bp, Homo sapiens
tcgagcatgcctgga

SEQ ID NO: 1856161 - DNA, 23 bp, Homo sapiens
tcgctgtgtcagcatagaagtaa

SEQ ID NO: 1856162 - DNA, 10 bp, Homo sapiens
tcggaccagc

SEQ ID NO: 1856163 - DNA, 22 bp, Homo sapiens
tcggtggagactatcagcccaa

SEQ ID NO: 1856164 - DNA, 19 bp, Homo sapiens
tcgtcctcgtttgtgttct

SEQ ID NO: 1856165 - DNA, 20 bp, Homo sapiens
tcgttttttttttgtttgtt

SEQ ID NO: 1856166 - DNA, 18 bp, Homo sapiens
tctaaaggagtttatgtt

SEQ ID NO: 1856167 - DNA, 22 bp, Homo sapiens
tctaacgcaaaaatagctcttg

SEQ ID NO: 1856168 - DNA, 15 bp, Homo sapiens
tctaactacaaaggt

SEQ ID NO: 1856169 - DNA, 14 bp, Homo sapiens
tctacactgtgctg

SEQ ID NO: 1856170 - DNA, 21 bp, Homo sapiens
tctacactgtgctgagtctga

SEQ ID NO: 1856171 - DNA, 20 bp, Homo sapiens
tctaccaagctatcctggct

SEQ ID NO: 1856172 - DNA, 14 bp, Homo sapiens
tctacccaggtgct

SEQ ID NO: 1856173 - DNA, 12 bp, Homo sapiens
tctacctgaggg

SEQ ID NO: 1856174 - DNA, 19 bp, Homo sapiens
tctacggtgtatggttctg

SEQ ID NO: 1856175 - DNA, 18 bp, Homo sapiens
tctactctagggaaaaac

SEQ ID NO: 1856176 - DNA, 13 bp, Homo sapiens
tctagaattccag

SEQ ID NO: 1856177 - DNA, 17 bp, Homo sapiens
tctagccgatggaaaat

SEQ ID NO: 1856178 - DNA, 16 bp, Homo sapiens
tctaggaagactttgg

SEQ ID NO: 1856179 - DNA, 19 bp, Homo sapiens
tctaggaagactttggaaa

SEQ ID NO: 1856180 - DNA, 20 bp, Homo sapiens
tctaggactgcagtgtggag

SEQ ID NO: 1856181 - DNA, 22 bp, Homo sapiens
tctagggaaaaaccagcgtgtg

SEQ ID NO: 1856182 - DNA, 23 bp, Homo sapiens
tctagttgtttgattcagacagc

SEQ ID NO: 1856183 - DNA, 13 bp, Homo sapiens
tctattgaataat

SEQ ID NO: 1856184 - DNA, 16 bp, Homo sapiens
tctcaaaaaaagaaaa

SEQ ID NO: 1856185 - DNA, 22 bp, Homo sapiens
tctcaggcagcaccacactggg

SEQ ID NO: 1856186 - DNA, 14 bp, Homo sapiens
tctcagggcctggt

SEQ ID NO: 1856187 - DNA, 15 bp, Homo sapiens
tctcagggcctggtc

SEQ ID NO: 1856188 - DNA, 19 bp, Homo sapiens
tctcagggcctggtcgttt

SEQ ID NO: 1856189 - DNA, 15 bp, Homo sapiens
tctcagggtctctgc

SEQ ID NO: 1856190 - DNA, 16 bp, Homo sapiens
tctcagggtctctgct

SEQ ID NO: 1856191 - DNA, 16 bp, Homo sapiens
tctcatgaagcaggag

SEQ ID NO: 1856192 - DNA, 14 bp, Homo sapiens
tctcatgaatctgc

SEQ ID NO: 1856193 - DNA, 17 bp, Homo sapiens
tctcattggaaatttag

SEQ ID NO: 1856194 - DNA, 19 bp, Homo sapiens
tctcattggaaatttagca

SEQ ID NO: 1856195 - DNA, 20 bp, Homo sapiens
tctcattggaaatttagcat

SEQ ID NO: 1856196 - DNA, 21 bp, Homo sapiens
tctcattggaaatttagcatt

SEQ ID NO: 1856197 - DNA, 19 bp, Homo sapiens
tctccaagcaggacatgga

SEQ ID NO: 1856198 - DNA, 15 bp, Homo sapiens
tctccaccttccaaa

SEQ ID NO: 1856199 - DNA, 13 bp, Homo sapiens
tctccagcccctg

SEQ ID NO: 1856200 - DNA, 18 bp, Homo sapiens
tctccagcccctggatgc

SEQ ID NO: 1856201 - DNA, 19 bp, Homo sapiens
tctccagtcatctgtaaga

SEQ ID NO: 1856202 - DNA, 14 bp, Homo sapiens
tctcccccagcccc

SEQ ID NO: 1856203 - DNA, 15 bp, Homo sapiens
tctcccccagcccca

SEQ ID NO: 1856204 - DNA, 22 bp, Homo sapiens
tctcccccagccccatcctctg

SEQ ID NO: 1856205 - DNA, 23 bp, Homo sapiens
tctccctcaactgaaggggtgca

SEQ ID NO: 1856206 - DNA, 18 bp, Homo sapiens
tctccctcagtctggccc

SEQ ID NO: 1856207 - DNA, 19 bp, Homo sapiens
tctcccttggattgtcccc

SEQ ID NO: 1856208 - DNA, 17 bp, Homo sapiens
tctcctccgtggcacat

SEQ ID NO: 1856209 - DNA, 15 bp, Homo sapiens
tctcctctgctgctg

SEQ ID NO: 1856210 - DNA, 16 bp, Homo sapiens
tctcctctgctgctgg

SEQ ID NO: 1856211 - DNA, 14 bp, Homo sapiens
tctccttcaccttt

SEQ ID NO: 1856212 - DNA, 17 bp, Homo sapiens
tctcggggtcaggttct

SEQ ID NO: 1856213 - DNA, 19 bp, Homo sapiens
tctcgtcctcgtttgtgtt

SEQ ID NO: 1856214 - DNA, 21 bp, Homo sapiens
tctcgtcctcgtttgtgttct

SEQ ID NO: 1856215 - DNA, 15 bp, Homo sapiens
tctctacaaaaagca

SEQ ID NO: 1856216 - DNA, 23 bp, Homo sapiens
tctctcaggaatcatctcctttg

SEQ ID NO: 1856217 - DNA, 13 bp, Homo sapiens
tctctccagcccc

SEQ ID NO: 1856218 - DNA, 19 bp, Homo sapiens
tctctgacgcttgtgacag

SEQ ID NO: 1856219 - DNA, 23 bp, Homo sapiens
tctctgacgcttgtgacagtgcc

SEQ ID NO: 1856220 - DNA, 15 bp, Homo sapiens
tctctggatgcctga

SEQ ID NO: 1856221 - DNA, 14 bp, Homo sapiens
tctcttgagagggt

SEQ ID NO: 1856222 - DNA, 13 bp, Homo sapiens
tctcttgagcctg

SEQ ID NO: 1856223 - DNA, 15 bp, Homo sapiens
tctcttgagcctggg

SEQ ID NO: 1856224 - DNA, 17 bp, Homo sapiens
tctcttgagcctgggag

SEQ ID NO: 1856225 - DNA, 14 bp, Homo sapiens
tctgaaacacacga

SEQ ID NO: 1856226 - DNA, 17 bp, Homo sapiens
tctgaaacacacgagca

SEQ ID NO: 1856227 - DNA, 18 bp, Homo sapiens
tctgaaggctgggttctg

SEQ ID NO: 1856228 - DNA, 12 bp, Homo sapiens
tctgacatctct

SEQ ID NO: 1856229 - DNA, 14 bp, Homo sapiens
tctgacatctctgc

SEQ ID NO: 1856230 - DNA, 16 bp, Homo sapiens
tctgacatctctgcaa

SEQ ID NO: 1856231 - DNA, 15 bp, Homo sapiens
tctgacccatgctgc

SEQ ID NO: 1856232 - DNA, 16 bp, Homo sapiens
tctgacccatgctgcc

SEQ ID NO: 1856233 - DNA, 18 bp, Homo sapiens
tctgacccatgctgccct

SEQ ID NO: 1856234 - DNA, 17 bp, Homo sapiens
tctgacgcttgtgacag

SEQ ID NO: 1856235 - DNA, 18 bp, Homo sapiens
tctgagcagcgagcctgc

SEQ ID NO: 1856236 - DNA, 14 bp, Homo sapiens
tctgcaatcttctc

SEQ ID NO: 1856237 - DNA, 14 bp, Homo sapiens
tctgcacaagctgc

SEQ ID NO: 1856238 - DNA, 13 bp, Homo sapiens
tctgcactcccct

SEQ ID NO: 1856239 - DNA, 14 bp, Homo sapiens
tctgcactcccctg

SEQ ID NO: 1856240 - DNA, 15 bp, Homo sapiens
tctgcactcccctgc

SEQ ID NO: 1856241 - DNA, 18 bp, Homo sapiens
tctgcactcccctgctgg

SEQ ID NO: 1856242 - DNA, 20 bp, Homo sapiens
tctgcactcccctgctgggt

SEQ ID NO: 1856243 - DNA, 13 bp, Homo sapiens
tctgccaaacaca

SEQ ID NO: 1856244 - DNA, 17 bp, Homo sapiens
tctgcctcccatcaccc

SEQ ID NO: 1856245 - DNA, 21 bp, Homo sapiens
tctgcctcccatcacccgcta

SEQ ID NO: 1856246 - DNA, 12 bp, Homo sapiens
tctgctcctgga

SEQ ID NO: 1856247 - DNA, 13 bp, Homo sapiens
tctgctctggtgg

SEQ ID NO: 1856248 - DNA, 20 bp, Homo sapiens
tctgctgaggcccagtgcat

SEQ ID NO: 1856249 - DNA, 22 bp, Homo sapiens
tctgctgatcctcccaggcttc

SEQ ID NO: 1856250 - DNA, 21 bp, Homo sapiens
tctgctgccgccccacccaga

SEQ ID NO: 1856251 - DNA, 11 bp, Homo sapiens
tctgctgctgg

SEQ ID NO: 1856252 - DNA, 14 bp, Homo sapiens
tctggaaagggcac

SEQ ID NO: 1856253 - DNA, 22 bp, Homo sapiens
tctggaagtgactttggctgca

SEQ ID NO: 1856254 - DNA, 14 bp, Homo sapiens
tctggattcccagg

SEQ ID NO: 1856255 - DNA, 21 bp, Homo sapiens
tctggattcccaggatgagca

SEQ ID NO: 1856256 - DNA, 16 bp, Homo sapiens
tctggcagctcagaga

SEQ ID NO: 1856257 - DNA, 18 bp, Homo sapiens
tctggcagctcagagagg

SEQ ID NO: 1856258 - DNA, 15 bp, Homo sapiens
tctggctcttccagg

SEQ ID NO: 1856259 - DNA, 17 bp, Homo sapiens
tctggctcttccaggct

SEQ ID NO: 1856260 - DNA, 15 bp, Homo sapiens
tctgggccagaattt

SEQ ID NO: 1856261 - DNA, 17 bp, Homo sapiens
tctggtctctaggctgg

SEQ ID NO: 1856262 - DNA, 19 bp, Homo sapiens
tctggtctctaggctgggg

SEQ ID NO: 1856263 - DNA, 16 bp, Homo sapiens
tctggtgactttcctc

SEQ ID NO: 1856264 - DNA, 15 bp, Homo sapiens
tctgtacagagccca

SEQ ID NO: 1856265 - DNA, 21 bp, Homo sapiens
tctgtcccacttggcatcagc

SEQ ID NO: 1856266 - DNA, 13 bp, Homo sapiens
tctgtcccaggtt

SEQ ID NO: 1856267 - DNA, 22 bp, Homo sapiens
tctgtctccctcccctctcaga

SEQ ID NO: 1856268 - DNA, 19 bp, Homo sapiens
tctgtctccttaacactga

SEQ ID NO: 1856269 - DNA, 19 bp, Homo sapiens
tctgtgcacgcagtggcct

SEQ ID NO: 1856270 - DNA, 13 bp, Homo sapiens
tctgttttatgac

SEQ ID NO: 1856271 - DNA, 15 bp, Homo sapiens
tctgttttgtgagaa

SEQ ID NO: 1856272 - DNA, 16 bp, Homo sapiens
tctgttttgtgagaac

SEQ ID NO: 1856273 - DNA, 19 bp, Homo sapiens
tctgttttgtttcgctctt

SEQ ID NO: 1856274 - DNA, 19 bp, Homo sapiens
tcttaaataataaagatca

SEQ ID NO: 1856275 - DNA, 14 bp, Homo sapiens
tcttaattctttgt

SEQ ID NO: 1856276 - DNA, 20 bp, Homo sapiens
tcttaggttggcaaaaaggc

SEQ ID NO: 1856277 - DNA, 16 bp, Homo sapiens
tcttatcaagcagcca

SEQ ID NO: 1856278 - DNA, 18 bp, Homo sapiens
tcttatggatgtccccag

SEQ ID NO: 1856279 - DNA, 14 bp, Homo sapiens
tcttatgggctggg

SEQ ID NO: 1856280 - DNA, 15 bp, Homo sapiens
tcttatgggctgggt

SEQ ID NO: 1856281 - DNA, 17 bp, Homo sapiens
tcttcagagactcctgc

SEQ ID NO: 1856282 - DNA, 18 bp, Homo sapiens
tcttcagagactcctgca

SEQ ID NO: 1856283 - DNA, 19 bp, Homo sapiens
tcttcagttaagcctttgg

SEQ ID NO: 1856284 - DNA, 22 bp, Homo sapiens
tcttcagttaagcctttggaaa

SEQ ID NO: 1856285 - DNA, 15 bp, Homo sapiens
tcttccaggctggga

SEQ ID NO: 1856286 - DNA, 17 bp, Homo sapiens
tcttccaggctgggaga

SEQ ID NO: 1856287 - DNA, 22 bp, Homo sapiens
tcttccaggctgggagagcctt

SEQ ID NO: 1856288 - DNA, 21 bp, Homo sapiens
tcttccgaatgggttttctat

SEQ ID NO: 1856289 - DNA, 21 bp, Homo sapiens
tcttctcagaaggcaaatgac

SEQ ID NO: 1856290 - DNA, 12 bp, Homo sapiens
tcttctccccag

SEQ ID NO: 1856291 - DNA, 23 bp, Homo sapiens
tcttctcgtcctcgtttgtgttc

SEQ ID NO: 1856292 - DNA, 22 bp, Homo sapiens
tcttcttctcgtcctcgtttgt

SEQ ID NO: 1856293 - DNA, 15 bp, Homo sapiens
tcttgcatgaggcta

SEQ ID NO: 1856294 - DNA, 16 bp, Homo sapiens
tctttcatttcttcta

SEQ ID NO: 1856295 - DNA, 23 bp, Homo sapiens
tctttccctcccttcctctttcc

SEQ ID NO: 1856296 - DNA, 14 bp, Homo sapiens
tctttcctgaggct

SEQ ID NO: 1856297 - DNA, 16 bp, Homo sapiens
tctttcctgaggctgg

SEQ ID NO: 1856298 - DNA, 17 bp, Homo sapiens
tctttgccaccctcatg

SEQ ID NO: 1856299 - DNA, 22 bp, Homo sapiens
tctttgccaccctcatgctgtg

SEQ ID NO: 1856300 - DNA, 13 bp, Homo sapiens
tctttggaccctg

SEQ ID NO: 1856301 - DNA, 14 bp, Homo sapiens
tctttggaccctga

SEQ ID NO: 1856302 - DNA, 14 bp, Homo sapiens
tctttggtctacac

SEQ ID NO: 1856303 - DNA, 21 bp, Homo sapiens
tctttggtctacactgtgctg

SEQ ID NO: 1856304 - DNA, 14 bp, Homo sapiens
tctttgttctgttt

SEQ ID NO: 1856305 - DNA, 19 bp, Homo sapiens
tctttgttttgtgtctctt

SEQ ID NO: 1856306 - DNA, 22 bp, Homo sapiens
tcttttttggccatctgctcct

SEQ ID NO: 1856307 - DNA, 22 bp, Homo sapiens
tgaaaaaaaacctgagatttat

SEQ ID NO: 1856308 - DNA, 21 bp, Homo sapiens
tgaaaacactgttctctgccc

SEQ ID NO: 1856309 - DNA, 22 bp, Homo sapiens
tgaaaacactgttctctgccct

SEQ ID NO: 1856310 - DNA, 20 bp, Homo sapiens
tgaaaagaaaaatgagcctg

SEQ ID NO: 1856311 - DNA, 21 bp, Homo sapiens
tgaaaagttggaaggatctgc

SEQ ID NO: 1856312 - DNA, 20 bp, Homo sapiens
tgaaacacaaacaatagtaa

SEQ ID NO: 1856313 - DNA, 18 bp, Homo sapiens
tgaaactgcttgtttcct

SEQ ID NO: 1856314 - DNA, 18 bp, Homo sapiens
tgaaagccctgagctttc

SEQ ID NO: 1856315 - DNA, 12 bp, Homo sapiens
tgaaaggaaaga

SEQ ID NO: 1856316 - DNA, 16 bp, Homo sapiens
tgaaatactgtttgag

SEQ ID NO: 1856317 - DNA, 18 bp, Homo sapiens
tgaacactccaattaagg

SEQ ID NO: 1856318 - DNA, 22 bp, Homo sapiens
tgaacactccaattaaggattt

SEQ ID NO: 1856319 - DNA, 18 bp, Homo sapiens
tgaacatgtgccttttct

SEQ ID NO: 1856320 - DNA, 13 bp, Homo sapiens
tgaacattcccag

SEQ ID NO: 1856321 - DNA, 13 bp, Homo sapiens
tgaaccctggcat

SEQ ID NO: 1856322 - DNA, 22 bp, Homo sapiens
tgaaccgatgagaaataaagtt

SEQ ID NO: 1856323 - DNA, 19 bp, Homo sapiens
tgaactaaactttcacacc

SEQ ID NO: 1856324 - DNA, 23 bp, Homo sapiens
tgaagatataactattgcccagg

SEQ ID NO: 1856325 - DNA, 16 bp, Homo sapiens
tgaagcattttataaa

SEQ ID NO: 1856326 - DNA, 17 bp, Homo sapiens
tgaagcattttataaat

SEQ ID NO: 1856327 - DNA, 10 bp, Homo sapiens
tgaaggactg

SEQ ID NO: 1856328 - DNA, 15 bp, Homo sapiens
tgaaggccccgccca

SEQ ID NO: 1856329 - DNA, 17 bp, Homo sapiens
tgaaggccccgcccagg

SEQ ID NO: 1856330 - DNA, 19 bp, Homo sapiens
tgaaggccccgcccaggct

SEQ ID NO: 1856331 - DNA, 20 bp, Homo sapiens
tgaaggctcgagcatgcctg

SEQ ID NO: 1856332 - DNA, 20 bp, Homo sapiens
tgaaggctgggttctgatcc

SEQ ID NO: 1856333 - DNA, 21 bp, Homo sapiens
tgaaggctgggttctgatcct

SEQ ID NO: 1856334 - DNA, 20 bp, Homo sapiens
tgaaggggtgcacccacctg

SEQ ID NO: 1856335 - DNA, 14 bp, Homo sapiens
tgaagtgaaactgc

SEQ ID NO: 1856336 - DNA, 16 bp, Homo sapiens
tgaagtttccttggct

SEQ ID NO: 1856337 - DNA, 19 bp, Homo sapiens
tgaagtttccttggctggt

SEQ ID NO: 1856338 - DNA, 13 bp, Homo sapiens
tgaataatacagt

SEQ ID NO: 1856339 - DNA, 19 bp, Homo sapiens
tgaatctcataattggaat

SEQ ID NO: 1856340 - DNA, 23 bp, Homo sapiens
tgaatgatgatcctaggcatttg

SEQ ID NO: 1856341 - DNA, 16 bp, Homo sapiens
tgaatgtttttctaaa

SEQ ID NO: 1856342 - DNA, 18 bp, Homo sapiens
tgaatgtttttctaaagg

SEQ ID NO: 1856343 - DNA, 23 bp, Homo sapiens
tgacaacactcattgacctgagg

SEQ ID NO: 1856344 - DNA, 16 bp, Homo sapiens
tgacacaaacctgcct

SEQ ID NO: 1856345 - DNA, 15 bp, Homo sapiens
tgacacctaactctt

SEQ ID NO: 1856346 - DNA, 18 bp, Homo sapiens
tgacacctaactcttctt

SEQ ID NO: 1856347 - DNA, 14 bp, Homo sapiens
tgacagctttctgg

SEQ ID NO: 1856348 - DNA, 23 bp, Homo sapiens
tgacagctttctgggatgtcaca

SEQ ID NO: 1856349 - DNA, 17 bp, Homo sapiens
tgacagtgcctcttcca

SEQ ID NO: 1856350 - DNA, 18 bp, Homo sapiens
tgacagtgcctcttccag

SEQ ID NO: 1856351 - DNA, 23 bp, Homo sapiens
tgacatctctgcaatcttctcag

SEQ ID NO: 1856352 - DNA, 17 bp, Homo sapiens
tgacattcatgcctggc

SEQ ID NO: 1856353 - DNA, 21 bp, Homo sapiens
tgacatttatttttctcatga

SEQ ID NO: 1856354 - DNA, 12 bp, Homo sapiens
tgaccaggcctg

SEQ ID NO: 1856355 - DNA, 22 bp, Homo sapiens
tgaccattctccacctgccagg

SEQ ID NO: 1856356 - DNA, 23 bp, Homo sapiens
tgaccattctccacctgccaggg

SEQ ID NO: 1856357 - DNA, 14 bp, Homo sapiens
tgacccatgctgcc

SEQ ID NO: 1856358 - DNA, 18 bp, Homo sapiens
tgacccatgctgccctgt

SEQ ID NO: 1856359 - DNA, 20 bp, Homo sapiens
tgacccatgctgccctgtga

SEQ ID NO: 1856360 - DNA, 14 bp, Homo sapiens
tgacctgaggccct

SEQ ID NO: 1856361 - DNA, 15 bp, Homo sapiens
tgacctgaggccctt

SEQ ID NO: 1856362 - DNA, 19 bp, Homo sapiens
tgacctgaggcccttctct

SEQ ID NO: 1856363 - DNA, 17 bp, Homo sapiens
tgacctgcctcccttca

SEQ ID NO: 1856364 - DNA, 21 bp, Homo sapiens
tgaccttgtacctctctttga

SEQ ID NO: 1856365 - DNA, 13 bp, Homo sapiens
tgacgccatccca

SEQ ID NO: 1856366 - DNA, 16 bp, Homo sapiens
tgacgccatcccagcc

SEQ ID NO: 1856367 - DNA, 18 bp, Homo sapiens
tgacgccatcccagcccc

SEQ ID NO: 1856368 - DNA, 19 bp, Homo sapiens
tgacgccatcccagcccca

SEQ ID NO: 1856369 - DNA, 20 bp, Homo sapiens
tgacgcttgtgacagtgcct

SEQ ID NO: 1856370 - DNA, 21 bp, Homo sapiens
tgacgcttgtgacagtgcctc

SEQ ID NO: 1856371 - DNA, 18 bp, Homo sapiens
tgactgtatctgtgtaga

SEQ ID NO: 1856372 - DNA, 22 bp, Homo sapiens
tgacttcattaataataaattc

SEQ ID NO: 1856373 - DNA, 16 bp, Homo sapiens
tgactttcctctttgg

SEQ ID NO: 1856374 - DNA, 15 bp, Homo sapiens
tgagaaataaagttt

SEQ ID NO: 1856375 - DNA, 14 bp, Homo sapiens
tgagaacactgtga

SEQ ID NO: 1856376 - DNA, 15 bp, Homo sapiens
tgagatcaaaacggt

SEQ ID NO: 1856377 - DNA, 22 bp, Homo sapiens
tgagatgaaccctggcatttgg

SEQ ID NO: 1856378 - DNA, 17 bp, Homo sapiens
tgagatttattaaagaa

SEQ ID NO: 1856379 - DNA, 18 bp, Homo sapiens
tgagatttattaaagaaa

SEQ ID NO: 1856380 - DNA, 21 bp, Homo sapiens
tgagatttattaaagaaaaaa

SEQ ID NO: 1856381 - DNA, 10 bp, Homo sapiens
tgccaggcat

SEQ ID NO: 1856382 - DNA, 11 bp, Homo sapiens
tgccagggaca

SEQ ID NO: 1856383 - DNA, 14 bp, Homo sapiens
tgccagtcaccccg

SEQ ID NO: 1856384 - DNA, 13 bp, Homo sapiens
tgccatgctggcc

SEQ ID NO: 1856385 - DNA, 17 bp, Homo sapiens
tgcccacctggcctctg

SEQ ID NO: 1856386 - DNA, 16 bp, Homo sapiens
tgcccactccctgcaa

SEQ ID NO: 1856387 - DNA, 15 bp, Homo sapiens
tgcccaggcccagac

SEQ ID NO: 1856388 - DNA, 20 bp, Homo sapiens
tgcccaggtttctggtctct

SEQ ID NO: 1856389 - DNA, 20 bp, Homo sapiens
tgccccttggacacgctcag

SEQ ID NO: 1856390 - DNA, 19 bp, Homo sapiens
tgccctccaagaccttctc

SEQ ID NO: 1856391 - DNA, 20 bp, Homo sapiens
tgccctccaagaccttctcc

SEQ ID NO: 1856392 - DNA, 14 bp, Homo sapiens
tgccctgcccacct

SEQ ID NO: 1856393 - DNA, 15 bp, Homo sapiens
tgccctgcccacctg

SEQ ID NO: 1856394 - DNA, 22 bp, Homo sapiens
tgccctgcccacctggcctctg

SEQ ID NO: 1856395 - DNA, 18 bp, Homo sapiens
tgccctgtgggcccccaa

SEQ ID NO: 1856396 - DNA, 16 bp, Homo sapiens
tgccgccccacccaga

SEQ ID NO: 1856397 - DNA, 15 bp, Homo sapiens
tgccgtctacctgag

SEQ ID NO: 1856398 - DNA, 18 bp, Homo sapiens
tgcctcctttgtgaggaa

SEQ ID NO: 1856399 - DNA, 16 bp, Homo sapiens
tgcctctacccaacca

SEQ ID NO: 1856400 - DNA, 12 bp, Homo sapiens
tgcctcttccag

SEQ ID NO: 1856401 - DNA, 15 bp, Homo sapiens
tgcctgatggacctg

SEQ ID NO: 1856402 - DNA, 20 bp, Homo sapiens
tgcctgattgccaagctcag

SEQ ID NO: 1856403 - DNA, 15 bp, Homo sapiens
tgcctgctcccatcc

SEQ ID NO: 1856404 - DNA, 18 bp, Homo sapiens
tgcctgctcccatcctgt

SEQ ID NO: 1856405 - DNA, 14 bp, Homo sapiens
tgcctggatggggc

SEQ ID NO: 1856406 - DNA, 21 bp, Homo sapiens
tgcctgggatccctcatcctc

SEQ ID NO: 1856407 - DNA, 14 bp, Homo sapiens
tgcctgtgaactga

SEQ ID NO: 1856408 - DNA, 21 bp, Homo sapiens
tgcctgtgaactgaactctga

SEQ ID NO: 1856409 - DNA, 23 bp, Homo sapiens
tgcctttgacctgcctcccttca

SEQ ID NO: 1856410 - DNA, 20 bp, Homo sapiens
tgcgagtgctcatttcagga

SEQ ID NO: 1856411 - DNA, 14 bp, Homo sapiens
tgcggctgtgtgtg

SEQ ID NO: 1856412 - DNA, 21 bp, Homo sapiens
tgcggtgctatctcccccagc

SEQ ID NO: 1856413 - DNA, 14 bp, Homo sapiens
tgctaaagccagga

SEQ ID NO: 1856414 - DNA, 16 bp, Homo sapiens
tgctaattttattata

SEQ ID NO: 1856415 - DNA, 20 bp, Homo sapiens
tgctatctcccccagcccca

SEQ ID NO: 1856416 - DNA, 19 bp, Homo sapiens
tgctcaatacctggcctca

SEQ ID NO: 1856417 - DNA, 14 bp, Homo sapiens
tgctcatttcagga

SEQ ID NO: 1856418 - DNA, 17 bp, Homo sapiens
tgctccagattctgatg

SEQ ID NO: 1856419 - DNA, 22 bp, Homo sapiens
tgctccaggcaggctaaggcgt

SEQ ID NO: 1856420 - DNA, 18 bp, Homo sapiens
tgctccctggttctgatg

SEQ ID NO: 1856421 - DNA, 18 bp, Homo sapiens
tgctcctggatctccctg

SEQ ID NO: 1856422 - DNA, 19 bp, Homo sapiens
tgctcctggcccactgcat

SEQ ID NO: 1856423 - DNA, 18 bp, Homo sapiens
tgctctttgttttgtgtc

SEQ ID NO: 1856424 - DNA, 20 bp, Homo sapiens
tgctctttgttttgtgtctc

SEQ ID NO: 1856425 - DNA, 23 bp, Homo sapiens
tgctgaatacagaggcaactgca

SEQ ID NO: 1856426 - DNA, 17 bp, Homo sapiens
tgctgactgttttctct

SEQ ID NO: 1856427 - DNA, 23 bp, Homo sapiens
tgctgagcctgtaaaataaaagg

SEQ ID NO: 1856428 - DNA, 12 bp, Homo sapiens
tgctgccctgcc

SEQ ID NO: 1856429 - DNA, 17 bp, Homo sapiens
tgctgccctgcccacct

SEQ ID NO: 1856430 - DNA, 21 bp, Homo sapiens
tgctgccctgcccacctggcc

SEQ ID NO: 1856431 - DNA, 15 bp, Homo sapiens
tgctgccctgtgagt

SEQ ID NO: 1856432 - DNA, 21 bp, Homo sapiens
tgctgccgccccacccagatg

SEQ ID NO: 1856433 - DNA, 23 bp, Homo sapiens
tgctgccgccccacccagatggg

SEQ ID NO: 1856434 - DNA, 13 bp, Homo sapiens
tgctgggtgtggc

SEQ ID NO: 1856435 - DNA, 17 bp, Homo sapiens
tgcttataggtggcctc

SEQ ID NO: 1856436 - DNA, 16 bp, Homo sapiens
tgcttccagtgaggct

SEQ ID NO: 1856437 - DNA, 22 bp, Homo sapiens
tgcttccagtgaggctctgccc

SEQ ID NO: 1856438 - DNA, 21 bp, Homo sapiens
tgcttggaggaaggaaaccca

SEQ ID NO: 1856439 - DNA, 14 bp, Homo sapiens
tgctttaatataaa

SEQ ID NO: 1856440 - DNA, 18 bp, Homo sapiens
tgctttaatatcatcagt

SEQ ID NO: 1856441 - DNA, 16 bp, Homo sapiens
tgcttttcatgcaaac

SEQ ID NO: 1856442 - DNA, 17 bp, Homo sapiens
tgcttttcatgcaaact

SEQ ID NO: 1856443 - DNA, 20 bp, Homo sapiens
tgcttttcatgcaaactctt

SEQ ID NO: 1856444 - DNA, 13 bp, Homo sapiens
tggaaaaccagga

SEQ ID NO: 1856445 - DNA, 21 bp, Homo sapiens
tggaaaatacctaattgtgga

SEQ ID NO: 1856446 - DNA, 21 bp, Homo sapiens
tggaaagacttttccaaccct

SEQ ID NO: 1856447 - DNA, 17 bp, Homo sapiens
tggaaatgggcagagca

SEQ ID NO: 1856448 - DNA, 23 bp, Homo sapiens
tggaaatgggcagagcagagacc

SEQ ID NO: 1856449 - DNA, 17 bp, Homo sapiens
tggaaattcccttcatc

SEQ ID NO: 1856450 - DNA, 16 bp, Homo sapiens
tggaaattggaagagc

SEQ ID NO: 1856451 - DNA, 17 bp, Homo sapiens
tggaaattggaagagca

SEQ ID NO: 1856452 - DNA, 15 bp, Homo sapiens
tggaaatttagcatt

SEQ ID NO: 1856453 - DNA, 20 bp, Homo sapiens
tggaacagattcacactgtc

SEQ ID NO: 1856454 - DNA, 15 bp, Homo sapiens
tggaagacacattga

SEQ ID NO: 1856455 - DNA, 15 bp, Homo sapiens
tggaaggatctgctg

SEQ ID NO: 1856456 - DNA, 13 bp, Homo sapiens
tggaaggtgggga

SEQ ID NO: 1856457 - DNA, 11 bp, Homo sapiens
tggaagttgca

SEQ ID NO: 1856458 - DNA, 22 bp, Homo sapiens
tggacacgctcagtggggcaga

SEQ ID NO: 1856459 - DNA, 16 bp, Homo sapiens
tggacagaagcagctc

SEQ ID NO: 1856460 - DNA, 17 bp, Homo sapiens
tggacagaagcagctct

SEQ ID NO: 1856461 - DNA, 19 bp, Homo sapiens
tggaccctgaggcccagag

SEQ ID NO: 1856462 - DNA, 21 bp, Homo sapiens
tggaccctgaggcccagaggg

SEQ ID NO: 1856463 - DNA, 17 bp, Homo sapiens
tggacggtgctccaggc

SEQ ID NO: 1856464 - DNA, 19 bp, Homo sapiens
tggactaacttgtctttgg

SEQ ID NO: 1856465 - DNA, 20 bp, Homo sapiens
tggactaacttgtctttgga

SEQ ID NO: 1856466 - DNA, 12 bp, Homo sapiens
tggactcagcct

SEQ ID NO: 1856467 - DNA, 13 bp, Homo sapiens
tggactcagcctt

SEQ ID NO: 1856468 - DNA, 22 bp, Homo sapiens
tggactttgttagtttctccaa

SEQ ID NO: 1856469 - DNA, 22 bp, Homo sapiens
tggagaagcggctggcagccca

SEQ ID NO: 1856470 - DNA, 22 bp, Homo sapiens
tggagactcctaggcaggacat

SEQ ID NO: 1856471 - DNA, 16 bp, Homo sapiens
tggagatcccacatat

SEQ ID NO: 1856472 - DNA, 18 bp, Homo sapiens
tggagccccaccttgtct

SEQ ID NO: 1856473 - DNA, 21 bp, Homo sapiens
tggagccccaccttgtctgct

SEQ ID NO: 1856474 - DNA, 13 bp, Homo sapiens
tggagctgcctga

SEQ ID NO: 1856475 - DNA, 15 bp, Homo sapiens
tggagctgcctgata

SEQ ID NO: 1856476 - DNA, 20 bp, Homo sapiens
tggaggaaggaaacccagct

SEQ ID NO: 1856477 - DNA, 21 bp, Homo sapiens
tggaggaaggaaacccagctc

SEQ ID NO: 1856478 - DNA, 23 bp, Homo sapiens
tggaggaaggaaacccagctctg

SEQ ID NO: 1856479 - DNA, 14 bp, Homo sapiens
tggaggagcaaagg

SEQ ID NO: 1856480 - DNA, 21 bp, Homo sapiens
tggaggagcaaaggctgagaa

SEQ ID NO: 1856481 - DNA, 22 bp, Homo sapiens
tggatgcagcctcacagtcctt

SEQ ID NO: 1856482 - DNA, 20 bp, Homo sapiens
tggatgcatgttttccagct

SEQ ID NO: 1856483 - DNA, 22 bp, Homo sapiens
tggatgcatgttttccagctcc

SEQ ID NO: 1856484 - DNA, 18 bp, Homo sapiens
tggatgttatgaacagct

SEQ ID NO: 1856485 - DNA, 20 bp, Homo sapiens
tggatgttatgaacagctgt

SEQ ID NO: 1856486 - DNA, 21 bp, Homo sapiens
tggatgttatgaacagctgtg

SEQ ID NO: 1856487 - DNA, 23 bp, Homo sapiens
tggattggagaagtaatcctagg

SEQ ID NO: 1856488 - DNA, 20 bp, Homo sapiens
tggattggagatagggaaag

SEQ ID NO: 1856489 - DNA, 21 bp, Homo sapiens
tggattggagatagggaaaga

SEQ ID NO: 1856490 - DNA, 12 bp, Homo sapiens
tggcaaagccag

SEQ ID NO: 1856491 - DNA, 14 bp, Homo sapiens
tggcaaggctgtgc

SEQ ID NO: 1856492 - DNA, 23 bp, Homo sapiens
tggcaaggctgtgctccctggtt

SEQ ID NO: 1856493 - DNA, 18 bp, Homo sapiens
tggcacatttaagagaca

SEQ ID NO: 1856494 - DNA, 16 bp, Homo sapiens
tggcaccagcagcctg

SEQ ID NO: 1856495 - DNA, 19 bp, Homo sapiens
tggcactgactgggcatag

SEQ ID NO: 1856496 - DNA, 19 bp, Homo sapiens
tggcactgcttccagtgag

SEQ ID NO: 1856497 - DNA, 22 bp, Homo sapiens
tggcagagcttggactggatgc

SEQ ID NO: 1856498 - DNA, 16 bp, Homo sapiens
tggcagcctcttcaaa

SEQ ID NO: 1856499 - DNA, 15 bp, Homo sapiens
tggcagctcacctct

SEQ ID NO: 1856500 - DNA, 21 bp, Homo sapiens
tggcagctcacctctcccttg

SEQ ID NO: 1856501 - DNA, 22 bp, Homo sapiens
tggcagctcacctctcccttgg

SEQ ID NO: 1856502 - DNA, 13 bp, Homo sapiens
tggcagctcagag

SEQ ID NO: 1856503 - DNA, 14 bp, Homo sapiens
tggcagctcagaga

SEQ ID NO: 1856504 - DNA, 18 bp, Homo sapiens
tggcagctcagagagggt

SEQ ID NO: 1856505 - DNA, 15 bp, Homo sapiens
tggcaggtgcagccc

SEQ ID NO: 1856506 - DNA, 18 bp, Homo sapiens
tggcatcagctggcgtca

SEQ ID NO: 1856507 - DNA, 18 bp, Homo sapiens
tggcatttggtctcaggc

SEQ ID NO: 1856508 - DNA, 20 bp, Homo sapiens
tggcatttggtctcaggcag

SEQ ID NO: 1856509 - DNA, 14 bp, Homo sapiens
tggccacggccaca

SEQ ID NO: 1856510 - DNA, 20 bp, Homo sapiens
tggccaggctggtctcgaac

SEQ ID NO: 1856511 - DNA, 23 bp, Homo sapiens
tggccagggcctggaagacagag

SEQ ID NO: 1856512 - DNA, 17 bp, Homo sapiens
tggccatctctggatgc

SEQ ID NO: 1856513 - DNA, 21 bp, Homo sapiens
tggccatgcaggaggtggaga

SEQ ID NO: 1856514 - DNA, 13 bp, Homo sapiens
tggcccacgcact

SEQ ID NO: 1856515 - DNA, 19 bp, Homo sapiens
tggcccacgcacttcggga

SEQ ID NO: 1856516 - DNA, 15 bp, Homo sapiens
tggccgggaccccga

SEQ ID NO: 1856517 - DNA, 23 bp, Homo sapiens
tggccgggaccccgagcctggct

SEQ ID NO: 1856518 - DNA, 19 bp, Homo sapiens
tggccgttgatgttggctg

SEQ ID NO: 1856519 - DNA, 20 bp, Homo sapiens
tggcctcatttaaaacaaga

SEQ ID NO: 1856520 - DNA, 11 bp, Homo sapiens
tggcctcccaa

SEQ ID NO: 1856521 - DNA, 14 bp, Homo sapiens
tggcctcccaactc

SEQ ID NO: 1856522 - DNA, 21 bp, Homo sapiens
tggcctcccaactcaccccag

SEQ ID NO: 1856523 - DNA, 23 bp, Homo sapiens
tggcctcccaactcaccccagcc

SEQ ID NO: 1856524 - DNA, 21 bp, Homo sapiens
tggcctctccttgtggcctgg

SEQ ID NO: 1856525 - DNA, 13 bp, Homo sapiens
tggcctctgcact

SEQ ID NO: 1856526 - DNA, 14 bp, Homo sapiens
tggcctctgcactc

SEQ ID NO: 1856527 - DNA, 20 bp, Homo sapiens
tggcggctggggtcccagca

SEQ ID NO: 1856528 - DNA, 18 bp, Homo sapiens
tggcgtctgctctggtgg

SEQ ID NO: 1856529 - DNA, 19 bp, Homo sapiens
tggcgtctgctctggtggc

SEQ ID NO: 1856530 - DNA, 18 bp, Homo sapiens
tggctccaaaccctcgag

SEQ ID NO: 1856531 - DNA, 20 bp, Homo sapiens
tggctccaaaccctcgaggc

SEQ ID NO: 1856532 - DNA, 13 bp, Homo sapiens
tggctcttccagg

SEQ ID NO: 1856533 - DNA, 15 bp, Homo sapiens
tggctcttccaggct

SEQ ID NO: 1856534 - DNA, 20 bp, Homo sapiens
tggctcttccaggctgggag

SEQ ID NO: 1856535 - DNA, 15 bp, Homo sapiens
tggctgaaggactgt

SEQ ID NO: 1856536 - DNA, 14 bp, Homo sapiens
tggctgctgcccag

SEQ ID NO: 1856537 - DNA, 23 bp, Homo sapiens
tggctgtggggctaggggctggg

SEQ ID NO: 1856538 - DNA, 21 bp, Homo sapiens
tggcttaagtgagcagaacag

SEQ ID NO: 1856539 - DNA, 17 bp, Homo sapiens
tggcttcacggaagagc

SEQ ID NO: 1856540 - DNA, 20 bp, Homo sapiens
tgggaacaccataggtcacc

SEQ ID NO: 1856541 - DNA, 14 bp, Homo sapiens
tgggacaccctgtg

SEQ ID NO: 1856542 - DNA, 19 bp, Homo sapiens
tgggaccacgtgagatcat

SEQ ID NO: 1856543 - DNA, 22 bp, Homo sapiens
tgggaggatctcttgagcctgg

SEQ ID NO: 1856544 - DNA, 21 bp, Homo sapiens
tgggaggattgcttgagctca

SEQ ID NO: 1856545 - DNA, 18 bp, Homo sapiens
tgggaggtgcgtgttcag

SEQ ID NO: 1856546 - DNA, 22 bp, Homo sapiens
tgggaggtgcgtgttcagcaga

SEQ ID NO: 1856547 - DNA, 14 bp, Homo sapiens
tgggagtgggccca

SEQ ID NO: 1856548 - DNA, 12 bp, Homo sapiens
tgggatcctcca

SEQ ID NO: 1856549 - DNA, 23 bp, Homo sapiens
tgggatggcatttggtctcaggc

SEQ ID NO: 1856550 - DNA, 16 bp, Homo sapiens
tgggatgtcacagtcc

SEQ ID NO: 1856551 - DNA, 22 bp, Homo sapiens
tgggatgtcacagtccaaccag

SEQ ID NO: 1856552 - DNA, 14 bp, Homo sapiens
tgggcaaacaggca

SEQ ID NO: 1856553 - DNA, 15 bp, Homo sapiens
tgggcaaacaggcag

SEQ ID NO: 1856554 - DNA, 16 bp, Homo sapiens
tgggcaaacaggcagt

SEQ ID NO: 1856555 - DNA, 13 bp, Homo sapiens
tgggcagagcaga

SEQ ID NO: 1856556 - DNA, 15 bp, Homo sapiens
tgggcagagcagaga

SEQ ID NO: 1856557 - DNA, 21 bp, Homo sapiens
tgggcaggactcagctcccca

SEQ ID NO: 1856558 - DNA, 22 bp, Homo sapiens
tgggcaggactcagctccccag

SEQ ID NO: 1856559 - DNA, 16 bp, Homo sapiens
tgggcatagatgcagg

SEQ ID NO: 1856560 - DNA, 17 bp, Homo sapiens
tgggccagaatttcaaa

SEQ ID NO: 1856561 - DNA, 21 bp, Homo sapiens
tgggcccccaaatggaaatgg

SEQ ID NO: 1856562 - DNA, 20 bp, Homo sapiens
tgggctcccttcccacctct

SEQ ID NO: 1856563 - DNA, 19 bp, Homo sapiens
tgggctgaacactccaatt

SEQ ID NO: 1856564 - DNA, 13 bp, Homo sapiens
tgggcttcccaag

SEQ ID NO: 1856565 - DNA, 13 bp, Homo sapiens
tggggaaaatggc

SEQ ID NO: 1856566 - DNA, 14 bp, Homo sapiens
tggggaaaatggcc

SEQ ID NO: 1856567 - DNA, 21 bp, Homo sapiens
tggggaaaatggccatgcagg

SEQ ID NO: 1856568 - DNA, 22 bp, Homo sapiens
tggggctgcaccggctggcctg

SEQ ID NO: 1856569 - DNA, 15 bp, Homo sapiens
tgggggaaagcacag

SEQ ID NO: 1856570 - DNA, 20 bp, Homo sapiens
tgggggatcacagcctctga

SEQ ID NO: 1856571 - DNA, 19 bp, Homo sapiens
tgggggcaaaatcagaatg

SEQ ID NO: 1856572 - DNA, 13 bp, Homo sapiens
tggggtcactctg

SEQ ID NO: 1856573 - DNA, 17 bp, Homo sapiens
tggggtcactctggcag

SEQ ID NO: 1856574 - DNA, 15 bp, Homo sapiens
tgggtgcttggagga

SEQ ID NO: 1856575 - DNA, 21 bp, Homo sapiens
tgggtggcaccagcagcctgg

SEQ ID NO: 1856576 - DNA, 22 bp, Homo sapiens
tgggtggcaccagcagcctgga

SEQ ID NO: 1856577 - DNA, 14 bp, Homo sapiens
tggtcaacatttct

SEQ ID NO: 1856578 - DNA, 15 bp, Homo sapiens
tggtccatagagagc

SEQ ID NO: 1856579 - DNA, 14 bp, Homo sapiens
tggtcccaccccac

SEQ ID NO: 1856580 - DNA, 16 bp, Homo sapiens
tggtcccaccccacac

SEQ ID NO: 1856581 - DNA, 16 bp, Homo sapiens
tggtcccccttccatg

SEQ ID NO: 1856582 - DNA, 23 bp, Homo sapiens
tggtcccccttccatggactttg

SEQ ID NO: 1856583 - DNA, 13 bp, Homo sapiens
tggtcctgctgca

SEQ ID NO: 1856584 - DNA, 13 bp, Homo sapiens
tggtcgttttttt

SEQ ID NO: 1856585 - DNA, 22 bp, Homo sapiens
tggtcgttttttttttgtttgt

SEQ ID NO: 1856586 - DNA, 17 bp, Homo sapiens
tggtctacactgtgctg

SEQ ID NO: 1856587 - DNA, 14 bp, Homo sapiens
tggtctctaggctg

SEQ ID NO: 1856588 - DNA, 17 bp, Homo sapiens
tggtctctaggctgggg

SEQ ID NO: 1856589 - DNA, 19 bp, Homo sapiens
tggtctctaggctggggaa

SEQ ID NO: 1856590 - DNA, 18 bp, Homo sapiens
tggtgacatcaggttttt

SEQ ID NO: 1856591 - DNA, 18 bp, Homo sapiens
tggtgccacaaataaaat

SEQ ID NO: 1856592 - DNA, 19 bp, Homo sapiens
tggtgctgctgctgctgtg

SEQ ID NO: 1856593 - DNA, 21 bp, Homo sapiens
tggtggagaggcccggcctct

SEQ ID NO: 1856594 - DNA, 12 bp, Homo sapiens
tggtggcagctc

SEQ ID NO: 1856595 - DNA, 19 bp, Homo sapiens
tggtggcagctcacctctc

SEQ ID NO: 1856596 - DNA, 19 bp, Homo sapiens
tggtgtctggattcccagg

SEQ ID NO: 1856597 - DNA, 14 bp, Homo sapiens
tggtgtgaactaaa

SEQ ID NO: 1856598 - DNA, 18 bp, Homo sapiens
tggttaagtctgttttat

SEQ ID NO: 1856599 - DNA, 18 bp, Homo sapiens
tggttcctcccctcctcc

SEQ ID NO: 1856600 - DNA, 23 bp, Homo sapiens
tggttcctcccctcctcctggac

SEQ ID NO: 1856601 - DNA, 20 bp, Homo sapiens
tggttctgatgatgtgcctg

SEQ ID NO: 1856602 - DNA, 18 bp, Homo sapiens
tggttgctttaatatcat

SEQ ID NO: 1856603 - DNA, 16 bp, Homo sapiens
tggttggctggccttc

SEQ ID NO: 1856604 - DNA, 20 bp, Homo sapiens
tggtttggccatctctggat

SEQ ID NO: 1856605 - DNA, 21 bp, Homo sapiens
tggttttcttcttctcgtcct

SEQ ID NO: 1856606 - DNA, 17 bp, Homo sapiens
tgtaaacattcatcaag

SEQ ID NO: 1856607 - DNA, 12 bp, Homo sapiens
tgtaaatataaa

SEQ ID NO: 1856608 - DNA, 17 bp, Homo sapiens
tgtaaatataaagacgt

SEQ ID NO: 1856609 - DNA, 21 bp, Homo sapiens
tgtaactgtttagatgaatgt

SEQ ID NO: 1856610 - DNA, 15 bp, Homo sapiens
tgtaatagaagctta

SEQ ID NO: 1856611 - DNA, 21 bp, Homo sapiens
tgtaattatatatactatatt

SEQ ID NO: 1856612 - DNA, 11 bp, Homo sapiens
tgtacagagcc

SEQ ID NO: 1856613 - DNA, 21 bp, Homo sapiens
tgtacagagcccacgccccca

SEQ ID NO: 1856614 - DNA, 13 bp, Homo sapiens
tgtagaaggcaca

SEQ ID NO: 1856615 - DNA, 13 bp, Homo sapiens
tgtagagtgggag

SEQ ID NO: 1856616 - DNA, 14 bp, Homo sapiens
tgtagagtgggagc

SEQ ID NO: 1856617 - DNA, 15 bp, Homo sapiens
tgtagtgctttgaga

SEQ ID NO: 1856618 - DNA, 22 bp, Homo sapiens
tgtagttgcaatagaacagaga

SEQ ID NO: 1856619 - DNA, 21 bp, Homo sapiens
tgtagttttgtgatgcatttt

SEQ ID NO: 1856620 - DNA, 17 bp, Homo sapiens
tgtataaacaagaaaaa

SEQ ID NO: 1856621 - DNA, 16 bp, Homo sapiens
tgtatctgtgtagact

SEQ ID NO: 1856622 - DNA, 12 bp, Homo sapiens
tgtatgtaaata

SEQ ID NO: 1856623 - DNA, 12 bp, Homo sapiens
tgtattaagaat

SEQ ID NO: 1856624 - DNA, 19 bp, Homo sapiens
tgtattgtgcaatgtgtat

SEQ ID NO: 1856625 - DNA, 20 bp, Homo sapiens
tgtattgtgcaatgtgtata

SEQ ID NO: 1856626 - DNA, 14 bp, Homo sapiens
tgtatttgtttgca

SEQ ID NO: 1856627 - DNA, 13 bp, Homo sapiens
tgtattttatgtt

SEQ ID NO: 1856628 - DNA, 14 bp, Homo sapiens
tgtattttatgtta

SEQ ID NO: 1856629 - DNA, 20 bp, Homo sapiens
tgtcaaccccaagttagttc

SEQ ID NO: 1856630 - DNA, 16 bp, Homo sapiens
tgagcagaacaggtag

SEQ ID NO: 1856631 - DNA, 15 bp, Homo sapiens
tgagcatcaggccag

SEQ ID NO: 1856632 - DNA, 16 bp, Homo sapiens
tgagcatggagctggc

SEQ ID NO: 1856633 - DNA, 15 bp, Homo sapiens
tgagcatgtttagac

SEQ ID NO: 1856634 - DNA, 24 bp, Homo sapiens
tgagcatgtttagactttaacata

SEQ ID NO: 1856635 - DNA, 17 bp, Homo sapiens
tgagcccatggccctcc

SEQ ID NO: 1856636 - DNA, 19 bp, Homo sapiens
tgagcctgggaggtcaagg

SEQ ID NO: 1856637 - DNA, 14 bp, Homo sapiens
tgagctgagcaggc

SEQ ID NO: 1856638 - DNA, 16 bp, Homo sapiens
tgagctggtcccctct

SEQ ID NO: 1856639 - DNA, 17 bp, Homo sapiens
tgaggaagccgctgggg

SEQ ID NO: 1856640 - DNA, 21 bp, Homo sapiens
tgaggaagccgctggggccag

SEQ ID NO: 1856641 - DNA, 22 bp, Homo sapiens
tgaggacttgggcgggacacag

SEQ ID NO: 1856642 - DNA, 14 bp, Homo sapiens
tgaggattgtggaa

SEQ ID NO: 1856643 - DNA, 20 bp, Homo sapiens
tgaggattgtggaaaaccag

SEQ ID NO: 1856644 - DNA, 12 bp, Homo sapiens
tgaggcccagag

SEQ ID NO: 1856645 - DNA, 13 bp, Homo sapiens
tgaggcccagagg

SEQ ID NO: 1856646 - DNA, 21 bp, Homo sapiens
tgaggcccagagggcctgcaa

SEQ ID NO: 1856647 - DNA, 21 bp, Homo sapiens
tgaggccccttctaggtggca

SEQ ID NO: 1856648 - DNA, 18 bp, Homo sapiens
tgaggcccttctctccag

SEQ ID NO: 1856649 - DNA, 19 bp, Homo sapiens
tgaggcccttctctccagc

SEQ ID NO: 1856650 - DNA, 23 bp, Homo sapiens
tgaggcccttctctccagcccct

SEQ ID NO: 1856651 - DNA, 13 bp, Homo sapiens
tgaggctctgccc

SEQ ID NO: 1856652 - DNA, 16 bp, Homo sapiens
tgaggtccagccctgg

SEQ ID NO: 1856653 - DNA, 21 bp, Homo sapiens
tgaggtccagccctggctgaa

SEQ ID NO: 1856654 - DNA, 23 bp, Homo sapiens
tgaggtccagccctggctgaagg

SEQ ID NO: 1856655 - DNA, 13 bp, Homo sapiens
tgagtccagaagt

SEQ ID NO: 1856656 - DNA, 19 bp, Homo sapiens
tgagtccagaagtttgaga

SEQ ID NO: 1856657 - DNA, 18 bp, Homo sapiens
tgagtctgaaggctgggt

SEQ ID NO: 1856658 - DNA, 14 bp, Homo sapiens
tgagtgacagcttt

SEQ ID NO: 1856659 - DNA, 20 bp, Homo sapiens
tgagtgatgcggcagattga

SEQ ID NO: 1856660 - DNA, 23 bp, Homo sapiens
tgagtgggggatcacagcctctg

SEQ ID NO: 1856661 - DNA, 22 bp, Homo sapiens
tgagtgtgcggctgtgtgtgca

SEQ ID NO: 1856662 - DNA, 23 bp, Homo sapiens
tgagttgatagcacagaccctgc

SEQ ID NO: 1856663 - DNA, 19 bp, Homo sapiens
tgagttgattcagctctgc

SEQ ID NO: 1856664 - DNA, 22 bp, Homo sapiens
tgagtttgggccccagaggctg

SEQ ID NO: 1856665 - DNA, 21 bp, Homo sapiens
tgataagagggcacacactgt

SEQ ID NO: 1856666 - DNA, 18 bp, Homo sapiens
tgataatcaactgggctg

SEQ ID NO: 1856667 - DNA, 24 bp, Homo sapiens
tgataatcaactgggctgaacact

SEQ ID NO: 1856668 - DNA, 21 bp, Homo sapiens
tgatacttcgacactgttctt

SEQ ID NO: 1856669 - DNA, 20 bp, Homo sapiens
tgatagcacagaccctgccc

SEQ ID NO: 1856670 - DNA, 21 bp, Homo sapiens
tgatatgtctagggtgtgatt

SEQ ID NO: 1856671 - DNA, 13 bp, Homo sapiens
tgatcctgtgaag

SEQ ID NO: 1856672 - DNA, 13 bp, Homo sapiens
tgatctaggaaga

SEQ ID NO: 1856673 - DNA, 14 bp, Homo sapiens
tgatctaggaagac

SEQ ID NO: 1856674 - DNA, 13 bp, Homo sapiens
tgatgaagaggag

SEQ ID NO: 1856675 - DNA, 14 bp, Homo sapiens
tgatgaagaggagt

SEQ ID NO: 1856676 - DNA, 14 bp, Homo sapiens
tgatgatcctaggc

SEQ ID NO: 1856677 - DNA, 12 bp, Homo sapiens
tgatgcatttta

SEQ ID NO: 1856678 - DNA, 15 bp, Homo sapiens
tgatgccaagttgtt

SEQ ID NO: 1856679 - DNA, 12 bp, Homo sapiens
tgatgctgggat

SEQ ID NO: 1856680 - DNA, 18 bp, Homo sapiens
tgatgcttcttcagagac

SEQ ID NO: 1856681 - DNA, 19 bp, Homo sapiens
tgatgcttcttcagagact

SEQ ID NO: 1856682 - DNA, 14 bp, Homo sapiens
tgatggagccccac

SEQ ID NO: 1856683 - DNA, 19 bp, Homo sapiens
tgatggggccctgcctcct

SEQ ID NO: 1856684 - DNA, 20 bp, Homo sapiens
tgattaaccacttcagctga

SEQ ID NO: 1856685 - DNA, 14 bp, Homo sapiens
tgattatatttcac

SEQ ID NO: 1856686 - DNA, 15 bp, Homo sapiens
tgattcagacagctg

SEQ ID NO: 1856687 - DNA, 19 bp, Homo sapiens
tgattcagacagctgcctg

SEQ ID NO: 1856688 - DNA, 21 bp, Homo sapiens
tgattctcagggtctctgctg

SEQ ID NO: 1856689 - DNA, 22 bp, Homo sapiens
tgattctcagggtctctgctgc

SEQ ID NO: 1856690 - DNA, 18 bp, Homo sapiens
tgattgccaagctcagga

SEQ ID NO: 1856691 - DNA, 13 bp, Homo sapiens
tgattggaggggg

SEQ ID NO: 1856692 - DNA, 17 bp, Homo sapiens
tgattgggacagaggtt

SEQ ID NO: 1856693 - DNA, 17 bp, Homo sapiens
tgatttttaaattaaat

SEQ ID NO: 1856694 - DNA, 12 bp, Homo sapiens
tgcaaaggctgg

SEQ ID NO: 1856695 - DNA, 21 bp, Homo sapiens
tgcaaagtcatgcaaaggctg

SEQ ID NO: 1856696 - DNA, 12 bp, Homo sapiens
tgcaacactcaa

SEQ ID NO: 1856697 - DNA, 13 bp, Homo sapiens
tgcaacagacaag

SEQ ID NO: 1856698 - DNA, 22 bp, Homo sapiens
tgcaacctgattgtgtctcttg

SEQ ID NO: 1856699 - DNA, 16 bp, Homo sapiens
tgcaatatttcctcat

SEQ ID NO: 1856700 - DNA, 18 bp, Homo sapiens
tgcaatgaagtctctgaa

SEQ ID NO: 1856701 - DNA, 13 bp, Homo sapiens
tgcaatgtgtata

SEQ ID NO: 1856702 - DNA, 14 bp, Homo sapiens
tgcaatgtgtataa

SEQ ID NO: 1856703 - DNA, 21 bp, Homo sapiens
tgcacaagctgcaccctcagg

SEQ ID NO: 1856704 - DNA, 14 bp, Homo sapiens
tgcacacaggacag

SEQ ID NO: 1856705 - DNA, 14 bp, Homo sapiens
tgcaccactgcact

SEQ ID NO: 1856706 - DNA, 15 bp, Homo sapiens
tgcaccactgcactc

SEQ ID NO: 1856707 - DNA, 13 bp, Homo sapiens
tgcacccacctgt

SEQ ID NO: 1856708 - DNA, 16 bp, Homo sapiens
tgcacccacctgtttt

SEQ ID NO: 1856709 - DNA, 22 bp, Homo sapiens
tgcacccacctgttttctgaaa

SEQ ID NO: 1856710 - DNA, 20 bp, Homo sapiens
tgcaccggctggcctggccc

SEQ ID NO: 1856711 - DNA, 21 bp, Homo sapiens
tgcaccggctggcctggcccc

SEQ ID NO: 1856712 - DNA, 23 bp, Homo sapiens
tgcaccggctggcctggcccctc

SEQ ID NO: 1856713 - DNA, 16 bp, Homo sapiens
tgcacctgcagccaag

SEQ ID NO: 1856714 - DNA, 13 bp, Homo sapiens
tgcacggctgctg

SEQ ID NO: 1856715 - DNA, 14 bp, Homo sapiens
tgcacggctgctga

SEQ ID NO: 1856716 - DNA, 14 bp, Homo sapiens
tgcactccagcctg

SEQ ID NO: 1856717 - DNA, 15 bp, Homo sapiens
tgcactccagcctgg

SEQ ID NO: 1856718 - DNA, 16 bp, Homo sapiens
tgcactcccctgctgg

SEQ ID NO: 1856719 - DNA, 12 bp, Homo sapiens
tgcactttgctt

SEQ ID NO: 1856720 - DNA, 18 bp, Homo sapiens
tgcagacctcatgcccag

SEQ ID NO: 1856721 - DNA, 15 bp, Homo sapiens
tgcagccactgattc

SEQ ID NO: 1856722 - DNA, 23 bp, Homo sapiens
tgcagcccccactgcctttgacc

SEQ ID NO: 1856723 - DNA, 13 bp, Homo sapiens
tgcagcctcacag

SEQ ID NO: 1856724 - DNA, 17 bp, Homo sapiens
tgcagcctcacagtcct

SEQ ID NO: 1856725 - DNA, 18 bp, Homo sapiens
tgcagcctcacagtcctt

SEQ ID NO: 1856726 - DNA, 12 bp, Homo sapiens
tgcagctgctcc

SEQ ID NO: 1856727 - DNA, 16 bp, Homo sapiens
tgcagctgctccccag

SEQ ID NO: 1856728 - DNA, 18 bp, Homo sapiens
tgcagctgctccccaggc

SEQ ID NO: 1856729 - DNA, 22 bp, Homo sapiens
tgcagctttaaaaaattaatct

SEQ ID NO: 1856730 - DNA, 18 bp, Homo sapiens
tgcaggacctcaggtgag

SEQ ID NO: 1856731 - DNA, 15 bp, Homo sapiens
tgcaggaggtggaga

SEQ ID NO: 1856732 - DNA, 20 bp, Homo sapiens
tgcaggcagcaggatagagt

SEQ ID NO: 1856733 - DNA, 16 bp, Homo sapiens
tgcaggcagccaggcc

SEQ ID NO: 1856734 - DNA, 18 bp, Homo sapiens
tgcaggcagccaggccac

SEQ ID NO: 1856735 - DNA, 19 bp, Homo sapiens
tgcaggcagccaggccaca

SEQ ID NO: 1856736 - DNA, 19 bp, Homo sapiens
tgcaggtgagcccatggcc

SEQ ID NO: 1856737 - DNA, 23 bp, Homo sapiens
tgcaggtgagcccatggccctcc

SEQ ID NO: 1856738 - DNA, 19 bp, Homo sapiens
tgcagtcacgtggaggagc

SEQ ID NO: 1856739 - DNA, 14 bp, Homo sapiens
tgcagtcccaagcg

SEQ ID NO: 1856740 - DNA, 20 bp, Homo sapiens
tgcagtcccaagcggtgtct

SEQ ID NO: 1856741 - DNA, 21 bp, Homo sapiens
tgcagtcccaagcggtgtctc

SEQ ID NO: 1856742 - DNA, 14 bp, Homo sapiens
tgcagttgccagtc

SEQ ID NO: 1856743 - DNA, 11 bp, Homo sapiens
tgcatggaaat

SEQ ID NO: 1856744 - DNA, 19 bp, Homo sapiens
tgcatggaaattcccttca

SEQ ID NO: 1856745 - DNA, 13 bp, Homo sapiens
tgcatttgtggga

SEQ ID NO: 1856746 - DNA, 13 bp, Homo sapiens
tgccaaattaaaa

SEQ ID NO: 1856747 - DNA, 18 bp, Homo sapiens
tgccaaattaaaaaagat

SEQ ID NO: 1856748 - DNA, 23 bp, Homo sapiens
tgccaacactcaagaagcaggct

SEQ ID NO: 1856749 - DNA, 15 bp, Homo sapiens
tgccaagctcaggac

SEQ ID NO: 1856750 - DNA, 13 bp, Homo sapiens
tgccaatggacta

SEQ ID NO: 1856751 - DNA, 17 bp, Homo sapiens
tgccagagccttaataa

SEQ ID NO: 1856752 - DNA, 11 bp, Homo sapiens
tgccagcccct

SEQ ID NO: 1856753 - DNA, 19 bp, Homo sapiens
tgccagcccctgccattgt

SEQ ID NO: 1856754 - DNA, 15 bp, Homo sapiens
tgccaggagcacggc

SEQ ID NO: 1856755 - DNA, 18 bp, Homo sapiens
tgtcacactgtggcctga

SEQ ID NO: 1856756 - DNA, 16 bp, Homo sapiens
tgtcaggagtgtgtgt

SEQ ID NO: 1856757 - DNA, 17 bp, Homo sapiens
tgtcagttgttatttat

SEQ ID NO: 1856758 - DNA, 12 bp, Homo sapiens
tgtccaaagcag

SEQ ID NO: 1856759 - DNA, 16 bp, Homo sapiens
tgtccacaggcttctg

SEQ ID NO: 1856760 - DNA, 13 bp, Homo sapiens
tgtccccaccgca

SEQ ID NO: 1856761 - DNA, 22 bp, Homo sapiens
tgtccccaccgcagacaggacc

SEQ ID NO: 1856762 - DNA, 14 bp, Homo sapiens
tgtccgagctttga

SEQ ID NO: 1856763 - DNA, 15 bp, Homo sapiens
tgtcctattatattc

SEQ ID NO: 1856764 - DNA, 12 bp, Homo sapiens
tgtcctgctggt

SEQ ID NO: 1856765 - DNA, 15 bp, Homo sapiens
tgtcctttttcactt

SEQ ID NO: 1856766 - DNA, 14 bp, Homo sapiens
tgtcgacatgtttt

SEQ ID NO: 1856767 - DNA, 22 bp, Homo sapiens
tgtcgggggctgtggatgggtg

SEQ ID NO: 1856768 - DNA, 19 bp, Homo sapiens
tgtctaggactgcagtgtg

SEQ ID NO: 1856769 - DNA, 20 bp, Homo sapiens
tgtctaggactgcagtgtgg

SEQ ID NO: 1856770 - DNA, 18 bp, Homo sapiens
tgtctattatcacattaa

SEQ ID NO: 1856771 - DNA, 17 bp, Homo sapiens
tgtctccctcccctctc

SEQ ID NO: 1856772 - DNA, 23 bp, Homo sapiens
tgtctccctcccctctcagaaca

SEQ ID NO: 1856773 - DNA, 17 bp, Homo sapiens
tgtctctcctgcccctt

SEQ ID NO: 1856774 - DNA, 15 bp, Homo sapiens
tgtctcttatggatg

SEQ ID NO: 1856775 - DNA, 16 bp, Homo sapiens
tgtctgccaaacacat

SEQ ID NO: 1856776 - DNA, 19 bp, Homo sapiens
tgtctggattcccaggatg

SEQ ID NO: 1856777 - DNA, 12 bp, Homo sapiens
tgtctgtctccc

SEQ ID NO: 1856778 - DNA, 17 bp, Homo sapiens
tgtcttggctgtggggc

SEQ ID NO: 1856779 - DNA, 17 bp, Homo sapiens
tgtctttggaccctgag

SEQ ID NO: 1856780 - DNA, 18 bp, Homo sapiens
tgtctttggaccctgagg

SEQ ID NO: 1856781 - DNA, 23 bp, Homo sapiens
tgtctttggaccctgaggcccag

SEQ ID NO: 1856782 - DNA, 16 bp, Homo sapiens
tgtcttttcttgcatg

SEQ ID NO: 1856783 - DNA, 13 bp, Homo sapiens
tgtgaaaagaaaa

SEQ ID NO: 1856784 - DNA, 15 bp, Homo sapiens
tgtgaaaagaaaaat

SEQ ID NO: 1856785 - DNA, 21 bp, Homo sapiens
tgtgaaaagaaaaatgagcct

SEQ ID NO: 1856786 - DNA, 13 bp, Homo sapiens
tgtgaaaggaaag

SEQ ID NO: 1856787 - DNA, 15 bp, Homo sapiens
tgtgaaaggaaagag

SEQ ID NO: 1856788 - DNA, 14 bp, Homo sapiens
tgtgaactaaactt

SEQ ID NO: 1856789 - DNA, 14 bp, Homo sapiens
tgtgaactgaactc

SEQ ID NO: 1856790 - DNA, 23 bp, Homo sapiens
tgtgaaggcaggggaatgtatgt

SEQ ID NO: 1856791 - DNA, 13 bp, Homo sapiens
tgtgacagtgcct

SEQ ID NO: 1856792 - DNA, 21 bp, Homo sapiens
tgtgacagtgcctcttccagt

SEQ ID NO: 1856793 - DNA, 11 bp, Homo sapiens
tgtgagctgga

SEQ ID NO: 1856794 - DNA, 22 bp, Homo sapiens
tgtgagctggatagacttggga

SEQ ID NO: 1856795 - DNA, 16 bp, Homo sapiens
tgtgatggggccctgc

SEQ ID NO: 1856796 - DNA, 15 bp, Homo sapiens
tgtgcaacagacaag

SEQ ID NO: 1856797 - DNA, 20 bp, Homo sapiens
tgtgcaatgtgtataaacaa

SEQ ID NO: 1856798 - DNA, 22 bp, Homo sapiens
tgtgcaatgtgtataaacaaga

SEQ ID NO: 1856799 - DNA, 18 bp, Homo sapiens
tgtgcaggagcggcagat

SEQ ID NO: 1856800 - DNA, 15 bp, Homo sapiens
tgtgccgacagaagg

SEQ ID NO: 1856801 - DNA, 18 bp, Homo sapiens
tgtgcctaatgtgtttga

SEQ ID NO: 1856802 - DNA, 15 bp, Homo sapiens
tgtgccttttctgaa

SEQ ID NO: 1856803 - DNA, 12 bp, Homo sapiens
tgtgctgccctg

SEQ ID NO: 1856804 - DNA, 13 bp, Homo sapiens
tgtgctgccctgc

SEQ ID NO: 1856805 - DNA, 14 bp, Homo sapiens
tgtgcttgttaact

SEQ ID NO: 1856806 - DNA, 18 bp, Homo sapiens
tgtggaaaaccaggaaaa

SEQ ID NO: 1856807 - DNA, 19 bp, Homo sapiens
tgtggagggcacattcctt

SEQ ID NO: 1856808 - DNA, 12 bp, Homo sapiens
tgtgggaagggg

SEQ ID NO: 1856809 - DNA, 14 bp, Homo sapiens
tgtgtataaacaag

SEQ ID NO: 1856810 - DNA, 21 bp, Homo sapiens
tgtgtataaacaagaaaaata

SEQ ID NO: 1856811 - DNA, 20 bp, Homo sapiens
tgtgtcacactgtggcctga

SEQ ID NO: 1856812 - DNA, 13 bp, Homo sapiens
tgtgtctcttggt

SEQ ID NO: 1856813 - DNA, 20 bp, Homo sapiens
tgtgtctcttggtcctgctg

SEQ ID NO: 1856814 - DNA, 21 bp, Homo sapiens
tgtgtctcttggtcctgctgc

SEQ ID NO: 1856815 - DNA, 12 bp, Homo sapiens
tgtgtctgccaa

SEQ ID NO: 1856816 - DNA, 19 bp, Homo sapiens
tgtgttaagctctgctatt

SEQ ID NO: 1856817 - DNA, 21 bp, Homo sapiens
tgtgttaagctctgctattag

SEQ ID NO: 1856818 - DNA, 13 bp, Homo sapiens
tgttaagctctgc

SEQ ID NO: 1856819 - DNA, 24 bp, Homo sapiens
tgttaagtatcagctacaattgta

SEQ ID NO: 1856820 - DNA, 13 bp, Homo sapiens
tgttaatatttta

SEQ ID NO: 1856821 - DNA, 14 bp, Homo sapiens
tgttatataaatgg

SEQ ID NO: 1856822 - DNA, 13 bp, Homo sapiens
tgttatatataaa

SEQ ID NO: 1856823 - DNA, 17 bp, Homo sapiens
tgttatatataaatata

SEQ ID NO: 1856824 - DNA, 16 bp, Homo sapiens
tgttatgaacagctgt

SEQ ID NO: 1856825 - DNA, 24 bp, Homo sapiens
tgttatgaacagctgtgtctgcca

SEQ ID NO: 1856826 - DNA, 18 bp, Homo sapiens
tgttatttataatcactt

SEQ ID NO: 1856827 - DNA, 13 bp, Homo sapiens
tgttatttattga

SEQ ID NO: 1856828 - DNA, 14 bp, Homo sapiens
tgttcagcagaacc

SEQ ID NO: 1856829 - DNA, 16 bp, Homo sapiens
tgttcagcagaacctg

SEQ ID NO: 1856830 - DNA, 18 bp, Homo sapiens
tgttcagcagaacctgca

SEQ ID NO: 1856831 - DNA, 22 bp, Homo sapiens
tgttcagcagaacctgcacaca

SEQ ID NO: 1856832 - DNA, 11 bp, Homo sapiens
tgttcagctgg

SEQ ID NO: 1856833 - DNA, 22 bp, Homo sapiens
tgttctaaatatcccttggaca

SEQ ID NO: 1856834 - DNA, 21 bp, Homo sapiens
tgttctcatgaagcaggaggc

SEQ ID NO: 1856835 - DNA, 16 bp, Homo sapiens
tgttctgttttgtttc

SEQ ID NO: 1856836 - DNA, 20 bp, Homo sapiens
tgttcttagctcaatgagca

SEQ ID NO: 1856837 - DNA, 20 bp, Homo sapiens
tgtttagatgaatgtcagtt

SEQ ID NO: 1856838 - DNA, 14 bp, Homo sapiens
tgtttcgctctttg

SEQ ID NO: 1856839 - DNA, 22 bp, Homo sapiens
tgtttgaggtttttaagcctta

SEQ ID NO: 1856840 - DNA, 22 bp, Homo sapiens
tgtttgattcagacagctgcct

SEQ ID NO: 1856841 - DNA, 13 bp, Homo sapiens
tgtttgtaagatt

SEQ ID NO: 1856842 - DNA, 17 bp, Homo sapiens
tgttttccagctcctca

SEQ ID NO: 1856843 - DNA, 13 bp, Homo sapiens
tgtttttgtctta

SEQ ID NO: 1856844 - DNA, 13 bp, Homo sapiens
ttaaaaaagataa

SEQ ID NO: 1856845 - DNA, 21 bp, Homo sapiens
ttaaaaaagataaacacaaga

SEQ ID NO: 1856846 - DNA, 18 bp, Homo sapiens
ttaaaaagtggaaaaata

SEQ ID NO: 1856847 - DNA, 15 bp, Homo sapiens
ttaaaatgaaatgca

SEQ ID NO: 1856848 - DNA, 18 bp, Homo sapiens
ttaaagaaaaaaatgtat

SEQ ID NO: 1856849 - DNA, 20 bp, Homo sapiens
ttaaagaaaaaaatgtattt

SEQ ID NO: 1856850 - DNA, 20 bp, Homo sapiens
ttaaaggaaggttctggtgt

SEQ ID NO: 1856851 - DNA, 18 bp, Homo sapiens
ttaaatgaacaagagaag

SEQ ID NO: 1856852 - DNA, 13 bp, Homo sapiens
ttaaatgcccagc

SEQ ID NO: 1856853 - DNA, 18 bp, Homo sapiens
ttaaatgtcttctgtatt

SEQ ID NO: 1856854 - DNA, 13 bp, Homo sapiens
ttaacaaattgca

SEQ ID NO: 1856855 - DNA, 18 bp, Homo sapiens
ttaacaaattgcatttgt

SEQ ID NO: 1856856 - DNA, 19 bp, Homo sapiens
ttaacaaattgcatttgtg

SEQ ID NO: 1856857 - DNA, 14 bp, Homo sapiens
ttaacataagctat

SEQ ID NO: 1856858 - DNA, 21 bp, Homo sapiens
ttaacataagctatttttcta

SEQ ID NO: 1856859 - DNA, 14 bp, Homo sapiens
ttaagaatgaaata

SEQ ID NO: 1856860 - DNA, 23 bp, Homo sapiens
ttaagacatttttggaaggggac

SEQ ID NO: 1856861 - DNA, 16 bp, Homo sapiens
ttaagcctttggaaac

SEQ ID NO: 1856862 - DNA, 21 bp, Homo sapiens
ttaaggaagacaatgtgaaaa

SEQ ID NO: 1856863 - DNA, 20 bp, Homo sapiens
ttaaggattttatgctttaa

SEQ ID NO: 1856864 - DNA, 13 bp, Homo sapiens
ttaagggtatgat

SEQ ID NO: 1856865 - DNA, 17 bp, Homo sapiens
ttaagtatctgacatct

SEQ ID NO: 1856866 - DNA, 18 bp, Homo sapiens
ttaagtgagcagaacagg

SEQ ID NO: 1856867 - DNA, 15 bp, Homo sapiens
ttaatatcatcagta

SEQ ID NO: 1856868 - DNA, 18 bp, Homo sapiens
ttaatatcatcagtattg

SEQ ID NO: 1856869 - DNA, 22 bp, Homo sapiens
ttaatatttataggtcactttg

SEQ ID NO: 1856870 - DNA, 21 bp, Homo sapiens
ttaatctgggccagaatttca

SEQ ID NO: 1856871 - DNA, 19 bp, Homo sapiens
ttaatggtagttttacagt

SEQ ID NO: 1856872 - DNA, 17 bp, Homo sapiens
ttaattctttgttctgt

SEQ ID NO: 1856873 - DNA, 20 bp, Homo sapiens
ttacagctgggtggcactgc

SEQ ID NO: 1856874 - DNA, 23 bp, Homo sapiens
ttaccctctgggtctcagtgtcc

SEQ ID NO: 1856875 - DNA, 13 bp, Homo sapiens
ttacgtttgtcct

SEQ ID NO: 1856876 - DNA, 23 bp, Homo sapiens
ttactcttcagttaagcctttgg

SEQ ID NO: 1856877 - DNA, 16 bp, Homo sapiens
ttacttgtaaatataa

SEQ ID NO: 1856878 - DNA, 21 bp, Homo sapiens
ttacttgtaaatataaagacg

SEQ ID NO: 1856879 - DNA, 20 bp, Homo sapiens
ttacttgtttgtaagattta

SEQ ID NO: 1856880 - DNA, 15 bp, Homo sapiens
aaaagttattttgta

SEQ ID NO: 1856881 - DNA, 21 bp, Homo sapiens
aaaagttggaaggatctgctg

SEQ ID NO: 1856882 - DNA, 21 bp, Homo sapiens
aaaatacagtttgtcacatga

SEQ ID NO: 1856883 - DNA, 12 bp, Homo sapiens
aaaatagcctgc

SEQ ID NO: 1856884 - DNA, 16 bp, Homo sapiens
aaaatattttcctgcc

SEQ ID NO: 1856885 - DNA, 15 bp, Homo sapiens
aaaatcgatgagcgc

SEQ ID NO: 1856886 - DNA, 17 bp, Homo sapiens
aaaatgaaatgcatttt

SEQ ID NO: 1856887 - DNA, 14 bp, Homo sapiens
aaaatgagcctggc

SEQ ID NO: 1856888 - DNA, 21 bp, Homo sapiens
aaaatgagcctggcaagaatg

SEQ ID NO: 1856889 - DNA, 15 bp, Homo sapiens
aaaatggagacacca

SEQ ID NO: 1856890 - DNA, 11 bp, Homo sapiens
aaaatgtattt

SEQ ID NO: 1856891 - DNA, 18 bp, Homo sapiens
aaaatgtattttatgtta

SEQ ID NO: 1856892 - DNA, 23 bp, Homo sapiens
aaaattaatctgggccagaattt

SEQ ID NO: 1856893 - DNA, 19 bp, Homo sapiens
aaacaagacacccaagtcc

SEQ ID NO: 1856894 - DNA, 13 bp, Homo sapiens
aaacacccctctg

SEQ ID NO: 1856895 - DNA, 20 bp, Homo sapiens
aaacacccctctgtctagga

SEQ ID NO: 1856896 - DNA, 15 bp, Homo sapiens
aaacactgcaggcat

SEQ ID NO: 1856897 - DNA, 22 bp, Homo sapiens
aaacactgttctctgccctcca

SEQ ID NO: 1856898 - DNA, 16 bp, Homo sapiens
aaacatgcttttccaa

SEQ ID NO: 1856899 - DNA, 15 bp, Homo sapiens
aaacattatgatgtg

SEQ ID NO: 1856900 - DNA, 21 bp, Homo sapiens
aaacattggttcttgtattaa

SEQ ID NO: 1856901 - DNA, 16 bp, Homo sapiens
aaacccagctctggtc

SEQ ID NO: 1856902 - DNA, 13 bp, Homo sapiens
aaaccctcgaggc

SEQ ID NO: 1856903 - DNA, 15 bp, Homo sapiens
aaaccgccaaggctg

SEQ ID NO: 1856904 - DNA, 16 bp, Homo sapiens
aaacctgagatttatt

SEQ ID NO: 1856905 - DNA, 22 bp, Homo sapiens
aaacctgagatttattaaagaa

SEQ ID NO: 1856906 - DNA, 20 bp, Homo sapiens
aaacgatttttaaaatgtac

SEQ ID NO: 1856907 - DNA, 16 bp, Homo sapiens
aaactactttgctgct

SEQ ID NO: 1856908 - DNA, 22 bp, Homo sapiens
aaactagttactaaacatgtat

SEQ ID NO: 1856909 - DNA, 19 bp, Homo sapiens
aaactggcttaacttagta

SEQ ID NO: 1856910 - DNA, 16 bp, Homo sapiens
aaactgggttcctgca

SEQ ID NO: 1856911 - DNA, 18 bp, Homo sapiens
aaagaaaaaaatgtattt

SEQ ID NO: 1856912 - DNA, 22 bp, Homo sapiens
aaagaaaaaaatgtattttatg

SEQ ID NO: 1856913 - DNA, 22 bp, Homo sapiens
aaagaattgttgggggtttttt

SEQ ID NO: 1856914 - DNA, 16 bp, Homo sapiens
aaagacaaatcaaagc

SEQ ID NO: 1856915 - DNA, 19 bp, Homo sapiens
aaagacgatttgtcagtta

SEQ ID NO: 1856916 - DNA, 18 bp, Homo sapiens
aaagacgttttataagca

SEQ ID NO: 1856917 - DNA, 20 bp, Homo sapiens
aaagacgttttataagcatc

SEQ ID NO: 1856918 - DNA, 13 bp, Homo sapiens
aaagagattcgaa

SEQ ID NO: 1856919 - DNA, 12 bp, Homo sapiens
aaagatgcactt

SEQ ID NO: 1856920 - DNA, 23 bp, Homo sapiens
aaagatgcactttgctttaatat

SEQ ID NO: 1856921 - DNA, 13 bp, Homo sapiens
aaagcaaatgtct

SEQ ID NO: 1856922 - DNA, 17 bp, Homo sapiens
aaagcccattcattcca

SEQ ID NO: 1856923 - DNA, 15 bp, Homo sapiens
aaagctgaagaaaat

SEQ ID NO: 1856924 - DNA, 22 bp, Homo sapiens
aaaggaaagagggaggtaagga

SEQ ID NO: 1856925 - DNA, 15 bp, Homo sapiens
aaaggagtttatgtt

SEQ ID NO: 1856926 - DNA, 22 bp, Homo sapiens
aaaggctccaggagcagccaca

SEQ ID NO: 1856927 - DNA, 20 bp, Homo sapiens
aaagggcgcaaagggcatgg

SEQ ID NO: 1856928 - DNA, 16 bp, Homo sapiens
aaaggtttaaatgaac

SEQ ID NO: 1856929 - DNA, 22 bp, Homo sapiens
aaaggtttaaatgaacaagaga

SEQ ID NO: 1856930 - DNA, 20 bp, Homo sapiens
aaagtcatgcaaaggctggg

SEQ ID NO: 1856931 - DNA, 12 bp, Homo sapiens
aaatagctcttg

SEQ ID NO: 1856932 - DNA, 15 bp, Homo sapiens
aaatagctcttgctt

SEQ ID NO: 1856933 - DNA, 24 bp, Homo sapiens
aaatataaagacgttttataagca

SEQ ID NO: 1856934 - DNA, 19 bp, Homo sapiens
aaatatattattacttgta

SEQ ID NO: 1856935 - DNA, 18 bp, Homo sapiens
aaatcagcctgctccagc

SEQ ID NO: 1856936 - DNA, 13 bp, Homo sapiens
aaatcgcttttga

SEQ ID NO: 1856937 - DNA, 14 bp, Homo sapiens
aaatgaaatgcatt

SEQ ID NO: 1856938 - DNA, 15 bp, Homo sapiens
aaatgaaatgcattt

SEQ ID NO: 1856939 - DNA, 15 bp, Homo sapiens
aaatgatttcacagt

SEQ ID NO: 1856940 - DNA, 16 bp, Homo sapiens
aaatgccaaattaaaa

SEQ ID NO: 1856941 - DNA, 16 bp, Homo sapiens
aaatggcgtctgctct

SEQ ID NO: 1856942 - DNA, 15 bp, Homo sapiens
aaatgggcagagcag

SEQ ID NO: 1856943 - DNA, 20 bp, Homo sapiens
aaatgggcagagcagagacc

SEQ ID NO: 1856944 - DNA, 13 bp, Homo sapiens
aaatggttaaaag

SEQ ID NO: 1856945 - DNA, 15 bp, Homo sapiens
aaatgtattttatgt

SEQ ID NO: 1856946 - DNA, 18 bp, Homo sapiens
aaatgtattttatgttat

SEQ ID NO: 1856947 - DNA, 19 bp, Homo sapiens
aaatgtattttatgttata

SEQ ID NO: 1856948 - DNA, 16 bp, Homo sapiens
aaattaaaaaagataa

SEQ ID NO: 1856949 - DNA, 20 bp, Homo sapiens
aaattaaaaaagataaacac

SEQ ID NO: 1856950 - DNA, 16 bp, Homo sapiens
aaattccccaccctga

SEQ ID NO: 1856951 - DNA, 15 bp, Homo sapiens
aaattccctggcctt

SEQ ID NO: 1856952 - DNA, 18 bp, Homo sapiens
aaattcccttcatctgga

SEQ ID NO: 1856953 - DNA, 12 bp, Homo sapiens
aaattgcatttg

SEQ ID NO: 1856954 - DNA, 13 bp, Homo sapiens
aaatttagcattg

SEQ ID NO: 1856955 - DNA, 16 bp, Homo sapiens
aaatttagcattgtag

SEQ ID NO: 1856956 - DNA, 13 bp, Homo sapiens
aacaaaatttgaa

SEQ ID NO: 1856957 - DNA, 17 bp, Homo sapiens
aacaaatgccaaattaa

SEQ ID NO: 1856958 - DNA, 14 bp, Homo sapiens
aacaaatgtgaagg

SEQ ID NO: 1856959 - DNA, 21 bp, Homo sapiens
aacaactcctagggccactga

SEQ ID NO: 1856960 - DNA, 11 bp, Homo sapiens
aacaagaaaaa

SEQ ID NO: 1856961 - DNA, 12 bp, Homo sapiens
aacaagaaaaat

SEQ ID NO: 1856962 - DNA, 18 bp, Homo sapiens
aacaagaaaaataaagaa

SEQ ID NO: 1856963 - DNA, 14 bp, Homo sapiens
aacaagacttcaga

SEQ ID NO: 1856964 - DNA, 18 bp, Homo sapiens
aacaagacttcagattcc

SEQ ID NO: 1856965 - DNA, 23 bp, Homo sapiens
aacacaagattggtgtttttttc

SEQ ID NO: 1856966 - DNA, 12 bp, Homo sapiens
aacacagtgtct

SEQ ID NO: 1856967 - DNA, 15 bp, Homo sapiens
aacacccctctgtct

SEQ ID NO: 1856968 - DNA, 17 bp, Homo sapiens
aacaccctcacactggg

SEQ ID NO: 1856969 - DNA, 21 bp, Homo sapiens
aacaccctcacactgggactt

SEQ ID NO: 1856970 - DNA, 17 bp, Homo sapiens
aacactccaattaagga

SEQ ID NO: 1856971 - DNA, 16 bp, Homo sapiens
aacactgttctctgcc

SEQ ID NO: 1856972 - DNA, 20 bp, Homo sapiens
aacactgttctctgccctcc

SEQ ID NO: 1856973 - DNA, 13 bp, Homo sapiens
aacagctgtgtct

SEQ ID NO: 1856974 - DNA, 14 bp, Homo sapiens
aacagctgtgtctg

SEQ ID NO: 1856975 - DNA, 23 bp, Homo sapiens
aacaggtagtattacaccaccgg

SEQ ID NO: 1856976 - DNA, 14 bp, Homo sapiens
aacagtcatcattt

SEQ ID NO: 1856977 - DNA, 13 bp, Homo sapiens
aacataagctatt

SEQ ID NO: 1856978 - DNA, 14 bp, Homo sapiens
aacatactcccatc

SEQ ID NO: 1856979 - DNA, 15 bp, Homo sapiens
aacatactcccatct

SEQ ID NO: 1856980 - DNA, 18 bp, Homo sapiens
aacatactcccatctgtg

SEQ ID NO: 1856981 - DNA, 17 bp, Homo sapiens
aacatgcttttccaaac

SEQ ID NO: 1856982 - DNA, 18 bp, Homo sapiens
aacattcatcaagctgta

SEQ ID NO: 1856983 - DNA, 23 bp, Homo sapiens
aacattccatccttgagtcaaaa

SEQ ID NO: 1856984 - DNA, 13 bp, Homo sapiens
aacatttctgttc

SEQ ID NO: 1856985 - DNA, 22 bp, Homo sapiens
aaccaaatcactgaactttgct

SEQ ID NO: 1856986 - DNA, 14 bp, Homo sapiens
aaccaattattttc

SEQ ID NO: 1856987 - DNA, 13 bp, Homo sapiens
aaccacagctgct

SEQ ID NO: 1856988 - DNA, 18 bp, Homo sapiens
aaccacagctgctggaga

SEQ ID NO: 1856989 - DNA, 15 bp, Homo sapiens
aaccacttcagctga

SEQ ID NO: 1856990 - DNA, 14 bp, Homo sapiens
aaccagctcagcac

SEQ ID NO: 1856991 - DNA, 18 bp, Homo sapiens
aaccagggccccggggcc

SEQ ID NO: 1856992 - DNA, 23 bp, Homo sapiens
aaccatgagtggcatggccacca

SEQ ID NO: 1856993 - DNA, 11 bp, Homo sapiens
aacccagctct

SEQ ID NO: 1856994 - DNA, 14 bp, Homo sapiens
aacccagctctggt

SEQ ID NO: 1856995 - DNA, 17 bp, Homo sapiens
aacccagctctggtcca

SEQ ID NO: 1856996 - DNA, 14 bp, Homo sapiens
aaccctggcatttg

SEQ ID NO: 1856997 - DNA, 20 bp, Homo sapiens
aacctgagatttattaaaga

SEQ ID NO: 1856998 - DNA, 13 bp, Homo sapiens
aacctgcacacag

SEQ ID NO: 1856999 - DNA, 14 bp, Homo sapiens
aacgatttttaaaa

SEQ ID NO: 1857000 - DNA, 18 bp, Homo sapiens
aacgcaaaaatagctctt

SEQ ID NO: 1857001 - DNA, 17 bp, Homo sapiens
aactacaaaggtttaaa

SEQ ID NO: 1857002 - DNA, 20 bp, Homo sapiens
aactacaaaggtttaaatga

SEQ ID NO: 1857003 - DNA, 16 bp, Homo sapiens
actctggcagctcaga

SEQ ID NO: 1857004 - DNA, 21 bp, Homo sapiens
actcttcagttaagcctttgg

SEQ ID NO: 1857005 - DNA, 20 bp, Homo sapiens
actgaactctgacaacagac

SEQ ID NO: 1857006 - DNA, 22 bp, Homo sapiens
actgaaggggtgcacccacctg

SEQ ID NO: 1857007 - DNA, 23 bp, Homo sapiens
actgaaggggtgcacccacctgt

SEQ ID NO: 1857008 - DNA, 21 bp, Homo sapiens
actgagacagcccgggctctg

SEQ ID NO: 1857009 - DNA, 22 bp, Homo sapiens
actgagacagcccgggctctgc

SEQ ID NO: 1857010 - DNA, 13 bp, Homo sapiens
actgattgggagg

SEQ ID NO: 1857011 - DNA, 20 bp, Homo sapiens
actgcactccagcctgggtg

SEQ ID NO: 1857012 - DNA, 16 bp, Homo sapiens
actgccatgcagggcc

SEQ ID NO: 1857013 - DNA, 11 bp, Homo sapiens
actgcctgctc

SEQ ID NO: 1857014 - DNA, 13 bp, Homo sapiens
actgcctgctccc

SEQ ID NO: 1857015 - DNA, 19 bp, Homo sapiens
actgcctgctcccatcctg

SEQ ID NO: 1857016 - DNA, 18 bp, Homo sapiens
actgcttccagtgaggct

SEQ ID NO: 1857017 - DNA, 21 bp, Homo sapiens
actgcttccagtgaggctctg

SEQ ID NO: 1857018 - DNA, 23 bp, Homo sapiens
actgcttccagtgaggctctgcc

SEQ ID NO: 1857019 - DNA, 13 bp, Homo sapiens
actgcttgtttcc

SEQ ID NO: 1857020 - DNA, 16 bp, Homo sapiens
actgcttgtttcctag

SEQ ID NO: 1857021 - DNA, 16 bp, Homo sapiens
actggcctgctggatg

SEQ ID NO: 1857022 - DNA, 19 bp, Homo sapiens
actgggtgcgtctccagtc

SEQ ID NO: 1857023 - DNA, 22 bp, Homo sapiens
actgtaactgtgtcatgattca

SEQ ID NO: 1857024 - DNA, 13 bp, Homo sapiens
actgtatctgtgt

SEQ ID NO: 1857025 - DNA, 12 bp, Homo sapiens
actgtcttcagt

SEQ ID NO: 1857026 - DNA, 13 bp, Homo sapiens
actgtgacaggca

SEQ ID NO: 1857027 - DNA, 15 bp, Homo sapiens
actgtgacaggcagc

SEQ ID NO: 1857028 - DNA, 16 bp, Homo sapiens
actgtgacaggcagca

SEQ ID NO: 1857029 - DNA, 20 bp, Homo sapiens
actgttatttataatcactt

SEQ ID NO: 1857030 - DNA, 16 bp, Homo sapiens
actgttcaagagcaca

SEQ ID NO: 1857031 - DNA, 17 bp, Homo sapiens
actgttctctgccctcc

SEQ ID NO: 1857032 - DNA, 18 bp, Homo sapiens
actgttctctgccctcca

SEQ ID NO: 1857033 - DNA, 19 bp, Homo sapiens
actgttctctgccctccaa

SEQ ID NO: 1857034 - DNA, 13 bp, Homo sapiens
actgttcttagct

SEQ ID NO: 1857035 - DNA, 23 bp, Homo sapiens
actgttcttagctcaatgagcat

SEQ ID NO: 1857036 - DNA, 18 bp, Homo sapiens
actgtttgaggtttttaa

SEQ ID NO: 1857037 - DNA, 17 bp, Homo sapiens
acttaactttactaagt

SEQ ID NO: 1857038 - DNA, 14 bp, Homo sapiens
acttaatagaaaca

SEQ ID NO: 1857039 - DNA, 20 bp, Homo sapiens
acttagaaaaccagctcagc

SEQ ID NO: 1857040 - DNA, 21 bp, Homo sapiens
acttagaaaaccagctcagca

SEQ ID NO: 1857041 - DNA, 20 bp, Homo sapiens
acttcttcagagctgacaca

SEQ ID NO: 1857042 - DNA, 21 bp, Homo sapiens
acttcttcagagctgacacag

SEQ ID NO: 1857043 - DNA, 20 bp, Homo sapiens
acttctttgctttgcccagc

SEQ ID NO: 1857044 - DNA, 21 bp, Homo sapiens
acttctttgctttgcccagca

SEQ ID NO: 1857045 - DNA, 18 bp, Homo sapiens
acttggattcaattttaa

SEQ ID NO: 1857046 - DNA, 16 bp, Homo sapiens
acttggtttttaaaaa

SEQ ID NO: 1857047 - DNA, 13 bp, Homo sapiens
acttgtaaatata

SEQ ID NO: 1857048 - DNA, 15 bp, Homo sapiens
acttgtaaatataaa

SEQ ID NO: 1857049 - DNA, 18 bp, Homo sapiens
acttgtaaatataaagac

SEQ ID NO: 1857050 - DNA, 21 bp, Homo sapiens
acttgtcaggagtgtgtgtga

SEQ ID NO: 1857051 - DNA, 18 bp, Homo sapiens
acttgtctttggaccctg

SEQ ID NO: 1857052 - DNA, 13 bp, Homo sapiens
acttgtgccaaca

SEQ ID NO: 1857053 - DNA, 18 bp, Homo sapiens
acttgtgccaacactcaa

SEQ ID NO: 1857054 - DNA, 23 bp, Homo sapiens
actttaacataagctatttttct

SEQ ID NO: 1857055 - DNA, 23 bp, Homo sapiens
actttccttcattcaacccacct

SEQ ID NO: 1857056 - DNA, 19 bp, Homo sapiens
actttgaagggcaagaaat

SEQ ID NO: 1857057 - DNA, 21 bp, Homo sapiens
actttgaagggcaagaaatgg

SEQ ID NO: 1857058 - DNA, 23 bp, Homo sapiens
actttgaagggcaagaaatggcg

SEQ ID NO: 1857059 - DNA, 18 bp, Homo sapiens
actttgctttaatataaa

SEQ ID NO: 1857060 - DNA, 21 bp, Homo sapiens
actttgctttaatataaatgc

SEQ ID NO: 1857061 - DNA, 22 bp, Homo sapiens
actttgctttaatataaatgca

SEQ ID NO: 1857062 - DNA, 12 bp, Homo sapiens
actttggaaaga

SEQ ID NO: 1857063 - DNA, 13 bp, Homo sapiens
actttggaaagac

SEQ ID NO: 1857064 - DNA, 17 bp, Homo sapiens
actttggaaagactttt

SEQ ID NO: 1857065 - DNA, 23 bp, Homo sapiens
actttggaaagagtaggaagact

SEQ ID NO: 1857066 - DNA, 13 bp, Homo sapiens
actttggctgcat

SEQ ID NO: 1857067 - DNA, 17 bp, Homo sapiens
actttggctgcatgcga

SEQ ID NO: 1857068 - DNA, 21 bp, Homo sapiens
actttgttagtttctccaagc

SEQ ID NO: 1857069 - DNA, 13 bp, Homo sapiens
acttttttccaca

SEQ ID NO: 1857070 - DNA, 18 bp, Homo sapiens
actttttttttttttccc

SEQ ID NO: 1857071 - DNA, 22 bp, Homo sapiens
agaaaaaaatgtattttatgtt

SEQ ID NO: 1857072 - DNA, 19 bp, Homo sapiens
agaaaaaatattttcccta

SEQ ID NO: 1857073 - DNA, 23 bp, Homo sapiens
agaaaaaatattttcctgccagg

SEQ ID NO: 1857074 - DNA, 14 bp, Homo sapiens
agaaaaataaagaa

SEQ ID NO: 1857075 - DNA, 20 bp, Homo sapiens
agaaacacccctctgtctag

SEQ ID NO: 1857076 - DNA, 15 bp, Homo sapiens
agaaacattgaagat

SEQ ID NO: 1857077 - DNA, 19 bp, Homo sapiens
agaaagttgcacggctgct

SEQ ID NO: 1857078 - DNA, 20 bp, Homo sapiens
agaaagttgcacggctgctg

SEQ ID NO: 1857079 - DNA, 15 bp, Homo sapiens
agaaataaagtttct

SEQ ID NO: 1857080 - DNA, 18 bp, Homo sapiens
agaaataaagtttctgtt

SEQ ID NO: 1857081 - DNA, 19 bp, Homo sapiens
agaaatagcttatgaaaag

SEQ ID NO: 1857082 - DNA, 13 bp, Homo sapiens
agaaattaagtat

SEQ ID NO: 1857083 - DNA, 16 bp, Homo sapiens
agaacaaagtgagaca

SEQ ID NO: 1857084 - DNA, 20 bp, Homo sapiens
agaacaaagtgagacagtcc

SEQ ID NO: 1857085 - DNA, 20 bp, Homo sapiens
agaacacagcaattcctcag

SEQ ID NO: 1857086 - DNA, 14 bp, Homo sapiens
agaacatactgatt

SEQ ID NO: 1857087 - DNA, 23 bp, Homo sapiens
agaaccccagggtcctgtagccc

SEQ ID NO: 1857088 - DNA, 21 bp, Homo sapiens
agaagagattgtggtttcatt

SEQ ID NO: 1857089 - DNA, 18 bp, Homo sapiens
agaagatcctaaaacaaa

SEQ ID NO: 1857090 - DNA, 13 bp, Homo sapiens
agaagcagctctt

SEQ ID NO: 1857091 - DNA, 12 bp, Homo sapiens
agaagcccagga

SEQ ID NO: 1857092 - DNA, 18 bp, Homo sapiens
agaagcccaggaaaggct

SEQ ID NO: 1857093 - DNA, 21 bp, Homo sapiens
agaagcccaggaaaggctcca

SEQ ID NO: 1857094 - DNA, 14 bp, Homo sapiens
agaagcttaaaata

SEQ ID NO: 1857095 - DNA, 16 bp, Homo sapiens
agaagcttaaaataaa

SEQ ID NO: 1857096 - DNA, 22 bp, Homo sapiens
agaaggactgcagccactgatt

SEQ ID NO: 1857097 - DNA, 15 bp, Homo sapiens
agaaggcaaatgact

SEQ ID NO: 1857098 - DNA, 22 bp, Homo sapiens
agaaggtgggttttcatcaaga

SEQ ID NO: 1857099 - DNA, 21 bp, Homo sapiens
agaagtcttctatttatttat

SEQ ID NO: 1857100 - DNA, 16 bp, Homo sapiens
agaatgaaatactgtt

SEQ ID NO: 1857101 - DNA, 19 bp, Homo sapiens
agaatgaaatactgtttga

SEQ ID NO: 1857102 - DNA, 15 bp, Homo sapiens
agaatgttttcaaat

SEQ ID NO: 1857103 - DNA, 20 bp, Homo sapiens
agaattccagtcccctttct

SEQ ID NO: 1857104 - DNA, 21 bp, Homo sapiens
agaattgttgggggttttttt

SEQ ID NO: 1857105 - DNA, 23 bp, Homo sapiens
agaattgttgggggtttttttgg

SEQ ID NO: 1857106 - DNA, 20 bp, Homo sapiens
agacaacgtgctctttgttt

SEQ ID NO: 1857107 - DNA, 22 bp, Homo sapiens
agacacatgtccaagaagccca

SEQ ID NO: 1857108 - DNA, 19 bp, Homo sapiens
agacagagacctcctgcct

SEQ ID NO: 1857109 - DNA, 16 bp, Homo sapiens
agacagcccgggctct

SEQ ID NO: 1857110 - DNA, 18 bp, Homo sapiens
agacagcccgggctctgc

SEQ ID NO: 1857111 - DNA, 20 bp, Homo sapiens
agacagcccgggctctgcct

SEQ ID NO: 1857112 - DNA, 14 bp, Homo sapiens
agacagctgcctgg

SEQ ID NO: 1857113 - DNA, 16 bp, Homo sapiens
agacaggaccagggat

SEQ ID NO: 1857114 - DNA, 13 bp, Homo sapiens
agacagtccctgc

SEQ ID NO: 1857115 - DNA, 19 bp, Homo sapiens
agacagtccctgccaatgg

SEQ ID NO: 1857116 - DNA, 17 bp, Homo sapiens
agacagttaaactggct

SEQ ID NO: 1857117 - DNA, 17 bp, Homo sapiens
agaccaggcaaagcaag

SEQ ID NO: 1857118 - DNA, 18 bp, Homo sapiens
agaccatccctgaaggcc

SEQ ID NO: 1857119 - DNA, 21 bp, Homo sapiens
agaccatccctgaaggccccg

SEQ ID NO: 1857120 - DNA, 15 bp, Homo sapiens
agaccctccccacag

SEQ ID NO: 1857121 - DNA, 13 bp, Homo sapiens
agaccctgccctg

SEQ ID NO: 1857122 - DNA, 23 bp, Homo sapiens
agacccttgtggtcccaccccac

SEQ ID NO: 1857123 - DNA, 13 bp, Homo sapiens
agacctcagcttg

SEQ ID NO: 1857124 - DNA, 14 bp, Homo sapiens
aggcacaatatggg

SEQ ID NO: 1857125 - DNA, 23 bp, Homo sapiens
aggcagcaccacactgggtgcgt

SEQ ID NO: 1857126 - DNA, 14 bp, Homo sapiens
aggcaggacatgct

SEQ ID NO: 1857127 - DNA, 21 bp, Homo sapiens
aggcaggacatgctgaagcca

SEQ ID NO: 1857128 - DNA, 23 bp, Homo sapiens
aggcaggacatgctgaagccaaa

SEQ ID NO: 1857129 - DNA, 12 bp, Homo sapiens
aggcaggatggc

SEQ ID NO: 1857130 - DNA, 22 bp, Homo sapiens
aggcaggctaaggcgtggagct

SEQ ID NO: 1857131 - DNA, 19 bp, Homo sapiens
aggcaggggaatgtatgtg

SEQ ID NO: 1857132 - DNA, 17 bp, Homo sapiens
aggcattccccaggagg

SEQ ID NO: 1857133 - DNA, 18 bp, Homo sapiens
aggcattccccaggaggc

SEQ ID NO: 1857134 - DNA, 16 bp, Homo sapiens
aggcatttgctgaata

SEQ ID NO: 1857135 - DNA, 18 bp, Homo sapiens
aggccacaagacccttgt

SEQ ID NO: 1857136 - DNA, 19 bp, Homo sapiens
aggccaccccgctgatgga

SEQ ID NO: 1857137 - DNA, 23 bp, Homo sapiens
aggccaccccgctgatggagccc

SEQ ID NO: 1857138 - DNA, 15 bp, Homo sapiens
aggccaccctgcctc

SEQ ID NO: 1857139 - DNA, 13 bp, Homo sapiens
aggccagccttga

SEQ ID NO: 1857140 - DNA, 18 bp, Homo sapiens
aggccaggccaccctgcc

SEQ ID NO: 1857141 - DNA, 21 bp, Homo sapiens
aggccatcatcagtggagcca

SEQ ID NO: 1857142 - DNA, 21 bp, Homo sapiens
aggccatggagagctggagcc

SEQ ID NO: 1857143 - DNA, 20 bp, Homo sapiens
aggccattccccgtctctgg

SEQ ID NO: 1857144 - DNA, 16 bp, Homo sapiens
aggcccagagggcctg

SEQ ID NO: 1857145 - DNA, 20 bp, Homo sapiens
aggcccagagggcctgcaag

SEQ ID NO: 1857146 - DNA, 17 bp, Homo sapiens
aggcccagtgagatgca

SEQ ID NO: 1857147 - DNA, 13 bp, Homo sapiens
aggcccggcctct

SEQ ID NO: 1857148 - DNA, 14 bp, Homo sapiens
aggcccggcctctc

SEQ ID NO: 1857149 - DNA, 13 bp, Homo sapiens
aggccctctgccc

SEQ ID NO: 1857150 - DNA, 17 bp, Homo sapiens
aggccctctgcccactc

SEQ ID NO: 1857151 - DNA, 12 bp, Homo sapiens
aggcccttctct

SEQ ID NO: 1857152 - DNA, 18 bp, Homo sapiens
aggcgtggagctgcctga

SEQ ID NO: 1857153 - DNA, 14 bp, Homo sapiens
aggctaagctgccg

SEQ ID NO: 1857154 - DNA, 15 bp, Homo sapiens
aggctaaggcgtgga

SEQ ID NO: 1857155 - DNA, 19 bp, Homo sapiens
aggctaaggcgtggagctg

SEQ ID NO: 1857156 - DNA, 20 bp, Homo sapiens
aggctactacagagaaggct

SEQ ID NO: 1857157 - DNA, 21 bp, Homo sapiens
aggctcgagcatgcctggatg

SEQ ID NO: 1857158 - DNA, 20 bp, Homo sapiens
aggctgaacttgttttctgg

SEQ ID NO: 1857159 - DNA, 23 bp, Homo sapiens
aggctgatgccaagttgtttgag

SEQ ID NO: 1857160 - DNA, 23 bp, Homo sapiens
aggctgatttatggtcagaattt

SEQ ID NO: 1857161 - DNA, 17 bp, Homo sapiens
aggctgggaccacgtga

SEQ ID NO: 1857162 - DNA, 14 bp, Homo sapiens
aggctgggagagcc

SEQ ID NO: 1857163 - DNA, 21 bp, Homo sapiens
aggctgggagagccttccagg

SEQ ID NO: 1857164 - DNA, 18 bp, Homo sapiens
aggctgggctcccttccc

SEQ ID NO: 1857165 - DNA, 23 bp, Homo sapiens
aggctgggctcccttcccacctc

SEQ ID NO: 1857166 - DNA, 22 bp, Homo sapiens
aggcttagtcactgagacagcc

SEQ ID NO: 1857167 - DNA, 23 bp, Homo sapiens
aggcttctggttgatgcctgtga

SEQ ID NO: 1857168 - DNA, 16 bp, Homo sapiens
aggcttggggaaaatg

SEQ ID NO: 1857169 - DNA, 16 bp, Homo sapiens
agggaaaacattccat

SEQ ID NO: 1857170 - DNA, 12 bp, Homo sapiens
agggaaagaaaa

SEQ ID NO: 1857171 - DNA, 23 bp, Homo sapiens
agggaaagaaagttgcacggctg

SEQ ID NO: 1857172 - DNA, 12 bp, Homo sapiens
agggaagggtgg

SEQ ID NO: 1857173 - DNA, 21 bp, Homo sapiens
agggaatgcctgagtgcctgg

SEQ ID NO: 1857174 - DNA, 22 bp, Homo sapiens
agggaatgcctgagtgcctggc

SEQ ID NO: 1857175 - DNA, 20 bp, Homo sapiens
agggacagagggggtggcct

SEQ ID NO: 1857176 - DNA, 18 bp, Homo sapiens
agggagcatcagtgccct

SEQ ID NO: 1857177 - DNA, 16 bp, Homo sapiens
agggagttttgtctgt

SEQ ID NO: 1857178 - DNA, 19 bp, Homo sapiens
agggatgagcatggagctg

SEQ ID NO: 1857179 - DNA, 21 bp, Homo sapiens
agggatgagcatggagctggc

SEQ ID NO: 1857180 - DNA, 13 bp, Homo sapiens
agggatggtgccc

SEQ ID NO: 1857181 - DNA, 19 bp, Homo sapiens
agggattttagtcacacgt

SEQ ID NO: 1857182 - DNA, 14 bp, Homo sapiens
agggcacacactgt

SEQ ID NO: 1857183 - DNA, 19 bp, Homo sapiens
agggcacattccttgcctg

SEQ ID NO: 1857184 - DNA, 21 bp, Homo sapiens
agggcacattccttgcctgca

SEQ ID NO: 1857185 - DNA, 14 bp, Homo sapiens
agggcatgggtcgg

SEQ ID NO: 1857186 - DNA, 16 bp, Homo sapiens
agggcatgggtcggga

SEQ ID NO: 1857187 - DNA, 19 bp, Homo sapiens
agggcatgggtcgggagag

SEQ ID NO: 1857188 - DNA, 14 bp, Homo sapiens
agggccatgcagac

SEQ ID NO: 1857189 - DNA, 15 bp, Homo sapiens
agggcctggcctgag

SEQ ID NO: 1857190 - DNA, 16 bp, Homo sapiens
agggcctggcctgagc

SEQ ID NO: 1857191 - DNA, 17 bp, Homo sapiens
agggcctggcctgagct

SEQ ID NO: 1857192 - DNA, 14 bp, Homo sapiens
agggcgcaaagggc

SEQ ID NO: 1857193 - DNA, 17 bp, Homo sapiens
agggcgcaaagggcatg

SEQ ID NO: 1857194 - DNA, 17 bp, Homo sapiens
agggctgctagacggag

SEQ ID NO: 1857195 - DNA, 21 bp, Homo sapiens
aggggaagcagaaatccaagc

SEQ ID NO: 1857196 - DNA, 20 bp, Homo sapiens
aggggacgcaggcccctctc

SEQ ID NO: 1857197 - DNA, 16 bp, Homo sapiens
aggggagaggaaaagt

SEQ ID NO: 1857198 - DNA, 14 bp, Homo sapiens
aggggagggcaggc

SEQ ID NO: 1857199 - DNA, 12 bp, Homo sapiens
aggggctggggc

SEQ ID NO: 1857200 - DNA, 23 bp, Homo sapiens
aggggctggggccaaataaagtc

SEQ ID NO: 1857201 - DNA, 18 bp, Homo sapiens
agggggtggcctcccaac

SEQ ID NO: 1857202 - DNA, 18 bp, Homo sapiens
aggggtgggacaccctgt

SEQ ID NO: 1857203 - DNA, 23 bp, Homo sapiens
agggtccacaggaagtgaagaat

SEQ ID NO: 1857204 - DNA, 17 bp, Homo sapiens
agggtccctggtggcag

SEQ ID NO: 1857205 - DNA, 22 bp, Homo sapiens
agggtccctggtggcagctcac

SEQ ID NO: 1857206 - DNA, 17 bp, Homo sapiens
agggtctgggcaggact

SEQ ID NO: 1857207 - DNA, 15 bp, Homo sapiens
agggtggtggagcca

SEQ ID NO: 1857208 - DNA, 17 bp, Homo sapiens
aggtaaggaatacctgt

SEQ ID NO: 1857209 - DNA, 20 bp, Homo sapiens
aggtactgatcctgtttctt

SEQ ID NO: 1857210 - DNA, 18 bp, Homo sapiens
aggtcacctttattctgg

SEQ ID NO: 1857211 - DNA, 19 bp, Homo sapiens
aggtcacctttattctggc

SEQ ID NO: 1857212 - DNA, 23 bp, Homo sapiens
aggtcactttttttttttttccc

SEQ ID NO: 1857213 - DNA, 20 bp, Homo sapiens
aggtccagccctggctgaag

SEQ ID NO: 1857214 - DNA, 21 bp, Homo sapiens
aggtccagccctggctgaagg

SEQ ID NO: 1857215 - DNA, 13 bp, Homo sapiens
aggtcccctttca

SEQ ID NO: 1857216 - DNA, 19 bp, Homo sapiens
aggtcccctttcagagata

SEQ ID NO: 1857217 - DNA, 16 bp, Homo sapiens
aggtgagaagcagagg

SEQ ID NO: 1857218 - DNA, 23 bp, Homo sapiens
aggtgagaagcagaggaaggaga

SEQ ID NO: 1857219 - DNA, 20 bp, Homo sapiens
aggtgagcccatggccctcc

SEQ ID NO: 1857220 - DNA, 18 bp, Homo sapiens
aggtgcacaagctccaag

SEQ ID NO: 1857221 - DNA, 20 bp, Homo sapiens
aggtgcacaagctccaagct

SEQ ID NO: 1857222 - DNA, 19 bp, Homo sapiens
aggtgccgccagctgccgc

SEQ ID NO: 1857223 - DNA, 22 bp, Homo sapiens
aggtgcgtgttcagcagaacct

SEQ ID NO: 1857224 - DNA, 19 bp, Homo sapiens
aggtggagaaaattggaac

SEQ ID NO: 1857225 - DNA, 14 bp, Homo sapiens
aggtggcaaggctg

SEQ ID NO: 1857226 - DNA, 12 bp, Homo sapiens
aggtgggaggat

SEQ ID NO: 1857227 - DNA, 16 bp, Homo sapiens
aggtgggatcctccag

SEQ ID NO: 1857228 - DNA, 20 bp, Homo sapiens
aggtgggatcctccaggtgc

SEQ ID NO: 1857229 - DNA, 15 bp, Homo sapiens
aggtgggcttcccag

SEQ ID NO: 1857230 - DNA, 17 bp, Homo sapiens
aggtggggacagggatg

SEQ ID NO: 1857231 - DNA, 17 bp, Homo sapiens
aggtggttatggagagg

SEQ ID NO: 1857232 - DNA, 16 bp, Homo sapiens
aggttgttcctaaaat

SEQ ID NO: 1857233 - DNA, 18 bp, Homo sapiens
aggtttgcagtcccaagc

SEQ ID NO: 1857234 - DNA, 14 bp, Homo sapiens
agtaaagtgaagaa

SEQ ID NO: 1857235 - DNA, 19 bp, Homo sapiens
agtaacagtcatcatttat

SEQ ID NO: 1857236 - DNA, 16 bp, Homo sapiens
agtaacatttctgttc

SEQ ID NO: 1857237 - DNA, 20 bp, Homo sapiens
agtaagccgtgattttcatt

SEQ ID NO: 1857238 - DNA, 19 bp, Homo sapiens
agtaggaagactttggaaa

SEQ ID NO: 1857239 - DNA, 14 bp, Homo sapiens
agtatggagctcag

SEQ ID NO: 1857240 - DNA, 18 bp, Homo sapiens
agtatgggttagggaaaa

SEQ ID NO: 1857241 - DNA, 19 bp, Homo sapiens
agtatggtaggggagggca

SEQ ID NO: 1857242 - DNA, 23 bp, Homo sapiens
agtatggtaggggagggcaggct

SEQ ID NO: 1857243 - DNA, 15 bp, Homo sapiens
agtattgaagcattt

SEQ ID NO: 1857244 - DNA, 22 bp, Homo sapiens
agtattgctcacccagtgccct

SEQ ID NO: 1857245 - DNA, 23 bp, Homo sapiens
attgtgtctcttggtcctgctgc

SEQ ID NO: 1857246 - DNA, 23 bp, Homo sapiens
atttaaacgtgatttttaaatta

SEQ ID NO: 1857247 - DNA, 16 bp, Homo sapiens
atttaagagacagtca

SEQ ID NO: 1857248 - DNA, 19 bp, Homo sapiens
atttaattacttcttagta

SEQ ID NO: 1857249 - DNA, 15 bp, Homo sapiens
atttaatttgaaggt

SEQ ID NO: 1857250 - DNA, 13 bp, Homo sapiens
atttagcattgta

SEQ ID NO: 1857251 - DNA, 19 bp, Homo sapiens
atttagcattgtagtgctt

SEQ ID NO: 1857252 - DNA, 23 bp, Homo sapiens
atttaggtcagtagactgtgatt

SEQ ID NO: 1857253 - DNA, 22 bp, Homo sapiens
atttataatcacttttttccac

SEQ ID NO: 1857254 - DNA, 16 bp, Homo sapiens
atttatccttgttaag

SEQ ID NO: 1857255 - DNA, 14 bp, Homo sapiens
atttatgtattgtg

SEQ ID NO: 1857256 - DNA, 17 bp, Homo sapiens
atttattaaagaaaaaa

SEQ ID NO: 1857257 - DNA, 23 bp, Homo sapiens
atttattaaagaaaaaaatgtat

SEQ ID NO: 1857258 - DNA, 22 bp, Homo sapiens
atttattgaaatgatttcacag

SEQ ID NO: 1857259 - DNA, 14 bp, Homo sapiens
atttatttattcat

SEQ ID NO: 1857260 - DNA, 16 bp, Homo sapiens
atttcaaaaacatgct

SEQ ID NO: 1857261 - DNA, 23 bp, Homo sapiens
atttcaaaaacatgcttttccaa

SEQ ID NO: 1857262 - DNA, 15 bp, Homo sapiens
atttcaggagcagcc

SEQ ID NO: 1857263 - DNA, 14 bp, Homo sapiens
atttccagccaggg

SEQ ID NO: 1857264 - DNA, 12 bp, Homo sapiens
atttctgttctc

SEQ ID NO: 1857265 - DNA, 19 bp, Homo sapiens
atttgaagatttaattact

SEQ ID NO: 1857266 - DNA, 14 bp, Homo sapiens
atttgccaagtctc

SEQ ID NO: 1857267 - DNA, 23 bp, Homo sapiens
atttggtctcaggcagcaccaca

SEQ ID NO: 1857268 - DNA, 20 bp, Homo sapiens
atttggtttggccatctctg

SEQ ID NO: 1857269 - DNA, 16 bp, Homo sapiens
atttgttcattaaacg

SEQ ID NO: 1857270 - DNA, 13 bp, Homo sapiens
attttatgttata

SEQ ID NO: 1857271 - DNA, 23 bp, Homo sapiens
attttatgttatatataaatata

SEQ ID NO: 1857272 - DNA, 14 bp, Homo sapiens
atttttaaaatgta

SEQ ID NO: 1857273 - DNA, 15 bp, Homo sapiens
atttttaaattaaat

SEQ ID NO: 1857274 - DNA, 12 bp, Homo sapiens
attttttcttcc

SEQ ID NO: 1857275 - DNA, 15 bp, Homo sapiens
attttttttctgtta

SEQ ID NO: 1857276 - DNA, 17 bp, Homo sapiens
attttttttctgttata

SEQ ID NO: 1857277 - DNA, 18 bp, Homo sapiens
attttttttctgttatat

SEQ ID NO: 1857278 - DNA, 20 bp, Homo sapiens
attttttttctgttatataa

SEQ ID NO: 1857279 - DNA, 20 bp, Homo sapiens
caaaaatagctcttgctttg

SEQ ID NO: 1857280 - DNA, 21 bp, Homo sapiens
caaaacggttttactgcagct

SEQ ID NO: 1857281 - DNA, 22 bp, Homo sapiens
caaaactctcctctgctgctgg

SEQ ID NO: 1857282 - DNA, 15 bp, Homo sapiens
caaaagctgggcagg

SEQ ID NO: 1857283 - DNA, 19 bp, Homo sapiens
caaaagctgggcaggttgg

SEQ ID NO: 1857284 - DNA, 15 bp, Homo sapiens
caaacacctggactt

SEQ ID NO: 1857285 - DNA, 22 bp, Homo sapiens
caaactacaaagctgaagaaaa

SEQ ID NO: 1857286 - DNA, 20 bp, Homo sapiens
caaactactttgctgctaat

SEQ ID NO: 1857287 - DNA, 14 bp, Homo sapiens
caaagagattcgaa

SEQ ID NO: 1857288 - DNA, 18 bp, Homo sapiens
caaagcctcctccagccg

SEQ ID NO: 1857289 - DNA, 20 bp, Homo sapiens
caaagctgaagaaaatgaag

SEQ ID NO: 1857290 - DNA, 12 bp, Homo sapiens
caaaggctggga

SEQ ID NO: 1857291 - DNA, 13 bp, Homo sapiens
caaaggctgggac

SEQ ID NO: 1857292 - DNA, 22 bp, Homo sapiens
caaagggcatgggtcgggagag

SEQ ID NO: 1857293 - DNA, 20 bp, Homo sapiens
caaagtcatgcaaaggctgg

SEQ ID NO: 1857294 - DNA, 21 bp, Homo sapiens
caaagtcatgcaaaggctggg

SEQ ID NO: 1857295 - DNA, 11 bp, Homo sapiens
caaataaagtc

SEQ ID NO: 1857296 - DNA, 23 bp, Homo sapiens
caaatatcagtgggctctcttac

SEQ ID NO: 1857297 - DNA, 14 bp, Homo sapiens
caaatcactgaact

SEQ ID NO: 1857298 - DNA, 14 bp, Homo sapiens
caaatgcctgccaa

SEQ ID NO: 1857299 - DNA, 18 bp, Homo sapiens
caaatgcctgccaaattt

SEQ ID NO: 1857300 - DNA, 20 bp, Homo sapiens
caaatggaaatgggcagagc

SEQ ID NO: 1857301 - DNA, 21 bp, Homo sapiens
caaatggaaatgggcagagca

SEQ ID NO: 1857302 - DNA, 22 bp, Homo sapiens
caaatggaaatgggcagagcag

SEQ ID NO: 1857303 - DNA, 18 bp, Homo sapiens
caaatgtcttcctggatt

SEQ ID NO: 1857304 - DNA, 19 bp, Homo sapiens
caaattaaaaaagataaac

SEQ ID NO: 1857305 - DNA, 20 bp, Homo sapiens
caaattaaaaaagataaaca

SEQ ID NO: 1857306 - DNA, 21 bp, Homo sapiens
caaattaaaaaagataaacac

SEQ ID NO: 1857307 - DNA, 14 bp, Homo sapiens
caaattgcatttgt

SEQ ID NO: 1857308 - DNA, 19 bp, Homo sapiens
caacataatttttattttt

SEQ ID NO: 1857309 - DNA, 16 bp, Homo sapiens
caacatactcccatct

SEQ ID NO: 1857310 - DNA, 23 bp, Homo sapiens
caacatgccagccactgtgatag

SEQ ID NO: 1857311 - DNA, 15 bp, Homo sapiens
caacatggtgtctgg

SEQ ID NO: 1857312 - DNA, 16 bp, Homo sapiens
caacatggtgtctgga

SEQ ID NO: 1857313 - DNA, 16 bp, Homo sapiens
caacctccaccttctg

SEQ ID NO: 1857314 - DNA, 16 bp, Homo sapiens
caacctgattgtgtct

SEQ ID NO: 1857315 - DNA, 17 bp, Homo sapiens
caacctgattgtgtctc

SEQ ID NO: 1857316 - DNA, 13 bp, Homo sapiens
caacgtctgtgcc

SEQ ID NO: 1857317 - DNA, 13 bp, Homo sapiens
caactcaccccag

SEQ ID NO: 1857318 - DNA, 14 bp, Homo sapiens
caactgaaggggtg

SEQ ID NO: 1857319 - DNA, 21 bp, Homo sapiens
caactgaaggggtgcacccac

SEQ ID NO: 1857320 - DNA, 16 bp, Homo sapiens
caactgcattggcttt

SEQ ID NO: 1857321 - DNA, 14 bp, Homo sapiens
caagaaaaataaag

SEQ ID NO: 1857322 - DNA, 16 bp, Homo sapiens
caagaaaaataaagaa

SEQ ID NO: 1857323 - DNA, 20 bp, Homo sapiens
caagaaaaataaagaaaaga

SEQ ID NO: 1857324 - DNA, 13 bp, Homo sapiens
caagaagcaggct

SEQ ID NO: 1857325 - DNA, 23 bp, Homo sapiens
caagacccttgtggtcccacccc

SEQ ID NO: 1857326 - DNA, 14 bp, Homo sapiens
caagaccttctcct

SEQ ID NO: 1857327 - DNA, 16 bp, Homo sapiens
caagaccttctccttc

SEQ ID NO: 1857328 - DNA, 13 bp, Homo sapiens
caagacgctgtgc

SEQ ID NO: 1857329 - DNA, 18 bp, Homo sapiens
caagacgctgtgctgccc

SEQ ID NO: 1857330 - DNA, 20 bp, Homo sapiens
caagacgctgtgctgccctg

SEQ ID NO: 1857331 - DNA, 23 bp, Homo sapiens
caagacgctgtgctgccctgccc

SEQ ID NO: 1857332 - DNA, 18 bp, Homo sapiens
caagactctttggacact

SEQ ID NO: 1857333 - DNA, 13 bp, Homo sapiens
caagagaagcatt

SEQ ID NO: 1857334 - DNA, 16 bp, Homo sapiens
caagagaagcattctc

SEQ ID NO: 1857335 - DNA, 18 bp, Homo sapiens
caagagaagcattctcat

SEQ ID NO: 1857336 - DNA, 21 bp, Homo sapiens
caagagccatgtagaagctgc

SEQ ID NO: 1857337 - DNA, 21 bp, Homo sapiens
caagattggtgtttttttcta

SEQ ID NO: 1857338 - DNA, 22 bp, Homo sapiens
caagattggtgtttttttctat

SEQ ID NO: 1857339 - DNA, 20 bp, Homo sapiens
caagcaaatgcctgccaaat

SEQ ID NO: 1857340 - DNA, 12 bp, Homo sapiens
caagcaagctcc

SEQ ID NO: 1857341 - DNA, 12 bp, Homo sapiens
caagcagccaag

SEQ ID NO: 1857342 - DNA, 15 bp, Homo sapiens
caagctatcctggct

SEQ ID NO: 1857343 - DNA, 16 bp, Homo sapiens
caagctcaggaccagg

SEQ ID NO: 1857344 - DNA, 12 bp, Homo sapiens
caagctcccagg

SEQ ID NO: 1857345 - DNA, 13 bp, Homo sapiens
caagctgcaccct

SEQ ID NO: 1857346 - DNA, 14 bp, Homo sapiens
caagctgcaccctc

SEQ ID NO: 1857347 - DNA, 18 bp, Homo sapiens
caagctgcaccctcaggc

SEQ ID NO: 1857348 - DNA, 17 bp, Homo sapiens
caaggaaaccacagctg

SEQ ID NO: 1857349 - DNA, 20 bp, Homo sapiens
caaggaaaccacagctgctg

SEQ ID NO: 1857350 - DNA, 17 bp, Homo sapiens
caaggaagaagaaatct

SEQ ID NO: 1857351 - DNA, 14 bp, Homo sapiens
caaggagaggaggc

SEQ ID NO: 1857352 - DNA, 18 bp, Homo sapiens
caaggagaggaggcaact

SEQ ID NO: 1857353 - DNA, 12 bp, Homo sapiens
caaggcactgcc

SEQ ID NO: 1857354 - DNA, 13 bp, Homo sapiens
caaggctgattta

SEQ ID NO: 1857355 - DNA, 12 bp, Homo sapiens
caaggctgcagt

SEQ ID NO: 1857356 - DNA, 18 bp, Homo sapiens
caaggctgggggaagaag

SEQ ID NO: 1857357 - DNA, 15 bp, Homo sapiens
caaggtaccatccta

SEQ ID NO: 1857358 - DNA, 20 bp, Homo sapiens
caagtatggtaggggagggc

SEQ ID NO: 1857359 - DNA, 17 bp, Homo sapiens
caagtcaagtgaaaaag

SEQ ID NO: 1857360 - DNA, 18 bp, Homo sapiens
caagtgactgtatctgtg

SEQ ID NO: 1857361 - DNA, 18 bp, Homo sapiens
caagtgattgggacagag

SEQ ID NO: 1857362 - DNA, 23 bp, Homo sapiens
caagtggcagagcttggactgga

SEQ ID NO: 1857363 - DNA, 22 bp, Homo sapiens
caagtgtggtagagtgtgcctg

SEQ ID NO: 1857364 - DNA, 20 bp, Homo sapiens
caagttacagctgtgacaat

SEQ ID NO: 1857365 - DNA, 21 bp, Homo sapiens
caatacctggcctcatttaaa

SEQ ID NO: 1857366 - DNA, 15 bp, Homo sapiens
caatatcccttactt

SEQ ID NO: 1857367 - DNA, 19 bp, Homo sapiens
cagtcccaagcggtgtctc

SEQ ID NO: 1857368 - DNA, 14 bp, Homo sapiens
cagtcccctttctc

SEQ ID NO: 1857369 - DNA, 12 bp, Homo sapiens
cagtccctgcca

SEQ ID NO: 1857370 - DNA, 13 bp, Homo sapiens
cagtccctgccaa

SEQ ID NO: 1857371 - DNA, 12 bp, Homo sapiens
cagtcctcccat

SEQ ID NO: 1857372 - DNA, 15 bp, Homo sapiens
cagtccttaccagca

SEQ ID NO: 1857373 - DNA, 14 bp, Homo sapiens
cagtcttgcagcag

SEQ ID NO: 1857374 - DNA, 12 bp, Homo sapiens
cagtgaacattc

SEQ ID NO: 1857375 - DNA, 17 bp, Homo sapiens
cagtgaacattcccagc

SEQ ID NO: 1857376 - DNA, 20 bp, Homo sapiens
cagtgaacattcccagccca

SEQ ID NO: 1857377 - DNA, 14 bp, Homo sapiens
cagtgataagtata

SEQ ID NO: 1857378 - DNA, 14 bp, Homo sapiens
cagtgcaggcacag

SEQ ID NO: 1857379 - DNA, 15 bp, Homo sapiens
cagtgccctccagga

SEQ ID NO: 1857380 - DNA, 13 bp, Homo sapiens
cagtgccctctcc

SEQ ID NO: 1857381 - DNA, 15 bp, Homo sapiens
cagtgcctcttccag

SEQ ID NO: 1857382 - DNA, 23 bp, Homo sapiens
cagtgctgaccagacagcctccc

SEQ ID NO: 1857383 - DNA, 15 bp, Homo sapiens
cagtgcttgccacag

SEQ ID NO: 1857384 - DNA, 17 bp, Homo sapiens
cagtgcttgccacagag

SEQ ID NO: 1857385 - DNA, 14 bp, Homo sapiens
cagtggctgctgcc

SEQ ID NO: 1857386 - DNA, 15 bp, Homo sapiens
cagtggctgctgccc

SEQ ID NO: 1857387 - DNA, 18 bp, Homo sapiens
cagtggctgctgcccagg

SEQ ID NO: 1857388 - DNA, 13 bp, Homo sapiens
cagtggggcagag

SEQ ID NO: 1857389 - DNA, 21 bp, Homo sapiens
cagttaaactggcttaactta

SEQ ID NO: 1857390 - DNA, 23 bp, Homo sapiens
cagttgccagtcaccccggccac

SEQ ID NO: 1857391 - DNA, 21 bp, Homo sapiens
cagttgttatttattgaaatg

SEQ ID NO: 1857392 - DNA, 20 bp, Homo sapiens
cagtttaacctgatgcagtc

SEQ ID NO: 1857393 - DNA, 18 bp, Homo sapiens
cagtttgagacaggagac

SEQ ID NO: 1857394 - DNA, 18 bp, Homo sapiens
cagttttggttgctttaa

SEQ ID NO: 1857395 - DNA, 16 bp, Homo sapiens
cataagctatttttct

SEQ ID NO: 1857396 - DNA, 12 bp, Homo sapiens
cataattggaat

SEQ ID NO: 1857397 - DNA, 22 bp, Homo sapiens
cataatttttatttttggcaaa

SEQ ID NO: 1857398 - DNA, 14 bp, Homo sapiens
catacccaccccca

SEQ ID NO: 1857399 - DNA, 23 bp, Homo sapiens
catagagagcaagacgctgtgct

SEQ ID NO: 1857400 - DNA, 17 bp, Homo sapiens
catattaacaaattgca

SEQ ID NO: 1857401 - DNA, 18 bp, Homo sapiens
catattaacaaattgcat

SEQ ID NO: 1857402 - DNA, 13 bp, Homo sapiens
catattttagcta

SEQ ID NO: 1857403 - DNA, 15 bp, Homo sapiens
catcaaatggaagac

SEQ ID NO: 1857404 - DNA, 13 bp, Homo sapiens
catcaagactgga

SEQ ID NO: 1857405 - DNA, 16 bp, Homo sapiens
catcaaggcactgcct

SEQ ID NO: 1857406 - DNA, 18 bp, Homo sapiens
catcaaggcactgcctga

SEQ ID NO: 1857407 - DNA, 17 bp, Homo sapiens
catcaatgataatgcta

SEQ ID NO: 1857408 - DNA, 22 bp, Homo sapiens
catcacagttttggttgcttta

SEQ ID NO: 1857409 - DNA, 13 bp, Homo sapiens
catcacctccacc

SEQ ID NO: 1857410 - DNA, 19 bp, Homo sapiens
catcaggagaaaaagcctc

SEQ ID NO: 1857411 - DNA, 13 bp, Homo sapiens
catcaggccaggc

SEQ ID NO: 1857412 - DNA, 16 bp, Homo sapiens
catcaggccaggccct

SEQ ID NO: 1857413 - DNA, 20 bp, Homo sapiens
catcaggccaggccctctgc

SEQ ID NO: 1857414 - DNA, 16 bp, Homo sapiens
catcagtattgaagca

SEQ ID NO: 1857415 - DNA, 20 bp, Homo sapiens
catcagtattgaagcatttt

SEQ ID NO: 1857416 - DNA, 15 bp, Homo sapiens
catcagttagagctg

SEQ ID NO: 1857417 - DNA, 20 bp, Homo sapiens
catcagttagagctgacaca

SEQ ID NO: 1857418 - DNA, 16 bp, Homo sapiens
catcatacttaacttt

SEQ ID NO: 1857419 - DNA, 21 bp, Homo sapiens
catcatcaaggcactgcctga

SEQ ID NO: 1857420 - DNA, 17 bp, Homo sapiens
catcatcagtggagcca

SEQ ID NO: 1857421 - DNA, 21 bp, Homo sapiens
catcatttatcatcacaaatg

SEQ ID NO: 1857422 - DNA, 12 bp, Homo sapiens
catcccagcccc

SEQ ID NO: 1857423 - DNA, 11 bp, Homo sapiens
catccctgaag

SEQ ID NO: 1857424 - DNA, 18 bp, Homo sapiens
catccctgaaggccccgc

SEQ ID NO: 1857425 - DNA, 23 bp, Homo sapiens
catcccttgaccaggcctgggcc

SEQ ID NO: 1857426 - DNA, 16 bp, Homo sapiens
catcctcaaacactgc

SEQ ID NO: 1857427 - DNA, 18 bp, Homo sapiens
catcctcaaacactgcag

SEQ ID NO: 1857428 - DNA, 21 bp, Homo sapiens
catcctcatacccacccccac

SEQ ID NO: 1857429 - DNA, 22 bp, Homo sapiens
catcctcatacccacccccacc

SEQ ID NO: 1857430 - DNA, 19 bp, Homo sapiens
catcctctgtacagagccc

SEQ ID NO: 1857431 - DNA, 21 bp, Homo sapiens
catcctctgtacagagcccac

SEQ ID NO: 1857432 - DNA, 22 bp, Homo sapiens
catcctctgtacagagcccacg

SEQ ID NO: 1857433 - DNA, 22 bp, Homo sapiens
catccttgtcttattcccttcc

SEQ ID NO: 1857434 - DNA, 17 bp, Homo sapiens
catctcacacatgagca

SEQ ID NO: 1857435 - DNA, 16 bp, Homo sapiens
catctctggatgcctg

SEQ ID NO: 1857436 - DNA, 13 bp, Homo sapiens
catctctgtccca

SEQ ID NO: 1857437 - DNA, 15 bp, Homo sapiens
catctgcattcctga

SEQ ID NO: 1857438 - DNA, 12 bp, Homo sapiens
catctggaacca

SEQ ID NO: 1857439 - DNA, 13 bp, Homo sapiens
catctgggctcct

SEQ ID NO: 1857440 - DNA, 14 bp, Homo sapiens
catctgtaagagct

SEQ ID NO: 1857441 - DNA, 17 bp, Homo sapiens
catctgtaagagcttgc

SEQ ID NO: 1857442 - DNA, 15 bp, Homo sapiens
catctgtgcacgcag

SEQ ID NO: 1857443 - DNA, 15 bp, Homo sapiens
catcttaagagatgc

SEQ ID NO: 1857444 - DNA, 14 bp, Homo sapiens
catgaagcaggagg

SEQ ID NO: 1857445 - DNA, 23 bp, Homo sapiens
catgaagcaggaggcccttgtcg

SEQ ID NO: 1857446 - DNA, 20 bp, Homo sapiens
catgaagtttccttggctgg

SEQ ID NO: 1857447 - DNA, 23 bp, Homo sapiens
catgaagtttccttggctggtgc

SEQ ID NO: 1857448 - DNA, 16 bp, Homo sapiens
catgagcatcaggcca

SEQ ID NO: 1857449 - DNA, 22 bp, Homo sapiens
catgagcatcaggccaggccct

SEQ ID NO: 1857450 - DNA, 14 bp, Homo sapiens
catgagtgcgtgct

SEQ ID NO: 1857451 - DNA, 18 bp, Homo sapiens
catgagtgcgtgctcagt

SEQ ID NO: 1857452 - DNA, 13 bp, Homo sapiens
catgatgttttcc

SEQ ID NO: 1857453 - DNA, 14 bp, Homo sapiens
catgcaaaggctgg

SEQ ID NO: 1857454 - DNA, 19 bp, Homo sapiens
catgcagacatgagtgcgt

SEQ ID NO: 1857455 - DNA, 22 bp, Homo sapiens
catgcagacctcatgcccagct

SEQ ID NO: 1857456 - DNA, 14 bp, Homo sapiens
catgcagctgctcc

SEQ ID NO: 1857457 - DNA, 16 bp, Homo sapiens
catgcagctgctcccc

SEQ ID NO: 1857458 - DNA, 14 bp, Homo sapiens
catgcaggaggtgg

SEQ ID NO: 1857459 - DNA, 15 bp, Homo sapiens
catgcaggaggtgga

SEQ ID NO: 1857460 - DNA, 15 bp, Homo sapiens
catgcatggaaattc

SEQ ID NO: 1857461 - DNA, 18 bp, Homo sapiens
catgcatgttatgcttta

SEQ ID NO: 1857462 - DNA, 13 bp, Homo sapiens
catgcccagctct

SEQ ID NO: 1857463 - DNA, 13 bp, Homo sapiens
catgcctggatgg

SEQ ID NO: 1857464 - DNA, 21 bp, Homo sapiens
catgcctggatggggctgcac

SEQ ID NO: 1857465 - DNA, 16 bp, Homo sapiens
catgctcctggcccac

SEQ ID NO: 1857466 - DNA, 20 bp, Homo sapiens
catgctcctggcccactgca

SEQ ID NO: 1857467 - DNA, 16 bp, Homo sapiens
catgctgaagccaaag

SEQ ID NO: 1857468 - DNA, 13 bp, Homo sapiens
catgctgccctgt

SEQ ID NO: 1857469 - DNA, 16 bp, Homo sapiens
catgctgccctgtgag

SEQ ID NO: 1857470 - DNA, 17 bp, Homo sapiens
catgctgtgtgactcaa

SEQ ID NO: 1857471 - DNA, 21 bp, Homo sapiens
catgctgtgtgactcaaacca

SEQ ID NO: 1857472 - DNA, 15 bp, Homo sapiens
catgcttttccaaac

SEQ ID NO: 1857473 - DNA, 21 bp, Homo sapiens
catggagagctggagcctggt

SEQ ID NO: 1857474 - DNA, 12 bp, Homo sapiens
catggagctggc

SEQ ID NO: 1857475 - DNA, 14 bp, Homo sapiens
catggagctggccg

SEQ ID NO: 1857476 - DNA, 16 bp, Homo sapiens
catggcccctgtgagt

SEQ ID NO: 1857477 - DNA, 23 bp, Homo sapiens
catggccctcccagtacctcctg

SEQ ID NO: 1857478 - DNA, 14 bp, Homo sapiens
catggccgtgaact

SEQ ID NO: 1857479 - DNA, 13 bp, Homo sapiens
catgggtcgggag

SEQ ID NO: 1857480 - DNA, 20 bp, Homo sapiens
catgggtcgggagaggggac

SEQ ID NO: 1857481 - DNA, 23 bp, Homo sapiens
catgggtcgggagaggggacgca

SEQ ID NO: 1857482 - DNA, 16 bp, Homo sapiens
catgtgagaatatttt

SEQ ID NO: 1857483 - DNA, 13 bp, Homo sapiens
catgtgccctcag

SEQ ID NO: 1857484 - DNA, 18 bp, Homo sapiens
catgttgagacctcagct

SEQ ID NO: 1857485 - DNA, 19 bp, Homo sapiens
catgtttagactttaacat

SEQ ID NO: 1857486 - DNA, 18 bp, Homo sapiens
catgttttccagctcctc

SEQ ID NO: 1857487 - DNA, 19 bp, Homo sapiens
catgtttttcttctccctc

SEQ ID NO: 1857488 - DNA, 20 bp, Homo sapiens
catgtttttcttctccctca

SEQ ID NO: 1857489 - DNA, 16 bp, Homo sapiens
cattaatctcaaagag

SEQ ID NO: 1857490 - DNA, 19 bp, Homo sapiens
ccgttgatgttggctggga

SEQ ID NO: 1857491 - DNA, 12 bp, Homo sapiens
ccgttgtgagct

SEQ ID NO: 1857492 - DNA, 15 bp, Homo sapiens
ccgttgtgagctgga

SEQ ID NO: 1857493 - DNA, 18 bp, Homo sapiens
cctaaaacaaaagctcat

SEQ ID NO: 1857494 - DNA, 14 bp, Homo sapiens
cctaactcttcttt

SEQ ID NO: 1857495 - DNA, 15 bp, Homo sapiens
cctaactcttctttc

SEQ ID NO: 1857496 - DNA, 17 bp, Homo sapiens
cctaactcttctttcat

SEQ ID NO: 1857497 - DNA, 13 bp, Homo sapiens
cctaagtctctgt

SEQ ID NO: 1857498 - DNA, 15 bp, Homo sapiens
cctaagtctctgtga

SEQ ID NO: 1857499 - DNA, 12 bp, Homo sapiens
cctaatgtgttt

SEQ ID NO: 1857500 - DNA, 18 bp, Homo sapiens
cctacaaggagataagaa

SEQ ID NO: 1857501 - DNA, 22 bp, Homo sapiens
cctacagttgaaaaacagctga

SEQ ID NO: 1857502 - DNA, 21 bp, Homo sapiens
cctagaaattccccaccctga

SEQ ID NO: 1857503 - DNA, 20 bp, Homo sapiens
cctagctgaatgtttttcta

SEQ ID NO: 1857504 - DNA, 21 bp, Homo sapiens
cctagctgaatgtttttctaa

SEQ ID NO: 1857505 - DNA, 23 bp, Homo sapiens
cctaggcatttgctgaatacaga

SEQ ID NO: 1857506 - DNA, 23 bp, Homo sapiens
cctagttccaccatcaagccacc

SEQ ID NO: 1857507 - DNA, 15 bp, Homo sapiens
cctcaaacactgcag

SEQ ID NO: 1857508 - DNA, 16 bp, Homo sapiens
cctcaacacctctgca

SEQ ID NO: 1857509 - DNA, 13 bp, Homo sapiens
cctcaactgaagg

SEQ ID NO: 1857510 - DNA, 12 bp, Homo sapiens
cctcacactggg

SEQ ID NO: 1857511 - DNA, 15 bp, Homo sapiens
cctcaccccactgtg

SEQ ID NO: 1857512 - DNA, 15 bp, Homo sapiens
cctcagggtccctgg

SEQ ID NO: 1857513 - DNA, 16 bp, Homo sapiens
cctcagggtccctggt

SEQ ID NO: 1857514 - DNA, 17 bp, Homo sapiens
cctcagggtccctggtg

SEQ ID NO: 1857515 - DNA, 20 bp, Homo sapiens
cctcagtaacatttctgttc

SEQ ID NO: 1857516 - DNA, 15 bp, Homo sapiens
cctcagtaagacgac

SEQ ID NO: 1857517 - DNA, 14 bp, Homo sapiens
cctcatccagggct

SEQ ID NO: 1857518 - DNA, 23 bp, Homo sapiens
cctcatccagggctctgaccagt

SEQ ID NO: 1857519 - DNA, 16 bp, Homo sapiens
cctcatgcccagctct

SEQ ID NO: 1857520 - DNA, 19 bp, Homo sapiens
cctccaagaccttctcctt

SEQ ID NO: 1857521 - DNA, 12 bp, Homo sapiens
cctccaggtgca

SEQ ID NO: 1857522 - DNA, 17 bp, Homo sapiens
cctccaggtgcacaagc

SEQ ID NO: 1857523 - DNA, 22 bp, Homo sapiens
cctccaggtgcacaagctccaa

SEQ ID NO: 1857524 - DNA, 14 bp, Homo sapiens
cctcccaactcacc

SEQ ID NO: 1857525 - DNA, 17 bp, Homo sapiens
cctcccaactcacccca

SEQ ID NO: 1857526 - DNA, 14 bp, Homo sapiens
cctccccctgtccc

SEQ ID NO: 1857527 - DNA, 16 bp, Homo sapiens
cctcccctctcagaac

SEQ ID NO: 1857528 - DNA, 13 bp, Homo sapiens
cctcccctgggga

SEQ ID NO: 1857529 - DNA, 14 bp, Homo sapiens
cctcccctggggac

SEQ ID NO: 1857530 - DNA, 10 bp, Homo sapiens
cctccctccc

SEQ ID NO: 1857531 - DNA, 16 bp, Homo sapiens
cctccctccctctttc

SEQ ID NO: 1857532 - DNA, 12 bp, Homo sapiens
cctcctccagcc

SEQ ID NO: 1857533 - DNA, 12 bp, Homo sapiens
cctcctgcctcc

SEQ ID NO: 1857534 - DNA, 19 bp, Homo sapiens
cctcctttgtgaggaagcc

SEQ ID NO: 1857535 - DNA, 19 bp, Homo sapiens
cctctcagaacatactgat

SEQ ID NO: 1857536 - DNA, 15 bp, Homo sapiens
cctctcccctcagcc

SEQ ID NO: 1857537 - DNA, 13 bp, Homo sapiens
cctctcccttgga

SEQ ID NO: 1857538 - DNA, 13 bp, Homo sapiens
cctctgaggctga

SEQ ID NO: 1857539 - DNA, 11 bp, Homo sapiens
cctctgcacaa

SEQ ID NO: 1857540 - DNA, 20 bp, Homo sapiens
cctctgcacaagctgcaccc

SEQ ID NO: 1857541 - DNA, 15 bp, Homo sapiens
cctctgcactcccct

SEQ ID NO: 1857542 - DNA, 18 bp, Homo sapiens
cctctgcactcccctgct

SEQ ID NO: 1857543 - DNA, 22 bp, Homo sapiens
cctctgcactcccctgctgggt

SEQ ID NO: 1857544 - DNA, 23 bp, Homo sapiens
cctctgcactcccctgctgggtg

SEQ ID NO: 1857545 - DNA, 16 bp, Homo sapiens
cctctgcccactccct

SEQ ID NO: 1857546 - DNA, 15 bp, Homo sapiens
cctctgctgatcctc

SEQ ID NO: 1857547 - DNA, 14 bp, Homo sapiens
cctctgctgctggc

SEQ ID NO: 1857548 - DNA, 18 bp, Homo sapiens
cctctgctgctggctggt

SEQ ID NO: 1857549 - DNA, 14 bp, Homo sapiens
cctctgtacagagc

SEQ ID NO: 1857550 - DNA, 21 bp, Homo sapiens
cctctgtctaggactgcagtg

SEQ ID NO: 1857551 - DNA, 22 bp, Homo sapiens
cctctgtctaggactgcagtgt

SEQ ID NO: 1857552 - DNA, 22 bp, Homo sapiens
cctctgttgccaaggctggagt

SEQ ID NO: 1857553 - DNA, 17 bp, Homo sapiens
cctcttatgggctgggt

SEQ ID NO: 1857554 - DNA, 15 bp, Homo sapiens
cctcttccagtgaac

SEQ ID NO: 1857555 - DNA, 17 bp, Homo sapiens
cctcttccagtgaacat

SEQ ID NO: 1857556 - DNA, 18 bp, Homo sapiens
cctcttccagtgaacatt

SEQ ID NO: 1857557 - DNA, 19 bp, Homo sapiens
cctcttgtagtcttggcta

SEQ ID NO: 1857558 - DNA, 11 bp, Homo sapiens
cctctttccct

SEQ ID NO: 1857559 - DNA, 19 bp, Homo sapiens
cctctttccctcccttcct

SEQ ID NO: 1857560 - DNA, 19 bp, Homo sapiens
cctctttggtctacactgt

SEQ ID NO: 1857561 - DNA, 18 bp, Homo sapiens
cctgaaagccctgagctt

SEQ ID NO: 1857562 - DNA, 21 bp, Homo sapiens
cctgaaggccccgcccaggct

SEQ ID NO: 1857563 - DNA, 22 bp, Homo sapiens
cctgaaggccccgcccaggctt

SEQ ID NO: 1857564 - DNA, 15 bp, Homo sapiens
cctgacaacactcat

SEQ ID NO: 1857565 - DNA, 16 bp, Homo sapiens
cctgacaacactcatt

SEQ ID NO: 1857566 - DNA, 22 bp, Homo sapiens
cctgagatttattaaagaaaaa

SEQ ID NO: 1857567 - DNA, 23 bp, Homo sapiens
cctgagatttattaaagaaaaaa

SEQ ID NO: 1857568 - DNA, 16 bp, Homo sapiens
cctgagccttcagcac

SEQ ID NO: 1857569 - DNA, 14 bp, Homo sapiens
cctgagctttctgc

SEQ ID NO: 1857570 - DNA, 14 bp, Homo sapiens
cctgaggcccagag

SEQ ID NO: 1857571 - DNA, 15 bp, Homo sapiens
cctgaggcccagagg

SEQ ID NO: 1857572 - DNA, 13 bp, Homo sapiens
cctgaggctgggc

SEQ ID NO: 1857573 - DNA, 12 bp, Homo sapiens
cctgaggggcct

SEQ ID NO: 1857574 - DNA, 15 bp, Homo sapiens
cctgagtgcctggcc

SEQ ID NO: 1857575 - DNA, 14 bp, Homo sapiens
cctgagtgcttgct

SEQ ID NO: 1857576 - DNA, 15 bp, Homo sapiens
cctgatcctgtgaag

SEQ ID NO: 1857577 - DNA, 15 bp, Homo sapiens
cctgatgcagtcacg

SEQ ID NO: 1857578 - DNA, 16 bp, Homo sapiens
cctgatgcagtcacgt

SEQ ID NO: 1857579 - DNA, 14 bp, Homo sapiens
cctgatgcttcttc

SEQ ID NO: 1857580 - DNA, 17 bp, Homo sapiens
cctgatgcttcttcaga

SEQ ID NO: 1857581 - DNA, 20 bp, Homo sapiens
cctgatgcttcttcagagac

SEQ ID NO: 1857582 - DNA, 21 bp, Homo sapiens
cctgatgcttcttcagagact

SEQ ID NO: 1857583 - DNA, 22 bp, Homo sapiens
cctgatgcttcttcagagactc

SEQ ID NO: 1857584 - DNA, 16 bp, Homo sapiens
cctgcaacctgattgt

SEQ ID NO: 1857585 - DNA, 21 bp, Homo sapiens
cctgcacacgctccttcctct

SEQ ID NO: 1857586 - DNA, 14 bp, Homo sapiens
cctgcaggcagcca

SEQ ID NO: 1857587 - DNA, 16 bp, Homo sapiens
cctgcaggcagccagg

SEQ ID NO: 1857588 - DNA, 17 bp, Homo sapiens
cctgcaggcagccaggc

SEQ ID NO: 1857589 - DNA, 21 bp, Homo sapiens
cctgcaggcagccaggccaca

SEQ ID NO: 1857590 - DNA, 12 bp, Homo sapiens
cctgccagggac

SEQ ID NO: 1857591 - DNA, 16 bp, Homo sapiens
cctgccagggacagag

SEQ ID NO: 1857592 - DNA, 14 bp, Homo sapiens
cctgcccacctggc

SEQ ID NO: 1857593 - DNA, 22 bp, Homo sapiens
cctgcccctcctctccctcatc

SEQ ID NO: 1857594 - DNA, 11 bp, Homo sapiens
cctgccctgtg

SEQ ID NO: 1857595 - DNA, 15 bp, Homo sapiens
cctgcctcctttgtg

SEQ ID NO: 1857596 - DNA, 21 bp, Homo sapiens
cctgcctcctttgtgaggaag

SEQ ID NO: 1857597 - DNA, 22 bp, Homo sapiens
cctgcctcctttgtgaggaagc

SEQ ID NO: 1857598 - DNA, 23 bp, Homo sapiens
cctgcctcctttgtgaggaagcc

SEQ ID NO: 1857599 - DNA, 14 bp, Homo sapiens
cctgcctctaccca

SEQ ID NO: 1857600 - DNA, 16 bp, Homo sapiens
cctgcctgccctggtg

SEQ ID NO: 1857601 - DNA, 14 bp, Homo sapiens
cctgctccagctgt

SEQ ID NO: 1857602 - DNA, 22 bp, Homo sapiens
cctgctccagctgttcagctgg

SEQ ID NO: 1857603 - DNA, 15 bp, Homo sapiens
cctgctcccatcctg

SEQ ID NO: 1857604 - DNA, 11 bp, Homo sapiens
cctgctgcagt

SEQ ID NO: 1857605 - DNA, 20 bp, Homo sapiens
cctgctgcagttgccagtca

SEQ ID NO: 1857606 - DNA, 20 bp, Homo sapiens
cctggaaggacatccatgtt

SEQ ID NO: 1857607 - DNA, 19 bp, Homo sapiens
cctggatgcagcctcacag

SEQ ID NO: 1857608 - DNA, 18 bp, Homo sapiens
cctggatggggctgcacc

SEQ ID NO: 1857609 - DNA, 15 bp, Homo sapiens
cctggccagggcctg

SEQ ID NO: 1857610 - DNA, 16 bp, Homo sapiens
cctggcccactgcatc

SEQ ID NO: 1857611 - DNA, 14 bp, Homo sapiens
cctggcccctcagg

SEQ ID NO: 1857612 - DNA, 16 bp, Homo sapiens
cctggcccctcagggt

SEQ ID NO: 1857613 - DNA, 18 bp, Homo sapiens
ctccatcagttagagctg

SEQ ID NO: 1857614 - DNA, 21 bp, Homo sapiens
ctccatgtgagaatatttttc

SEQ ID NO: 1857615 - DNA, 14 bp, Homo sapiens
ctccattttttctt

SEQ ID NO: 1857616 - DNA, 14 bp, Homo sapiens
ctcccaagggatgg

SEQ ID NO: 1857617 - DNA, 18 bp, Homo sapiens
ctcccaagggatggtgcc

SEQ ID NO: 1857618 - DNA, 19 bp, Homo sapiens
ctcccaggcattccccagg

SEQ ID NO: 1857619 - DNA, 22 bp, Homo sapiens
ctcccaggcattccccaggagg

SEQ ID NO: 1857620 - DNA, 16 bp, Homo sapiens
ctcccatcctgtgtgt

SEQ ID NO: 1857621 - DNA, 15 bp, Homo sapiens
ctcccatctcacaca

SEQ ID NO: 1857622 - DNA, 21 bp, Homo sapiens
ctcccctcagcctctcccctg

SEQ ID NO: 1857623 - DNA, 12 bp, Homo sapiens
ctcccctcctcc

SEQ ID NO: 1857624 - DNA, 13 bp, Homo sapiens
ctcccctctcaga

SEQ ID NO: 1857625 - DNA, 14 bp, Homo sapiens
ctcccctctcagaa

SEQ ID NO: 1857626 - DNA, 23 bp, Homo sapiens
ctcccctctcagaacatactgat

SEQ ID NO: 1857627 - DNA, 12 bp, Homo sapiens
ctcccctgctgg

SEQ ID NO: 1857628 - DNA, 23 bp, Homo sapiens
ctcccctgctgggtgtggcgcag

SEQ ID NO: 1857629 - DNA, 23 bp, Homo sapiens
ctcccctggggacagcaagggct

SEQ ID NO: 1857630 - DNA, 21 bp, Homo sapiens
ctccctattttttttctgtta

SEQ ID NO: 1857631 - DNA, 22 bp, Homo sapiens
ctccctcatcaaggacacgggc

SEQ ID NO: 1857632 - DNA, 23 bp, Homo sapiens
ctccctcatcaaggacacgggcc

SEQ ID NO: 1857633 - DNA, 16 bp, Homo sapiens
ctccctccctctttcc

SEQ ID NO: 1857634 - DNA, 13 bp, Homo sapiens
ctcccttcctctt

SEQ ID NO: 1857635 - DNA, 14 bp, Homo sapiens
ctcccttcctcttt

SEQ ID NO: 1857636 - DNA, 20 bp, Homo sapiens
ctcccttggattgtccccga

SEQ ID NO: 1857637 - DNA, 17 bp, Homo sapiens
ctccctttcttccctac

SEQ ID NO: 1857638 - DNA, 18 bp, Homo sapiens
ctcctcagggttgaggtc

SEQ ID NO: 1857639 - DNA, 23 bp, Homo sapiens
ctcctcagggttgaggtccagcc

SEQ ID NO: 1857640 - DNA, 20 bp, Homo sapiens
ctcctcatccagggctctga

SEQ ID NO: 1857641 - DNA, 15 bp, Homo sapiens
ctcctccagccgcca

SEQ ID NO: 1857642 - DNA, 13 bp, Homo sapiens
ctcctccgtggca

SEQ ID NO: 1857643 - DNA, 14 bp, Homo sapiens
ctcctctgctgctg

SEQ ID NO: 1857644 - DNA, 18 bp, Homo sapiens
ctcctctgctgctggctg

SEQ ID NO: 1857645 - DNA, 20 bp, Homo sapiens
ctcctgcaggcagccaggcc

SEQ ID NO: 1857646 - DNA, 21 bp, Homo sapiens
ctcctgcaggcagccaggcca

SEQ ID NO: 1857647 - DNA, 11 bp, Homo sapiens
ctcctggactc

SEQ ID NO: 1857648 - DNA, 12 bp, Homo sapiens
ctcctggactcc

SEQ ID NO: 1857649 - DNA, 16 bp, Homo sapiens
ctcctggatctccctg

SEQ ID NO: 1857650 - DNA, 19 bp, Homo sapiens
ctcctggatctccctgaga

SEQ ID NO: 1857651 - DNA, 18 bp, Homo sapiens
ctcctggcccactgcatc

SEQ ID NO: 1857652 - DNA, 17 bp, Homo sapiens
ctccttaacactgagct

SEQ ID NO: 1857653 - DNA, 17 bp, Homo sapiens
ctccttcacagatgggt

SEQ ID NO: 1857654 - DNA, 17 bp, Homo sapiens
ctccttgagagaccagg

SEQ ID NO: 1857655 - DNA, 20 bp, Homo sapiens
ctccttgtggcctgggcctc

SEQ ID NO: 1857656 - DNA, 16 bp, Homo sapiens
ctcgagcatgcctgga

SEQ ID NO: 1857657 - DNA, 11 bp, Homo sapiens
ctcggtgcctt

SEQ ID NO: 1857658 - DNA, 17 bp, Homo sapiens
ctcggtgtggagaagcg

SEQ ID NO: 1857659 - DNA, 23 bp, Homo sapiens
ctcggtgtggagaagcggctggc

SEQ ID NO: 1857660 - DNA, 19 bp, Homo sapiens
ctcgtcctcgtttgtgttc

SEQ ID NO: 1857661 - DNA, 13 bp, Homo sapiens
ctctacaaaaagc

SEQ ID NO: 1857662 - DNA, 20 bp, Homo sapiens
ctctaccaagctatcctggc

SEQ ID NO: 1857663 - DNA, 12 bp, Homo sapiens
ctctaggctggg

SEQ ID NO: 1857664 - DNA, 13 bp, Homo sapiens
ctctcagaacata

SEQ ID NO: 1857665 - DNA, 12 bp, Homo sapiens
ctctccagcccc

SEQ ID NO: 1857666 - DNA, 13 bp, Homo sapiens
ctctccagcccct

SEQ ID NO: 1857667 - DNA, 16 bp, Homo sapiens
ctctccagcccctgga

SEQ ID NO: 1857668 - DNA, 18 bp, Homo sapiens
ctctccagcccctggatg

SEQ ID NO: 1857669 - DNA, 14 bp, Homo sapiens
ctctcccctgcctg

SEQ ID NO: 1857670 - DNA, 13 bp, Homo sapiens
ctctcccttggat

SEQ ID NO: 1857671 - DNA, 10 bp, Homo sapiens
ctctcctctg

SEQ ID NO: 1857672 - DNA, 15 bp, Homo sapiens
ctctcctctgctgct

SEQ ID NO: 1857673 - DNA, 14 bp, Homo sapiens
ctctctcactcctt

SEQ ID NO: 1857674 - DNA, 23 bp, Homo sapiens
ctctctgacgcttgtgacagtgc

SEQ ID NO: 1857675 - DNA, 23 bp, Homo sapiens
ctctgacagaagaaccccagggt

SEQ ID NO: 1857676 - DNA, 17 bp, Homo sapiens
ctctgacgcttgtgaca

SEQ ID NO: 1857677 - DNA, 20 bp, Homo sapiens
ctctgacgcttgtgacagtg

SEQ ID NO: 1857678 - DNA, 14 bp, Homo sapiens
ctctgcacaagctg

SEQ ID NO: 1857679 - DNA, 16 bp, Homo sapiens
ctctgcccactccctg

SEQ ID NO: 1857680 - DNA, 15 bp, Homo sapiens
ctctgccctccaaga

SEQ ID NO: 1857681 - DNA, 16 bp, Homo sapiens
ctctgccctccaagac

SEQ ID NO: 1857682 - DNA, 12 bp, Homo sapiens
ctctgcccttgg

SEQ ID NO: 1857683 - DNA, 21 bp, Homo sapiens
ctctgcctcccatcacccgct

SEQ ID NO: 1857684 - DNA, 14 bp, Homo sapiens
ctctggcagctcag

SEQ ID NO: 1857685 - DNA, 17 bp, Homo sapiens
ctctggcagctcagaga

SEQ ID NO: 1857686 - DNA, 14 bp, Homo sapiens
ctctggtccataga

SEQ ID NO: 1857687 - DNA, 23 bp, Homo sapiens
ctctggtggcttaagtgagcaga

SEQ ID NO: 1857688 - DNA, 21 bp, Homo sapiens
ctctgtacagagcccacgccc

SEQ ID NO: 1857689 - DNA, 22 bp, Homo sapiens
ctctgtcccacttggcatcagc

SEQ ID NO: 1857690 - DNA, 13 bp, Homo sapiens
ctctgtccccagc

SEQ ID NO: 1857691 - DNA, 16 bp, Homo sapiens
ctctgtccccagcctg

SEQ ID NO: 1857692 - DNA, 22 bp, Homo sapiens
ctctgtctaggactgcagtgtg

SEQ ID NO: 1857693 - DNA, 21 bp, Homo sapiens
ctctgtgagcatcacagtttt

SEQ ID NO: 1857694 - DNA, 22 bp, Homo sapiens
ctcttatggatgtccccagcag

SEQ ID NO: 1857695 - DNA, 20 bp, Homo sapiens
ctcttcagttaagcctttgg

SEQ ID NO: 1857696 - DNA, 15 bp, Homo sapiens
ctcttccaggctggg

SEQ ID NO: 1857697 - DNA, 13 bp, Homo sapiens
ctcttgagcctgg

SEQ ID NO: 1857698 - DNA, 14 bp, Homo sapiens
ctcttgagcctggg

SEQ ID NO: 1857699 - DNA, 21 bp, Homo sapiens
ctcttgtagtcttggctaagg

SEQ ID NO: 1857700 - DNA, 18 bp, Homo sapiens
ctctttaaaaactcactt

SEQ ID NO: 1857701 - DNA, 18 bp, Homo sapiens
ctctttggacactcacac

SEQ ID NO: 1857702 - DNA, 21 bp, Homo sapiens
ctctttggtctacactgtgct

SEQ ID NO: 1857703 - DNA, 18 bp, Homo sapiens
ctctttgttttgtgtctc

SEQ ID NO: 1857704 - DNA, 20 bp, Homo sapiens
ctctttgttttgtgtctctt

SEQ ID NO: 1857705 - DNA, 15 bp, Homo sapiens
ctgaaaaaaaacctg

SEQ ID NO: 1857706 - DNA, 23 bp, Homo sapiens
ctgaaagccctgagctttctgct

SEQ ID NO: 1857707 - DNA, 21 bp, Homo sapiens
ctgaacctgggtaactaggga

SEQ ID NO: 1857708 - DNA, 12 bp, Homo sapiens
ctgaactttgct

SEQ ID NO: 1857709 - DNA, 14 bp, Homo sapiens
ctgaaggccccgcc

SEQ ID NO: 1857710 - DNA, 18 bp, Homo sapiens
ctgaaggccccgcccagg

SEQ ID NO: 1857711 - DNA, 19 bp, Homo sapiens
ctgaaggccccgcccaggc

SEQ ID NO: 1857712 - DNA, 17 bp, Homo sapiens
ctgaagtgaaactgctt

SEQ ID NO: 1857713 - DNA, 16 bp, Homo sapiens
ctgaatacagaggcaa

SEQ ID NO: 1857714 - DNA, 14 bp, Homo sapiens
ctgaatgtttttct

SEQ ID NO: 1857715 - DNA, 17 bp, Homo sapiens
ctgaatgtttttctaaa

SEQ ID NO: 1857716 - DNA, 23 bp, Homo sapiens
ctgaatgtttttctaaaggagtt

SEQ ID NO: 1857717 - DNA, 16 bp, Homo sapiens
ctgacacaaacctgcc

SEQ ID NO: 1857718 - DNA, 22 bp, Homo sapiens
ctgacactggtattcctgcctc

SEQ ID NO: 1857719 - DNA, 12 bp, Homo sapiens
ctgacatcattt

SEQ ID NO: 1857720 - DNA, 14 bp, Homo sapiens
ctgacccatgctgc

SEQ ID NO: 1857721 - DNA, 21 bp, Homo sapiens
ctgacccatgctgccctgtga

SEQ ID NO: 1857722 - DNA, 15 bp, Homo sapiens
ctgacgcttgtgaca

SEQ ID NO: 1857723 - DNA, 19 bp, Homo sapiens
ctgacgcttgtgacagtgc

SEQ ID NO: 1857724 - DNA, 20 bp, Homo sapiens
ctgacgcttgtgacagtgcc

SEQ ID NO: 1857725 - DNA, 21 bp, Homo sapiens
ctgacgcttgtgacagtgcct

SEQ ID NO: 1857726 - DNA, 22 bp, Homo sapiens
ctgacgcttgtgacagtgcctc

SEQ ID NO: 1857727 - DNA, 17 bp, Homo sapiens
ctgagaacactgtgaaa

SEQ ID NO: 1857728 - DNA, 16 bp, Homo sapiens
ctgagacagcccgggc

SEQ ID NO: 1857729 - DNA, 22 bp, Homo sapiens
ctgagacagcccgggctctgcc

SEQ ID NO: 1857730 - DNA, 18 bp, Homo sapiens
ctgagatgaaccctggca

SEQ ID NO: 1857731 - DNA, 14 bp, Homo sapiens
ctgagatttattaa

SEQ ID NO: 1857732 - DNA, 18 bp, Homo sapiens
ctgagatttattaaagaa

SEQ ID NO: 1857733 - DNA, 19 bp, Homo sapiens
ctgagatttattaaagaaa

SEQ ID NO: 1857734 - DNA, 17 bp, Homo sapiens
ctgagcagcgagcctgc

SEQ ID NO: 1857735 - DNA, 15 bp, Homo sapiens
cttccaggggtggga

SEQ ID NO: 1857736 - DNA, 15 bp, Homo sapiens
cttccagtgaacatt

SEQ ID NO: 1857737 - DNA, 20 bp, Homo sapiens
cttccagtgaacattcccag

SEQ ID NO: 1857738 - DNA, 14 bp, Homo sapiens
cttccagtgaggct

SEQ ID NO: 1857739 - DNA, 22 bp, Homo sapiens
cttccagtgaggctctgccctt

SEQ ID NO: 1857740 - DNA, 18 bp, Homo sapiens
cttccatctttcctgatg

SEQ ID NO: 1857741 - DNA, 17 bp, Homo sapiens
cttccatggactttgtt

SEQ ID NO: 1857742 - DNA, 17 bp, Homo sapiens
cttcccaagggctgccg

SEQ ID NO: 1857743 - DNA, 11 bp, Homo sapiens
cttcccacctc

SEQ ID NO: 1857744 - DNA, 15 bp, Homo sapiens
cttcccagtggctgc

SEQ ID NO: 1857745 - DNA, 17 bp, Homo sapiens
cttcccagtggctgctg

SEQ ID NO: 1857746 - DNA, 18 bp, Homo sapiens
cttcccagtggctgctgc

SEQ ID NO: 1857747 - DNA, 19 bp, Homo sapiens
cttcccatgacccaggctg

SEQ ID NO: 1857748 - DNA, 22 bp, Homo sapiens
cttcccatgacccaggctgggc

SEQ ID NO: 1857749 - DNA, 22 bp, Homo sapiens
cttccctatctttgccaccctc

SEQ ID NO: 1857750 - DNA, 21 bp, Homo sapiens
cttcctcagtaacatttctgt

SEQ ID NO: 1857751 - DNA, 12 bp, Homo sapiens
cttcctccctcc

SEQ ID NO: 1857752 - DNA, 14 bp, Homo sapiens
cttcctccctccct

SEQ ID NO: 1857753 - DNA, 14 bp, Homo sapiens
cttcctgccagccc

SEQ ID NO: 1857754 - DNA, 17 bp, Homo sapiens
cttcctgccagcccctg

SEQ ID NO: 1857755 - DNA, 18 bp, Homo sapiens
cttcctgccagcccctgc

SEQ ID NO: 1857756 - DNA, 21 bp, Homo sapiens
cttcgggaggtcgaggcagga

SEQ ID NO: 1857757 - DNA, 16 bp, Homo sapiens
cttctaggacgccacc

SEQ ID NO: 1857758 - DNA, 20 bp, Homo sapiens
cttctaggtggcaaggctgt

SEQ ID NO: 1857759 - DNA, 16 bp, Homo sapiens
cttctcagaaggcaaa

SEQ ID NO: 1857760 - DNA, 13 bp, Homo sapiens
cttctccagggtc

SEQ ID NO: 1857761 - DNA, 12 bp, Homo sapiens
cttctccccaga

SEQ ID NO: 1857762 - DNA, 22 bp, Homo sapiens
cttctccctcatttcaggagca

SEQ ID NO: 1857763 - DNA, 19 bp, Homo sapiens
cttctccttcacctttgtc

SEQ ID NO: 1857764 - DNA, 21 bp, Homo sapiens
cttctcgtcctcgtttgtgtt

SEQ ID NO: 1857765 - DNA, 13 bp, Homo sapiens
cttctctccagcc

SEQ ID NO: 1857766 - DNA, 15 bp, Homo sapiens
cttctgacccatgct

SEQ ID NO: 1857767 - DNA, 17 bp, Homo sapiens
cttctgacccatgctgc

SEQ ID NO: 1857768 - DNA, 20 bp, Homo sapiens
cttctgacccatgctgccct

SEQ ID NO: 1857769 - DNA, 21 bp, Homo sapiens
cttctgacccatgctgccctg

SEQ ID NO: 1857770 - DNA, 22 bp, Homo sapiens
cttctgagcagcgagcctgcta

SEQ ID NO: 1857771 - DNA, 14 bp, Homo sapiens
cttctggttgatgc

SEQ ID NO: 1857772 - DNA, 15 bp, Homo sapiens
cttgaaaagggtgtt

SEQ ID NO: 1857773 - DNA, 17 bp, Homo sapiens
cttgaccattctccacc

SEQ ID NO: 1857774 - DNA, 12 bp, Homo sapiens
cttgagcctggg

SEQ ID NO: 1857775 - DNA, 20 bp, Homo sapiens
cttgagttgattcagctctg

SEQ ID NO: 1857776 - DNA, 12 bp, Homo sapiens
cttgcagcagga

SEQ ID NO: 1857777 - DNA, 13 bp, Homo sapiens
cttgcatgaggct

SEQ ID NO: 1857778 - DNA, 16 bp, Homo sapiens
cttgcctgcacaaact

SEQ ID NO: 1857779 - DNA, 19 bp, Homo sapiens
cttgcttttcatgcaaact

SEQ ID NO: 1857780 - DNA, 22 bp, Homo sapiens
cttggaagggcgttctaggtag

SEQ ID NO: 1857781 - DNA, 18 bp, Homo sapiens
cttggaagttgcatggca

SEQ ID NO: 1857782 - DNA, 13 bp, Homo sapiens
cttggattgtccc

SEQ ID NO: 1857783 - DNA, 14 bp, Homo sapiens
cttggattgtcccc

SEQ ID NO: 1857784 - DNA, 17 bp, Homo sapiens
cttggctacacagggat

SEQ ID NO: 1857785 - DNA, 17 bp, Homo sapiens
cttggctgtggggctag

SEQ ID NO: 1857786 - DNA, 20 bp, Homo sapiens
cttggggaaaatggccatgc

SEQ ID NO: 1857787 - DNA, 21 bp, Homo sapiens
cttggggaaaatggccatgca

SEQ ID NO: 1857788 - DNA, 14 bp, Homo sapiens
cttggtcctgctgc

SEQ ID NO: 1857789 - DNA, 18 bp, Homo sapiens
cttggtcctgctgcagtt

SEQ ID NO: 1857790 - DNA, 20 bp, Homo sapiens
cttggtcctgctgcagttgc

SEQ ID NO: 1857791 - DNA, 17 bp, Homo sapiens
cttgtaaatataaagac

SEQ ID NO: 1857792 - DNA, 20 bp, Homo sapiens
cttgtcaggagtgtgtgtga

SEQ ID NO: 1857793 - DNA, 13 bp, Homo sapiens
cttgtctttggac

SEQ ID NO: 1857794 - DNA, 13 bp, Homo sapiens
cttgtgacagtgc

SEQ ID NO: 1857795 - DNA, 19 bp, Homo sapiens
cttgtgacagtgcctcttc

SEQ ID NO: 1857796 - DNA, 22 bp, Homo sapiens
cttgtgacagtgcctcttccag

SEQ ID NO: 1857797 - DNA, 18 bp, Homo sapiens
cttgtgccaacactcaag

SEQ ID NO: 1857798 - DNA, 19 bp, Homo sapiens
cttgtggtcccaccccaca

SEQ ID NO: 1857799 - DNA, 21 bp, Homo sapiens
ctttaaaaagctccaaatgca

SEQ ID NO: 1857800 - DNA, 20 bp, Homo sapiens
ctttaaaagacaaatcaaag

SEQ ID NO: 1857801 - DNA, 16 bp, Homo sapiens
ctttaatataaatgca

SEQ ID NO: 1857802 - DNA, 18 bp, Homo sapiens
ctttaatataaatgcaaa

SEQ ID NO: 1857803 - DNA, 18 bp, Homo sapiens
ctttaatatcatcagtat

SEQ ID NO: 1857804 - DNA, 16 bp, Homo sapiens
ctttaattaagctctc

SEQ ID NO: 1857805 - DNA, 22 bp, Homo sapiens
ctttacacatcagtcacaagtt

SEQ ID NO: 1857806 - DNA, 16 bp, Homo sapiens
ctttactaagtaatct

SEQ ID NO: 1857807 - DNA, 23 bp, Homo sapiens
ctttagttagtgattatatttca

SEQ ID NO: 1857808 - DNA, 20 bp, Homo sapiens
ctttattctggcagaggagg

SEQ ID NO: 1857809 - DNA, 19 bp, Homo sapiens
ctttcattttgcacctgca

SEQ ID NO: 1857810 - DNA, 22 bp, Homo sapiens
ctttcattttgcacctgcagcc

SEQ ID NO: 1857811 - DNA, 21 bp, Homo sapiens
ctttccaaaggccatggagag

SEQ ID NO: 1857812 - DNA, 15 bp, Homo sapiens
ctttccccatgtctc

SEQ ID NO: 1857813 - DNA, 17 bp, Homo sapiens
ctttcctgaggctgggc

SEQ ID NO: 1857814 - DNA, 19 bp, Homo sapiens
ctttcctgatggcaggatg

SEQ ID NO: 1857815 - DNA, 19 bp, Homo sapiens
ctttccttgttccccatca

SEQ ID NO: 1857816 - DNA, 13 bp, Homo sapiens
ctttctccctcaa

SEQ ID NO: 1857817 - DNA, 20 bp, Homo sapiens
ctttctcttttcctctacca

SEQ ID NO: 1857818 - DNA, 18 bp, Homo sapiens
ctttctgggatgtcacag

SEQ ID NO: 1857819 - DNA, 23 bp, Homo sapiens
ctttcttttttggccatctgctc

SEQ ID NO: 1857820 - DNA, 15 bp, Homo sapiens
ctttgacctgcctcc

SEQ ID NO: 1857821 - DNA, 23 bp, Homo sapiens
ctttgacctgcctcccttcatgc

SEQ ID NO: 1857822 - DNA, 16 bp, Homo sapiens
ctttgacgccatccca

SEQ ID NO: 1857823 - DNA, 19 bp, Homo sapiens
ctttgacgccatcccagcc

SEQ ID NO: 1857824 - DNA, 21 bp, Homo sapiens
ctttgacgccatcccagcccc

SEQ ID NO: 1857825 - DNA, 13 bp, Homo sapiens
ctttgagactgtt

SEQ ID NO: 1857826 - DNA, 17 bp, Homo sapiens
ctttgccaccctcatgc

SEQ ID NO: 1857827 - DNA, 17 bp, Homo sapiens
ctttgctttaatataaa

SEQ ID NO: 1857828 - DNA, 19 bp, Homo sapiens
ctttggaaagagtaggaag

SEQ ID NO: 1857829 - DNA, 15 bp, Homo sapiens
ctttggaccctgagg

SEQ ID NO: 1857830 - DNA, 24 bp, Homo sapiens
ctttggcaggtgcagcccccactg

SEQ ID NO: 1857831 - DNA, 19 bp, Homo sapiens
ctttggccccactttgaag

SEQ ID NO: 1857832 - DNA, 16 bp, Homo sapiens
ctttggctgcatgcga

SEQ ID NO: 1857833 - DNA, 13 bp, Homo sapiens
ctttgggaggcca

SEQ ID NO: 1857834 - DNA, 22 bp, Homo sapiens
ctttgtccccaccgcagacagg

SEQ ID NO: 1857835 - DNA, 18 bp, Homo sapiens
ctttgttagtttctccaa

SEQ ID NO: 1857836 - DNA, 21 bp, Homo sapiens
ctttgttctggctcttccagg

SEQ ID NO: 1857837 - DNA, 14 bp, Homo sapiens
cttttaattaaatg

SEQ ID NO: 1857838 - DNA, 13 bp, Homo sapiens
cttttcatgcaaa

SEQ ID NO: 1857839 - DNA, 14 bp, Homo sapiens
cttttcatgcaaac

SEQ ID NO: 1857840 - DNA, 13 bp, Homo sapiens
cttttccaaccct

SEQ ID NO: 1857841 - DNA, 23 bp, Homo sapiens
cttttccaaccctcatcaccaac

SEQ ID NO: 1857842 - DNA, 18 bp, Homo sapiens
cttttctgtccgagcttt

SEQ ID NO: 1857843 - DNA, 22 bp, Homo sapiens
cttttgataatcaactgggctg

SEQ ID NO: 1857844 - DNA, 23 bp, Homo sapiens
cttttgataatcaactgggctga

SEQ ID NO: 1857845 - DNA, 20 bp, Homo sapiens
cttttggttaagtctgtttt

SEQ ID NO: 1857846 - DNA, 15 bp, Homo sapiens
ctttttcactttgaa

SEQ ID NO: 1857847 - DNA, 20 bp, Homo sapiens
cttttttggctgctgaaggc

SEQ ID NO: 1857848 - DNA, 17 bp, Homo sapiens
ctttttttttttttccc

SEQ ID NO: 1857849 - DNA, 18 bp, Homo sapiens
gaaaaaaaacctgagatt

SEQ ID NO: 1857850 - DNA, 19 bp, Homo sapiens
gaaaaaatattttcctgcc

SEQ ID NO: 1857851 - DNA, 16 bp, Homo sapiens
gaaaaagaaaaaatat

SEQ ID NO: 1857852 - DNA, 18 bp, Homo sapiens
gaaaacactgttctctgc

SEQ ID NO: 1857853 - DNA, 21 bp, Homo sapiens
gaaaacactgttctctgccct

SEQ ID NO: 1857854 - DNA, 22 bp, Homo sapiens
gaaaacactgttctctgccctc

SEQ ID NO: 1857855 - DNA, 24 bp, Homo sapiens
gaaaacactgttctctgccctcca

SEQ ID NO: 1857856 - DNA, 19 bp, Homo sapiens
gagcgtgagctgagcaggc

SEQ ID NO: 1857857 - DNA, 15 bp, Homo sapiens
gagctagcagcaggg

SEQ ID NO: 1857858 - DNA, 17 bp, Homo sapiens
gagctagcagcagggag

SEQ ID NO: 1857859 - DNA, 23 bp, Homo sapiens
gagctatgatttttttttccaaa

SEQ ID NO: 1857860 - DNA, 20 bp, Homo sapiens
gagctcagagagggcaggca

SEQ ID NO: 1857861 - DNA, 16 bp, Homo sapiens
gagctgacacaggatg

SEQ ID NO: 1857862 - DNA, 20 bp, Homo sapiens
gagctggagcctggtgccct

SEQ ID NO: 1857863 - DNA, 20 bp, Homo sapiens
gagctggccgtgggcctggg

SEQ ID NO: 1857864 - DNA, 14 bp, Homo sapiens
gagctgggagaccc

SEQ ID NO: 1857865 - DNA, 20 bp, Homo sapiens
gagctgggagaccctcccca

SEQ ID NO: 1857866 - DNA, 15 bp, Homo sapiens
gagcttgctccagat

SEQ ID NO: 1857867 - DNA, 21 bp, Homo sapiens
gagcttgctccagattctgat

SEQ ID NO: 1857868 - DNA, 22 bp, Homo sapiens
gagctttctgctatcaaagagg

SEQ ID NO: 1857869 - DNA, 20 bp, Homo sapiens
gagctttgaaaattcagtgg

SEQ ID NO: 1857870 - DNA, 13 bp, Homo sapiens
gaggaagccgctg

SEQ ID NO: 1857871 - DNA, 17 bp, Homo sapiens
gaggaagccgctggggc

SEQ ID NO: 1857872 - DNA, 18 bp, Homo sapiens
gaggaagccgctggggcc

SEQ ID NO: 1857873 - DNA, 19 bp, Homo sapiens
gaggaaggaaacccagctc

SEQ ID NO: 1857874 - DNA, 21 bp, Homo sapiens
gaggaaggaaacccagctctg

SEQ ID NO: 1857875 - DNA, 15 bp, Homo sapiens
gaggagcagtgcagg

SEQ ID NO: 1857876 - DNA, 17 bp, Homo sapiens
gaggatccctctctgga

SEQ ID NO: 1857877 - DNA, 18 bp, Homo sapiens
gaggatgctgacatcatt

SEQ ID NO: 1857878 - DNA, 19 bp, Homo sapiens
gaggatgctgacatcattt

SEQ ID NO: 1857879 - DNA, 23 bp, Homo sapiens
gaggcagtacctgggcaagctgg

SEQ ID NO: 1857880 - DNA, 22 bp, Homo sapiens
gaggccaaggtgggaggattgc

SEQ ID NO: 1857881 - DNA, 11 bp, Homo sapiens
gaggcccagag

SEQ ID NO: 1857882 - DNA, 14 bp, Homo sapiens
gaggcccagagggc

SEQ ID NO: 1857883 - DNA, 19 bp, Homo sapiens
gaggccccttctaggtggc

SEQ ID NO: 1857884 - DNA, 15 bp, Homo sapiens
gaggcccttctctcc

SEQ ID NO: 1857885 - DNA, 21 bp, Homo sapiens
gaggcccttctctccagcccc

SEQ ID NO: 1857886 - DNA, 22 bp, Homo sapiens
gaggcccttctctccagcccct

SEQ ID NO: 1857887 - DNA, 23 bp, Homo sapiens
gaggcccttctctccagcccctg

SEQ ID NO: 1857888 - DNA, 14 bp, Homo sapiens
gaggctctgccctt

SEQ ID NO: 1857889 - DNA, 15 bp, Homo sapiens
gaggctctgcccttg

SEQ ID NO: 1857890 - DNA, 17 bp, Homo sapiens
gaggctctgcccttggt

SEQ ID NO: 1857891 - DNA, 13 bp, Homo sapiens
gaggctgggctcc

SEQ ID NO: 1857892 - DNA, 20 bp, Homo sapiens
gagggagggctccagacaca

SEQ ID NO: 1857893 - DNA, 12 bp, Homo sapiens
gagggcacacac

SEQ ID NO: 1857894 - DNA, 20 bp, Homo sapiens
gagggcacattccttgcctg

SEQ ID NO: 1857895 - DNA, 14 bp, Homo sapiens
gagggcctgcaagg

SEQ ID NO: 1857896 - DNA, 21 bp, Homo sapiens
gagggcctgcaagggagtgag

SEQ ID NO: 1857897 - DNA, 16 bp, Homo sapiens
gaggggacgcaggccc

SEQ ID NO: 1857898 - DNA, 15 bp, Homo sapiens
gagggggtggcctcc

SEQ ID NO: 1857899 - DNA, 17 bp, Homo sapiens
gagggggtggcctccca

SEQ ID NO: 1857900 - DNA, 19 bp, Homo sapiens
gaggtgcgtgttcagcaga

SEQ ID NO: 1857901 - DNA, 20 bp, Homo sapiens
gaggtgcgtgttcagcagaa

SEQ ID NO: 1857902 - DNA, 12 bp, Homo sapiens
gaggtggagaaa

SEQ ID NO: 1857903 - DNA, 13 bp, Homo sapiens
gaggtgggatcct

SEQ ID NO: 1857904 - DNA, 14 bp, Homo sapiens
gaggttccctttga

SEQ ID NO: 1857905 - DNA, 19 bp, Homo sapiens
gaggttttaaaaaaatccc

SEQ ID NO: 1857906 - DNA, 19 bp, Homo sapiens
gagtaggaagactttggaa

SEQ ID NO: 1857907 - DNA, 14 bp, Homo sapiens
gagtattggtctcc

SEQ ID NO: 1857908 - DNA, 12 bp, Homo sapiens
gagtcccctgtt

SEQ ID NO: 1857909 - DNA, 14 bp, Homo sapiens
gagtcccctgtttg

SEQ ID NO: 1857910 - DNA, 13 bp, Homo sapiens
gagtctgaaggct

SEQ ID NO: 1857911 - DNA, 21 bp, Homo sapiens
gagtgacagctttctgggatg

SEQ ID NO: 1857912 - DNA, 22 bp, Homo sapiens
gagtgacagctttctgggatgt

SEQ ID NO: 1857913 - DNA, 10 bp, Homo sapiens
gagtgatctt

SEQ ID NO: 1857914 - DNA, 14 bp, Homo sapiens
gagtgcgtgctcag

SEQ ID NO: 1857915 - DNA, 17 bp, Homo sapiens
gagtgtgcctgaagtcc

SEQ ID NO: 1857916 - DNA, 19 bp, Homo sapiens
gagttcaccttggaagggc

SEQ ID NO: 1857917 - DNA, 22 bp, Homo sapiens
gagttgatagcacagaccctgc

SEQ ID NO: 1857918 - DNA, 15 bp, Homo sapiens
gagttttgtctgtct

SEQ ID NO: 1857919 - DNA, 17 bp, Homo sapiens
gataactgttatttata

SEQ ID NO: 1857920 - DNA, 13 bp, Homo sapiens
gataagaaagcag

SEQ ID NO: 1857921 - DNA, 14 bp, Homo sapiens
gataagaaagcagg

SEQ ID NO: 1857922 - DNA, 20 bp, Homo sapiens
gataagagggcacacactgt

SEQ ID NO: 1857923 - DNA, 17 bp, Homo sapiens
gataatcaactgggctg

SEQ ID NO: 1857924 - DNA, 21 bp, Homo sapiens
gataatcaactgggctgaaca

SEQ ID NO: 1857925 - DNA, 16 bp, Homo sapiens
gatagcacagaccctg

SEQ ID NO: 1857926 - DNA, 19 bp, Homo sapiens
gatagcacagaccctgccc

SEQ ID NO: 1857927 - DNA, 21 bp, Homo sapiens
gatagcacagaccctgccctg

SEQ ID NO: 1857928 - DNA, 16 bp, Homo sapiens
gatatagaacagtgct

SEQ ID NO: 1857929 - DNA, 21 bp, Homo sapiens
gatatatagaaggactgcagc

SEQ ID NO: 1857930 - DNA, 22 bp, Homo sapiens
gatatgtctagggtgtgattta

SEQ ID NO: 1857931 - DNA, 14 bp, Homo sapiens
gatcacagcctctg

SEQ ID NO: 1857932 - DNA, 12 bp, Homo sapiens
gatcagcctggg

SEQ ID NO: 1857933 - DNA, 15 bp, Homo sapiens
gatcagcctgggcaa

SEQ ID NO: 1857934 - DNA, 24 bp, Homo sapiens
gatcccatcttgataagaccacca

SEQ ID NO: 1857935 - DNA, 16 bp, Homo sapiens
gatccctcatcctcat

SEQ ID NO: 1857936 - DNA, 14 bp, Homo sapiens
gatccctctctgga

SEQ ID NO: 1857937 - DNA, 18 bp, Homo sapiens
gatcctagttccaccatc

SEQ ID NO: 1857938 - DNA, 11 bp, Homo sapiens
gatcctccagg

SEQ ID NO: 1857939 - DNA, 14 bp, Homo sapiens
gatcctccaggtgc

SEQ ID NO: 1857940 - DNA, 20 bp, Homo sapiens
gatcgcaagagccatgtaga

SEQ ID NO: 1857941 - DNA, 18 bp, Homo sapiens
gatctaggaagactttgg

SEQ ID NO: 1857942 - DNA, 18 bp, Homo sapiens
gatctcttgagcctggga

SEQ ID NO: 1857943 - DNA, 22 bp, Homo sapiens
gatgaatgtcagttgttattta

SEQ ID NO: 1857944 - DNA, 23 bp, Homo sapiens
gatgagaaataaagtttctgttg

SEQ ID NO: 1857945 - DNA, 17 bp, Homo sapiens
gatgagcatggagctgg

SEQ ID NO: 1857946 - DNA, 13 bp, Homo sapiens
gatgatcctaggc

SEQ ID NO: 1857947 - DNA, 22 bp, Homo sapiens
gatgatttcttgaaaagggtgt

SEQ ID NO: 1857948 - DNA, 12 bp, Homo sapiens
gatgcagcctca

SEQ ID NO: 1857949 - DNA, 15 bp, Homo sapiens
gatgctgacatcatt

SEQ ID NO: 1857950 - DNA, 11 bp, Homo sapiens
gatgctgggat

SEQ ID NO: 1857951 - DNA, 20 bp, Homo sapiens
gatgcttcttcagagactcc

SEQ ID NO: 1857952 - DNA, 15 bp, Homo sapiens
gatggagccccacct

SEQ ID NO: 1857953 - DNA, 16 bp, Homo sapiens
gatggagccccacctt

SEQ ID NO: 1857954 - DNA, 13 bp, Homo sapiens
gatggcaggatgg

SEQ ID NO: 1857955 - DNA, 22 bp, Homo sapiens
gatggcaggatggcctggccag

SEQ ID NO: 1857956 - DNA, 20 bp, Homo sapiens
gatggcatttggtctcaggc

SEQ ID NO: 1857957 - DNA, 14 bp, Homo sapiens
gatggggccctgcc

SEQ ID NO: 1857958 - DNA, 13 bp, Homo sapiens
gatggggctgcac

SEQ ID NO: 1857959 - DNA, 21 bp, Homo sapiens
gatgtatgttgaagcctttgt

SEQ ID NO: 1857960 - DNA, 20 bp, Homo sapiens
gatgtcacagtccaaccaga

SEQ ID NO: 1857961 - DNA, 15 bp, Homo sapiens
gatgtccccagcaga

SEQ ID NO: 1857962 - DNA, 15 bp, Homo sapiens
gatgtcgacatgttt

SEQ ID NO: 1857963 - DNA, 15 bp, Homo sapiens
gatgtgcctgggtgg

SEQ ID NO: 1857964 - DNA, 18 bp, Homo sapiens
gatgttatgaacagctgt

SEQ ID NO: 1857965 - DNA, 23 bp, Homo sapiens
gatgttttccatgagtcccctgt

SEQ ID NO: 1857966 - DNA, 18 bp, Homo sapiens
gattaaccacttcagctg

SEQ ID NO: 1857967 - DNA, 21 bp, Homo sapiens
gattaaccacttcagctgact

SEQ ID NO: 1857968 - DNA, 12 bp, Homo sapiens
gattcacactgt

SEQ ID NO: 1857969 - DNA, 19 bp, Homo sapiens
gattcagacagctgcctgg

SEQ ID NO: 1857970 - DNA, 13 bp, Homo sapiens
gattcagctctgc

SEQ ID NO: 1857971 - DNA, 15 bp, Homo sapiens
gattcagctctgcaa

SEQ ID NO: 1857972 - DNA, 17 bp, Homo sapiens
gattcttcctccctccc

SEQ ID NO: 1857973 - DNA, 16 bp, Homo sapiens
gattctttcctgaggc

SEQ ID NO: 1857974 - DNA, 22 bp, Homo sapiens
gattctttcctgaggctgggct

SEQ ID NO: 1857975 - DNA, 16 bp, Homo sapiens
gattgcaccactgcac

SEQ ID NO: 1857976 - DNA, 23 bp, Homo sapiens
gattgcaccactgcactccagcc

SEQ ID NO: 1857977 - DNA, 16 bp, Homo sapiens
gattgtggaaaaccag

SEQ ID NO: 1857978 - DNA, 20 bp, Homo sapiens
gcgcacaatagtaacctggg

SEQ ID NO: 1857979 - DNA, 13 bp, Homo sapiens
gcgcgccaccacg

SEQ ID NO: 1857980 - DNA, 17 bp, Homo sapiens
gcggctggggtcccagc

SEQ ID NO: 1857981 - DNA, 18 bp, Homo sapiens
gcggctggggtcccagca

SEQ ID NO: 1857982 - DNA, 19 bp, Homo sapiens
gcggtgctatctcccccag

SEQ ID NO: 1857983 - DNA, 21 bp, Homo sapiens
gcggtgtctctcctgcccctt

SEQ ID NO: 1857984 - DNA, 19 bp, Homo sapiens
gcgtctcatactcacctca

SEQ ID NO: 1857985 - DNA, 16 bp, Homo sapiens
gcgtctgctctggtgg

SEQ ID NO: 1857986 - DNA, 12 bp, Homo sapiens
gcgtgaatctgt

SEQ ID NO: 1857987 - DNA, 12 bp, Homo sapiens
gcgtggagctgc

SEQ ID NO: 1857988 - DNA, 16 bp, Homo sapiens
gcgtggagctgcctga

SEQ ID NO: 1857989 - DNA, 15 bp, Homo sapiens
gcgtgtgcaggagcg

SEQ ID NO: 1857990 - DNA, 15 bp, Homo sapiens
gcgtgttcagcagaa

SEQ ID NO: 1857991 - DNA, 20 bp, Homo sapiens
gctaagagggagggagggct

SEQ ID NO: 1857992 - DNA, 17 bp, Homo sapiens
gctaaggcgtggagctg

SEQ ID NO: 1857993 - DNA, 22 bp, Homo sapiens
gctaaggcgtggagctgcctga

SEQ ID NO: 1857994 - DNA, 14 bp, Homo sapiens
gctacacagggatg

SEQ ID NO: 1857995 - DNA, 14 bp, Homo sapiens
gctacccgggaagg

SEQ ID NO: 1857996 - DNA, 22 bp, Homo sapiens
gctagcagcagggagggcttct

SEQ ID NO: 1857997 - DNA, 12 bp, Homo sapiens
gctaggggctgg

SEQ ID NO: 1857998 - DNA, 15 bp, Homo sapiens
gctatctcccccagc

SEQ ID NO: 1857999 - DNA, 22 bp, Homo sapiens
gctcaatacctggcctcattta

SEQ ID NO: 1858000 - DNA, 20 bp, Homo sapiens
gctcaatgagcatgtttaga

SEQ ID NO: 1858001 - DNA, 14 bp, Homo sapiens
gctcacctctccct

SEQ ID NO: 1858002 - DNA, 16 bp, Homo sapiens
gctcacctctcccttg

SEQ ID NO: 1858003 - DNA, 18 bp, Homo sapiens
gctcacctctcccttgga

SEQ ID NO: 1858004 - DNA, 13 bp, Homo sapiens
gctcagagagggt

SEQ ID NO: 1858005 - DNA, 23 bp, Homo sapiens
gctcagcaaaagatgcttctcac

SEQ ID NO: 1858006 - DNA, 17 bp, Homo sapiens
gctcagcactgcctgct

SEQ ID NO: 1858007 - DNA, 20 bp, Homo sapiens
gctcagggcctggctcaggt

SEQ ID NO: 1858008 - DNA, 22 bp, Homo sapiens
gctcaggtggggtcactctggc

SEQ ID NO: 1858009 - DNA, 23 bp, Homo sapiens
gctcaggtggggtcactctggca

SEQ ID NO: 1858010 - DNA, 17 bp, Homo sapiens
gctcagttcagaatcac

SEQ ID NO: 1858011 - DNA, 16 bp, Homo sapiens
gctcatctctgtccca

SEQ ID NO: 1858012 - DNA, 18 bp, Homo sapiens
gctccaaaccctcgaggc

SEQ ID NO: 1858013 - DNA, 16 bp, Homo sapiens
gctccaaatgcagctt

SEQ ID NO: 1858014 - DNA, 14 bp, Homo sapiens
gctccaagctccca

SEQ ID NO: 1858015 - DNA, 18 bp, Homo sapiens
gctccagacacatgtcca

SEQ ID NO: 1858016 - DNA, 13 bp, Homo sapiens
gctccagattctg

SEQ ID NO: 1858017 - DNA, 16 bp, Homo sapiens
gctccagattctgatg

SEQ ID NO: 1858018 - DNA, 16 bp, Homo sapiens
gctccaggagcagcca

SEQ ID NO: 1858019 - DNA, 13 bp, Homo sapiens
gctccaggcaggc

SEQ ID NO: 1858020 - DNA, 17 bp, Homo sapiens
gctcccatcctgtgtgt

SEQ ID NO: 1858021 - DNA, 16 bp, Homo sapiens
gctccccaggccaccc

SEQ ID NO: 1858022 - DNA, 15 bp, Homo sapiens
gctcccttcccacct

SEQ ID NO: 1858023 - DNA, 19 bp, Homo sapiens
gctcccttcccacctctct

SEQ ID NO: 1858024 - DNA, 18 bp, Homo sapiens
gctcctggcccactgcat

SEQ ID NO: 1858025 - DNA, 19 bp, Homo sapiens
gctcctggcccactgcatc

SEQ ID NO: 1858026 - DNA, 17 bp, Homo sapiens
gctcgagcatgcctgga

SEQ ID NO: 1858027 - DNA, 19 bp, Homo sapiens
gctcgagcatgcctggatg

SEQ ID NO: 1858028 - DNA, 17 bp, Homo sapiens
gctctctgacgcttgtg

SEQ ID NO: 1858029 - DNA, 18 bp, Homo sapiens
gctctctgacgcttgtga

SEQ ID NO: 1858030 - DNA, 22 bp, Homo sapiens
gctctgccaacttcttcagagc

SEQ ID NO: 1858031 - DNA, 23 bp, Homo sapiens
gctctgccaacttcttcagagct

SEQ ID NO: 1858032 - DNA, 13 bp, Homo sapiens
gctctgcctccca

SEQ ID NO: 1858033 - DNA, 15 bp, Homo sapiens
gctctgcctcccatc

SEQ ID NO: 1858034 - DNA, 15 bp, Homo sapiens
gctctgtccccagcc

SEQ ID NO: 1858035 - DNA, 12 bp, Homo sapiens
gctcttccaggc

SEQ ID NO: 1858036 - DNA, 13 bp, Homo sapiens
gctctttgagaaa

SEQ ID NO: 1858037 - DNA, 15 bp, Homo sapiens
gctgaactcatgaga

SEQ ID NO: 1858038 - DNA, 12 bp, Homo sapiens
gctgaaggctcg

SEQ ID NO: 1858039 - DNA, 22 bp, Homo sapiens
gctgactgttttctcttgagag

SEQ ID NO: 1858040 - DNA, 12 bp, Homo sapiens
gctgagcaggcc

SEQ ID NO: 1858041 - DNA, 13 bp, Homo sapiens
gctgaggcccagt

SEQ ID NO: 1858042 - DNA, 17 bp, Homo sapiens
gctgaggcccagtgcat

SEQ ID NO: 1858043 - DNA, 19 bp, Homo sapiens
gctgaggcccagtgcatat

SEQ ID NO: 1858044 - DNA, 15 bp, Homo sapiens
gctgaggtgggagga

SEQ ID NO: 1858045 - DNA, 18 bp, Homo sapiens
gctgagtctgaaggctgg

SEQ ID NO: 1858046 - DNA, 15 bp, Homo sapiens
gctgatggagcccca

SEQ ID NO: 1858047 - DNA, 17 bp, Homo sapiens
gctgatggagccccacc

SEQ ID NO: 1858048 - DNA, 19 bp, Homo sapiens
gctgatggagccccacctt

SEQ ID NO: 1858049 - DNA, 20 bp, Homo sapiens
gctgatgtcctcaccacatg

SEQ ID NO: 1858050 - DNA, 21 bp, Homo sapiens
gctgattctcagggtctctgc

SEQ ID NO: 1858051 - DNA, 13 bp, Homo sapiens
gctgcaccctcag

SEQ ID NO: 1858052 - DNA, 16 bp, Homo sapiens
gctgcaccctcaggca

SEQ ID NO: 1858053 - DNA, 19 bp, Homo sapiens
gctgcaccggctggcctgg

SEQ ID NO: 1858054 - DNA, 14 bp, Homo sapiens
gctgcagttgccag

SEQ ID NO: 1858055 - DNA, 17 bp, Homo sapiens
gctgcagttgccagtca

SEQ ID NO: 1858056 - DNA, 20 bp, Homo sapiens
gctgcagttgccagtcaccc

SEQ ID NO: 1858057 - DNA, 12 bp, Homo sapiens
gctgcccaggcc

SEQ ID NO: 1858058 - DNA, 12 bp, Homo sapiens
gctgccctgccc

SEQ ID NO: 1858059 - DNA, 23 bp, Homo sapiens
gctgccctgcccacctggcctct

SEQ ID NO: 1858060 - DNA, 12 bp, Homo sapiens
gctgccctgtga

SEQ ID NO: 1858061 - DNA, 14 bp, Homo sapiens
gctgccctgtgagt

SEQ ID NO: 1858062 - DNA, 17 bp, Homo sapiens
gctgccggggcagcccc

SEQ ID NO: 1858063 - DNA, 13 bp, Homo sapiens
gctgcctgggatc

SEQ ID NO: 1858064 - DNA, 19 bp, Homo sapiens
gctgcctgggatccctcat

SEQ ID NO: 1858065 - DNA, 18 bp, Homo sapiens
gctgctaatattttcctc

SEQ ID NO: 1858066 - DNA, 13 bp, Homo sapiens
gctgctccccagg

SEQ ID NO: 1858067 - DNA, 17 bp, Homo sapiens
gctgctccccaggccac

SEQ ID NO: 1858068 - DNA, 15 bp, Homo sapiens
gctgctgcccaggcc

SEQ ID NO: 1858069 - DNA, 21 bp, Homo sapiens
gctggaacagattcacactgt

SEQ ID NO: 1858070 - DNA, 19 bp, Homo sapiens
gctggatagacttgggatg

SEQ ID NO: 1858071 - DNA, 14 bp, Homo sapiens
gctggccaggctgg

SEQ ID NO: 1858072 - DNA, 16 bp, Homo sapiens
gctgggaactcacctg

SEQ ID NO: 1858073 - DNA, 18 bp, Homo sapiens
gctgggaactcacctggg

SEQ ID NO: 1858074 - DNA, 16 bp, Homo sapiens
gctgggctcccttccc

SEQ ID NO: 1858075 - DNA, 17 bp, Homo sapiens
gctgggctcccttccca

SEQ ID NO: 1858076 - DNA, 19 bp, Homo sapiens
gctggggccaaataaagtc

SEQ ID NO: 1858077 - DNA, 14 bp, Homo sapiens
gctgggtggcactg

SEQ ID NO: 1858078 - DNA, 20 bp, Homo sapiens
gctggtctcgaactgctgga

SEQ ID NO: 1858079 - DNA, 21 bp, Homo sapiens
gctggttagaggttccctttg

SEQ ID NO: 1858080 - DNA, 13 bp, Homo sapiens
gctgtgctgccct

SEQ ID NO: 1858081 - DNA, 14 bp, Homo sapiens
gctgtgctgccctg

SEQ ID NO: 1858082 - DNA, 20 bp, Homo sapiens
gctgtgtctgccaaacacat

SEQ ID NO: 1858083 - DNA, 13 bp, Homo sapiens
gctgttcagctgg

SEQ ID NO: 1858084 - DNA, 20 bp, Homo sapiens
gcttaagtgagcagaacagg

SEQ ID NO: 1858085 - DNA, 18 bp, Homo sapiens
gcttagctttgctctgcc

SEQ ID NO: 1858086 - DNA, 14 bp, Homo sapiens
gcttatttaataaa

SEQ ID NO: 1858087 - DNA, 15 bp, Homo sapiens
gcttcacggaagagc

SEQ ID NO: 1858088 - DNA, 17 bp, Homo sapiens
gcttcacggaagagcct

SEQ ID NO: 1858089 - DNA, 16 bp, Homo sapiens
gcttcattagagcagg

SEQ ID NO: 1858090 - DNA, 21 bp, Homo sapiens
gcttccacaggcaaaactcag

SEQ ID NO: 1858091 - DNA, 18 bp, Homo sapiens
gcttccagtgaggctctg

SEQ ID NO: 1858092 - DNA, 22 bp, Homo sapiens
gcttccagtgaggctctgccct

SEQ ID NO: 1858093 - DNA, 23 bp, Homo sapiens
gcttccagtgaggctctgccctt

SEQ ID NO: 1858094 - DNA, 20 bp, Homo sapiens
gcttcccagtggctgctgcc

SEQ ID NO: 1858095 - DNA, 22 bp, Homo sapiens
gcttcctcagtaacatttctgt

SEQ ID NO: 1858096 - DNA, 22 bp, Homo sapiens
gcttctgagcagcgagcctgct

SEQ ID NO: 1858097 - DNA, 23 bp, Homo sapiens
gcttcttcagagactcctgcagg

SEQ ID NO: 1858098 - DNA, 22 bp, Homo sapiens
gcttgctccagattctgatgca

SEQ ID NO: 1858099 - DNA, 21 bp, Homo sapiens
gcttgcttttcatgcaaactc

SEQ ID NO: 1858100 - DNA, 15 bp, Homo sapiens
gtcaagtgaaaaagg

SEQ ID NO: 1858101 - DNA, 22 bp, Homo sapiens
gtcaatccaagagtctgatgat

SEQ ID NO: 1858102 - DNA, 21 bp, Homo sapiens
gtcacagtccaaccagaaaca

SEQ ID NO: 1858103 - DNA, 18 bp, Homo sapiens
gtcaccccggccacctgc

SEQ ID NO: 1858104 - DNA, 22 bp, Homo sapiens
gtcacgtggaggagcagtgcag

SEQ ID NO: 1858105 - DNA, 15 bp, Homo sapiens
gtcactgagacagcc

SEQ ID NO: 1858106 - DNA, 18 bp, Homo sapiens
gtcactgagacagcccgg

SEQ ID NO: 1858107 - DNA, 17 bp, Homo sapiens
gtcactttgttttactg

SEQ ID NO: 1858108 - DNA, 22 bp, Homo sapiens
gtcactttttttttttttcccc

SEQ ID NO: 1858109 - DNA, 18 bp, Homo sapiens
gtcaggagtgtgtgtgag

SEQ ID NO: 1858110 - DNA, 24 bp, Homo sapiens
gtcagtgtccaaagcagggtctgg

SEQ ID NO: 1858111 - DNA, 18 bp, Homo sapiens
gtcagttgttatttattg

SEQ ID NO: 1858112 - DNA, 23 bp, Homo sapiens
gtcatctgtaagagcttgctcca

SEQ ID NO: 1858113 - DNA, 17 bp, Homo sapiens
gtcattatgttaatatt

SEQ ID NO: 1858114 - DNA, 22 bp, Homo sapiens
gtccaaggaaaccacagctgct

SEQ ID NO: 1858115 - DNA, 15 bp, Homo sapiens
gtcccaccccacaca

SEQ ID NO: 1858116 - DNA, 21 bp, Homo sapiens
gtcccaccccacacacgccag

SEQ ID NO: 1858117 - DNA, 14 bp, Homo sapiens
gtcccagcagctgc

SEQ ID NO: 1858118 - DNA, 12 bp, Homo sapiens
gtcccagtgccg

SEQ ID NO: 1858119 - DNA, 13 bp, Homo sapiens
gtccccagcctgg

SEQ ID NO: 1858120 - DNA, 16 bp, Homo sapiens
gtcccccttccatgga

SEQ ID NO: 1858121 - DNA, 19 bp, Homo sapiens
gtccctgggagggacatgc

SEQ ID NO: 1858122 - DNA, 19 bp, Homo sapiens
gtccctggtggcagctcac

SEQ ID NO: 1858123 - DNA, 14 bp, Homo sapiens
gtcctcccatctca

SEQ ID NO: 1858124 - DNA, 23 bp, Homo sapiens
gtcctcccatctcacacatgagc

SEQ ID NO: 1858125 - DNA, 16 bp, Homo sapiens
gtcctgctgcagttgc

SEQ ID NO: 1858126 - DNA, 18 bp, Homo sapiens
gtccttaccagcagagca

SEQ ID NO: 1858127 - DNA, 19 bp, Homo sapiens
gtccttaccagcagagcac

SEQ ID NO: 1858128 - DNA, 17 bp, Homo sapiens
gtcgcacccacagcgaa

SEQ ID NO: 1858129 - DNA, 15 bp, Homo sapiens
gtcgggagaggggac

SEQ ID NO: 1858130 - DNA, 21 bp, Homo sapiens
gtcgggagaggggacgcaggc

SEQ ID NO: 1858131 - DNA, 22 bp, Homo sapiens
gtcgggagaggggacgcaggcc

SEQ ID NO: 1858132 - DNA, 13 bp, Homo sapiens
gtctacctgaggg

SEQ ID NO: 1858133 - DNA, 16 bp, Homo sapiens
gtctaggactgcagtg

SEQ ID NO: 1858134 - DNA, 18 bp, Homo sapiens
gtctatataaccacattt

SEQ ID NO: 1858135 - DNA, 17 bp, Homo sapiens
gtctattatcacattaa

SEQ ID NO: 1858136 - DNA, 22 bp, Homo sapiens
gtctcagtgtcctcatctgtaa

SEQ ID NO: 1858137 - DNA, 16 bp, Homo sapiens
gtctccctcccctctc

SEQ ID NO: 1858138 - DNA, 22 bp, Homo sapiens
gtctccctcccctctcagaaca

SEQ ID NO: 1858139 - DNA, 16 bp, Homo sapiens
gtctccttaacactga

SEQ ID NO: 1858140 - DNA, 22 bp, Homo sapiens
gtctccttaacactgagctgtc

SEQ ID NO: 1858141 - DNA, 15 bp, Homo sapiens
gtctctaggctgggg

SEQ ID NO: 1858142 - DNA, 15 bp, Homo sapiens
gtctctgaagtgaaa

SEQ ID NO: 1858143 - DNA, 13 bp, Homo sapiens
gtctctgctgccg

SEQ ID NO: 1858144 - DNA, 14 bp, Homo sapiens
gtctctgctgccgc

SEQ ID NO: 1858145 - DNA, 12 bp, Homo sapiens
gtctctggcctg

SEQ ID NO: 1858146 - DNA, 19 bp, Homo sapiens
gtctcttggtcctgctgca

SEQ ID NO: 1858147 - DNA, 14 bp, Homo sapiens
gtctgaaggctggg

SEQ ID NO: 1858148 - DNA, 13 bp, Homo sapiens
gtctgccaaacac

SEQ ID NO: 1858149 - DNA, 17 bp, Homo sapiens
gtctgctaaataaacat

SEQ ID NO: 1858150 - DNA, 16 bp, Homo sapiens
gtctgctctggtggct

SEQ ID NO: 1858151 - DNA, 14 bp, Homo sapiens
gtctggcccttcct

SEQ ID NO: 1858152 - DNA, 17 bp, Homo sapiens
gtctggtttcaccgagg

SEQ ID NO: 1858153 - DNA, 18 bp, Homo sapiens
gtctgtgccattttgtat

SEQ ID NO: 1858154 - DNA, 21 bp, Homo sapiens
gtcttaaaaagtggaaaaata

SEQ ID NO: 1858155 - DNA, 15 bp, Homo sapiens
gtcttatcaagcagc

SEQ ID NO: 1858156 - DNA, 16 bp, Homo sapiens
gtcttattcccttcct

SEQ ID NO: 1858157 - DNA, 23 bp, Homo sapiens
gtcttcatacctacatgtatttg

SEQ ID NO: 1858158 - DNA, 14 bp, Homo sapiens
gtgaaaagaaaaat

SEQ ID NO: 1858159 - DNA, 23 bp, Homo sapiens
gtgaaactgcttgtttcctagca

SEQ ID NO: 1858160 - DNA, 23 bp, Homo sapiens
gtgaataatacagtatctcaggg

SEQ ID NO: 1858161 - DNA, 19 bp, Homo sapiens
gtgacagctttctgggatg

SEQ ID NO: 1858162 - DNA, 14 bp, Homo sapiens
gtgacaggcagcag

SEQ ID NO: 1858163 - DNA, 22 bp, Homo sapiens
gtgacatgtgttggcagcctct

SEQ ID NO: 1858164 - DNA, 21 bp, Homo sapiens
gtgacatttatttttctcatg

SEQ ID NO: 1858165 - DNA, 19 bp, Homo sapiens
gtgactgtatctgtgtaga

SEQ ID NO: 1858166 - DNA, 18 bp, Homo sapiens
gtgactttggctgcatgc

SEQ ID NO: 1858167 - DNA, 20 bp, Homo sapiens
gtgactttggctgcatgcga

SEQ ID NO: 1858168 - DNA, 20 bp, Homo sapiens
gtgagacagtccagcctgga

SEQ ID NO: 1858169 - DNA, 22 bp, Homo sapiens
gtgagaccctgtctcaaaaaaa

SEQ ID NO: 1858170 - DNA, 16 bp, Homo sapiens
gtgagctgagcaggcc

SEQ ID NO: 1858171 - DNA, 23 bp, Homo sapiens
gtgagctggatagacttgggatg

SEQ ID NO: 1858172 - DNA, 17 bp, Homo sapiens
gtgaggctctgcccttg

SEQ ID NO: 1858173 - DNA, 18 bp, Homo sapiens
gtgaggctctgcccttgg

SEQ ID NO: 1858174 - DNA, 19 bp, Homo sapiens
gtgagtactacagtcctcc

SEQ ID NO: 1858175 - DNA, 21 bp, Homo sapiens
gtgagtactacagtcctccca

SEQ ID NO: 1858176 - DNA, 23 bp, Homo sapiens
gtgagtactacagtcctcccatc

SEQ ID NO: 1858177 - DNA, 17 bp, Homo sapiens
gtgagttgatagcacag

SEQ ID NO: 1858178 - DNA, 14 bp, Homo sapiens
gtgatgcattttat

SEQ ID NO: 1858179 - DNA, 12 bp, Homo sapiens
gtgatgcggcag

SEQ ID NO: 1858180 - DNA, 13 bp, Homo sapiens
gtgatgcggcaga

SEQ ID NO: 1858181 - DNA, 18 bp, Homo sapiens
gtgatggggccctgcctc

SEQ ID NO: 1858182 - DNA, 14 bp, Homo sapiens
gtgattatatttca

SEQ ID NO: 1858183 - DNA, 16 bp, Homo sapiens
gtgattgggacagagg

SEQ ID NO: 1858184 - DNA, 12 bp, Homo sapiens
gtgattttcatt

SEQ ID NO: 1858185 - DNA, 16 bp, Homo sapiens
gtgatttttaaattaa

SEQ ID NO: 1858186 - DNA, 15 bp, Homo sapiens
gtgcaacagacaagt

SEQ ID NO: 1858187 - DNA, 17 bp, Homo sapiens
gtgcaatgtgtataaac

SEQ ID NO: 1858188 - DNA, 19 bp, Homo sapiens
gtgcaatgtgtataaacaa

SEQ ID NO: 1858189 - DNA, 23 bp, Homo sapiens
gtgcaatgtgtataaacaagaaa

SEQ ID NO: 1858190 - DNA, 23 bp, Homo sapiens
gtgcacaagctccaagctcccag

SEQ ID NO: 1858191 - DNA, 13 bp, Homo sapiens
gtgcacccacctg

SEQ ID NO: 1858192 - DNA, 15 bp, Homo sapiens
gtgcacttttctgtg

SEQ ID NO: 1858193 - DNA, 18 bp, Homo sapiens
gtgccaacactcaagaag

SEQ ID NO: 1858194 - DNA, 23 bp, Homo sapiens
gtgccaacactcaagaagcaggc

SEQ ID NO: 1858195 - DNA, 21 bp, Homo sapiens
gtgccacccatgcagctgctc

SEQ ID NO: 1858196 - DNA, 15 bp, Homo sapiens
gtgccgacagaagga

SEQ ID NO: 1858197 - DNA, 22 bp, Homo sapiens
gtgccgagaaggaagcctccca

SEQ ID NO: 1858198 - DNA, 19 bp, Homo sapiens
gtgcgtgttcagcagaacc

SEQ ID NO: 1858199 - DNA, 17 bp, Homo sapiens
gtgctaggaacactcct

SEQ ID NO: 1858200 - DNA, 22 bp, Homo sapiens
gtgctaggaacactccttcaca

SEQ ID NO: 1858201 - DNA, 22 bp, Homo sapiens
gtgctatctcccccagccccat

SEQ ID NO: 1858202 - DNA, 16 bp, Homo sapiens
gtgctcatttcaggat

SEQ ID NO: 1858203 - DNA, 16 bp, Homo sapiens
gtgctctttgttttgt

SEQ ID NO: 1858204 - DNA, 12 bp, Homo sapiens
gtgctgagtctg

SEQ ID NO: 1858205 - DNA, 18 bp, Homo sapiens
gtgctgagtctgaaggct

SEQ ID NO: 1858206 - DNA, 11 bp, Homo sapiens
gtgctgccctg

SEQ ID NO: 1858207 - DNA, 13 bp, Homo sapiens
gtgctgccctgcc

SEQ ID NO: 1858208 - DNA, 15 bp, Homo sapiens
gtgctgccctgccca

SEQ ID NO: 1858209 - DNA, 20 bp, Homo sapiens
gtgctgccctgcccacctgg

SEQ ID NO: 1858210 - DNA, 23 bp, Homo sapiens
gtgctgccctgcccacctggcct

SEQ ID NO: 1858211 - DNA, 12 bp, Homo sapiens
gtgcttggagga

SEQ ID NO: 1858212 - DNA, 18 bp, Homo sapiens
gtggaaaaatagcctgcc

SEQ ID NO: 1858213 - DNA, 15 bp, Homo sapiens
gtggaaaaccaggaa

SEQ ID NO: 1858214 - DNA, 17 bp, Homo sapiens
gtggagaaaattggaac

SEQ ID NO: 1858215 - DNA, 18 bp, Homo sapiens
gtggagaggcccggcctc

SEQ ID NO: 1858216 - DNA, 21 bp, Homo sapiens
gtggagatcccacatatttca

SEQ ID NO: 1858217 - DNA, 23 bp, Homo sapiens
gtggagggcacattccttgcctg

SEQ ID NO: 1858218 - DNA, 12 bp, Homo sapiens
gtggagttcacc

SEQ ID NO: 1858219 - DNA, 19 bp, Homo sapiens
gtggcaccagcagcctgga

SEQ ID NO: 1858220 - DNA, 16 bp, Homo sapiens
gtggcacctcttccga

SEQ ID NO: 1858221 - DNA, 18 bp, Homo sapiens
tcacgattgtcatcagga

SEQ ID NO: 1858222 - DNA, 19 bp, Homo sapiens
tcacgcctgtaatcctagc

SEQ ID NO: 1858223 - DNA, 17 bp, Homo sapiens
tcacggaagagccttgc

SEQ ID NO: 1858224 - DNA, 21 bp, Homo sapiens
tcacgtggaggagcagtgcag

SEQ ID NO: 1858225 - DNA, 17 bp, Homo sapiens
tcactcatacatctggc

SEQ ID NO: 1858226 - DNA, 12 bp, Homo sapiens
tcactctggcag

SEQ ID NO: 1858227 - DNA, 13 bp, Homo sapiens
tcactctggcagc

SEQ ID NO: 1858228 - DNA, 17 bp, Homo sapiens
tcactctggcagctcag

SEQ ID NO: 1858229 - DNA, 20 bp, Homo sapiens
tcactctggcagctcagaga

SEQ ID NO: 1858230 - DNA, 21 bp, Homo sapiens
tcactgaactttgctgagcct

SEQ ID NO: 1858231 - DNA, 13 bp, Homo sapiens
tcactgagacagc

SEQ ID NO: 1858232 - DNA, 16 bp, Homo sapiens
tcactgagacagcccg

SEQ ID NO: 1858233 - DNA, 17 bp, Homo sapiens
tcacttctgagaactca

SEQ ID NO: 1858234 - DNA, 10 bp, Homo sapiens
tcacttgagt

SEQ ID NO: 1858235 - DNA, 19 bp, Homo sapiens
tcacttgtcaggagtgtgt

SEQ ID NO: 1858236 - DNA, 19 bp, Homo sapiens
tcacttgtgccaacactca

SEQ ID NO: 1858237 - DNA, 11 bp, Homo sapiens
tcactttgaaa

SEQ ID NO: 1858238 - DNA, 22 bp, Homo sapiens
tcactttgaaaagttggaagga

SEQ ID NO: 1858239 - DNA, 13 bp, Homo sapiens
tcacttttttcca

SEQ ID NO: 1858240 - DNA, 15 bp, Homo sapiens
tcacttttttccaca

SEQ ID NO: 1858241 - DNA, 10 bp, Homo sapiens
tcagaacata

SEQ ID NO: 1858242 - DNA, 13 bp, Homo sapiens
tcagacagctgcc

SEQ ID NO: 1858243 - DNA, 15 bp, Homo sapiens
tcagacagctgcctg

SEQ ID NO: 1858244 - DNA, 23 bp, Homo sapiens
tcagagactcctgcaggcagcca

SEQ ID NO: 1858245 - DNA, 16 bp, Homo sapiens
tcagagagggtgggag

SEQ ID NO: 1858246 - DNA, 23 bp, Homo sapiens
tcagagagggtgggagtgggccc

SEQ ID NO: 1858247 - DNA, 23 bp, Homo sapiens
tcagaggtgaaagctatatcaat

SEQ ID NO: 1858248 - DNA, 15 bp, Homo sapiens
tcagataactgttat

SEQ ID NO: 1858249 - DNA, 14 bp, Homo sapiens
tcagattccccact

SEQ ID NO: 1858250 - DNA, 20 bp, Homo sapiens
tcagattccccactcagcct

SEQ ID NO: 1858251 - DNA, 18 bp, Homo sapiens
tcagcactgcctgctccc

SEQ ID NO: 1858252 - DNA, 22 bp, Homo sapiens
tcagcactgcctgctcccatcc

SEQ ID NO: 1858253 - DNA, 19 bp, Homo sapiens
tcagcagaacctgcacaca

SEQ ID NO: 1858254 - DNA, 16 bp, Homo sapiens
tcagcccaagatgctt

SEQ ID NO: 1858255 - DNA, 16 bp, Homo sapiens
tcagcctgctccagct

SEQ ID NO: 1858256 - DNA, 18 bp, Homo sapiens
tcagcctgctccagctgt

SEQ ID NO: 1858257 - DNA, 14 bp, Homo sapiens
tcagccttgcaaat

SEQ ID NO: 1858258 - DNA, 19 bp, Homo sapiens
tcagctacaattgtaaact

SEQ ID NO: 1858259 - DNA, 15 bp, Homo sapiens
tcagcttggcactca

SEQ ID NO: 1858260 - DNA, 12 bp, Homo sapiens
tcaggaagctca

SEQ ID NO: 1858261 - DNA, 20 bp, Homo sapiens
tcaggaagctcagggcctgg

SEQ ID NO: 1858262 - DNA, 23 bp, Homo sapiens
tcaggaagctcagggcctggctc

SEQ ID NO: 1858263 - DNA, 13 bp, Homo sapiens
tcaggaccaggca

SEQ ID NO: 1858264 - DNA, 14 bp, Homo sapiens
tcaggaccaggcaa

SEQ ID NO: 1858265 - DNA, 12 bp, Homo sapiens
tcaggagaaaaa

SEQ ID NO: 1858266 - DNA, 15 bp, Homo sapiens
tcaggcagcaccaca

SEQ ID NO: 1858267 - DNA, 23 bp, Homo sapiens
tcaggcagcaccacactgggtgc

SEQ ID NO: 1858268 - DNA, 17 bp, Homo sapiens
tcaggcaggtgggatgg

SEQ ID NO: 1858269 - DNA, 11 bp, Homo sapiens
tcaggccaggc

SEQ ID NO: 1858270 - DNA, 14 bp, Homo sapiens
tcaggccaggccct

SEQ ID NO: 1858271 - DNA, 15 bp, Homo sapiens
tcaggccaggccctc

SEQ ID NO: 1858272 - DNA, 18 bp, Homo sapiens
tcaggccaggccctctgc

SEQ ID NO: 1858273 - DNA, 20 bp, Homo sapiens
tcaggccaggccctctgccc

SEQ ID NO: 1858274 - DNA, 22 bp, Homo sapiens
tcaggccaggccctctgcccac

SEQ ID NO: 1858275 - DNA, 23 bp, Homo sapiens
tcaggccaggccctctgcccact

SEQ ID NO: 1858276 - DNA, 19 bp, Homo sapiens
tcaggggtgtgcggccttt

SEQ ID NO: 1858277 - DNA, 19 bp, Homo sapiens
tcagggtccctggtggcag

SEQ ID NO: 1858278 - DNA, 12 bp, Homo sapiens
tcagggtctctg

SEQ ID NO: 1858279 - DNA, 23 bp, Homo sapiens
tcaggtgagaagcagaggaagga

SEQ ID NO: 1858280 - DNA, 12 bp, Homo sapiens
tcaggtgctgaa

SEQ ID NO: 1858281 - DNA, 21 bp, Homo sapiens
tcaggtggggtcactctggca

SEQ ID NO: 1858282 - DNA, 23 bp, Homo sapiens
tcaggtggggtcactctggcagc

SEQ ID NO: 1858283 - DNA, 13 bp, Homo sapiens
tcagtaagacgac

SEQ ID NO: 1858284 - DNA, 15 bp, Homo sapiens
tcagtattgaagcat

SEQ ID NO: 1858285 - DNA, 16 bp, Homo sapiens
tcagtattgaagcatt

SEQ ID NO: 1858286 - DNA, 15 bp, Homo sapiens
tcagtctggcccttc

SEQ ID NO: 1858287 - DNA, 15 bp, Homo sapiens
tcagttactcttcag

SEQ ID NO: 1858288 - DNA, 20 bp, Homo sapiens
tcagttcctgcccttggcct

SEQ ID NO: 1858289 - DNA, 15 bp, Homo sapiens
tcagttgttatttat

SEQ ID NO: 1858290 - DNA, 13 bp, Homo sapiens
tcatacccacccc

SEQ ID NO: 1858291 - DNA, 20 bp, Homo sapiens
tcatacccacccccacccaa

SEQ ID NO: 1858292 - DNA, 21 bp, Homo sapiens
tcatacccacccccacccaag

SEQ ID NO: 1858293 - DNA, 15 bp, Homo sapiens
tcatacctacatgta

SEQ ID NO: 1858294 - DNA, 16 bp, Homo sapiens
tcatacctacatgtat

SEQ ID NO: 1858295 - DNA, 15 bp, Homo sapiens
tcatactcacctcac

SEQ ID NO: 1858296 - DNA, 20 bp, Homo sapiens
tcatatgacattcatgcctg

SEQ ID NO: 1858297 - DNA, 19 bp, Homo sapiens
tcatcaagactggaaggtg

SEQ ID NO: 1858298 - DNA, 15 bp, Homo sapiens
tcatcaaggcactgc

SEQ ID NO: 1858299 - DNA, 15 bp, Homo sapiens
tcatcacaaatggct

SEQ ID NO: 1858300 - DNA, 21 bp, Homo sapiens
tcatcaccaacgtctgtgcca

SEQ ID NO: 1858301 - DNA, 14 bp, Homo sapiens
tcatcagtattgaa

SEQ ID NO: 1858302 - DNA, 21 bp, Homo sapiens
tcatcagtattgaagcatttt

SEQ ID NO: 1858303 - DNA, 21 bp, Homo sapiens
tcatccagggctctgaccagt

SEQ ID NO: 1858304 - DNA, 18 bp, Homo sapiens
tcatctcctttgcagaat

SEQ ID NO: 1858305 - DNA, 23 bp, Homo sapiens
tcatcttaggttggcaaaaaggc

SEQ ID NO: 1858306 - DNA, 13 bp, Homo sapiens
tcatgcctggctt

SEQ ID NO: 1858307 - DNA, 21 bp, Homo sapiens
tcatgttttaaagcttgctca

SEQ ID NO: 1858308 - DNA, 15 bp, Homo sapiens
tcattagagcaggcg

SEQ ID NO: 1858309 - DNA, 14 bp, Homo sapiens
tcattccattctgg

SEQ ID NO: 1858310 - DNA, 14 bp, Homo sapiens
tcattgacctgagg

SEQ ID NO: 1858311 - DNA, 15 bp, Homo sapiens
tcattgacctgaggc

SEQ ID NO: 1858312 - DNA, 19 bp, Homo sapiens
tcattgacctgaggccctt

SEQ ID NO: 1858313 - DNA, 21 bp, Homo sapiens
tcattggaaatttagcattgt

SEQ ID NO: 1858314 - DNA, 22 bp, Homo sapiens
tcattttgcacctgcagccaag

SEQ ID NO: 1858315 - DNA, 13 bp, Homo sapiens
tccaaagagtgct

SEQ ID NO: 1858316 - DNA, 23 bp, Homo sapiens
tccaaagagtgctaagcattagc

SEQ ID NO: 1858317 - DNA, 13 bp, Homo sapiens
tccaaagcagggt

SEQ ID NO: 1858318 - DNA, 23 bp, Homo sapiens
tccaaaggaataacctttctgga

SEQ ID NO: 1858319 - DNA, 22 bp, Homo sapiens
tccaaaggccatggagagctgg

SEQ ID NO: 1858320 - DNA, 15 bp, Homo sapiens
tccaaatgcagcttt

SEQ ID NO: 1858321 - DNA, 14 bp, Homo sapiens
tccaaccctcatca

SEQ ID NO: 1858322 - DNA, 16 bp, Homo sapiens
tccaaccctcatcacc

SEQ ID NO: 1858323 - DNA, 17 bp, Homo sapiens
tccaaccctcatcacca

SEQ ID NO: 1858324 - DNA, 15 bp, Homo sapiens
tccaagaagcccagg

SEQ ID NO: 1858325 - DNA, 20 bp, Homo sapiens
tccaagaagcccaggaaagg

SEQ ID NO: 1858326 - DNA, 19 bp, Homo sapiens
tccaaggaaaccacagctg

SEQ ID NO: 1858327 - DNA, 17 bp, Homo sapiens
tccaattttaaaatgaa

SEQ ID NO: 1858328 - DNA, 22 bp, Homo sapiens
tccaattttaaaatgaaatgca

SEQ ID NO: 1858329 - DNA, 16 bp, Homo sapiens
tccacaggcttctgag

SEQ ID NO: 1858330 - DNA, 18 bp, Homo sapiens
tccacataaggaaactgg

SEQ ID NO: 1858331 - DNA, 15 bp, Homo sapiens
tccaccatcaagcca

SEQ ID NO: 1858332 - DNA, 18 bp, Homo sapiens
tccaccatcaagccacca

SEQ ID NO: 1858333 - DNA, 14 bp, Homo sapiens
tccactcccaggca

SEQ ID NO: 1858334 - DNA, 13 bp, Homo sapiens
tccagacacatgt

SEQ ID NO: 1858335 - DNA, 16 bp, Homo sapiens
tccagattctgatgca

SEQ ID NO: 1858336 - DNA, 13 bp, Homo sapiens
tccagccagggct

SEQ ID NO: 1858337 - DNA, 16 bp, Homo sapiens
tccagcccctggatgc

SEQ ID NO: 1858338 - DNA, 21 bp, Homo sapiens
tccagcccctggatgcagcct

SEQ ID NO: 1858339 - DNA, 15 bp, Homo sapiens
tccagccctggctga

SEQ ID NO: 1858340 - DNA, 20 bp, Homo sapiens
tccagccctggctgaaggac

SEQ ID NO: 1858341 - DNA, 21 bp, Homo sapiens
tccagccctggctgaaggact

SEQ ID NO: 1858342 - DNA, 11 bp, Homo sapiens
tccagcctggg

SEQ ID NO: 1858343 - DNA, 22 bp, Homo sapiens
tgagcatcaggccaggccctct

SEQ ID NO: 1858344 - DNA, 24 bp, Homo sapiens
tgagcatcaggccaggccctctgc

SEQ ID NO: 1858345 - DNA, 23 bp, Homo sapiens
tgagcatcgcttaggagaagtct

SEQ ID NO: 1858346 - DNA, 18 bp, Homo sapiens
tgagcatggagctggccg

SEQ ID NO: 1858347 - DNA, 14 bp, Homo sapiens
tgagcctgggaggt

SEQ ID NO: 1858348 - DNA, 14 bp, Homo sapiens
tgaggaagccgctg

SEQ ID NO: 1858349 - DNA, 18 bp, Homo sapiens
tgaggaagccgctggggc

SEQ ID NO: 1858350 - DNA, 13 bp, Homo sapiens
tgaggattgtgga

SEQ ID NO: 1858351 - DNA, 17 bp, Homo sapiens
tgaggattgtggaaaac

SEQ ID NO: 1858352 - DNA, 17 bp, Homo sapiens
tgaggcccagagggcct

SEQ ID NO: 1858353 - DNA, 20 bp, Homo sapiens
tgaggcccagagggcctgca

SEQ ID NO: 1858354 - DNA, 16 bp, Homo sapiens
tgaggcccttctctcc

SEQ ID NO: 1858355 - DNA, 20 bp, Homo sapiens
tgaggcccttctctccagcc

SEQ ID NO: 1858356 - DNA, 22 bp, Homo sapiens
tgaggcccttctctccagcccc

SEQ ID NO: 1858357 - DNA, 11 bp, Homo sapiens
tgaggctgggc

SEQ ID NO: 1858358 - DNA, 16 bp, Homo sapiens
tgaggctgggctccct

SEQ ID NO: 1858359 - DNA, 23 bp, Homo sapiens
tgaggcttagctttgctctgcca

SEQ ID NO: 1858360 - DNA, 13 bp, Homo sapiens
tgaggggcctctt

SEQ ID NO: 1858361 - DNA, 21 bp, Homo sapiens
tgaggtgggaggatctcttga

SEQ ID NO: 1858362 - DNA, 19 bp, Homo sapiens
tgaggtttcaaacctccct

SEQ ID NO: 1858363 - DNA, 14 bp, Homo sapiens
tgagtactacagtc

SEQ ID NO: 1858364 - DNA, 22 bp, Homo sapiens
tgagtactacagtcctcccatc

SEQ ID NO: 1858365 - DNA, 15 bp, Homo sapiens
tgagtcaaaaaatct

SEQ ID NO: 1858366 - DNA, 19 bp, Homo sapiens
tgagtcccctgtttgtttc

SEQ ID NO: 1858367 - DNA, 20 bp, Homo sapiens
tgagtcccctgtttgtttct

SEQ ID NO: 1858368 - DNA, 13 bp, Homo sapiens
tgagtctgaaggc

SEQ ID NO: 1858369 - DNA, 15 bp, Homo sapiens
tgagtgacagctttc

SEQ ID NO: 1858370 - DNA, 16 bp, Homo sapiens
tgagtgacagctttct

SEQ ID NO: 1858371 - DNA, 20 bp, Homo sapiens
tgagtgacagctttctggga

SEQ ID NO: 1858372 - DNA, 23 bp, Homo sapiens
tgagtgacagctttctgggatgt

SEQ ID NO: 1858373 - DNA, 19 bp, Homo sapiens
tgagtgcttgcttttcatg

SEQ ID NO: 1858374 - DNA, 15 bp, Homo sapiens
tgagtggcatggcca

SEQ ID NO: 1858375 - DNA, 21 bp, Homo sapiens
tgagtgggggatcacagcctc

SEQ ID NO: 1858376 - DNA, 19 bp, Homo sapiens
tgataagagggcacacact

SEQ ID NO: 1858377 - DNA, 19 bp, Homo sapiens
tgataatattgtggtgcca

SEQ ID NO: 1858378 - DNA, 16 bp, Homo sapiens
tgatagcacagaccct

SEQ ID NO: 1858379 - DNA, 17 bp, Homo sapiens
tgatagcacagaccctg

SEQ ID NO: 1858380 - DNA, 22 bp, Homo sapiens
tgataggaagaggggaagcaga

SEQ ID NO: 1858381 - DNA, 22 bp, Homo sapiens
tgatatagaacagtgcttgcca

SEQ ID NO: 1858382 - DNA, 14 bp, Homo sapiens
tgatcctgtgaagt

SEQ ID NO: 1858383 - DNA, 15 bp, Homo sapiens
tgatctaggaagact

SEQ ID NO: 1858384 - DNA, 21 bp, Homo sapiens
tgatctaggaagactttggaa

SEQ ID NO: 1858385 - DNA, 15 bp, Homo sapiens
tgatctcatttaatc

SEQ ID NO: 1858386 - DNA, 20 bp, Homo sapiens
tgatgatcctaggcatttgc

SEQ ID NO: 1858387 - DNA, 15 bp, Homo sapiens
tgatgcctgtgaact

SEQ ID NO: 1858388 - DNA, 20 bp, Homo sapiens
tgatgcctgtgaactgaact

SEQ ID NO: 1858389 - DNA, 22 bp, Homo sapiens
tgatgcttcttcagagactcct

SEQ ID NO: 1858390 - DNA, 11 bp, Homo sapiens
tgatggagccc

SEQ ID NO: 1858391 - DNA, 20 bp, Homo sapiens
tgatggcaggatggcctggc

SEQ ID NO: 1858392 - DNA, 13 bp, Homo sapiens
tgatggcttctcc

SEQ ID NO: 1858393 - DNA, 16 bp, Homo sapiens
tgatggggccctgcct

SEQ ID NO: 1858394 - DNA, 13 bp, Homo sapiens
tgatgtgcctggg

SEQ ID NO: 1858395 - DNA, 15 bp, Homo sapiens
tgatgttggctggga

SEQ ID NO: 1858396 - DNA, 17 bp, Homo sapiens
tgatgttttccatgagt

SEQ ID NO: 1858397 - DNA, 19 bp, Homo sapiens
tgatgttttccatgagtcc

SEQ ID NO: 1858398 - DNA, 14 bp, Homo sapiens
tgattcagacagct

SEQ ID NO: 1858399 - DNA, 16 bp, Homo sapiens
tgattcagacagctgc

SEQ ID NO: 1858400 - DNA, 20 bp, Homo sapiens
tgattcagacagctgcctgg

SEQ ID NO: 1858401 - DNA, 21 bp, Homo sapiens
tgattcagacagctgcctggg

SEQ ID NO: 1858402 - DNA, 23 bp, Homo sapiens
tgattcagacagctgcctgggat

SEQ ID NO: 1858403 - DNA, 14 bp, Homo sapiens
tgattcagctctgc

SEQ ID NO: 1858404 - DNA, 19 bp, Homo sapiens
tgattctcagggtctctgc

SEQ ID NO: 1858405 - DNA, 20 bp, Homo sapiens
tgattctcagggtctctgct

SEQ ID NO: 1858406 - DNA, 15 bp, Homo sapiens
tgattgggacagagg

SEQ ID NO: 1858407 - DNA, 16 bp, Homo sapiens
tgattgtgtctcttgg

SEQ ID NO: 1858408 - DNA, 14 bp, Homo sapiens
tgatttcacagtgt

SEQ ID NO: 1858409 - DNA, 15 bp, Homo sapiens
tgatttttttttcca

SEQ ID NO: 1858410 - DNA, 20 bp, Homo sapiens
tgcaaactctttggtcgttt

SEQ ID NO: 1858411 - DNA, 20 bp, Homo sapiens
tgcaaagtcatgcaaaggct

SEQ ID NO: 1858412 - DNA, 23 bp, Homo sapiens
tgcaaagtcatgcaaaggctggg

SEQ ID NO: 1858413 - DNA, 13 bp, Homo sapiens
tgcaaataacaaa

SEQ ID NO: 1858414 - DNA, 17 bp, Homo sapiens
tgcaaataacaaatgcc

SEQ ID NO: 1858415 - DNA, 13 bp, Homo sapiens
tgcaaatagccag

SEQ ID NO: 1858416 - DNA, 17 bp, Homo sapiens
tgcaacactcaagtcta

SEQ ID NO: 1858417 - DNA, 19 bp, Homo sapiens
tgcaacctgattgtgtctc

SEQ ID NO: 1858418 - DNA, 20 bp, Homo sapiens
tgcaacctgattgtgtctct

SEQ ID NO: 1858419 - DNA, 20 bp, Homo sapiens
tgcaatagaacagagaaaga

SEQ ID NO: 1858420 - DNA, 19 bp, Homo sapiens
tgcaatatttcctcatgtg

SEQ ID NO: 1858421 - DNA, 15 bp, Homo sapiens
tgcaatgtgtataaa

SEQ ID NO: 1858422 - DNA, 18 bp, Homo sapiens
tgcaatgtgtataaacaa

SEQ ID NO: 1858423 - DNA, 14 bp, Homo sapiens
tgcacaacattaca

SEQ ID NO: 1858424 - DNA, 14 bp, Homo sapiens
tgcacaagctgcac

SEQ ID NO: 1858425 - DNA, 13 bp, Homo sapiens
tgcacacaggaca

SEQ ID NO: 1858426 - DNA, 17 bp, Homo sapiens
tgcacacaggacagcgg

SEQ ID NO: 1858427 - DNA, 14 bp, Homo sapiens
tgcacactgtccta

SEQ ID NO: 1858428 - DNA, 21 bp, Homo sapiens
tgcacactgtcctattatatt

SEQ ID NO: 1858429 - DNA, 12 bp, Homo sapiens
tgcacatccctg

SEQ ID NO: 1858430 - DNA, 13 bp, Homo sapiens
tgcacatctgttt

SEQ ID NO: 1858431 - DNA, 21 bp, Homo sapiens
tgcaccactgcactccagcct

SEQ ID NO: 1858432 - DNA, 16 bp, Homo sapiens
tgcaccctcaggcagg

SEQ ID NO: 1858433 - DNA, 15 bp, Homo sapiens
tgcaccggctggcct

SEQ ID NO: 1858434 - DNA, 16 bp, Homo sapiens
tgcaccggctggcctg

SEQ ID NO: 1858435 - DNA, 18 bp, Homo sapiens
tgcaccggctggcctggc

SEQ ID NO: 1858436 - DNA, 14 bp, Homo sapiens
tgcacctgcagcca

SEQ ID NO: 1858437 - DNA, 12 bp, Homo sapiens
tgcactcccctg

SEQ ID NO: 1858438 - DNA, 13 bp, Homo sapiens
tgcactcccctgc

SEQ ID NO: 1858439 - DNA, 17 bp, Homo sapiens
tgcactcccctgctggg

SEQ ID NO: 1858440 - DNA, 19 bp, Homo sapiens
tgcactcccctgctgggtg

SEQ ID NO: 1858441 - DNA, 16 bp, Homo sapiens
tgcactttgctttaat

SEQ ID NO: 1858442 - DNA, 22 bp, Homo sapiens
tgcactttgctttaatataaat

SEQ ID NO: 1858443 - DNA, 12 bp, Homo sapiens
tgcactttgttc

SEQ ID NO: 1858444 - DNA, 15 bp, Homo sapiens
tgcactttgttctgg

SEQ ID NO: 1858445 - DNA, 18 bp, Homo sapiens
tgcactttgttctggctc

SEQ ID NO: 1858446 - DNA, 16 bp, Homo sapiens
tgcagcctcacagtcc

SEQ ID NO: 1858447 - DNA, 16 bp, Homo sapiens
tgcaggacctcaggtg

SEQ ID NO: 1858448 - DNA, 17 bp, Homo sapiens
tgcaggcagccaggcca

SEQ ID NO: 1858449 - DNA, 21 bp, Homo sapiens
tgcagtcacgtggaggagcag

SEQ ID NO: 1858450 - DNA, 11 bp, Homo sapiens
tgcagtcccaa

SEQ ID NO: 1858451 - DNA, 22 bp, Homo sapiens
tgcagtcccaagcggtgtctct

SEQ ID NO: 1858452 - DNA, 23 bp, Homo sapiens
tgcagtcccaagcggtgtctctc

SEQ ID NO: 1858453 - DNA, 14 bp, Homo sapiens
tgcagtgagccgag

SEQ ID NO: 1858454 - DNA, 21 bp, Homo sapiens
tgcagtgtggagttcaccttg

SEQ ID NO: 1858455 - DNA, 22 bp, Homo sapiens
tgcatacggctatattggttta

SEQ ID NO: 1858456 - DNA, 19 bp, Homo sapiens
tgcatgaataaaattattc

SEQ ID NO: 1858457 - DNA, 21 bp, Homo sapiens
tgcatgaggctagtgtggtgt

SEQ ID NO: 1858458 - DNA, 21 bp, Homo sapiens
tgcatgttttccagctcctca

SEQ ID NO: 1858459 - DNA, 19 bp, Homo sapiens
tgcattttgctagacagtt

SEQ ID NO: 1858460 - DNA, 20 bp, Homo sapiens
tgcattttgctagacagtta

SEQ ID NO: 1858461 - DNA, 19 bp, Homo sapiens
tgccaaattaaaaaagata

SEQ ID NO: 1858462 - DNA, 22 bp, Homo sapiens
tgccaaattaaaaaagataaac

SEQ ID NO: 1858463 - DNA, 22 bp, Homo sapiens
tgccaacactcaagaagcaggc

SEQ ID NO: 1858464 - DNA, 14 bp, Homo sapiens
tgccaagcactgtg

SEQ ID NO: 1858465 - DNA, 16 bp, Homo sapiens
tggatgtccccagcag

SEQ ID NO: 1858466 - DNA, 20 bp, Homo sapiens
tggattgtgcctaatgtgtt

SEQ ID NO: 1858467 - DNA, 16 bp, Homo sapiens
tggcaaaaaggcagga

SEQ ID NO: 1858468 - DNA, 14 bp, Homo sapiens
tggcaaagccagaa

SEQ ID NO: 1858469 - DNA, 12 bp, Homo sapiens
tggcaaggctgt

SEQ ID NO: 1858470 - DNA, 16 bp, Homo sapiens
tggcaaggctgtgctc

SEQ ID NO: 1858471 - DNA, 17 bp, Homo sapiens
tggcaccagcagcctgg

SEQ ID NO: 1858472 - DNA, 17 bp, Homo sapiens
tggcactcaggtgctga

SEQ ID NO: 1858473 - DNA, 18 bp, Homo sapiens
tggcactcaggtgctgaa

SEQ ID NO: 1858474 - DNA, 13 bp, Homo sapiens
tggcactgccatg

SEQ ID NO: 1858475 - DNA, 16 bp, Homo sapiens
tggcactgcttccagt

SEQ ID NO: 1858476 - DNA, 13 bp, Homo sapiens
tggcactggatgc

SEQ ID NO: 1858477 - DNA, 19 bp, Homo sapiens
tggcagctcacctctccct

SEQ ID NO: 1858478 - DNA, 14 bp, Homo sapiens
tggcatggccacca

SEQ ID NO: 1858479 - DNA, 15 bp, Homo sapiens
tggcatttggcctct

SEQ ID NO: 1858480 - DNA, 21 bp, Homo sapiens
tggcatttggtctcaggcagc

SEQ ID NO: 1858481 - DNA, 18 bp, Homo sapiens
tggccatgcaggaggtgg

SEQ ID NO: 1858482 - DNA, 21 bp, Homo sapiens
tggcccaagtggcagagcttg

SEQ ID NO: 1858483 - DNA, 13 bp, Homo sapiens
tggcccactgcat

SEQ ID NO: 1858484 - DNA, 16 bp, Homo sapiens
tggccccactttgaag

SEQ ID NO: 1858485 - DNA, 19 bp, Homo sapiens
tggccccactttgaagggc

SEQ ID NO: 1858486 - DNA, 18 bp, Homo sapiens
tggccccatattaacaaa

SEQ ID NO: 1858487 - DNA, 21 bp, Homo sapiens
tggccgttgatgttggctggg

SEQ ID NO: 1858488 - DNA, 18 bp, Homo sapiens
tggcctctgcactcccct

SEQ ID NO: 1858489 - DNA, 22 bp, Homo sapiens
tggcctgatcagcaggagccaa

SEQ ID NO: 1858490 - DNA, 15 bp, Homo sapiens
tggcctgctggatgt

SEQ ID NO: 1858491 - DNA, 21 bp, Homo sapiens
tggcctggcccctcagggtcc

SEQ ID NO: 1858492 - DNA, 14 bp, Homo sapiens
tggcctgggcctcc

SEQ ID NO: 1858493 - DNA, 17 bp, Homo sapiens
tggcctgggcctcctca

SEQ ID NO: 1858494 - DNA, 20 bp, Homo sapiens
tggcctttcatattttagct

SEQ ID NO: 1858495 - DNA, 22 bp, Homo sapiens
tggcgcagcatattcaggaagc

SEQ ID NO: 1858496 - DNA, 13 bp, Homo sapiens
tggcgtctgctct

SEQ ID NO: 1858497 - DNA, 20 bp, Homo sapiens
tggctcaggtggggtcactc

SEQ ID NO: 1858498 - DNA, 11 bp, Homo sapiens
tggctgaagga

SEQ ID NO: 1858499 - DNA, 12 bp, Homo sapiens
tggctgcatgcg

SEQ ID NO: 1858500 - DNA, 14 bp, Homo sapiens
tggctgctgaaggc

SEQ ID NO: 1858501 - DNA, 16 bp, Homo sapiens
tggctgctgaaggctc

SEQ ID NO: 1858502 - DNA, 20 bp, Homo sapiens
tggcttaagtgagcagaaca

SEQ ID NO: 1858503 - DNA, 22 bp, Homo sapiens
tggcttaagtgagcagaacagg

SEQ ID NO: 1858504 - DNA, 14 bp, Homo sapiens
tggcttcacggaag

SEQ ID NO: 1858505 - DNA, 20 bp, Homo sapiens
tggcttcacggaagagcctt

SEQ ID NO: 1858506 - DNA, 23 bp, Homo sapiens
tggcttcacggaagagccttgcg

SEQ ID NO: 1858507 - DNA, 20 bp, Homo sapiens
tggcttcattagagcaggcg

SEQ ID NO: 1858508 - DNA, 22 bp, Homo sapiens
tgggaaagcccctgcccctcct

SEQ ID NO: 1858509 - DNA, 15 bp, Homo sapiens
tgggaactcacctgg

SEQ ID NO: 1858510 - DNA, 18 bp, Homo sapiens
tgggaactcacctggggc

SEQ ID NO: 1858511 - DNA, 13 bp, Homo sapiens
tgggacaccctgt

SEQ ID NO: 1858512 - DNA, 15 bp, Homo sapiens
tgggacaccctgtga

SEQ ID NO: 1858513 - DNA, 16 bp, Homo sapiens
tgggacatgggaaagg

SEQ ID NO: 1858514 - DNA, 16 bp, Homo sapiens
tgggactggcctctgc

SEQ ID NO: 1858515 - DNA, 21 bp, Homo sapiens
tgggaggatctcttgagcctg

SEQ ID NO: 1858516 - DNA, 18 bp, Homo sapiens
tgggaggattgcttgagc

SEQ ID NO: 1858517 - DNA, 17 bp, Homo sapiens
tgggaggtcaaggctgc

SEQ ID NO: 1858518 - DNA, 18 bp, Homo sapiens
tgggaggtcaaggctgca

SEQ ID NO: 1858519 - DNA, 20 bp, Homo sapiens
tgggaggtcaaggctgcagt

SEQ ID NO: 1858520 - DNA, 19 bp, Homo sapiens
tgggatcacatgtggactt

SEQ ID NO: 1858521 - DNA, 15 bp, Homo sapiens
tgggatggggaggga

SEQ ID NO: 1858522 - DNA, 14 bp, Homo sapiens
tgggatgtcacagt

SEQ ID NO: 1858523 - DNA, 18 bp, Homo sapiens
tgggcagagcagagacca

SEQ ID NO: 1858524 - DNA, 22 bp, Homo sapiens
tgggcagagcagagaccatccc

SEQ ID NO: 1858525 - DNA, 19 bp, Homo sapiens
tgggcagctcatctctgtc

SEQ ID NO: 1858526 - DNA, 16 bp, Homo sapiens
tgggcccccaaatgga

SEQ ID NO: 1858527 - DNA, 13 bp, Homo sapiens
tgggcctcctcac

SEQ ID NO: 1858528 - DNA, 19 bp, Homo sapiens
tgggctcccttcccacctc

SEQ ID NO: 1858529 - DNA, 23 bp, Homo sapiens
tgggctgggttctacccaggtgc

SEQ ID NO: 1858530 - DNA, 14 bp, Homo sapiens
tgggcttagagcag

SEQ ID NO: 1858531 - DNA, 22 bp, Homo sapiens
tgggcttcccagtggctgctgc

SEQ ID NO: 1858532 - DNA, 23 bp, Homo sapiens
tgggcttcccagtggctgctgcc

SEQ ID NO: 1858533 - DNA, 19 bp, Homo sapiens
tggggaaaatggccatgca

SEQ ID NO: 1858534 - DNA, 20 bp, Homo sapiens
tggggccagttggtccccct

SEQ ID NO: 1858535 - DNA, 12 bp, Homo sapiens
tggggctgctgg

SEQ ID NO: 1858536 - DNA, 13 bp, Homo sapiens
tggggctgctggc

SEQ ID NO: 1858537 - DNA, 21 bp, Homo sapiens
tgggggatcacagcctctgaa

SEQ ID NO: 1858538 - DNA, 12 bp, Homo sapiens
tgggggtttttt

SEQ ID NO: 1858539 - DNA, 16 bp, Homo sapiens
tggggtcactctggca

SEQ ID NO: 1858540 - DNA, 19 bp, Homo sapiens
tggggtcactctggcagct

SEQ ID NO: 1858541 - DNA, 20 bp, Homo sapiens
tggggtcactctggcagctc

SEQ ID NO: 1858542 - DNA, 22 bp, Homo sapiens
tggggtcactctggcagctcag

SEQ ID NO: 1858543 - DNA, 14 bp, Homo sapiens
tggggtcccagcag

SEQ ID NO: 1858544 - DNA, 23 bp, Homo sapiens
tgggtcagtgtccaaagcagggt

SEQ ID NO: 1858545 - DNA, 14 bp, Homo sapiens
tgggtcgggagagg

SEQ ID NO: 1858546 - DNA, 16 bp, Homo sapiens
tgggtcgggagagggg

SEQ ID NO: 1858547 - DNA, 17 bp, Homo sapiens
tgggtcgggagagggga

SEQ ID NO: 1858548 - DNA, 19 bp, Homo sapiens
tgggtgcttggaggaagga

SEQ ID NO: 1858549 - DNA, 22 bp, Homo sapiens
tgggtgcttggaggaaggaaac

SEQ ID NO: 1858550 - DNA, 22 bp, Homo sapiens
tgggtgttatcacctagctgaa

SEQ ID NO: 1858551 - DNA, 18 bp, Homo sapiens
tgggttagggaaaacatt

SEQ ID NO: 1858552 - DNA, 21 bp, Homo sapiens
tgggttagggaaaacattcca

SEQ ID NO: 1858553 - DNA, 15 bp, Homo sapiens
tgggttctacccagg

SEQ ID NO: 1858554 - DNA, 22 bp, Homo sapiens
tggtaggggagggcaggcttgg

SEQ ID NO: 1858555 - DNA, 23 bp, Homo sapiens
tggtaggggagggcaggcttggg

SEQ ID NO: 1858556 - DNA, 16 bp, Homo sapiens
tggtattcctgcctcc

SEQ ID NO: 1858557 - DNA, 13 bp, Homo sapiens
tggtcccacccca

SEQ ID NO: 1858558 - DNA, 15 bp, Homo sapiens
tggtcccaccccaca

SEQ ID NO: 1858559 - DNA, 20 bp, Homo sapiens
tggtctcaggcagcaccaca

SEQ ID NO: 1858560 - DNA, 20 bp, Homo sapiens
tggtctttcttacaaggaag

SEQ ID NO: 1858561 - DNA, 19 bp, Homo sapiens
tggtgactttcctctttgg

SEQ ID NO: 1858562 - DNA, 17 bp, Homo sapiens
tggtgccacaaataaaa

SEQ ID NO: 1858563 - DNA, 23 bp, Homo sapiens
tggtggcagctcacctctccctt

SEQ ID NO: 1858564 - DNA, 22 bp, Homo sapiens
tggtgtgaactaaactttcaca

SEQ ID NO: 1858565 - DNA, 17 bp, Homo sapiens
tggtgtttcctggcact

SEQ ID NO: 1858566 - DNA, 20 bp, Homo sapiens
tggttaggcattgtgggaag

SEQ ID NO: 1858567 - DNA, 14 bp, Homo sapiens
tggttatggagagg

SEQ ID NO: 1858568 - DNA, 12 bp, Homo sapiens
tggttcctcccc

SEQ ID NO: 1858569 - DNA, 13 bp, Homo sapiens
tggttctgtgcca

SEQ ID NO: 1858570 - DNA, 14 bp, Homo sapiens
tggttcttgtatta

SEQ ID NO: 1858571 - DNA, 14 bp, Homo sapiens
tggttgctttaata

SEQ ID NO: 1858572 - DNA, 16 bp, Homo sapiens
tggttggttttcttct

SEQ ID NO: 1858573 - DNA, 17 bp, Homo sapiens
tggttggttttcttctt

SEQ ID NO: 1858574 - DNA, 21 bp, Homo sapiens
tggtttttaaaaaactgctga

SEQ ID NO: 1858575 - DNA, 14 bp, Homo sapiens
tgtaaatataaaga

SEQ ID NO: 1858576 - DNA, 16 bp, Homo sapiens
tgtaaatataaagacg

SEQ ID NO: 1858577 - DNA, 15 bp, Homo sapiens
tgtaagagcttgctc

SEQ ID NO: 1858578 - DNA, 16 bp, Homo sapiens
tgtacaaggacagccc

SEQ ID NO: 1858579 - DNA, 13 bp, Homo sapiens
tgtacagagccca

SEQ ID NO: 1858580 - DNA, 17 bp, Homo sapiens
tgtacagagcccacgcc

SEQ ID NO: 1858581 - DNA, 17 bp, Homo sapiens
tgtactctacaaaatat

SEQ ID NO: 1858582 - DNA, 15 bp, Homo sapiens
tgtagcgtctttctt

SEQ ID NO: 1858583 - DNA, 22 bp, Homo sapiens
tgtagtgctttgagagagaaag

SEQ ID NO: 1858584 - DNA, 16 bp, Homo sapiens
tgtataaacaagaaaa

SEQ ID NO: 1858585 - DNA, 21 bp, Homo sapiens
tgtatagtgtctattatcaca

SEQ ID NO: 1858586 - DNA, 12 bp, Homo sapiens
tgtatctgtgta

SEQ ID NO: 1858587 - DNA, 13 bp, Homo sapiens
tttgtcttaaaaa

SEQ ID NO: 1858588 - DNA, 18 bp, Homo sapiens
tttgtgaggaagccgctg

SEQ ID NO: 1858589 - DNA, 15 bp, Homo sapiens
tttgtgatgcatttt

SEQ ID NO: 1858590 - DNA, 21 bp, Homo sapiens
tttgtgctccattttttcttc

SEQ ID NO: 1858591 - DNA, 13 bp, Homo sapiens
tttgtgttctgtt

SEQ ID NO: 1858592 - DNA, 17 bp, Homo sapiens
tttgtgttctgttttgt

SEQ ID NO: 1858593 - DNA, 12 bp, Homo sapiens
tttgttctgttt

SEQ ID NO: 1858594 - DNA, 13 bp, Homo sapiens
tttgttctgtttt

SEQ ID NO: 1858595 - DNA, 15 bp, Homo sapiens
tttgttgtcagctga

SEQ ID NO: 1858596 - DNA, 14 bp, Homo sapiens
tttgtttctgaaag

SEQ ID NO: 1858597 - DNA, 16 bp, Homo sapiens
tttgtttctgaaaggg

SEQ ID NO: 1858598 - DNA, 14 bp, Homo sapiens
ttttaaaatgtaca

SEQ ID NO: 1858599 - DNA, 13 bp, Homo sapiens
ttttaattaaatg

SEQ ID NO: 1858600 - DNA, 15 bp, Homo sapiens
ttttacttttaaatg

SEQ ID NO: 1858601 - DNA, 21 bp, Homo sapiens
ttttagaccctattgctgctt

SEQ ID NO: 1858602 - DNA, 12 bp, Homo sapiens
ttttataaatcg

SEQ ID NO: 1858603 - DNA, 20 bp, Homo sapiens
ttttataaatcgcttttgat

SEQ ID NO: 1858604 - DNA, 15 bp, Homo sapiens
ttttcaaatgttctc

SEQ ID NO: 1858605 - DNA, 17 bp, Homo sapiens
ttttcatgcaaactctt

SEQ ID NO: 1858606 - DNA, 13 bp, Homo sapiens
ttttccagctcct

SEQ ID NO: 1858607 - DNA, 21 bp, Homo sapiens
ttttcccccttgaggattgtg

SEQ ID NO: 1858608 - DNA, 23 bp, Homo sapiens
ttttcccccttgaggattgtgga

SEQ ID NO: 1858609 - DNA, 12 bp, Homo sapiens
ttttctgaaaca

SEQ ID NO: 1858610 - DNA, 15 bp, Homo sapiens
ttttctgaaacacac

SEQ ID NO: 1858611 - DNA, 14 bp, Homo sapiens
ttttctgaattatg

SEQ ID NO: 1858612 - DNA, 14 bp, Homo sapiens
ttttcttctccctc

SEQ ID NO: 1858613 - DNA, 19 bp, Homo sapiens
ttttgcacctgcagccaag

SEQ ID NO: 1858614 - DNA, 17 bp, Homo sapiens
ttttggcaaagccagaa

SEQ ID NO: 1858615 - DNA, 15 bp, Homo sapiens
ttttggttgctttaa

SEQ ID NO: 1858616 - DNA, 14 bp, Homo sapiens
tttttaaattaaat

SEQ ID NO: 1858617 - DNA, 12 bp, Homo sapiens
tttttccccctt

SEQ ID NO: 1858618 - DNA, 14 bp, Homo sapiens
tttttctgttatat

SEQ ID NO: 1858619 - DNA, 23 bp, Homo sapiens
tttttcttaaataataaagatca

SEQ ID NO: 1858620 - DNA, 13 bp, Homo sapiens
ttttttccaaaac

SEQ ID NO: 1858621 - DNA, 21 bp, Homo sapiens
ttttttggccatctgctcctg

SEQ ID NO: 1858622 - DNA, 14 bp, Homo sapiens
aaaatgtacttaaa

SEQ ID NO: 1858623 - DNA, 17 bp, Homo sapiens
aaaattccatgcactct

SEQ ID NO: 1858624 - DNA, 14 bp, Homo sapiens
aaaattgaaagtat

SEQ ID NO: 1858625 - DNA, 14 bp, Homo sapiens
aaacaaaaaaaaga

SEQ ID NO: 1858626 - DNA, 15 bp, Homo sapiens
aaacaaaaaaaagaa

SEQ ID NO: 1858627 - DNA, 22 bp, Homo sapiens
aaacaaatggcttacttacaaa

SEQ ID NO: 1858628 - DNA, 18 bp, Homo sapiens
aaacagagaaagaaaagg

SEQ ID NO: 1858629 - DNA, 21 bp, Homo sapiens
aaacagagaaagaaaaggcaa

SEQ ID NO: 1858630 - DNA, 16 bp, Homo sapiens
aaacagcaaagccata

SEQ ID NO: 1858631 - DNA, 16 bp, Homo sapiens
aaacaggagacaggaa

SEQ ID NO: 1858632 - DNA, 18 bp, Homo sapiens
aaaccagtttattctgtg

SEQ ID NO: 1858633 - DNA, 16 bp, Homo sapiens
aaacccccttttccct

SEQ ID NO: 1858634 - DNA, 22 bp, Homo sapiens
aaacccccttttcccttcagct

SEQ ID NO: 1858635 - DNA, 12 bp, Homo sapiens
aaaccctttgta

SEQ ID NO: 1858636 - DNA, 22 bp, Homo sapiens
aaacctagcttttaaaaaatat

SEQ ID NO: 1858637 - DNA, 20 bp, Homo sapiens
aaacctgtttttaacatgtg

SEQ ID NO: 1858638 - DNA, 17 bp, Homo sapiens
aaacctttctacttttt

SEQ ID NO: 1858639 - DNA, 21 bp, Homo sapiens
aaacgtattttgatcagtgtt

SEQ ID NO: 1858640 - DNA, 17 bp, Homo sapiens
aaactaaatctctaata

SEQ ID NO: 1858641 - DNA, 21 bp, Homo sapiens
aaactagtttaagggtggaaa

SEQ ID NO: 1858642 - DNA, 13 bp, Homo sapiens
aaactcaaaactt

SEQ ID NO: 1858643 - DNA, 19 bp, Homo sapiens
aaactcaaaacttaacata

SEQ ID NO: 1858644 - DNA, 16 bp, Homo sapiens
aacctatatgatttat

SEQ ID NO: 1858645 - DNA, 17 bp, Homo sapiens
aaccttactggcactgt

SEQ ID NO: 1858646 - DNA, 13 bp, Homo sapiens
aacctttcccttc

SEQ ID NO: 1858647 - DNA, 18 bp, Homo sapiens
aacgtaattgtacaagca

SEQ ID NO: 1858648 - DNA, 12 bp, Homo sapiens
aacgtattttga

SEQ ID NO: 1858649 - DNA, 19 bp, Homo sapiens
aacgtgattgattcagtat

SEQ ID NO: 1858650 - DNA, 15 bp, Homo sapiens
aactaactgactctg

SEQ ID NO: 1858651 - DNA, 14 bp, Homo sapiens
aactacatctgcct

SEQ ID NO: 1858652 - DNA, 18 bp, Homo sapiens
aactagacattattttgt

SEQ ID NO: 1858653 - DNA, 23 bp, Homo sapiens
aactatgccgtgtagtttctggt

SEQ ID NO: 1858654 - DNA, 18 bp, Homo sapiens
aactatttgtctttcagg

SEQ ID NO: 1858655 - DNA, 20 bp, Homo sapiens
aactcgtgacagcctctgac

SEQ ID NO: 1858656 - DNA, 23 bp, Homo sapiens
aactcgtgacagcctctgactca

SEQ ID NO: 1858657 - DNA, 18 bp, Homo sapiens
aactctgattttgatatt

SEQ ID NO: 1858658 - DNA, 19 bp, Homo sapiens
aactgaaaatctaatatta

SEQ ID NO: 1858659 - DNA, 16 bp, Homo sapiens
aactgagtccatgaaa

SEQ ID NO: 1858660 - DNA, 17 bp, Homo sapiens
aactgagtccatgaaaa

SEQ ID NO: 1858661 - DNA, 22 bp, Homo sapiens
aactgagtccatgaaaatacca

SEQ ID NO: 1858662 - DNA, 14 bp, Homo sapiens
aactggtgatatat

SEQ ID NO: 1858663 - DNA, 10 bp, Homo sapiens
aactgtattt

SEQ ID NO: 1858664 - DNA, 15 bp, Homo sapiens
aactgtggaatttat

SEQ ID NO: 1858665 - DNA, 16 bp, Homo sapiens
aactgtggaatttatt

SEQ ID NO: 1858666 - DNA, 20 bp, Homo sapiens
aactgtggaatttattggca

SEQ ID NO: 1858667 - DNA, 22 bp, Homo sapiens
aactgtttggtcgagtctttgt

SEQ ID NO: 1858668 - DNA, 11 bp, Homo sapiens
aacttcagaga

SEQ ID NO: 1858669 - DNA, 16 bp, Homo sapiens
aacttctaatatattt

SEQ ID NO: 1858670 - DNA, 14 bp, Homo sapiens
aacttgattcttgt

SEQ ID NO: 1858671 - DNA, 16 bp, Homo sapiens
aacttgctacttatca

SEQ ID NO: 1858672 - DNA, 15 bp, Homo sapiens
aactttaaaaggcaa

SEQ ID NO: 1858673 - DNA, 16 bp, Homo sapiens
aactttaaaaggcaac

SEQ ID NO: 1858674 - DNA, 11 bp, Homo sapiens
aactttctgta

SEQ ID NO: 1858675 - DNA, 16 bp, Homo sapiens
aacttttacagaatgc

SEQ ID NO: 1858676 - DNA, 19 bp, Homo sapiens
aacttttacagaatgcatt

SEQ ID NO: 1858677 - DNA, 20 bp, Homo sapiens
aacttttacagaatgcatta

SEQ ID NO: 1858678 - DNA, 16 bp, Homo sapiens
aacttttgtaatttga

SEQ ID NO: 1858679 - DNA, 19 bp, Homo sapiens
aacttttgtaatttgaatt

SEQ ID NO: 1858680 - DNA, 13 bp, Homo sapiens
aagaaaaggcaaa

SEQ ID NO: 1858681 - DNA, 23 bp, Homo sapiens
aagaaaaggcaaaagactggttt

SEQ ID NO: 1858682 - DNA, 16 bp, Homo sapiens
aagaaacactaaatta

SEQ ID NO: 1858683 - DNA, 19 bp, Homo sapiens
aagaaagccaccttgttac

SEQ ID NO: 1858684 - DNA, 19 bp, Homo sapiens
aagaaagggaaagctgtgc

SEQ ID NO: 1858685 - DNA, 15 bp, Homo sapiens
aagaattctattttg

SEQ ID NO: 1858686 - DNA, 19 bp, Homo sapiens
aagaattctattttgctgg

SEQ ID NO: 1858687 - DNA, 16 bp, Homo sapiens
aagaatttaatggact

SEQ ID NO: 1858688 - DNA, 20 bp, Homo sapiens
aagaatttaatggactgtga

SEQ ID NO: 1858689 - DNA, 22 bp, Homo sapiens
aagaatttaatggactgtgaat

SEQ ID NO: 1858690 - DNA, 18 bp, Homo sapiens
aagacacatgctgaggtt

SEQ ID NO: 1858691 - DNA, 17 bp, Homo sapiens
aagacagtggcactaaa

SEQ ID NO: 1858692 - DNA, 23 bp, Homo sapiens
aagacagtggcactaaaatgttt

SEQ ID NO: 1858693 - DNA, 20 bp, Homo sapiens
aagacatctgcctgtaatta

SEQ ID NO: 1858694 - DNA, 17 bp, Homo sapiens
aagaccacaaaaattga

SEQ ID NO: 1858695 - DNA, 12 bp, Homo sapiens
aagacccctgcc

SEQ ID NO: 1858696 - DNA, 16 bp, Homo sapiens
aagactaatttaaaaa

SEQ ID NO: 1858697 - DNA, 12 bp, Homo sapiens
aagactggtttg

SEQ ID NO: 1858698 - DNA, 18 bp, Homo sapiens
aagactgtcaaatgaact

SEQ ID NO: 1858699 - DNA, 21 bp, Homo sapiens
aagactgtcaaatgaactttt

SEQ ID NO: 1858700 - DNA, 17 bp, Homo sapiens
aagacttggcaacagaa

SEQ ID NO: 1858701 - DNA, 18 bp, Homo sapiens
aagacttggcaacagaag

SEQ ID NO: 1858702 - DNA, 15 bp, Homo sapiens
aagagaatgaactgt

SEQ ID NO: 1858703 - DNA, 17 bp, Homo sapiens
aagagatgaaataattt

SEQ ID NO: 1858704 - DNA, 22 bp, Homo sapiens
aagagccaggggtgtcccagtc

SEQ ID NO: 1858705 - DNA, 14 bp, Homo sapiens
aagaggttctgcac

SEQ ID NO: 1858706 - DNA, 21 bp, Homo sapiens
aagagtagaaaaggattgctt

SEQ ID NO: 1858707 - DNA, 16 bp, Homo sapiens
aagataagtctacatt

SEQ ID NO: 1858708 - DNA, 20 bp, Homo sapiens
aagataatggataatcttcg

SEQ ID NO: 1858709 - DNA, 22 bp, Homo sapiens
aagataatggataatcttcggc

SEQ ID NO: 1858710 - DNA, 19 bp, Homo sapiens
aagatgatggaaacgcact

SEQ ID NO: 1858711 - DNA, 22 bp, Homo sapiens
aagatgggggctggagggggca

SEQ ID NO: 1858712 - DNA, 18 bp, Homo sapiens
aagattagggaaaatgga

SEQ ID NO: 1858713 - DNA, 17 bp, Homo sapiens
aagattgtcattagtga

SEQ ID NO: 1858714 - DNA, 21 bp, Homo sapiens
aagcaagacagtggcactaaa

SEQ ID NO: 1858715 - DNA, 12 bp, Homo sapiens
aagcaatttata

SEQ ID NO: 1858716 - DNA, 18 bp, Homo sapiens
aagcaatttatatcttta

SEQ ID NO: 1858717 - DNA, 19 bp, Homo sapiens
aagcaatttatatctttat

SEQ ID NO: 1858718 - DNA, 18 bp, Homo sapiens
aagcagattacaataaat

SEQ ID NO: 1858719 - DNA, 20 bp, Homo sapiens
aagcatgggaaaaagagact

SEQ ID NO: 1858720 - DNA, 16 bp, Homo sapiens
aagccacaagaaattt

SEQ ID NO: 1858721 - DNA, 13 bp, Homo sapiens
aagccatattcta

SEQ ID NO: 1858722 - DNA, 19 bp, Homo sapiens
aagcctttcataccagtca

SEQ ID NO: 1858723 - DNA, 22 bp, Homo sapiens
aagcctttcataccagtcagta

SEQ ID NO: 1858724 - DNA, 21 bp, Homo sapiens
aagctcatattttgtatatat

SEQ ID NO: 1858725 - DNA, 22 bp, Homo sapiens
aagctcatattttgtatatatc

SEQ ID NO: 1858726 - DNA, 17 bp, Homo sapiens
aagctggtaaactattt

SEQ ID NO: 1858727 - DNA, 22 bp, Homo sapiens
aagctgtagtagccctttctgt

SEQ ID NO: 1858728 - DNA, 20 bp, Homo sapiens
aagcttgatttgatctttgt

SEQ ID NO: 1858729 - DNA, 15 bp, Homo sapiens
aaggaaaattgaaag

SEQ ID NO: 1858730 - DNA, 17 bp, Homo sapiens
aaggaaaattgaaagta

SEQ ID NO: 1858731 - DNA, 17 bp, Homo sapiens
aaggaatgtgtccaaga

SEQ ID NO: 1858732 - DNA, 17 bp, Homo sapiens
agcaatttatatcttta

SEQ ID NO: 1858733 - DNA, 22 bp, Homo sapiens
agcaatttatatctttatgcaa

SEQ ID NO: 1858734 - DNA, 14 bp, Homo sapiens
agcacaagaaggcc

SEQ ID NO: 1858735 - DNA, 23 bp, Homo sapiens
agcacaagaaggccagcccactg

SEQ ID NO: 1858736 - DNA, 16 bp, Homo sapiens
agcacaattaattaaa

SEQ ID NO: 1858737 - DNA, 22 bp, Homo sapiens
agcacgcatgtccctccaaggc

SEQ ID NO: 1858738 - DNA, 20 bp, Homo sapiens
agcacgttttctggcttctg

SEQ ID NO: 1858739 - DNA, 19 bp, Homo sapiens
agcactagagtcacccccc

SEQ ID NO: 1858740 - DNA, 16 bp, Homo sapiens
agcactctaattagag

SEQ ID NO: 1858741 - DNA, 20 bp, Homo sapiens
agcagaatggagaaagtaag

SEQ ID NO: 1858742 - DNA, 21 bp, Homo sapiens
agcagaatggagaaagtaagt

SEQ ID NO: 1858743 - DNA, 22 bp, Homo sapiens
agcagcacgcatgtccctccaa

SEQ ID NO: 1858744 - DNA, 12 bp, Homo sapiens
agcagcccccaa

SEQ ID NO: 1858745 - DNA, 20 bp, Homo sapiens
agcagcccccaaagagctgt

SEQ ID NO: 1858746 - DNA, 21 bp, Homo sapiens
agcagcccccaaagagctgtg

SEQ ID NO: 1858747 - DNA, 22 bp, Homo sapiens
agcagcccccaaagagctgtgg

SEQ ID NO: 1858748 - DNA, 20 bp, Homo sapiens
agcagctggcactgacagcc

SEQ ID NO: 1858749 - DNA, 22 bp, Homo sapiens
agcagctggcactgacagcctg

SEQ ID NO: 1858750 - DNA, 23 bp, Homo sapiens
agcagttgagtcgtcatcacttt

SEQ ID NO: 1858751 - DNA, 17 bp, Homo sapiens
agcattaactaaatgct

SEQ ID NO: 1858752 - DNA, 19 bp, Homo sapiens
agcattaactaaatgctca

SEQ ID NO: 1858753 - DNA, 15 bp, Homo sapiens
agcatttatttctct

SEQ ID NO: 1858754 - DNA, 13 bp, Homo sapiens
agcatttttccat

SEQ ID NO: 1858755 - DNA, 23 bp, Homo sapiens
agccaaggaatgtgtccaagaca

SEQ ID NO: 1858756 - DNA, 20 bp, Homo sapiens
agccaggagaagacccctgc

SEQ ID NO: 1858757 - DNA, 19 bp, Homo sapiens
agccaggggtgtcccagtc

SEQ ID NO: 1858758 - DNA, 21 bp, Homo sapiens
agccatatctagtcaataact

SEQ ID NO: 1858759 - DNA, 18 bp, Homo sapiens
agccatattctaaattca

SEQ ID NO: 1858760 - DNA, 14 bp, Homo sapiens
agccattcctgttc

SEQ ID NO: 1858761 - DNA, 11 bp, Homo sapiens
agcccactggg

SEQ ID NO: 1858762 - DNA, 16 bp, Homo sapiens
agcccactgggccctg

SEQ ID NO: 1858763 - DNA, 18 bp, Homo sapiens
agcccactgggccctggg

SEQ ID NO: 1858764 - DNA, 21 bp, Homo sapiens
agcccccaaagagctgtggct

SEQ ID NO: 1858765 - DNA, 14 bp, Homo sapiens
agcccccactgacc

SEQ ID NO: 1858766 - DNA, 22 bp, Homo sapiens
agcccccactgacctgcccatg

SEQ ID NO: 1858767 - DNA, 21 bp, Homo sapiens
agccctggatggcctctgggg

SEQ ID NO: 1858768 - DNA, 12 bp, Homo sapiens
agccctttctgt

SEQ ID NO: 1858769 - DNA, 17 bp, Homo sapiens
agccctttctgtgtgca

SEQ ID NO: 1858770 - DNA, 15 bp, Homo sapiens
agccgggaaagctgt

SEQ ID NO: 1858771 - DNA, 15 bp, Homo sapiens
agccgtgcaggactc

SEQ ID NO: 1858772 - DNA, 16 bp, Homo sapiens
agccgtgcaggactct

SEQ ID NO: 1858773 - DNA, 13 bp, Homo sapiens
agcctctggggca

SEQ ID NO: 1858774 - DNA, 18 bp, Homo sapiens
agcctctggggcagagct

SEQ ID NO: 1858775 - DNA, 14 bp, Homo sapiens
agccttatgtgtta

SEQ ID NO: 1858776 - DNA, 16 bp, Homo sapiens
agccttatgtgttaca

SEQ ID NO: 1858777 - DNA, 21 bp, Homo sapiens
agccttatgtgttacattatt

SEQ ID NO: 1858778 - DNA, 18 bp, Homo sapiens
agcgatggtctcagaaac

SEQ ID NO: 1858779 - DNA, 17 bp, Homo sapiens
agcgcttagaaacatgt

SEQ ID NO: 1858780 - DNA, 23 bp, Homo sapiens
agcgtccatttcttatttaatta

SEQ ID NO: 1858781 - DNA, 13 bp, Homo sapiens
agctaagcaagcc

SEQ ID NO: 1858782 - DNA, 14 bp, Homo sapiens
agctaatctgcctg

SEQ ID NO: 1858783 - DNA, 20 bp, Homo sapiens
agctaatctgcctggtttta

SEQ ID NO: 1858784 - DNA, 22 bp, Homo sapiens
agctaatctgcctggttttatt

SEQ ID NO: 1858785 - DNA, 16 bp, Homo sapiens
agctacctttttatat

SEQ ID NO: 1858786 - DNA, 14 bp, Homo sapiens
agctagaaatcaca

SEQ ID NO: 1858787 - DNA, 13 bp, Homo sapiens
agctagtgccaaa

SEQ ID NO: 1858788 - DNA, 20 bp, Homo sapiens
agctagtgccaaataattga

SEQ ID NO: 1858789 - DNA, 19 bp, Homo sapiens
agctattcccttctgatct

SEQ ID NO: 1858790 - DNA, 18 bp, Homo sapiens
agctcatattttgtatat

SEQ ID NO: 1858791 - DNA, 22 bp, Homo sapiens
agctgactccagtataatctcc

SEQ ID NO: 1858792 - DNA, 14 bp, Homo sapiens
agctgagagacttt

SEQ ID NO: 1858793 - DNA, 20 bp, Homo sapiens
agctggcactgacagcctgg

SEQ ID NO: 1858794 - DNA, 22 bp, Homo sapiens
agctggcactgacagcctgggg

SEQ ID NO: 1858795 - DNA, 23 bp, Homo sapiens
agctggcactgacagcctggggg

SEQ ID NO: 1858796 - DNA, 21 bp, Homo sapiens
agctgtagtagccctttctgt

SEQ ID NO: 1858797 - DNA, 14 bp, Homo sapiens
agctgtggctgggg

SEQ ID NO: 1858798 - DNA, 19 bp, Homo sapiens
agctgttcttttttgtact

SEQ ID NO: 1858799 - DNA, 15 bp, Homo sapiens
agcttaaagcttgat

SEQ ID NO: 1858800 - DNA, 21 bp, Homo sapiens
agcttacccttggtttgcaca

SEQ ID NO: 1858801 - DNA, 14 bp, Homo sapiens
agcttatttttaca

SEQ ID NO: 1858802 - DNA, 22 bp, Homo sapiens
agcttatttttacagttataga

SEQ ID NO: 1858803 - DNA, 21 bp, Homo sapiens
agcttcagaagtttggcaata

SEQ ID NO: 1858804 - DNA, 15 bp, Homo sapiens
agcttcctgtctgtt

SEQ ID NO: 1858805 - DNA, 13 bp, Homo sapiens
agcttgtagccct

SEQ ID NO: 1858806 - DNA, 15 bp, Homo sapiens
agcttgtagccctgg

SEQ ID NO: 1858807 - DNA, 16 bp, Homo sapiens
agctttatctttgtgt

SEQ ID NO: 1858808 - DNA, 15 bp, Homo sapiens
atagtttgtacatgc

SEQ ID NO: 1858809 - DNA, 11 bp, Homo sapiens
atataaaagga

SEQ ID NO: 1858810 - DNA, 17 bp, Homo sapiens
atataaccataaatcaa

SEQ ID NO: 1858811 - DNA, 16 bp, Homo sapiens
atataagcaagacagt

SEQ ID NO: 1858812 - DNA, 19 bp, Homo sapiens
atatacagattcctgttgt

SEQ ID NO: 1858813 - DNA, 15 bp, Homo sapiens
atataggttgtgcaa

SEQ ID NO: 1858814 - DNA, 16 bp, Homo sapiens
atataggttgtgcaaa

SEQ ID NO: 1858815 - DNA, 20 bp, Homo sapiens
atatatcatattggtattca

SEQ ID NO: 1858816 - DNA, 18 bp, Homo sapiens
atatatctgcttcagtgg

SEQ ID NO: 1858817 - DNA, 13 bp, Homo sapiens
atatatgctgtat

SEQ ID NO: 1858818 - DNA, 22 bp, Homo sapiens
atatatgctgtatttctttgta

SEQ ID NO: 1858819 - DNA, 20 bp, Homo sapiens
atatatgttctgcaagaatt

SEQ ID NO: 1858820 - DNA, 21 bp, Homo sapiens
atatattgaaagttgctttta

SEQ ID NO: 1858821 - DNA, 14 bp, Homo sapiens
atatatttttatat

SEQ ID NO: 1858822 - DNA, 21 bp, Homo sapiens
atatatttttatatttagtta

SEQ ID NO: 1858823 - DNA, 14 bp, Homo sapiens
atatattttttgta

SEQ ID NO: 1858824 - DNA, 17 bp, Homo sapiens
atatctagtcaataact

SEQ ID NO: 1858825 - DNA, 17 bp, Homo sapiens
atatctataaacactgt

SEQ ID NO: 1858826 - DNA, 13 bp, Homo sapiens
atatctgcttcag

SEQ ID NO: 1858827 - DNA, 16 bp, Homo sapiens
atatctgcttcagtgg

SEQ ID NO: 1858828 - DNA, 14 bp, Homo sapiens
atatctgtttgtat

SEQ ID NO: 1858829 - DNA, 19 bp, Homo sapiens
atatctgtttgtatatttg

SEQ ID NO: 1858830 - DNA, 20 bp, Homo sapiens
atatctgtttgtatatttgc

SEQ ID NO: 1858831 - DNA, 21 bp, Homo sapiens
atatctgtttgtatatttgca

SEQ ID NO: 1858832 - DNA, 15 bp, Homo sapiens
atatcttgttattaa

SEQ ID NO: 1858833 - DNA, 14 bp, Homo sapiens
atatctttatgcaa

SEQ ID NO: 1858834 - DNA, 14 bp, Homo sapiens
atatgattggttca

SEQ ID NO: 1858835 - DNA, 14 bp, Homo sapiens
atatgatttatagt

SEQ ID NO: 1858836 - DNA, 16 bp, Homo sapiens
atatggcaaaaatggc

SEQ ID NO: 1858837 - DNA, 15 bp, Homo sapiens
atatggcaagaaagc

SEQ ID NO: 1858838 - DNA, 17 bp, Homo sapiens
atatggcaagaaagctg

SEQ ID NO: 1858839 - DNA, 13 bp, Homo sapiens
atattaaatgagg

SEQ ID NO: 1858840 - DNA, 15 bp, Homo sapiens
atattcaaggcttta

SEQ ID NO: 1858841 - DNA, 21 bp, Homo sapiens
atattcaaggctttaaaagtc

SEQ ID NO: 1858842 - DNA, 21 bp, Homo sapiens
atattgaaagttgcttttatt

SEQ ID NO: 1858843 - DNA, 16 bp, Homo sapiens
atattgctaaaagtgc

SEQ ID NO: 1858844 - DNA, 18 bp, Homo sapiens
atattgctaaaagtgcat

SEQ ID NO: 1858845 - DNA, 12 bp, Homo sapiens
atattgctctta

SEQ ID NO: 1858846 - DNA, 13 bp, Homo sapiens
atattggtattca

SEQ ID NO: 1858847 - DNA, 23 bp, Homo sapiens
atatttagttacgtataatgctt

SEQ ID NO: 1858848 - DNA, 21 bp, Homo sapiens
atatttagttatagtttcaga

SEQ ID NO: 1858849 - DNA, 21 bp, Homo sapiens
atatttgcaaaccctttgtat

SEQ ID NO: 1858850 - DNA, 17 bp, Homo sapiens
atatttgtgtgttcact

SEQ ID NO: 1858851 - DNA, 23 bp, Homo sapiens
atatttttaaaggaaaaatcata

SEQ ID NO: 1858852 - DNA, 22 bp, Homo sapiens
atcaatgggatatgattggttc

SEQ ID NO: 1858853 - DNA, 15 bp, Homo sapiens
atcacaaacatatgt

SEQ ID NO: 1858854 - DNA, 16 bp, Homo sapiens
atcacatctaaagctt

SEQ ID NO: 1858855 - DNA, 14 bp, Homo sapiens
atcacttttcagtg

SEQ ID NO: 1858856 - DNA, 15 bp, Homo sapiens
atcacttttcagtga

SEQ ID NO: 1858857 - DNA, 13 bp, Homo sapiens
atcagaaaaggga

SEQ ID NO: 1858858 - DNA, 22 bp, Homo sapiens
atcagacttgcggccacagcac

SEQ ID NO: 1858859 - DNA, 15 bp, Homo sapiens
atcagctttttgtat

SEQ ID NO: 1858860 - DNA, 21 bp, Homo sapiens
atcagctttttgtattaacaa

SEQ ID NO: 1858861 - DNA, 22 bp, Homo sapiens
atcagctttttgtattaacaaa

SEQ ID NO: 1858862 - DNA, 19 bp, Homo sapiens
atcaggatttcctcttgaa

SEQ ID NO: 1858863 - DNA, 20 bp, Homo sapiens
atcaggtttactcagtgaaa

SEQ ID NO: 1858864 - DNA, 15 bp, Homo sapiens
atcagtaaacactgt

SEQ ID NO: 1858865 - DNA, 17 bp, Homo sapiens
atcatactcctatgctt

SEQ ID NO: 1858866 - DNA, 19 bp, Homo sapiens
atcatactcctatgcttta

SEQ ID NO: 1858867 - DNA, 13 bp, Homo sapiens
atcatataagcaa

SEQ ID NO: 1858868 - DNA, 13 bp, Homo sapiens
atcatattaatta

SEQ ID NO: 1858869 - DNA, 15 bp, Homo sapiens
atcatattaattatt

SEQ ID NO: 1858870 - DNA, 19 bp, Homo sapiens
atcatcagacttgcggcca

SEQ ID NO: 1858871 - DNA, 21 bp, Homo sapiens
atcatcagacttgcggccaca

SEQ ID NO: 1858872 - DNA, 19 bp, Homo sapiens
atcatcaggtttactcagt

SEQ ID NO: 1858873 - DNA, 18 bp, Homo sapiens
atcatctgtgtgaaaatg

SEQ ID NO: 1858874 - DNA, 19 bp, Homo sapiens
atcatctgtgtgaaaatgg

SEQ ID NO: 1858875 - DNA, 15 bp, Homo sapiens
atcatgctcatgtat

SEQ ID NO: 1858876 - DNA, 12 bp, Homo sapiens
atcattaaaata

SEQ ID NO: 1858877 - DNA, 17 bp, Homo sapiens
atcatttggttaaatca

SEQ ID NO: 1858878 - DNA, 18 bp, Homo sapiens
atcatttttgtataaaaa

SEQ ID NO: 1858879 - DNA, 19 bp, Homo sapiens
atcatttttgtataaaaag

SEQ ID NO: 1858880 - DNA, 18 bp, Homo sapiens
atccagctagtgccaaat

SEQ ID NO: 1858881 - DNA, 14 bp, Homo sapiens
atccatgcttcact

SEQ ID NO: 1858882 - DNA, 19 bp, Homo sapiens
atcccccagcgcttagaaa

SEQ ID NO: 1858883 - DNA, 19 bp, Homo sapiens
atcctatatctgtttgtat

SEQ ID NO: 1858884 - DNA, 12 bp, Homo sapiens
atcctccctgga

SEQ ID NO: 1858885 - DNA, 20 bp, Homo sapiens
atcgcagcttcctgtctgtt

SEQ ID NO: 1858886 - DNA, 13 bp, Homo sapiens
atcgttcgcttgt

SEQ ID NO: 1858887 - DNA, 17 bp, Homo sapiens
atctaaagctttatctt

SEQ ID NO: 1858888 - DNA, 14 bp, Homo sapiens
atctataaacactg

SEQ ID NO: 1858889 - DNA, 15 bp, Homo sapiens
atctataaacactgt

SEQ ID NO: 1858890 - DNA, 19 bp, Homo sapiens
atctataactacatattga

SEQ ID NO: 1858891 - DNA, 14 bp, Homo sapiens
atctatattaaatg

SEQ ID NO: 1858892 - DNA, 15 bp, Homo sapiens
atctatattaaatga

SEQ ID NO: 1858893 - DNA, 15 bp, Homo sapiens
atctcctctgctcat

SEQ ID NO: 1858894 - DNA, 12 bp, Homo sapiens
atctgcttcagt

SEQ ID NO: 1858895 - DNA, 15 bp, Homo sapiens
atctgtatgattcta

SEQ ID NO: 1858896 - DNA, 17 bp, Homo sapiens
atctgtttgtatatttg

SEQ ID NO: 1858897 - DNA, 18 bp, Homo sapiens
atctgtttgtatatttgc

SEQ ID NO: 1858898 - DNA, 20 bp, Homo sapiens
atctgtttgtatatttgcaa

SEQ ID NO: 1858899 - DNA, 21 bp, Homo sapiens
atctgtttgtatatttgcaaa

SEQ ID NO: 1858900 - DNA, 16 bp, Homo sapiens
atcttagagtttacag

SEQ ID NO: 1858901 - DNA, 17 bp, Homo sapiens
atcttagagtttacagt

SEQ ID NO: 1858902 - DNA, 13 bp, Homo sapiens
atcttggcttctt

SEQ ID NO: 1858903 - DNA, 15 bp, Homo sapiens
atcttggtttggtac

SEQ ID NO: 1858904 - DNA, 19 bp, Homo sapiens
atcttggtttggtacagtt

SEQ ID NO: 1858905 - DNA, 20 bp, Homo sapiens
atcttgttattaatgtttct

SEQ ID NO: 1858906 - DNA, 17 bp, Homo sapiens
atctttatgcaaaaaca

SEQ ID NO: 1858907 - DNA, 15 bp, Homo sapiens
atctttggggaaact

SEQ ID NO: 1858908 - DNA, 21 bp, Homo sapiens
atctttgtttaaatgccaaaa

SEQ ID NO: 1858909 - DNA, 18 bp, Homo sapiens
atcttttctgaatcttct

SEQ ID NO: 1858910 - DNA, 18 bp, Homo sapiens
atgaaaataccataggaa

SEQ ID NO: 1858911 - DNA, 16 bp, Homo sapiens
atgaacacatggcaga

SEQ ID NO: 1858912 - DNA, 16 bp, Homo sapiens
atgaactgtggaattt

SEQ ID NO: 1858913 - DNA, 19 bp, Homo sapiens
atgaactgtggaatttatt

SEQ ID NO: 1858914 - DNA, 19 bp, Homo sapiens
atgaacttttacagaatgc

SEQ ID NO: 1858915 - DNA, 15 bp, Homo sapiens
atgaagcaatttata

SEQ ID NO: 1858916 - DNA, 20 bp, Homo sapiens
atgaagcaatttatatcttt

SEQ ID NO: 1858917 - DNA, 15 bp, Homo sapiens
atgaagtataaatct

SEQ ID NO: 1858918 - DNA, 18 bp, Homo sapiens
gactgggccgggcccagg

SEQ ID NO: 1858919 - DNA, 22 bp, Homo sapiens
gactgggccgggcccagggcct

SEQ ID NO: 1858920 - DNA, 15 bp, Homo sapiens
gactggtcctgtgtg

SEQ ID NO: 1858921 - DNA, 17 bp, Homo sapiens
gactggtttgtttgctt

SEQ ID NO: 1858922 - DNA, 21 bp, Homo sapiens
gactgtaagcagattacaata

SEQ ID NO: 1858923 - DNA, 16 bp, Homo sapiens
gactgtcaaatgaact

SEQ ID NO: 1858924 - DNA, 14 bp, Homo sapiens
gactgtgaatttca

SEQ ID NO: 1858925 - DNA, 18 bp, Homo sapiens
gactttgaaaatatatac

SEQ ID NO: 1858926 - DNA, 17 bp, Homo sapiens
gagaaagaaaaggcaaa

SEQ ID NO: 1858927 - DNA, 23 bp, Homo sapiens
gagaaagaaaaggcaaaagactg

SEQ ID NO: 1858928 - DNA, 15 bp, Homo sapiens
gagaagacccctgcc

SEQ ID NO: 1858929 - DNA, 23 bp, Homo sapiens
gagaagatgggggctggaggggg

SEQ ID NO: 1858930 - DNA, 14 bp, Homo sapiens
gagaatgaactgtg

SEQ ID NO: 1858931 - DNA, 20 bp, Homo sapiens
gagacaattagcagaatgga

SEQ ID NO: 1858932 - DNA, 16 bp, Homo sapiens
gagacagaagtcaggt

SEQ ID NO: 1858933 - DNA, 12 bp, Homo sapiens
gagacaggaagg

SEQ ID NO: 1858934 - DNA, 13 bp, Homo sapiens
gagactttgctgt

SEQ ID NO: 1858935 - DNA, 14 bp, Homo sapiens
gagactttgctgtt

SEQ ID NO: 1858936 - DNA, 14 bp, Homo sapiens
gagaggggaagaat

SEQ ID NO: 1858937 - DNA, 13 bp, Homo sapiens
gagcaagagccag

SEQ ID NO: 1858938 - DNA, 21 bp, Homo sapiens
gagcacaagaaggccagccca

SEQ ID NO: 1858939 - DNA, 23 bp, Homo sapiens
gagcacaagaaggccagcccact

SEQ ID NO: 1858940 - DNA, 12 bp, Homo sapiens
gagcagccccca

SEQ ID NO: 1858941 - DNA, 15 bp, Homo sapiens
gagcagctggcactg

SEQ ID NO: 1858942 - DNA, 19 bp, Homo sapiens
gagcagctggcactgacag

SEQ ID NO: 1858943 - DNA, 20 bp, Homo sapiens
gagcagctggcactgacagc

SEQ ID NO: 1858944 - DNA, 20 bp, Homo sapiens
gagcattaactaaatgctca

SEQ ID NO: 1858945 - DNA, 23 bp, Homo sapiens
gagccaggggtgtcccagtccca

SEQ ID NO: 1858946 - DNA, 13 bp, Homo sapiens
gagccgggaaagc

SEQ ID NO: 1858947 - DNA, 16 bp, Homo sapiens
gagctattttaaacca

SEQ ID NO: 1858948 - DNA, 15 bp, Homo sapiens
gagctgtggctgggg

SEQ ID NO: 1858949 - DNA, 17 bp, Homo sapiens
gaggaaccacatataac

SEQ ID NO: 1858950 - DNA, 13 bp, Homo sapiens
gaggacccacctg

SEQ ID NO: 1858951 - DNA, 14 bp, Homo sapiens
gaggacccacctgg

SEQ ID NO: 1858952 - DNA, 21 bp, Homo sapiens
gaggagggccgagacaggagc

SEQ ID NO: 1858953 - DNA, 18 bp, Homo sapiens
gaggccatttgctgccct

SEQ ID NO: 1858954 - DNA, 20 bp, Homo sapiens
gaggccatttgctgccctgg

SEQ ID NO: 1858955 - DNA, 22 bp, Homo sapiens
gaggccatttgctgccctgggg

SEQ ID NO: 1858956 - DNA, 16 bp, Homo sapiens
gagggggcagagtggc

SEQ ID NO: 1858957 - DNA, 17 bp, Homo sapiens
gagggggcagagtggcc

SEQ ID NO: 1858958 - DNA, 19 bp, Homo sapiens
gagggtgtcggctgtgagg

SEQ ID NO: 1858959 - DNA, 23 bp, Homo sapiens
gaggtccttggagtgctgcagct

SEQ ID NO: 1858960 - DNA, 15 bp, Homo sapiens
gaggtgacctgttag

SEQ ID NO: 1858961 - DNA, 21 bp, Homo sapiens
gaggttttgaataaaaagtga

SEQ ID NO: 1858962 - DNA, 15 bp, Homo sapiens
gagtatattataata

SEQ ID NO: 1858963 - DNA, 12 bp, Homo sapiens
gagtcacccccc

SEQ ID NO: 1858964 - DNA, 16 bp, Homo sapiens
gagtcacccccccagg

SEQ ID NO: 1858965 - DNA, 15 bp, Homo sapiens
gagtcagccattcct

SEQ ID NO: 1858966 - DNA, 23 bp, Homo sapiens
gagtcttaactgtatttcagtat

SEQ ID NO: 1858967 - DNA, 14 bp, Homo sapiens
gagtctttgtgtgt

SEQ ID NO: 1858968 - DNA, 18 bp, Homo sapiens
gagtgaaacagagaaaga

SEQ ID NO: 1858969 - DNA, 19 bp, Homo sapiens
gagtgaaacagagaaagaa

SEQ ID NO: 1858970 - DNA, 20 bp, Homo sapiens
gagtgaaacagagaaagaaa

SEQ ID NO: 1858971 - DNA, 13 bp, Homo sapiens
gagtggcctgtga

SEQ ID NO: 1858972 - DNA, 20 bp, Homo sapiens
gagttctatggagactttgc

SEQ ID NO: 1858973 - DNA, 15 bp, Homo sapiens
gataaccagctgtaa

SEQ ID NO: 1858974 - DNA, 16 bp, Homo sapiens
gatacccaacagttta

SEQ ID NO: 1858975 - DNA, 23 bp, Homo sapiens
gatacccaacagtttatttttat

SEQ ID NO: 1858976 - DNA, 18 bp, Homo sapiens
gatataatcttggcttct

SEQ ID NO: 1858977 - DNA, 22 bp, Homo sapiens
gatataatcttggcttcttaaa

SEQ ID NO: 1858978 - DNA, 12 bp, Homo sapiens
gatatagaaaat

SEQ ID NO: 1858979 - DNA, 13 bp, Homo sapiens
gatattttcacag

SEQ ID NO: 1858980 - DNA, 22 bp, Homo sapiens
gatattttccctttttaaaaaa

SEQ ID NO: 1858981 - DNA, 23 bp, Homo sapiens
gatattttccctttttaaaaaat

SEQ ID NO: 1858982 - DNA, 20 bp, Homo sapiens
gatcatataagcaagacagt

SEQ ID NO: 1858983 - DNA, 13 bp, Homo sapiens
gatcatggcagga

SEQ ID NO: 1858984 - DNA, 18 bp, Homo sapiens
gatcattatcttcatgtt

SEQ ID NO: 1858985 - DNA, 16 bp, Homo sapiens
gatctgtactttgtgt

SEQ ID NO: 1858986 - DNA, 14 bp, Homo sapiens
gatctttaaataca

SEQ ID NO: 1858987 - DNA, 19 bp, Homo sapiens
gatctttaaatacagtcaa

SEQ ID NO: 1858988 - DNA, 11 bp, Homo sapiens
gatcttttgta

SEQ ID NO: 1858989 - DNA, 14 bp, Homo sapiens
gatcttttgtaaat

SEQ ID NO: 1858990 - DNA, 13 bp, Homo sapiens
gatgaaaagccat

SEQ ID NO: 1858991 - DNA, 15 bp, Homo sapiens
gatgaaaagccatat

SEQ ID NO: 1858992 - DNA, 16 bp, Homo sapiens
gatgacgcctctggac

SEQ ID NO: 1858993 - DNA, 18 bp, Homo sapiens
gatgacgcctctggacct

SEQ ID NO: 1858994 - DNA, 21 bp, Homo sapiens
gatgacgcctctggacctcgg

SEQ ID NO: 1858995 - DNA, 16 bp, Homo sapiens
gatgacggccaggctc

SEQ ID NO: 1858996 - DNA, 22 bp, Homo sapiens
gatgagggtgtcggctgtgagg

SEQ ID NO: 1858997 - DNA, 21 bp, Homo sapiens
gatggcacttagctatcagaa

SEQ ID NO: 1858998 - DNA, 15 bp, Homo sapiens
gatgttaaatgcctt

SEQ ID NO: 1858999 - DNA, 17 bp, Homo sapiens
gatgttacaagtttgct

SEQ ID NO: 1859000 - DNA, 16 bp, Homo sapiens
gattacaataaatcct

SEQ ID NO: 1859001 - DNA, 22 bp, Homo sapiens
gattacaataaatcctttactt

SEQ ID NO: 1859002 - DNA, 13 bp, Homo sapiens
gattacagaggaa

SEQ ID NO: 1859003 - DNA, 16 bp, Homo sapiens
gattaccagtctgatt

SEQ ID NO: 1859004 - DNA, 14 bp, Homo sapiens
gattagacctttat

SEQ ID NO: 1859005 - DNA, 18 bp, Homo sapiens
gattagacctttatccag

SEQ ID NO: 1859006 - DNA, 14 bp, Homo sapiens
gattcagatttctc

SEQ ID NO: 1859007 - DNA, 23 bp, Homo sapiens
gattgattcagtatcttagagtt

SEQ ID NO: 1859008 - DNA, 16 bp, Homo sapiens
gattggatttgctgtg

SEQ ID NO: 1859009 - DNA, 12 bp, Homo sapiens
gattgttttatc

SEQ ID NO: 1859010 - DNA, 20 bp, Homo sapiens
gatttatagtttgtacatgc

SEQ ID NO: 1859011 - DNA, 21 bp, Homo sapiens
gatttcctcttgaaccagaac

SEQ ID NO: 1859012 - DNA, 19 bp, Homo sapiens
gattttttttttaagtgac

SEQ ID NO: 1859013 - DNA, 21 bp, Homo sapiens
gattttttttttaagtgacat

SEQ ID NO: 1859014 - DNA, 22 bp, Homo sapiens
gcaaaagactggtttgtttgct

SEQ ID NO: 1859015 - DNA, 14 bp, Homo sapiens
gcaaaccctttgta

SEQ ID NO: 1859016 - DNA, 19 bp, Homo sapiens
gcaaagagacccagtcaat

SEQ ID NO: 1859017 - DNA, 18 bp, Homo sapiens
gcaacattaccttgtctt

SEQ ID NO: 1859018 - DNA, 15 bp, Homo sapiens
gcaacatttctgtat

SEQ ID NO: 1859019 - DNA, 20 bp, Homo sapiens
gcaacatttctgtatactgt

SEQ ID NO: 1859020 - DNA, 14 bp, Homo sapiens
gcaaccgtggggag

SEQ ID NO: 1859021 - DNA, 15 bp, Homo sapiens
gcaacctttcccttc

SEQ ID NO: 1859022 - DNA, 15 bp, Homo sapiens
gcaagaattaaaact

SEQ ID NO: 1859023 - DNA, 17 bp, Homo sapiens
gcaagaattaaaactga

SEQ ID NO: 1859024 - DNA, 18 bp, Homo sapiens
gcaagaattaaaactgag

SEQ ID NO: 1859025 - DNA, 12 bp, Homo sapiens
gcaagagccagg

SEQ ID NO: 1859026 - DNA, 16 bp, Homo sapiens
gcaaggggaaacctgt

SEQ ID NO: 1859027 - DNA, 15 bp, Homo sapiens
gcaatgccctgcctt

SEQ ID NO: 1859028 - DNA, 16 bp, Homo sapiens
gcaatgtcctgcatgc

SEQ ID NO: 1859029 - DNA, 19 bp, Homo sapiens
gcaatttatatctttatgc

SEQ ID NO: 1859030 - DNA, 21 bp, Homo sapiens
gcaatttcaggaatttaattt

SEQ ID NO: 1859031 - DNA, 16 bp, Homo sapiens
gcacaagaaggccagc

SEQ ID NO: 1859032 - DNA, 18 bp, Homo sapiens
gcacaagaaggccagccc

SEQ ID NO: 1859033 - DNA, 19 bp, Homo sapiens
gcacaagaaggccagccca

SEQ ID NO: 1859034 - DNA, 20 bp, Homo sapiens
gcacaagaaggccagcccac

SEQ ID NO: 1859035 - DNA, 21 bp, Homo sapiens
gcacaagaaggccagcccact

SEQ ID NO: 1859036 - DNA, 23 bp, Homo sapiens
gcacacacacacacacatacaca

SEQ ID NO: 1859037 - DNA, 21 bp, Homo sapiens
gcacctaaaccaccagtgccc

SEQ ID NO: 1859038 - DNA, 16 bp, Homo sapiens
gcacctagtccagtga

SEQ ID NO: 1859039 - DNA, 21 bp, Homo sapiens
gcaccttaccaactttctgta

SEQ ID NO: 1859040 - DNA, 17 bp, Homo sapiens
gcactaaaatgtttaat

SEQ ID NO: 1859041 - DNA, 21 bp, Homo sapiens
gcactacatgtggtttataga

SEQ ID NO: 1859042 - DNA, 14 bp, Homo sapiens
gcactagaagatga

SEQ ID NO: 1859043 - DNA, 21 bp, Homo sapiens
gcactctctctctgttaaaga

SEQ ID NO: 1859044 - DNA, 16 bp, Homo sapiens
gcactgacagcctggg

SEQ ID NO: 1859045 - DNA, 23 bp, Homo sapiens
gcactgccaccagcaatgccctg

SEQ ID NO: 1859046 - DNA, 15 bp, Homo sapiens
gcactgtggcactgc

SEQ ID NO: 1859047 - DNA, 17 bp, Homo sapiens
gcactgtggcactgcca

SEQ ID NO: 1859048 - DNA, 18 bp, Homo sapiens
gcactgtggcactgccac

SEQ ID NO: 1859049 - DNA, 21 bp, Homo sapiens
gcacttataggtaacgtgatt

SEQ ID NO: 1859050 - DNA, 16 bp, Homo sapiens
gcactttttaaaaaac

SEQ ID NO: 1859051 - DNA, 14 bp, Homo sapiens
gcagaatggagaaa

SEQ ID NO: 1859052 - DNA, 20 bp, Homo sapiens
gcagaatggagaaagtaagt

SEQ ID NO: 1859053 - DNA, 21 bp, Homo sapiens
gcagagcttgtagccctggat

SEQ ID NO: 1859054 - DNA, 16 bp, Homo sapiens
gcagagtggcctgtga

SEQ ID NO: 1859055 - DNA, 19 bp, Homo sapiens
gcagattacaataaatcct

SEQ ID NO: 1859056 - DNA, 15 bp, Homo sapiens
gcagcacgcatgtcc

SEQ ID NO: 1859057 - DNA, 12 bp, Homo sapiens
gcagccaaggaa

SEQ ID NO: 1859058 - DNA, 17 bp, Homo sapiens
gcagccaaggaatgtgt

SEQ ID NO: 1859059 - DNA, 12 bp, Homo sapiens
gcagcccccaaa

SEQ ID NO: 1859060 - DNA, 11 bp, Homo sapiens
gcagcccccac

SEQ ID NO: 1859061 - DNA, 23 bp, Homo sapiens
gcagcccccactgacctgcccat

SEQ ID NO: 1859062 - DNA, 16 bp, Homo sapiens
gcagcgggccaggcag

SEQ ID NO: 1859063 - DNA, 13 bp, Homo sapiens
gcagctggcactg

SEQ ID NO: 1859064 - DNA, 16 bp, Homo sapiens
gcagctttgggaaagc

SEQ ID NO: 1859065 - DNA, 20 bp, Homo sapiens
gcagcttttagttcagactt

SEQ ID NO: 1859066 - DNA, 22 bp, Homo sapiens
gcaggaccactagctaagcaag

SEQ ID NO: 1859067 - DNA, 23 bp, Homo sapiens
gcaggaccactagctaagcaagc

SEQ ID NO: 1859068 - DNA, 13 bp, Homo sapiens
gcaggactctagc

SEQ ID NO: 1859069 - DNA, 19 bp, Homo sapiens
gcaggatgcgctgggacgg

SEQ ID NO: 1859070 - DNA, 18 bp, Homo sapiens
gcaggccaggccagcttc

SEQ ID NO: 1859071 - DNA, 22 bp, Homo sapiens
gcaggtcatggagcagccccca

SEQ ID NO: 1859072 - DNA, 23 bp, Homo sapiens
gcaggtcatggagcagcccccaa

SEQ ID NO: 1859073 - DNA, 14 bp, Homo sapiens
gcagtcttttgctg

SEQ ID NO: 1859074 - DNA, 14 bp, Homo sapiens
gcagtgagtgccat

SEQ ID NO: 1859075 - DNA, 15 bp, Homo sapiens
gcataatttgtctta

SEQ ID NO: 1859076 - DNA, 22 bp, Homo sapiens
gcatatgcttctttaaaaaagc

SEQ ID NO: 1859077 - DNA, 16 bp, Homo sapiens
gcatgacaaaaataac

SEQ ID NO: 1859078 - DNA, 14 bp, Homo sapiens
gcatgggaaaaaga

SEQ ID NO: 1859079 - DNA, 18 bp, Homo sapiens
gcatgtccctccaaggct

SEQ ID NO: 1859080 - DNA, 21 bp, Homo sapiens
gcatgtccctccaaggctgtc

SEQ ID NO: 1859081 - DNA, 18 bp, Homo sapiens
gcatgtttgtctgtgtgc

SEQ ID NO: 1859082 - DNA, 21 bp, Homo sapiens
gcatgtttgtctgtgtgctgt

SEQ ID NO: 1859083 - DNA, 16 bp, Homo sapiens
gcattaactaaatgct

SEQ ID NO: 1859084 - DNA, 16 bp, Homo sapiens
gcatttttccatctgt

SEQ ID NO: 1859085 - DNA, 19 bp, Homo sapiens
gcatttttccatctgtgtg

SEQ ID NO: 1859086 - DNA, 15 bp, Homo sapiens
gccaaaatgtactta

SEQ ID NO: 1859087 - DNA, 23 bp, Homo sapiens
gccaaaggaccgttttgtattgc

SEQ ID NO: 1859088 - DNA, 20 bp, Homo sapiens
gccaaattaatcttttaaaa

SEQ ID NO: 1859089 - DNA, 15 bp, Homo sapiens
gccaaattatttgtg

SEQ ID NO: 1859090 - DNA, 19 bp, Homo sapiens
gccaaattatttgtgtaat

SEQ ID NO: 1859091 - DNA, 12 bp, Homo sapiens
gccaagacttgg

SEQ ID NO: 1859092 - DNA, 18 bp, Homo sapiens
gccaagacttggcaacag

SEQ ID NO: 1859093 - DNA, 23 bp, Homo sapiens
gccaagacttggcaacagaagca

SEQ ID NO: 1859094 - DNA, 16 bp, Homo sapiens
gccaaggaatgtgtcc

SEQ ID NO: 1859095 - DNA, 23 bp, Homo sapiens
gccacaagaaatttgatttctat

SEQ ID NO: 1859096 - DNA, 23 bp, Homo sapiens
gccaccagcaatgccctgccttg

SEQ ID NO: 1859097 - DNA, 14 bp, Homo sapiens
gccagcccactggg

SEQ ID NO: 1859098 - DNA, 17 bp, Homo sapiens
gccagcccactgggccc

SEQ ID NO: 1859099 - DNA, 12 bp, Homo sapiens
gccaggagaaga

SEQ ID NO: 1859100 - DNA, 19 bp, Homo sapiens
gccaggagaagacccctgc

SEQ ID NO: 1859101 - DNA, 20 bp, Homo sapiens
gccaggagaagacccctgcc

SEQ ID NO: 1859102 - DNA, 17 bp, Homo sapiens
gccaggctccctgacca

SEQ ID NO: 1859103 - DNA, 19 bp, Homo sapiens
gccaggctccctgaccacc

SEQ ID NO: 1859104 - DNA, 20 bp, Homo sapiens
gccaggggtgtcccagtccc

SEQ ID NO: 1859105 - DNA, 15 bp, Homo sapiens
gccagtttagagttc

SEQ ID NO: 1859106 - DNA, 17 bp, Homo sapiens
gccatgctttttggtga

SEQ ID NO: 1859107 - DNA, 15 bp, Homo sapiens
gccattcctgttctc

SEQ ID NO: 1859108 - DNA, 13 bp, Homo sapiens
gccatttgctgcc

SEQ ID NO: 1859109 - DNA, 16 bp, Homo sapiens
gccatttgctgccctg

SEQ ID NO: 1859110 - DNA, 17 bp, Homo sapiens
gccatttgctgccctgg

SEQ ID NO: 1859111 - DNA, 21 bp, Homo sapiens
gccatttgctgccctggggca

SEQ ID NO: 1859112 - DNA, 14 bp, Homo sapiens
gcccaagtggctct

SEQ ID NO: 1859113 - DNA, 17 bp, Homo sapiens
gcccaagtggctcttgg

SEQ ID NO: 1859114 - DNA, 13 bp, Homo sapiens
gcccaatcctccc

SEQ ID NO: 1859115 - DNA, 15 bp, Homo sapiens
gcccaatcctccctg

SEQ ID NO: 1859116 - DNA, 19 bp, Homo sapiens
gcccaatcctccctggaga

SEQ ID NO: 1859117 - DNA, 15 bp, Homo sapiens
gcccactcccccagg

SEQ ID NO: 1859118 - DNA, 18 bp, Homo sapiens
gcccactcccccaggagc

SEQ ID NO: 1859119 - DNA, 17 bp, Homo sapiens
gcccactgggccctggg

SEQ ID NO: 1859120 - DNA, 23 bp, Homo sapiens
gcccagggcctctggcttccctg

SEQ ID NO: 1859121 - DNA, 20 bp, Homo sapiens
gcccccaaagagctgtggct

SEQ ID NO: 1859122 - DNA, 13 bp, Homo sapiens
gcccccactgacc

SEQ ID NO: 1859123 - DNA, 19 bp, Homo sapiens
gcccccactgacctgccca

SEQ ID NO: 1859124 - DNA, 17 bp, Homo sapiens
gcccctccccaaaagaa

SEQ ID NO: 1859125 - DNA, 15 bp, Homo sapiens
gccctatttttgcaa

SEQ ID NO: 1859126 - DNA, 12 bp, Homo sapiens
gccctcactcag

SEQ ID NO: 1859127 - DNA, 20 bp, Homo sapiens
gccctcactcaggaaccctg

SEQ ID NO: 1859128 - DNA, 22 bp, Homo sapiens
gccctcactcaggaaccctgga

SEQ ID NO: 1859129 - DNA, 16 bp, Homo sapiens
gccctgccttgctgcc

SEQ ID NO: 1859130 - DNA, 18 bp, Homo sapiens
gccctggatggcctctgg

SEQ ID NO: 1859131 - DNA, 15 bp, Homo sapiens
gccctggggctgccc

SEQ ID NO: 1859132 - DNA, 17 bp, Homo sapiens
gccctggggctgccctc

SEQ ID NO: 1859133 - DNA, 22 bp, Homo sapiens
gccctggggctgccctcggcaa

SEQ ID NO: 1859134 - DNA, 11 bp, Homo sapiens
gccctgtctgt

SEQ ID NO: 1859135 - DNA, 22 bp, Homo sapiens
gccctttcccaggtaatttaaa

SEQ ID NO: 1859136 - DNA, 13 bp, Homo sapiens
gccctttctgtgt

SEQ ID NO: 1859137 - DNA, 13 bp, Homo sapiens
gccgcagccccca

SEQ ID NO: 1859138 - DNA, 21 bp, Homo sapiens
gccgcagcccccactgacctg

SEQ ID NO: 1859139 - DNA, 17 bp, Homo sapiens
gccgctctccccctgca

SEQ ID NO: 1859140 - DNA, 18 bp, Homo sapiens
gccgctctccccctgcag

SEQ ID NO: 1859141 - DNA, 20 bp, Homo sapiens
gccgctctccccctgcagcc

SEQ ID NO: 1859142 - DNA, 21 bp, Homo sapiens
gccgctctccccctgcagccg

SEQ ID NO: 1859143 - DNA, 11 bp, Homo sapiens
gccgggaaagc

SEQ ID NO: 1859144 - DNA, 19 bp, Homo sapiens
gccgggcccagggcctctg

SEQ ID NO: 1859145 - DNA, 15 bp, Homo sapiens
gcctctgactcacca

SEQ ID NO: 1859146 - DNA, 22 bp, Homo sapiens
gcctctggacctcggtgatgcc

SEQ ID NO: 1859147 - DNA, 23 bp, Homo sapiens
gcctctggacctcggtgatgcct

SEQ ID NO: 1859148 - DNA, 13 bp, Homo sapiens
gcctctggcttcc

SEQ ID NO: 1859149 - DNA, 19 bp, Homo sapiens
gcctctggggcaggaccac

SEQ ID NO: 1859150 - DNA, 16 bp, Homo sapiens
gcctgggggggccgct

SEQ ID NO: 1859151 - DNA, 16 bp, Homo sapiens
gccttaaagaaagtcg

SEQ ID NO: 1859152 - DNA, 13 bp, Homo sapiens
gccttcaccctga

SEQ ID NO: 1859153 - DNA, 20 bp, Homo sapiens
gccttccgacaccactggga

SEQ ID NO: 1859154 - DNA, 16 bp, Homo sapiens
gccttgatgttgtgtt

SEQ ID NO: 1859155 - DNA, 14 bp, Homo sapiens
gccttttatagcta

SEQ ID NO: 1859156 - DNA, 21 bp, Homo sapiens
gccttttttagcttcatatct

SEQ ID NO: 1859157 - DNA, 17 bp, Homo sapiens
gcgaaacccccttttcc

SEQ ID NO: 1859158 - DNA, 15 bp, Homo sapiens
gcgatggtctcagaa

SEQ ID NO: 1859159 - DNA, 17 bp, Homo sapiens
gcgcttagaaacatgtt

SEQ ID NO: 1859160 - DNA, 15 bp, Homo sapiens
gcggccacagcacta

SEQ ID NO: 1859161 - DNA, 24 bp, Homo sapiens
gcggggacaccgggaagtgcagcg

SEQ ID NO: 1859162 - DNA, 16 bp, Homo sapiens
gcgtggggcagcagct

SEQ ID NO: 1859163 - DNA, 16 bp, Homo sapiens
gctaaaagaagagagg

SEQ ID NO: 1859164 - DNA, 19 bp, Homo sapiens
gctaaaagtgcatttaagg

SEQ ID NO: 1859165 - DNA, 23 bp, Homo sapiens
gctaaaagtgcatttaaggagat

SEQ ID NO: 1859166 - DNA, 15 bp, Homo sapiens
gctaagcaagccagg

SEQ ID NO: 1859167 - DNA, 18 bp, Homo sapiens
gctaagcaagccaggaga

SEQ ID NO: 1859168 - DNA, 20 bp, Homo sapiens
gctacatggggtctgggtgg

SEQ ID NO: 1859169 - DNA, 18 bp, Homo sapiens
gctactgcagctttacat

SEQ ID NO: 1859170 - DNA, 15 bp, Homo sapiens
gctagacacccattt

SEQ ID NO: 1859171 - DNA, 18 bp, Homo sapiens
gctagtgccaaataattg

SEQ ID NO: 1859172 - DNA, 13 bp, Homo sapiens
gctatcctgctga

SEQ ID NO: 1859173 - DNA, 20 bp, Homo sapiens
gctatcctgctgaaagtcct

SEQ ID NO: 1859174 - DNA, 15 bp, Homo sapiens
gctattactgtctgg

SEQ ID NO: 1859175 - DNA, 16 bp, Homo sapiens
gctattcccttctgat

SEQ ID NO: 1859176 - DNA, 22 bp, Homo sapiens
gctattcccttctgatcttgga

SEQ ID NO: 1859177 - DNA, 21 bp, Homo sapiens
gctattttaaaccaattgcag

SEQ ID NO: 1859178 - DNA, 20 bp, Homo sapiens
gctcagctactgatttttgt

SEQ ID NO: 1859179 - DNA, 15 bp, Homo sapiens
gctcatgtatattta

SEQ ID NO: 1859180 - DNA, 18 bp, Homo sapiens
gctccctgaccaccctgc

SEQ ID NO: 1859181 - DNA, 15 bp, Homo sapiens
gctcctgctcattgt

SEQ ID NO: 1859182 - DNA, 12 bp, Homo sapiens
gctctagaaagt

SEQ ID NO: 1859183 - DNA, 16 bp, Homo sapiens
gctctccccctgcagc

SEQ ID NO: 1859184 - DNA, 17 bp, Homo sapiens
gctctccccctgcagcc

SEQ ID NO: 1859185 - DNA, 15 bp, Homo sapiens
gctctgacccagtga

SEQ ID NO: 1859186 - DNA, 14 bp, Homo sapiens
gctcttaaaaatct

SEQ ID NO: 1859187 - DNA, 17 bp, Homo sapiens
gctcttatttttgtacc

SEQ ID NO: 1859188 - DNA, 17 bp, Homo sapiens
gctgaaagtcctgcttt

SEQ ID NO: 1859189 - DNA, 22 bp, Homo sapiens
gctgaattgagctagaaatcac

SEQ ID NO: 1859190 - DNA, 14 bp, Homo sapiens
gctgagagactttt

SEQ ID NO: 1859191 - DNA, 22 bp, Homo sapiens
gctgaggttttgaataaaaagt

SEQ ID NO: 1859192 - DNA, 13 bp, Homo sapiens
gctgccctggggc

SEQ ID NO: 1859193 - DNA, 15 bp, Homo sapiens
gctgccttcaccctg

SEQ ID NO: 1859194 - DNA, 17 bp, Homo sapiens
gctgcttacactccagg

SEQ ID NO: 1859195 - DNA, 15 bp, Homo sapiens
gctgctttgatatat

SEQ ID NO: 1859196 - DNA, 14 bp, Homo sapiens
gctggacacctaca

SEQ ID NO: 1859197 - DNA, 22 bp, Homo sapiens
gctggagggggcagagtggcct

SEQ ID NO: 1859198 - DNA, 19 bp, Homo sapiens
gctggcaggtcatggagca

SEQ ID NO: 1859199 - DNA, 21 bp, Homo sapiens
gctggcaggtcatggagcagc

SEQ ID NO: 1859200 - DNA, 22 bp, Homo sapiens
gctggcaggtcatggagcagcc

SEQ ID NO: 1859201 - DNA, 23 bp, Homo sapiens
gctggcaggtcatggagcagccc

SEQ ID NO: 1859202 - DNA, 18 bp, Homo sapiens
gctggggggatgacggcc

SEQ ID NO: 1859203 - DNA, 14 bp, Homo sapiens
gctggtaaactatt

SEQ ID NO: 1859204 - DNA, 15 bp, Homo sapiens
gctggtaaactattt

SEQ ID NO: 1859205 - DNA, 19 bp, Homo sapiens
gctgtacattactgtatgt

SEQ ID NO: 1859206 - DNA, 20 bp, Homo sapiens
gctgtagtagccctttctgt

SEQ ID NO: 1859207 - DNA, 21 bp, Homo sapiens
gctgtagtagccctttctgtg

SEQ ID NO: 1859208 - DNA, 15 bp, Homo sapiens
gctgtgaggcgggtg

SEQ ID NO: 1859209 - DNA, 12 bp, Homo sapiens
gcttaatttcct

SEQ ID NO: 1859210 - DNA, 20 bp, Homo sapiens
gcttaatttccttctgttaa

SEQ ID NO: 1859211 - DNA, 22 bp, Homo sapiens
gcttacttacaaaagcagcttt

SEQ ID NO: 1859212 - DNA, 19 bp, Homo sapiens
ccgctctccccctgcagcc

SEQ ID NO: 1859213 - DNA, 14 bp, Homo sapiens
ccggccgcagcccc

SEQ ID NO: 1859214 - DNA, 16 bp, Homo sapiens
ccggccgcagccccca

SEQ ID NO: 1859215 - DNA, 14 bp, Homo sapiens
ccgggcccagggcc

SEQ ID NO: 1859216 - DNA, 23 bp, Homo sapiens
ccgtggggaggccatttgctgcc

SEQ ID NO: 1859217 - DNA, 11 bp, Homo sapiens
ccgtttacagt

SEQ ID NO: 1859218 - DNA, 12 bp, Homo sapiens
cctacagcagca

SEQ ID NO: 1859219 - DNA, 14 bp, Homo sapiens
cctacaggactggg

SEQ ID NO: 1859220 - DNA, 12 bp, Homo sapiens
cctagagactca

SEQ ID NO: 1859221 - DNA, 23 bp, Homo sapiens
cctatctagcatttatttctctg

SEQ ID NO: 1859222 - DNA, 24 bp, Homo sapiens
cctcactcaggaaccctggagaca

SEQ ID NO: 1859223 - DNA, 16 bp, Homo sapiens
cctccaaggctgtctt

SEQ ID NO: 1859224 - DNA, 18 bp, Homo sapiens
cctccaaggctgtcttct

SEQ ID NO: 1859225 - DNA, 22 bp, Homo sapiens
cctccagaaccttactggcact

SEQ ID NO: 1859226 - DNA, 23 bp, Homo sapiens
cctccccaaaagaaaccatgaca

SEQ ID NO: 1859227 - DNA, 12 bp, Homo sapiens
cctccctggaga

SEQ ID NO: 1859228 - DNA, 20 bp, Homo sapiens
cctcctgggcatgtttgtct

SEQ ID NO: 1859229 - DNA, 15 bp, Homo sapiens
cctctagctgttctt

SEQ ID NO: 1859230 - DNA, 17 bp, Homo sapiens
cctctgactcaccacga

SEQ ID NO: 1859231 - DNA, 22 bp, Homo sapiens
cctctggacctcggtgatgcct

SEQ ID NO: 1859232 - DNA, 15 bp, Homo sapiens
cctctggcttccctg

SEQ ID NO: 1859233 - DNA, 17 bp, Homo sapiens
cctctggcttccctgcc

SEQ ID NO: 1859234 - DNA, 20 bp, Homo sapiens
cctctggcttccctgcccaa

SEQ ID NO: 1859235 - DNA, 14 bp, Homo sapiens
cctcttgcatttca

SEQ ID NO: 1859236 - DNA, 21 bp, Homo sapiens
cctgaacatttagtaccctgc

SEQ ID NO: 1859237 - DNA, 14 bp, Homo sapiens
cctgaccaccctgc

SEQ ID NO: 1859238 - DNA, 21 bp, Homo sapiens
cctgaccaccctgcctgtgga

SEQ ID NO: 1859239 - DNA, 21 bp, Homo sapiens
cctgatggcacttagctatca

SEQ ID NO: 1859240 - DNA, 19 bp, Homo sapiens
cctgcagccgtgcaggact

SEQ ID NO: 1859241 - DNA, 14 bp, Homo sapiens
cctgcaggccaggc

SEQ ID NO: 1859242 - DNA, 9 bp, Homo sapiens
cctgcccaa

SEQ ID NO: 1859243 - DNA, 20 bp, Homo sapiens
cctgcccctccccaaaagaa

SEQ ID NO: 1859244 - DNA, 21 bp, Homo sapiens
cctgcccctccccaaaagaaa

SEQ ID NO: 1859245 - DNA, 22 bp, Homo sapiens
cctgcccctccccaaaagaaac

SEQ ID NO: 1859246 - DNA, 18 bp, Homo sapiens
cctgcctgtggaggtgac

SEQ ID NO: 1859247 - DNA, 14 bp, Homo sapiens
cctgccttatgcaa

SEQ ID NO: 1859248 - DNA, 17 bp, Homo sapiens
cctgccttatgcaaggg

SEQ ID NO: 1859249 - DNA, 14 bp, Homo sapiens
cctgccttgctgcc

SEQ ID NO: 1859250 - DNA, 21 bp, Homo sapiens
cctggaaggtgtcatttgaca

SEQ ID NO: 1859251 - DNA, 20 bp, Homo sapiens
cctggagaagggacatggga

SEQ ID NO: 1859252 - DNA, 14 bp, Homo sapiens
cctgggccaaggac

SEQ ID NO: 1859253 - DNA, 15 bp, Homo sapiens
cctgggccaaggact

SEQ ID NO: 1859254 - DNA, 17 bp, Homo sapiens
cctgggccaaggactcc

SEQ ID NO: 1859255 - DNA, 22 bp, Homo sapiens
cctgtatagttaggatagcatt

SEQ ID NO: 1859256 - DNA, 14 bp, Homo sapiens
cctgtctgtttata

SEQ ID NO: 1859257 - DNA, 20 bp, Homo sapiens
cctgtgctatgctggacatt

SEQ ID NO: 1859258 - DNA, 19 bp, Homo sapiens
cctgttaggtctcatgccc

SEQ ID NO: 1859259 - DNA, 21 bp, Homo sapiens
cctgttaggtctcatgcccac

SEQ ID NO: 1859260 - DNA, 20 bp, Homo sapiens
cctgttgtgtaataacagaa

SEQ ID NO: 1859261 - DNA, 23 bp, Homo sapiens
ccttaaagaaagtcgaattaata

SEQ ID NO: 1859262 - DNA, 17 bp, Homo sapiens
ccttatgtgttacatta

SEQ ID NO: 1859263 - DNA, 17 bp, Homo sapiens
ccttccgacaccactgg

SEQ ID NO: 1859264 - DNA, 22 bp, Homo sapiens
ccttcctttttattcagctaga

SEQ ID NO: 1859265 - DNA, 16 bp, Homo sapiens
ccttctgttaagaaag

SEQ ID NO: 1859266 - DNA, 21 bp, Homo sapiens
ccttctgttaagaaaggatat

SEQ ID NO: 1859267 - DNA, 14 bp, Homo sapiens
ccttgctgccttca

SEQ ID NO: 1859268 - DNA, 19 bp, Homo sapiens
ccttgctgccttcaccctg

SEQ ID NO: 1859269 - DNA, 22 bp, Homo sapiens
ccttggagtgctgcagctttgg

SEQ ID NO: 1859270 - DNA, 11 bp, Homo sapiens
cctttctgtgt

SEQ ID NO: 1859271 - DNA, 16 bp, Homo sapiens
ccttttatagctatta

SEQ ID NO: 1859272 - DNA, 17 bp, Homo sapiens
cctttttaaaaaatacc

SEQ ID NO: 1859273 - DNA, 15 bp, Homo sapiens
cgatgacgcctctgg

SEQ ID NO: 1859274 - DNA, 16 bp, Homo sapiens
cgatgacgcctctgga

SEQ ID NO: 1859275 - DNA, 19 bp, Homo sapiens
cgcagcccccactgacctg

SEQ ID NO: 1859276 - DNA, 20 bp, Homo sapiens
cgcagcccccactgacctgc

SEQ ID NO: 1859277 - DNA, 22 bp, Homo sapiens
cgctggacacctacagcagcac

SEQ ID NO: 1859278 - DNA, 13 bp, Homo sapiens
cgcttagaaacat

SEQ ID NO: 1859279 - DNA, 18 bp, Homo sapiens
cgcttagttcttgaattg

SEQ ID NO: 1859280 - DNA, 13 bp, Homo sapiens
cgcttcccacctg

SEQ ID NO: 1859281 - DNA, 14 bp, Homo sapiens
cgcttcccacctgc

SEQ ID NO: 1859282 - DNA, 18 bp, Homo sapiens
cggacaaagttcagtgtc

SEQ ID NO: 1859283 - DNA, 19 bp, Homo sapiens
cggcaaccgtggggaggcc

SEQ ID NO: 1859284 - DNA, 13 bp, Homo sapiens
cggccacagcact

SEQ ID NO: 1859285 - DNA, 16 bp, Homo sapiens
cggccacagcactaga

SEQ ID NO: 1859286 - DNA, 16 bp, Homo sapiens
cggccaggctccctga

SEQ ID NO: 1859287 - DNA, 21 bp, Homo sapiens
cggccaggctccctgaccacc

SEQ ID NO: 1859288 - DNA, 14 bp, Homo sapiens
cggccgcagccccc

SEQ ID NO: 1859289 - DNA, 15 bp, Homo sapiens
cggccgcagccccca

SEQ ID NO: 1859290 - DNA, 16 bp, Homo sapiens
cggccgcagcccccac

SEQ ID NO: 1859291 - DNA, 21 bp, Homo sapiens
cggccgcagcccccactgacc

SEQ ID NO: 1859292 - DNA, 24 bp, Homo sapiens
cggccgcagcccccactgacctgc

SEQ ID NO: 1859293 - DNA, 19 bp, Homo sapiens
cgggaagtgcagcgggcca

SEQ ID NO: 1859294 - DNA, 16 bp, Homo sapiens
cgggatgaaaagccat

SEQ ID NO: 1859295 - DNA, 13 bp, Homo sapiens
cgggccaggcagg

SEQ ID NO: 1859296 - DNA, 18 bp, Homo sapiens
cgtattttgatcagtgtt

SEQ ID NO: 1859297 - DNA, 19 bp, Homo sapiens
cgtccatttcttatttaat

SEQ ID NO: 1859298 - DNA, 17 bp, Homo sapiens
cgtccccctagagactc

SEQ ID NO: 1859299 - DNA, 18 bp, Homo sapiens
cgtccccctagagactca

SEQ ID NO: 1859300 - DNA, 13 bp, Homo sapiens
cgtgacagcctct

SEQ ID NO: 1859301 - DNA, 16 bp, Homo sapiens
cgttcttacaagctta

SEQ ID NO: 1859302 - DNA, 20 bp, Homo sapiens
cgttcttacaagcttaaagc

SEQ ID NO: 1859303 - DNA, 19 bp, Homo sapiens
cgtttggttaaagtatgtc

SEQ ID NO: 1859304 - DNA, 19 bp, Homo sapiens
ctaaaagtgcatttaagga

SEQ ID NO: 1859305 - DNA, 17 bp, Homo sapiens
ctaaaatgtttaattca

SEQ ID NO: 1859306 - DNA, 17 bp, Homo sapiens
ctaaacaaggtaatttt

SEQ ID NO: 1859307 - DNA, 16 bp, Homo sapiens
ctaaactctgaataag

SEQ ID NO: 1859308 - DNA, 12 bp, Homo sapiens
ctaaagctttat

SEQ ID NO: 1859309 - DNA, 14 bp, Homo sapiens
ctaaagctttatct

SEQ ID NO: 1859310 - DNA, 14 bp, Homo sapiens
ctaaagggagaaat

SEQ ID NO: 1859311 - DNA, 16 bp, Homo sapiens
ctaaagtatgtaaagt

SEQ ID NO: 1859312 - DNA, 16 bp, Homo sapiens
ctaaattagtttaaaa

SEQ ID NO: 1859313 - DNA, 19 bp, Homo sapiens
ctaagttgagtatattata

SEQ ID NO: 1859314 - DNA, 21 bp, Homo sapiens
ctaagttgagtatattataat

SEQ ID NO: 1859315 - DNA, 23 bp, Homo sapiens
ctaatatactttttttgttatag

SEQ ID NO: 1859316 - DNA, 13 bp, Homo sapiens
ctaatattaaaaa

SEQ ID NO: 1859317 - DNA, 19 bp, Homo sapiens
ctaatctgcctggttttat

SEQ ID NO: 1859318 - DNA, 19 bp, Homo sapiens
ctaattatcaatgggatat

SEQ ID NO: 1859319 - DNA, 15 bp, Homo sapiens
ctaattcctttctat

SEQ ID NO: 1859320 - DNA, 23 bp, Homo sapiens
ctaatttaccattattttacagt

SEQ ID NO: 1859321 - DNA, 12 bp, Homo sapiens
ctacatattgaa

SEQ ID NO: 1859322 - DNA, 22 bp, Homo sapiens
ctacatggggtctgggtggggg

SEQ ID NO: 1859323 - DNA, 12 bp, Homo sapiens
ctacattaaaca

SEQ ID NO: 1859324 - DNA, 14 bp, Homo sapiens
ctacctttttatat

SEQ ID NO: 1859325 - DNA, 15 bp, Homo sapiens
ctacctttttatatt

SEQ ID NO: 1859326 - DNA, 20 bp, Homo sapiens
ctacttatcatttttgtata

SEQ ID NO: 1859327 - DNA, 20 bp, Homo sapiens
ctagaaatcacaagaacaaa

SEQ ID NO: 1859328 - DNA, 12 bp, Homo sapiens
ctagaagcagaa

SEQ ID NO: 1859329 - DNA, 13 bp, Homo sapiens
ctagactttctgt

SEQ ID NO: 1859330 - DNA, 16 bp, Homo sapiens
ctagcatttatttctc

SEQ ID NO: 1859331 - DNA, 21 bp, Homo sapiens
ccaagggccctcactcaggaa

SEQ ID NO: 1859332 - DNA, 21 bp, Homo sapiens
ccaagtatgaagtataaatct

SEQ ID NO: 1859333 - DNA, 12 bp, Homo sapiens
ccaagtggctct

SEQ ID NO: 1859334 - DNA, 21 bp, Homo sapiens
ccaatgatacccaacagttta

SEQ ID NO: 1859335 - DNA, 14 bp, Homo sapiens
ccaattctgaaata

SEQ ID NO: 1859336 - DNA, 14 bp, Homo sapiens
ccaatttatgcaga

SEQ ID NO: 1859337 - DNA, 15 bp, Homo sapiens
ccacaagaaatttga

SEQ ID NO: 1859338 - DNA, 16 bp, Homo sapiens
ccacaagaaatttgat

SEQ ID NO: 1859339 - DNA, 15 bp, Homo sapiens
ccaccctgcctgtgg

SEQ ID NO: 1859340 - DNA, 16 bp, Homo sapiens
ccaccctgcctgtgga

SEQ ID NO: 1859341 - DNA, 18 bp, Homo sapiens
ccacgatgacgcctctgg

SEQ ID NO: 1859342 - DNA, 20 bp, Homo sapiens
ccacgatgacgcctctggac

SEQ ID NO: 1859343 - DNA, 17 bp, Homo sapiens
ccactcccccaggagca

SEQ ID NO: 1859344 - DNA, 17 bp, Homo sapiens
ccactgacctgcccatg

SEQ ID NO: 1859345 - DNA, 16 bp, Homo sapiens
ccactggcatcgcagc

SEQ ID NO: 1859346 - DNA, 14 bp, Homo sapiens
ccactgggccctgg

SEQ ID NO: 1859347 - DNA, 15 bp, Homo sapiens
ccactgggccctggg

SEQ ID NO: 1859348 - DNA, 22 bp, Homo sapiens
ccactgggccctggggctgccc

SEQ ID NO: 1859349 - DNA, 13 bp, Homo sapiens
ccagaaattagaa

SEQ ID NO: 1859350 - DNA, 18 bp, Homo sapiens
ccagagcacaagaaggcc

SEQ ID NO: 1859351 - DNA, 23 bp, Homo sapiens
ccagagcacaagaaggccagccc

SEQ ID NO: 1859352 - DNA, 16 bp, Homo sapiens
ccagagggactggaca

SEQ ID NO: 1859353 - DNA, 18 bp, Homo sapiens
ccagagggactggacagc

SEQ ID NO: 1859354 - DNA, 22 bp, Homo sapiens
ccagagggactggacagccagg

SEQ ID NO: 1859355 - DNA, 14 bp, Homo sapiens
ccagcaatgccctg

SEQ ID NO: 1859356 - DNA, 16 bp, Homo sapiens
ccagcaatgccctgcc

SEQ ID NO: 1859357 - DNA, 23 bp, Homo sapiens
ccagcacgttttctggcttctgc

SEQ ID NO: 1859358 - DNA, 22 bp, Homo sapiens
ccagcagttgaatgacaacaga

SEQ ID NO: 1859359 - DNA, 13 bp, Homo sapiens
ccagcctctgggg

SEQ ID NO: 1859360 - DNA, 21 bp, Homo sapiens
ccagccttatgtgttacatta

SEQ ID NO: 1859361 - DNA, 21 bp, Homo sapiens
ccagctagtgccaaataattg

SEQ ID NO: 1859362 - DNA, 16 bp, Homo sapiens
ccagcttcccctcact

SEQ ID NO: 1859363 - DNA, 20 bp, Homo sapiens
ccaggagaagacccctgccc

SEQ ID NO: 1859364 - DNA, 22 bp, Homo sapiens
ccaggagaagacccctgcccaa

SEQ ID NO: 1859365 - DNA, 13 bp, Homo sapiens
ccaggagcagctg

SEQ ID NO: 1859366 - DNA, 17 bp, Homo sapiens
ccaggagcagctggcac

SEQ ID NO: 1859367 - DNA, 14 bp, Homo sapiens
ccaggccagcttcc

SEQ ID NO: 1859368 - DNA, 13 bp, Homo sapiens
ccaggctccctga

SEQ ID NO: 1859369 - DNA, 15 bp, Homo sapiens
ccaggctccctgacc

SEQ ID NO: 1859370 - DNA, 23 bp, Homo sapiens
ccaggctccctgaccaccctgcc

SEQ ID NO: 1859371 - DNA, 23 bp, Homo sapiens
ccagggcctctggcttccctgcc

SEQ ID NO: 1859372 - DNA, 19 bp, Homo sapiens
ccaggggtgtcccagtccc

SEQ ID NO: 1859373 - DNA, 22 bp, Homo sapiens
ccaggggtgtcccagtcccagc

SEQ ID NO: 1859374 - DNA, 23 bp, Homo sapiens
ccaggtgtggaccggccgcagcc

SEQ ID NO: 1859375 - DNA, 18 bp, Homo sapiens
ccagtcacctcctgctcc

SEQ ID NO: 1859376 - DNA, 18 bp, Homo sapiens
ccagtgacctgctgggta

SEQ ID NO: 1859377 - DNA, 20 bp, Homo sapiens
ccagtgacctgctgggtaaa

SEQ ID NO: 1859378 - DNA, 22 bp, Homo sapiens
ccagtgacctgctgggtaaact

SEQ ID NO: 1859379 - DNA, 16 bp, Homo sapiens
ccagtttattctgtgg

SEQ ID NO: 1859380 - DNA, 19 bp, Homo sapiens
ccataaatcaattcattgt

SEQ ID NO: 1859381 - DNA, 22 bp, Homo sapiens
ccataggaagacataaaacttt

SEQ ID NO: 1859382 - DNA, 23 bp, Homo sapiens
ccatatatgctgtatttctttgt

SEQ ID NO: 1859383 - DNA, 14 bp, Homo sapiens
ccatattgctctta

SEQ ID NO: 1859384 - DNA, 23 bp, Homo sapiens
ccatggccacgaggaagcagcaa

SEQ ID NO: 1859385 - DNA, 14 bp, Homo sapiens
ccatgtccagaggg

SEQ ID NO: 1859386 - DNA, 15 bp, Homo sapiens
ccatgtttgtaaaac

SEQ ID NO: 1859387 - DNA, 19 bp, Homo sapiens
ccattattttacagtctct

SEQ ID NO: 1859388 - DNA, 18 bp, Homo sapiens
ccatttgctgccctgggg

SEQ ID NO: 1859389 - DNA, 21 bp, Homo sapiens
ccatttgctgccctggggcat

SEQ ID NO: 1859390 - DNA, 17 bp, Homo sapiens
cccaaagagctgtggct

SEQ ID NO: 1859391 - DNA, 23 bp, Homo sapiens
cccaaagagctgtggctgggggg

SEQ ID NO: 1859392 - DNA, 16 bp, Homo sapiens
cccaaagtctgtgtga

SEQ ID NO: 1859393 - DNA, 16 bp, Homo sapiens
cccaatcctccctgga

SEQ ID NO: 1859394 - DNA, 21 bp, Homo sapiens
cccactcccccaggagcagct

SEQ ID NO: 1859395 - DNA, 14 bp, Homo sapiens
cccactgacctgcc

SEQ ID NO: 1859396 - DNA, 15 bp, Homo sapiens
cccactgggccctgg

SEQ ID NO: 1859397 - DNA, 16 bp, Homo sapiens
cccactgggccctggg

SEQ ID NO: 1859398 - DNA, 17 bp, Homo sapiens
cccagcctctggggcag

SEQ ID NO: 1859399 - DNA, 14 bp, Homo sapiens
cccaggagcagctg

SEQ ID NO: 1859400 - DNA, 15 bp, Homo sapiens
cccaggagcagctgg

SEQ ID NO: 1859401 - DNA, 16 bp, Homo sapiens
cccaggagcagctggc

SEQ ID NO: 1859402 - DNA, 21 bp, Homo sapiens
cccaggagcagctggcactga

SEQ ID NO: 1859403 - DNA, 22 bp, Homo sapiens
cccaggagcagctggcactgac

SEQ ID NO: 1859404 - DNA, 23 bp, Homo sapiens
cccaggagcagctggcactgaca

SEQ ID NO: 1859405 - DNA, 12 bp, Homo sapiens
cccagggcctct

SEQ ID NO: 1859406 - DNA, 15 bp, Homo sapiens
cccagggcctctggc

SEQ ID NO: 1859407 - DNA, 13 bp, Homo sapiens
cccagtcccagcc

SEQ ID NO: 1859408 - DNA, 17 bp, Homo sapiens
cccagtcccagcctctg

SEQ ID NO: 1859409 - DNA, 17 bp, Homo sapiens
ccccaaagagctgtggc

SEQ ID NO: 1859410 - DNA, 21 bp, Homo sapiens
ccccaaatcacaaacatatgt

SEQ ID NO: 1859411 - DNA, 15 bp, Homo sapiens
ccccaatccatgctt

SEQ ID NO: 1859412 - DNA, 17 bp, Homo sapiens
ccccactgacctgccca

SEQ ID NO: 1859413 - DNA, 18 bp, Homo sapiens
ccccaggcctccagaacc

SEQ ID NO: 1859414 - DNA, 19 bp, Homo sapiens
ccccaggcctccagaacct

SEQ ID NO: 1859415 - DNA, 17 bp, Homo sapiens
ccccataccagtcacct

SEQ ID NO: 1859416 - DNA, 18 bp, Homo sapiens
cccccactgacctgccca

SEQ ID NO: 1859417 - DNA, 22 bp, Homo sapiens
cccccaggagcagctggcactg

SEQ ID NO: 1859418 - DNA, 16 bp, Homo sapiens
cccccaggcctccaga

SEQ ID NO: 1859419 - DNA, 13 bp, Homo sapiens
ccctacttgcagc

SEQ ID NO: 1859420 - DNA, 13 bp, Homo sapiens
ccctagagactca

SEQ ID NO: 1859421 - DNA, 23 bp, Homo sapiens
ccctcactcaggaaccctggaga

SEQ ID NO: 1859422 - DNA, 23 bp, Homo sapiens
ccctgaacatttagtaccctgca

SEQ ID NO: 1859423 - DNA, 17 bp, Homo sapiens
ccctgaccaccctgcct

SEQ ID NO: 1859424 - DNA, 13 bp, Homo sapiens
ccctgcagccgtg

SEQ ID NO: 1859425 - DNA, 15 bp, Homo sapiens
ccctgcaggccaggc

SEQ ID NO: 1859426 - DNA, 23 bp, Homo sapiens
gaaaaatattgctaaaagtgcat

SEQ ID NO: 1859427 - DNA, 20 bp, Homo sapiens
gaaaaatgcccatttttgct

SEQ ID NO: 1859428 - DNA, 15 bp, Homo sapiens
gaaaacctgttttta

SEQ ID NO: 1859429 - DNA, 22 bp, Homo sapiens
gaaaacctgtttttaacatgtg

SEQ ID NO: 1859430 - DNA, 16 bp, Homo sapiens
gaaaactgaaaatcta

SEQ ID NO: 1859431 - DNA, 18 bp, Homo sapiens
gaaaactgaaaatctaat

SEQ ID NO: 1859432 - DNA, 19 bp, Homo sapiens
gaaaaggcaaaagactggt

SEQ ID NO: 1859433 - DNA, 13 bp, Homo sapiens
gaaaatcagattt

SEQ ID NO: 1859434 - DNA, 22 bp, Homo sapiens
gaaaatggatatagaaaatctt

SEQ ID NO: 1859435 - DNA, 12 bp, Homo sapiens
gaaacactaaat

SEQ ID NO: 1859436 - DNA, 13 bp, Homo sapiens
gaaacagagaaag

SEQ ID NO: 1859437 - DNA, 16 bp, Homo sapiens
gaaacagagaaagaaa

SEQ ID NO: 1859438 - DNA, 22 bp, Homo sapiens
gaaacccccttttcccttcagc

SEQ ID NO: 1859439 - DNA, 13 bp, Homo sapiens
gaaacctgaaaaa

SEQ ID NO: 1859440 - DNA, 12 bp, Homo sapiens
gaaacctttcta

SEQ ID NO: 1859441 - DNA, 17 bp, Homo sapiens
gaaacgcacttacaagt

SEQ ID NO: 1859442 - DNA, 18 bp, Homo sapiens
gaaacgcacttacaagtg

SEQ ID NO: 1859443 - DNA, 14 bp, Homo sapiens
gaaagaaaaggcaa

SEQ ID NO: 1859444 - DNA, 20 bp, Homo sapiens
gaaagaaaaggcaaaagact

SEQ ID NO: 1859445 - DNA, 23 bp, Homo sapiens
gaaagaaaaggcaaaagactggt

SEQ ID NO: 1859446 - DNA, 15 bp, Homo sapiens
gaaagacatctgcct

SEQ ID NO: 1859447 - DNA, 21 bp, Homo sapiens
gaaagacatctgcctgtaatt

SEQ ID NO: 1859448 - DNA, 11 bp, Homo sapiens
gaaagagaatg

SEQ ID NO: 1859449 - DNA, 16 bp, Homo sapiens
gaaagagaatgaactg

SEQ ID NO: 1859450 - DNA, 18 bp, Homo sapiens
gaaagagaatgaactgtg

SEQ ID NO: 1859451 - DNA, 17 bp, Homo sapiens
gaaagccaaattttatt

SEQ ID NO: 1859452 - DNA, 15 bp, Homo sapiens
gaaagccaccttgtt

SEQ ID NO: 1859453 - DNA, 14 bp, Homo sapiens
gaaagctgcactca

SEQ ID NO: 1859454 - DNA, 18 bp, Homo sapiens
gaaaggatataaaaggat

SEQ ID NO: 1859455 - DNA, 19 bp, Homo sapiens
gaaagtcacctacaggact

SEQ ID NO: 1859456 - DNA, 16 bp, Homo sapiens
gaaagtcctgctttcc

SEQ ID NO: 1859457 - DNA, 22 bp, Homo sapiens
gaaagtcgaattaatagctttt

SEQ ID NO: 1859458 - DNA, 13 bp, Homo sapiens
gaaagttgctttt

SEQ ID NO: 1859459 - DNA, 19 bp, Homo sapiens
gaaagttgcttttattgca

SEQ ID NO: 1859460 - DNA, 15 bp, Homo sapiens
gaaatcagcatgaca

SEQ ID NO: 1859461 - DNA, 18 bp, Homo sapiens
gaaatcagcatgacaaaa

SEQ ID NO: 1859462 - DNA, 19 bp, Homo sapiens
gaaatcagtaaacactgtg

SEQ ID NO: 1859463 - DNA, 14 bp, Homo sapiens
gaaatggggcgctg

SEQ ID NO: 1859464 - DNA, 16 bp, Homo sapiens
gaaatggggcgctgga

SEQ ID NO: 1859465 - DNA, 14 bp, Homo sapiens
gaaattaaaatatt

SEQ ID NO: 1859466 - DNA, 22 bp, Homo sapiens
gaaattaaaatattatttgata

SEQ ID NO: 1859467 - DNA, 13 bp, Homo sapiens
gaaattagtcttt

SEQ ID NO: 1859468 - DNA, 13 bp, Homo sapiens
gaaattatttaat

SEQ ID NO: 1859469 - DNA, 18 bp, Homo sapiens
gaacatttagtaccctgc

SEQ ID NO: 1859470 - DNA, 21 bp, Homo sapiens
gaacatttagtaccctgcagg

SEQ ID NO: 1859471 - DNA, 17 bp, Homo sapiens
gaaccaagggccctcac

SEQ ID NO: 1859472 - DNA, 20 bp, Homo sapiens
gaaccctggagacagaagtc

SEQ ID NO: 1859473 - DNA, 21 bp, Homo sapiens
gaaccctggagacagaagtca

SEQ ID NO: 1859474 - DNA, 15 bp, Homo sapiens
gaaccgtttacagtg

SEQ ID NO: 1859475 - DNA, 21 bp, Homo sapiens
gaactttctcttcatactttt

SEQ ID NO: 1859476 - DNA, 23 bp, Homo sapiens
gaactttctcttcatactttttt

SEQ ID NO: 1859477 - DNA, 15 bp, Homo sapiens
gaacttttacagaat

SEQ ID NO: 1859478 - DNA, 19 bp, Homo sapiens
gaacttttacagaatgcat

SEQ ID NO: 1859479 - DNA, 18 bp, Homo sapiens
tatagtgtaaaataagaa

SEQ ID NO: 1859480 - DNA, 17 bp, Homo sapiens
tatagttaggatagcat

SEQ ID NO: 1859481 - DNA, 16 bp, Homo sapiens
tatataaggtaatgta

SEQ ID NO: 1859482 - DNA, 17 bp, Homo sapiens
tatataaggtaatgtag

SEQ ID NO: 1859483 - DNA, 21 bp, Homo sapiens
tatatatctgcttcagtggag

SEQ ID NO: 1859484 - DNA, 18 bp, Homo sapiens
tatatctataaacactgt

SEQ ID NO: 1859485 - DNA, 17 bp, Homo sapiens
tatatctgcttcagtgg

SEQ ID NO: 1859486 - DNA, 13 bp, Homo sapiens
tatatctgtttgt

SEQ ID NO: 1859487 - DNA, 14 bp, Homo sapiens
tatatctgtttgta

SEQ ID NO: 1859488 - DNA, 21 bp, Homo sapiens
tatatctgtttgtatatttgc

SEQ ID NO: 1859489 - DNA, 16 bp, Homo sapiens
tatatgatttatagtt

SEQ ID NO: 1859490 - DNA, 12 bp, Homo sapiens
tatatgctgtat

SEQ ID NO: 1859491 - DNA, 16 bp, Homo sapiens
tatatgctgtatttct

SEQ ID NO: 1859492 - DNA, 14 bp, Homo sapiens
tatatgttctgcaa

SEQ ID NO: 1859493 - DNA, 13 bp, Homo sapiens
tatattataatag

SEQ ID NO: 1859494 - DNA, 23 bp, Homo sapiens
tatattgaaagttgcttttattg

SEQ ID NO: 1859495 - DNA, 18 bp, Homo sapiens
tatatttagttatagttt

SEQ ID NO: 1859496 - DNA, 22 bp, Homo sapiens
tatatttttaaaggaaaaatca

SEQ ID NO: 1859497 - DNA, 18 bp, Homo sapiens
tatatttttatatttagt

SEQ ID NO: 1859498 - DNA, 21 bp, Homo sapiens
tatcagaagaccacaaaaatt

SEQ ID NO: 1859499 - DNA, 23 bp, Homo sapiens
tatcagaagaccacaaaaattga

SEQ ID NO: 1859500 - DNA, 16 bp, Homo sapiens
tatcaggatttcctct

SEQ ID NO: 1859501 - DNA, 20 bp, Homo sapiens
tatcagtttgtcctgtagag

SEQ ID NO: 1859502 - DNA, 21 bp, Homo sapiens
tatcattaaaatatatgttct

SEQ ID NO: 1859503 - DNA, 14 bp, Homo sapiens
tatcatttttgtat

SEQ ID NO: 1859504 - DNA, 17 bp, Homo sapiens
tatcatttttgtataaa

SEQ ID NO: 1859505 - DNA, 19 bp, Homo sapiens
tatcatttttgtataaaaa

SEQ ID NO: 1859506 - DNA, 21 bp, Homo sapiens
tatccagaatggaattttgct

SEQ ID NO: 1859507 - DNA, 13 bp, Homo sapiens
tatcctgctgaaa

SEQ ID NO: 1859508 - DNA, 13 bp, Homo sapiens
tatctagtcaata

SEQ ID NO: 1859509 - DNA, 14 bp, Homo sapiens
tatctagtcaataa

SEQ ID NO: 1859510 - DNA, 16 bp, Homo sapiens
tatctataaacactgt

SEQ ID NO: 1859511 - DNA, 16 bp, Homo sapiens
tatctatacctgcctt

SEQ ID NO: 1859512 - DNA, 18 bp, Homo sapiens
tatctgtttgtatatttg

SEQ ID NO: 1859513 - DNA, 23 bp, Homo sapiens
tatctgtttgtatatttgcaaac

SEQ ID NO: 1859514 - DNA, 18 bp, Homo sapiens
tatcttagagtttacagt

SEQ ID NO: 1859515 - DNA, 22 bp, Homo sapiens
tatcttagagtttacagtttgt

SEQ ID NO: 1859516 - DNA, 13 bp, Homo sapiens
tatcttcatgttt

SEQ ID NO: 1859517 - DNA, 17 bp, Homo sapiens
tatcttgttattaatgt

SEQ ID NO: 1859518 - DNA, 22 bp, Homo sapiens
tatctttggggaaactaacaat

SEQ ID NO: 1859519 - DNA, 18 bp, Homo sapiens
tatctttgtgtaatctaa

SEQ ID NO: 1859520 - DNA, 14 bp, Homo sapiens
tatgaagtataaat

SEQ ID NO: 1859521 - DNA, 16 bp, Homo sapiens
tatgagactgtgtttc

SEQ ID NO: 1859522 - DNA, 14 bp, Homo sapiens
tatgagatttactg

SEQ ID NO: 1859523 - DNA, 15 bp, Homo sapiens
tatgattgcactaaa

SEQ ID NO: 1859524 - DNA, 14 bp, Homo sapiens
tatgatttatagtt

SEQ ID NO: 1859525 - DNA, 18 bp, Homo sapiens
tatgattttgatgcacaa

SEQ ID NO: 1859526 - DNA, 14 bp, Homo sapiens
tatgctgtatttct

SEQ ID NO: 1859527 - DNA, 16 bp, Homo sapiens
tatgctgtatttcttt

SEQ ID NO: 1859528 - DNA, 17 bp, Homo sapiens
tatgctgtatttctttg

SEQ ID NO: 1859529 - DNA, 15 bp, Homo sapiens
tatggagactttgct

SEQ ID NO: 1859530 - DNA, 14 bp, Homo sapiens
tatggcaaaaatgg

SEQ ID NO: 1859531 - DNA, 22 bp, Homo sapiens
tatggctatctatacctgcctt

SEQ ID NO: 1859532 - DNA, 22 bp, Homo sapiens
tatgtacctctagctgttcttt

SEQ ID NO: 1859533 - DNA, 20 bp, Homo sapiens
tatgtctgtctttgcaaagg

SEQ ID NO: 1859534 - DNA, 13 bp, Homo sapiens
tatgtgttacatt

SEQ ID NO: 1859535 - DNA, 16 bp, Homo sapiens
tatgtgttacattatt

SEQ ID NO: 1859536 - DNA, 12 bp, Homo sapiens
tattaaaaatat

SEQ ID NO: 1859537 - DNA, 16 bp, Homo sapiens
tattaaatgagggttt

SEQ ID NO: 1859538 - DNA, 12 bp, Homo sapiens
tattaattattt

SEQ ID NO: 1859539 - DNA, 17 bp, Homo sapiens
tattaattgtcctgtgt

SEQ ID NO: 1859540 - DNA, 18 bp, Homo sapiens
tattaattgtcctgtgtc

SEQ ID NO: 1859541 - DNA, 20 bp, Homo sapiens
tattaattgtcctgtgtcta

SEQ ID NO: 1859542 - DNA, 13 bp, Homo sapiens
tattagttaatat

SEQ ID NO: 1859543 - DNA, 11 bp, Homo sapiens
tattattaatg

SEQ ID NO: 1859544 - DNA, 14 bp, Homo sapiens
tattatttgatatc

SEQ ID NO: 1859545 - DNA, 16 bp, Homo sapiens
tattcaagttattgta

SEQ ID NO: 1859546 - DNA, 20 bp, Homo sapiens
tattcaagttattgtacagc

SEQ ID NO: 1859547 - DNA, 15 bp, Homo sapiens
tattcagaaattaaa

SEQ ID NO: 1859548 - DNA, 14 bp, Homo sapiens
tattcagagaaaac

SEQ ID NO: 1859549 - DNA, 14 bp, Homo sapiens
tattccaaggaaaa

SEQ ID NO: 1859550 - DNA, 18 bp, Homo sapiens
tattccaaggaaaattga

SEQ ID NO: 1859551 - DNA, 22 bp, Homo sapiens
tattcccttctgatcttggaaa

SEQ ID NO: 1859552 - DNA, 22 bp, Homo sapiens
tattctgtggttctataataag

SEQ ID NO: 1859553 - DNA, 20 bp, Homo sapiens
tattcttttgttattaaaaa

SEQ ID NO: 1859554 - DNA, 17 bp, Homo sapiens
tattgaaagttgctttt

SEQ ID NO: 1859555 - DNA, 17 bp, Homo sapiens
tattgctaaaagtgcat

SEQ ID NO: 1859556 - DNA, 21 bp, Homo sapiens
tattgtataaactatcagttt

SEQ ID NO: 1859557 - DNA, 16 bp, Homo sapiens
tattgtgttggcttta

SEQ ID NO: 1859558 - DNA, 16 bp, Homo sapiens
tatttaaaaaattaaa

SEQ ID NO: 1859559 - DNA, 19 bp, Homo sapiens
tatttaagaaagggaaagc

SEQ ID NO: 1859560 - DNA, 19 bp, Homo sapiens
tatttaattagaatggata

SEQ ID NO: 1859561 - DNA, 21 bp, Homo sapiens
tatttagactgtggccatata

SEQ ID NO: 1859562 - DNA, 20 bp, Homo sapiens
tatttagttatagtttcaga

SEQ ID NO: 1859563 - DNA, 17 bp, Homo sapiens
tatttcagtattttcca

SEQ ID NO: 1859564 - DNA, 22 bp, Homo sapiens
tatttcagtattttccagcctt

SEQ ID NO: 1859565 - DNA, 15 bp, Homo sapiens
tatttctctggcaaa

SEQ ID NO: 1859566 - DNA, 15 bp, Homo sapiens
tatttgtctttcagg

SEQ ID NO: 1859567 - DNA, 14 bp, Homo sapiens
tatttgttattttc

SEQ ID NO: 1859568 - DNA, 18 bp, Homo sapiens
tatttgttattttcagta

SEQ ID NO: 1859569 - DNA, 14 bp, Homo sapiens
tattttaagaaaga

SEQ ID NO: 1859570 - DNA, 11 bp, Homo sapiens
tattttacagt

SEQ ID NO: 1859571 - DNA, 12 bp, Homo sapiens
tattttacagtc

SEQ ID NO: 1859572 - DNA, 20 bp, Homo sapiens
tattttacagtctctgttgt

SEQ ID NO: 1859573 - DNA, 16 bp, Homo sapiens
tattttccaaaatcta

SEQ ID NO: 1859574 - DNA, 18 bp, Homo sapiens
tattttccagccttatgt

SEQ ID NO: 1859575 - DNA, 15 bp, Homo sapiens
tattttgtatatatc

SEQ ID NO: 1859576 - DNA, 12 bp, Homo sapiens
tatttttgaaag

SEQ ID NO: 1859577 - DNA, 19 bp, Homo sapiens
tatttttgaaagaattcta

SEQ ID NO: 1859578 - DNA, 12 bp, Homo sapiens
tatttttgtacc

SEQ ID NO: 1859579 - DNA, 18 bp, Homo sapiens
tacaagtttgctaaaaga

SEQ ID NO: 1859580 - DNA, 20 bp, Homo sapiens
tacaataaatcctttacttt

SEQ ID NO: 1859581 - DNA, 13 bp, Homo sapiens
tacaatgtgactt

SEQ ID NO: 1859582 - DNA, 10 bp, Homo sapiens
tacacacacg

SEQ ID NO: 1859583 - DNA, 13 bp, Homo sapiens
tacacagttaaat

SEQ ID NO: 1859584 - DNA, 17 bp, Homo sapiens
tacacagttaaataaat

SEQ ID NO: 1859585 - DNA, 14 bp, Homo sapiens
tacagaatgcatta

SEQ ID NO: 1859586 - DNA, 15 bp, Homo sapiens
tacagaatgcattaa

SEQ ID NO: 1859587 - DNA, 17 bp, Homo sapiens
tacagaatgcattaaaa

SEQ ID NO: 1859588 - DNA, 18 bp, Homo sapiens
tacagaatgcattaaaaa

SEQ ID NO: 1859589 - DNA, 20 bp, Homo sapiens
tacagatggagcaaatgtcc

SEQ ID NO: 1859590 - DNA, 13 bp, Homo sapiens
tacaggactgggc

SEQ ID NO: 1859591 - DNA, 14 bp, Homo sapiens
tacagtcaacttac

SEQ ID NO: 1859592 - DNA, 17 bp, Homo sapiens
tacagttcataattcac

SEQ ID NO: 1859593 - DNA, 13 bp, Homo sapiens
tacagtttgtgtt

SEQ ID NO: 1859594 - DNA, 22 bp, Homo sapiens
tacataattttttattcaagtt

SEQ ID NO: 1859595 - DNA, 12 bp, Homo sapiens
tacatattgaat

SEQ ID NO: 1859596 - DNA, 20 bp, Homo sapiens
tacatgcaatttattaaaat

SEQ ID NO: 1859597 - DNA, 15 bp, Homo sapiens
taccaagtatgaagt

SEQ ID NO: 1859598 - DNA, 21 bp, Homo sapiens
taccaagtatgaagtataaat

SEQ ID NO: 1859599 - DNA, 13 bp, Homo sapiens
taccagtctgatt

SEQ ID NO: 1859600 - DNA, 22 bp, Homo sapiens
taccagtctgattataccatgt

SEQ ID NO: 1859601 - DNA, 23 bp, Homo sapiens
taccataggaagacataaaactt

SEQ ID NO: 1859602 - DNA, 16 bp, Homo sapiens
taccatattgctctta

SEQ ID NO: 1859603 - DNA, 16 bp, Homo sapiens
taccatgtgtgctaat

SEQ ID NO: 1859604 - DNA, 17 bp, Homo sapiens
taccatgtgtgctaata

SEQ ID NO: 1859605 - DNA, 15 bp, Homo sapiens
taccattattttaca

SEQ ID NO: 1859606 - DNA, 22 bp, Homo sapiens
taccattattttacagtctctg

SEQ ID NO: 1859607 - DNA, 17 bp, Homo sapiens
taccattgaaatcagca

SEQ ID NO: 1859608 - DNA, 13 bp, Homo sapiens
taccctatatcta

SEQ ID NO: 1859609 - DNA, 18 bp, Homo sapiens
taccctgcaggccaggcc

SEQ ID NO: 1859610 - DNA, 20 bp, Homo sapiens
taccctgcaggccaggccag

SEQ ID NO: 1859611 - DNA, 15 bp, Homo sapiens
tacccttggtttgca

SEQ ID NO: 1859612 - DNA, 19 bp, Homo sapiens
tacccttggtttgcacata

SEQ ID NO: 1859613 - DNA, 18 bp, Homo sapiens
tacctctagctgttcttt

SEQ ID NO: 1859614 - DNA, 18 bp, Homo sapiens
tacgtataatgctttctg

SEQ ID NO: 1859615 - DNA, 14 bp, Homo sapiens
tactaaaatatgca

SEQ ID NO: 1859616 - DNA, 21 bp, Homo sapiens
tactataacatagaattgcaa

SEQ ID NO: 1859617 - DNA, 12 bp, Homo sapiens
tactatctttgt

SEQ ID NO: 1859618 - DNA, 21 bp, Homo sapiens
tactatctttgtctaaacaag

SEQ ID NO: 1859619 - DNA, 15 bp, Homo sapiens
tactcccttctgtag

SEQ ID NO: 1859620 - DNA, 13 bp, Homo sapiens
tactgatttttgt

SEQ ID NO: 1859621 - DNA, 17 bp, Homo sapiens
tactgatttttgtgatt

SEQ ID NO: 1859622 - DNA, 19 bp, Homo sapiens
tactgcagctttacatgca

SEQ ID NO: 1859623 - DNA, 22 bp, Homo sapiens
tactgcagctttacatgcaatt

SEQ ID NO: 1859624 - DNA, 16 bp, Homo sapiens
tactgctctagaaagt

SEQ ID NO: 1859625 - DNA, 14 bp, Homo sapiens
tactgcttctcttt

SEQ ID NO: 1859626 - DNA, 16 bp, Homo sapiens
tactgcttctctttgt

SEQ ID NO: 1859627 - DNA, 23 bp, Homo sapiens
tactggcactgtggcactgccac

SEQ ID NO: 1859628 - DNA, 13 bp, Homo sapiens
tactgtaaaagtt

SEQ ID NO: 1859629 - DNA, 23 bp, Homo sapiens
tactgtaaaagttataataactg

SEQ ID NO: 1859630 - DNA, 12 bp, Homo sapiens
tacttaaatgag

SEQ ID NO: 1859631 - DNA, 17 bp, Homo sapiens
tacttagaatgccataa

SEQ ID NO: 1859632 - DNA, 21 bp, Homo sapiens
tacttagaatgccataaaatt

SEQ ID NO: 1859633 - DNA, 22 bp, Homo sapiens
tacttagaatgccataaaattg

SEQ ID NO: 1859634 - DNA, 16 bp, Homo sapiens
tacttatcatttttgt

SEQ ID NO: 1859635 - DNA, 22 bp, Homo sapiens
tacttatcatttttgtataaaa

SEQ ID NO: 1859636 - DNA, 12 bp, Homo sapiens
tactttgcttct

SEQ ID NO: 1859637 - DNA, 16 bp, Homo sapiens
tacttttctggttcca

SEQ ID NO: 1859638 - DNA, 14 bp, Homo sapiens
tacttttttgaaat

SEQ ID NO: 1859639 - DNA, 20 bp, Homo sapiens
tagaaaactgaaaatctaat

SEQ ID NO: 1859640 - DNA, 23 bp, Homo sapiens
tagaaagacatctgcctgtaatt

SEQ ID NO: 1859641 - DNA, 14 bp, Homo sapiens
tagaaagagttcta

SEQ ID NO: 1859642 - DNA, 16 bp, Homo sapiens
tagaagctgtagtagc

SEQ ID NO: 1859643 - DNA, 14 bp, Homo sapiens
tagaataaatggtt

SEQ ID NO: 1859644 - DNA, 18 bp, Homo sapiens
tagaattgcaatctataa

SEQ ID NO: 1859645 - DNA, 18 bp, Homo sapiens
tagacacccattttcaca

SEQ ID NO: 1859646 - DNA, 11 bp, Homo sapiens
tagactttctg

SEQ ID NO: 1859647 - DNA, 20 bp, Homo sapiens
tagagcgtttggttaaagta

SEQ ID NO: 1859648 - DNA, 18 bp, Homo sapiens
tagaggggttttagattt

SEQ ID NO: 1859649 - DNA, 19 bp, Homo sapiens
tagaggttttgttgtttta

SEQ ID NO: 1859650 - DNA, 14 bp, Homo sapiens
tagagtaatgatgt

SEQ ID NO: 1859651 - DNA, 15 bp, Homo sapiens
tagagtaatgatgta

SEQ ID NO: 1859652 - DNA, 13 bp, Homo sapiens
tagagtttacagt

SEQ ID NO: 1859653 - DNA, 21 bp, Homo sapiens
tagagtttacagtttgtgttt

SEQ ID NO: 1859654 - DNA, 14 bp, Homo sapiens
tagatggtgaaatt

SEQ ID NO: 1859655 - DNA, 20 bp, Homo sapiens
tagattgcaaatattggtta

SEQ ID NO: 1859656 - DNA, 13 bp, Homo sapiens
tagatttgaaaaa

SEQ ID NO: 1859657 - DNA, 17 bp, Homo sapiens
tagatttgaaaaacttt

SEQ ID NO: 1859658 - DNA, 14 bp, Homo sapiens
tagcatttttgatt

SEQ ID NO: 1859659 - DNA, 19 bp, Homo sapiens
tagccctggatggcctctg

SEQ ID NO: 1859660 - DNA, 20 bp, Homo sapiens
tagccctggatggcctctgg

SEQ ID NO: 1859661 - DNA, 15 bp, Homo sapiens
tagccctttctgtgt

SEQ ID NO: 1859662 - DNA, 16 bp, Homo sapiens
tagctatcagaagacc

SEQ ID NO: 1859663 - DNA, 15 bp, Homo sapiens
tagctattactgtct

SEQ ID NO: 1859664 - DNA, 14 bp, Homo sapiens
tagcttttaaaaaa

SEQ ID NO: 1859665 - DNA, 19 bp, Homo sapiens
tagcttttaaaaaatattt

SEQ ID NO: 1859666 - DNA, 18 bp, Homo sapiens
tagcttttattgtataaa

SEQ ID NO: 1859667 - DNA, 14 bp, Homo sapiens
taggaagacataaa

SEQ ID NO: 1859668 - DNA, 22 bp, Homo sapiens
taggaagacataaaactttaaa

SEQ ID NO: 1859669 - DNA, 13 bp, Homo sapiens
taggatagcattt

SEQ ID NO: 1859670 - DNA, 17 bp, Homo sapiens
taggcagatctttaaat

SEQ ID NO: 1859671 - DNA, 13 bp, Homo sapiens
tagggttatattt

SEQ ID NO: 1859672 - DNA, 16 bp, Homo sapiens
taggtctcatgcccac

SEQ ID NO: 1859673 - DNA, 13 bp, Homo sapiens
tagtaccctgcag

SEQ ID NO: 1859674 - DNA, 23 bp, Homo sapiens
tagtactggattattcaggcttt

SEQ ID NO: 1859675 - DNA, 20 bp, Homo sapiens
tagtagaaagacatctgcct

SEQ ID NO: 1859676 - DNA, 22 bp, Homo sapiens
tagtagaaagacatctgcctgt

SEQ ID NO: 1859677 - DNA, 16 bp, Homo sapiens
tagtagccctttctgt

SEQ ID NO: 1859678 - DNA, 23 bp, Homo sapiens
tagtatctattgtgttggcttta

SEQ ID NO: 1859679 - DNA, 21 bp, Homo sapiens
tagtctttttttccttccttt

SEQ ID NO: 1859680 - DNA, 16 bp, Homo sapiens
tagtgccaaataattg

SEQ ID NO: 1859681 - DNA, 19 bp, Homo sapiens
tagtgtaaaataagaatga

SEQ ID NO: 1859682 - DNA, 13 bp, Homo sapiens
tagttaaaagcct

SEQ ID NO: 1859683 - DNA, 14 bp, Homo sapiens
tagttaatctataa

SEQ ID NO: 1859684 - DNA, 15 bp, Homo sapiens
tagttcttgaattgt

SEQ ID NO: 1859685 - DNA, 16 bp, Homo sapiens
tagttcttgaattgtt

SEQ ID NO: 1859686 - DNA, 21 bp, Homo sapiens
tataaaaaggaaattagtctt

SEQ ID NO: 1859687 - DNA, 22 bp, Homo sapiens
tataaaaaggaaattagtcttt

SEQ ID NO: 1859688 - DNA, 21 bp, Homo sapiens
tataaaaggatgttacaagtt

SEQ ID NO: 1859689 - DNA, 13 bp, Homo sapiens
tataaacactgtt

SEQ ID NO: 1859690 - DNA, 15 bp, Homo sapiens
tataaattatattcc

SEQ ID NO: 1859691 - DNA, 16 bp, Homo sapiens
tataagcaagacagtg

SEQ ID NO: 1859692 - DNA, 13 bp, Homo sapiens
tataataactgaa

SEQ ID NO: 1859693 - DNA, 15 bp, Homo sapiens
tataataagttttga

SEQ ID NO: 1859694 - DNA, 18 bp, Homo sapiens
tataataagttttgatat

SEQ ID NO: 1859695 - DNA, 15 bp, Homo sapiens
tataatcatgctcat

SEQ ID NO: 1859696 - DNA, 17 bp, Homo sapiens
tataatcatgctcatgt

SEQ ID NO: 1859697 - DNA, 20 bp, Homo sapiens
tataatcatgctcatgtata

SEQ ID NO: 1859698 - DNA, 14 bp, Homo sapiens
gcttagttcttgaa

SEQ ID NO: 1859699 - DNA, 17 bp, Homo sapiens
gcttagttcttgaattg

SEQ ID NO: 1859700 - DNA, 16 bp, Homo sapiens
gcttcatatctaattt

SEQ ID NO: 1859701 - DNA, 13 bp, Homo sapiens
gcttcccctcact

SEQ ID NO: 1859702 - DNA, 12 bp, Homo sapiens
gcttccctgccc

SEQ ID NO: 1859703 - DNA, 14 bp, Homo sapiens
gcttccctgcccaa

SEQ ID NO: 1859704 - DNA, 21 bp, Homo sapiens
gcttctctttgtgcagtgtta

SEQ ID NO: 1859705 - DNA, 15 bp, Homo sapiens
gcttcttaaaaactg

SEQ ID NO: 1859706 - DNA, 21 bp, Homo sapiens
gctttaaaagtcattattcct

SEQ ID NO: 1859707 - DNA, 15 bp, Homo sapiens
gctttacaaataatt

SEQ ID NO: 1859708 - DNA, 12 bp, Homo sapiens
gctttacatgca

SEQ ID NO: 1859709 - DNA, 12 bp, Homo sapiens
gctttagcttat

SEQ ID NO: 1859710 - DNA, 17 bp, Homo sapiens
gctttatctttgtgtaa

SEQ ID NO: 1859711 - DNA, 14 bp, Homo sapiens
gctttcctatctag

SEQ ID NO: 1859712 - DNA, 18 bp, Homo sapiens
gctttggggggcactaga

SEQ ID NO: 1859713 - DNA, 15 bp, Homo sapiens
gcttttaaaaaatat

SEQ ID NO: 1859714 - DNA, 13 bp, Homo sapiens
ggaaaattgaaag

SEQ ID NO: 1859715 - DNA, 23 bp, Homo sapiens
ggaaacctgtgaaagctgcactc

SEQ ID NO: 1859716 - DNA, 14 bp, Homo sapiens
ggaaacgcacttac

SEQ ID NO: 1859717 - DNA, 23 bp, Homo sapiens
ggaaagctcagctactgattttt

SEQ ID NO: 1859718 - DNA, 22 bp, Homo sapiens
ggaaagtcacctacaggactgg

SEQ ID NO: 1859719 - DNA, 17 bp, Homo sapiens
ggaacccccaaatttaa

SEQ ID NO: 1859720 - DNA, 19 bp, Homo sapiens
ggaaccctggagacagaag

SEQ ID NO: 1859721 - DNA, 19 bp, Homo sapiens
ggaagaagttttttacttt

SEQ ID NO: 1859722 - DNA, 21 bp, Homo sapiens
ggaagtgcagcgggccaggca

SEQ ID NO: 1859723 - DNA, 23 bp, Homo sapiens
ggaatgaattgaaatggggcgct

SEQ ID NO: 1859724 - DNA, 15 bp, Homo sapiens
ggaatgtgtccaaga

SEQ ID NO: 1859725 - DNA, 15 bp, Homo sapiens
ggacacctacagcag

SEQ ID NO: 1859726 - DNA, 15 bp, Homo sapiens
ggacagccagggcag

SEQ ID NO: 1859727 - DNA, 17 bp, Homo sapiens
ggacagccagggcaggg

SEQ ID NO: 1859728 - DNA, 12 bp, Homo sapiens
ggacccacctgg

SEQ ID NO: 1859729 - DNA, 18 bp, Homo sapiens
ggaccggccgcagccccc

SEQ ID NO: 1859730 - DNA, 17 bp, Homo sapiens
ggagaagacccctgccc

SEQ ID NO: 1859731 - DNA, 19 bp, Homo sapiens
ggagaagacccctgcccaa

SEQ ID NO: 1859732 - DNA, 14 bp, Homo sapiens
ggagacaattagca

SEQ ID NO: 1859733 - DNA, 14 bp, Homo sapiens
ggagactatttaag

SEQ ID NO: 1859734 - DNA, 14 bp, Homo sapiens
ggagcagcccccaa

SEQ ID NO: 1859735 - DNA, 17 bp, Homo sapiens
ggagcagcccccaaaga

SEQ ID NO: 1859736 - DNA, 17 bp, Homo sapiens
ggagcagctggcactga

SEQ ID NO: 1859737 - DNA, 14 bp, Homo sapiens
ggagggaggagggc

SEQ ID NO: 1859738 - DNA, 17 bp, Homo sapiens
ggagtgctgcagctttg

SEQ ID NO: 1859739 - DNA, 17 bp, Homo sapiens
ggatataaaaggatgtt

SEQ ID NO: 1859740 - DNA, 16 bp, Homo sapiens
ggatgaatgggaaagt

SEQ ID NO: 1859741 - DNA, 20 bp, Homo sapiens
ggatggcctctggggcagga

SEQ ID NO: 1859742 - DNA, 20 bp, Homo sapiens
ggatgttacaagtttgctaa

SEQ ID NO: 1859743 - DNA, 20 bp, Homo sapiens
ggcaaagagacccagtcaat

SEQ ID NO: 1859744 - DNA, 17 bp, Homo sapiens
ggcaactcgtgacagcc

SEQ ID NO: 1859745 - DNA, 16 bp, Homo sapiens
ggcaaggttcagtctg

SEQ ID NO: 1859746 - DNA, 22 bp, Homo sapiens
ggcactaaaatgtttaattcat

SEQ ID NO: 1859747 - DNA, 15 bp, Homo sapiens
ggcactgccaccagc

SEQ ID NO: 1859748 - DNA, 21 bp, Homo sapiens
ggcagagcttgtagccctgga

SEQ ID NO: 1859749 - DNA, 14 bp, Homo sapiens
ggcagagtggcctg

SEQ ID NO: 1859750 - DNA, 12 bp, Homo sapiens
ggcagccaagga

SEQ ID NO: 1859751 - DNA, 21 bp, Homo sapiens
ggcaggtcatggagcagcccc

SEQ ID NO: 1859752 - DNA, 19 bp, Homo sapiens
ggcagtgagtgccatgctt

SEQ ID NO: 1859753 - DNA, 20 bp, Homo sapiens
ggcagtgagtgccatgcttt

SEQ ID NO: 1859754 - DNA, 23 bp, Homo sapiens
ggcatgtttgtctgtgtgctgta

SEQ ID NO: 1859755 - DNA, 15 bp, Homo sapiens
ggccaagacttggca

SEQ ID NO: 1859756 - DNA, 23 bp, Homo sapiens
ggccacagcactagagtcacccc

SEQ ID NO: 1859757 - DNA, 20 bp, Homo sapiens
ggccagcccactgggccctg

SEQ ID NO: 1859758 - DNA, 20 bp, Homo sapiens
ggccagcttcccctcactta

SEQ ID NO: 1859759 - DNA, 12 bp, Homo sapiens
ggccaggccagc

SEQ ID NO: 1859760 - DNA, 13 bp, Homo sapiens
ggccaggccagct

SEQ ID NO: 1859761 - DNA, 15 bp, Homo sapiens
ggccaggctccctga

SEQ ID NO: 1859762 - DNA, 20 bp, Homo sapiens
ggccaggctccctgaccacc

SEQ ID NO: 1859763 - DNA, 15 bp, Homo sapiens
ggccatttgctgccc

SEQ ID NO: 1859764 - DNA, 16 bp, Homo sapiens
ggccatttgctgccct

SEQ ID NO: 1859765 - DNA, 21 bp, Homo sapiens
ggccatttgctgccctggggc

SEQ ID NO: 1859766 - DNA, 14 bp, Homo sapiens
ggcccagggcctct

SEQ ID NO: 1859767 - DNA, 14 bp, Homo sapiens
ggccctggggctgc

SEQ ID NO: 1859768 - DNA, 16 bp, Homo sapiens
ggccctggggctgccc

SEQ ID NO: 1859769 - DNA, 15 bp, Homo sapiens
ggccgcagcccccac

SEQ ID NO: 1859770 - DNA, 17 bp, Homo sapiens
ggccgcagcccccactg

SEQ ID NO: 1859771 - DNA, 18 bp, Homo sapiens
ggccgctctccccctgca

SEQ ID NO: 1859772 - DNA, 16 bp, Homo sapiens
ggccgggcccagggcc

SEQ ID NO: 1859773 - DNA, 20 bp, Homo sapiens
ggccgggcccagggcctctg

SEQ ID NO: 1859774 - DNA, 13 bp, Homo sapiens
ggcctccagaacc

SEQ ID NO: 1859775 - DNA, 17 bp, Homo sapiens
ggcctctggcttccctg

SEQ ID NO: 1859776 - DNA, 19 bp, Homo sapiens
ggcctgtgagcaagagcca

SEQ ID NO: 1859777 - DNA, 20 bp, Homo sapiens
ggcctgtgagcaagagccag

SEQ ID NO: 1859778 - DNA, 22 bp, Homo sapiens
ggcctgtgagcaagagccaggg

SEQ ID NO: 1859779 - DNA, 16 bp, Homo sapiens
ggcgcttcccacctgc

SEQ ID NO: 1859780 - DNA, 18 bp, Homo sapiens
ggctactgcagctttaca

SEQ ID NO: 1859781 - DNA, 15 bp, Homo sapiens
ggctacttgctttga

SEQ ID NO: 1859782 - DNA, 13 bp, Homo sapiens
ggctccctgacca

SEQ ID NO: 1859783 - DNA, 22 bp, Homo sapiens
ggctggggggatgacggccagg

SEQ ID NO: 1859784 - DNA, 18 bp, Homo sapiens
ggctgggtgggagggagg

SEQ ID NO: 1859785 - DNA, 19 bp, Homo sapiens
ggctgtcttctcccagagc

SEQ ID NO: 1859786 - DNA, 21 bp, Homo sapiens
ggctgtgaggcgggtggctgg

SEQ ID NO: 1859787 - DNA, 14 bp, Homo sapiens
ggcttaaaaaaaac

SEQ ID NO: 1859788 - DNA, 19 bp, Homo sapiens
ggcttacttacaaaagcag

SEQ ID NO: 1859789 - DNA, 12 bp, Homo sapiens
ggcttccctgcc

SEQ ID NO: 1859790 - DNA, 13 bp, Homo sapiens
ggcttcttaaaaa

SEQ ID NO: 1859791 - DNA, 21 bp, Homo sapiens
ggcttcttaaaaactgtgtat

SEQ ID NO: 1859792 - DNA, 11 bp, Homo sapiens
gggaaagctgt

SEQ ID NO: 1859793 - DNA, 13 bp, Homo sapiens
gggaaagtatttt

SEQ ID NO: 1859794 - DNA, 17 bp, Homo sapiens
gggactggacagccagg

SEQ ID NO: 1859795 - DNA, 22 bp, Homo sapiens
gggactggacagccagggcagg

SEQ ID NO: 1859796 - DNA, 20 bp, Homo sapiens
gggagacaattagcagaatg

SEQ ID NO: 1859797 - DNA, 22 bp, Homo sapiens
gggaggccatttgctgccctgg

SEQ ID NO: 1859798 - DNA, 19 bp, Homo sapiens
gggagtgaaacagagaaag

SEQ ID NO: 1859799 - DNA, 21 bp, Homo sapiens
gggagtgaaacagagaaagaa

SEQ ID NO: 1859800 - DNA, 17 bp, Homo sapiens
gggatgacggccaggct

SEQ ID NO: 1859801 - DNA, 17 bp, Homo sapiens
gggcaactcgtgacagc

SEQ ID NO: 1859802 - DNA, 17 bp, Homo sapiens
gggcagagtggcctgtg

SEQ ID NO: 1859803 - DNA, 18 bp, Homo sapiens
gggcagagtggcctgtga

SEQ ID NO: 1859804 - DNA, 13 bp, Homo sapiens
gggcaggaccact

SEQ ID NO: 1859805 - DNA, 17 bp, Homo sapiens
gggcatcatgggcaact

SEQ ID NO: 1859806 - DNA, 18 bp, Homo sapiens
gggccctggggctgccct

SEQ ID NO: 1859807 - DNA, 18 bp, Homo sapiens
gggcctctggcttccctg

SEQ ID NO: 1859808 - DNA, 19 bp, Homo sapiens
gggcctctggcttccctgc

SEQ ID NO: 1859809 - DNA, 20 bp, Homo sapiens
gggcgcttcccacctgcccc

SEQ ID NO: 1859810 - DNA, 16 bp, Homo sapiens
ggggatgacggccagg

SEQ ID NO: 1859811 - DNA, 12 bp, Homo sapiens
ggggcagagctt

SEQ ID NO: 1859812 - DNA, 11 bp, Homo sapiens
ggggctgccct

SEQ ID NO: 1859813 - DNA, 18 bp, Homo sapiens
ggggctggagggggcaga

SEQ ID NO: 1859814 - DNA, 15 bp, Homo sapiens
ggggtgtcccagtcc

SEQ ID NO: 1859815 - DNA, 13 bp, Homo sapiens
gggtaaactgtgg

SEQ ID NO: 1859816 - DNA, 13 bp, Homo sapiens
ggtaaatttttga

SEQ ID NO: 1859817 - DNA, 18 bp, Homo sapiens
tcttttttttttccaaat

SEQ ID NO: 1859818 - DNA, 12 bp, Homo sapiens
tgaaaaactttt

SEQ ID NO: 1859819 - DNA, 23 bp, Homo sapiens
tgcaaaagactaatttaaaaaat

SEQ ID NO: 1859820 - DNA, 16 bp, Homo sapiens
tgcaaaccctttgtat

SEQ ID NO: 1859821 - DNA, 21 bp, Homo sapiens
tgcaaaggactgtaagcagat

SEQ ID NO: 1859822 - DNA, 22 bp, Homo sapiens
tgcaactaactgactctgttat

SEQ ID NO: 1859823 - DNA, 22 bp, Homo sapiens
tgcaagattttttttttaagtg

SEQ ID NO: 1859824 - DNA, 16 bp, Homo sapiens
tgcacagtaatatgaa

SEQ ID NO: 1859825 - DNA, 19 bp, Homo sapiens
tgcaccttaccaactttct

SEQ ID NO: 1859826 - DNA, 20 bp, Homo sapiens
tgcaccttaccaactttctg

SEQ ID NO: 1859827 - DNA, 19 bp, Homo sapiens
tgcactaaataaactactt

SEQ ID NO: 1859828 - DNA, 16 bp, Homo sapiens
tgcagcgggccaggca

SEQ ID NO: 1859829 - DNA, 19 bp, Homo sapiens
tgcagcgggccaggcaggc

SEQ ID NO: 1859830 - DNA, 13 bp, Homo sapiens
tgcagctcctgga

SEQ ID NO: 1859831 - DNA, 21 bp, Homo sapiens
tgcaggactctagctcatgag

SEQ ID NO: 1859832 - DNA, 23 bp, Homo sapiens
tgcaggcaacattaccttgtctt

SEQ ID NO: 1859833 - DNA, 14 bp, Homo sapiens
tgcagtttcatgta

SEQ ID NO: 1859834 - DNA, 15 bp, Homo sapiens
tgcagtttcatgtat

SEQ ID NO: 1859835 - DNA, 17 bp, Homo sapiens
tgcagtttcatgtatgt

SEQ ID NO: 1859836 - DNA, 20 bp, Homo sapiens
tgcatcactggtatacacac

SEQ ID NO: 1859837 - DNA, 12 bp, Homo sapiens
tgcattaaaaaa

SEQ ID NO: 1859838 - DNA, 23 bp, Homo sapiens
tgcattaaaaaaaaaaaaaaact

SEQ ID NO: 1859839 - DNA, 14 bp, Homo sapiens
tgcatttaaggaga

SEQ ID NO: 1859840 - DNA, 15 bp, Homo sapiens
tgcatttaaggagat

SEQ ID NO: 1859841 - DNA, 14 bp, Homo sapiens
tgccaccagcaatg

SEQ ID NO: 1859842 - DNA, 21 bp, Homo sapiens
tgccaccagcaatgccctgcc

SEQ ID NO: 1859843 - DNA, 23 bp, Homo sapiens
tgccaggcggacaaagttcagtg

SEQ ID NO: 1859844 - DNA, 21 bp, Homo sapiens
tgccataaaattgcagtttca

SEQ ID NO: 1859845 - DNA, 18 bp, Homo sapiens
tgccatagagtttaacac

SEQ ID NO: 1859846 - DNA, 14 bp, Homo sapiens
tgcccactccccca

SEQ ID NO: 1859847 - DNA, 23 bp, Homo sapiens
tgcccactcccccaggagcagct

SEQ ID NO: 1859848 - DNA, 17 bp, Homo sapiens
tgcccagaagaactttg

SEQ ID NO: 1859849 - DNA, 22 bp, Homo sapiens
tgcccatgtccagagggactgg

SEQ ID NO: 1859850 - DNA, 17 bp, Homo sapiens
tgcccatttttgctaat

SEQ ID NO: 1859851 - DNA, 13 bp, Homo sapiens
tgccctgccttgc

SEQ ID NO: 1859852 - DNA, 16 bp, Homo sapiens
tgccctgccttgctgc

SEQ ID NO: 1859853 - DNA, 22 bp, Homo sapiens
tgcctgtaattaaactagttta

SEQ ID NO: 1859854 - DNA, 23 bp, Homo sapiens
tgccttaataagaatggttgcct

SEQ ID NO: 1859855 - DNA, 22 bp, Homo sapiens
tgccttccgacaccactgggaa

SEQ ID NO: 1859856 - DNA, 23 bp, Homo sapiens
tgccttccgacaccactgggaac

SEQ ID NO: 1859857 - DNA, 13 bp, Homo sapiens
tgccttttatagc

SEQ ID NO: 1859858 - DNA, 17 bp, Homo sapiens
tgccttttatagctatt

SEQ ID NO: 1859859 - DNA, 12 bp, Homo sapiens
tgcggccacagc

SEQ ID NO: 1859860 - DNA, 22 bp, Homo sapiens
tgcggtgtctgcagctcctgga

SEQ ID NO: 1859861 - DNA, 14 bp, Homo sapiens
tgctaaaagaagag

SEQ ID NO: 1859862 - DNA, 15 bp, Homo sapiens
tgctaaaagaagaga

SEQ ID NO: 1859863 - DNA, 17 bp, Homo sapiens
tgctaaaagaagagagg

SEQ ID NO: 1859864 - DNA, 16 bp, Homo sapiens
tgctaaaagtgcattt

SEQ ID NO: 1859865 - DNA, 22 bp, Homo sapiens
tgctagcaaacaaatggcttac

SEQ ID NO: 1859866 - DNA, 19 bp, Homo sapiens
tgctcatgtatatttagtt

SEQ ID NO: 1859867 - DNA, 16 bp, Homo sapiens
tgctcattgtggccag

SEQ ID NO: 1859868 - DNA, 15 bp, Homo sapiens
tgctcttaaaaatct

SEQ ID NO: 1859869 - DNA, 16 bp, Homo sapiens
tgctcttaaaaatctt

SEQ ID NO: 1859870 - DNA, 18 bp, Homo sapiens
tgctgaaagtcctgcttt

SEQ ID NO: 1859871 - DNA, 16 bp, Homo sapiens
tgctgaattgagaata

SEQ ID NO: 1859872 - DNA, 17 bp, Homo sapiens
tgctgaggttttgaata

SEQ ID NO: 1859873 - DNA, 20 bp, Homo sapiens
tgctgaggttttgaataaaa

SEQ ID NO: 1859874 - DNA, 19 bp, Homo sapiens
tgctgccttcaccctgaac

SEQ ID NO: 1859875 - DNA, 18 bp, Homo sapiens
tgctgcttacactccagg

SEQ ID NO: 1859876 - DNA, 18 bp, Homo sapiens
tgctggagactatttaag

SEQ ID NO: 1859877 - DNA, 19 bp, Homo sapiens
tgctggagactatttaagt

SEQ ID NO: 1859878 - DNA, 17 bp, Homo sapiens
tgctgtaacctgaagtc

SEQ ID NO: 1859879 - DNA, 13 bp, Homo sapiens
tgctgtatttctt

SEQ ID NO: 1859880 - DNA, 16 bp, Homo sapiens
tgctgtatttctttgt

SEQ ID NO: 1859881 - DNA, 16 bp, Homo sapiens
tgctgtgctgtacatt

SEQ ID NO: 1859882 - DNA, 21 bp, Homo sapiens
tgctgtttactcccttctgta

SEQ ID NO: 1859883 - DNA, 22 bp, Homo sapiens
tgctgtttactcccttctgtag

SEQ ID NO: 1859884 - DNA, 19 bp, Homo sapiens
tgcttaatttccttctgtt

SEQ ID NO: 1859885 - DNA, 23 bp, Homo sapiens
tgcttcactcatgcaaactgctt

SEQ ID NO: 1859886 - DNA, 16 bp, Homo sapiens
tgcttcagtggagaat

SEQ ID NO: 1859887 - DNA, 13 bp, Homo sapiens
tgcttctctttgt

SEQ ID NO: 1859888 - DNA, 14 bp, Homo sapiens
tgcttctctttgtg

SEQ ID NO: 1859889 - DNA, 22 bp, Homo sapiens
tgctttgaggctcaccagaatt

SEQ ID NO: 1859890 - DNA, 12 bp, Homo sapiens
tgctttgatata

SEQ ID NO: 1859891 - DNA, 13 bp, Homo sapiens
tggaaaaatgccc

SEQ ID NO: 1859892 - DNA, 15 bp, Homo sapiens
tggaaacctgaaaaa

SEQ ID NO: 1859893 - DNA, 20 bp, Homo sapiens
tggaaagaggttctgcactc

SEQ ID NO: 1859894 - DNA, 13 bp, Homo sapiens
tggaacttctaat

SEQ ID NO: 1859895 - DNA, 15 bp, Homo sapiens
tggaacttctaatat

SEQ ID NO: 1859896 - DNA, 18 bp, Homo sapiens
tggaacttctaatatatt

SEQ ID NO: 1859897 - DNA, 20 bp, Homo sapiens
tggacacctacagcagcacg

SEQ ID NO: 1859898 - DNA, 13 bp, Homo sapiens
tggacagccaggg

SEQ ID NO: 1859899 - DNA, 15 bp, Homo sapiens
tggacagccagggca

SEQ ID NO: 1859900 - DNA, 16 bp, Homo sapiens
tggacagccagggcag

SEQ ID NO: 1859901 - DNA, 16 bp, Homo sapiens
tggaccggccgcagcc

SEQ ID NO: 1859902 - DNA, 17 bp, Homo sapiens
tggaccggccgcagccc

SEQ ID NO: 1859903 - DNA, 18 bp, Homo sapiens
tggaccggccgcagcccc

SEQ ID NO: 1859904 - DNA, 21 bp, Homo sapiens
tggaccggccgcagcccccac

SEQ ID NO: 1859905 - DNA, 19 bp, Homo sapiens
tggactgtgaatttcaaaa

SEQ ID NO: 1859906 - DNA, 20 bp, Homo sapiens
tggactgtgaatttcaaaaa

SEQ ID NO: 1859907 - DNA, 14 bp, Homo sapiens
tggagaaagtaagt

SEQ ID NO: 1859908 - DNA, 11 bp, Homo sapiens
tggagaaatta

SEQ ID NO: 1859909 - DNA, 15 bp, Homo sapiens
tggagaaattattta

SEQ ID NO: 1859910 - DNA, 21 bp, Homo sapiens
tggagaaattatttaataaaa

SEQ ID NO: 1859911 - DNA, 19 bp, Homo sapiens
tggagactggtcctgtgtg

SEQ ID NO: 1859912 - DNA, 17 bp, Homo sapiens
tggagatggtctgcatc

SEQ ID NO: 1859913 - DNA, 13 bp, Homo sapiens
tggagcagccccc

SEQ ID NO: 1859914 - DNA, 15 bp, Homo sapiens
tggagcagcccccaa

SEQ ID NO: 1859915 - DNA, 13 bp, Homo sapiens
tggagtgctgcag

SEQ ID NO: 1859916 - DNA, 16 bp, Homo sapiens
tggagtgctgcagctt

SEQ ID NO: 1859917 - DNA, 19 bp, Homo sapiens
tggataagatgatgttaaa

SEQ ID NO: 1859918 - DNA, 21 bp, Homo sapiens
tggataagatgatgttaaatg

SEQ ID NO: 1859919 - DNA, 17 bp, Homo sapiens
tggatatagaaaatctt

SEQ ID NO: 1859920 - DNA, 17 bp, Homo sapiens
tggatgaaattttctag

SEQ ID NO: 1859921 - DNA, 13 bp, Homo sapiens
tggatggcctctg

SEQ ID NO: 1859922 - DNA, 15 bp, Homo sapiens
tggatggcctctggg

SEQ ID NO: 1859923 - DNA, 18 bp, Homo sapiens
tggatggcctctggggca

SEQ ID NO: 1859924 - DNA, 17 bp, Homo sapiens
tggcaaaaatggctaga

SEQ ID NO: 1859925 - DNA, 15 bp, Homo sapiens
tggcaaaataaagaa

SEQ ID NO: 1859926 - DNA, 12 bp, Homo sapiens
tggcaacagaag

SEQ ID NO: 1859927 - DNA, 13 bp, Homo sapiens
tggcaacagaagc

SEQ ID NO: 1859928 - DNA, 15 bp, Homo sapiens
tggcaagaaagctgg

SEQ ID NO: 1859929 - DNA, 16 bp, Homo sapiens
tggcaaggttcagtct

SEQ ID NO: 1859930 - DNA, 12 bp, Homo sapiens
tggcactaaaat

SEQ ID NO: 1859931 - DNA, 11 bp, Homo sapiens
tggcactgaca

SEQ ID NO: 1859932 - DNA, 13 bp, Homo sapiens
tggcactgacagc

SEQ ID NO: 1859933 - DNA, 20 bp, Homo sapiens
tggcactgacagcctggggg

SEQ ID NO: 1859934 - DNA, 22 bp, Homo sapiens
tggcagccaaggaatgtgtcca

SEQ ID NO: 1859935 - DNA, 20 bp, Homo sapiens
tggcaggtcatggagcagcc

SEQ ID NO: 1859936 - DNA, 13 bp, Homo sapiens
tcacccccccagg

SEQ ID NO: 1859937 - DNA, 19 bp, Homo sapiens
tcactcaggaaccctggag

SEQ ID NO: 1859938 - DNA, 20 bp, Homo sapiens
tcactcaggaaccctggaga

SEQ ID NO: 1859939 - DNA, 21 bp, Homo sapiens
tcactcaggaaccctggagac

SEQ ID NO: 1859940 - DNA, 20 bp, Homo sapiens
tcactcatgcaaactgcttt

SEQ ID NO: 1859941 - DNA, 20 bp, Homo sapiens
tcactggggcatgagatttt

SEQ ID NO: 1859942 - DNA, 15 bp, Homo sapiens
tcactgttgaaaatt

SEQ ID NO: 1859943 - DNA, 18 bp, Homo sapiens
tcactgttgaaaattatt

SEQ ID NO: 1859944 - DNA, 18 bp, Homo sapiens
tcagaaaccaaacagttt

SEQ ID NO: 1859945 - DNA, 14 bp, Homo sapiens
tcagaaattaaaat

SEQ ID NO: 1859946 - DNA, 16 bp, Homo sapiens
tcagaaattaaaatat

SEQ ID NO: 1859947 - DNA, 17 bp, Homo sapiens
tcagaaattaaaatatt

SEQ ID NO: 1859948 - DNA, 18 bp, Homo sapiens
tcagaaattaaaatatta

SEQ ID NO: 1859949 - DNA, 17 bp, Homo sapiens
tcagaagtttggcaata

SEQ ID NO: 1859950 - DNA, 20 bp, Homo sapiens
tcagaattggcataatttgt

SEQ ID NO: 1859951 - DNA, 20 bp, Homo sapiens
tcagacttagtttttataaa

SEQ ID NO: 1859952 - DNA, 21 bp, Homo sapiens
tcagacttagtttttataaaa

SEQ ID NO: 1859953 - DNA, 20 bp, Homo sapiens
tcagacttgcggccacagca

SEQ ID NO: 1859954 - DNA, 22 bp, Homo sapiens
tcagacttgcggccacagcact

SEQ ID NO: 1859955 - DNA, 15 bp, Homo sapiens
tcagagaaaacttca

SEQ ID NO: 1859956 - DNA, 17 bp, Homo sapiens
tcagaggacccacctgg

SEQ ID NO: 1859957 - DNA, 21 bp, Homo sapiens
tcagagggaggagtttttctt

SEQ ID NO: 1859958 - DNA, 15 bp, Homo sapiens
tcagatgctgaattg

SEQ ID NO: 1859959 - DNA, 18 bp, Homo sapiens
tcagatttctctttgaaa

SEQ ID NO: 1859960 - DNA, 12 bp, Homo sapiens
tcagcatgacaa

SEQ ID NO: 1859961 - DNA, 18 bp, Homo sapiens
tcagccattcctgttctc

SEQ ID NO: 1859962 - DNA, 17 bp, Homo sapiens
tcagctagaatttctgg

SEQ ID NO: 1859963 - DNA, 21 bp, Homo sapiens
tcagcttgcttagatgttcca

SEQ ID NO: 1859964 - DNA, 21 bp, Homo sapiens
tcagctttttgtattaacaaa

SEQ ID NO: 1859965 - DNA, 13 bp, Homo sapiens
tcaggaaccctgg

SEQ ID NO: 1859966 - DNA, 14 bp, Homo sapiens
tcaggaaccctgga

SEQ ID NO: 1859967 - DNA, 16 bp, Homo sapiens
tcaggaaccctggaga

SEQ ID NO: 1859968 - DNA, 19 bp, Homo sapiens
tcagtattttccagcctta

SEQ ID NO: 1859969 - DNA, 23 bp, Homo sapiens
tcagtattttggagaaattattt

SEQ ID NO: 1859970 - DNA, 21 bp, Homo sapiens
tcagtctgaatggcatggaga

SEQ ID NO: 1859971 - DNA, 18 bp, Homo sapiens
tcagtgtcgggaattttc

SEQ ID NO: 1859972 - DNA, 18 bp, Homo sapiens
tcagtttttttttttcca

SEQ ID NO: 1859973 - DNA, 19 bp, Homo sapiens
tcagtttttttttttccag

SEQ ID NO: 1859974 - DNA, 13 bp, Homo sapiens
tcataattcacca

SEQ ID NO: 1859975 - DNA, 15 bp, Homo sapiens
tcatagattgcaaat

SEQ ID NO: 1859976 - DNA, 17 bp, Homo sapiens
tcatataatttaaagaa

SEQ ID NO: 1859977 - DNA, 23 bp, Homo sapiens
tcatataatttaaagaaacacta

SEQ ID NO: 1859978 - DNA, 14 bp, Homo sapiens
tcatcatcagtctt

SEQ ID NO: 1859979 - DNA, 17 bp, Homo sapiens
tcatctgtgtgaaaatg

SEQ ID NO: 1859980 - DNA, 14 bp, Homo sapiens
tcatgacatgttat

SEQ ID NO: 1859981 - DNA, 17 bp, Homo sapiens
tcatgcaaactgcttta

SEQ ID NO: 1859982 - DNA, 18 bp, Homo sapiens
tcatgcaaactgctttat

SEQ ID NO: 1859983 - DNA, 21 bp, Homo sapiens
tcatgcccactcccccaggag

SEQ ID NO: 1859984 - DNA, 23 bp, Homo sapiens
tcatgcccactcccccaggagca

SEQ ID NO: 1859985 - DNA, 15 bp, Homo sapiens
tcatggagcagcccc

SEQ ID NO: 1859986 - DNA, 22 bp, Homo sapiens
tcatgggcaactcgtgacagcc

SEQ ID NO: 1859987 - DNA, 21 bp, Homo sapiens
tcatgtatgtatataatcatg

SEQ ID NO: 1859988 - DNA, 15 bp, Homo sapiens
tcattaaaatatatg

SEQ ID NO: 1859989 - DNA, 18 bp, Homo sapiens
tcattaaaatatatgttc

SEQ ID NO: 1859990 - DNA, 14 bp, Homo sapiens
tcattgcatcattt

SEQ ID NO: 1859991 - DNA, 18 bp, Homo sapiens
tcatttgacaacacatgt

SEQ ID NO: 1859992 - DNA, 16 bp, Homo sapiens
tcatttggcttgctgt

SEQ ID NO: 1859993 - DNA, 17 bp, Homo sapiens
tcatttttgtataaaaa

SEQ ID NO: 1859994 - DNA, 20 bp, Homo sapiens
tccaaaataatctatattaa

SEQ ID NO: 1859995 - DNA, 16 bp, Homo sapiens
tccaaaccagtttatt

SEQ ID NO: 1859996 - DNA, 16 bp, Homo sapiens
tccaaattgtctgtct

SEQ ID NO: 1859997 - DNA, 18 bp, Homo sapiens
tccaaattgtctgtctgc

SEQ ID NO: 1859998 - DNA, 21 bp, Homo sapiens
tccaaattgtctgtctgctct

SEQ ID NO: 1859999 - DNA, 22 bp, Homo sapiens
tccaaattgtctgtctgctctt

SEQ ID NO: 1860000 - DNA, 13 bp, Homo sapiens
tccaacagtgagt

SEQ ID NO: 1860001 - DNA, 17 bp, Homo sapiens
tccaaggaaaattgaaa

SEQ ID NO: 1860002 - DNA, 21 bp, Homo sapiens
tccaaggaaaattgaaagtat

SEQ ID NO: 1860003 - DNA, 21 bp, Homo sapiens
tccaaggctgtcttctcccag

SEQ ID NO: 1860004 - DNA, 22 bp, Homo sapiens
tccaatgatacccaacagttta

SEQ ID NO: 1860005 - DNA, 19 bp, Homo sapiens
tccaattctgaaatacttt

SEQ ID NO: 1860006 - DNA, 21 bp, Homo sapiens
tccagaaccttactggcactg

SEQ ID NO: 1860007 - DNA, 20 bp, Homo sapiens
tccagagggactggacagcc

SEQ ID NO: 1860008 - DNA, 22 bp, Homo sapiens
tccagagggactggacagccag

SEQ ID NO: 1860009 - DNA, 20 bp, Homo sapiens
tccagcacgttttctggctt

SEQ ID NO: 1860010 - DNA, 19 bp, Homo sapiens
tccagccttatgtgttaca

SEQ ID NO: 1860011 - DNA, 18 bp, Homo sapiens
tccagctagtgccaaata

SEQ ID NO: 1860012 - DNA, 23 bp, Homo sapiens
tccagctagtgccaaataattga

SEQ ID NO: 1860013 - DNA, 23 bp, Homo sapiens
tccaggtgtggaccggccgcagc

SEQ ID NO: 1860014 - DNA, 9 bp, Homo sapiens
tccatgctt

SEQ ID NO: 1860015 - DNA, 14 bp, Homo sapiens
tccatgcttcactc

SEQ ID NO: 1860016 - DNA, 19 bp, Homo sapiens
tccatgtttgtaaaactac

SEQ ID NO: 1860017 - DNA, 16 bp, Homo sapiens
tccatttcttatttaa

SEQ ID NO: 1860018 - DNA, 19 bp, Homo sapiens
tcccagcacctattgaatt

SEQ ID NO: 1860019 - DNA, 20 bp, Homo sapiens
tcccagcacctattgaatta

SEQ ID NO: 1860020 - DNA, 16 bp, Homo sapiens
tcccagcctctggggc

SEQ ID NO: 1860021 - DNA, 17 bp, Homo sapiens
tcccagcctctggggca

SEQ ID NO: 1860022 - DNA, 14 bp, Homo sapiens
tcccagtcccagcc

SEQ ID NO: 1860023 - DNA, 16 bp, Homo sapiens
tcccagtcccagcctc

SEQ ID NO: 1860024 - DNA, 18 bp, Homo sapiens
tccccaatccatgcttca

SEQ ID NO: 1860025 - DNA, 22 bp, Homo sapiens
tcccccaggagcagctggcact

SEQ ID NO: 1860026 - DNA, 16 bp, Homo sapiens
tcccccccctgtatag

SEQ ID NO: 1860027 - DNA, 15 bp, Homo sapiens
tccctacttgcagcg

SEQ ID NO: 1860028 - DNA, 13 bp, Homo sapiens
tccctccaaggct

SEQ ID NO: 1860029 - DNA, 18 bp, Homo sapiens
tccctgaccaccctgcct

SEQ ID NO: 1860030 - DNA, 21 bp, Homo sapiens
tccctgaccaccctgcctgtg

SEQ ID NO: 1860031 - DNA, 24 bp, Homo sapiens
tccctgaccaccctgcctgtggag

SEQ ID NO: 1860032 - DNA, 22 bp, Homo sapiens
tccctgcccaatcctccctgga

SEQ ID NO: 1860033 - DNA, 13 bp, Homo sapiens
tccctggagaagg

SEQ ID NO: 1860034 - DNA, 13 bp, Homo sapiens
tcccttctgtagt

SEQ ID NO: 1860035 - DNA, 14 bp, Homo sapiens
tccctttttaaaaa

SEQ ID NO: 1860036 - DNA, 14 bp, Homo sapiens
tcctccctggagaa

SEQ ID NO: 1860037 - DNA, 22 bp, Homo sapiens
tcctcgggatgaaaagccatat

SEQ ID NO: 1860038 - DNA, 18 bp, Homo sapiens
tcctgattaccagtctga

SEQ ID NO: 1860039 - DNA, 21 bp, Homo sapiens
tcctgctgaaagtcctgcttt

SEQ ID NO: 1860040 - DNA, 22 bp, Homo sapiens
tcctgctgaaagtcctgctttc

SEQ ID NO: 1860041 - DNA, 21 bp, Homo sapiens
tcctgtagaggttttgttgtt

SEQ ID NO: 1860042 - DNA, 15 bp, Homo sapiens
tcctgtgtgcagtga

SEQ ID NO: 1860043 - DNA, 22 bp, Homo sapiens
tccttaaaggcaccatctaata

SEQ ID NO: 1860044 - DNA, 23 bp, Homo sapiens
tccttaaaggcaccatctaatag

SEQ ID NO: 1860045 - DNA, 16 bp, Homo sapiens
tcctttatatttagtg

SEQ ID NO: 1860046 - DNA, 13 bp, Homo sapiens
tcctttttattca

SEQ ID NO: 1860047 - DNA, 15 bp, Homo sapiens
tcgaattaatagctt

SEQ ID NO: 1860048 - DNA, 16 bp, Homo sapiens
tcgagtctttgtgtgt

SEQ ID NO: 1860049 - DNA, 16 bp, Homo sapiens
tcgcttgttttaaaag

SEQ ID NO: 1860050 - DNA, 15 bp, Homo sapiens
tcggcaaccgtgggg

SEQ ID NO: 1860051 - DNA, 14 bp, Homo sapiens
tcggctcacaaatt

SEQ ID NO: 1860052 - DNA, 20 bp, Homo sapiens
tcggctgtgaggcgggtggc

SEQ ID NO: 1860053 - DNA, 12 bp, Homo sapiens
tcgtgacagcct

SEQ ID NO: 1860054 - DNA, 18 bp, Homo sapiens
tcgtgacagcctctgact

SEQ ID NO: 1860055 - DNA, 19 bp, Homo sapiens
tcgttagcgtccatttctt

SEQ ID NO: 1860056 - DNA, 21 bp, Homo sapiens
tctaaagctttatctttgtgt

SEQ ID NO: 1860057 - DNA, 12 bp, Homo sapiens
tctaaattcact

SEQ ID NO: 1860058 - DNA, 15 bp, Homo sapiens
tctaacctgatggca

SEQ ID NO: 1860059 - DNA, 21 bp, Homo sapiens
tctaatagcgggttactttca

SEQ ID NO: 1860060 - DNA, 17 bp, Homo sapiens
tctaattagagaactgg

SEQ ID NO: 1860061 - DNA, 21 bp, Homo sapiens
tctacattcttggttgttaat

SEQ ID NO: 1860062 - DNA, 16 bp, Homo sapiens
tctagcatttatttct

SEQ ID NO: 1860063 - DNA, 13 bp, Homo sapiens
tctagttgcattt

SEQ ID NO: 1860064 - DNA, 17 bp, Homo sapiens
tctataaacactgtttg

SEQ ID NO: 1860065 - DNA, 20 bp, Homo sapiens
tctataataagttttgatat

SEQ ID NO: 1860066 - DNA, 21 bp, Homo sapiens
tctataatatttgtgtgttca

SEQ ID NO: 1860067 - DNA, 15 bp, Homo sapiens
tctatacctgccttt

SEQ ID NO: 1860068 - DNA, 15 bp, Homo sapiens
tctatattaaatgag

SEQ ID NO: 1860069 - DNA, 16 bp, Homo sapiens
tctatcctacaacaag

SEQ ID NO: 1860070 - DNA, 18 bp, Homo sapiens
tctatggagactttgctg

SEQ ID NO: 1860071 - DNA, 19 bp, Homo sapiens
tctatggagactttgctgt

SEQ ID NO: 1860072 - DNA, 20 bp, Homo sapiens
tctatggagactttgctgtt

SEQ ID NO: 1860073 - DNA, 22 bp, Homo sapiens
tctattgtgttggctttacaaa

SEQ ID NO: 1860074 - DNA, 18 bp, Homo sapiens
tctattttgctggagact

SEQ ID NO: 1860075 - DNA, 17 bp, Homo sapiens
tctcactaaactttacc

SEQ ID NO: 1860076 - DNA, 16 bp, Homo sapiens
tctccaattctgaaat

SEQ ID NO: 1860077 - DNA, 19 bp, Homo sapiens
tctccaattctgaaatact

SEQ ID NO: 1860078 - DNA, 22 bp, Homo sapiens
tctccccaatccatgcttcact

SEQ ID NO: 1860079 - DNA, 13 bp, Homo sapiens
tctccccctgcag

SEQ ID NO: 1860080 - DNA, 14 bp, Homo sapiens
tctccccctgcagc

SEQ ID NO: 1860081 - DNA, 15 bp, Homo sapiens
tctccccctgcagcc

SEQ ID NO: 1860082 - DNA, 19 bp, Homo sapiens
tctcctctgctcattaaac

SEQ ID NO: 1860083 - DNA, 15 bp, Homo sapiens
tctcctgtgggaaaa

SEQ ID NO: 1860084 - DNA, 15 bp, Homo sapiens
tctctctgttaaaga

SEQ ID NO: 1860085 - DNA, 16 bp, Homo sapiens
tctctctgttaaagat

SEQ ID NO: 1860086 - DNA, 18 bp, Homo sapiens
tctctggcaaacttttct

SEQ ID NO: 1860087 - DNA, 14 bp, Homo sapiens
tctcttcatacttt

SEQ ID NO: 1860088 - DNA, 19 bp, Homo sapiens
tctcttgccccaaatcaca

SEQ ID NO: 1860089 - DNA, 16 bp, Homo sapiens
tctgaaaccaaatgta

SEQ ID NO: 1860090 - DNA, 19 bp, Homo sapiens
tctgaataagcacttttta

SEQ ID NO: 1860091 - DNA, 15 bp, Homo sapiens
tctgacccagtgaga

SEQ ID NO: 1860092 - DNA, 17 bp, Homo sapiens
tctgatacttttttgaa

SEQ ID NO: 1860093 - DNA, 22 bp, Homo sapiens
tctgattttgatattttcacag

SEQ ID NO: 1860094 - DNA, 15 bp, Homo sapiens
tctgcaagaattaaa

SEQ ID NO: 1860095 - DNA, 22 bp, Homo sapiens
tctgcaagaattaaaactgagt

SEQ ID NO: 1860096 - DNA, 20 bp, Homo sapiens
tctgcatcagctttttgtat

SEQ ID NO: 1860097 - DNA, 21 bp, Homo sapiens
tctggacctcggtgatgcctt

SEQ ID NO: 1860098 - DNA, 16 bp, Homo sapiens
tctggcttccctgccc

SEQ ID NO: 1860099 - DNA, 17 bp, Homo sapiens
tctggcttccctgccca

SEQ ID NO: 1860100 - DNA, 18 bp, Homo sapiens
tctggcttccctgcccaa

SEQ ID NO: 1860101 - DNA, 14 bp, Homo sapiens
tctggggcagagct

SEQ ID NO: 1860102 - DNA, 15 bp, Homo sapiens
tctggggcaggacca

SEQ ID NO: 1860103 - DNA, 13 bp, Homo sapiens
tctggttccaaac

SEQ ID NO: 1860104 - DNA, 15 bp, Homo sapiens
tctgtaaactcaaaa

SEQ ID NO: 1860105 - DNA, 19 bp, Homo sapiens
tctgtatactgtaaaagtt

SEQ ID NO: 1860106 - DNA, 14 bp, Homo sapiens
tctgtctgctctta

SEQ ID NO: 1860107 - DNA, 14 bp, Homo sapiens
tctgtctttgcaaa

SEQ ID NO: 1860108 - DNA, 16 bp, Homo sapiens
tctgtctttgcaaagg

SEQ ID NO: 1860109 - DNA, 18 bp, Homo sapiens
tctgtggttctataataa

SEQ ID NO: 1860110 - DNA, 21 bp, Homo sapiens
tctgtggttctataataagtt

SEQ ID NO: 1860111 - DNA, 20 bp, Homo sapiens
tctgtgtgatgaactttctc

SEQ ID NO: 1860112 - DNA, 12 bp, Homo sapiens
tctgtgttgctt

SEQ ID NO: 1860113 - DNA, 16 bp, Homo sapiens
tctgttaagaaaggat

SEQ ID NO: 1860114 - DNA, 18 bp, Homo sapiens
tctgttaagaaaggatat

SEQ ID NO: 1860115 - DNA, 14 bp, Homo sapiens
tctgttgtaaataa

SEQ ID NO: 1860116 - DNA, 18 bp, Homo sapiens
tctgtttgtatatttgca

SEQ ID NO: 1860117 - DNA, 15 bp, Homo sapiens
tcttaaaaactgtgt

SEQ ID NO: 1860118 - DNA, 17 bp, Homo sapiens
tcttaaaaactgtgtat

SEQ ID NO: 1860119 - DNA, 19 bp, Homo sapiens
tcttaaaaactgtgtatca

SEQ ID NO: 1860120 - DNA, 13 bp, Homo sapiens
tcttaaaaatctt

SEQ ID NO: 1860121 - DNA, 13 bp, Homo sapiens
tcttaactgtatt

SEQ ID NO: 1860122 - DNA, 15 bp, Homo sapiens
tcttaactgtatttc

SEQ ID NO: 1860123 - DNA, 20 bp, Homo sapiens
tcttaatattcagagaaaac

SEQ ID NO: 1860124 - DNA, 22 bp, Homo sapiens
tcttaatattcagagaaaactt

SEQ ID NO: 1860125 - DNA, 14 bp, Homo sapiens
tcttacaagcttaa

SEQ ID NO: 1860126 - DNA, 19 bp, Homo sapiens
tcttacaagcttaaagctt

SEQ ID NO: 1860127 - DNA, 17 bp, Homo sapiens
tcttagagtttacagtt

SEQ ID NO: 1860128 - DNA, 20 bp, Homo sapiens
tcttagagtttacagtttgt

SEQ ID NO: 1860129 - DNA, 13 bp, Homo sapiens
tcttatttaatta

SEQ ID NO: 1860130 - DNA, 22 bp, Homo sapiens
tcttcatactttttttcacagt

SEQ ID NO: 1860131 - DNA, 20 bp, Homo sapiens
tcttctccaattctgaaata

SEQ ID NO: 1860132 - DNA, 12 bp, Homo sapiens
tcttctcccaga

SEQ ID NO: 1860133 - DNA, 14 bp, Homo sapiens
tcttctcccagagc

SEQ ID NO: 1860134 - DNA, 16 bp, Homo sapiens
tcttctcccagagcac

SEQ ID NO: 1860135 - DNA, 15 bp, Homo sapiens
tcttgaattgttatg

SEQ ID NO: 1860136 - DNA, 17 bp, Homo sapiens
tcttgaattgttatgaa

SEQ ID NO: 1860137 - DNA, 19 bp, Homo sapiens
tcttgaattgttatgaaaa

SEQ ID NO: 1860138 - DNA, 14 bp, Homo sapiens
tcttgcatttcact

SEQ ID NO: 1860139 - DNA, 15 bp, Homo sapiens
tcttgccccaaatca

SEQ ID NO: 1860140 - DNA, 21 bp, Homo sapiens
tcttgccccaaatcacaaaca

SEQ ID NO: 1860141 - DNA, 21 bp, Homo sapiens
tcttggaaagaggttctgcac

SEQ ID NO: 1860142 - DNA, 13 bp, Homo sapiens
tcttggcttctta

SEQ ID NO: 1860143 - DNA, 16 bp, Homo sapiens
tcttggcttcttaaaa

SEQ ID NO: 1860144 - DNA, 19 bp, Homo sapiens
tcttggcttcttaaaaact

SEQ ID NO: 1860145 - DNA, 20 bp, Homo sapiens
tcttgggacaacgtgctgct

SEQ ID NO: 1860146 - DNA, 21 bp, Homo sapiens
tcttgggacaacgtgctgctt

SEQ ID NO: 1860147 - DNA, 18 bp, Homo sapiens
tcttgttattaatgtttc

SEQ ID NO: 1860148 - DNA, 14 bp, Homo sapiens
tctttaaatacagt

SEQ ID NO: 1860149 - DNA, 16 bp, Homo sapiens
tctttaacttgtaata

SEQ ID NO: 1860150 - DNA, 16 bp, Homo sapiens
tctttgtgtgttatat

SEQ ID NO: 1860151 - DNA, 15 bp, Homo sapiens
tctttgtttaaatgc

SEQ ID NO: 1860152 - DNA, 12 bp, Homo sapiens
tcttttctgaat

SEQ ID NO: 1860153 - DNA, 19 bp, Homo sapiens
tcttttctgaatcttctga

SEQ ID NO: 1860154 - DNA, 17 bp, Homo sapiens
tctttttttggtaaatt

SEQ ID NO: 1860155 - DNA, 16 bp, Homo sapiens
tcttttttttttccaa

SEQ ID NO: 1860156 - DNA, 17 bp, Homo sapiens
tcttttttttttccaaa

SEQ ID NO: 1860157 - DNA, 22 bp, Homo sapiens
ttagttatagtttcagatatat

SEQ ID NO: 1860158 - DNA, 11 bp, Homo sapiens
ttagttcttga

SEQ ID NO: 1860159 - DNA, 12 bp, Homo sapiens
ttagttcttgaa

SEQ ID NO: 1860160 - DNA, 17 bp, Homo sapiens
ttagttcttgaattgtt

SEQ ID NO: 1860161 - DNA, 12 bp, Homo sapiens
ttagtttaaaat

SEQ ID NO: 1860162 - DNA, 14 bp, Homo sapiens
ttataagcgtattt

SEQ ID NO: 1860163 - DNA, 14 bp, Homo sapiens
ttataataactgaa

SEQ ID NO: 1860164 - DNA, 14 bp, Homo sapiens
ttatagttaatcta

SEQ ID NO: 1860165 - DNA, 12 bp, Homo sapiens
ttatagtttgta

SEQ ID NO: 1860166 - DNA, 18 bp, Homo sapiens
ttatataggttgtgcaaa

SEQ ID NO: 1860167 - DNA, 22 bp, Homo sapiens
ttatattccaaggaaaattgaa

SEQ ID NO: 1860168 - DNA, 22 bp, Homo sapiens
ttatatttagttatagtttcag

SEQ ID NO: 1860169 - DNA, 18 bp, Homo sapiens
ttatcgtccagtgacttt

SEQ ID NO: 1860170 - DNA, 14 bp, Homo sapiens
ttatgcaaaaacat

SEQ ID NO: 1860171 - DNA, 20 bp, Homo sapiens
ttatgcagagtcagccattc

SEQ ID NO: 1860172 - DNA, 20 bp, Homo sapiens
ttatgtgttacattattcca

SEQ ID NO: 1860173 - DNA, 18 bp, Homo sapiens
ttatgtttgtaatctgta

SEQ ID NO: 1860174 - DNA, 19 bp, Homo sapiens
ttattaaaatgattgtaaa

SEQ ID NO: 1860175 - DNA, 19 bp, Homo sapiens
ttattctgtggttctataa

SEQ ID NO: 1860176 - DNA, 19 bp, Homo sapiens
ttattgtacagctgtttaa

SEQ ID NO: 1860177 - DNA, 13 bp, Homo sapiens
ttatttacatttt

SEQ ID NO: 1860178 - DNA, 16 bp, Homo sapiens
ttatttatatcttgtt

SEQ ID NO: 1860179 - DNA, 17 bp, Homo sapiens
ttatttccaaataaaat

SEQ ID NO: 1860180 - DNA, 19 bp, Homo sapiens
ttatttctctggcaaactt

SEQ ID NO: 1860181 - DNA, 16 bp, Homo sapiens
ttatttgtgtaataga

SEQ ID NO: 1860182 - DNA, 21 bp, Homo sapiens
ttcaaaaaaaaaaaaaaagac

SEQ ID NO: 1860183 - DNA, 22 bp, Homo sapiens
ttcaaaaaaaaaaaaaaagact

SEQ ID NO: 1860184 - DNA, 16 bp, Homo sapiens
ttcaaattggtctgaa

SEQ ID NO: 1860185 - DNA, 20 bp, Homo sapiens
ttcaaggtggccaaattatt

SEQ ID NO: 1860186 - DNA, 15 bp, Homo sapiens
ttcacagttctgtaa

SEQ ID NO: 1860187 - DNA, 16 bp, Homo sapiens
ttcaccatgcaggcaa

SEQ ID NO: 1860188 - DNA, 20 bp, Homo sapiens
ttcaccatgcaggcaacatt

SEQ ID NO: 1860189 - DNA, 15 bp, Homo sapiens
ttcaccctgggcagt

SEQ ID NO: 1860190 - DNA, 20 bp, Homo sapiens
ttcactcatgcaaactgctt

SEQ ID NO: 1860191 - DNA, 18 bp, Homo sapiens
ttcagaaattaaaatatt

SEQ ID NO: 1860192 - DNA, 21 bp, Homo sapiens
ttcagaaattaaaatattatt

SEQ ID NO: 1860193 - DNA, 23 bp, Homo sapiens
ttcagaagtttggcaatagtttg

SEQ ID NO: 1860194 - DNA, 14 bp, Homo sapiens
ttcagctagaattt

SEQ ID NO: 1860195 - DNA, 18 bp, Homo sapiens
ttcagctagaatttctgg

SEQ ID NO: 1860196 - DNA, 22 bp, Homo sapiens
ttcaggctttaggcatatgctt

SEQ ID NO: 1860197 - DNA, 12 bp, Homo sapiens
ttcagtatctta

SEQ ID NO: 1860198 - DNA, 23 bp, Homo sapiens
ttcagtatcttagagtttacagt

SEQ ID NO: 1860199 - DNA, 13 bp, Homo sapiens
ttcagtattttcc

SEQ ID NO: 1860200 - DNA, 14 bp, Homo sapiens
ttcagtattttcca

SEQ ID NO: 1860201 - DNA, 18 bp, Homo sapiens
ttcagtattttccagcct

SEQ ID NO: 1860202 - DNA, 19 bp, Homo sapiens
ttcagtattttggagaaat

SEQ ID NO: 1860203 - DNA, 20 bp, Homo sapiens
ttcagtattttggagaaatt

SEQ ID NO: 1860204 - DNA, 21 bp, Homo sapiens
ttcagtattttggagaaatta

SEQ ID NO: 1860205 - DNA, 21 bp, Homo sapiens
ttcagtgtcgggaattttccc

SEQ ID NO: 1860206 - DNA, 23 bp, Homo sapiens
ttcagtgtcgggaattttccccg

SEQ ID NO: 1860207 - DNA, 21 bp, Homo sapiens
ttcatagatttgaaaaacttt

SEQ ID NO: 1860208 - DNA, 15 bp, Homo sapiens
ttcatttctaacata

SEQ ID NO: 1860209 - DNA, 15 bp, Homo sapiens
ttccaaataaaatga

SEQ ID NO: 1860210 - DNA, 21 bp, Homo sapiens
ttccaaggaaaattgaaagta

SEQ ID NO: 1860211 - DNA, 22 bp, Homo sapiens
ttccaaggaaaattgaaagtat

SEQ ID NO: 1860212 - DNA, 14 bp, Homo sapiens
ttccagaatctgta

SEQ ID NO: 1860213 - DNA, 15 bp, Homo sapiens
ttccagagttgttgt

SEQ ID NO: 1860214 - DNA, 18 bp, Homo sapiens
ttccagataaccagctgt

SEQ ID NO: 1860215 - DNA, 22 bp, Homo sapiens
ttcccagaaatacaacagaagt

SEQ ID NO: 1860216 - DNA, 20 bp, Homo sapiens
ttcccaggtaatttaaattg

SEQ ID NO: 1860217 - DNA, 14 bp, Homo sapiens
ttccctacttgcag

SEQ ID NO: 1860218 - DNA, 12 bp, Homo sapiens
ttccctgcccaa

SEQ ID NO: 1860219 - DNA, 15 bp, Homo sapiens
ttccctgcccaatcc

SEQ ID NO: 1860220 - DNA, 19 bp, Homo sapiens
ttcctctcactaaacttta

SEQ ID NO: 1860221 - DNA, 13 bp, Homo sapiens
ttcctgtctgttt

SEQ ID NO: 1860222 - DNA, 15 bp, Homo sapiens
ttcctgttgtgtaat

SEQ ID NO: 1860223 - DNA, 21 bp, Homo sapiens
ttccttctgttaagaaaggat

SEQ ID NO: 1860224 - DNA, 14 bp, Homo sapiens
ttcctttatattta

SEQ ID NO: 1860225 - DNA, 13 bp, Homo sapiens
ttctaacataagt

SEQ ID NO: 1860226 - DNA, 22 bp, Homo sapiens
ttctaatatatttttatattta

SEQ ID NO: 1860227 - DNA, 23 bp, Homo sapiens
ttctagtatctattgtgttggct

SEQ ID NO: 1860228 - DNA, 23 bp, Homo sapiens
ttctatcctacaacaagagttta

SEQ ID NO: 1860229 - DNA, 15 bp, Homo sapiens
ttctatggagacttt

SEQ ID NO: 1860230 - DNA, 12 bp, Homo sapiens
ttctattttgct

SEQ ID NO: 1860231 - DNA, 19 bp, Homo sapiens
ttctcaagtttaaagtcat

SEQ ID NO: 1860232 - DNA, 14 bp, Homo sapiens
ttctcattaaactc

SEQ ID NO: 1860233 - DNA, 11 bp, Homo sapiens
ttctcctgccc

SEQ ID NO: 1860234 - DNA, 16 bp, Homo sapiens
ttctctggcaaacttt

SEQ ID NO: 1860235 - DNA, 17 bp, Homo sapiens
ttctctggcaaactttt

SEQ ID NO: 1860236 - DNA, 17 bp, Homo sapiens
ttctctttgccttgatg

SEQ ID NO: 1860237 - DNA, 12 bp, Homo sapiens
ttctctttgtgc

SEQ ID NO: 1860238 - DNA, 15 bp, Homo sapiens
ttctctttgtgcagt

SEQ ID NO: 1860239 - DNA, 18 bp, Homo sapiens
ttctgcaagaattaaaac

SEQ ID NO: 1860240 - DNA, 20 bp, Homo sapiens
ttctgcaagaattaaaactg

SEQ ID NO: 1860241 - DNA, 12 bp, Homo sapiens
ttctggttccaa

SEQ ID NO: 1860242 - DNA, 14 bp, Homo sapiens
ttctggttccaaac

SEQ ID NO: 1860243 - DNA, 21 bp, Homo sapiens
ttctgtagtttttaattaaaa

SEQ ID NO: 1860244 - DNA, 14 bp, Homo sapiens
ttctgtatactgta

SEQ ID NO: 1860245 - DNA, 19 bp, Homo sapiens
ttctgtatactgtaaaagt

SEQ ID NO: 1860246 - DNA, 23 bp, Homo sapiens
ttctgtgtgcaccttaccaactt

SEQ ID NO: 1860247 - DNA, 14 bp, Homo sapiens
ttctgttaagaaag

SEQ ID NO: 1860248 - DNA, 12 bp, Homo sapiens
ttcttaaaaact

SEQ ID NO: 1860249 - DNA, 16 bp, Homo sapiens
ttcttacaagcttaaa

SEQ ID NO: 1860250 - DNA, 19 bp, Homo sapiens
ttcttacaagcttaaagct

SEQ ID NO: 1860251 - DNA, 13 bp, Homo sapiens
ttcttgaattgtt

SEQ ID NO: 1860252 - DNA, 20 bp, Homo sapiens
ttcttgaattgttatgaaaa

SEQ ID NO: 1860253 - DNA, 16 bp, Homo sapiens
ttcttggttgttaatt

SEQ ID NO: 1860254 - DNA, 13 bp, Homo sapiens
ttcttgtcaaaaa

SEQ ID NO: 1860255 - DNA, 11 bp, Homo sapiens
ttctttgaatg

SEQ ID NO: 1860256 - DNA, 21 bp, Homo sapiens
ttctttgtagaataaatggtt

SEQ ID NO: 1860257 - DNA, 14 bp, Homo sapiens
ttgaaaaatattgc

SEQ ID NO: 1860258 - DNA, 15 bp, Homo sapiens
ttgaaaaatattgct

SEQ ID NO: 1860259 - DNA, 20 bp, Homo sapiens
ttgaaaattattttaaacaa

SEQ ID NO: 1860260 - DNA, 21 bp, Homo sapiens
ttgaaagaattctattttgct

SEQ ID NO: 1860261 - DNA, 13 bp, Homo sapiens
ttgaaagtattca

SEQ ID NO: 1860262 - DNA, 23 bp, Homo sapiens
ttgaaagtattcagaaattaaaa

SEQ ID NO: 1860263 - DNA, 15 bp, Homo sapiens
ttgaaatcagcatga

SEQ ID NO: 1860264 - DNA, 19 bp, Homo sapiens
ttgaaatcagcatgacaaa

SEQ ID NO: 1860265 - DNA, 13 bp, Homo sapiens
ttgaataaaaagt

SEQ ID NO: 1860266 - DNA, 14 bp, Homo sapiens
ttgaataaaaagtg

SEQ ID NO: 1860267 - DNA, 16 bp, Homo sapiens
ttgaataaaaagtgaa

SEQ ID NO: 1860268 - DNA, 17 bp, Homo sapiens
ttgaatgacaacagaag

SEQ ID NO: 1860269 - DNA, 17 bp, Homo sapiens
ttgaatgctttttgaat

SEQ ID NO: 1860270 - DNA, 23 bp, Homo sapiens
ttgaatgctttttgaatgttatt

SEQ ID NO: 1860271 - DNA, 16 bp, Homo sapiens
ttgaattgttatgaaa

SEQ ID NO: 1860272 - DNA, 20 bp, Homo sapiens
ttgatattttccctttttaa

SEQ ID NO: 1860273 - DNA, 17 bp, Homo sapiens
ttgatcagatgctgaat

SEQ ID NO: 1860274 - DNA, 21 bp, Homo sapiens
ttgatcccttctcctgccctt

SEQ ID NO: 1860275 - DNA, 21 bp, Homo sapiens
ttgatctttgtttaaatgcca

SEQ ID NO: 1860276 - DNA, 21 bp, Homo sapiens
tttttgaaaaatattgctaaa

SEQ ID NO: 1860277 - DNA, 23 bp, Homo sapiens
tttttgaaatcagtaaacactgt

SEQ ID NO: 1860278 - DNA, 12 bp, Homo sapiens
tttttgctaatt

SEQ ID NO: 1860279 - DNA, 20 bp, Homo sapiens
tttttgtaccatattgctct

SEQ ID NO: 1860280 - DNA, 11 bp, Homo sapiens
tttttgtactt

SEQ ID NO: 1860281 - DNA, 12 bp, Homo sapiens
tttttgtataaa

SEQ ID NO: 1860282 - DNA, 16 bp, Homo sapiens
tttttgtattaacaaa

SEQ ID NO: 1860283 - DNA, 23 bp, Homo sapiens
ttttttaaacaaaatttcacagt

SEQ ID NO: 1860284 - DNA, 17 bp, Homo sapiens
ttttttaagtgcaacat

SEQ ID NO: 1860285 - DNA, 12 bp, Homo sapiens
ttttttccaaat

SEQ ID NO: 1860286 - DNA, 13 bp, Homo sapiens
ttttttggtaaat

SEQ ID NO: 1860287 - DNA, 12 bp, Homo sapiens
ttttttttaagt

SEQ ID NO: 1860288 - DNA, 13 bp, Homo sapiens
ttttttttgtaaa

SEQ ID NO: 1860289 - DNA, 13 bp, Homo sapiens
tttttttttaagt

SEQ ID NO: 1860290 - DNA, 17 bp, Homo sapiens
tttcattgtgatttata

SEQ ID NO: 1860291 - DNA, 18 bp, Homo sapiens
tttcattgtgatttatat

SEQ ID NO: 1860292 - DNA, 20 bp, Homo sapiens
tttcattgtgatttatatat

SEQ ID NO: 1860293 - DNA, 22 bp, Homo sapiens
tttcattgtgatttatatataa

SEQ ID NO: 1860294 - DNA, 19 bp, Homo sapiens
tttcatttctaacataagt

SEQ ID NO: 1860295 - DNA, 18 bp, Homo sapiens
tttccagagttgttgttt

SEQ ID NO: 1860296 - DNA, 17 bp, Homo sapiens
tttccagccttatgtgt

SEQ ID NO: 1860297 - DNA, 18 bp, Homo sapiens
tttccctttttaaaaaat

SEQ ID NO: 1860298 - DNA, 15 bp, Homo sapiens
tttccttctgttaag

SEQ ID NO: 1860299 - DNA, 13 bp, Homo sapiens
tttctactcattt

SEQ ID NO: 1860300 - DNA, 22 bp, Homo sapiens
tttctactttttctgtactttt

SEQ ID NO: 1860301 - DNA, 16 bp, Homo sapiens
tttctagtatctattg

SEQ ID NO: 1860302 - DNA, 16 bp, Homo sapiens
tttctctggcaaactt

SEQ ID NO: 1860303 - DNA, 17 bp, Homo sapiens
tttctggcttctgcttc

SEQ ID NO: 1860304 - DNA, 19 bp, Homo sapiens
tttctgtatactgtaaaag

SEQ ID NO: 1860305 - DNA, 11 bp, Homo sapiens
tttctgtgtgc

SEQ ID NO: 1860306 - DNA, 14 bp, Homo sapiens
tttcttatttaatt

SEQ ID NO: 1860307 - DNA, 18 bp, Homo sapiens
tttctttgtagaataaat

SEQ ID NO: 1860308 - DNA, 15 bp, Homo sapiens
tttcttttttaaagt

SEQ ID NO: 1860309 - DNA, 13 bp, Homo sapiens
tttgaaaaatatt

SEQ ID NO: 1860310 - DNA, 16 bp, Homo sapiens
tttgaaactaactcat

SEQ ID NO: 1860311 - DNA, 21 bp, Homo sapiens
tttgaaactaactcatagatt

SEQ ID NO: 1860312 - DNA, 17 bp, Homo sapiens
tttgaaagaattctatt

SEQ ID NO: 1860313 - DNA, 23 bp, Homo sapiens
tttgaaagaattctattttgctg

SEQ ID NO: 1860314 - DNA, 21 bp, Homo sapiens
tttgaaggtaataaatacaca

SEQ ID NO: 1860315 - DNA, 16 bp, Homo sapiens
tttgaataaaaagtga

SEQ ID NO: 1860316 - DNA, 17 bp, Homo sapiens
tttgaataaaaagtgaa

SEQ ID NO: 1860317 - DNA, 13 bp, Homo sapiens
tttgacaacacat

SEQ ID NO: 1860318 - DNA, 15 bp, Homo sapiens
tttgaggtctacatt

SEQ ID NO: 1860319 - DNA, 19 bp, Homo sapiens
tttgaggtctacattcttg

SEQ ID NO: 1860320 - DNA, 16 bp, Homo sapiens
tttgatctttgtttaa

SEQ ID NO: 1860321 - DNA, 21 bp, Homo sapiens
tttgatctttgtttaaatgcc

SEQ ID NO: 1860322 - DNA, 13 bp, Homo sapiens
tttgatttctatt

SEQ ID NO: 1860323 - DNA, 16 bp, Homo sapiens
tttgccaagctaatct

SEQ ID NO: 1860324 - DNA, 12 bp, Homo sapiens
tttgctaaaaga

SEQ ID NO: 1860325 - DNA, 10 bp, Homo sapiens
tttgctgccc

SEQ ID NO: 1860326 - DNA, 12 bp, Homo sapiens
tttgctgccctg

SEQ ID NO: 1860327 - DNA, 15 bp, Homo sapiens
tttgctgccctgggg

SEQ ID NO: 1860328 - DNA, 13 bp, Homo sapiens
tttgctgttactg

SEQ ID NO: 1860329 - DNA, 16 bp, Homo sapiens
tttgcttgattaaaca

SEQ ID NO: 1860330 - DNA, 17 bp, Homo sapiens
tttggagccgggaaagc

SEQ ID NO: 1860331 - DNA, 16 bp, Homo sapiens
tttggcactgatgcaa

SEQ ID NO: 1860332 - DNA, 19 bp, Homo sapiens
tttggtacagttcataatt

SEQ ID NO: 1860333 - DNA, 18 bp, Homo sapiens
tttggtcgagtctttgtg

SEQ ID NO: 1860334 - DNA, 14 bp, Homo sapiens
tttgtaatttgaat

SEQ ID NO: 1860335 - DNA, 15 bp, Homo sapiens
tttgtaatttgaatt

SEQ ID NO: 1860336 - DNA, 18 bp, Homo sapiens
tttgtagaataaatggtt

SEQ ID NO: 1860337 - DNA, 20 bp, Homo sapiens
tttgtaggggtcaaagaaat

SEQ ID NO: 1860338 - DNA, 21 bp, Homo sapiens
tttgtaggggtcaaagaaatg

SEQ ID NO: 1860339 - DNA, 23 bp, Homo sapiens
tttgtaggggtcaaagaaatgct

SEQ ID NO: 1860340 - DNA, 12 bp, Homo sapiens
tttgtataaaaa

SEQ ID NO: 1860341 - DNA, 15 bp, Homo sapiens
tttgtataaaaagga

SEQ ID NO: 1860342 - DNA, 16 bp, Homo sapiens
tttgtataaaaaggaa

SEQ ID NO: 1860343 - DNA, 18 bp, Homo sapiens
tttgtataacttcttaaa

SEQ ID NO: 1860344 - DNA, 19 bp, Homo sapiens
tttgtataacttcttaaaa

SEQ ID NO: 1860345 - DNA, 14 bp, Homo sapiens
tttgtatatttgca

SEQ ID NO: 1860346 - DNA, 15 bp, Homo sapiens
tttgtatatttgcaa

SEQ ID NO: 1860347 - DNA, 15 bp, Homo sapiens
tttgtattataattg

SEQ ID NO: 1860348 - DNA, 22 bp, Homo sapiens
tttgtattataattgttgatat

SEQ ID NO: 1860349 - DNA, 18 bp, Homo sapiens
tttgtctaaacaaggtaa

SEQ ID NO: 1860350 - DNA, 19 bp, Homo sapiens
tttgtctgtgtgctgtaac

SEQ ID NO: 1860351 - DNA, 20 bp, Homo sapiens
tttgtgcatcagaaaatgca

SEQ ID NO: 1860352 - DNA, 14 bp, Homo sapiens
tttgtgtgttatat

SEQ ID NO: 1860353 - DNA, 19 bp, Homo sapiens
tttgtgtgttatattccaa

SEQ ID NO: 1860354 - DNA, 21 bp, Homo sapiens
tttgtgttttaaaaaaactga

SEQ ID NO: 1860355 - DNA, 13 bp, Homo sapiens
tttgttatagatt

SEQ ID NO: 1860356 - DNA, 14 bp, Homo sapiens
tttgttattaaaaa

SEQ ID NO: 1860357 - DNA, 18 bp, Homo sapiens
tttgttccagaatctgta

SEQ ID NO: 1860358 - DNA, 17 bp, Homo sapiens
ttttaaaaaaactgaag

SEQ ID NO: 1860359 - DNA, 20 bp, Homo sapiens
ttttaaaaaaactgaaggtt

SEQ ID NO: 1860360 - DNA, 11 bp, Homo sapiens
ttttaaaaata

SEQ ID NO: 1860361 - DNA, 17 bp, Homo sapiens
ttttaaacaaaatttca

SEQ ID NO: 1860362 - DNA, 20 bp, Homo sapiens
ttttaaacaaaatttcacag

SEQ ID NO: 1860363 - DNA, 22 bp, Homo sapiens
ttttaaagtaaacttgtgtatt

SEQ ID NO: 1860364 - DNA, 23 bp, Homo sapiens
ttttaagtgacataattgtccag

SEQ ID NO: 1860365 - DNA, 23 bp, Homo sapiens
ttttaagtgcaacatttctgtat

SEQ ID NO: 1860366 - DNA, 16 bp, Homo sapiens
ttttaatgattgttta

SEQ ID NO: 1860367 - DNA, 12 bp, Homo sapiens
ttttaatttcca

SEQ ID NO: 1860368 - DNA, 17 bp, Homo sapiens
ttttacagtctctgttg

SEQ ID NO: 1860369 - DNA, 19 bp, Homo sapiens
ttttaccctatatctataa

SEQ ID NO: 1860370 - DNA, 19 bp, Homo sapiens
ttttagatgtgctgctttg

SEQ ID NO: 1860371 - DNA, 14 bp, Homo sapiens
ttttagttcagact

SEQ ID NO: 1860372 - DNA, 16 bp, Homo sapiens
ttttatacataaacag

SEQ ID NO: 1860373 - DNA, 18 bp, Homo sapiens
ttttatacataaacagtt

SEQ ID NO: 1860374 - DNA, 15 bp, Homo sapiens
ttttatcatgacatg

SEQ ID NO: 1860375 - DNA, 12 bp, Homo sapiens
ttttattgtttt

SEQ ID NO: 1860376 - DNA, 11 bp, Homo sapiens
ttttatttaca

SEQ ID NO: 1860377 - DNA, 23 bp, Homo sapiens
ttttcagtattttggagaaatta

SEQ ID NO: 1860378 - DNA, 20 bp, Homo sapiens
ttttcatttctaacataagt

SEQ ID NO: 1860379 - DNA, 21 bp, Homo sapiens
ttttccagccttatgtgttac

SEQ ID NO: 1860380 - DNA, 17 bp, Homo sapiens
ttttccatctgtgtgca

SEQ ID NO: 1860381 - DNA, 13 bp, Homo sapiens
ttttcccttttta

SEQ ID NO: 1860382 - DNA, 17 bp, Homo sapiens
ttttccctttttaaaaa

SEQ ID NO: 1860383 - DNA, 20 bp, Homo sapiens
ttttccttcctttttattca

SEQ ID NO: 1860384 - DNA, 14 bp, Homo sapiens
ttttctagactttc

SEQ ID NO: 1860385 - DNA, 21 bp, Homo sapiens
ttttctccagggttcaccatg

SEQ ID NO: 1860386 - DNA, 22 bp, Homo sapiens
ttttctctgatacttttttgaa

SEQ ID NO: 1860387 - DNA, 14 bp, Homo sapiens
ttttctggttccaa

SEQ ID NO: 1860388 - DNA, 19 bp, Homo sapiens
ttttgaaaaatattgctaa

SEQ ID NO: 1860389 - DNA, 17 bp, Homo sapiens
ttttgaataaaaagtga

SEQ ID NO: 1860390 - DNA, 13 bp, Homo sapiens
ttttgaatgttat

SEQ ID NO: 1860391 - DNA, 10 bp, Homo sapiens
ttttgatata

SEQ ID NO: 1860392 - DNA, 17 bp, Homo sapiens
ttttgatataatcttgg

SEQ ID NO: 1860393 - DNA, 13 bp, Homo sapiens
ttttgatgcacaa

SEQ ID NO: 1860394 - DNA, 18 bp, Homo sapiens
ttttgctgtgctgtacat

SEQ ID NO: 1860395 - DNA, 18 bp, Homo sapiens
ttttggagaaaaattaca

SEQ ID NO: 1860396 - DNA, 10 bp, Homo sapiens
ttttgtaaag

SEQ ID NO: 1860397 - DNA, 16 bp, Homo sapiens
ttttgtaaatgagaca

SEQ ID NO: 1860398 - DNA, 19 bp, Homo sapiens
ttttgtaaatgagacacat

SEQ ID NO: 1860399 - DNA, 14 bp, Homo sapiens
ttttgtataaaaag

SEQ ID NO: 1860400 - DNA, 16 bp, Homo sapiens
ttttgtataaaaagga

SEQ ID NO: 1860401 - DNA, 13 bp, Homo sapiens
ttttgtatatatc

SEQ ID NO: 1860402 - DNA, 16 bp, Homo sapiens
ttttgtgatttagaac

SEQ ID NO: 1860403 - DNA, 19 bp, Homo sapiens
tttttaaagtaaacttgtg

SEQ ID NO: 1860404 - DNA, 22 bp, Homo sapiens
tttttaaagtaaacttgtgtat

SEQ ID NO: 1860405 - DNA, 13 bp, Homo sapiens
tttttaagtgcaa

SEQ ID NO: 1860406 - DNA, 18 bp, Homo sapiens
tttttaagtgcaacattt

SEQ ID NO: 1860407 - DNA, 23 bp, Homo sapiens
tttttaagtgcaacatttctgta

SEQ ID NO: 1860408 - DNA, 15 bp, Homo sapiens
tttttatatttagtt

SEQ ID NO: 1860409 - DNA, 13 bp, Homo sapiens
ttgattaaacagc

SEQ ID NO: 1860410 - DNA, 19 bp, Homo sapiens
ttgattcacacttgttcaa

SEQ ID NO: 1860411 - DNA, 14 bp, Homo sapiens
ttgattcagtatct

SEQ ID NO: 1860412 - DNA, 16 bp, Homo sapiens
ttgattcagtatctta

SEQ ID NO: 1860413 - DNA, 12 bp, Homo sapiens
ttgatttatgca

SEQ ID NO: 1860414 - DNA, 14 bp, Homo sapiens
ttgcaaaccctttg

SEQ ID NO: 1860415 - DNA, 15 bp, Homo sapiens
ttgcactaaagtatg

SEQ ID NO: 1860416 - DNA, 14 bp, Homo sapiens
ttgcagtcttttgc

SEQ ID NO: 1860417 - DNA, 15 bp, Homo sapiens
ttgccttaagtttcc

SEQ ID NO: 1860418 - DNA, 12 bp, Homo sapiens
ttgctaaaagaa

SEQ ID NO: 1860419 - DNA, 13 bp, Homo sapiens
ttgctcttaaaaa

SEQ ID NO: 1860420 - DNA, 17 bp, Homo sapiens
ttgctgccttcaccctg

SEQ ID NO: 1860421 - DNA, 12 bp, Homo sapiens
ttgctggagact

SEQ ID NO: 1860422 - DNA, 14 bp, Homo sapiens
ttgctgtttactcc

SEQ ID NO: 1860423 - DNA, 18 bp, Homo sapiens
ttgcttcaaattggtctg

SEQ ID NO: 1860424 - DNA, 16 bp, Homo sapiens
ttgcttgattaaacag

SEQ ID NO: 1860425 - DNA, 20 bp, Homo sapiens
ttggaagaagttttttactt

SEQ ID NO: 1860426 - DNA, 22 bp, Homo sapiens
ttggaagaagttttttactttg

SEQ ID NO: 1860427 - DNA, 16 bp, Homo sapiens
ttggagccgggaaagc

SEQ ID NO: 1860428 - DNA, 20 bp, Homo sapiens
ttggcaatagtttgcataga

SEQ ID NO: 1860429 - DNA, 21 bp, Homo sapiens
ttggctggatgaaattttcta

SEQ ID NO: 1860430 - DNA, 23 bp, Homo sapiens
ttggctggatgaaattttctaga

SEQ ID NO: 1860431 - DNA, 21 bp, Homo sapiens
ttggcttcttaaaaactgtgt

SEQ ID NO: 1860432 - DNA, 22 bp, Homo sapiens
ttggcttcttaaaaactgtgta

SEQ ID NO: 1860433 - DNA, 17 bp, Homo sapiens
ttggctttacaaataat

SEQ ID NO: 1860434 - DNA, 18 bp, Homo sapiens
ttggtcgagtctttgtgt

SEQ ID NO: 1860435 - DNA, 15 bp, Homo sapiens
ttggttcctcacata

SEQ ID NO: 1860436 - DNA, 15 bp, Homo sapiens
ttgtaaaatagcttg

SEQ ID NO: 1860437 - DNA, 18 bp, Homo sapiens
ttgtaaatgagacacata

SEQ ID NO: 1860438 - DNA, 12 bp, Homo sapiens
ttgtaatttgaa

SEQ ID NO: 1860439 - DNA, 16 bp, Homo sapiens
ttgtaatttgaattgg

SEQ ID NO: 1860440 - DNA, 15 bp, Homo sapiens
ttgtaccatattgct

SEQ ID NO: 1860441 - DNA, 17 bp, Homo sapiens
ttgtaccatattgctct

SEQ ID NO: 1860442 - DNA, 19 bp, Homo sapiens
ttgtagaataaatggtttc

SEQ ID NO: 1860443 - DNA, 13 bp, Homo sapiens
ttgtagccctgga

SEQ ID NO: 1860444 - DNA, 19 bp, Homo sapiens
ttgtaggggtcaaagaaat

SEQ ID NO: 1860445 - DNA, 21 bp, Homo sapiens
ttgtataaaaaggaaattagt

SEQ ID NO: 1860446 - DNA, 14 bp, Homo sapiens
ttgtataacttctt

SEQ ID NO: 1860447 - DNA, 14 bp, Homo sapiens
ttgtatagtgtaaa

SEQ ID NO: 1860448 - DNA, 16 bp, Homo sapiens
ttgtatagtgtaaaat

SEQ ID NO: 1860449 - DNA, 19 bp, Homo sapiens
ttgtatatatctgcttcag

SEQ ID NO: 1860450 - DNA, 15 bp, Homo sapiens
ttgtatatttgcaaa

SEQ ID NO: 1860451 - DNA, 19 bp, Homo sapiens
ttgtattaacaaagttact

SEQ ID NO: 1860452 - DNA, 15 bp, Homo sapiens
ttgtattataattgt

SEQ ID NO: 1860453 - DNA, 19 bp, Homo sapiens
ttgtcctgtgtctatgtac

SEQ ID NO: 1860454 - DNA, 13 bp, Homo sapiens
ttgtctaaacaag

SEQ ID NO: 1860455 - DNA, 16 bp, Homo sapiens
ttgtgaataatgattt

SEQ ID NO: 1860456 - DNA, 14 bp, Homo sapiens
ttgtgtaatctaag

SEQ ID NO: 1860457 - DNA, 21 bp, Homo sapiens
ttgtgtaatctaagtatatgt

SEQ ID NO: 1860458 - DNA, 22 bp, Homo sapiens
ttgtgtattgagtcttaactgt

SEQ ID NO: 1860459 - DNA, 17 bp, Homo sapiens
ttgtgttggctttacaa

SEQ ID NO: 1860460 - DNA, 17 bp, Homo sapiens
ttgtgttttaaaaaaac

SEQ ID NO: 1860461 - DNA, 13 bp, Homo sapiens
ttgttattttcag

SEQ ID NO: 1860462 - DNA, 13 bp, Homo sapiens
ttgtttaaatgcc

SEQ ID NO: 1860463 - DNA, 13 bp, Homo sapiens
ttgttttaaaagg

SEQ ID NO: 1860464 - DNA, 14 bp, Homo sapiens
ttgttttgttttaa

SEQ ID NO: 1860465 - DNA, 14 bp, Homo sapiens
tttaaaaaaactga

SEQ ID NO: 1860466 - DNA, 19 bp, Homo sapiens
tttaaaaaaactgaaggtt

SEQ ID NO: 1860467 - DNA, 18 bp, Homo sapiens
tttaaaaaactttctact

SEQ ID NO: 1860468 - DNA, 23 bp, Homo sapiens
tttaaaaaataccattgaaatca

SEQ ID NO: 1860469 - DNA, 22 bp, Homo sapiens
tttaaaaaattaaaaatgaaaa

SEQ ID NO: 1860470 - DNA, 23 bp, Homo sapiens
tttaaaaggtaggttttaaaaat

SEQ ID NO: 1860471 - DNA, 12 bp, Homo sapiens
tttaaaatgaag

SEQ ID NO: 1860472 - DNA, 20 bp, Homo sapiens
tttaaacaaaatagaagctg

SEQ ID NO: 1860473 - DNA, 16 bp, Homo sapiens
tttaaacaaaatttca

SEQ ID NO: 1860474 - DNA, 18 bp, Homo sapiens
tttaaagaaacactaaat

SEQ ID NO: 1860475 - DNA, 13 bp, Homo sapiens
tttaaagtaaact

SEQ ID NO: 1860476 - DNA, 18 bp, Homo sapiens
tttaaagtaaacttgtgt

SEQ ID NO: 1860477 - DNA, 12 bp, Homo sapiens
tttaaatgccaa

SEQ ID NO: 1860478 - DNA, 20 bp, Homo sapiens
tttaaattggtcatggtaga

SEQ ID NO: 1860479 - DNA, 23 bp, Homo sapiens
tttaacaatttcctttatattta

SEQ ID NO: 1860480 - DNA, 17 bp, Homo sapiens
tttaactacatctgcct

SEQ ID NO: 1860481 - DNA, 11 bp, Homo sapiens
tttaactatgc

SEQ ID NO: 1860482 - DNA, 20 bp, Homo sapiens
tttaagaaagggaaagctgt

SEQ ID NO: 1860483 - DNA, 22 bp, Homo sapiens
tttaaggagattgggagacaat

SEQ ID NO: 1860484 - DNA, 12 bp, Homo sapiens
tttaagtgacat

SEQ ID NO: 1860485 - DNA, 21 bp, Homo sapiens
tttaagtgacataattgtcca

SEQ ID NO: 1860486 - DNA, 14 bp, Homo sapiens
tttaagtgcaacat

SEQ ID NO: 1860487 - DNA, 16 bp, Homo sapiens
tttaagtgcaacattt

SEQ ID NO: 1860488 - DNA, 19 bp, Homo sapiens
tttaagtgcaacatttctg

SEQ ID NO: 1860489 - DNA, 23 bp, Homo sapiens
tttaagtgcaacatttctgtata

SEQ ID NO: 1860490 - DNA, 16 bp, Homo sapiens
tttaattaaaaacttt

SEQ ID NO: 1860491 - DNA, 20 bp, Homo sapiens
tttaatttataggcagatct

SEQ ID NO: 1860492 - DNA, 22 bp, Homo sapiens
tttaatttataggcagatcttt

SEQ ID NO: 1860493 - DNA, 14 bp, Homo sapiens
tttacaaataattt

SEQ ID NO: 1860494 - DNA, 21 bp, Homo sapiens
tttacaagtgtatatcagaaa

SEQ ID NO: 1860495 - DNA, 21 bp, Homo sapiens
tttacagaatgcattaaaaaa

SEQ ID NO: 1860496 - DNA, 18 bp, Homo sapiens
tttacagtgtatttaaga

SEQ ID NO: 1860497 - DNA, 22 bp, Homo sapiens
tttacagtttgtgttttaaaaa

SEQ ID NO: 1860498 - DNA, 18 bp, Homo sapiens
tttacccaaaaactaaat

SEQ ID NO: 1860499 - DNA, 20 bp, Homo sapiens
tttactaagccacaagaaat

SEQ ID NO: 1860500 - DNA, 21 bp, Homo sapiens
tttactaagccacaagaaatt

SEQ ID NO: 1860501 - DNA, 13 bp, Homo sapiens
tttactcttaaat

SEQ ID NO: 1860502 - DNA, 14 bp, Homo sapiens
tttagaaaatcaga

SEQ ID NO: 1860503 - DNA, 20 bp, Homo sapiens
tttagctacctttttatatt

SEQ ID NO: 1860504 - DNA, 21 bp, Homo sapiens
tttaggcatatgcttctttaa

SEQ ID NO: 1860505 - DNA, 15 bp, Homo sapiens
tttaggttgttacca

SEQ ID NO: 1860506 - DNA, 14 bp, Homo sapiens
tttagtaccctgca

SEQ ID NO: 1860507 - DNA, 16 bp, Homo sapiens
tttagtaccctgcagg

SEQ ID NO: 1860508 - DNA, 14 bp, Homo sapiens
tttagttatagttt

SEQ ID NO: 1860509 - DNA, 15 bp, Homo sapiens
tttagttatagtttc

SEQ ID NO: 1860510 - DNA, 13 bp, Homo sapiens
tttatacataaac

SEQ ID NO: 1860511 - DNA, 21 bp, Homo sapiens
tttataggcagatctttaaat

SEQ ID NO: 1860512 - DNA, 14 bp, Homo sapiens
tttatagttaatct

SEQ ID NO: 1860513 - DNA, 16 bp, Homo sapiens
tttatagttaatctat

SEQ ID NO: 1860514 - DNA, 17 bp, Homo sapiens
tttatagtttgtacatg

SEQ ID NO: 1860515 - DNA, 19 bp, Homo sapiens
tttatagtttgtacatgca

SEQ ID NO: 1860516 - DNA, 21 bp, Homo sapiens
tttatatattgaaagttgctt

SEQ ID NO: 1860517 - DNA, 13 bp, Homo sapiens
tttatatccattt

SEQ ID NO: 1860518 - DNA, 23 bp, Homo sapiens
tttatatctttatgcaaaaacat

SEQ ID NO: 1860519 - DNA, 17 bp, Homo sapiens
tttatgcaaaaacatat

SEQ ID NO: 1860520 - DNA, 14 bp, Homo sapiens
tttattaaaatgat

SEQ ID NO: 1860521 - DNA, 21 bp, Homo sapiens
tttattaaaatgattgtaaaa

SEQ ID NO: 1860522 - DNA, 17 bp, Homo sapiens
tttattcaagttattgt

SEQ ID NO: 1860523 - DNA, 13 bp, Homo sapiens
tttcaaaagacac

SEQ ID NO: 1860524 - DNA, 21 bp, Homo sapiens
tttcacagatggaagaagttt

SEQ ID NO: 1860525 - DNA, 16 bp, Homo sapiens
tttcaggaccttttga

SEQ ID NO: 1860526 - DNA, 20 bp, Homo sapiens
tttcatagatttgaaaaact

SEQ ID NO: 1860527 - DNA, 14 bp, Homo sapiens
tttcatgtatgtat

SEQ ID NO: 1860528 - DNA, 20 bp, Homo sapiens
tggccatatatgctgtattt

SEQ ID NO: 1860529 - DNA, 13 bp, Homo sapiens
tggcctctggggc

SEQ ID NO: 1860530 - DNA, 12 bp, Homo sapiens
tggcctgtgagc

SEQ ID NO: 1860531 - DNA, 20 bp, Homo sapiens
tggcctgtgagcaagagcca

SEQ ID NO: 1860532 - DNA, 21 bp, Homo sapiens
tggcctgtgagcaagagccag

SEQ ID NO: 1860533 - DNA, 21 bp, Homo sapiens
tggctatctatacctgccttt

SEQ ID NO: 1860534 - DNA, 19 bp, Homo sapiens
tggctggatgaaattttct

SEQ ID NO: 1860535 - DNA, 20 bp, Homo sapiens
tggcttacttacaaaagcag

SEQ ID NO: 1860536 - DNA, 10 bp, Homo sapiens
tggcttccct

SEQ ID NO: 1860537 - DNA, 15 bp, Homo sapiens
tggcttccctgccca

SEQ ID NO: 1860538 - DNA, 18 bp, Homo sapiens
tggcttcttaaaaactgt

SEQ ID NO: 1860539 - DNA, 21 bp, Homo sapiens
tggcttcttaaaaactgtgta

SEQ ID NO: 1860540 - DNA, 23 bp, Homo sapiens
tggcttcttaaaaactgtgtatc

SEQ ID NO: 1860541 - DNA, 12 bp, Homo sapiens
tggcttgctgtt

SEQ ID NO: 1860542 - DNA, 13 bp, Homo sapiens
tggctttacaaat

SEQ ID NO: 1860543 - DNA, 14 bp, Homo sapiens
tgggaaccaagggc

SEQ ID NO: 1860544 - DNA, 18 bp, Homo sapiens
tgggaaccaagggccctc

SEQ ID NO: 1860545 - DNA, 21 bp, Homo sapiens
tgggagacaattagcagaatg

SEQ ID NO: 1860546 - DNA, 22 bp, Homo sapiens
tgggagacaattagcagaatgg

SEQ ID NO: 1860547 - DNA, 18 bp, Homo sapiens
tgggcaactcgtgacagc

SEQ ID NO: 1860548 - DNA, 11 bp, Homo sapiens
tgggccctggg

SEQ ID NO: 1860549 - DNA, 13 bp, Homo sapiens
tgggccctggggc

SEQ ID NO: 1860550 - DNA, 20 bp, Homo sapiens
tgggccctggggctgccctc

SEQ ID NO: 1860551 - DNA, 20 bp, Homo sapiens
tgggccgggcccagggcctc

SEQ ID NO: 1860552 - DNA, 21 bp, Homo sapiens
tgggccgggcccagggcctct

SEQ ID NO: 1860553 - DNA, 22 bp, Homo sapiens
tgggccgggcccagggcctctg

SEQ ID NO: 1860554 - DNA, 23 bp, Homo sapiens
tgggccgggcccagggcctctgg

SEQ ID NO: 1860555 - DNA, 18 bp, Homo sapiens
tgggcgcttcccacctgc

SEQ ID NO: 1860556 - DNA, 21 bp, Homo sapiens
tggggaggccatttgctgccc

SEQ ID NO: 1860557 - DNA, 18 bp, Homo sapiens
tggggattcagatttctc

SEQ ID NO: 1860558 - DNA, 19 bp, Homo sapiens
tggggcagagcttgtagcc

SEQ ID NO: 1860559 - DNA, 14 bp, Homo sapiens
tggggctgccctcg

SEQ ID NO: 1860560 - DNA, 13 bp, Homo sapiens
tgggtaagaaagc

SEQ ID NO: 1860561 - DNA, 20 bp, Homo sapiens
tgggtggcttaaaaaaaact

SEQ ID NO: 1860562 - DNA, 14 bp, Homo sapiens
tggtaaatttttga

SEQ ID NO: 1860563 - DNA, 18 bp, Homo sapiens
tggtaagtgaatttatga

SEQ ID NO: 1860564 - DNA, 17 bp, Homo sapiens
tggtagatttttttcat

SEQ ID NO: 1860565 - DNA, 19 bp, Homo sapiens
tggtagggtataatgtgtc

SEQ ID NO: 1860566 - DNA, 22 bp, Homo sapiens
tggtcatggtagatttttttca

SEQ ID NO: 1860567 - DNA, 17 bp, Homo sapiens
tggtcgagtctttgtgt

SEQ ID NO: 1860568 - DNA, 18 bp, Homo sapiens
tggtcgagtctttgtgtg

SEQ ID NO: 1860569 - DNA, 21 bp, Homo sapiens
tggtgaccaaaatttttaggt

SEQ ID NO: 1860570 - DNA, 13 bp, Homo sapiens
tggtgggttgatg

SEQ ID NO: 1860571 - DNA, 14 bp, Homo sapiens
tggttctataataa

SEQ ID NO: 1860572 - DNA, 18 bp, Homo sapiens
tggttgccttaaagaaag

SEQ ID NO: 1860573 - DNA, 15 bp, Homo sapiens
tggtttgcacataaa

SEQ ID NO: 1860574 - DNA, 16 bp, Homo sapiens
tggtttgtttgcttaa

SEQ ID NO: 1860575 - DNA, 22 bp, Homo sapiens
tggtttgtttgcttaatttcct

SEQ ID NO: 1860576 - DNA, 18 bp, Homo sapiens
tggttttaacaatttcct

SEQ ID NO: 1860577 - DNA, 20 bp, Homo sapiens
tgtaaacaggagacaggaag

SEQ ID NO: 1860578 - DNA, 22 bp, Homo sapiens
tgtaaactcaaaacttaacata

SEQ ID NO: 1860579 - DNA, 16 bp, Homo sapiens
tgtaaaggtcactttt

SEQ ID NO: 1860580 - DNA, 21 bp, Homo sapiens
tgtaaaggtcacttttcacat

SEQ ID NO: 1860581 - DNA, 21 bp, Homo sapiens
tgtaaatgaacacatggcaga

SEQ ID NO: 1860582 - DNA, 16 bp, Homo sapiens
tgtaaatgagacacat

SEQ ID NO: 1860583 - DNA, 17 bp, Homo sapiens
tgtaagcagattacaat

SEQ ID NO: 1860584 - DNA, 23 bp, Homo sapiens
tgtaataaacccttaactggcat

SEQ ID NO: 1860585 - DNA, 16 bp, Homo sapiens
tgtaatagaaaactga

SEQ ID NO: 1860586 - DNA, 18 bp, Homo sapiens
tgtaatagaaaactgaaa

SEQ ID NO: 1860587 - DNA, 15 bp, Homo sapiens
tgtaattaaactagt

SEQ ID NO: 1860588 - DNA, 12 bp, Homo sapiens
tgtaatttgaat

SEQ ID NO: 1860589 - DNA, 14 bp, Homo sapiens
tgtaatttgaattg

SEQ ID NO: 1860590 - DNA, 13 bp, Homo sapiens
tgtacattactgt

SEQ ID NO: 1860591 - DNA, 13 bp, Homo sapiens
tgtacttaaatga

SEQ ID NO: 1860592 - DNA, 21 bp, Homo sapiens
tgtacttaaatgagttactta

SEQ ID NO: 1860593 - DNA, 22 bp, Homo sapiens
tgtacttaaatgagttacttag

SEQ ID NO: 1860594 - DNA, 17 bp, Homo sapiens
tgtactttttgttttgt

SEQ ID NO: 1860595 - DNA, 14 bp, Homo sapiens
tgtagaataaatgg

SEQ ID NO: 1860596 - DNA, 15 bp, Homo sapiens
tgtagaataaatggt

SEQ ID NO: 1860597 - DNA, 22 bp, Homo sapiens
tgtagaataaatggtttctcat

SEQ ID NO: 1860598 - DNA, 13 bp, Homo sapiens
tgtagccctggat

SEQ ID NO: 1860599 - DNA, 22 bp, Homo sapiens
tgtaggcacttttattttcatt

SEQ ID NO: 1860600 - DNA, 18 bp, Homo sapiens
tgtagtagccctttctgt

SEQ ID NO: 1860601 - DNA, 18 bp, Homo sapiens
tgtataaaaaggaaatta

SEQ ID NO: 1860602 - DNA, 21 bp, Homo sapiens
tgtataacttcttaaaagttg

SEQ ID NO: 1860603 - DNA, 17 bp, Homo sapiens
tgtatactgtaaaagtt

SEQ ID NO: 1860604 - DNA, 18 bp, Homo sapiens
tgtatactgtaaaagtta

SEQ ID NO: 1860605 - DNA, 24 bp, Homo sapiens
tgtatagtgtaaaataagaatgat

SEQ ID NO: 1860606 - DNA, 21 bp, Homo sapiens
tgtatataatcatgctcatgt

SEQ ID NO: 1860607 - DNA, 23 bp, Homo sapiens
tgtatataatcatgctcatgtat

SEQ ID NO: 1860608 - DNA, 12 bp, Homo sapiens
tgtatcattaaa

SEQ ID NO: 1860609 - DNA, 14 bp, Homo sapiens
tgtatgtataaatt

SEQ ID NO: 1860610 - DNA, 22 bp, Homo sapiens
tgtattaacaaagttactggct

SEQ ID NO: 1860611 - DNA, 19 bp, Homo sapiens
tgtattgagtcttaactgt

SEQ ID NO: 1860612 - DNA, 20 bp, Homo sapiens
tgtattgagtcttaactgta

SEQ ID NO: 1860613 - DNA, 14 bp, Homo sapiens
tgtattgcttcctg

SEQ ID NO: 1860614 - DNA, 12 bp, Homo sapiens
tgtcaaatgaac

SEQ ID NO: 1860615 - DNA, 15 bp, Homo sapiens
tgtcaaatgaacttt

SEQ ID NO: 1860616 - DNA, 17 bp, Homo sapiens
tgtccagagggactgga

SEQ ID NO: 1860617 - DNA, 20 bp, Homo sapiens
tgtccagagggactggacag

SEQ ID NO: 1860618 - DNA, 21 bp, Homo sapiens
tgtcctgcatgcataatgaac

SEQ ID NO: 1860619 - DNA, 17 bp, Homo sapiens
tgtcctgtgtctatgta

SEQ ID NO: 1860620 - DNA, 12 bp, Homo sapiens
tgtctgcagctc

SEQ ID NO: 1860621 - DNA, 13 bp, Homo sapiens
tgtctgcagctcc

SEQ ID NO: 1860622 - DNA, 16 bp, Homo sapiens
tgtctgcagctcctgg

SEQ ID NO: 1860623 - DNA, 14 bp, Homo sapiens
tgtctgtctttgca

SEQ ID NO: 1860624 - DNA, 16 bp, Homo sapiens
tgtctgtctttgcaaa

SEQ ID NO: 1860625 - DNA, 14 bp, Homo sapiens
tgtctgtgttgctt

SEQ ID NO: 1860626 - DNA, 16 bp, Homo sapiens
tgtcttctcccagagc

SEQ ID NO: 1860627 - DNA, 14 bp, Homo sapiens
tgtctttgcaaagg

SEQ ID NO: 1860628 - DNA, 17 bp, Homo sapiens
tgtctttgcaaaggact

SEQ ID NO: 1860629 - DNA, 13 bp, Homo sapiens
tgtgactttgaaa

SEQ ID NO: 1860630 - DNA, 20 bp, Homo sapiens
tgtgactttgaaaatatata

SEQ ID NO: 1860631 - DNA, 13 bp, Homo sapiens
tgtgagaagatgg

SEQ ID NO: 1860632 - DNA, 21 bp, Homo sapiens
tgtgcaccttaccaactttct

SEQ ID NO: 1860633 - DNA, 20 bp, Homo sapiens
tgtgcagtgaaggttgctga

SEQ ID NO: 1860634 - DNA, 18 bp, Homo sapiens
tgtgccatagagtttaac

SEQ ID NO: 1860635 - DNA, 18 bp, Homo sapiens
tgtgttttaaaaaaactg

SEQ ID NO: 1860636 - DNA, 19 bp, Homo sapiens
tgtgttttaaaaaaactga

SEQ ID NO: 1860637 - DNA, 13 bp, Homo sapiens
tgttaagaaagga

SEQ ID NO: 1860638 - DNA, 14 bp, Homo sapiens
tgttaagaaaggat

SEQ ID NO: 1860639 - DNA, 20 bp, Homo sapiens
tgttaagaaaggatataaaa

SEQ ID NO: 1860640 - DNA, 20 bp, Homo sapiens
tgttacaaattttttaattt

SEQ ID NO: 1860641 - DNA, 15 bp, Homo sapiens
tgttacaagtttgct

SEQ ID NO: 1860642 - DNA, 22 bp, Homo sapiens
tgttacaagtttgctaaaagaa

SEQ ID NO: 1860643 - DNA, 14 bp, Homo sapiens
tgttacattattcc

SEQ ID NO: 1860644 - DNA, 16 bp, Homo sapiens
tgttatagattgtctt

SEQ ID NO: 1860645 - DNA, 18 bp, Homo sapiens
tgttatagattgtcttaa

SEQ ID NO: 1860646 - DNA, 17 bp, Homo sapiens
tgttatattccaaggaa

SEQ ID NO: 1860647 - DNA, 15 bp, Homo sapiens
tgttatgaaaatcct

SEQ ID NO: 1860648 - DNA, 21 bp, Homo sapiens
tgttattaatgtttcttctcc

SEQ ID NO: 1860649 - DNA, 14 bp, Homo sapiens
tgttattttcagta

SEQ ID NO: 1860650 - DNA, 15 bp, Homo sapiens
tgttcactaaactct

SEQ ID NO: 1860651 - DNA, 19 bp, Homo sapiens
tgttgaatgcctgtcccag

SEQ ID NO: 1860652 - DNA, 20 bp, Homo sapiens
tgttgttttgttttaaatac

SEQ ID NO: 1860653 - DNA, 14 bp, Homo sapiens
tgtttaagatgggc

SEQ ID NO: 1860654 - DNA, 20 bp, Homo sapiens
tgtttagctacctttttata

SEQ ID NO: 1860655 - DNA, 12 bp, Homo sapiens
tgtttcttctcc

SEQ ID NO: 1860656 - DNA, 17 bp, Homo sapiens
tgtttgtacaagattgt

SEQ ID NO: 1860657 - DNA, 17 bp, Homo sapiens
tgtttgtatatttgcaa

SEQ ID NO: 1860658 - DNA, 12 bp, Homo sapiens
tgttttaaaaaa

SEQ ID NO: 1860659 - DNA, 15 bp, Homo sapiens
tgttttaaaaaaact

SEQ ID NO: 1860660 - DNA, 18 bp, Homo sapiens
tgttttaaaaaaactgaa

SEQ ID NO: 1860661 - DNA, 19 bp, Homo sapiens
tgttttaaaaaaactgaag

SEQ ID NO: 1860662 - DNA, 21 bp, Homo sapiens
ttaaaaaaaactctttaactt

SEQ ID NO: 1860663 - DNA, 12 bp, Homo sapiens
ttaaaaaaacac

SEQ ID NO: 1860664 - DNA, 21 bp, Homo sapiens
ttaaaaaatattttaagaaag

SEQ ID NO: 1860665 - DNA, 23 bp, Homo sapiens
ttaaaaaatattttaagaaagag

SEQ ID NO: 1860666 - DNA, 15 bp, Homo sapiens
ttaaaaaattaaaaa

SEQ ID NO: 1860667 - DNA, 15 bp, Homo sapiens
ttaaaaactgtgtat

SEQ ID NO: 1860668 - DNA, 22 bp, Homo sapiens
ttaaaaactgtgtatcattaaa

SEQ ID NO: 1860669 - DNA, 16 bp, Homo sapiens
ttaaaaactttaaaga

SEQ ID NO: 1860670 - DNA, 22 bp, Homo sapiens
ttaaaaatatggaacttctaat

SEQ ID NO: 1860671 - DNA, 23 bp, Homo sapiens
ttaaaaatatggaacttctaata

SEQ ID NO: 1860672 - DNA, 16 bp, Homo sapiens
ttaaaaatgaaaatta

SEQ ID NO: 1860673 - DNA, 12 bp, Homo sapiens
ttaaaactgagt

SEQ ID NO: 1860674 - DNA, 23 bp, Homo sapiens
ttaaaactgagtccatgaaaata

SEQ ID NO: 1860675 - DNA, 18 bp, Homo sapiens
ttaaaatatatgttctgc

SEQ ID NO: 1860676 - DNA, 20 bp, Homo sapiens
ttaaaatatatgttctgcaa

SEQ ID NO: 1860677 - DNA, 16 bp, Homo sapiens
ttaaaatgaagcaatt

SEQ ID NO: 1860678 - DNA, 20 bp, Homo sapiens
ttaaacaaaatagaagctgt

SEQ ID NO: 1860679 - DNA, 17 bp, Homo sapiens
ttaaacaaaatttcaca

SEQ ID NO: 1860680 - DNA, 18 bp, Homo sapiens
ttaaacagcaaagccata

SEQ ID NO: 1860681 - DNA, 22 bp, Homo sapiens
ttaaacagcaaagccatattct

SEQ ID NO: 1860682 - DNA, 14 bp, Homo sapiens
ttaaactagtttaa

SEQ ID NO: 1860683 - DNA, 17 bp, Homo sapiens
ttaaagaaacactaaat

SEQ ID NO: 1860684 - DNA, 22 bp, Homo sapiens
ttaaagataagtctacattaaa

SEQ ID NO: 1860685 - DNA, 14 bp, Homo sapiens
ttaaagccttaagc

SEQ ID NO: 1860686 - DNA, 21 bp, Homo sapiens
ttaaagccttaagcacaatta

SEQ ID NO: 1860687 - DNA, 19 bp, Homo sapiens
ttaaagtaaacttgtgtat

SEQ ID NO: 1860688 - DNA, 20 bp, Homo sapiens
ttaaagtaaacttgtgtatt

SEQ ID NO: 1860689 - DNA, 21 bp, Homo sapiens
ttaaatgagggtttctgatct

SEQ ID NO: 1860690 - DNA, 18 bp, Homo sapiens
ttaaatgccaaaatgtac

SEQ ID NO: 1860691 - DNA, 21 bp, Homo sapiens
ttaaatgccaaaatgtactta

SEQ ID NO: 1860692 - DNA, 17 bp, Homo sapiens
ttaacaaagcaaccttt

SEQ ID NO: 1860693 - DNA, 15 bp, Homo sapiens
ttaacaaagttactg

SEQ ID NO: 1860694 - DNA, 16 bp, Homo sapiens
ttaacacaagtcctgt

SEQ ID NO: 1860695 - DNA, 17 bp, Homo sapiens
ttaacatatttactaag

SEQ ID NO: 1860696 - DNA, 14 bp, Homo sapiens
ttaactaaatgctc

SEQ ID NO: 1860697 - DNA, 11 bp, Homo sapiens
ttaagaaagag

SEQ ID NO: 1860698 - DNA, 12 bp, Homo sapiens
ttaagaaagaga

SEQ ID NO: 1860699 - DNA, 23 bp, Homo sapiens
ttaagaaagagaatgaactgtgg

SEQ ID NO: 1860700 - DNA, 20 bp, Homo sapiens
ttaagaaaggatataaaagg

SEQ ID NO: 1860701 - DNA, 16 bp, Homo sapiens
ttaagaaagggaaagc

SEQ ID NO: 1860702 - DNA, 19 bp, Homo sapiens
ttaagggtggaaaaatgcc

SEQ ID NO: 1860703 - DNA, 20 bp, Homo sapiens
ttaataaaaaaacaatcatt

SEQ ID NO: 1860704 - DNA, 22 bp, Homo sapiens
ttaataatagattgtgaataat

SEQ ID NO: 1860705 - DNA, 22 bp, Homo sapiens
ttaataggatgaatgggaaagt

SEQ ID NO: 1860706 - DNA, 15 bp, Homo sapiens
ttaatattcttttgt

SEQ ID NO: 1860707 - DNA, 16 bp, Homo sapiens
ttaatattcttttgtt

SEQ ID NO: 1860708 - DNA, 13 bp, Homo sapiens
ttaatcttttaaa

SEQ ID NO: 1860709 - DNA, 18 bp, Homo sapiens
ttaatggaaacatgctgt

SEQ ID NO: 1860710 - DNA, 20 bp, Homo sapiens
ttaatggactgtgaatttca

SEQ ID NO: 1860711 - DNA, 13 bp, Homo sapiens
ttaattaaaaact

SEQ ID NO: 1860712 - DNA, 23 bp, Homo sapiens
ttaattaaaaactttaaagataa

SEQ ID NO: 1860713 - DNA, 19 bp, Homo sapiens
ttaattcattaatctgttt

SEQ ID NO: 1860714 - DNA, 13 bp, Homo sapiens
ttaggttgttacc

SEQ ID NO: 1860715 - DNA, 13 bp, Homo sapiens
ttagtaccctgca

SEQ ID NO: 1860716 - DNA, 14 bp, Homo sapiens
ttagtaccctgcag

SEQ ID NO: 1860717 - DNA, 18 bp, Homo sapiens
ttagtaccctgcaggcca

SEQ ID NO: 1860718 - DNA, 19 bp, Homo sapiens
ttagtatagtagaaagaca

SEQ ID NO: 1860719 - DNA, 20 bp, Homo sapiens
ttagtatagtagaaagacat

SEQ ID NO: 1860720 - DNA, 20 bp, Homo sapiens
ttagttacgtataatgcttt

SEQ ID NO: 1860721 - DNA, 16 bp, Homo sapiens
ttagttcttgaattgt

SEQ ID NO: 1860722 - DNA, 19 bp, Homo sapiens
ttagttcttgaattgttat

SEQ ID NO: 1860723 - DNA, 17 bp, Homo sapiens
ttataataactgaactg

SEQ ID NO: 1860724 - DNA, 19 bp, Homo sapiens
ttataataactgaactgtt

SEQ ID NO: 1860725 - DNA, 14 bp, Homo sapiens
ttatacataaacag

SEQ ID NO: 1860726 - DNA, 19 bp, Homo sapiens
ttatagagggccaagactt

SEQ ID NO: 1860727 - DNA, 15 bp, Homo sapiens
ttatagattgtctta

SEQ ID NO: 1860728 - DNA, 17 bp, Homo sapiens
ttatagattgtcttaat

SEQ ID NO: 1860729 - DNA, 17 bp, Homo sapiens
ttatagctattactgtc

SEQ ID NO: 1860730 - DNA, 23 bp, Homo sapiens
ttatatattgaaagttgctttta

SEQ ID NO: 1860731 - DNA, 13 bp, Homo sapiens
ttatattccaagg

SEQ ID NO: 1860732 - DNA, 15 bp, Homo sapiens
ttatattccaaggaa

SEQ ID NO: 1860733 - DNA, 17 bp, Homo sapiens
ttatatttagttatagt

SEQ ID NO: 1860734 - DNA, 18 bp, Homo sapiens
ttatatttagttatagtt

SEQ ID NO: 1860735 - DNA, 17 bp, Homo sapiens
ttatcatttttgtataa

SEQ ID NO: 1860736 - DNA, 14 bp, Homo sapiens
tcacaaacatatgt

SEQ ID NO: 1860737 - DNA, 23 bp, Homo sapiens
tcacaaattccgattagaccttt

SEQ ID NO: 1860738 - DNA, 14 bp, Homo sapiens
tcacagttctgtaa

SEQ ID NO: 1860739 - DNA, 22 bp, Homo sapiens
tcacagttggctggatgaaatt

SEQ ID NO: 1860740 - DNA, 19 bp, Homo sapiens
tcacatccttgacttttta

SEQ ID NO: 1860741 - DNA, 21 bp, Homo sapiens
tcacatccttgactttttaga

SEQ ID NO: 1860742 - DNA, 22 bp, Homo sapiens
tcacatctaaagctttatcttt

SEQ ID NO: 1860743 - DNA, 22 bp, Homo sapiens
tcaccacgatgacgcctctgga

SEQ ID NO: 1860744 - DNA, 16 bp, Homo sapiens
tcaccatgcaggcaac

SEQ ID NO: 1860745 - DNA, 16 bp, Homo sapiens
tcacccccccaggcct

SEQ ID NO: 1860746 - DNA, 21 bp, Homo sapiens
tcacccccccaggcctccaga

SEQ ID NO: 1860747 - DNA, 16 bp, Homo sapiens
tcacctacaggactgg

SEQ ID NO: 1860748 - DNA, 20 bp, Homo sapiens
tcacctacaggactgggccg

SEQ ID NO: 1860749 - DNA, 12 bp, Homo sapiens
tcacctcctgct

SEQ ID NO: 1860750 - DNA, 15 bp, Homo sapiens
tcacctcctgctcct

SEQ ID NO: 1860751 - DNA, 13 bp, Homo sapiens
tcaccttgcattt

SEQ ID NO: 1860752 - DNA, 22 bp, Homo sapiens
tcactcaggaaccctggagaca

SEQ ID NO: 1860753 - DNA, 23 bp, Homo sapiens
tcactcaggaaccctggagacag

SEQ ID NO: 1860754 - DNA, 19 bp, Homo sapiens
tcactcatgcaaactgctt

SEQ ID NO: 1860755 - DNA, 21 bp, Homo sapiens
tcactcatgcaaactgcttta

SEQ ID NO: 1860756 - DNA, 23 bp, Homo sapiens
tcactcatgcaaactgctttatt

SEQ ID NO: 1860757 - DNA, 16 bp, Homo sapiens
tcacttaaccacccca

SEQ ID NO: 1860758 - DNA, 14 bp, Homo sapiens
tcacttttcagtga

SEQ ID NO: 1860759 - DNA, 16 bp, Homo sapiens
tcacttttcagtgatg

SEQ ID NO: 1860760 - DNA, 21 bp, Homo sapiens
tcagacatccatgtttgtaaa

SEQ ID NO: 1860761 - DNA, 17 bp, Homo sapiens
tcagacttagtttttat

SEQ ID NO: 1860762 - DNA, 16 bp, Homo sapiens
tcagacttgcggccac

SEQ ID NO: 1860763 - DNA, 19 bp, Homo sapiens
tcagacttgcggccacagc

SEQ ID NO: 1860764 - DNA, 20 bp, Homo sapiens
tcagagaaattatgttttca

SEQ ID NO: 1860765 - DNA, 19 bp, Homo sapiens
tcagatttctctttgaaac

SEQ ID NO: 1860766 - DNA, 14 bp, Homo sapiens
tcagattttctcct

SEQ ID NO: 1860767 - DNA, 18 bp, Homo sapiens
tcagcatgacaaaaataa

SEQ ID NO: 1860768 - DNA, 22 bp, Homo sapiens
tcagcatgacaaaaataacact

SEQ ID NO: 1860769 - DNA, 14 bp, Homo sapiens
tcagccattcctgt

SEQ ID NO: 1860770 - DNA, 14 bp, Homo sapiens
tcagctactgattt

SEQ ID NO: 1860771 - DNA, 19 bp, Homo sapiens
tcagctactgatttttgtg

SEQ ID NO: 1860772 - DNA, 21 bp, Homo sapiens
tcagctattcccttctgatct

SEQ ID NO: 1860773 - DNA, 13 bp, Homo sapiens
tcagctttttgta

SEQ ID NO: 1860774 - DNA, 20 bp, Homo sapiens
tcaggaattgcccattgttt

SEQ ID NO: 1860775 - DNA, 17 bp, Homo sapiens
tcaggatttcctcttga

SEQ ID NO: 1860776 - DNA, 18 bp, Homo sapiens
tcaggatttcctcttgaa

SEQ ID NO: 1860777 - DNA, 20 bp, Homo sapiens
tcagtatcttagagtttaca

SEQ ID NO: 1860778 - DNA, 20 bp, Homo sapiens
tcagtattcccagccttgag

SEQ ID NO: 1860779 - DNA, 13 bp, Homo sapiens
tcagtattttcca

SEQ ID NO: 1860780 - DNA, 14 bp, Homo sapiens
tcagtattttccag

SEQ ID NO: 1860781 - DNA, 14 bp, Homo sapiens
tcagtctgaatggc

SEQ ID NO: 1860782 - DNA, 13 bp, Homo sapiens
tcatacacagtta

SEQ ID NO: 1860783 - DNA, 17 bp, Homo sapiens
tcatacacagttaaata

SEQ ID NO: 1860784 - DNA, 20 bp, Homo sapiens
tcatactcctatgctttagc

SEQ ID NO: 1860785 - DNA, 19 bp, Homo sapiens
tcatagatttgaaaaactt

SEQ ID NO: 1860786 - DNA, 20 bp, Homo sapiens
tcataggttgccaataatac

SEQ ID NO: 1860787 - DNA, 16 bp, Homo sapiens
tcatataatttaaaga

SEQ ID NO: 1860788 - DNA, 21 bp, Homo sapiens
tcatattgctaccaaaaacta

SEQ ID NO: 1860789 - DNA, 15 bp, Homo sapiens
tcatattttgtatat

SEQ ID NO: 1860790 - DNA, 19 bp, Homo sapiens
tcatcagacttgcggccac

SEQ ID NO: 1860791 - DNA, 22 bp, Homo sapiens
tcatcaggtttactcagtgaaa

SEQ ID NO: 1860792 - DNA, 16 bp, Homo sapiens
tcatcatcagacttgc

SEQ ID NO: 1860793 - DNA, 19 bp, Homo sapiens
tcatgacatgttatatatt

SEQ ID NO: 1860794 - DNA, 19 bp, Homo sapiens
tcatgcccactcccccagg

SEQ ID NO: 1860795 - DNA, 17 bp, Homo sapiens
tcatggagcagccccca

SEQ ID NO: 1860796 - DNA, 14 bp, Homo sapiens
tcatggtagatttt

SEQ ID NO: 1860797 - DNA, 19 bp, Homo sapiens
tcatggtagatttttttca

SEQ ID NO: 1860798 - DNA, 22 bp, Homo sapiens
tcattaaaatatatgttctgca

SEQ ID NO: 1860799 - DNA, 13 bp, Homo sapiens
tcattaaactcta

SEQ ID NO: 1860800 - DNA, 17 bp, Homo sapiens
tcattccaacagtgagt

SEQ ID NO: 1860801 - DNA, 23 bp, Homo sapiens
tcattgtgtatgagactgtgttt

SEQ ID NO: 1860802 - DNA, 21 bp, Homo sapiens
tcatttacaagacaacattgt

SEQ ID NO: 1860803 - DNA, 10 bp, Homo sapiens
tcatttctaa

SEQ ID NO: 1860804 - DNA, 21 bp, Homo sapiens
tcatttggcttgctgtttact

SEQ ID NO: 1860805 - DNA, 15 bp, Homo sapiens
tcatttttgtataaa

SEQ ID NO: 1860806 - DNA, 19 bp, Homo sapiens
tcatttttgtataaaaagg

SEQ ID NO: 1860807 - DNA, 13 bp, Homo sapiens
tcattttttctta

SEQ ID NO: 1860808 - DNA, 20 bp, Homo sapiens
tccaaaccagtttattctgt

SEQ ID NO: 1860809 - DNA, 22 bp, Homo sapiens
tccaaaccagtttattctgtgg

SEQ ID NO: 1860810 - DNA, 12 bp, Homo sapiens
tccaaattatta

SEQ ID NO: 1860811 - DNA, 21 bp, Homo sapiens
tccaaattattaattgtcctg

SEQ ID NO: 1860812 - DNA, 22 bp, Homo sapiens
tccaaattattaattgtcctgt

SEQ ID NO: 1860813 - DNA, 23 bp, Homo sapiens
tccaaattattaattgtcctgtg

SEQ ID NO: 1860814 - DNA, 15 bp, Homo sapiens
tccaaggaaaattga

SEQ ID NO: 1860815 - DNA, 16 bp, Homo sapiens
tccaaggaaaattgaa

SEQ ID NO: 1860816 - DNA, 19 bp, Homo sapiens
tccaaggaaaattgaaagt

SEQ ID NO: 1860817 - DNA, 13 bp, Homo sapiens
tccaaggctgtct

SEQ ID NO: 1860818 - DNA, 20 bp, Homo sapiens
tccaaggctgtcttctccca

SEQ ID NO: 1860819 - DNA, 21 bp, Homo sapiens
tccaatgatacccaacagttt

SEQ ID NO: 1860820 - DNA, 15 bp, Homo sapiens
tccacggtcttctgc

SEQ ID NO: 1860821 - DNA, 15 bp, Homo sapiens
tccagaaccttactg

SEQ ID NO: 1860822 - DNA, 19 bp, Homo sapiens
tccagagggactggacagc

SEQ ID NO: 1860823 - DNA, 22 bp, Homo sapiens
tccaggagattggatttgctgt

SEQ ID NO: 1860824 - DNA, 17 bp, Homo sapiens
tccaggtaactttgctt

SEQ ID NO: 1860825 - DNA, 19 bp, Homo sapiens
tccagtattcttgtcaaaa

SEQ ID NO: 1860826 - DNA, 12 bp, Homo sapiens
tccagtgacttt

SEQ ID NO: 1860827 - DNA, 12 bp, Homo sapiens
tccatgaaaata

SEQ ID NO: 1860828 - DNA, 13 bp, Homo sapiens
tccatgtttgtaa

SEQ ID NO: 1860829 - DNA, 15 bp, Homo sapiens
tcccagcctctgggg

SEQ ID NO: 1860830 - DNA, 19 bp, Homo sapiens
tcccaggtaatttaaattg

SEQ ID NO: 1860831 - DNA, 10 bp, Homo sapiens
tcccagtccc

SEQ ID NO: 1860832 - DNA, 15 bp, Homo sapiens
tcccagtcccagcct

SEQ ID NO: 1860833 - DNA, 13 bp, Homo sapiens
tccccaaaagaaa

SEQ ID NO: 1860834 - DNA, 22 bp, Homo sapiens
tccccaaaagaaaccatgacaa

SEQ ID NO: 1860835 - DNA, 17 bp, Homo sapiens
tccccaatccatgcttc

SEQ ID NO: 1860836 - DNA, 19 bp, Homo sapiens
tccccaatccatgcttcac

SEQ ID NO: 1860837 - DNA, 14 bp, Homo sapiens
tcccccaggagcag

SEQ ID NO: 1860838 - DNA, 23 bp, Homo sapiens
tcccccaggagcagctggcactg

SEQ ID NO: 1860839 - DNA, 11 bp, Homo sapiens
tccccctgcag

SEQ ID NO: 1860840 - DNA, 14 bp, Homo sapiens
tccccctgcagccg

SEQ ID NO: 1860841 - DNA, 17 bp, Homo sapiens
tccccctgcagccgtgc

SEQ ID NO: 1860842 - DNA, 16 bp, Homo sapiens
tcccctaatcttttct

SEQ ID NO: 1860843 - DNA, 15 bp, Homo sapiens
tcccgcttagttctt

SEQ ID NO: 1860844 - DNA, 21 bp, Homo sapiens
tccctgcccaatcctccctgg

SEQ ID NO: 1860845 - DNA, 21 bp, Homo sapiens
tccctggagaagggacatggg

SEQ ID NO: 1860846 - DNA, 15 bp, Homo sapiens
tcccttctcctgccc

SEQ ID NO: 1860847 - DNA, 19 bp, Homo sapiens
tcccttctgtagtttttaa

SEQ ID NO: 1860848 - DNA, 13 bp, Homo sapiens
tcccttttcctct

SEQ ID NO: 1860849 - DNA, 14 bp, Homo sapiens
tcccttttctcctc

SEQ ID NO: 1860850 - DNA, 15 bp, Homo sapiens
tcttttctgaatctt

SEQ ID NO: 1860851 - DNA, 20 bp, Homo sapiens
tcttttctgaatcttctgaa

SEQ ID NO: 1860852 - DNA, 13 bp, Homo sapiens
tcttttttaaagt

SEQ ID NO: 1860853 - DNA, 16 bp, Homo sapiens
tgaaaaaaagtttaca

SEQ ID NO: 1860854 - DNA, 14 bp, Homo sapiens
tgaaaaatattgct

SEQ ID NO: 1860855 - DNA, 12 bp, Homo sapiens
tgaaaagccata

SEQ ID NO: 1860856 - DNA, 13 bp, Homo sapiens
tgaaaatatatac

SEQ ID NO: 1860857 - DNA, 23 bp, Homo sapiens
aatatgattgcactaaataaact

SEQ ID NO: 1860858 - DNA, 20 bp, Homo sapiens
aatatggaacttctaatata

SEQ ID NO: 1860859 - DNA, 22 bp, Homo sapiens
aatatggggcattaatattctt

SEQ ID NO: 1860860 - DNA, 16 bp, Homo sapiens
aatattcttttgttat

SEQ ID NO: 1860861 - DNA, 12 bp, Homo sapiens
aatattgctaaa

SEQ ID NO: 1860862 - DNA, 14 bp, Homo sapiens
aatattggttagta

SEQ ID NO: 1860863 - DNA, 22 bp, Homo sapiens
aatattgtgttgtgcagcatta

SEQ ID NO: 1860864 - DNA, 12 bp, Homo sapiens
aatattttaaga

SEQ ID NO: 1860865 - DNA, 13 bp, Homo sapiens
aatattttaagaa

SEQ ID NO: 1860866 - DNA, 18 bp, Homo sapiens
aatcaaaataaaaattaa

SEQ ID NO: 1860867 - DNA, 15 bp, Homo sapiens
aatcacaaacatatg

SEQ ID NO: 1860868 - DNA, 16 bp, Homo sapiens
aatcagcatgacaaaa

SEQ ID NO: 1860869 - DNA, 22 bp, Homo sapiens
aatcagcatgacaaaaataaca

SEQ ID NO: 1860870 - DNA, 14 bp, Homo sapiens
aatcagtaaacact

SEQ ID NO: 1860871 - DNA, 24 bp, Homo sapiens
aatcataaccaccctagctttata

SEQ ID NO: 1860872 - DNA, 14 bp, Homo sapiens
aatcatattaatta

SEQ ID NO: 1860873 - DNA, 16 bp, Homo sapiens
aatcatgctcatgtat

SEQ ID NO: 1860874 - DNA, 14 bp, Homo sapiens
aatcatttggttaa

SEQ ID NO: 1860875 - DNA, 17 bp, Homo sapiens
aatcatttggttaaatc

SEQ ID NO: 1860876 - DNA, 14 bp, Homo sapiens
aatccatgcttcac

SEQ ID NO: 1860877 - DNA, 21 bp, Homo sapiens
aatcctatatctgtttgtata

SEQ ID NO: 1860878 - DNA, 16 bp, Homo sapiens
aatcctccctggagaa

SEQ ID NO: 1860879 - DNA, 20 bp, Homo sapiens
aatctaagtatatgtgagaa

SEQ ID NO: 1860880 - DNA, 16 bp, Homo sapiens
aatctaatattaaaaa

SEQ ID NO: 1860881 - DNA, 17 bp, Homo sapiens
aatctcctctgctcatt

SEQ ID NO: 1860882 - DNA, 22 bp, Homo sapiens
aatcttagtatagtagaaagac

SEQ ID NO: 1860883 - DNA, 16 bp, Homo sapiens
aatcttggcttcttaa

SEQ ID NO: 1860884 - DNA, 23 bp, Homo sapiens
aatcttggcttcttaaaaactgt

SEQ ID NO: 1860885 - DNA, 20 bp, Homo sapiens
aatcttggtttggtacagtt

SEQ ID NO: 1860886 - DNA, 22 bp, Homo sapiens
aatcttggtttggtacagttca

SEQ ID NO: 1860887 - DNA, 17 bp, Homo sapiens
aatctttaatggttaat

SEQ ID NO: 1860888 - DNA, 12 bp, Homo sapiens
aaaactttaaaa

SEQ ID NO: 1860889 - DNA, 19 bp, Homo sapiens
aaaactttaaagataagtc

SEQ ID NO: 1860890 - DNA, 21 bp, Homo sapiens
aaaagactggtttgtttgctt

SEQ ID NO: 1860891 - DNA, 18 bp, Homo sapiens
aaaagactgtcaaatgaa

SEQ ID NO: 1860892 - DNA, 22 bp, Homo sapiens
aaaagactgtcaaatgaacttt

SEQ ID NO: 1860893 - DNA, 14 bp, Homo sapiens
aaaagctcatattt

SEQ ID NO: 1860894 - DNA, 17 bp, Homo sapiens
aaaaggaaattagtctt

SEQ ID NO: 1860895 - DNA, 20 bp, Homo sapiens
aaaaggaaattagtcttttt

SEQ ID NO: 1860896 - DNA, 21 bp, Homo sapiens
aaaaggatgttacaagtttgc

SEQ ID NO: 1860897 - DNA, 20 bp, Homo sapiens
aaaaggcaactcaaagatga

SEQ ID NO: 1860898 - DNA, 20 bp, Homo sapiens
aaaagggaagttgtgccttt

SEQ ID NO: 1860899 - DNA, 20 bp, Homo sapiens
aaaagtgaaacgtaattgta

SEQ ID NO: 1860900 - DNA, 16 bp, Homo sapiens
aaaagtgaacttttgt

SEQ ID NO: 1860901 - DNA, 21 bp, Homo sapiens
aaaagtgaacttttgtaattt

SEQ ID NO: 1860902 - DNA, 20 bp, Homo sapiens
aaaagttataataactgaac

SEQ ID NO: 1860903 - DNA, 21 bp, Homo sapiens
aaaagttataataactgaact

SEQ ID NO: 1860904 - DNA, 21 bp, Homo sapiens
aaaataatctatattaaatga

SEQ ID NO: 1860905 - DNA, 19 bp, Homo sapiens
aaaatagcttgtatagtgt

SEQ ID NO: 1860906 - DNA, 16 bp, Homo sapiens
aaaatatggaacttct

SEQ ID NO: 1860907 - DNA, 14 bp, Homo sapiens
aaaatattatttga

SEQ ID NO: 1860908 - DNA, 16 bp, Homo sapiens
aaaatattgctaaaag

SEQ ID NO: 1860909 - DNA, 21 bp, Homo sapiens
aaaatattgctaaaagtgcat

SEQ ID NO: 1860910 - DNA, 22 bp, Homo sapiens
aaaatattgctaaaagtgcatt

SEQ ID NO: 1860911 - DNA, 14 bp, Homo sapiens
aaaatattttaaga

SEQ ID NO: 1860912 - DNA, 15 bp, Homo sapiens
aaaatattttaagaa

SEQ ID NO: 1860913 - DNA, 21 bp, Homo sapiens
aaaatattttaagaaagagaa

SEQ ID NO: 1860914 - DNA, 15 bp, Homo sapiens
aaaatcagattttct

SEQ ID NO: 1860915 - DNA, 14 bp, Homo sapiens
aaaatcctatatct

SEQ ID NO: 1860916 - DNA, 15 bp, Homo sapiens
aaaatctaatattaa

SEQ ID NO: 1860917 - DNA, 20 bp, Homo sapiens
aaaatgattgtaaaatagct

SEQ ID NO: 1860918 - DNA, 23 bp, Homo sapiens
aaaatgtttaattcattaatctg

SEQ ID NO: 1860919 - DNA, 13 bp, Homo sapiens
aaacaaaatttca

SEQ ID NO: 1860920 - DNA, 18 bp, Homo sapiens
aaacacaaaaaaataata

SEQ ID NO: 1860921 - DNA, 23 bp, Homo sapiens
aaacactaaattagtttaaaatg

SEQ ID NO: 1860922 - DNA, 23 bp, Homo sapiens
aaacactgtttgttccagaatct

SEQ ID NO: 1860923 - DNA, 16 bp, Homo sapiens
aaacagagaaagaaaa

SEQ ID NO: 1860924 - DNA, 19 bp, Homo sapiens
aaacagagaaagaaaaggc

SEQ ID NO: 1860925 - DNA, 23 bp, Homo sapiens
aaacatatgtctgtctttgcaaa

SEQ ID NO: 1860926 - DNA, 17 bp, Homo sapiens
aaacccccttttccctt

SEQ ID NO: 1860927 - DNA, 18 bp, Homo sapiens
aaacctagcttttaaaaa

SEQ ID NO: 1860928 - DNA, 19 bp, Homo sapiens
aaacctagcttttaaaaaa

SEQ ID NO: 1860929 - DNA, 22 bp, Homo sapiens
aaacctgaaaaaaagtttacaa

SEQ ID NO: 1860930 - DNA, 17 bp, Homo sapiens
aaacctgtttttaacat

SEQ ID NO: 1860931 - DNA, 21 bp, Homo sapiens
aaacctgtttttaacatgtga

SEQ ID NO: 1860932 - DNA, 15 bp, Homo sapiens
aaacgcacttacaag

SEQ ID NO: 1860933 - DNA, 18 bp, Homo sapiens
aaacgtatagtcaatatg

SEQ ID NO: 1860934 - DNA, 18 bp, Homo sapiens
aaactaaatctctaatat

SEQ ID NO: 1860935 - DNA, 16 bp, Homo sapiens
aaactatcagtttgtc

SEQ ID NO: 1860936 - DNA, 12 bp, Homo sapiens
aaactgaaaatc

SEQ ID NO: 1860937 - DNA, 13 bp, Homo sapiens
aaactgaaaatct

SEQ ID NO: 1860938 - DNA, 18 bp, Homo sapiens
aaactgaaaatctaatat

SEQ ID NO: 1860939 - DNA, 19 bp, Homo sapiens
aaactgaaaatctaatatt

SEQ ID NO: 1860940 - DNA, 12 bp, Homo sapiens
aaactgaaggtt

SEQ ID NO: 1860941 - DNA, 20 bp, Homo sapiens
aaactgagtccatgaaaata

SEQ ID NO: 1860942 - DNA, 13 bp, Homo sapiens
aaactgctttatt

SEQ ID NO: 1860943 - DNA, 16 bp, Homo sapiens
aaactgtgtatcatta

SEQ ID NO: 1860944 - DNA, 21 bp, Homo sapiens
aaactgtgtatcattaaaata

SEQ ID NO: 1860945 - DNA, 22 bp, Homo sapiens
aaactgtgtatcattaaaatat

SEQ ID NO: 1860946 - DNA, 12 bp, Homo sapiens
aaacttcagaga

SEQ ID NO: 1860947 - DNA, 15 bp, Homo sapiens
aaacttcagagaaat

SEQ ID NO: 1860948 - DNA, 18 bp, Homo sapiens
aaacttcagagaaattat

SEQ ID NO: 1860949 - DNA, 12 bp, Homo sapiens
aaactttaaaga

SEQ ID NO: 1860950 - DNA, 16 bp, Homo sapiens
aaacttttaggttgtt

SEQ ID NO: 1860951 - DNA, 12 bp, Homo sapiens
aaagaaaaggca

SEQ ID NO: 1860952 - DNA, 13 bp, Homo sapiens
aaagaaaccatga

SEQ ID NO: 1860953 - DNA, 16 bp, Homo sapiens
aaagaaaccatgacaa

SEQ ID NO: 1860954 - DNA, 17 bp, Homo sapiens
aaagaaaccatgacaaa

SEQ ID NO: 1860955 - DNA, 21 bp, Homo sapiens
aaagaagagaggggaagaatt

SEQ ID NO: 1860956 - DNA, 14 bp, Homo sapiens
aaagaattctattt

SEQ ID NO: 1860957 - DNA, 16 bp, Homo sapiens
aaagacacctgcctta

SEQ ID NO: 1860958 - DNA, 14 bp, Homo sapiens
aaagactaatttaa

SEQ ID NO: 1860959 - DNA, 23 bp, Homo sapiens
aaagactaatttaaaaaataact

SEQ ID NO: 1860960 - DNA, 12 bp, Homo sapiens
aaagactggttt

SEQ ID NO: 1860961 - DNA, 20 bp, Homo sapiens
aaagactggtttgtttgctt

SEQ ID NO: 1860962 - DNA, 18 bp, Homo sapiens
aaagactgtcaaatgaac

SEQ ID NO: 1860963 - DNA, 15 bp, Homo sapiens
aaagagaatgaactg

SEQ ID NO: 1860964 - DNA, 18 bp, Homo sapiens
aaagagaatgaactgtgg

SEQ ID NO: 1860965 - DNA, 14 bp, Homo sapiens
aaagatgatggaaa

SEQ ID NO: 1860966 - DNA, 18 bp, Homo sapiens
aaagcatgggaaaaagag

SEQ ID NO: 1860967 - DNA, 17 bp, Homo sapiens
aaagccaccttgttaca

SEQ ID NO: 1860968 - DNA, 19 bp, Homo sapiens
aaagcttacccttggtttg

SEQ ID NO: 1860969 - DNA, 20 bp, Homo sapiens
aaagcttgatttgatctttg

SEQ ID NO: 1860970 - DNA, 21 bp, Homo sapiens
aaagcttgatttgatctttgt

SEQ ID NO: 1860971 - DNA, 14 bp, Homo sapiens
aaagctttatcttt

SEQ ID NO: 1860972 - DNA, 16 bp, Homo sapiens
aaagctttatctttgt

SEQ ID NO: 1860973 - DNA, 13 bp, Homo sapiens
aaaggatgttaca

SEQ ID NO: 1860974 - DNA, 21 bp, Homo sapiens
aaaggatgttacaagtttgct

SEQ ID NO: 1860975 - DNA, 13 bp, Homo sapiens
aaaggcaactcaa

SEQ ID NO: 1860976 - DNA, 20 bp, Homo sapiens
aaaggcaactcaaagatgat

SEQ ID NO: 1860977 - DNA, 18 bp, Homo sapiens
aaagggaagttgtgcctt

SEQ ID NO: 1860978 - DNA, 15 bp, Homo sapiens
aaaggtaggttttaa

SEQ ID NO: 1860979 - DNA, 13 bp, Homo sapiens
aaagtaagtcttt

SEQ ID NO: 1860980 - DNA, 19 bp, Homo sapiens
aaagtatgtaaagtatgta

SEQ ID NO: 1860981 - DNA, 20 bp, Homo sapiens
aaagtatgtaaagtatgtaa

SEQ ID NO: 1860982 - DNA, 15 bp, Homo sapiens
aaagtattcagaaat

SEQ ID NO: 1860983 - DNA, 19 bp, Homo sapiens
aagaaaggatataaaagga

SEQ ID NO: 1860984 - DNA, 14 bp, Homo sapiens
aagaaagggaaagc

SEQ ID NO: 1860985 - DNA, 21 bp, Homo sapiens
aagaagggggagtgaaacaga

SEQ ID NO: 1860986 - DNA, 23 bp, Homo sapiens
aagaagttttttactttggttta

SEQ ID NO: 1860987 - DNA, 14 bp, Homo sapiens
aagaattctatttt

SEQ ID NO: 1860988 - DNA, 18 bp, Homo sapiens
aagaattctattttgctg

SEQ ID NO: 1860989 - DNA, 14 bp, Homo sapiens
aagacaacattgta

SEQ ID NO: 1860990 - DNA, 18 bp, Homo sapiens
aagacagtggcactaaaa

SEQ ID NO: 1860991 - DNA, 22 bp, Homo sapiens
aagacagtggcactaaaatgtt

SEQ ID NO: 1860992 - DNA, 23 bp, Homo sapiens
aagacataaaactttaaaaggca

SEQ ID NO: 1860993 - DNA, 13 bp, Homo sapiens
aagacatctgcct

SEQ ID NO: 1860994 - DNA, 19 bp, Homo sapiens
aagacatctgcctgtaatt

SEQ ID NO: 1860995 - DNA, 18 bp, Homo sapiens
aagactggtttgtttgct

SEQ ID NO: 1860996 - DNA, 19 bp, Homo sapiens
aagactggtttgtttgctt

SEQ ID NO: 1860997 - DNA, 20 bp, Homo sapiens
aagactggtttgtttgctta

SEQ ID NO: 1860998 - DNA, 21 bp, Homo sapiens
aagactggtttgtttgcttaa

SEQ ID NO: 1860999 - DNA, 19 bp, Homo sapiens
aagactgtcaaatgaactt

SEQ ID NO: 1861000 - DNA, 16 bp, Homo sapiens
aagacttggcaacaga

SEQ ID NO: 1861001 - DNA, 20 bp, Homo sapiens
aagagaatgaactgtggaat

SEQ ID NO: 1861002 - DNA, 15 bp, Homo sapiens
aagagaggggaagaa

SEQ ID NO: 1861003 - DNA, 18 bp, Homo sapiens
aagagaggggaagaattt

SEQ ID NO: 1861004 - DNA, 20 bp, Homo sapiens
aagagaggggaagaatttaa

SEQ ID NO: 1861005 - DNA, 12 bp, Homo sapiens
aagaggttttat

SEQ ID NO: 1861006 - DNA, 22 bp, Homo sapiens
aagatgagggtgtcggctgtga

SEQ ID NO: 1861007 - DNA, 22 bp, Homo sapiens
aagatgatggaaacgcacttac

SEQ ID NO: 1861008 - DNA, 18 bp, Homo sapiens
aagatgggcagctagttc

SEQ ID NO: 1861009 - DNA, 22 bp, Homo sapiens
ccaggagcagctggcactgaca

SEQ ID NO: 1861010 - DNA, 21 bp, Homo sapiens
ccaggccagcttcccctcact

SEQ ID NO: 1861011 - DNA, 13 bp, Homo sapiens
ccaggcctccaga

SEQ ID NO: 1861012 - DNA, 14 bp, Homo sapiens
ccaggctccctgac

SEQ ID NO: 1861013 - DNA, 17 bp, Homo sapiens
ccaggctccctgaccac

SEQ ID NO: 1861014 - DNA, 14 bp, Homo sapiens
ccaggggtgtccca

SEQ ID NO: 1861015 - DNA, 15 bp, Homo sapiens
ccaggggtgtcccag

SEQ ID NO: 1861016 - DNA, 14 bp, Homo sapiens
ccagtcccagcctc

SEQ ID NO: 1861017 - DNA, 15 bp, Homo sapiens
ccagtcccagcctct

SEQ ID NO: 1861018 - DNA, 19 bp, Homo sapiens
ccagtgcccaaagtctgtg

SEQ ID NO: 1861019 - DNA, 17 bp, Homo sapiens
ccagtttattctgtggt

SEQ ID NO: 1861020 - DNA, 19 bp, Homo sapiens
ccataccagtcacctcctg

SEQ ID NO: 1861021 - DNA, 23 bp, Homo sapiens
ccataccagtcacctcctgctcc

SEQ ID NO: 1861022 - DNA, 18 bp, Homo sapiens
ccatagagtaatgatgta

SEQ ID NO: 1861023 - DNA, 16 bp, Homo sapiens
ccatagagtttaacac

SEQ ID NO: 1861024 - DNA, 21 bp, Homo sapiens
ccataggaagacataaaactt

SEQ ID NO: 1861025 - DNA, 23 bp, Homo sapiens
ccataggaagacataaaacttta

SEQ ID NO: 1861026 - DNA, 14 bp, Homo sapiens
ccatatatgctgta

SEQ ID NO: 1861027 - DNA, 23 bp, Homo sapiens
ccatatctagtcaataactctga

SEQ ID NO: 1861028 - DNA, 18 bp, Homo sapiens
ccatattctaaattcact

SEQ ID NO: 1861029 - DNA, 18 bp, Homo sapiens
ccatcttggcaaggttca

SEQ ID NO: 1861030 - DNA, 11 bp, Homo sapiens
ccatgacaaac

SEQ ID NO: 1861031 - DNA, 17 bp, Homo sapiens
ccatgacaaacctagct

SEQ ID NO: 1861032 - DNA, 18 bp, Homo sapiens
ccatgacaaacctagctt

SEQ ID NO: 1861033 - DNA, 13 bp, Homo sapiens
ccatgcttcactc

SEQ ID NO: 1861034 - DNA, 21 bp, Homo sapiens
ccatgtgtgctaatatacttt

SEQ ID NO: 1861035 - DNA, 13 bp, Homo sapiens
ccatgtttgtaaa

SEQ ID NO: 1861036 - DNA, 15 bp, Homo sapiens
ccattattttacagt

SEQ ID NO: 1861037 - DNA, 16 bp, Homo sapiens
ccattattttacagtc

SEQ ID NO: 1861038 - DNA, 14 bp, Homo sapiens
ccattcctgttctc

SEQ ID NO: 1861039 - DNA, 16 bp, Homo sapiens
ccatttcttatttaat

SEQ ID NO: 1861040 - DNA, 17 bp, Homo sapiens
ccatttcttatttaatt

SEQ ID NO: 1861041 - DNA, 13 bp, Homo sapiens
ccatttgctgccc

SEQ ID NO: 1861042 - DNA, 15 bp, Homo sapiens
ccatttgctgccctg

SEQ ID NO: 1861043 - DNA, 17 bp, Homo sapiens
ccatttgctgccctggg

SEQ ID NO: 1861044 - DNA, 19 bp, Homo sapiens
ccatttgctgccctggggc

SEQ ID NO: 1861045 - DNA, 14 bp, Homo sapiens
ccatttttgctaat

SEQ ID NO: 1861046 - DNA, 18 bp, Homo sapiens
ccatttttgctaattatc

SEQ ID NO: 1861047 - DNA, 14 bp, Homo sapiens
cccaaatcacaaac

SEQ ID NO: 1861048 - DNA, 12 bp, Homo sapiens
cccaacagttta

SEQ ID NO: 1861049 - DNA, 17 bp, Homo sapiens
cccaacagtttattttt

SEQ ID NO: 1861050 - DNA, 13 bp, Homo sapiens
cccaagtggctct

SEQ ID NO: 1861051 - DNA, 16 bp, Homo sapiens
cccaagtggctcttgg

SEQ ID NO: 1861052 - DNA, 17 bp, Homo sapiens
cccaatccatgcttcac

SEQ ID NO: 1861053 - DNA, 14 bp, Homo sapiens
cccaatcctccctg

SEQ ID NO: 1861054 - DNA, 17 bp, Homo sapiens
cccacctgggccaagga

SEQ ID NO: 1861055 - DNA, 22 bp, Homo sapiens
cccactcccccaggagcagctg

SEQ ID NO: 1861056 - DNA, 16 bp, Homo sapiens
cccactgacctgccca

SEQ ID NO: 1861057 - DNA, 10 bp, Homo sapiens
cccactgggc

SEQ ID NO: 1861058 - DNA, 17 bp, Homo sapiens
cccactgggccctgggg

SEQ ID NO: 1861059 - DNA, 14 bp, Homo sapiens
cccagagcacaaga

SEQ ID NO: 1861060 - DNA, 22 bp, Homo sapiens
cccagagcacaagaaggccagc

SEQ ID NO: 1861061 - DNA, 15 bp, Homo sapiens
cccagcctctggggc

SEQ ID NO: 1861062 - DNA, 20 bp, Homo sapiens
cccagcctctggggcagagc

SEQ ID NO: 1861063 - DNA, 19 bp, Homo sapiens
cccaggagcagctggcact

SEQ ID NO: 1861064 - DNA, 13 bp, Homo sapiens
cccagggcctctg

SEQ ID NO: 1861065 - DNA, 20 bp, Homo sapiens
cccagggcctctggcttccc

SEQ ID NO: 1861066 - DNA, 14 bp, Homo sapiens
cccagtcccagcct

SEQ ID NO: 1861067 - DNA, 20 bp, Homo sapiens
cccatgtccagagggactgg

SEQ ID NO: 1861068 - DNA, 17 bp, Homo sapiens
cccatttttgctaatta

SEQ ID NO: 1861069 - DNA, 14 bp, Homo sapiens
ccccaaagagctgt

SEQ ID NO: 1861070 - DNA, 16 bp, Homo sapiens
ccccagcgcttagaaa

SEQ ID NO: 1861071 - DNA, 12 bp, Homo sapiens
ccccaggagcag

SEQ ID NO: 1861072 - DNA, 17 bp, Homo sapiens
ccccaggagcagctggc

SEQ ID NO: 1861073 - DNA, 15 bp, Homo sapiens
ccccataccagtcac

SEQ ID NO: 1861074 - DNA, 18 bp, Homo sapiens
cccccaaagagctgtggc

SEQ ID NO: 1861075 - DNA, 19 bp, Homo sapiens
cccccaggcctccagaacc

SEQ ID NO: 1861076 - DNA, 12 bp, Homo sapiens
cccccccaggcc

SEQ ID NO: 1861077 - DNA, 11 bp, Homo sapiens
ccccctgcagc

SEQ ID NO: 1861078 - DNA, 16 bp, Homo sapiens
cccctagagactcaga

SEQ ID NO: 1861079 - DNA, 18 bp, Homo sapiens
cccctccccaaaagaaac

SEQ ID NO: 1861080 - DNA, 11 bp, Homo sapiens
cccctgcccaa

SEQ ID NO: 1861081 - DNA, 15 bp, Homo sapiens
cccgcttagttcttg

SEQ ID NO: 1861082 - DNA, 19 bp, Homo sapiens
cccgcttagttcttgaatt

SEQ ID NO: 1861083 - DNA, 23 bp, Homo sapiens
cccgcttagttcttgaattgtta

SEQ ID NO: 1861084 - DNA, 19 bp, Homo sapiens
cccgtccccctagagactc

SEQ ID NO: 1861085 - DNA, 13 bp, Homo sapiens
acccccccaggcc

SEQ ID NO: 1861086 - DNA, 20 bp, Homo sapiens
accctagctttatattttgt

SEQ ID NO: 1861087 - DNA, 20 bp, Homo sapiens
accctgcaggccaggccagc

SEQ ID NO: 1861088 - DNA, 23 bp, Homo sapiens
accctgcccctccccaaaagaaa

SEQ ID NO: 1861089 - DNA, 21 bp, Homo sapiens
acccttggtttgcacataaaa

SEQ ID NO: 1861090 - DNA, 19 bp, Homo sapiens
accctttgtattataattg

SEQ ID NO: 1861091 - DNA, 20 bp, Homo sapiens
accctttgtattataattgt

SEQ ID NO: 1861092 - DNA, 17 bp, Homo sapiens
accggccgcagccccca

SEQ ID NO: 1861093 - DNA, 23 bp, Homo sapiens
accggccgcagcccccactgacc

SEQ ID NO: 1861094 - DNA, 13 bp, Homo sapiens
accgtggggaggc

SEQ ID NO: 1861095 - DNA, 19 bp, Homo sapiens
acctaacgccctatttttg

SEQ ID NO: 1861096 - DNA, 13 bp, Homo sapiens
acctacaggactg

SEQ ID NO: 1861097 - DNA, 14 bp, Homo sapiens
acctacaggactgg

SEQ ID NO: 1861098 - DNA, 14 bp, Homo sapiens
acctagcttttaaa

SEQ ID NO: 1861099 - DNA, 19 bp, Homo sapiens
acctagcttttaaaaaata

SEQ ID NO: 1861100 - DNA, 15 bp, Homo sapiens
acctcggtgatgcct

SEQ ID NO: 1861101 - DNA, 18 bp, Homo sapiens
acctgaaaaaaagtttac

SEQ ID NO: 1861102 - DNA, 21 bp, Homo sapiens
acctgatggcacttagctatc

SEQ ID NO: 1861103 - DNA, 16 bp, Homo sapiens
acctgtttttaacatg

SEQ ID NO: 1861104 - DNA, 16 bp, Homo sapiens
accttaccaactttct

SEQ ID NO: 1861105 - DNA, 14 bp, Homo sapiens
accttactggcact

SEQ ID NO: 1861106 - DNA, 20 bp, Homo sapiens
acctttctactttttctgta

SEQ ID NO: 1861107 - DNA, 13 bp, Homo sapiens
acgccctattttt

SEQ ID NO: 1861108 - DNA, 20 bp, Homo sapiens
acgcctctggacctcggtga

SEQ ID NO: 1861109 - DNA, 15 bp, Homo sapiens
acgcttgctcatttt

SEQ ID NO: 1861110 - DNA, 15 bp, Homo sapiens
acggccaggctccct

SEQ ID NO: 1861111 - DNA, 17 bp, Homo sapiens
acggccaggctccctga

SEQ ID NO: 1861112 - DNA, 13 bp, Homo sapiens
acggtcttctgca

SEQ ID NO: 1861113 - DNA, 14 bp, Homo sapiens
acggtcttctgcat

SEQ ID NO: 1861114 - DNA, 17 bp, Homo sapiens
acgtgattgattcagta

SEQ ID NO: 1861115 - DNA, 18 bp, Homo sapiens
acgtgattgattcagtat

SEQ ID NO: 1861116 - DNA, 17 bp, Homo sapiens
acgttttctggcttctg

SEQ ID NO: 1861117 - DNA, 17 bp, Homo sapiens
actaaaatgtttaattc

SEQ ID NO: 1861118 - DNA, 22 bp, Homo sapiens
actaaactctgaataagcactt

SEQ ID NO: 1861119 - DNA, 14 bp, Homo sapiens
actaaatctctaat

SEQ ID NO: 1861120 - DNA, 17 bp, Homo sapiens
actaaatctctaatatg

SEQ ID NO: 1861121 - DNA, 20 bp, Homo sapiens
actaactcatagattgcaaa

SEQ ID NO: 1861122 - DNA, 15 bp, Homo sapiens
actaagccacaagaa

SEQ ID NO: 1861123 - DNA, 18 bp, Homo sapiens
ctgcccatgtccagaggg

SEQ ID NO: 1861124 - DNA, 23 bp, Homo sapiens
ctgccccgtccccctagagactc

SEQ ID NO: 1861125 - DNA, 20 bp, Homo sapiens
ctgccctcggcaaccgtggg

SEQ ID NO: 1861126 - DNA, 19 bp, Homo sapiens
ctgcctggttttatttata

SEQ ID NO: 1861127 - DNA, 15 bp, Homo sapiens
ctgcctgtaattaaa

SEQ ID NO: 1861128 - DNA, 13 bp, Homo sapiens
ctgcctgtggagg

SEQ ID NO: 1861129 - DNA, 14 bp, Homo sapiens
ctgccttcaccctg

SEQ ID NO: 1861130 - DNA, 17 bp, Homo sapiens
ctgccttcaccctgaac

SEQ ID NO: 1861131 - DNA, 14 bp, Homo sapiens
ctgccttgctgcct

SEQ ID NO: 1861132 - DNA, 15 bp, Homo sapiens
ctgcggtgtctgcag

SEQ ID NO: 1861133 - DNA, 21 bp, Homo sapiens
ctgctaaagggagaaatgcca

SEQ ID NO: 1861134 - DNA, 16 bp, Homo sapiens
ctgcttacactccagg

SEQ ID NO: 1861135 - DNA, 19 bp, Homo sapiens
ctgcttacactccaggtgt

SEQ ID NO: 1861136 - DNA, 12 bp, Homo sapiens
ctggacagccag

SEQ ID NO: 1861137 - DNA, 18 bp, Homo sapiens
ctggacagccagggcagg

SEQ ID NO: 1861138 - DNA, 18 bp, Homo sapiens
ctggacctcggtgatgcc

SEQ ID NO: 1861139 - DNA, 19 bp, Homo sapiens
ctggagacagaagtcaggt

SEQ ID NO: 1861140 - DNA, 20 bp, Homo sapiens
ctggagacagaagtcaggtg

SEQ ID NO: 1861141 - DNA, 17 bp, Homo sapiens
ctggagactatttaagt

SEQ ID NO: 1861142 - DNA, 18 bp, Homo sapiens
ctggaggaaccacatata

SEQ ID NO: 1861143 - DNA, 13 bp, Homo sapiens
ctggatggcctct

SEQ ID NO: 1861144 - DNA, 18 bp, Homo sapiens
ctggcactgacagcctgg

SEQ ID NO: 1861145 - DNA, 21 bp, Homo sapiens
ctggcactgacagcctggggg

SEQ ID NO: 1861146 - DNA, 18 bp, Homo sapiens
ctggcactgtggcactgc

SEQ ID NO: 1861147 - DNA, 22 bp, Homo sapiens
ctggcaggtcatggagcagccc

SEQ ID NO: 1861148 - DNA, 23 bp, Homo sapiens
ctggcaggtcatggagcagcccc

SEQ ID NO: 1861149 - DNA, 22 bp, Homo sapiens
ctggcagtggcctccttttggt

SEQ ID NO: 1861150 - DNA, 22 bp, Homo sapiens
ctggcatcgcagcttcctgtct

SEQ ID NO: 1861151 - DNA, 13 bp, Homo sapiens
ctgggaagggaag

SEQ ID NO: 1861152 - DNA, 17 bp, Homo sapiens
ctgggcagtgagtgcca

SEQ ID NO: 1861153 - DNA, 18 bp, Homo sapiens
ctgggcagtgagtgccat

SEQ ID NO: 1861154 - DNA, 22 bp, Homo sapiens
ctgggcagtgagtgccatgctt

SEQ ID NO: 1861155 - DNA, 23 bp, Homo sapiens
ctgggccaaggactccaaagccg

SEQ ID NO: 1861156 - DNA, 21 bp, Homo sapiens
ctgggccgggcccagggcctc

SEQ ID NO: 1861157 - DNA, 12 bp, Homo sapiens
ctggggcagagc

SEQ ID NO: 1861158 - DNA, 13 bp, Homo sapiens
ctggggcagagct

SEQ ID NO: 1861159 - DNA, 15 bp, Homo sapiens
ctggggcagagcttg

SEQ ID NO: 1861160 - DNA, 12 bp, Homo sapiens
ctggggcaggac

SEQ ID NO: 1861161 - DNA, 17 bp, Homo sapiens
ctggggcatcatgggca

SEQ ID NO: 1861162 - DNA, 15 bp, Homo sapiens
ctggggctgccctcg

SEQ ID NO: 1861163 - DNA, 19 bp, Homo sapiens
ctggggggatgacggccag

SEQ ID NO: 1861164 - DNA, 20 bp, Homo sapiens
ctggggggatgacggccagg

SEQ ID NO: 1861165 - DNA, 16 bp, Homo sapiens
ctggtttgtttgctta

SEQ ID NO: 1861166 - DNA, 20 bp, Homo sapiens
ctggtttgtttgcttaattt

SEQ ID NO: 1861167 - DNA, 21 bp, Homo sapiens
ctggtttgtttgcttaatttc

SEQ ID NO: 1861168 - DNA, 13 bp, Homo sapiens
ctggttttaacaa

SEQ ID NO: 1861169 - DNA, 14 bp, Homo sapiens
ctgtaaaagttata

SEQ ID NO: 1861170 - DNA, 16 bp, Homo sapiens
ctgtaaaagttataat

SEQ ID NO: 1861171 - DNA, 19 bp, Homo sapiens
ctgtaaaagttataataac

SEQ ID NO: 1861172 - DNA, 20 bp, Homo sapiens
ctgtaaaagttataataact

SEQ ID NO: 1861173 - DNA, 21 bp, Homo sapiens
ctgtaacacagctgagagact

SEQ ID NO: 1861174 - DNA, 19 bp, Homo sapiens
ctgtaattaaactagttta

SEQ ID NO: 1861175 - DNA, 21 bp, Homo sapiens
ctgtatagttaggatagcatt

SEQ ID NO: 1861176 - DNA, 12 bp, Homo sapiens
ctgtatgtcaga

SEQ ID NO: 1861177 - DNA, 15 bp, Homo sapiens
ctgtatttcagtatt

SEQ ID NO: 1861178 - DNA, 16 bp, Homo sapiens
ctgtatttcagtattt

SEQ ID NO: 1861179 - DNA, 20 bp, Homo sapiens
ctgtatttcagtattttcca

SEQ ID NO: 1861180 - DNA, 21 bp, Homo sapiens
ctgtatttcagtattttccag

SEQ ID NO: 1861181 - DNA, 17 bp, Homo sapiens
ctgtatttctttgtaga

SEQ ID NO: 1861182 - DNA, 14 bp, Homo sapiens
ctgtcaaatgaact

SEQ ID NO: 1861183 - DNA, 15 bp, Homo sapiens
ctgtcttctcccaga

SEQ ID NO: 1861184 - DNA, 16 bp, Homo sapiens
ctgtcttctcccagag

SEQ ID NO: 1861185 - DNA, 20 bp, Homo sapiens
ctgtcttctcccagagcaca

SEQ ID NO: 1861186 - DNA, 13 bp, Homo sapiens
ctgtgaaagctgc

SEQ ID NO: 1861187 - DNA, 15 bp, Homo sapiens
ctgtgaatttcaaaa

SEQ ID NO: 1861188 - DNA, 16 bp, Homo sapiens
ctgtgagcaagagcca

SEQ ID NO: 1861189 - DNA, 19 bp, Homo sapiens
ctgtgctatgctggacatt

SEQ ID NO: 1861190 - DNA, 13 bp, Homo sapiens
ctgtggaatttat

SEQ ID NO: 1861191 - DNA, 16 bp, Homo sapiens
ctgtggaggtgacctg

SEQ ID NO: 1861192 - DNA, 15 bp, Homo sapiens
ctgtggcactgccac

SEQ ID NO: 1861193 - DNA, 17 bp, Homo sapiens
ctgtggcactgccacca

SEQ ID NO: 1861194 - DNA, 11 bp, Homo sapiens
ctgtggctggg

SEQ ID NO: 1861195 - DNA, 12 bp, Homo sapiens
ctgtggctgggg

SEQ ID NO: 1861196 - DNA, 15 bp, Homo sapiens
ctgtggctgggggga

SEQ ID NO: 1861197 - DNA, 13 bp, Homo sapiens
ctgtgtatcatta

SEQ ID NO: 1861198 - DNA, 16 bp, Homo sapiens
ctgtgtatcattaaaa

SEQ ID NO: 1861199 - DNA, 19 bp, Homo sapiens
ctgtgtatcattaaaatat

SEQ ID NO: 1861200 - DNA, 20 bp, Homo sapiens
ctgtgtatcattaaaatata

SEQ ID NO: 1861201 - DNA, 17 bp, Homo sapiens
ctgtgtcggtcagaaca

SEQ ID NO: 1861202 - DNA, 21 bp, Homo sapiens
ctgtgtgcaactaactgactc

SEQ ID NO: 1861203 - DNA, 21 bp, Homo sapiens
ctgtgtgcaccttaccaactt

SEQ ID NO: 1861204 - DNA, 17 bp, Homo sapiens
ctgtgtgcagtgaaggt

SEQ ID NO: 1861205 - DNA, 14 bp, Homo sapiens
ctgtgttgcttcaa

SEQ ID NO: 1861206 - DNA, 19 bp, Homo sapiens
taatagcgggttactttca

SEQ ID NO: 1861207 - DNA, 15 bp, Homo sapiens
taatatggcaaaaat

SEQ ID NO: 1861208 - DNA, 16 bp, Homo sapiens
taatatggcaaaaatg

SEQ ID NO: 1861209 - DNA, 18 bp, Homo sapiens
taatattaaaaatatgga

SEQ ID NO: 1861210 - DNA, 12 bp, Homo sapiens
taatattctttt

SEQ ID NO: 1861211 - DNA, 17 bp, Homo sapiens
taatcaatcatctgtgt

SEQ ID NO: 1861212 - DNA, 19 bp, Homo sapiens
taatcatgctcatgtatat

SEQ ID NO: 1861213 - DNA, 14 bp, Homo sapiens
taatctatattaaa

SEQ ID NO: 1861214 - DNA, 11 bp, Homo sapiens
taatctgcctg

SEQ ID NO: 1861215 - DNA, 21 bp, Homo sapiens
taatgagctcctgctcattgt

SEQ ID NO: 1861216 - DNA, 14 bp, Homo sapiens
taatgatgtaacag

SEQ ID NO: 1861217 - DNA, 13 bp, Homo sapiens
taatgctttctga

SEQ ID NO: 1861218 - DNA, 22 bp, Homo sapiens
taatggactgtgaatttcaaaa

SEQ ID NO: 1861219 - DNA, 23 bp, Homo sapiens
taatggactgtgaatttcaaaaa

SEQ ID NO: 1861220 - DNA, 21 bp, Homo sapiens
taattagagaactggaggaac

SEQ ID NO: 1861221 - DNA, 15 bp, Homo sapiens
taattattttccaaa

SEQ ID NO: 1861222 - DNA, 21 bp, Homo sapiens
taattgatcagatgctgaatt

SEQ ID NO: 1861223 - DNA, 14 bp, Homo sapiens
taattgtcctgtgt

SEQ ID NO: 1861224 - DNA, 23 bp, Homo sapiens
taattgtcctgtgtctatgtacc

SEQ ID NO: 1861225 - DNA, 16 bp, Homo sapiens
taattgttgatatttt

SEQ ID NO: 1861226 - DNA, 15 bp, Homo sapiens
taatttccttctgtt

SEQ ID NO: 1861227 - DNA, 18 bp, Homo sapiens
taatttccttctgttaag

SEQ ID NO: 1861228 - DNA, 15 bp, Homo sapiens
taatttgtcttagtt

SEQ ID NO: 1861229 - DNA, 23 bp, Homo sapiens
taatttgtgcatcagaaaatgca

SEQ ID NO: 1861230 - DNA, 20 bp, Homo sapiens
taattttttgcagtcttttg

SEQ ID NO: 1861231 - DNA, 16 bp, Homo sapiens
taatttttttttgtaa

SEQ ID NO: 1861232 - DNA, 19 bp, Homo sapiens
tacaaaaaaaatctttaat

SEQ ID NO: 1861233 - DNA, 13 bp, Homo sapiens
tacaaaagcagct

SEQ ID NO: 1861234 - DNA, 14 bp, Homo sapiens
tacaagtttgctaa

SEQ ID NO: 1861235 - DNA, 12 bp, Homo sapiens
tacaggactggg

SEQ ID NO: 1861236 - DNA, 19 bp, Homo sapiens
tacagtctctgttgtaaat

SEQ ID NO: 1861237 - DNA, 14 bp, Homo sapiens
tacagtgtatttaa

SEQ ID NO: 1861238 - DNA, 21 bp, Homo sapiens
tacagtttgtgttttaaaaaa

SEQ ID NO: 1861239 - DNA, 12 bp, Homo sapiens
tacataaacagt

SEQ ID NO: 1861240 - DNA, 19 bp, Homo sapiens
tacataattttttattcaa

SEQ ID NO: 1861241 - DNA, 19 bp, Homo sapiens
tacattcttggttgttaat

SEQ ID NO: 1861242 - DNA, 13 bp, Homo sapiens
taccaactttctg

SEQ ID NO: 1861243 - DNA, 15 bp, Homo sapiens
taccaactttctgta

SEQ ID NO: 1861244 - DNA, 17 bp, Homo sapiens
taccaagtatgaagtat

SEQ ID NO: 1861245 - DNA, 14 bp, Homo sapiens
taccagtcacctcc

SEQ ID NO: 1861246 - DNA, 22 bp, Homo sapiens
taccagtcacctcctgctcctt

SEQ ID NO: 1861247 - DNA, 19 bp, Homo sapiens
taccatattgctcttaaaa

SEQ ID NO: 1861248 - DNA, 17 bp, Homo sapiens
taccattattttacagt

SEQ ID NO: 1861249 - DNA, 19 bp, Homo sapiens
taccattattttacagtct

SEQ ID NO: 1861250 - DNA, 23 bp, Homo sapiens
taccctatatctataaacactgt

SEQ ID NO: 1861251 - DNA, 12 bp, Homo sapiens
taccctgcaggc

SEQ ID NO: 1861252 - DNA, 15 bp, Homo sapiens
taccctgcaggccag

SEQ ID NO: 1861253 - DNA, 17 bp, Homo sapiens
taccctgcaggccaggc

SEQ ID NO: 1861254 - DNA, 20 bp, Homo sapiens
tacccttggtttgcacataa

SEQ ID NO: 1861255 - DNA, 17 bp, Homo sapiens
tacctgccttttaagtt

SEQ ID NO: 1861256 - DNA, 14 bp, Homo sapiens
tacctttttatatt

SEQ ID NO: 1861257 - DNA, 23 bp, Homo sapiens
tacgcactacatgtggtttatag

SEQ ID NO: 1861258 - DNA, 15 bp, Homo sapiens
tactgcagctttaca

SEQ ID NO: 1861259 - DNA, 18 bp, Homo sapiens
tactgcttctctttgtgc

SEQ ID NO: 1861260 - DNA, 11 bp, Homo sapiens
tactggcactg

SEQ ID NO: 1861261 - DNA, 14 bp, Homo sapiens
tactgtaaaagtta

SEQ ID NO: 1861262 - DNA, 16 bp, Homo sapiens
tactgtctggttttaa

SEQ ID NO: 1861263 - DNA, 22 bp, Homo sapiens
tactgtctggttttaacaattt

SEQ ID NO: 1861264 - DNA, 19 bp, Homo sapiens
tacttacaaaagcagcttt

SEQ ID NO: 1861265 - DNA, 16 bp, Homo sapiens
tacttagaatgccata

SEQ ID NO: 1861266 - DNA, 20 bp, Homo sapiens
tacttagaatgccataaaat

SEQ ID NO: 1861267 - DNA, 16 bp, Homo sapiens
tactttgtgtttagct

SEQ ID NO: 1861268 - DNA, 15 bp, Homo sapiens
tacttttttgaaatc

SEQ ID NO: 1861269 - DNA, 13 bp, Homo sapiens
tagaaaactgaaa

SEQ ID NO: 1861270 - DNA, 22 bp, Homo sapiens
tagaaaactgaaaatctaatat

SEQ ID NO: 1861271 - DNA, 13 bp, Homo sapiens
tagaaaatcagat

SEQ ID NO: 1861272 - DNA, 15 bp, Homo sapiens
tagaaaatcttagta

SEQ ID NO: 1861273 - DNA, 20 bp, Homo sapiens
tagaactgtatgtcagacat

SEQ ID NO: 1861274 - DNA, 17 bp, Homo sapiens
tagaataaatggtttct

SEQ ID NO: 1861275 - DNA, 22 bp, Homo sapiens
tagaggggttttagatttttaa

SEQ ID NO: 1861276 - DNA, 23 bp, Homo sapiens
tagaggtaccagcaatatgtaaa

SEQ ID NO: 1861277 - DNA, 16 bp, Homo sapiens
tagagtaatgatgtaa

SEQ ID NO: 1861278 - DNA, 21 bp, Homo sapiens
tagatgagattgttttatcat

SEQ ID NO: 1861279 - DNA, 15 bp, Homo sapiens
tagatggtgaaattt

SEQ ID NO: 1861280 - DNA, 12 bp, Homo sapiens
tagatttttaaa

SEQ ID NO: 1861281 - DNA, 15 bp, Homo sapiens
tagatttttaaaagg

SEQ ID NO: 1861282 - DNA, 22 bp, Homo sapiens
tagcatttatttctctggcaaa

SEQ ID NO: 1861283 - DNA, 18 bp, Homo sapiens
tagccctggatggcctct

SEQ ID NO: 1861284 - DNA, 22 bp, Homo sapiens
tagcgtccatttcttatttaat

SEQ ID NO: 1861285 - DNA, 18 bp, Homo sapiens
tagctaagcaagccagga

SEQ ID NO: 1861286 - DNA, 17 bp, Homo sapiens
tagcttcatatctaatt

SEQ ID NO: 1861287 - DNA, 19 bp, Homo sapiens
tagctttcccaaataaact

SEQ ID NO: 1861288 - DNA, 15 bp, Homo sapiens
tagcttttaaaaaat

SEQ ID NO: 1861289 - DNA, 17 bp, Homo sapiens
tagcttttaaaaaatat

SEQ ID NO: 1861290 - DNA, 14 bp, Homo sapiens
tagcttttattgta

SEQ ID NO: 1861291 - DNA, 15 bp, Homo sapiens
taggaagacataaaa

SEQ ID NO: 1861292 - DNA, 18 bp, Homo sapiens
taggatgaatgggaaagt

SEQ ID NO: 1861293 - DNA, 21 bp, Homo sapiens
taggcacttttattttcattg

SEQ ID NO: 1861294 - DNA, 14 bp, Homo sapiens
taggggtcaaagaa

SEQ ID NO: 1861295 - DNA, 12 bp, Homo sapiens
taggttgttacc

SEQ ID NO: 1861296 - DNA, 20 bp, Homo sapiens
taggttgttaccaagtatga

SEQ ID NO: 1861297 - DNA, 15 bp, Homo sapiens
tagtaccctgcaggc

SEQ ID NO: 1861298 - DNA, 17 bp, Homo sapiens
tagtaccctgcaggcca

SEQ ID NO: 1861299 - DNA, 18 bp, Homo sapiens
tagtaccctgcaggccag

SEQ ID NO: 1861300 - DNA, 17 bp, Homo sapiens
tagtagccctttctgtg

SEQ ID NO: 1861301 - DNA, 23 bp, Homo sapiens
tagtatagtagaaagacatctgc

SEQ ID NO: 1861302 - DNA, 22 bp, Homo sapiens
tagtgtaaaataagaatgattt

SEQ ID NO: 1861303 - DNA, 15 bp, Homo sapiens
tagttatagtttcag

SEQ ID NO: 1861304 - DNA, 17 bp, Homo sapiens
tagttcagacttagttt

SEQ ID NO: 1861305 - DNA, 18 bp, Homo sapiens
tagtttaaaatgaagcaa

SEQ ID NO: 1861306 - DNA, 17 bp, Homo sapiens
tagtttgtacatgcatt

SEQ ID NO: 1861307 - DNA, 14 bp, Homo sapiens
tagtttgtataact

SEQ ID NO: 1861308 - DNA, 13 bp, Homo sapiens
tataaaaaggaaa

SEQ ID NO: 1861309 - DNA, 16 bp, Homo sapiens
tataaattatgaagga

SEQ ID NO: 1861310 - DNA, 14 bp, Homo sapiens
tataagcgtattta

SEQ ID NO: 1861311 - DNA, 17 bp, Homo sapiens
tataagcgtatttagac

SEQ ID NO: 1861312 - DNA, 16 bp, Homo sapiens
tataaggatcttttgt

SEQ ID NO: 1861313 - DNA, 17 bp, Homo sapiens
tataaggatcttttgta

SEQ ID NO: 1861314 - DNA, 18 bp, Homo sapiens
tataaggatcttttgtaa

SEQ ID NO: 1861315 - DNA, 18 bp, Homo sapiens
tataataactgaactgtt

SEQ ID NO: 1861316 - DNA, 17 bp, Homo sapiens
gagcttgtagccctgga

SEQ ID NO: 1861317 - DNA, 23 bp, Homo sapiens
gaggaaccacatataacacttaa

SEQ ID NO: 1861318 - DNA, 16 bp, Homo sapiens
gaggccatttgctgcc

SEQ ID NO: 1861319 - DNA, 23 bp, Homo sapiens
gaggccatttgctgccctggggc

SEQ ID NO: 1861320 - DNA, 11 bp, Homo sapiens
gagggactgga

SEQ ID NO: 1861321 - DNA, 15 bp, Homo sapiens
gagggactggacagc

SEQ ID NO: 1861322 - DNA, 16 bp, Homo sapiens
gagggactggacagcc

SEQ ID NO: 1861323 - DNA, 18 bp, Homo sapiens
gagggactggacagccag

SEQ ID NO: 1861324 - DNA, 18 bp, Homo sapiens
gagggccgagacaggagc

SEQ ID NO: 1861325 - DNA, 15 bp, Homo sapiens
gaggggaagaattta

SEQ ID NO: 1861326 - DNA, 18 bp, Homo sapiens
gagggtttctgatctgta

SEQ ID NO: 1861327 - DNA, 21 bp, Homo sapiens
gagggtttctgatctgtactt

SEQ ID NO: 1861328 - DNA, 15 bp, Homo sapiens
gagtcacccccccag

SEQ ID NO: 1861329 - DNA, 17 bp, Homo sapiens
gagtcacccccccaggc

SEQ ID NO: 1861330 - DNA, 23 bp, Homo sapiens
gagtcacccccccaggcctccag

SEQ ID NO: 1861331 - DNA, 17 bp, Homo sapiens
gagtccatgaaaatacc

SEQ ID NO: 1861332 - DNA, 19 bp, Homo sapiens
gagtcgtcatcacttttca

SEQ ID NO: 1861333 - DNA, 18 bp, Homo sapiens
gagtcttaactgtatttc

SEQ ID NO: 1861334 - DNA, 21 bp, Homo sapiens
gagtcttaactgtatttcagt

SEQ ID NO: 1861335 - DNA, 22 bp, Homo sapiens
gagtcttaactgtatttcagta

SEQ ID NO: 1861336 - DNA, 18 bp, Homo sapiens
gagtctttgtgtgttata

SEQ ID NO: 1861337 - DNA, 14 bp, Homo sapiens
gagtgaaacagaga

SEQ ID NO: 1861338 - DNA, 15 bp, Homo sapiens
gagtgctgcagcttt

SEQ ID NO: 1861339 - DNA, 16 bp, Homo sapiens
gagtggaaagtcacct

SEQ ID NO: 1861340 - DNA, 20 bp, Homo sapiens
gagtggaggtttatagttaa

SEQ ID NO: 1861341 - DNA, 15 bp, Homo sapiens
gagtggcctgtgagc

SEQ ID NO: 1861342 - DNA, 22 bp, Homo sapiens
gagtggcctgtgagcaagagcc

SEQ ID NO: 1861343 - DNA, 18 bp, Homo sapiens
gagttgttgtttgccaag

SEQ ID NO: 1861344 - DNA, 19 bp, Homo sapiens
gagtttacagtttgtgttt

SEQ ID NO: 1861345 - DNA, 17 bp, Homo sapiens
gataacctatatgattt

SEQ ID NO: 1861346 - DNA, 15 bp, Homo sapiens
gataatcttcggcca

SEQ ID NO: 1861347 - DNA, 18 bp, Homo sapiens
gatacccaacagtttatt

SEQ ID NO: 1861348 - DNA, 17 bp, Homo sapiens
gatagcatttttgattt

SEQ ID NO: 1861349 - DNA, 23 bp, Homo sapiens
gatagcatttttgatttatgcat

SEQ ID NO: 1861350 - DNA, 20 bp, Homo sapiens
gatataaaaggatgttacaa

SEQ ID NO: 1861351 - DNA, 17 bp, Homo sapiens
gatataatcttggcttc

SEQ ID NO: 1861352 - DNA, 13 bp, Homo sapiens
gatatatatcata

SEQ ID NO: 1861353 - DNA, 20 bp, Homo sapiens
gatattttccctttttaaaa

SEQ ID NO: 1861354 - DNA, 17 bp, Homo sapiens
gatcacatctaaagctt

SEQ ID NO: 1861355 - DNA, 20 bp, Homo sapiens
gatcagatgctgaattgaga

SEQ ID NO: 1861356 - DNA, 23 bp, Homo sapiens
gatcagatgctgaattgagaata

SEQ ID NO: 1861357 - DNA, 17 bp, Homo sapiens
gatctgtactttgtgtt

SEQ ID NO: 1861358 - DNA, 18 bp, Homo sapiens
gatctttaaatacagtca

SEQ ID NO: 1861359 - DNA, 13 bp, Homo sapiens
gatgaaataattt

SEQ ID NO: 1861360 - DNA, 15 bp, Homo sapiens
gatgacgcctctgga

SEQ ID NO: 1861361 - DNA, 23 bp, Homo sapiens
gatgacggccaggctccctgacc

SEQ ID NO: 1861362 - DNA, 15 bp, Homo sapiens
gatgatggaaacgca

SEQ ID NO: 1861363 - DNA, 19 bp, Homo sapiens
gatgatggaaacgcactta

SEQ ID NO: 1861364 - DNA, 22 bp, Homo sapiens
gatgccttccgacaccactggg

SEQ ID NO: 1861365 - DNA, 23 bp, Homo sapiens
gatgccttccgacaccactggga

SEQ ID NO: 1861366 - DNA, 22 bp, Homo sapiens
gatggagactggtcctgtgtgc

SEQ ID NO: 1861367 - DNA, 18 bp, Homo sapiens
gatggataacctatatga

SEQ ID NO: 1861368 - DNA, 12 bp, Homo sapiens
gatggcctctgg

SEQ ID NO: 1861369 - DNA, 16 bp, Homo sapiens
gatggcctctggggca

SEQ ID NO: 1861370 - DNA, 18 bp, Homo sapiens
gatggcctctggggcagg

SEQ ID NO: 1861371 - DNA, 22 bp, Homo sapiens
gatggcctctggggcaggacca

SEQ ID NO: 1861372 - DNA, 19 bp, Homo sapiens
gatggtctgcatcagcttt

SEQ ID NO: 1861373 - DNA, 22 bp, Homo sapiens
gatgtaacagtgcaagattttt

SEQ ID NO: 1861374 - DNA, 12 bp, Homo sapiens
gatgttacaagt

SEQ ID NO: 1861375 - DNA, 19 bp, Homo sapiens
gatgttacaagtttgctaa

SEQ ID NO: 1861376 - DNA, 20 bp, Homo sapiens
gattaaacagcaaagccata

SEQ ID NO: 1861377 - DNA, 16 bp, Homo sapiens
gattagggaaaatgga

SEQ ID NO: 1861378 - DNA, 15 bp, Homo sapiens
gattcttgtgattga

SEQ ID NO: 1861379 - DNA, 17 bp, Homo sapiens
gattgattcagtatctt

SEQ ID NO: 1861380 - DNA, 12 bp, Homo sapiens
gattgcactaaa

SEQ ID NO: 1861381 - DNA, 15 bp, Homo sapiens
gattggatttgctgt

SEQ ID NO: 1861382 - DNA, 20 bp, Homo sapiens
gattgtaaaatagcttgtat

SEQ ID NO: 1861383 - DNA, 21 bp, Homo sapiens
gatttatagtttgtacatgca

SEQ ID NO: 1861384 - DNA, 13 bp, Homo sapiens
gatttctctttga

SEQ ID NO: 1861385 - DNA, 16 bp, Homo sapiens
gatttgaaaaactttt

SEQ ID NO: 1861386 - DNA, 13 bp, Homo sapiens
gatttgatctttg

SEQ ID NO: 1861387 - DNA, 20 bp, Homo sapiens
gcaaaaacatatgtctgtct

SEQ ID NO: 1861388 - DNA, 10 bp, Homo sapiens
gcaaaagact

SEQ ID NO: 1861389 - DNA, 15 bp, Homo sapiens
gcaaaccctttgtat

SEQ ID NO: 1861390 - DNA, 13 bp, Homo sapiens
gcaaactgcttta

SEQ ID NO: 1861391 - DNA, 14 bp, Homo sapiens
gcaaactgctttat

SEQ ID NO: 1861392 - DNA, 12 bp, Homo sapiens
gcaaagccatat

SEQ ID NO: 1861393 - DNA, 16 bp, Homo sapiens
gcaaagccatattcta

SEQ ID NO: 1861394 - DNA, 22 bp, Homo sapiens
gcaacatttctgtatactgtaa

SEQ ID NO: 1861395 - DNA, 13 bp, Homo sapiens
gcaagaattaaaa

SEQ ID NO: 1861396 - DNA, 21 bp, Homo sapiens
gcaagaattaaaactgagtcc

SEQ ID NO: 1861397 - DNA, 21 bp, Homo sapiens
gcaagacagtggcactaaaat

SEQ ID NO: 1861398 - DNA, 13 bp, Homo sapiens
gcaagagccaggg

SEQ ID NO: 1861399 - DNA, 14 bp, Homo sapiens
gcaatatgtaaata

SEQ ID NO: 1861400 - DNA, 14 bp, Homo sapiens
gcaatgtcctgcat

SEQ ID NO: 1861401 - DNA, 10 bp, Homo sapiens
gcacataaaa

SEQ ID NO: 1861402 - DNA, 23 bp, Homo sapiens
gcacctaaaccaccagtgcccaa

SEQ ID NO: 1861403 - DNA, 14 bp, Homo sapiens
gcacctattgaatt

SEQ ID NO: 1861404 - DNA, 19 bp, Homo sapiens
gcaccttaccaactttctg

SEQ ID NO: 1861405 - DNA, 20 bp, Homo sapiens
gcaccttaccaactttctgt

SEQ ID NO: 1861406 - DNA, 16 bp, Homo sapiens
gcacgcatgtccctcc

SEQ ID NO: 1861407 - DNA, 22 bp, Homo sapiens
gttttaaatacgcactacatgt

SEQ ID NO: 1861408 - DNA, 21 bp, Homo sapiens
gttttactcttaaatcatttg

SEQ ID NO: 1861409 - DNA, 17 bp, Homo sapiens
gttttatacataaacag

SEQ ID NO: 1861410 - DNA, 15 bp, Homo sapiens
gttttatatccattt

SEQ ID NO: 1861411 - DNA, 21 bp, Homo sapiens
gttttatcgtccagtgacttt

SEQ ID NO: 1861412 - DNA, 14 bp, Homo sapiens
gttttctttgaatg

SEQ ID NO: 1861413 - DNA, 14 bp, Homo sapiens
gtttttcttacata

SEQ ID NO: 1861414 - DNA, 23 bp, Homo sapiens
gttttttactttggtttagtctt

SEQ ID NO: 1861415 - DNA, 22 bp, Homo sapiens
gttttttttttaagtgcaacat

SEQ ID NO: 1861416 - DNA, 15 bp, Homo sapiens
taaaaaaacacaaaa

SEQ ID NO: 1861417 - DNA, 18 bp, Homo sapiens
taaaaaaactgaaggttt

SEQ ID NO: 1861418 - DNA, 17 bp, Homo sapiens
taaaaaataccattgaa

SEQ ID NO: 1861419 - DNA, 19 bp, Homo sapiens
taaaaaataccattgaaat

SEQ ID NO: 1861420 - DNA, 20 bp, Homo sapiens
taaaaaataccattgaaatc

SEQ ID NO: 1861421 - DNA, 13 bp, Homo sapiens
taaaaaatatttt

SEQ ID NO: 1861422 - DNA, 19 bp, Homo sapiens
taaaaaatattttaagaaa

SEQ ID NO: 1861423 - DNA, 11 bp, Homo sapiens
taaaaactgtg

SEQ ID NO: 1861424 - DNA, 14 bp, Homo sapiens
taaaaactgtgtat

SEQ ID NO: 1861425 - DNA, 15 bp, Homo sapiens
taaaaactttaaaga

SEQ ID NO: 1861426 - DNA, 15 bp, Homo sapiens
taaaaagtgaacttt

SEQ ID NO: 1861427 - DNA, 20 bp, Homo sapiens
taaaaagtgaacttttgtaa

SEQ ID NO: 1861428 - DNA, 19 bp, Homo sapiens
taaaaatatggaacttcta

SEQ ID NO: 1861429 - DNA, 11 bp, Homo sapiens
taaaaatcttg

SEQ ID NO: 1861430 - DNA, 18 bp, Homo sapiens
taaaacgtatagtcaata

SEQ ID NO: 1861431 - DNA, 13 bp, Homo sapiens
taaaactttaaaa

SEQ ID NO: 1861432 - DNA, 19 bp, Homo sapiens
taaaactttaaaaggcaac

SEQ ID NO: 1861433 - DNA, 13 bp, Homo sapiens
taaaagaagagag

SEQ ID NO: 1861434 - DNA, 12 bp, Homo sapiens
taaaaggatgtt

SEQ ID NO: 1861435 - DNA, 15 bp, Homo sapiens
taaaaggatgttaca

SEQ ID NO: 1861436 - DNA, 21 bp, Homo sapiens
taaaaggcaactcaaagatga

SEQ ID NO: 1861437 - DNA, 14 bp, Homo sapiens
taaaagtcacataa

SEQ ID NO: 1861438 - DNA, 18 bp, Homo sapiens
taaaagtgcatttaagga

SEQ ID NO: 1861439 - DNA, 15 bp, Homo sapiens
taaaagttataataa

SEQ ID NO: 1861440 - DNA, 16 bp, Homo sapiens
taaaagttataataac

SEQ ID NO: 1861441 - DNA, 13 bp, Homo sapiens
taaaatatatgtt

SEQ ID NO: 1861442 - DNA, 12 bp, Homo sapiens
taaaatattatt

SEQ ID NO: 1861443 - DNA, 15 bp, Homo sapiens
taaaatgattgtaaa

SEQ ID NO: 1861444 - DNA, 17 bp, Homo sapiens
taaaatgattgtaaaat

SEQ ID NO: 1861445 - DNA, 18 bp, Homo sapiens
taaaatgattgtaaaata

SEQ ID NO: 1861446 - DNA, 22 bp, Homo sapiens
taaaatgattgtaaaatagctt

SEQ ID NO: 1861447 - DNA, 23 bp, Homo sapiens
taaaatgcggcactatttctgaa

SEQ ID NO: 1861448 - DNA, 17 bp, Homo sapiens
taaaatgtttaattcat

SEQ ID NO: 1861449 - DNA, 19 bp, Homo sapiens
taaaattgcagtttcatgt

SEQ ID NO: 1861450 - DNA, 20 bp, Homo sapiens
taaaattgcagtttcatgta

SEQ ID NO: 1861451 - DNA, 23 bp, Homo sapiens
taaacaaaatagaagctgtagta

SEQ ID NO: 1861452 - DNA, 17 bp, Homo sapiens
taaacaaggtaattttt

SEQ ID NO: 1861453 - DNA, 21 bp, Homo sapiens
taaacagttttggagaaaaat

SEQ ID NO: 1861454 - DNA, 22 bp, Homo sapiens
taaacgtattttgatcagtgtt

SEQ ID NO: 1861455 - DNA, 13 bp, Homo sapiens
taaactatcagtt

SEQ ID NO: 1861456 - DNA, 15 bp, Homo sapiens
taaactcaaaactta

SEQ ID NO: 1861457 - DNA, 20 bp, Homo sapiens
taaactcaaaacttaacata

SEQ ID NO: 1861458 - DNA, 14 bp, Homo sapiens
taaactctaaagat

SEQ ID NO: 1861459 - DNA, 14 bp, Homo sapiens
taaactctgaataa

SEQ ID NO: 1861460 - DNA, 11 bp, Homo sapiens
taaagaaagtc

SEQ ID NO: 1861461 - DNA, 21 bp, Homo sapiens
taaagaaagtcgaattaatag

SEQ ID NO: 1861462 - DNA, 20 bp, Homo sapiens
taaagccttaagcacaatta

SEQ ID NO: 1861463 - DNA, 20 bp, Homo sapiens
taaagcttacccttggtttg

SEQ ID NO: 1861464 - DNA, 13 bp, Homo sapiens
taaagcttgattt

SEQ ID NO: 1861465 - DNA, 18 bp, Homo sapiens
taaagcttgatttgatct

SEQ ID NO: 1861466 - DNA, 23 bp, Homo sapiens
taaagcttgatttgatctttgtt

SEQ ID NO: 1861467 - DNA, 16 bp, Homo sapiens
taaagctttatctttg

SEQ ID NO: 1861468 - DNA, 22 bp, Homo sapiens
taaagtatgtaaacaggagaca

SEQ ID NO: 1861469 - DNA, 16 bp, Homo sapiens
taaagtcagatttgta

SEQ ID NO: 1861470 - DNA, 17 bp, Homo sapiens
taaagttttgcaacaat

SEQ ID NO: 1861471 - DNA, 16 bp, Homo sapiens
taaatcaattcattgt

SEQ ID NO: 1861472 - DNA, 17 bp, Homo sapiens
taaatcaattcattgtg

SEQ ID NO: 1861473 - DNA, 15 bp, Homo sapiens
taaatcatttggtta

SEQ ID NO: 1861474 - DNA, 14 bp, Homo sapiens
taaatctctaatat

SEQ ID NO: 1861475 - DNA, 17 bp, Homo sapiens
taaatgagacacataca

SEQ ID NO: 1861476 - DNA, 16 bp, Homo sapiens
taaatgccaaaatgta

SEQ ID NO: 1861477 - DNA, 19 bp, Homo sapiens
taaatgccaaaatgtactt

SEQ ID NO: 1861478 - DNA, 15 bp, Homo sapiens
taaatgccttggttt

SEQ ID NO: 1861479 - DNA, 16 bp, Homo sapiens
taaatgccttggtttg

SEQ ID NO: 1861480 - DNA, 16 bp, Homo sapiens
taaatgctcatacaca

SEQ ID NO: 1861481 - DNA, 21 bp, Homo sapiens
taaatggtttctcattaaact

SEQ ID NO: 1861482 - DNA, 17 bp, Homo sapiens
taaatttttgaaaaata

SEQ ID NO: 1861483 - DNA, 20 bp, Homo sapiens
taacaatatgattgcactaa

SEQ ID NO: 1861484 - DNA, 13 bp, Homo sapiens
taacaatttcctt

SEQ ID NO: 1861485 - DNA, 17 bp, Homo sapiens
taacacaagtcctgtga

SEQ ID NO: 1861486 - DNA, 12 bp, Homo sapiens
taacactgttgg

SEQ ID NO: 1861487 - DNA, 14 bp, Homo sapiens
taacatatttacta

SEQ ID NO: 1861488 - DNA, 23 bp, Homo sapiens
taacatatttactaagccacaag

SEQ ID NO: 1861489 - DNA, 22 bp, Homo sapiens
taaccaccctagctttatattt

SEQ ID NO: 1861490 - DNA, 15 bp, Homo sapiens
taaccagctgtaaca

SEQ ID NO: 1861491 - DNA, 20 bp, Homo sapiens
taacgaacgttttaaagctt

SEQ ID NO: 1861492 - DNA, 20 bp, Homo sapiens
taacgccctatttttgcaat

SEQ ID NO: 1861493 - DNA, 12 bp, Homo sapiens
taactaaatgct

SEQ ID NO: 1861494 - DNA, 14 bp, Homo sapiens
taactaaatgctca

SEQ ID NO: 1861495 - DNA, 18 bp, Homo sapiens
taactacatattgaatag

SEQ ID NO: 1861496 - DNA, 15 bp, Homo sapiens
taactacatctgcct

SEQ ID NO: 1861497 - DNA, 13 bp, Homo sapiens
taactgaactgtt

SEQ ID NO: 1861498 - DNA, 16 bp, Homo sapiens
taactgaactgtttgg

SEQ ID NO: 1861499 - DNA, 15 bp, Homo sapiens
taactgactctgtta

SEQ ID NO: 1861500 - DNA, 16 bp, Homo sapiens
taactgactctgttat

SEQ ID NO: 1861501 - DNA, 17 bp, Homo sapiens
taactggtgatatatct

SEQ ID NO: 1861502 - DNA, 17 bp, Homo sapiens
taactgtatttcagtat

SEQ ID NO: 1861503 - DNA, 16 bp, Homo sapiens
taactttgcttgatta

SEQ ID NO: 1861504 - DNA, 22 bp, Homo sapiens
taactttgcttgattaaacagc

SEQ ID NO: 1861505 - DNA, 21 bp, Homo sapiens
taagaaagccaccttgttaca

SEQ ID NO: 1861506 - DNA, 15 bp, Homo sapiens
taagatgatgttaaa

SEQ ID NO: 1861507 - DNA, 23 bp, Homo sapiens
taagcaagacagtggcactaaaa

SEQ ID NO: 1861508 - DNA, 21 bp, Homo sapiens
taagcactttttaaaaaactt

SEQ ID NO: 1861509 - DNA, 18 bp, Homo sapiens
taagcagattacaataaa

SEQ ID NO: 1861510 - DNA, 13 bp, Homo sapiens
taaggatcttttg

SEQ ID NO: 1861511 - DNA, 17 bp, Homo sapiens
taaggatcttttgtaaa

SEQ ID NO: 1861512 - DNA, 19 bp, Homo sapiens
taaggtataaggatctttt

SEQ ID NO: 1861513 - DNA, 17 bp, Homo sapiens
ttggagtgctgcagctt

SEQ ID NO: 1861514 - DNA, 13 bp, Homo sapiens
ttggatttgctgt

SEQ ID NO: 1861515 - DNA, 14 bp, Homo sapiens
ttggcaacagaagc

SEQ ID NO: 1861516 - DNA, 17 bp, Homo sapiens
ttggcataatttgtctt

SEQ ID NO: 1861517 - DNA, 16 bp, Homo sapiens
ttggcttcttaaaaac

SEQ ID NO: 1861518 - DNA, 23 bp, Homo sapiens
ttggcttcttaaaaactgtgtat

SEQ ID NO: 1861519 - DNA, 15 bp, Homo sapiens
ttggcttgctgttta

SEQ ID NO: 1861520 - DNA, 19 bp, Homo sapiens
ttgggagacaattagcaga

SEQ ID NO: 1861521 - DNA, 22 bp, Homo sapiens
ttgggagacaattagcagaatg

SEQ ID NO: 1861522 - DNA, 12 bp, Homo sapiens
ttggtaaatttt

SEQ ID NO: 1861523 - DNA, 18 bp, Homo sapiens
ttggtacagttcataatt

SEQ ID NO: 1861524 - DNA, 21 bp, Homo sapiens
ttggtacagttcataattcac

SEQ ID NO: 1861525 - DNA, 22 bp, Homo sapiens
ttggtacagttcataattcacc

SEQ ID NO: 1861526 - DNA, 23 bp, Homo sapiens
ttggtacagttcataattcacca

SEQ ID NO: 1861527 - DNA, 22 bp, Homo sapiens
ttggtcgagtctttgtgtgtta

SEQ ID NO: 1861528 - DNA, 23 bp, Homo sapiens
ttggtcgagtctttgtgtgttat

SEQ ID NO: 1861529 - DNA, 19 bp, Homo sapiens
ttggtttaaaagtcacata

SEQ ID NO: 1861530 - DNA, 17 bp, Homo sapiens
ttggtttggtacagttc

SEQ ID NO: 1861531 - DNA, 21 bp, Homo sapiens
ttgtaaaatagcttgtatagt

SEQ ID NO: 1861532 - DNA, 21 bp, Homo sapiens
ttgtaattaataatagattgt

SEQ ID NO: 1861533 - DNA, 14 bp, Homo sapiens
ttgtaatttgaatt

SEQ ID NO: 1861534 - DNA, 19 bp, Homo sapiens
ttgtacttttctggttcca

SEQ ID NO: 1861535 - DNA, 18 bp, Homo sapiens
ttgtagaataaatggttt

SEQ ID NO: 1861536 - DNA, 12 bp, Homo sapiens
ttgtagccctgg

SEQ ID NO: 1861537 - DNA, 20 bp, Homo sapiens
ttgtaggggtcaaagaaatg

SEQ ID NO: 1861538 - DNA, 16 bp, Homo sapiens
ttgtataaaaaggaaa

SEQ ID NO: 1861539 - DNA, 14 bp, Homo sapiens
ttgtatatttgcaa

SEQ ID NO: 1861540 - DNA, 15 bp, Homo sapiens
ttgtctaaacaaggt

SEQ ID NO: 1861541 - DNA, 22 bp, Homo sapiens
ttgtcttgaaacctttctactt

SEQ ID NO: 1861542 - DNA, 16 bp, Homo sapiens
ttgtgccttttatagc

SEQ ID NO: 1861543 - DNA, 19 bp, Homo sapiens
ttgtgtaatagaaaactga

SEQ ID NO: 1861544 - DNA, 21 bp, Homo sapiens
ttgtgtaatagaaaactgaaa

SEQ ID NO: 1861545 - DNA, 18 bp, Homo sapiens
ttgtgtatgagactgtgt

SEQ ID NO: 1861546 - DNA, 17 bp, Homo sapiens
ttgtgtgttatattcca

SEQ ID NO: 1861547 - DNA, 13 bp, Homo sapiens
ttgtgttggcttt

SEQ ID NO: 1861548 - DNA, 23 bp, Homo sapiens
ttgtgtttagctacctttttata

SEQ ID NO: 1861549 - DNA, 15 bp, Homo sapiens
ttgtgttttaaaaaa

SEQ ID NO: 1861550 - DNA, 18 bp, Homo sapiens
ttgtgttttaaaaaaact

SEQ ID NO: 1861551 - DNA, 21 bp, Homo sapiens
ttgtgttttaaaaaaactgaa

SEQ ID NO: 1861552 - DNA, 22 bp, Homo sapiens
ttgtgttttaaaaaaactgaag

SEQ ID NO: 1861553 - DNA, 22 bp, Homo sapiens
ttgttagtttcttttattttca

SEQ ID NO: 1861554 - DNA, 14 bp, Homo sapiens
ttgttatcatttaa

SEQ ID NO: 1861555 - DNA, 21 bp, Homo sapiens
ttgttattaaaaaaacacaaa

SEQ ID NO: 1861556 - DNA, 14 bp, Homo sapiens
ttgttattaatgtt

SEQ ID NO: 1861557 - DNA, 18 bp, Homo sapiens
ttgttattaatgtttctt

SEQ ID NO: 1861558 - DNA, 12 bp, Homo sapiens
ttgttgatattt

SEQ ID NO: 1861559 - DNA, 22 bp, Homo sapiens
ttgttgatattttcccttttta

SEQ ID NO: 1861560 - DNA, 23 bp, Homo sapiens
ttgttgatattttccctttttaa

SEQ ID NO: 1861561 - DNA, 16 bp, Homo sapiens
ttgtttaaatgccaaa

SEQ ID NO: 1861562 - DNA, 18 bp, Homo sapiens
ttgtttgcttaatttcct

SEQ ID NO: 1861563 - DNA, 13 bp, Homo sapiens
tttaaaaaaactg

SEQ ID NO: 1861564 - DNA, 17 bp, Homo sapiens
tttaaaaaaactgaagg

SEQ ID NO: 1861565 - DNA, 16 bp, Homo sapiens
tttaaaaaactttcta

SEQ ID NO: 1861566 - DNA, 16 bp, Homo sapiens
tttaaaaaataccatt

SEQ ID NO: 1861567 - DNA, 20 bp, Homo sapiens
tttaaaaaataccattgaaa

SEQ ID NO: 1861568 - DNA, 20 bp, Homo sapiens
tttaaaaaatattttaagaa

SEQ ID NO: 1861569 - DNA, 22 bp, Homo sapiens
tttaaaaaatattttaagaaag

SEQ ID NO: 1861570 - DNA, 20 bp, Homo sapiens
tttaaaaaattaaaaatgaa

SEQ ID NO: 1861571 - DNA, 13 bp, Homo sapiens
tttaaaaggcaac

SEQ ID NO: 1861572 - DNA, 17 bp, Homo sapiens
tttaaaaggcaactcaa

SEQ ID NO: 1861573 - DNA, 17 bp, Homo sapiens
tttaaaatgaagcaatt

SEQ ID NO: 1861574 - DNA, 20 bp, Homo sapiens
tttaaacaaaatttcacagt

SEQ ID NO: 1861575 - DNA, 14 bp, Homo sapiens
tttaaagtaaactt

SEQ ID NO: 1861576 - DNA, 15 bp, Homo sapiens
tttaaagtaaacttg

SEQ ID NO: 1861577 - DNA, 20 bp, Homo sapiens
tttaaagtaaacttgtgtat

SEQ ID NO: 1861578 - DNA, 11 bp, Homo sapiens
tttaagaaaga

SEQ ID NO: 1861579 - DNA, 12 bp, Homo sapiens
tttaagaaagag

SEQ ID NO: 1861580 - DNA, 13 bp, Homo sapiens
tttaagaaagaga

SEQ ID NO: 1861581 - DNA, 13 bp, Homo sapiens
tttaagtttgaaa

SEQ ID NO: 1861582 - DNA, 16 bp, Homo sapiens
tttaataaaataataa

SEQ ID NO: 1861583 - DNA, 19 bp, Homo sapiens
tttaatggactgtgaattt

SEQ ID NO: 1861584 - DNA, 23 bp, Homo sapiens
tttaattaaaaactttaaagata

SEQ ID NO: 1861585 - DNA, 14 bp, Homo sapiens
tttaatttccaaaa

SEQ ID NO: 1861586 - DNA, 16 bp, Homo sapiens
tttacaacctagaagt

SEQ ID NO: 1861587 - DNA, 20 bp, Homo sapiens
tttacaagacaacattgtaa

SEQ ID NO: 1861588 - DNA, 15 bp, Homo sapiens
tttacaagtgtatat

SEQ ID NO: 1861589 - DNA, 13 bp, Homo sapiens
tttacagtctctg

SEQ ID NO: 1861590 - DNA, 15 bp, Homo sapiens
tttacattttagggt

SEQ ID NO: 1861591 - DNA, 19 bp, Homo sapiens
tttaccattattttacagt

SEQ ID NO: 1861592 - DNA, 15 bp, Homo sapiens
tttactcttaaatca

SEQ ID NO: 1861593 - DNA, 16 bp, Homo sapiens
tttactgctctagaaa

SEQ ID NO: 1861594 - DNA, 23 bp, Homo sapiens
tttagactgtggccatatatgct

SEQ ID NO: 1861595 - DNA, 19 bp, Homo sapiens
tttagagcgtttggttaaa

SEQ ID NO: 1861596 - DNA, 12 bp, Homo sapiens
tttagctacctt

SEQ ID NO: 1861597 - DNA, 19 bp, Homo sapiens
tttagctacctttttatat

SEQ ID NO: 1861598 - DNA, 15 bp, Homo sapiens
ttttgatcagtgtta

SEQ ID NO: 1861599 - DNA, 15 bp, Homo sapiens
ttttgatttatgcat

SEQ ID NO: 1861600 - DNA, 17 bp, Homo sapiens
ttttgcaatggctatat

SEQ ID NO: 1861601 - DNA, 22 bp, Homo sapiens
ttttggtaaatttttgaaaaat

SEQ ID NO: 1861602 - DNA, 23 bp, Homo sapiens
ttttgtaggggtcaaagaaatgc

SEQ ID NO: 1861603 - DNA, 12 bp, Homo sapiens
ttttgtataaaa

SEQ ID NO: 1861604 - DNA, 15 bp, Homo sapiens
ttttgtataaaaagg

SEQ ID NO: 1861605 - DNA, 22 bp, Homo sapiens
ttttgttattaaaaaaacacaa

SEQ ID NO: 1861606 - DNA, 17 bp, Homo sapiens
ttttgttcttggtctcc

SEQ ID NO: 1861607 - DNA, 13 bp, Homo sapiens
tttttaaaaaact

SEQ ID NO: 1861608 - DNA, 14 bp, Homo sapiens
tttttaaaaaactt

SEQ ID NO: 1861609 - DNA, 12 bp, Homo sapiens
tttttaaaaggt

SEQ ID NO: 1861610 - DNA, 13 bp, Homo sapiens
tttttaattaaaa

SEQ ID NO: 1861611 - DNA, 20 bp, Homo sapiens
tttttagatgtgctgctttg

SEQ ID NO: 1861612 - DNA, 21 bp, Homo sapiens
tttttccaaattattaattgt

SEQ ID NO: 1861613 - DNA, 14 bp, Homo sapiens
tttttgaaaaatat

SEQ ID NO: 1861614 - DNA, 14 bp, Homo sapiens
tttttggtaaattt

SEQ ID NO: 1861615 - DNA, 12 bp, Homo sapiens
ttttttaaagta

SEQ ID NO: 1861616 - DNA, 12 bp, Homo sapiens
ttttttaagtga

SEQ ID NO: 1861617 - DNA, 12 bp, Homo sapiens
ttttttactttg

SEQ ID NO: 1861618 - DNA, 16 bp, Homo sapiens
ttttttccagagttgt

SEQ ID NO: 1861619 - DNA, 13 bp, Homo sapiens
ttttttgaaatca

SEQ ID NO: 1861620 - DNA, 14 bp, Homo sapiens
ttttttggtaatta

SEQ ID NO: 1861621 - DNA, 13 bp, Homo sapiens
tttttttccaaat

SEQ ID NO: 1861622 - DNA, 13 bp, Homo sapiens
ttttttttccaaa

SEQ ID NO: 1861623 - DNA, 13 bp, Homo sapiens
ttttttttttcca

SEQ ID NO: 1861624 - DNA, 19 bp, Homo sapiens
tataatctcctctgctcat

SEQ ID NO: 1861625 - DNA, 12 bp, Homo sapiens
tataatgctttc

SEQ ID NO: 1861626 - DNA, 22 bp, Homo sapiens
tataatttaaagaaacactaaa

SEQ ID NO: 1861627 - DNA, 14 bp, Homo sapiens
tatacataaacagt

SEQ ID NO: 1861628 - DNA, 19 bp, Homo sapiens
tatacctgccttttaagtt

SEQ ID NO: 1861629 - DNA, 20 bp, Homo sapiens
tatactgtaaaagttataat

SEQ ID NO: 1861630 - DNA, 22 bp, Homo sapiens
tatactttttttgttatagatt

SEQ ID NO: 1861631 - DNA, 11 bp, Homo sapiens
tatagctatta

SEQ ID NO: 1861632 - DNA, 22 bp, Homo sapiens
tataggtaacgtgattgattca

SEQ ID NO: 1861633 - DNA, 23 bp, Homo sapiens
tataggtaacgtgattgattcag

SEQ ID NO: 1861634 - DNA, 21 bp, Homo sapiens
tatagtagaaagacatctgcc

SEQ ID NO: 1861635 - DNA, 11 bp, Homo sapiens
tatagtcaata

SEQ ID NO: 1861636 - DNA, 17 bp, Homo sapiens
tatataatcatgctcat

SEQ ID NO: 1861637 - DNA, 22 bp, Homo sapiens
tatatatcatattggtattcac

SEQ ID NO: 1861638 - DNA, 15 bp, Homo sapiens
tatatattgaaagtt

SEQ ID NO: 1861639 - DNA, 21 bp, Homo sapiens
tatatattgaaagttgctttt

SEQ ID NO: 1861640 - DNA, 18 bp, Homo sapiens
tatatcagaaaagggaag

SEQ ID NO: 1861641 - DNA, 16 bp, Homo sapiens
tatatctgtttgtata

SEQ ID NO: 1861642 - DNA, 23 bp, Homo sapiens
tatatgctgtatttctttgtaga

SEQ ID NO: 1861643 - DNA, 17 bp, Homo sapiens
tatatgttctgcaagaa

SEQ ID NO: 1861644 - DNA, 18 bp, Homo sapiens
tatatgttctgcaagaat

SEQ ID NO: 1861645 - DNA, 14 bp, Homo sapiens
tatattccaaggaa

SEQ ID NO: 1861646 - DNA, 17 bp, Homo sapiens
tatattgaaagttgctt

SEQ ID NO: 1861647 - DNA, 19 bp, Homo sapiens
tatatttaaaaaattaaaa

SEQ ID NO: 1861648 - DNA, 21 bp, Homo sapiens
tatatttgcaaaccctttgta

SEQ ID NO: 1861649 - DNA, 13 bp, Homo sapiens
tatatttttatat

SEQ ID NO: 1861650 - DNA, 20 bp, Homo sapiens
tatatttttatatttagtta

SEQ ID NO: 1861651 - DNA, 14 bp, Homo sapiens
tatcagaagaccac

SEQ ID NO: 1861652 - DNA, 18 bp, Homo sapiens
tatcatttttgtataaaa

SEQ ID NO: 1861653 - DNA, 20 bp, Homo sapiens
tatcatttttgtataaaaag

SEQ ID NO: 1861654 - DNA, 14 bp, Homo sapiens
tatcccagaaatta

SEQ ID NO: 1861655 - DNA, 19 bp, Homo sapiens
tatcccccccctgtatagt

SEQ ID NO: 1861656 - DNA, 15 bp, Homo sapiens
tatcctacaacaaga

SEQ ID NO: 1861657 - DNA, 16 bp, Homo sapiens
tatcgttcgcttgttt

SEQ ID NO: 1861658 - DNA, 12 bp, Homo sapiens
tatctaatttac

SEQ ID NO: 1861659 - DNA, 14 bp, Homo sapiens
tatctaatttacca

SEQ ID NO: 1861660 - DNA, 20 bp, Homo sapiens
tatctagcatttatttctct

SEQ ID NO: 1861661 - DNA, 20 bp, Homo sapiens
tatctgcttcagtggagaat

SEQ ID NO: 1861662 - DNA, 20 bp, Homo sapiens
tatcttagagtttacagttt

SEQ ID NO: 1861663 - DNA, 19 bp, Homo sapiens
tatctttatgcaaaaacat

SEQ ID NO: 1861664 - DNA, 19 bp, Homo sapiens
tatgaaaatcctatatctg

SEQ ID NO: 1861665 - DNA, 22 bp, Homo sapiens
tatgaaaatcctatatctgttt

SEQ ID NO: 1861666 - DNA, 17 bp, Homo sapiens
tatgaagtataaatctg

SEQ ID NO: 1861667 - DNA, 19 bp, Homo sapiens
tatgagactgtgtttctag

SEQ ID NO: 1861668 - DNA, 16 bp, Homo sapiens
tatgagatttactgct

SEQ ID NO: 1861669 - DNA, 12 bp, Homo sapiens
tatgattgcact

SEQ ID NO: 1861670 - DNA, 19 bp, Homo sapiens
tatgattgcactaaataaa

SEQ ID NO: 1861671 - DNA, 19 bp, Homo sapiens
tatgattggttcagttttt

SEQ ID NO: 1861672 - DNA, 14 bp, Homo sapiens
tatgcaaaaacata

SEQ ID NO: 1861673 - DNA, 18 bp, Homo sapiens
tatgccgtgtagtttctg

SEQ ID NO: 1861674 - DNA, 18 bp, Homo sapiens
tatgctgtatttctttgt

SEQ ID NO: 1861675 - DNA, 13 bp, Homo sapiens
tatggaacttcta

SEQ ID NO: 1861676 - DNA, 20 bp, Homo sapiens
tatggaacttctaatatatt

SEQ ID NO: 1861677 - DNA, 19 bp, Homo sapiens
tatggagactttgctgtta

SEQ ID NO: 1861678 - DNA, 21 bp, Homo sapiens
tatggagactttgctgttact

SEQ ID NO: 1861679 - DNA, 19 bp, Homo sapiens
tatggctatctatacctgc

SEQ ID NO: 1861680 - DNA, 14 bp, Homo sapiens
tatgtaaagtatgt

SEQ ID NO: 1861681 - DNA, 18 bp, Homo sapiens
tatgtaaagtatgtaaac

SEQ ID NO: 1861682 - DNA, 12 bp, Homo sapiens
tatgtatctttg

SEQ ID NO: 1861683 - DNA, 13 bp, Homo sapiens
tatgtatctttgg

SEQ ID NO: 1861684 - DNA, 16 bp, Homo sapiens
tatgtccttcagctga

SEQ ID NO: 1861685 - DNA, 13 bp, Homo sapiens
tatgtctgtcttt

SEQ ID NO: 1861686 - DNA, 17 bp, Homo sapiens
tatgtctgtctttgcaa

SEQ ID NO: 1861687 - DNA, 20 bp, Homo sapiens
tatgtgagaaatcagaattg

SEQ ID NO: 1861688 - DNA, 22 bp, Homo sapiens
tatgttctgcaagaattaaaac

SEQ ID NO: 1861689 - DNA, 18 bp, Homo sapiens
tattaaaaaaacacaaaa

SEQ ID NO: 1861690 - DNA, 17 bp, Homo sapiens
tattaaaatgattgtaa

SEQ ID NO: 1861691 - DNA, 19 bp, Homo sapiens
tattaatataaccataaat

SEQ ID NO: 1861692 - DNA, 21 bp, Homo sapiens
tattaatggaaacatgctgta

SEQ ID NO: 1861693 - DNA, 19 bp, Homo sapiens
tattaattgtcctgtgtct

SEQ ID NO: 1861694 - DNA, 14 bp, Homo sapiens
tattataattgttg

SEQ ID NO: 1861695 - DNA, 17 bp, Homo sapiens
tattataattgttgata

SEQ ID NO: 1861696 - DNA, 19 bp, Homo sapiens
tattatttttttaaacaaa

SEQ ID NO: 1861697 - DNA, 14 bp, Homo sapiens
tattcagctagaat

SEQ ID NO: 1861698 - DNA, 19 bp, Homo sapiens
tattcagctagaatttctg

SEQ ID NO: 1861699 - DNA, 15 bp, Homo sapiens
tattcaggctttagg

SEQ ID NO: 1861700 - DNA, 16 bp, Homo sapiens
tattccaaggaaaatt

SEQ ID NO: 1861701 - DNA, 20 bp, Homo sapiens
tattccaaggaaaattgaaa

SEQ ID NO: 1861702 - DNA, 15 bp, Homo sapiens
tattctaaattcact

SEQ ID NO: 1861703 - DNA, 14 bp, Homo sapiens
tattgctaaaagtg

SEQ ID NO: 1861704 - DNA, 20 bp, Homo sapiens
tattgtacagctgtttaaga

SEQ ID NO: 1861705 - DNA, 16 bp, Homo sapiens
tattgtataaactatc

SEQ ID NO: 1861706 - DNA, 20 bp, Homo sapiens
tattgtgttggctttacaaa

SEQ ID NO: 1861707 - DNA, 23 bp, Homo sapiens
tatttagttacgtataatgcttt

SEQ ID NO: 1861708 - DNA, 19 bp, Homo sapiens
tatttctctggcaaacttt

SEQ ID NO: 1861709 - DNA, 13 bp, Homo sapiens
tatttgcaaaccc

SEQ ID NO: 1861710 - DNA, 19 bp, Homo sapiens
tatttgcaaaccctttgta

SEQ ID NO: 1861711 - DNA, 13 bp, Homo sapiens
tatttgtgtaata

SEQ ID NO: 1861712 - DNA, 17 bp, Homo sapiens
tatttgtgtaatagaaa

SEQ ID NO: 1861713 - DNA, 22 bp, Homo sapiens
tatttgtgtgttcactaaactc

SEQ ID NO: 1861714 - DNA, 12 bp, Homo sapiens
tattttaaacaa

SEQ ID NO: 1861715 - DNA, 12 bp, Homo sapiens
tattttaagaaa

SEQ ID NO: 1861716 - DNA, 13 bp, Homo sapiens
tattttcacagat

SEQ ID NO: 1861717 - DNA, 17 bp, Homo sapiens
tattttcagtattttgg

SEQ ID NO: 1861718 - DNA, 15 bp, Homo sapiens
tattttcccttttta

SEQ ID NO: 1861719 - DNA, 12 bp, Homo sapiens
tatttttattat

SEQ ID NO: 1861720 - DNA, 13 bp, Homo sapiens
tatttttgaaaga

SEQ ID NO: 1861721 - DNA, 17 bp, Homo sapiens
tattttttattgttttc

SEQ ID NO: 1861722 - DNA, 15 bp, Homo sapiens
tcaaaccttaagata

SEQ ID NO: 1861723 - DNA, 16 bp, Homo sapiens
tcaaagaaatgctgat

SEQ ID NO: 1861724 - DNA, 16 bp, Homo sapiens
tcaaagaaggatggca

SEQ ID NO: 1861725 - DNA, 12 bp, Homo sapiens
tcaaatgaactt

SEQ ID NO: 1861726 - DNA, 13 bp, Homo sapiens
tcaaatgaacttt

SEQ ID NO: 1861727 - DNA, 18 bp, Homo sapiens
tcaaatgaacttttacag

SEQ ID NO: 1861728 - DNA, 21 bp, Homo sapiens
tcaaatgaacttttacagaat

SEQ ID NO: 1861729 - DNA, 17 bp, Homo sapiens
tcaacacttttctccag

SEQ ID NO: 1861730 - DNA, 22 bp, Homo sapiens
tcaacatggctacttgctttga

SEQ ID NO: 1861731 - DNA, 17 bp, Homo sapiens
tcaagtaataaaaagag

SEQ ID NO: 1861732 - DNA, 17 bp, Homo sapiens
tcaagttattgtacagc

SEQ ID NO: 1861733 - DNA, 16 bp, Homo sapiens
tcaataactctgattt

SEQ ID NO: 1861734 - DNA, 19 bp, Homo sapiens
tcaataactctgattttga

SEQ ID NO: 1861735 - DNA, 18 bp, Homo sapiens
tcaatatggggcattaat

SEQ ID NO: 1861736 - DNA, 15 bp, Homo sapiens
tcaatcatctgtgtg

SEQ ID NO: 1861737 - DNA, 16 bp, Homo sapiens
tcaatcatctgtgtga

SEQ ID NO: 1861738 - DNA, 20 bp, Homo sapiens
tcaatttggagcattaacta

SEQ ID NO: 1861739 - DNA, 13 bp, Homo sapiens
tgcatgtaatcaa

SEQ ID NO: 1861740 - DNA, 18 bp, Homo sapiens
tgccaagctaatctgcct

SEQ ID NO: 1861741 - DNA, 20 bp, Homo sapiens
tgccatagagtttaacacaa

SEQ ID NO: 1861742 - DNA, 21 bp, Homo sapiens
tgccatagagtttaacacaag

SEQ ID NO: 1861743 - DNA, 15 bp, Homo sapiens
tgcccaagtggctct

SEQ ID NO: 1861744 - DNA, 19 bp, Homo sapiens
tgcccaagtggctcttggg

SEQ ID NO: 1861745 - DNA, 22 bp, Homo sapiens
tgcccaagtggctcttgggaca

SEQ ID NO: 1861746 - DNA, 16 bp, Homo sapiens
tgcccaatcctccctg

SEQ ID NO: 1861747 - DNA, 20 bp, Homo sapiens
tgcccactcccccaggagca

SEQ ID NO: 1861748 - DNA, 19 bp, Homo sapiens
tgcccattgtttttctgat

SEQ ID NO: 1861749 - DNA, 17 bp, Homo sapiens
tgccctgccttgctgcc

SEQ ID NO: 1861750 - DNA, 12 bp, Homo sapiens
tgccctggggca

SEQ ID NO: 1861751 - DNA, 15 bp, Homo sapiens
tgcctggttttattt

SEQ ID NO: 1861752 - DNA, 17 bp, Homo sapiens
tgcctggttttatttat

SEQ ID NO: 1861753 - DNA, 13 bp, Homo sapiens
tgccttaaagaaa

SEQ ID NO: 1861754 - DNA, 15 bp, Homo sapiens
tgccttaaagaaagt

SEQ ID NO: 1861755 - DNA, 21 bp, Homo sapiens
tgccttatgcaaggggaaacc

SEQ ID NO: 1861756 - DNA, 15 bp, Homo sapiens
tgccttcaccctgaa

SEQ ID NO: 1861757 - DNA, 17 bp, Homo sapiens
tgccttcaccctgaaca

SEQ ID NO: 1861758 - DNA, 16 bp, Homo sapiens
tgccttccgacaccac

SEQ ID NO: 1861759 - DNA, 20 bp, Homo sapiens
tgccttccgacaccactggg

SEQ ID NO: 1861760 - DNA, 21 bp, Homo sapiens
tgccttgatgttgtgttgtta

SEQ ID NO: 1861761 - DNA, 13 bp, Homo sapiens
tgccttgctgcct

SEQ ID NO: 1861762 - DNA, 14 bp, Homo sapiens
tgccttgctgcctt

SEQ ID NO: 1861763 - DNA, 18 bp, Homo sapiens
tgccttgctgccttcacc

SEQ ID NO: 1861764 - DNA, 15 bp, Homo sapiens
tgccttttaagtttg

SEQ ID NO: 1861765 - DNA, 17 bp, Homo sapiens
tgccttttaagtttgaa

SEQ ID NO: 1861766 - DNA, 17 bp, Homo sapiens
tgccttttttagcttca

SEQ ID NO: 1861767 - DNA, 22 bp, Homo sapiens
tgcgaggttgttttaaagtcag

SEQ ID NO: 1861768 - DNA, 14 bp, Homo sapiens
tgcggccacagcac

SEQ ID NO: 1861769 - DNA, 21 bp, Homo sapiens
tgcggtgtctgcagctcctgg

SEQ ID NO: 1861770 - DNA, 13 bp, Homo sapiens
tgctaaaagaaga

SEQ ID NO: 1861771 - DNA, 23 bp, Homo sapiens
tgctaaaagaagagaggggaaga

SEQ ID NO: 1861772 - DNA, 18 bp, Homo sapiens
tgctaaagggagaaatgc

SEQ ID NO: 1861773 - DNA, 20 bp, Homo sapiens
tgctaaagggagaaatgcca

SEQ ID NO: 1861774 - DNA, 21 bp, Homo sapiens
tgctaatatactttttttgtt

SEQ ID NO: 1861775 - DNA, 22 bp, Homo sapiens
tgctacttatcatttttgtata

SEQ ID NO: 1861776 - DNA, 20 bp, Homo sapiens
tgctagcaaacaaatggctt

SEQ ID NO: 1861777 - DNA, 15 bp, Homo sapiens
tgctcattgtggcca

SEQ ID NO: 1861778 - DNA, 22 bp, Homo sapiens
tgctgaattgagaataagaatt

SEQ ID NO: 1861779 - DNA, 19 bp, Homo sapiens
tgctgatagctaagtgagt

SEQ ID NO: 1861780 - DNA, 22 bp, Homo sapiens
tgctgatagctaagtgagtttt

SEQ ID NO: 1861781 - DNA, 20 bp, Homo sapiens
tgctgccctggggcatcatg

SEQ ID NO: 1861782 - DNA, 23 bp, Homo sapiens
tgctgctaaagggagaaatgcca

SEQ ID NO: 1861783 - DNA, 21 bp, Homo sapiens
tgctgcttacactccaggtgt

SEQ ID NO: 1861784 - DNA, 16 bp, Homo sapiens
tgctgtacattactgt

SEQ ID NO: 1861785 - DNA, 15 bp, Homo sapiens
tgctgttactgcttc

SEQ ID NO: 1861786 - DNA, 19 bp, Homo sapiens
tgctgttactgcttctctt

SEQ ID NO: 1861787 - DNA, 22 bp, Homo sapiens
tgcttcactcatgcaaactgct

SEQ ID NO: 1861788 - DNA, 18 bp, Homo sapiens
tgcttcagtggagaatta

SEQ ID NO: 1861789 - DNA, 16 bp, Homo sapiens
tgcttctctttgtgca

SEQ ID NO: 1861790 - DNA, 15 bp, Homo sapiens
tgcttgattaaacag

SEQ ID NO: 1861791 - DNA, 15 bp, Homo sapiens
tgctttcctatctag

SEQ ID NO: 1861792 - DNA, 13 bp, Homo sapiens
tgctttgatatat

SEQ ID NO: 1861793 - DNA, 17 bp, Homo sapiens
tggaaacctgaaaaaaa

SEQ ID NO: 1861794 - DNA, 16 bp, Homo sapiens
tggaacttctaatata

SEQ ID NO: 1861795 - DNA, 20 bp, Homo sapiens
tggaagaagttttaactatg

SEQ ID NO: 1861796 - DNA, 15 bp, Homo sapiens
tggaagaagtttttt

SEQ ID NO: 1861797 - DNA, 23 bp, Homo sapiens
tggaatttattggcagccaagga

SEQ ID NO: 1861798 - DNA, 14 bp, Homo sapiens
tggacacctacagc

SEQ ID NO: 1861799 - DNA, 16 bp, Homo sapiens
tggacacctacagcag

SEQ ID NO: 1861800 - DNA, 19 bp, Homo sapiens
tggaccggccgcagccccc

SEQ ID NO: 1861801 - DNA, 20 bp, Homo sapiens
tggaccggccgcagccccca

SEQ ID NO: 1861802 - DNA, 16 bp, Homo sapiens
tggactgtgaatttca

SEQ ID NO: 1861803 - DNA, 17 bp, Homo sapiens
tggactgtgaatttcaa

SEQ ID NO: 1861804 - DNA, 18 bp, Homo sapiens
tggactgtgaatttcaaa

SEQ ID NO: 1861805 - DNA, 18 bp, Homo sapiens
tggagaaagtaagtcttt

SEQ ID NO: 1861806 - DNA, 22 bp, Homo sapiens
tggagcagcccccaaagagctg

SEQ ID NO: 1861807 - DNA, 23 bp, Homo sapiens
tggagcattaactaaatgctcat

SEQ ID NO: 1861808 - DNA, 18 bp, Homo sapiens
tggagccgggaaagctgt

SEQ ID NO: 1861809 - DNA, 15 bp, Homo sapiens
tggagctattttaaa

SEQ ID NO: 1861810 - DNA, 15 bp, Homo sapiens
tggagggggcagagt

SEQ ID NO: 1861811 - DNA, 16 bp, Homo sapiens
tggagggggcagagtg

SEQ ID NO: 1861812 - DNA, 17 bp, Homo sapiens
tggagggggcagagtgg

SEQ ID NO: 1861813 - DNA, 15 bp, Homo sapiens
tggatgaaattttct

SEQ ID NO: 1861814 - DNA, 18 bp, Homo sapiens
tggatgaaattttctaga

SEQ ID NO: 1861815 - DNA, 16 bp, Homo sapiens
tggattattcaggctt

SEQ ID NO: 1861816 - DNA, 17 bp, Homo sapiens
tggcactaaaatgttta

SEQ ID NO: 1861817 - DNA, 19 bp, Homo sapiens
tggcactaaaatgtttaat

SEQ ID NO: 1861818 - DNA, 12 bp, Homo sapiens
tggcactgacag

SEQ ID NO: 1861819 - DNA, 16 bp, Homo sapiens
tggcactgacagcctg

SEQ ID NO: 1861820 - DNA, 19 bp, Homo sapiens
tggcactgacagcctgggg

SEQ ID NO: 1861821 - DNA, 17 bp, Homo sapiens
tggcactgccaccagca

SEQ ID NO: 1861822 - DNA, 18 bp, Homo sapiens
tggcactgtggcactgcc

SEQ ID NO: 1861823 - DNA, 23 bp, Homo sapiens
tggcagccaaggaatgtgtccaa

SEQ ID NO: 1861824 - DNA, 19 bp, Homo sapiens
tggcaggtcatggagcagc

SEQ ID NO: 1861825 - DNA, 17 bp, Homo sapiens
tggcataatttgtctta

SEQ ID NO: 1861826 - DNA, 16 bp, Homo sapiens
tggccaaattatttgt

SEQ ID NO: 1861827 - DNA, 18 bp, Homo sapiens
tggccaaattatttgtgt

SEQ ID NO: 1861828 - DNA, 18 bp, Homo sapiens
tggccatatatgctgtat

SEQ ID NO: 1861829 - DNA, 23 bp, Homo sapiens
tggccatatatgctgtatttctt

SEQ ID NO: 1861830 - DNA, 14 bp, Homo sapiens
tggcctctggggca

SEQ ID NO: 1861831 - DNA, 13 bp, Homo sapiens
tggcctgtgagca

SEQ ID NO: 1861832 - DNA, 18 bp, Homo sapiens
tggcctgtgagcaagagc

SEQ ID NO: 1861833 - DNA, 21 bp, Homo sapiens
tggctatatggcaagaaagct

SEQ ID NO: 1861834 - DNA, 11 bp, Homo sapiens
tggctgggggg

SEQ ID NO: 1861835 - DNA, 16 bp, Homo sapiens
tggctggggggatgac

SEQ ID NO: 1861836 - DNA, 18 bp, Homo sapiens
tggcttaaaaaaaactct

SEQ ID NO: 1861837 - DNA, 19 bp, Homo sapiens
tggcttaaaaaaaactctt

SEQ ID NO: 1861838 - DNA, 16 bp, Homo sapiens
tggcttccctgcccaa

SEQ ID NO: 1861839 - DNA, 19 bp, Homo sapiens
tggcttcttaaaaactgtg

SEQ ID NO: 1861840 - DNA, 16 bp, Homo sapiens
tgggaaaaagagactc

SEQ ID NO: 1861841 - DNA, 16 bp, Homo sapiens
tgggagggaggagggc

SEQ ID NO: 1861842 - DNA, 19 bp, Homo sapiens
tgggccctggggctgccct

SEQ ID NO: 1861843 - DNA, 17 bp, Homo sapiens
tgggccgggcccagggc

SEQ ID NO: 1861844 - DNA, 20 bp, Homo sapiens
tggggaggccatttgctgcc

SEQ ID NO: 1861845 - DNA, 22 bp, Homo sapiens
tggggaggccatttgctgccct

SEQ ID NO: 1861846 - DNA, 13 bp, Homo sapiens
tggggattcagat

SEQ ID NO: 1861847 - DNA, 20 bp, Homo sapiens
tggggattcagatttctctt

SEQ ID NO: 1861848 - DNA, 13 bp, Homo sapiens
tggggcagagctt

SEQ ID NO: 1861849 - DNA, 15 bp, Homo sapiens
tggggcaggaccact

SEQ ID NO: 1861850 - DNA, 20 bp, Homo sapiens
tggggggcactagaagatga

SEQ ID NO: 1861851 - DNA, 13 bp, Homo sapiens
tggtaaactattt

SEQ ID NO: 1861852 - DNA, 21 bp, Homo sapiens
tggtaaactatttgtctttca

SEQ ID NO: 1861853 - DNA, 18 bp, Homo sapiens
tggtaaatttttgaaaaa

SEQ ID NO: 1861854 - DNA, 22 bp, Homo sapiens
tggtaaatttttgaaaaatatt

SEQ ID NO: 1861855 - DNA, 23 bp, Homo sapiens
tggtacagttcataattcaccaa

SEQ ID NO: 1861856 - DNA, 21 bp, Homo sapiens
tggtatcgttcgcttgtttta

SEQ ID NO: 1861857 - DNA, 21 bp, Homo sapiens
attgctaaaagtgcatttaag

SEQ ID NO: 1861858 - DNA, 19 bp, Homo sapiens
attggatttgctgtgacta

SEQ ID NO: 1861859 - DNA, 17 bp, Homo sapiens
attggcagccaaggaat

SEQ ID NO: 1861860 - DNA, 21 bp, Homo sapiens
attggcagccaaggaatgtgt

SEQ ID NO: 1861861 - DNA, 10 bp, Homo sapiens
attgggtccc

SEQ ID NO: 1861862 - DNA, 22 bp, Homo sapiens
attgggtcccgcttagttcttg

SEQ ID NO: 1861863 - DNA, 17 bp, Homo sapiens
attggtcatggtagatt

SEQ ID NO: 1861864 - DNA, 14 bp, Homo sapiens
attggttagtattt

SEQ ID NO: 1861865 - DNA, 19 bp, Homo sapiens
attgtaaaatagcttgtat

SEQ ID NO: 1861866 - DNA, 16 bp, Homo sapiens
attgtacagctgttta

SEQ ID NO: 1861867 - DNA, 17 bp, Homo sapiens
attgtataaactatcag

SEQ ID NO: 1861868 - DNA, 21 bp, Homo sapiens
attgtataaactatcagtttg

SEQ ID NO: 1861869 - DNA, 14 bp, Homo sapiens
attgtcattagtga

SEQ ID NO: 1861870 - DNA, 12 bp, Homo sapiens
attgtcctgtgt

SEQ ID NO: 1861871 - DNA, 17 bp, Homo sapiens
attgtctgtctgctctt

SEQ ID NO: 1861872 - DNA, 19 bp, Homo sapiens
attgtctgtctgctcttat

SEQ ID NO: 1861873 - DNA, 17 bp, Homo sapiens
attgtgaataatgattt

SEQ ID NO: 1861874 - DNA, 19 bp, Homo sapiens
attgtgtatgagactgtgt

SEQ ID NO: 1861875 - DNA, 20 bp, Homo sapiens
attgtgttgtgcagcattaa

SEQ ID NO: 1861876 - DNA, 17 bp, Homo sapiens
attgttatgaaaatcct

SEQ ID NO: 1861877 - DNA, 13 bp, Homo sapiens
attgttttatcat

SEQ ID NO: 1861878 - DNA, 20 bp, Homo sapiens
attgtttttctgatatgttt

SEQ ID NO: 1861879 - DNA, 13 bp, Homo sapiens
atttaaaaaataa

SEQ ID NO: 1861880 - DNA, 17 bp, Homo sapiens
atttaaaaaattaaaaa

SEQ ID NO: 1861881 - DNA, 15 bp, Homo sapiens
atttaaagaaacact

SEQ ID NO: 1861882 - DNA, 21 bp, Homo sapiens
atttaagaaagggaaagctgt

SEQ ID NO: 1861883 - DNA, 12 bp, Homo sapiens
atttaagtacta

SEQ ID NO: 1861884 - DNA, 15 bp, Homo sapiens
atttaagtactatct

SEQ ID NO: 1861885 - DNA, 21 bp, Homo sapiens
atttaagtactatctttgtct

SEQ ID NO: 1861886 - DNA, 15 bp, Homo sapiens
atttaatggactgtg

SEQ ID NO: 1861887 - DNA, 20 bp, Homo sapiens
atttaatggactgtgaattt

SEQ ID NO: 1861888 - DNA, 19 bp, Homo sapiens
atttaatttataggcagat

SEQ ID NO: 1861889 - DNA, 23 bp, Homo sapiens
atttactaagccacaagaaattt

SEQ ID NO: 1861890 - DNA, 13 bp, Homo sapiens
atttactgctcta

SEQ ID NO: 1861891 - DNA, 14 bp, Homo sapiens
atttagaactgtat

SEQ ID NO: 1861892 - DNA, 18 bp, Homo sapiens
atttagagcgtttggtta

SEQ ID NO: 1861893 - DNA, 15 bp, Homo sapiens
atttagtgaactacg

SEQ ID NO: 1861894 - DNA, 14 bp, Homo sapiens
atttagttatagtt

SEQ ID NO: 1861895 - DNA, 16 bp, Homo sapiens
atttagttatagtttc

SEQ ID NO: 1861896 - DNA, 22 bp, Homo sapiens
atttataggcagatctttaaat

SEQ ID NO: 1861897 - DNA, 17 bp, Homo sapiens
atttatatcttgttatt

SEQ ID NO: 1861898 - DNA, 21 bp, Homo sapiens
atttatatctttatgcaaaaa

SEQ ID NO: 1861899 - DNA, 17 bp, Homo sapiens
atttatgagatttactg

SEQ ID NO: 1861900 - DNA, 19 bp, Homo sapiens
atttatgcatggaaacctg

SEQ ID NO: 1861901 - DNA, 21 bp, Homo sapiens
atttattaaaatgattgtaaa

SEQ ID NO: 1861902 - DNA, 17 bp, Homo sapiens
atttattggcagccaag

SEQ ID NO: 1861903 - DNA, 20 bp, Homo sapiens
atttattggcagccaaggaa

SEQ ID NO: 1861904 - DNA, 23 bp, Homo sapiens
atttattggcagccaaggaatgt

SEQ ID NO: 1861905 - DNA, 13 bp, Homo sapiens
atttatttctctg

SEQ ID NO: 1861906 - DNA, 23 bp, Homo sapiens
atttcaaaatggtaactttacaa

SEQ ID NO: 1861907 - DNA, 10 bp, Homo sapiens
atttcacagt

SEQ ID NO: 1861908 - DNA, 15 bp, Homo sapiens
atttcacttgagtgg

SEQ ID NO: 1861909 - DNA, 13 bp, Homo sapiens
atttcagtatttt

SEQ ID NO: 1861910 - DNA, 17 bp, Homo sapiens
atttccaaataaaatga

SEQ ID NO: 1861911 - DNA, 19 bp, Homo sapiens
atttccttctgttaagaaa

SEQ ID NO: 1861912 - DNA, 22 bp, Homo sapiens
atttccttctgttaagaaagga

SEQ ID NO: 1861913 - DNA, 15 bp, Homo sapiens
atttctagtatctat

SEQ ID NO: 1861914 - DNA, 18 bp, Homo sapiens
atttctagtatctattgt

SEQ ID NO: 1861915 - DNA, 13 bp, Homo sapiens
atttctctttgaa

SEQ ID NO: 1861916 - DNA, 22 bp, Homo sapiens
atttctgaacaaagagagctca

SEQ ID NO: 1861917 - DNA, 17 bp, Homo sapiens
atttctttgtagaataa

SEQ ID NO: 1861918 - DNA, 15 bp, Homo sapiens
atttgaaaaactttt

SEQ ID NO: 1861919 - DNA, 14 bp, Homo sapiens
atttgacaacacat

SEQ ID NO: 1861920 - DNA, 21 bp, Homo sapiens
atttgaggtctacattcttgg

SEQ ID NO: 1861921 - DNA, 14 bp, Homo sapiens
atttgatctttgtt

SEQ ID NO: 1861922 - DNA, 22 bp, Homo sapiens
atttgatctttgtttaaatgcc

SEQ ID NO: 1861923 - DNA, 17 bp, Homo sapiens
atttgatttctattcaa

SEQ ID NO: 1861924 - DNA, 20 bp, Homo sapiens
atttgcaaaccctttgtatt

SEQ ID NO: 1861925 - DNA, 10 bp, Homo sapiens
atttgctgcc

SEQ ID NO: 1861926 - DNA, 12 bp, Homo sapiens
atttgctgccct

SEQ ID NO: 1861927 - DNA, 21 bp, Homo sapiens
atttggagcattaactaaatg

SEQ ID NO: 1861928 - DNA, 21 bp, Homo sapiens
atttgtgtaatagaaaactga

SEQ ID NO: 1861929 - DNA, 23 bp, Homo sapiens
actgtaagcagattacaataaat

SEQ ID NO: 1861930 - DNA, 15 bp, Homo sapiens
actgtatgtataaat

SEQ ID NO: 1861931 - DNA, 12 bp, Homo sapiens
actgtgaatttc

SEQ ID NO: 1861932 - DNA, 17 bp, Homo sapiens
actgtgaatttcaaaaa

SEQ ID NO: 1861933 - DNA, 18 bp, Homo sapiens
actgtggaatttattggc

SEQ ID NO: 1861934 - DNA, 15 bp, Homo sapiens
actgtggcactgcca

SEQ ID NO: 1861935 - DNA, 19 bp, Homo sapiens
actgtggcactgccaccag

SEQ ID NO: 1861936 - DNA, 21 bp, Homo sapiens
actgttgaaaattattttaaa

SEQ ID NO: 1861937 - DNA, 23 bp, Homo sapiens
actgttgaaaattattttaaaca

SEQ ID NO: 1861938 - DNA, 14 bp, Homo sapiens
actgttggcactta

SEQ ID NO: 1861939 - DNA, 15 bp, Homo sapiens
actgttggcacttat

SEQ ID NO: 1861940 - DNA, 22 bp, Homo sapiens
actgtttggtcgagtctttgtg

SEQ ID NO: 1861941 - DNA, 22 bp, Homo sapiens
acttacggtgcacagtaatatg

SEQ ID NO: 1861942 - DNA, 13 bp, Homo sapiens
acttagaatgcca

SEQ ID NO: 1861943 - DNA, 14 bp, Homo sapiens
acttagaatgccat

SEQ ID NO: 1861944 - DNA, 14 bp, Homo sapiens
acttagtttttata

SEQ ID NO: 1861945 - DNA, 20 bp, Homo sapiens
acttatcatttttgtataaa

SEQ ID NO: 1861946 - DNA, 22 bp, Homo sapiens
acttatcatttttgtataaaaa

SEQ ID NO: 1861947 - DNA, 19 bp, Homo sapiens
acttctaagttgagtatat

SEQ ID NO: 1861948 - DNA, 17 bp, Homo sapiens
acttgctacttatcatt

SEQ ID NO: 1861949 - DNA, 15 bp, Homo sapiens
acttggcaacagaag

SEQ ID NO: 1861950 - DNA, 16 bp, Homo sapiens
acttggcaacagaagc

SEQ ID NO: 1861951 - DNA, 21 bp, Homo sapiens
acttgttcaacagtttctcaa

SEQ ID NO: 1861952 - DNA, 18 bp, Homo sapiens
actttaaaaggcaactca

SEQ ID NO: 1861953 - DNA, 20 bp, Homo sapiens
actttaaaaggcaactcaaa

SEQ ID NO: 1861954 - DNA, 17 bp, Homo sapiens
actttacccaaaaacta

SEQ ID NO: 1861955 - DNA, 19 bp, Homo sapiens
actttctcttcatactttt

SEQ ID NO: 1861956 - DNA, 17 bp, Homo sapiens
actttgaaggtaataaa

SEQ ID NO: 1861957 - DNA, 19 bp, Homo sapiens
actttgaaggtaataaata

SEQ ID NO: 1861958 - DNA, 15 bp, Homo sapiens
actttgccttaagtt

SEQ ID NO: 1861959 - DNA, 22 bp, Homo sapiens
actttgctgttactgcttctct

SEQ ID NO: 1861960 - DNA, 14 bp, Homo sapiens
actttgcttgatta

SEQ ID NO: 1861961 - DNA, 16 bp, Homo sapiens
actttgcttgattaaa

SEQ ID NO: 1861962 - DNA, 16 bp, Homo sapiens
acttttacagaatgca

SEQ ID NO: 1861963 - DNA, 19 bp, Homo sapiens
acttttacagaatgcatta

SEQ ID NO: 1861964 - DNA, 21 bp, Homo sapiens
acttttacagaatgcattaaa

SEQ ID NO: 1861965 - DNA, 18 bp, Homo sapiens
acttttaggttgttacca

SEQ ID NO: 1861966 - DNA, 22 bp, Homo sapiens
acttttattttcattgtgattt

SEQ ID NO: 1861967 - DNA, 18 bp, Homo sapiens
acttttctggttccaaac

SEQ ID NO: 1861968 - DNA, 19 bp, Homo sapiens
acttttctggttccaaacc

SEQ ID NO: 1861969 - DNA, 18 bp, Homo sapiens
acttttgtaatttgaatt

SEQ ID NO: 1861970 - DNA, 20 bp, Homo sapiens
acttttgtaatttgaattgg

SEQ ID NO: 1861971 - DNA, 18 bp, Homo sapiens
agaaaacctgtttttaac

SEQ ID NO: 1861972 - DNA, 16 bp, Homo sapiens
agaaaactgaaaatct

SEQ ID NO: 1861973 - DNA, 13 bp, Homo sapiens
agaaaaggcaaaa

SEQ ID NO: 1861974 - DNA, 21 bp, Homo sapiens
agaaaatcagattttctcctg

SEQ ID NO: 1861975 - DNA, 22 bp, Homo sapiens
agaaaatgcagccttaaacagt

SEQ ID NO: 1861976 - DNA, 12 bp, Homo sapiens
agaaagaaaagg

SEQ ID NO: 1861977 - DNA, 15 bp, Homo sapiens
agaaagagaatgaac

SEQ ID NO: 1861978 - DNA, 18 bp, Homo sapiens
agaaagagaatgaactgt

SEQ ID NO: 1861979 - DNA, 22 bp, Homo sapiens
agaaagagaatgaactgtggaa

SEQ ID NO: 1861980 - DNA, 15 bp, Homo sapiens
agaaagcaagatgta

SEQ ID NO: 1861981 - DNA, 16 bp, Homo sapiens
agaaagctggtaaact

SEQ ID NO: 1861982 - DNA, 19 bp, Homo sapiens
agaaagctggtaaactatt

SEQ ID NO: 1861983 - DNA, 13 bp, Homo sapiens
agaaattaaaata

SEQ ID NO: 1861984 - DNA, 19 bp, Homo sapiens
acaattagcagaatggaga

SEQ ID NO: 1861985 - DNA, 16 bp, Homo sapiens
acaatttcctttatat

SEQ ID NO: 1861986 - DNA, 20 bp, Homo sapiens
acaatttcctttatatttag

SEQ ID NO: 1861987 - DNA, 14 bp, Homo sapiens
acacagttaaataa

SEQ ID NO: 1861988 - DNA, 13 bp, Homo sapiens
acacatacacaca

SEQ ID NO: 1861989 - DNA, 14 bp, Homo sapiens
acaccactgggaac

SEQ ID NO: 1861990 - DNA, 23 bp, Homo sapiens
acaccgggaagtgcagcgggcca

SEQ ID NO: 1861991 - DNA, 15 bp, Homo sapiens
acacctacagcagca

SEQ ID NO: 1861992 - DNA, 23 bp, Homo sapiens
acacttgttcaacagtttctcaa

SEQ ID NO: 1861993 - DNA, 18 bp, Homo sapiens
acactttgaaggtaataa

SEQ ID NO: 1861994 - DNA, 16 bp, Homo sapiens
acagaatgcattaaaa

SEQ ID NO: 1861995 - DNA, 18 bp, Homo sapiens
acagaatgcattaaaaaa

SEQ ID NO: 1861996 - DNA, 17 bp, Homo sapiens
acagattcctgttgtgt

SEQ ID NO: 1861997 - DNA, 19 bp, Homo sapiens
acagattcctgttgtgtaa

SEQ ID NO: 1861998 - DNA, 13 bp, Homo sapiens
acagcaaagccat

SEQ ID NO: 1861999 - DNA, 14 bp, Homo sapiens
acagcaaagccata

SEQ ID NO: 1862000 - DNA, 22 bp, Homo sapiens
acagcaaagccatattctaaat

SEQ ID NO: 1862001 - DNA, 23 bp, Homo sapiens
acagcaaagccatattctaaatt

SEQ ID NO: 1862002 - DNA, 20 bp, Homo sapiens
acagcagcacgcatgtccct

SEQ ID NO: 1862003 - DNA, 14 bp, Homo sapiens
acagcatgcagact

SEQ ID NO: 1862004 - DNA, 22 bp, Homo sapiens
acagctgagagacttttaatca

SEQ ID NO: 1862005 - DNA, 15 bp, Homo sapiens
acagctgtttaagat

SEQ ID NO: 1862006 - DNA, 19 bp, Homo sapiens
acagctgtttaagatgggc

SEQ ID NO: 1862007 - DNA, 22 bp, Homo sapiens
acaggagcagcccacccagcag

SEQ ID NO: 1862008 - DNA, 15 bp, Homo sapiens
acagtctctgttgta

SEQ ID NO: 1862009 - DNA, 10 bp, Homo sapiens
acagtgcaag

SEQ ID NO: 1862010 - DNA, 13 bp, Homo sapiens
acagttaaataaa

SEQ ID NO: 1862011 - DNA, 12 bp, Homo sapiens
acagttctgtaa

SEQ ID NO: 1862012 - DNA, 16 bp, Homo sapiens
acagttctgtaatgta

SEQ ID NO: 1862013 - DNA, 14 bp, Homo sapiens
acagtttgctctag

SEQ ID NO: 1862014 - DNA, 14 bp, Homo sapiens
acagtttgtgtttt

SEQ ID NO: 1862015 - DNA, 17 bp, Homo sapiens
acagtttgtgttttaaa

SEQ ID NO: 1862016 - DNA, 20 bp, Homo sapiens
acatacaaaaaaaatcttta

SEQ ID NO: 1862017 - DNA, 14 bp, Homo sapiens
acatataacactta

SEQ ID NO: 1862018 - DNA, 17 bp, Homo sapiens
acatataacacttaact

SEQ ID NO: 1862019 - DNA, 21 bp, Homo sapiens
acatatgtatctttggggaaa

SEQ ID NO: 1862020 - DNA, 21 bp, Homo sapiens
acatatgtctgtctttgcaaa

SEQ ID NO: 1862021 - DNA, 23 bp, Homo sapiens
acatatgtctgtctttgcaaagg

SEQ ID NO: 1862022 - DNA, 14 bp, Homo sapiens
acatctaaagcttt

SEQ ID NO: 1862023 - DNA, 23 bp, Homo sapiens
acatctgcctgtaattaaactag

SEQ ID NO: 1862024 - DNA, 21 bp, Homo sapiens
acatgcaatttattaaaatga

SEQ ID NO: 1862025 - DNA, 21 bp, Homo sapiens
acatgctgaggttttgaataa

SEQ ID NO: 1862026 - DNA, 20 bp, Homo sapiens
acattaccttgtctttcaaa

SEQ ID NO: 1862027 - DNA, 14 bp, Homo sapiens
acattactgtatgt

SEQ ID NO: 1862028 - DNA, 22 bp, Homo sapiens
acattactgtatgtataaatta

SEQ ID NO: 1862029 - DNA, 12 bp, Homo sapiens
aaaaaaactgaa

SEQ ID NO: 1862030 - DNA, 10 bp, Homo sapiens
aaaaaaagaa

SEQ ID NO: 1862031 - DNA, 12 bp, Homo sapiens
aaaaaatatttt

SEQ ID NO: 1862032 - DNA, 14 bp, Homo sapiens
aaaaaatattttaa

SEQ ID NO: 1862033 - DNA, 12 bp, Homo sapiens
aaaaactgtgta

SEQ ID NO: 1862034 - DNA, 18 bp, Homo sapiens
aaaaactttctactcatt

SEQ ID NO: 1862035 - DNA, 20 bp, Homo sapiens
aaaaacttttaggttgttac

SEQ ID NO: 1862036 - DNA, 11 bp, Homo sapiens
aaaaagactgt

SEQ ID NO: 1862037 - DNA, 18 bp, Homo sapiens
aaaaagctcatattttgt

SEQ ID NO: 1862038 - DNA, 11 bp, Homo sapiens
aaaaaggaaat

SEQ ID NO: 1862039 - DNA, 16 bp, Homo sapiens
aaaaagtgaacttttg

SEQ ID NO: 1862040 - DNA, 17 bp, Homo sapiens
aaaaagtgaacttttgt

SEQ ID NO: 1862041 - DNA, 19 bp, Homo sapiens
aaaaagtgaacttttgtaa

SEQ ID NO: 1862042 - DNA, 17 bp, Homo sapiens
aaaaagtttacaagtgt

SEQ ID NO: 1862043 - DNA, 14 bp, Homo sapiens
aaaaataacactgt

SEQ ID NO: 1862044 - DNA, 19 bp, Homo sapiens
aaaaataagttttatacat

SEQ ID NO: 1862045 - DNA, 10 bp, Homo sapiens
aaaaataata

SEQ ID NO: 1862046 - DNA, 13 bp, Homo sapiens
aaaaataataaaa

SEQ ID NO: 1862047 - DNA, 13 bp, Homo sapiens
aaaaataccattg

SEQ ID NO: 1862048 - DNA, 16 bp, Homo sapiens
aaaaataccattgaaa

SEQ ID NO: 1862049 - DNA, 12 bp, Homo sapiens
aaaaatattgct

SEQ ID NO: 1862050 - DNA, 13 bp, Homo sapiens
aaaaatattttaa

SEQ ID NO: 1862051 - DNA, 21 bp, Homo sapiens
aaaaatattttaagaaagaga

SEQ ID NO: 1862052 - DNA, 15 bp, Homo sapiens
aaaacatatgtctgt

SEQ ID NO: 1862053 - DNA, 22 bp, Homo sapiens
aaaacatatgtctgtctttgca

SEQ ID NO: 1862054 - DNA, 13 bp, Homo sapiens
aaaactcctgtgt

SEQ ID NO: 1862055 - DNA, 13 bp, Homo sapiens
aaaactctttaac

SEQ ID NO: 1862056 - DNA, 21 bp, Homo sapiens
aaaactctttaacttgtaata

SEQ ID NO: 1862057 - DNA, 19 bp, Homo sapiens
aaaactgaaaatctaatat

SEQ ID NO: 1862058 - DNA, 23 bp, Homo sapiens
aaaactgaaggttttttttttaa

SEQ ID NO: 1862059 - DNA, 21 bp, Homo sapiens
aaaactgagtccatgaaaata

SEQ ID NO: 1862060 - DNA, 13 bp, Homo sapiens
aaaactttaaaag

SEQ ID NO: 1862061 - DNA, 17 bp, Homo sapiens
aaaactttaaaaggcaa

SEQ ID NO: 1862062 - DNA, 18 bp, Homo sapiens
aaaagaaaccatgacaaa

SEQ ID NO: 1862063 - DNA, 14 bp, Homo sapiens
aaaagactgtcaaa

SEQ ID NO: 1862064 - DNA, 17 bp, Homo sapiens
aaaagactgtcaaatga

SEQ ID NO: 1862065 - DNA, 21 bp, Homo sapiens
aaaagactgtcaaatgaactt

SEQ ID NO: 1862066 - DNA, 23 bp, Homo sapiens
aaaagcagcttttagttcagact

SEQ ID NO: 1862067 - DNA, 11 bp, Homo sapiens
aaaagccatat

SEQ ID NO: 1862068 - DNA, 14 bp, Homo sapiens
aaaagccatatcta

SEQ ID NO: 1862069 - DNA, 18 bp, Homo sapiens
aaaagctcatattttgta

SEQ ID NO: 1862070 - DNA, 15 bp, Homo sapiens
aaaaggaaattagtc

SEQ ID NO: 1862071 - DNA, 19 bp, Homo sapiens
aaaaggatgttacaagttt

SEQ ID NO: 1862072 - DNA, 22 bp, Homo sapiens
aaaaggatgttacaagtttgct

SEQ ID NO: 1862073 - DNA, 16 bp, Homo sapiens
aaaaggcaaaagactg

SEQ ID NO: 1862074 - DNA, 16 bp, Homo sapiens
aaaagtcattattcct

SEQ ID NO: 1862075 - DNA, 22 bp, Homo sapiens
aaaagtgaacttttgtaatttg

SEQ ID NO: 1862076 - DNA, 22 bp, Homo sapiens
aaaagttcatataatttaaaga

SEQ ID NO: 1862077 - DNA, 22 bp, Homo sapiens
aaaagtttacaagtgtatatca

SEQ ID NO: 1862078 - DNA, 22 bp, Homo sapiens
aaaataatctatattaaatgag

SEQ ID NO: 1862079 - DNA, 17 bp, Homo sapiens
aaaataccattgaaatc

SEQ ID NO: 1862080 - DNA, 15 bp, Homo sapiens
aaaatagaagctgta

SEQ ID NO: 1862081 - DNA, 13 bp, Homo sapiens
aaaatagcttgta

SEQ ID NO: 1862082 - DNA, 21 bp, Homo sapiens
aaaatagcttgtatagtgtaa

SEQ ID NO: 1862083 - DNA, 13 bp, Homo sapiens
aaaatatatgttc

SEQ ID NO: 1862084 - DNA, 14 bp, Homo sapiens
aaaatatatgttct

SEQ ID NO: 1862085 - DNA, 21 bp, Homo sapiens
aaaatatatgttctgcaagaa

SEQ ID NO: 1862086 - DNA, 20 bp, Homo sapiens
aaaatatggaacttctaata

SEQ ID NO: 1862087 - DNA, 21 bp, Homo sapiens
aaaatatggaacttctaatat

SEQ ID NO: 1862088 - DNA, 17 bp, Homo sapiens
aaaatattgctaaaagt

SEQ ID NO: 1862089 - DNA, 13 bp, Homo sapiens
aaaatattttaag

SEQ ID NO: 1862090 - DNA, 18 bp, Homo sapiens
aaaatattttaagaaaga

SEQ ID NO: 1862091 - DNA, 12 bp, Homo sapiens
aaaatctttaat

SEQ ID NO: 1862092 - DNA, 16 bp, Homo sapiens
aaaatgatgataatca

SEQ ID NO: 1862093 - DNA, 16 bp, Homo sapiens
aaaatgattgtaaaat

SEQ ID NO: 1862094 - DNA, 19 bp, Homo sapiens
aaaatgattgtaaaatagc

SEQ ID NO: 1862095 - DNA, 20 bp, Homo sapiens
aaaatgcccatttttgctaa

SEQ ID NO: 1862096 - DNA, 15 bp, Homo sapiens
aaaatgtttaattca

SEQ ID NO: 1862097 - DNA, 22 bp, Homo sapiens
aaaattacgttcttacaagctt

SEQ ID NO: 1862098 - DNA, 17 bp, Homo sapiens
aaaattattttaaacaa

SEQ ID NO: 1862099 - DNA, 18 bp, Homo sapiens
aaaattattttaaacaaa

SEQ ID NO: 1862100 - DNA, 19 bp, Homo sapiens
aaaattattttaaacaaaa

SEQ ID NO: 1862101 - DNA, 14 bp, Homo sapiens
aaaatttcacagtt

SEQ ID NO: 1862102 - DNA, 23 bp, Homo sapiens
aaacaaaatttcacagttctgta

SEQ ID NO: 1862103 - DNA, 13 bp, Homo sapiens
aaacagagaaaga

SEQ ID NO: 1862104 - DNA, 21 bp, Homo sapiens
aaacagcaaagccatattcta

SEQ ID NO: 1862105 - DNA, 18 bp, Homo sapiens
aaacaggagacaggaagg

SEQ ID NO: 1862106 - DNA, 14 bp, Homo sapiens
aaacatatgtctgt

SEQ ID NO: 1862107 - DNA, 17 bp, Homo sapiens
aaacatatgtctgtctt

SEQ ID NO: 1862108 - DNA, 18 bp, Homo sapiens
aaacatatgtctgtcttt

SEQ ID NO: 1862109 - DNA, 22 bp, Homo sapiens
aaacatatgtctgtctttgcaa

SEQ ID NO: 1862110 - DNA, 23 bp, Homo sapiens
aaaccaccagtgcccaaagtctg

SEQ ID NO: 1862111 - DNA, 17 bp, Homo sapiens
aaaccagtttattctgt

SEQ ID NO: 1862112 - DNA, 15 bp, Homo sapiens
aaacccccttttccc

SEQ ID NO: 1862113 - DNA, 16 bp, Homo sapiens
acttatcatttttgta

SEQ ID NO: 1862114 - DNA, 17 bp, Homo sapiens
acttatcatttttgtat

SEQ ID NO: 1862115 - DNA, 18 bp, Homo sapiens
acttatcatttttgtata

SEQ ID NO: 1862116 - DNA, 19 bp, Homo sapiens
acttatcatttttgtataa

SEQ ID NO: 1862117 - DNA, 15 bp, Homo sapiens
acttctaatatattt

SEQ ID NO: 1862118 - DNA, 16 bp, Homo sapiens
acttcttaaaagttgt

SEQ ID NO: 1862119 - DNA, 19 bp, Homo sapiens
acttgattggtttaaaagt

SEQ ID NO: 1862120 - DNA, 12 bp, Homo sapiens
acttgcggccac

SEQ ID NO: 1862121 - DNA, 14 bp, Homo sapiens
acttgcggccacag

SEQ ID NO: 1862122 - DNA, 18 bp, Homo sapiens
acttgcggccacagcact

SEQ ID NO: 1862123 - DNA, 12 bp, Homo sapiens
acttgctactta

SEQ ID NO: 1862124 - DNA, 19 bp, Homo sapiens
actttctactcattttaat

SEQ ID NO: 1862125 - DNA, 14 bp, Homo sapiens
actttctgtaaact

SEQ ID NO: 1862126 - DNA, 17 bp, Homo sapiens
acttttacagaatgcat

SEQ ID NO: 1862127 - DNA, 12 bp, Homo sapiens
acttttcagtga

SEQ ID NO: 1862128 - DNA, 15 bp, Homo sapiens
acttttctggttcca

SEQ ID NO: 1862129 - DNA, 17 bp, Homo sapiens
acttttctggttccaaa

SEQ ID NO: 1862130 - DNA, 16 bp, Homo sapiens
acttttgtaatttgaa

SEQ ID NO: 1862131 - DNA, 18 bp, Homo sapiens
actttttaaaaaactttc

SEQ ID NO: 1862132 - DNA, 12 bp, Homo sapiens
actttttctgta

SEQ ID NO: 1862133 - DNA, 16 bp, Homo sapiens
acttttttgaaatcag

SEQ ID NO: 1862134 - DNA, 15 bp, Homo sapiens
agaaaaattacagat

SEQ ID NO: 1862135 - DNA, 14 bp, Homo sapiens
agaaaacctgtttt

SEQ ID NO: 1862136 - DNA, 23 bp, Homo sapiens
agaaaacttcagagaaattatgt

SEQ ID NO: 1862137 - DNA, 20 bp, Homo sapiens
agaaaaggcaaaagactggt

SEQ ID NO: 1862138 - DNA, 15 bp, Homo sapiens
agaaaatcagatttt

SEQ ID NO: 1862139 - DNA, 12 bp, Homo sapiens
agaaacactaaa

SEQ ID NO: 1862140 - DNA, 13 bp, Homo sapiens
agaaacactaaat

SEQ ID NO: 1862141 - DNA, 14 bp, Homo sapiens
agaaacactaaatt

SEQ ID NO: 1862142 - DNA, 13 bp, Homo sapiens
agaaaccatgaca

SEQ ID NO: 1862143 - DNA, 23 bp, Homo sapiens
agaaaccatgacaaacctagctt

SEQ ID NO: 1862144 - DNA, 20 bp, Homo sapiens
agaaagaaaaggcaaaagac

SEQ ID NO: 1862145 - DNA, 16 bp, Homo sapiens
agaaagccaccttgtt

SEQ ID NO: 1862146 - DNA, 19 bp, Homo sapiens
agaaagccaccttgttaca

SEQ ID NO: 1862147 - DNA, 16 bp, Homo sapiens
agaaattaaaatatta

SEQ ID NO: 1862148 - DNA, 21 bp, Homo sapiens
agaaattaaaatattatttga

SEQ ID NO: 1862149 - DNA, 17 bp, Homo sapiens
agaaattatttaataaa

SEQ ID NO: 1862150 - DNA, 22 bp, Homo sapiens
agaaccagtctttcaactcatt

SEQ ID NO: 1862151 - DNA, 19 bp, Homo sapiens
agaactgtatgtcagacat

SEQ ID NO: 1862152 - DNA, 14 bp, Homo sapiens
agaagacccctgcc

SEQ ID NO: 1862153 - DNA, 17 bp, Homo sapiens
agaagatgggggctgga

SEQ ID NO: 1862154 - DNA, 16 bp, Homo sapiens
agaagcttcagaagtt

SEQ ID NO: 1862155 - DNA, 17 bp, Homo sapiens
agaagcttcagaagttt

SEQ ID NO: 1862156 - DNA, 18 bp, Homo sapiens
agaaggccagcccactgg

SEQ ID NO: 1862157 - DNA, 22 bp, Homo sapiens
agaaggccagcccactgggccc

SEQ ID NO: 1862158 - DNA, 20 bp, Homo sapiens
agaagttttttactttggtt

SEQ ID NO: 1862159 - DNA, 13 bp, Homo sapiens
agaataagaattt

SEQ ID NO: 1862160 - DNA, 14 bp, Homo sapiens
agaatgaactgtgg

SEQ ID NO: 1862161 - DNA, 15 bp, Homo sapiens
agaatgaactgtgga

SEQ ID NO: 1862162 - DNA, 21 bp, Homo sapiens
agaatgaactgtggaatttat

SEQ ID NO: 1862163 - DNA, 15 bp, Homo sapiens
agaatgcattaaaaa

SEQ ID NO: 1862164 - DNA, 14 bp, Homo sapiens
agaatggagaaagt

SEQ ID NO: 1862165 - DNA, 17 bp, Homo sapiens
agaatggagaaagtaag

SEQ ID NO: 1862166 - DNA, 22 bp, Homo sapiens
agaatggagaaagtaagtcttt

SEQ ID NO: 1862167 - DNA, 15 bp, Homo sapiens
agaattaaaactgag

SEQ ID NO: 1862168 - DNA, 13 bp, Homo sapiens
agaattctatttt

SEQ ID NO: 1862169 - DNA, 17 bp, Homo sapiens
agaattggcataatttg

SEQ ID NO: 1862170 - DNA, 15 bp, Homo sapiens
agaatttaatggact

SEQ ID NO: 1862171 - DNA, 21 bp, Homo sapiens
agaatttaatggactgtgaat

SEQ ID NO: 1862172 - DNA, 14 bp, Homo sapiens
agaatttctggtgg

SEQ ID NO: 1862173 - DNA, 18 bp, Homo sapiens
agacaattagcagaatgg

SEQ ID NO: 1862174 - DNA, 12 bp, Homo sapiens
agacataaaact

SEQ ID NO: 1862175 - DNA, 15 bp, Homo sapiens
agacataaaacttta

SEQ ID NO: 1862176 - DNA, 21 bp, Homo sapiens
agacataaaactttaaaaggc

SEQ ID NO: 1862177 - DNA, 17 bp, Homo sapiens
agacatccatgtttgta

SEQ ID NO: 1862178 - DNA, 22 bp, Homo sapiens
agacatccatgtttgtaaaact

SEQ ID NO: 1862179 - DNA, 17 bp, Homo sapiens
agacatctgcctgtaat

SEQ ID NO: 1862180 - DNA, 18 bp, Homo sapiens
agacatctgcctgtaatt

SEQ ID NO: 1862181 - DNA, 16 bp, Homo sapiens
agaccacaaaaattga

SEQ ID NO: 1862182 - DNA, 17 bp, Homo sapiens
agacccctgcccaagtg

SEQ ID NO: 1862183 - DNA, 14 bp, Homo sapiens
agactaatttaaaa

SEQ ID NO: 1862184 - DNA, 15 bp, Homo sapiens
agactaatttaaaaa

SEQ ID NO: 1862185 - DNA, 14 bp, Homo sapiens
agactatttaagta

SEQ ID NO: 1862186 - DNA, 15 bp, Homo sapiens
agactggtcctgtgt

SEQ ID NO: 1862187 - DNA, 18 bp, Homo sapiens
agactggtcctgtgtgca

SEQ ID NO: 1862188 - DNA, 19 bp, Homo sapiens
agactggtttgtttgctta

SEQ ID NO: 1862189 - DNA, 23 bp, Homo sapiens
agactgtggccatatatgctgta

SEQ ID NO: 1862190 - DNA, 21 bp, Homo sapiens
agacttgcggccacagcacta

SEQ ID NO: 1862191 - DNA, 17 bp, Homo sapiens
agacttggcaacagaag

SEQ ID NO: 1862192 - DNA, 20 bp, Homo sapiens
agactttgctgttactgctt

SEQ ID NO: 1862193 - DNA, 22 bp, Homo sapiens
agactttgctgttactgcttct

SEQ ID NO: 1862194 - DNA, 16 bp, Homo sapiens
agagaaagaaaaggca

SEQ ID NO: 1862195 - DNA, 21 bp, Homo sapiens
agagaaagaaaaggcaaaaga

SEQ ID NO: 1862196 - DNA, 22 bp, Homo sapiens
agagaaattatgttttcatcca

SEQ ID NO: 1862197 - DNA, 22 bp, Homo sapiens
agagactcagaggacccacctg

SEQ ID NO: 1862198 - DNA, 16 bp, Homo sapiens
agagagctcatcatca

SEQ ID NO: 1862199 - DNA, 16 bp, Homo sapiens
agagaggggaagaatt

SEQ ID NO: 1862200 - DNA, 17 bp, Homo sapiens
agagaggggaagaattt

SEQ ID NO: 1862201 - DNA, 21 bp, Homo sapiens
agagaggggaagaatttaatg

SEQ ID NO: 1862202 - DNA, 19 bp, Homo sapiens
agagcacaagaaggccagc

SEQ ID NO: 1862203 - DNA, 18 bp, Homo sapiens
agagccaggggtgtccca

SEQ ID NO: 1862204 - DNA, 12 bp, Homo sapiens
agagggactgga

SEQ ID NO: 1862205 - DNA, 15 bp, Homo sapiens
agagggactggacag

SEQ ID NO: 1862206 - DNA, 16 bp, Homo sapiens
agaggttctgcactcc

SEQ ID NO: 1862207 - DNA, 20 bp, Homo sapiens
agaggttctgcactcctgga

SEQ ID NO: 1862208 - DNA, 16 bp, Homo sapiens
agagtcacccccccag

SEQ ID NO: 1862209 - DNA, 13 bp, Homo sapiens
agagtttacagtt

SEQ ID NO: 1862210 - DNA, 22 bp, Homo sapiens
agagtttacagtttgtgtttta

SEQ ID NO: 1862211 - DNA, 21 bp, Homo sapiens
agataaccagctgtaacacag

SEQ ID NO: 1862212 - DNA, 18 bp, Homo sapiens
agataatggataatcttc

SEQ ID NO: 1862213 - DNA, 13 bp, Homo sapiens
agatatatatcat

SEQ ID NO: 1862214 - DNA, 22 bp, Homo sapiens
agatcaacacttttctccaggg

SEQ ID NO: 1862215 - DNA, 21 bp, Homo sapiens
agatcagctattcccttctga

SEQ ID NO: 1862216 - DNA, 15 bp, Homo sapiens
agatgatgttaaatg

SEQ ID NO: 1862217 - DNA, 15 bp, Homo sapiens
agatggagcaaatgt

SEQ ID NO: 1862218 - DNA, 15 bp, Homo sapiens
agatgggggctggag

SEQ ID NO: 1862219 - DNA, 15 bp, Homo sapiens
agatggtgaaattta

SEQ ID NO: 1862220 - DNA, 15 bp, Homo sapiens
agatgtactataaca

SEQ ID NO: 1862221 - DNA, 14 bp, Homo sapiens
agatgtgctgcttt

SEQ ID NO: 1862222 - DNA, 16 bp, Homo sapiens
agatgtgctgctttga

SEQ ID NO: 1862223 - DNA, 18 bp, Homo sapiens
agattcctgttgtgtaat

SEQ ID NO: 1862224 - DNA, 15 bp, Homo sapiens
agattggatttgctg

SEQ ID NO: 1862225 - DNA, 17 bp, Homo sapiens
agattggatttgctgtg

SEQ ID NO: 1862226 - DNA, 13 bp, Homo sapiens
agattgtgaataa

SEQ ID NO: 1862227 - DNA, 21 bp, Homo sapiens
agatttactgctctagaaagt

SEQ ID NO: 1862228 - DNA, 14 bp, Homo sapiens
agatttctctttga

SEQ ID NO: 1862229 - DNA, 22 bp, Homo sapiens
agatttttttcatagatttgaa

SEQ ID NO: 1862230 - DNA, 22 bp, Homo sapiens
atcaatcatctgtgtgaaaatg

SEQ ID NO: 1862231 - DNA, 14 bp, Homo sapiens
atcaattcattgtg

SEQ ID NO: 1862232 - DNA, 21 bp, Homo sapiens
atcacaaacatatgtatcttt

SEQ ID NO: 1862233 - DNA, 20 bp, Homo sapiens
atcacatctaaagctttatc

SEQ ID NO: 1862234 - DNA, 15 bp, Homo sapiens
atcagaaaagggaag

SEQ ID NO: 1862235 - DNA, 23 bp, Homo sapiens
atcagaagaccacaaaaattgac

SEQ ID NO: 1862236 - DNA, 15 bp, Homo sapiens
atcagattttctcct

SEQ ID NO: 1862237 - DNA, 22 bp, Homo sapiens
atcagcatgacaaaaataacac

SEQ ID NO: 1862238 - DNA, 13 bp, Homo sapiens
atcagtaaacact

SEQ ID NO: 1862239 - DNA, 21 bp, Homo sapiens
atcagtcttaatattcagaga

SEQ ID NO: 1862240 - DNA, 16 bp, Homo sapiens
atcatctgtgtgaaaa

SEQ ID NO: 1862241 - DNA, 16 bp, Homo sapiens
atcatgacatgttata

SEQ ID NO: 1862242 - DNA, 18 bp, Homo sapiens
atcatgacatgttatata

SEQ ID NO: 1862243 - DNA, 17 bp, Homo sapiens
atcatgctcatgtatat

SEQ ID NO: 1862244 - DNA, 16 bp, Homo sapiens
atcattaaaatatatg

SEQ ID NO: 1862245 - DNA, 14 bp, Homo sapiens
atcatttttgtata

SEQ ID NO: 1862246 - DNA, 15 bp, Homo sapiens
atcatttttgtataa

SEQ ID NO: 1862247 - DNA, 16 bp, Homo sapiens
atccatgtttgtaaaa

SEQ ID NO: 1862248 - DNA, 13 bp, Homo sapiens
atcccagaaatta

SEQ ID NO: 1862249 - DNA, 17 bp, Homo sapiens
atcccttctcctgccct

SEQ ID NO: 1862250 - DNA, 12 bp, Homo sapiens
atcctatatctg

SEQ ID NO: 1862251 - DNA, 17 bp, Homo sapiens
atcctatatctgtttgt

SEQ ID NO: 1862252 - DNA, 14 bp, Homo sapiens
atcctccctggaga

SEQ ID NO: 1862253 - DNA, 15 bp, Homo sapiens
atccttgacttttta

SEQ ID NO: 1862254 - DNA, 20 bp, Homo sapiens
atcgttcgcttgttttaaaa

SEQ ID NO: 1862255 - DNA, 14 bp, Homo sapiens
atctaaagctttat

SEQ ID NO: 1862256 - DNA, 19 bp, Homo sapiens
atctaaagctttatctttg

SEQ ID NO: 1862257 - DNA, 22 bp, Homo sapiens
atctaaagctttatctttgtgt

SEQ ID NO: 1862258 - DNA, 21 bp, Homo sapiens
atctaatagcgggttactttc

SEQ ID NO: 1862259 - DNA, 22 bp, Homo sapiens
atctaatagcgggttactttca

SEQ ID NO: 1862260 - DNA, 16 bp, Homo sapiens
atctaatttaccatta

SEQ ID NO: 1862261 - DNA, 16 bp, Homo sapiens
atctagcatttatttc

SEQ ID NO: 1862262 - DNA, 21 bp, Homo sapiens
atctagtcaataactctgatt

SEQ ID NO: 1862263 - DNA, 14 bp, Homo sapiens
atctatacctgcct

SEQ ID NO: 1862264 - DNA, 22 bp, Homo sapiens
atctatacctgccttttaagtt

SEQ ID NO: 1862265 - DNA, 16 bp, Homo sapiens
atctatattaaatgag

SEQ ID NO: 1862266 - DNA, 16 bp, Homo sapiens
atctattgtgttggct

SEQ ID NO: 1862267 - DNA, 17 bp, Homo sapiens
atctcataggttgccaa

SEQ ID NO: 1862268 - DNA, 16 bp, Homo sapiens
atctcctctgctcatt

SEQ ID NO: 1862269 - DNA, 21 bp, Homo sapiens
atctcctctgctcattaaact

SEQ ID NO: 1862270 - DNA, 14 bp, Homo sapiens
atctgcttcagtgg

SEQ ID NO: 1862271 - DNA, 21 bp, Homo sapiens
atctgtactttgtgtttagct

SEQ ID NO: 1862272 - DNA, 14 bp, Homo sapiens
atctgtatgattct

SEQ ID NO: 1862273 - DNA, 17 bp, Homo sapiens
atctgtgtgaaaatggg

SEQ ID NO: 1862274 - DNA, 15 bp, Homo sapiens
atctgttgttttgtt

SEQ ID NO: 1862275 - DNA, 22 bp, Homo sapiens
atctgtttgtatatttgcaaac

SEQ ID NO: 1862276 - DNA, 22 bp, Homo sapiens
atcttagagtttacagtttgtg

SEQ ID NO: 1862277 - DNA, 19 bp, Homo sapiens
atcttggcttcttaaaaac

SEQ ID NO: 1862278 - DNA, 21 bp, Homo sapiens
atcttggcttcttaaaaactg

SEQ ID NO: 1862279 - DNA, 23 bp, Homo sapiens
atcttggcttcttaaaaactgtg

SEQ ID NO: 1862280 - DNA, 19 bp, Homo sapiens
atcttgttattaatgtttc

SEQ ID NO: 1862281 - DNA, 12 bp, Homo sapiens
atctttaaatac

SEQ ID NO: 1862282 - DNA, 12 bp, Homo sapiens
atctttgtgtaa

SEQ ID NO: 1862283 - DNA, 20 bp, Homo sapiens
atcttttcctcccattttag

SEQ ID NO: 1862284 - DNA, 12 bp, Homo sapiens
atgaaaagccat

SEQ ID NO: 1862285 - DNA, 20 bp, Homo sapiens
atgaaaataccataggaaga

SEQ ID NO: 1862286 - DNA, 23 bp, Homo sapiens
atgaaaataccataggaagacat

SEQ ID NO: 1862287 - DNA, 19 bp, Homo sapiens
atgaaaatcctatatctgt

SEQ ID NO: 1862288 - DNA, 23 bp, Homo sapiens
atgaaaatcctatatctgtttgt

SEQ ID NO: 1862289 - DNA, 21 bp, Homo sapiens
atgaaattttctagactttct

SEQ ID NO: 1862290 - DNA, 22 bp, Homo sapiens
atgaaattttctagactttctg

SEQ ID NO: 1862291 - DNA, 16 bp, Homo sapiens
atgaaccgtttacagt

SEQ ID NO: 1862292 - DNA, 12 bp, Homo sapiens
atgaactgtgga

SEQ ID NO: 1862293 - DNA, 17 bp, Homo sapiens
atgaactgtggaattta

SEQ ID NO: 1862294 - DNA, 17 bp, Homo sapiens
atgaagcaatttatatc

SEQ ID NO: 1862295 - DNA, 19 bp, Homo sapiens
atgacaaaaataacactgt

SEQ ID NO: 1862296 - DNA, 19 bp, Homo sapiens
atgacaaacctagctttta

SEQ ID NO: 1862297 - DNA, 19 bp, Homo sapiens
atgacaacagaagcttcag

SEQ ID NO: 1862298 - DNA, 23 bp, Homo sapiens
atgacatgttatatattttttgt

SEQ ID NO: 1862299 - DNA, 18 bp, Homo sapiens
atgacgcctctggacctc

SEQ ID NO: 1862300 - DNA, 20 bp, Homo sapiens
atgacggccaggctccctga

SEQ ID NO: 1862301 - DNA, 22 bp, Homo sapiens
atgagatttactgctctagaaa

SEQ ID NO: 1862302 - DNA, 13 bp, Homo sapiens
atgagcacttcta

SEQ ID NO: 1862303 - DNA, 14 bp, Homo sapiens
atgagcacttctaa

SEQ ID NO: 1862304 - DNA, 21 bp, Homo sapiens
atgagggtgtcggctgtgagg

SEQ ID NO: 1862305 - DNA, 18 bp, Homo sapiens
atgataatcatcaggttt

SEQ ID NO: 1862306 - DNA, 16 bp, Homo sapiens
atgatacccaacagtt

SEQ ID NO: 1862307 - DNA, 15 bp, Homo sapiens
atgatcacatctaaa

SEQ ID NO: 1862308 - DNA, 18 bp, Homo sapiens
atgatcacatctaaagct

SEQ ID NO: 1862309 - DNA, 19 bp, Homo sapiens
atgatcacatctaaagctt

SEQ ID NO: 1862310 - DNA, 19 bp, Homo sapiens
atgatggaaacgcacttac

SEQ ID NO: 1862311 - DNA, 11 bp, Homo sapiens
atgatgttaaa

SEQ ID NO: 1862312 - DNA, 18 bp, Homo sapiens
atgattgtaaaatagctt

SEQ ID NO: 1862313 - DNA, 15 bp, Homo sapiens
atgatttatagtttg

SEQ ID NO: 1862314 - DNA, 18 bp, Homo sapiens
atgattttgatgcacaac

SEQ ID NO: 1862315 - DNA, 13 bp, Homo sapiens
atgatttttagat

SEQ ID NO: 1862316 - DNA, 22 bp, Homo sapiens
atgatttttagatgagattgtt

SEQ ID NO: 1862317 - DNA, 22 bp, Homo sapiens
atgcaaaaacatatgtctgtct

SEQ ID NO: 1862318 - DNA, 17 bp, Homo sapiens
atgcaaactgctttatt

SEQ ID NO: 1862319 - DNA, 22 bp, Homo sapiens
atgcaaactgctttattttccc

SEQ ID NO: 1862320 - DNA, 22 bp, Homo sapiens
atgcaatgtatggcttttctct

SEQ ID NO: 1862321 - DNA, 22 bp, Homo sapiens
atgcacaactagttaaaagcct

SEQ ID NO: 1862322 - DNA, 19 bp, Homo sapiens
atgccctgccttgctgcct

SEQ ID NO: 1862323 - DNA, 17 bp, Homo sapiens
atgccgtgtagtttctg

SEQ ID NO: 1862324 - DNA, 19 bp, Homo sapiens
atgccgtgtagtttctggt

SEQ ID NO: 1862325 - DNA, 23 bp, Homo sapiens
atgccttccgacaccactgggaa

SEQ ID NO: 1862326 - DNA, 22 bp, Homo sapiens
atgctgctaaagggagaaatgc

SEQ ID NO: 1862327 - DNA, 14 bp, Homo sapiens
atgctgtatttctt

SEQ ID NO: 1862328 - DNA, 12 bp, Homo sapiens
atgcttctttaa

SEQ ID NO: 1862329 - DNA, 16 bp, Homo sapiens
atggaaacctgaaaaa

SEQ ID NO: 1862330 - DNA, 18 bp, Homo sapiens
atggaaacgcacttacaa

SEQ ID NO: 1862331 - DNA, 21 bp, Homo sapiens
atggaaacgcacttacaagtg

SEQ ID NO: 1862332 - DNA, 18 bp, Homo sapiens
atggaacttctaatatat

SEQ ID NO: 1862333 - DNA, 15 bp, Homo sapiens
atggagcaaatgtcc

SEQ ID NO: 1862334 - DNA, 11 bp, Homo sapiens
atggagcagcc

SEQ ID NO: 1862335 - DNA, 18 bp, Homo sapiens
atggagcagcccccaaag

SEQ ID NO: 1862336 - DNA, 18 bp, Homo sapiens
atggagctattttaaacc

SEQ ID NO: 1862337 - DNA, 13 bp, Homo sapiens
atggcctctgggg

SEQ ID NO: 1862338 - DNA, 19 bp, Homo sapiens
atggctatatggcaagaaa

SEQ ID NO: 1862339 - DNA, 22 bp, Homo sapiens
atggctatctatacctgccttt

SEQ ID NO: 1862340 - DNA, 16 bp, Homo sapiens
atggcttacttacaaa

SEQ ID NO: 1862341 - DNA, 17 bp, Homo sapiens
atggcttacttacaaaa

SEQ ID NO: 1862342 - DNA, 21 bp, Homo sapiens
atggcttacttacaaaagcag

SEQ ID NO: 1862343 - DNA, 20 bp, Homo sapiens
atgggaaagtatttttgaaa

SEQ ID NO: 1862344 - DNA, 15 bp, Homo sapiens
atgggagagtagatg

SEQ ID NO: 1862345 - DNA, 21 bp, Homo sapiens
atgggcaactcgtgacagcct

SEQ ID NO: 1862346 - DNA, 12 bp, Homo sapiens
caagagccaggg

SEQ ID NO: 1862347 - DNA, 22 bp, Homo sapiens
caagagtttatttccaaataaa

SEQ ID NO: 1862348 - DNA, 16 bp, Homo sapiens
caagattgtcattagt

SEQ ID NO: 1862349 - DNA, 19 bp, Homo sapiens
caagccaggagaagacccc

SEQ ID NO: 1862350 - DNA, 16 bp, Homo sapiens
caagctaatctgcctg

SEQ ID NO: 1862351 - DNA, 16 bp, Homo sapiens
caaggaatgtgtccaa

SEQ ID NO: 1862352 - DNA, 14 bp, Homo sapiens
caaggctgtcttct

SEQ ID NO: 1862353 - DNA, 20 bp, Homo sapiens
caaggctgtcttctcccaga

SEQ ID NO: 1862354 - DNA, 13 bp, Homo sapiens
caagggccctcac

SEQ ID NO: 1862355 - DNA, 22 bp, Homo sapiens
caagggccctcactcaggaacc

SEQ ID NO: 1862356 - DNA, 17 bp, Homo sapiens
caaggttcagtctgaat

SEQ ID NO: 1862357 - DNA, 17 bp, Homo sapiens
caagtcctgtgaatttc

SEQ ID NO: 1862358 - DNA, 12 bp, Homo sapiens
caagtggctctt

SEQ ID NO: 1862359 - DNA, 18 bp, Homo sapiens
caagtgtatatcagaaaa

SEQ ID NO: 1862360 - DNA, 12 bp, Homo sapiens
caagtttaaagt

SEQ ID NO: 1862361 - DNA, 12 bp, Homo sapiens
caagtttgctaa

SEQ ID NO: 1862362 - DNA, 18 bp, Homo sapiens
caagtttgctaaaagaag

SEQ ID NO: 1862363 - DNA, 20 bp, Homo sapiens
caagtttgctaaaagaagag

SEQ ID NO: 1862364 - DNA, 14 bp, Homo sapiens
caataactctgatt

SEQ ID NO: 1862365 - DNA, 18 bp, Homo sapiens
caataactctgattttga

SEQ ID NO: 1862366 - DNA, 15 bp, Homo sapiens
caatatgtaaatagt

SEQ ID NO: 1862367 - DNA, 15 bp, Homo sapiens
caatccatgcttcac

SEQ ID NO: 1862368 - DNA, 16 bp, Homo sapiens
caatccatgcttcact

SEQ ID NO: 1862369 - DNA, 13 bp, Homo sapiens
caatcctccctgg

SEQ ID NO: 1862370 - DNA, 23 bp, Homo sapiens
caatgatacccaacagtttattt

SEQ ID NO: 1862371 - DNA, 18 bp, Homo sapiens
caatgccctgccttgctg

SEQ ID NO: 1862372 - DNA, 21 bp, Homo sapiens
caatgccctgccttgctgcct

SEQ ID NO: 1862373 - DNA, 22 bp, Homo sapiens
caatgccctgccttgctgcctt

SEQ ID NO: 1862374 - DNA, 12 bp, Homo sapiens
caattagcagaa

SEQ ID NO: 1862375 - DNA, 11 bp, Homo sapiens
caattcattgt

SEQ ID NO: 1862376 - DNA, 14 bp, Homo sapiens
caattcattgtgta

SEQ ID NO: 1862377 - DNA, 16 bp, Homo sapiens
caattggttaatcttt

SEQ ID NO: 1862378 - DNA, 19 bp, Homo sapiens
caatttatatctttatgca

SEQ ID NO: 1862379 - DNA, 23 bp, Homo sapiens
caatttattaaaatgattgtaaa

SEQ ID NO: 1862380 - DNA, 15 bp, Homo sapiens
caatttcctttatat

SEQ ID NO: 1862381 - DNA, 22 bp, Homo sapiens
cacaagaaggccagcccactgg

SEQ ID NO: 1862382 - DNA, 12 bp, Homo sapiens
cacacatacaca

SEQ ID NO: 1862383 - DNA, 21 bp, Homo sapiens
cacagatggaagaagttttaa

SEQ ID NO: 1862384 - DNA, 13 bp, Homo sapiens
cacagcatgcaga

SEQ ID NO: 1862385 - DNA, 20 bp, Homo sapiens
cacaggaacgcacagatcat

SEQ ID NO: 1862386 - DNA, 22 bp, Homo sapiens
cacagttaaataaatagaaaga

SEQ ID NO: 1862387 - DNA, 17 bp, Homo sapiens
cacagttggctggatga

SEQ ID NO: 1862388 - DNA, 13 bp, Homo sapiens
cacatacacacac

SEQ ID NO: 1862389 - DNA, 14 bp, Homo sapiens
cacatataacactt

SEQ ID NO: 1862390 - DNA, 11 bp, Homo sapiens
cacatggcaga

SEQ ID NO: 1862391 - DNA, 13 bp, Homo sapiens
caccactgggaac

SEQ ID NO: 1862392 - DNA, 17 bp, Homo sapiens
caccagcaatgccctgc

SEQ ID NO: 1862393 - DNA, 19 bp, Homo sapiens
caccagcaatgccctgcct

SEQ ID NO: 1862394 - DNA, 21 bp, Homo sapiens
caccagcaatgccctgccttg

SEQ ID NO: 1862395 - DNA, 13 bp, Homo sapiens
cacccccccaggc

SEQ ID NO: 1862396 - DNA, 14 bp, Homo sapiens
cacccccccaggcc

SEQ ID NO: 1862397 - DNA, 16 bp, Homo sapiens
cacccccccaggcctc

SEQ ID NO: 1862398 - DNA, 14 bp, Homo sapiens
cacctacaggactg

SEQ ID NO: 1862399 - DNA, 18 bp, Homo sapiens
cacctacaggactgggcc

SEQ ID NO: 1862400 - DNA, 15 bp, Homo sapiens
cacctgccttatgca

SEQ ID NO: 1862401 - DNA, 17 bp, Homo sapiens
cacctgggccaaggact

SEQ ID NO: 1862402 - DNA, 22 bp, Homo sapiens
cacgcatgtccctccaaggctg

SEQ ID NO: 1862403 - DNA, 15 bp, Homo sapiens
cacgttttctggctt

SEQ ID NO: 1862404 - DNA, 17 bp, Homo sapiens
cactaaaatgtttaatt

SEQ ID NO: 1862405 - DNA, 22 bp, Homo sapiens
cactaaagtatgtaaagtatgt

SEQ ID NO: 1862406 - DNA, 17 bp, Homo sapiens
cactaaattagtttaaa

SEQ ID NO: 1862407 - DNA, 19 bp, Homo sapiens
cactacatgtggtttatag

SEQ ID NO: 1862408 - DNA, 13 bp, Homo sapiens
cactagaagatga

SEQ ID NO: 1862409 - DNA, 21 bp, Homo sapiens
cactagagtcacccccccagg

SEQ ID NO: 1862410 - DNA, 22 bp, Homo sapiens
cactagagtcacccccccaggc

SEQ ID NO: 1862411 - DNA, 17 bp, Homo sapiens
cactagctaagcaagcc

SEQ ID NO: 1862412 - DNA, 23 bp, Homo sapiens
cactagctaagcaagccaggaga

SEQ ID NO: 1862413 - DNA, 16 bp, Homo sapiens
cactcaggaaccctgg

SEQ ID NO: 1862414 - DNA, 17 bp, Homo sapiens
cactcaggaaccctgga

SEQ ID NO: 1862415 - DNA, 22 bp, Homo sapiens
cactcaggaaccctggagacag

SEQ ID NO: 1862416 - DNA, 13 bp, Homo sapiens
cactcccccagga

SEQ ID NO: 1862417 - DNA, 16 bp, Homo sapiens
cactcccccaggagca

SEQ ID NO: 1862418 - DNA, 19 bp, Homo sapiens
cactcccccaggagcagct

SEQ ID NO: 1862419 - DNA, 22 bp, Homo sapiens
cactcccccaggagcagctggc

SEQ ID NO: 1862420 - DNA, 14 bp, Homo sapiens
cactctctctctgt

SEQ ID NO: 1862421 - DNA, 19 bp, Homo sapiens
cactgacagcctggggggg

SEQ ID NO: 1862422 - DNA, 14 bp, Homo sapiens
cactgacctgccca

SEQ ID NO: 1862423 - DNA, 15 bp, Homo sapiens
cactgacctgcccat

SEQ ID NO: 1862424 - DNA, 16 bp, Homo sapiens
cactgacctgcccatg

SEQ ID NO: 1862425 - DNA, 18 bp, Homo sapiens
cactgacctgcccatgtc

SEQ ID NO: 1862426 - DNA, 13 bp, Homo sapiens
cactgccaccagc

SEQ ID NO: 1862427 - DNA, 22 bp, Homo sapiens
cactgccaccagcaatgccctg

SEQ ID NO: 1862428 - DNA, 23 bp, Homo sapiens
cactgccaccagcaatgccctgc

SEQ ID NO: 1862429 - DNA, 19 bp, Homo sapiens
cactgcggtgtctgcagct

SEQ ID NO: 1862430 - DNA, 22 bp, Homo sapiens
cactgcggtgtctgcagctcct

SEQ ID NO: 1862431 - DNA, 22 bp, Homo sapiens
cactggcatcgcagcttcctgt

SEQ ID NO: 1862432 - DNA, 12 bp, Homo sapiens
cactgggccctg

SEQ ID NO: 1862433 - DNA, 18 bp, Homo sapiens
cactgtggcactgccacc

SEQ ID NO: 1862434 - DNA, 14 bp, Homo sapiens
cactgttgaaaatt

SEQ ID NO: 1862435 - DNA, 13 bp, Homo sapiens
cacttttcagtga

SEQ ID NO: 1862436 - DNA, 22 bp, Homo sapiens
cagaaattaaaatattatttga

SEQ ID NO: 1862437 - DNA, 23 bp, Homo sapiens
cagaaattagaaaccttaatatg

SEQ ID NO: 1862438 - DNA, 17 bp, Homo sapiens
cagaaccagtctttcaa

SEQ ID NO: 1862439 - DNA, 14 bp, Homo sapiens
cagaaccttactgg

SEQ ID NO: 1862440 - DNA, 18 bp, Homo sapiens
cagaaccttactggcact

SEQ ID NO: 1862441 - DNA, 14 bp, Homo sapiens
cagaagcttcagaa

SEQ ID NO: 1862442 - DNA, 12 bp, Homo sapiens
cagaatctgtat

SEQ ID NO: 1862443 - DNA, 16 bp, Homo sapiens
cagaatctgtatgatt

SEQ ID NO: 1862444 - DNA, 15 bp, Homo sapiens
cagaatgcattaaaa

SEQ ID NO: 1862445 - DNA, 20 bp, Homo sapiens
cagaatggagaaagtaagtc

SEQ ID NO: 1862446 - DNA, 19 bp, Homo sapiens
cagacatccatgtttgtaa

SEQ ID NO: 1862447 - DNA, 22 bp, Homo sapiens
cagacatccatgtttgtaaaac

SEQ ID NO: 1862448 - DNA, 14 bp, Homo sapiens
cagacttgcggcca

SEQ ID NO: 1862449 - DNA, 18 bp, Homo sapiens
cagacttgcggccacagc

SEQ ID NO: 1862450 - DNA, 11 bp, Homo sapiens
cagagaaagaa

SEQ ID NO: 1862451 - DNA, 18 bp, Homo sapiens
cagagaaagaaaaggcaa

SEQ ID NO: 1862452 - DNA, 23 bp, Homo sapiens
cagagaaagaaaaggcaaaagac

SEQ ID NO: 1862453 - DNA, 17 bp, Homo sapiens
cagagaaattatgtttt

SEQ ID NO: 1862454 - DNA, 18 bp, Homo sapiens
cagagcacaagaaggcca

SEQ ID NO: 1862455 - DNA, 22 bp, Homo sapiens
cagagcacaagaaggccagccc

SEQ ID NO: 1862456 - DNA, 23 bp, Homo sapiens
cagagcacaagaaggccagccca

SEQ ID NO: 1862457 - DNA, 16 bp, Homo sapiens
cagagcttgtagccct

SEQ ID NO: 1862458 - DNA, 19 bp, Homo sapiens
cagagcttgtagccctgga

SEQ ID NO: 1862459 - DNA, 12 bp, Homo sapiens
cagagggactgg

SEQ ID NO: 1862460 - DNA, 13 bp, Homo sapiens
cagagggactgga

SEQ ID NO: 1862461 - DNA, 16 bp, Homo sapiens
cagagggactggacag

SEQ ID NO: 1862462 - DNA, 18 bp, Homo sapiens
cagagggactggacagcc

SEQ ID NO: 1862463 - DNA, 17 bp, Homo sapiens
ctagtatctattgtgtt

SEQ ID NO: 1862464 - DNA, 15 bp, Homo sapiens
ctagttaaaagcctt

SEQ ID NO: 1862465 - DNA, 12 bp, Homo sapiens
ctagttgcattt

SEQ ID NO: 1862466 - DNA, 12 bp, Homo sapiens
ctataaacactg

SEQ ID NO: 1862467 - DNA, 21 bp, Homo sapiens
ctataaacactgtttgttcca

SEQ ID NO: 1862468 - DNA, 14 bp, Homo sapiens
ctataataagtttt

SEQ ID NO: 1862469 - DNA, 18 bp, Homo sapiens
ctataataagttttgata

SEQ ID NO: 1862470 - DNA, 19 bp, Homo sapiens
ctatacctgccttttaagt

SEQ ID NO: 1862471 - DNA, 13 bp, Homo sapiens
ctatatctgtttg

SEQ ID NO: 1862472 - DNA, 19 bp, Homo sapiens
ctatatgatttatagtttg

SEQ ID NO: 1862473 - DNA, 19 bp, Homo sapiens
ctatatggcaagaaagctg

SEQ ID NO: 1862474 - DNA, 13 bp, Homo sapiens
ctatattaaatga

SEQ ID NO: 1862475 - DNA, 14 bp, Homo sapiens
ctatattaaatgag

SEQ ID NO: 1862476 - DNA, 15 bp, Homo sapiens
ctatgctggacatta

SEQ ID NO: 1862477 - DNA, 17 bp, Homo sapiens
ctatttgtctttcagga

SEQ ID NO: 1862478 - DNA, 17 bp, Homo sapiens
ctattttctctgatact

SEQ ID NO: 1862479 - DNA, 16 bp, Homo sapiens
ctcaaaacttaacata

SEQ ID NO: 1862480 - DNA, 20 bp, Homo sapiens
ctcaaaacttaacatattta

SEQ ID NO: 1862481 - DNA, 15 bp, Homo sapiens
ctcacatattattgg

SEQ ID NO: 1862482 - DNA, 22 bp, Homo sapiens
ctcaccacgatgacgcctctgg

SEQ ID NO: 1862483 - DNA, 23 bp, Homo sapiens
ctcaccacgatgacgcctctgga

SEQ ID NO: 1862484 - DNA, 18 bp, Homo sapiens
ctcactcaggaaccctgg

SEQ ID NO: 1862485 - DNA, 20 bp, Homo sapiens
ctcactcaggaaccctggag

SEQ ID NO: 1862486 - DNA, 17 bp, Homo sapiens
ctcagaggacccacctg

SEQ ID NO: 1862487 - DNA, 20 bp, Homo sapiens
ctcagagggaggagtttttc

SEQ ID NO: 1862488 - DNA, 15 bp, Homo sapiens
ctcaggaaccctgga

SEQ ID NO: 1862489 - DNA, 16 bp, Homo sapiens
ctcaggaaccctggag

SEQ ID NO: 1862490 - DNA, 17 bp, Homo sapiens
ctcaggaaccctggaga

SEQ ID NO: 1862491 - DNA, 16 bp, Homo sapiens
ctcatcatcagtctta

SEQ ID NO: 1862492 - DNA, 16 bp, Homo sapiens
ctcatgcaaactgctt

SEQ ID NO: 1862493 - DNA, 21 bp, Homo sapiens
ctcatgcaaactgctttattt

SEQ ID NO: 1862494 - DNA, 12 bp, Homo sapiens
ctcatgcccact

SEQ ID NO: 1862495 - DNA, 19 bp, Homo sapiens
ctcattaaactctaaagat

SEQ ID NO: 1862496 - DNA, 18 bp, Homo sapiens
ctcattaaactgattcca

SEQ ID NO: 1862497 - DNA, 23 bp, Homo sapiens
ctcattgtggccagtttagagtt

SEQ ID NO: 1862498 - DNA, 20 bp, Homo sapiens
ctcattttaatgattgttta

SEQ ID NO: 1862499 - DNA, 20 bp, Homo sapiens
ctccaattctgaaatacttt

SEQ ID NO: 1862500 - DNA, 14 bp, Homo sapiens
ctccaggtaacttt

SEQ ID NO: 1862501 - DNA, 18 bp, Homo sapiens
ctccagtataatctcctc

SEQ ID NO: 1862502 - DNA, 16 bp, Homo sapiens
ctccccaaaagaaacc

SEQ ID NO: 1862503 - DNA, 14 bp, Homo sapiens
ctcccccaggagca

SEQ ID NO: 1862504 - DNA, 13 bp, Homo sapiens
ctccccctgcagc

SEQ ID NO: 1862505 - DNA, 17 bp, Homo sapiens
ctccctgaccaccctgc

SEQ ID NO: 1862506 - DNA, 19 bp, Homo sapiens
ctccctgaccaccctgcct

SEQ ID NO: 1862507 - DNA, 15 bp, Homo sapiens
ctcccttttctcctc

SEQ ID NO: 1862508 - DNA, 21 bp, Homo sapiens
ctcctggaaccggtcacagga

SEQ ID NO: 1862509 - DNA, 21 bp, Homo sapiens
ctcctgggcatgtttgtctgt

SEQ ID NO: 1862510 - DNA, 21 bp, Homo sapiens
ctcgtgacagcctctgactca

SEQ ID NO: 1862511 - DNA, 14 bp, Homo sapiens
ctctaattagagaa

SEQ ID NO: 1862512 - DNA, 14 bp, Homo sapiens
ctctagctgttctt

SEQ ID NO: 1862513 - DNA, 21 bp, Homo sapiens
ctctagctgttcttttttgta

SEQ ID NO: 1862514 - DNA, 16 bp, Homo sapiens
ctctggcttccctgcc

SEQ ID NO: 1862515 - DNA, 17 bp, Homo sapiens
ctctggggcaggaccac

SEQ ID NO: 1862516 - DNA, 21 bp, Homo sapiens
ctctggggcaggaccactagc

SEQ ID NO: 1862517 - DNA, 22 bp, Homo sapiens
ctctggggcaggaccactagct

SEQ ID NO: 1862518 - DNA, 16 bp, Homo sapiens
ctctgttaaagatcag

SEQ ID NO: 1862519 - DNA, 13 bp, Homo sapiens
ctcttaaatcatt

SEQ ID NO: 1862520 - DNA, 14 bp, Homo sapiens
ctcttaaatcattt

SEQ ID NO: 1862521 - DNA, 19 bp, Homo sapiens
ctcttcatactttttttca

SEQ ID NO: 1862522 - DNA, 22 bp, Homo sapiens
ctcttgccccaaatcacaaaca

SEQ ID NO: 1862523 - DNA, 17 bp, Homo sapiens
ctctttaacttgtaata

SEQ ID NO: 1862524 - DNA, 11 bp, Homo sapiens
ctctttgaaac

SEQ ID NO: 1862525 - DNA, 20 bp, Homo sapiens
ctctttgccttgatgttgtg

SEQ ID NO: 1862526 - DNA, 18 bp, Homo sapiens
ctcttttgtgagaagatg

SEQ ID NO: 1862527 - DNA, 19 bp, Homo sapiens
ctcttttgtgagaagatgg

SEQ ID NO: 1862528 - DNA, 14 bp, Homo sapiens
ctgaaaaaaagttt

SEQ ID NO: 1862529 - DNA, 18 bp, Homo sapiens
ctgaaaaaaagtttacaa

SEQ ID NO: 1862530 - DNA, 17 bp, Homo sapiens
ctgaaaatctaatatta

SEQ ID NO: 1862531 - DNA, 20 bp, Homo sapiens
ctgaacatttagtaccctgc

SEQ ID NO: 1862532 - DNA, 22 bp, Homo sapiens
ctgaacatttagtaccctgcag

SEQ ID NO: 1862533 - DNA, 12 bp, Homo sapiens
ctgaactgtttg

SEQ ID NO: 1862534 - DNA, 14 bp, Homo sapiens
ctgaactgtttggt

SEQ ID NO: 1862535 - DNA, 13 bp, Homo sapiens
ctgaaggtttttt

SEQ ID NO: 1862536 - DNA, 22 bp, Homo sapiens
ctgaaggttttttttttaagtg

SEQ ID NO: 1862537 - DNA, 19 bp, Homo sapiens
ctgaataagcactttttaa

SEQ ID NO: 1862538 - DNA, 15 bp, Homo sapiens
ctgaatcttctgaaa

SEQ ID NO: 1862539 - DNA, 14 bp, Homo sapiens
ctgacagcctgggg

SEQ ID NO: 1862540 - DNA, 15 bp, Homo sapiens
ctgaccaccctgcct

SEQ ID NO: 1862541 - DNA, 22 bp, Homo sapiens
ctgaccaccctgcctgtggagg

SEQ ID NO: 1862542 - DNA, 12 bp, Homo sapiens
ctgacctgccca

SEQ ID NO: 1862543 - DNA, 13 bp, Homo sapiens
ctgacctgcccat

SEQ ID NO: 1862544 - DNA, 16 bp, Homo sapiens
ctgactctgttattga

SEQ ID NO: 1862545 - DNA, 17 bp, Homo sapiens
ctgaggttttgaataaa

SEQ ID NO: 1862546 - DNA, 20 bp, Homo sapiens
ctgaggttttgaataaaaag

SEQ ID NO: 1862547 - DNA, 16 bp, Homo sapiens
ctgagtgagttttact

SEQ ID NO: 1862548 - DNA, 18 bp, Homo sapiens
ctgatagctaagtgagtt

SEQ ID NO: 1862549 - DNA, 13 bp, Homo sapiens
ctgatatgtttgt

SEQ ID NO: 1862550 - DNA, 17 bp, Homo sapiens
ctgatctgtactttgtg

SEQ ID NO: 1862551 - DNA, 18 bp, Homo sapiens
ctgatctgtactttgtgt

SEQ ID NO: 1862552 - DNA, 22 bp, Homo sapiens
ctgatggcacttagctatcaga

SEQ ID NO: 1862553 - DNA, 19 bp, Homo sapiens
ctgattataccatgtgtgc

SEQ ID NO: 1862554 - DNA, 14 bp, Homo sapiens
ctgcaagaattaaa

SEQ ID NO: 1862555 - DNA, 19 bp, Homo sapiens
ctgcaagaattaaaactga

SEQ ID NO: 1862556 - DNA, 18 bp, Homo sapiens
ctgcaagcatttttccat

SEQ ID NO: 1862557 - DNA, 15 bp, Homo sapiens
ctgcagccgtgcagg

SEQ ID NO: 1862558 - DNA, 15 bp, Homo sapiens
ctgcagctcctggaa

SEQ ID NO: 1862559 - DNA, 18 bp, Homo sapiens
ctgcagctttgggaaagc

SEQ ID NO: 1862560 - DNA, 12 bp, Homo sapiens
ctgcaggccagg

SEQ ID NO: 1862561 - DNA, 14 bp, Homo sapiens
ctgcaggccaggcc

SEQ ID NO: 1862562 - DNA, 15 bp, Homo sapiens
ctgcaggccaggcca

SEQ ID NO: 1862563 - DNA, 23 bp, Homo sapiens
ctgcatgcataatgaaccgttta

SEQ ID NO: 1862564 - DNA, 18 bp, Homo sapiens
ctgccaccagcaatgccc

SEQ ID NO: 1862565 - DNA, 20 bp, Homo sapiens
ctgccaccagcaatgccctg

SEQ ID NO: 1862566 - DNA, 20 bp, Homo sapiens
ctgcccaagtggctcttggg

SEQ ID NO: 1862567 - DNA, 16 bp, Homo sapiens
ctgcccaatcctccct

SEQ ID NO: 1862568 - DNA, 13 bp, Homo sapiens
ctgcccatgtcca

SEQ ID NO: 1862569 - DNA, 11 bp, Homo sapiens
ctgccctcggc

SEQ ID NO: 1862570 - DNA, 11 bp, Homo sapiens
ctgccctgggg

SEQ ID NO: 1862571 - DNA, 12 bp, Homo sapiens
ctgccctggggc

SEQ ID NO: 1862572 - DNA, 16 bp, Homo sapiens
ctgccctggggcatca

SEQ ID NO: 1862573 - DNA, 23 bp, Homo sapiens
ctgccctttcccaggtaatttaa

SEQ ID NO: 1862574 - DNA, 15 bp, Homo sapiens
ctgcctcgtttccct

SEQ ID NO: 1862575 - DNA, 15 bp, Homo sapiens
ctgccttcaccctga

SEQ ID NO: 1862576 - DNA, 14 bp, Homo sapiens
ctgcggtgtctgca

SEQ ID NO: 1862577 - DNA, 20 bp, Homo sapiens
ctgctcattaaactgattcc

SEQ ID NO: 1862578 - DNA, 19 bp, Homo sapiens
ctgctgaaagtcctgcttt

SEQ ID NO: 1862579 - DNA, 17 bp, Homo sapiens
ctgcttcatcctgctcc

SEQ ID NO: 1862580 - DNA, 22 bp, Homo sapiens
gaaatcagcatgacaaaaataa

SEQ ID NO: 1862581 - DNA, 23 bp, Homo sapiens
gaaatcagcatgacaaaaataac

SEQ ID NO: 1862582 - DNA, 12 bp, Homo sapiens
gaaatcatatta

SEQ ID NO: 1862583 - DNA, 17 bp, Homo sapiens
gaaatggtatccagaat

SEQ ID NO: 1862584 - DNA, 12 bp, Homo sapiens
gaaattaaaata

SEQ ID NO: 1862585 - DNA, 14 bp, Homo sapiens
gaaattagtctttt

SEQ ID NO: 1862586 - DNA, 21 bp, Homo sapiens
gaaatttattagttaatatat

SEQ ID NO: 1862587 - DNA, 14 bp, Homo sapiens
gaaatttgatttct

SEQ ID NO: 1862588 - DNA, 21 bp, Homo sapiens
gaaatttgatttctattcaag

SEQ ID NO: 1862589 - DNA, 18 bp, Homo sapiens
gaaattttctagactttc

SEQ ID NO: 1862590 - DNA, 14 bp, Homo sapiens
gaacacatggcaga

SEQ ID NO: 1862591 - DNA, 20 bp, Homo sapiens
gaacatttagtaccctgcag

SEQ ID NO: 1862592 - DNA, 14 bp, Homo sapiens
gaaccaagggccct

SEQ ID NO: 1862593 - DNA, 17 bp, Homo sapiens
gaacccccaaatttaat

SEQ ID NO: 1862594 - DNA, 13 bp, Homo sapiens
gaaccctggagac

SEQ ID NO: 1862595 - DNA, 16 bp, Homo sapiens
gaaccctggagacaga

SEQ ID NO: 1862596 - DNA, 18 bp, Homo sapiens
gaaccttactggcactgt

SEQ ID NO: 1862597 - DNA, 20 bp, Homo sapiens
gaaccttactggcactgtgg

SEQ ID NO: 1862598 - DNA, 22 bp, Homo sapiens
gaaccttactggcactgtggca

SEQ ID NO: 1862599 - DNA, 14 bp, Homo sapiens
gaacgttttaaagc

SEQ ID NO: 1862600 - DNA, 14 bp, Homo sapiens
gaactgtggaattt

SEQ ID NO: 1862601 - DNA, 13 bp, Homo sapiens
gaacttctaatat

SEQ ID NO: 1862602 - DNA, 14 bp, Homo sapiens
gaacttctaatata

SEQ ID NO: 1862603 - DNA, 17 bp, Homo sapiens
gaactttgccttaagtt

SEQ ID NO: 1862604 - DNA, 14 bp, Homo sapiens
gaacttttacagaa

SEQ ID NO: 1862605 - DNA, 18 bp, Homo sapiens
gaacttttacagaatgca

SEQ ID NO: 1862606 - DNA, 15 bp, Homo sapiens
gaacttttgtaattt

SEQ ID NO: 1862607 - DNA, 18 bp, Homo sapiens
gaacttttgtaatttgaa

SEQ ID NO: 1862608 - DNA, 12 bp, Homo sapiens
gaagaagttttt

SEQ ID NO: 1862609 - DNA, 14 bp, Homo sapiens
gaagaatttaatgg

SEQ ID NO: 1862610 - DNA, 18 bp, Homo sapiens
gaagaatttaatggactg

SEQ ID NO: 1862611 - DNA, 13 bp, Homo sapiens
gaagacataaaac

SEQ ID NO: 1862612 - DNA, 14 bp, Homo sapiens
gaagacataaaact

SEQ ID NO: 1862613 - DNA, 15 bp, Homo sapiens
gaagacataaaactt

SEQ ID NO: 1862614 - DNA, 17 bp, Homo sapiens
gaagacccctgcccaag

SEQ ID NO: 1862615 - DNA, 19 bp, Homo sapiens
gaagacccctgcccaagtg

SEQ ID NO: 1862616 - DNA, 15 bp, Homo sapiens
gaagatgggggctgg

SEQ ID NO: 1862617 - DNA, 17 bp, Homo sapiens
gaagatgggggctggag

SEQ ID NO: 1862618 - DNA, 13 bp, Homo sapiens
gaagcagcaatta

SEQ ID NO: 1862619 - DNA, 13 bp, Homo sapiens
gaagggacatggg

SEQ ID NO: 1862620 - DNA, 14 bp, Homo sapiens
gaaggtaataaata

SEQ ID NO: 1862621 - DNA, 21 bp, Homo sapiens
gaaggttttttttttaagtgc

SEQ ID NO: 1862622 - DNA, 19 bp, Homo sapiens
gaagtaactggtgatatat

SEQ ID NO: 1862623 - DNA, 12 bp, Homo sapiens
gaagtcaggtgt

SEQ ID NO: 1862624 - DNA, 23 bp, Homo sapiens
gaataaaaagtgaacttttgtaa

SEQ ID NO: 1862625 - DNA, 16 bp, Homo sapiens
gaataagcacttttta

SEQ ID NO: 1862626 - DNA, 16 bp, Homo sapiens
gaatagaggccaaatt

SEQ ID NO: 1862627 - DNA, 17 bp, Homo sapiens
gaatatagattaaatca

SEQ ID NO: 1862628 - DNA, 17 bp, Homo sapiens
gaatattaatggaaaca

SEQ ID NO: 1862629 - DNA, 17 bp, Homo sapiens
gaatctgtatgattcta

SEQ ID NO: 1862630 - DNA, 18 bp, Homo sapiens
gaatctgtatgattctat

SEQ ID NO: 1862631 - DNA, 16 bp, Homo sapiens
gaatgaactgtggaat

SEQ ID NO: 1862632 - DNA, 18 bp, Homo sapiens
gaatgctttttgaatgtt

SEQ ID NO: 1862633 - DNA, 14 bp, Homo sapiens
gaatggagaaagta

SEQ ID NO: 1862634 - DNA, 17 bp, Homo sapiens
gaatggagaaagtaagt

SEQ ID NO: 1862635 - DNA, 12 bp, Homo sapiens
gaatgggaaagt

SEQ ID NO: 1862636 - DNA, 12 bp, Homo sapiens
gaattaaaactg

SEQ ID NO: 1862637 - DNA, 13 bp, Homo sapiens
gaattaaaactga

SEQ ID NO: 1862638 - DNA, 15 bp, Homo sapiens
gaattaaaactgagt

SEQ ID NO: 1862639 - DNA, 22 bp, Homo sapiens
gaattaaaactgagtccatgaa

SEQ ID NO: 1862640 - DNA, 15 bp, Homo sapiens
gaattaatagctttt

SEQ ID NO: 1862641 - DNA, 22 bp, Homo sapiens
gaattaccatagagtaatgatg

SEQ ID NO: 1862642 - DNA, 19 bp, Homo sapiens
gaattgagaataagaattt

SEQ ID NO: 1862643 - DNA, 17 bp, Homo sapiens
gaattggcataatttgt

SEQ ID NO: 1862644 - DNA, 21 bp, Homo sapiens
gaattggcataatttgtctta

SEQ ID NO: 1862645 - DNA, 15 bp, Homo sapiens
gaatttaatggactg

SEQ ID NO: 1862646 - DNA, 17 bp, Homo sapiens
gacaaaaataacactgt

SEQ ID NO: 1862647 - DNA, 19 bp, Homo sapiens
gacaaaaataacactgttg

SEQ ID NO: 1862648 - DNA, 13 bp, Homo sapiens
gacaaacctagct

SEQ ID NO: 1862649 - DNA, 12 bp, Homo sapiens
gacaacagaagc

SEQ ID NO: 1862650 - DNA, 22 bp, Homo sapiens
gacacactgcggtgtctgcagc

SEQ ID NO: 1862651 - DNA, 14 bp, Homo sapiens
gacaccactgggaa

SEQ ID NO: 1862652 - DNA, 16 bp, Homo sapiens
gacaccactgggaacc

SEQ ID NO: 1862653 - DNA, 23 bp, Homo sapiens
gacaccgggaagtgcagcgggcc

SEQ ID NO: 1862654 - DNA, 16 bp, Homo sapiens
gacacctacagcagca

SEQ ID NO: 1862655 - DNA, 16 bp, Homo sapiens
gacacctgccttatgc

SEQ ID NO: 1862656 - DNA, 14 bp, Homo sapiens
gacagaagtcaggt

SEQ ID NO: 1862657 - DNA, 11 bp, Homo sapiens
gacagccaggg

SEQ ID NO: 1862658 - DNA, 19 bp, Homo sapiens
gacagccagggcagggctt

SEQ ID NO: 1862659 - DNA, 16 bp, Homo sapiens
gacagcctctgactca

SEQ ID NO: 1862660 - DNA, 19 bp, Homo sapiens
gacagcctctgactcacca

SEQ ID NO: 1862661 - DNA, 13 bp, Homo sapiens
gacataaaacttt

SEQ ID NO: 1862662 - DNA, 15 bp, Homo sapiens
gacataaaactttaa

SEQ ID NO: 1862663 - DNA, 20 bp, Homo sapiens
gacataaaactttaaaaggc

SEQ ID NO: 1862664 - DNA, 22 bp, Homo sapiens
gacataaaactttaaaaggcaa

SEQ ID NO: 1862665 - DNA, 22 bp, Homo sapiens
gacatccatgtttgtaaaacta

SEQ ID NO: 1862666 - DNA, 14 bp, Homo sapiens
gacatgtttttgtt

SEQ ID NO: 1862667 - DNA, 18 bp, Homo sapiens
gacatgtttttgttttct

SEQ ID NO: 1862668 - DNA, 18 bp, Homo sapiens
gacattgatttgattttt

SEQ ID NO: 1862669 - DNA, 13 bp, Homo sapiens
gaccaccctgcct

SEQ ID NO: 1862670 - DNA, 14 bp, Homo sapiens
gaccaccctgcctg

SEQ ID NO: 1862671 - DNA, 23 bp, Homo sapiens
gacccagtgagattacagaggaa

SEQ ID NO: 1862672 - DNA, 12 bp, Homo sapiens
gacccctgccca

SEQ ID NO: 1862673 - DNA, 21 bp, Homo sapiens
gacccctgcccaagtggctct

SEQ ID NO: 1862674 - DNA, 12 bp, Homo sapiens
gacctttatcca

SEQ ID NO: 1862675 - DNA, 12 bp, Homo sapiens
gacgcctctgga

SEQ ID NO: 1862676 - DNA, 15 bp, Homo sapiens
gacgcctctggacct

SEQ ID NO: 1862677 - DNA, 11 bp, Homo sapiens
gacggccaggc

SEQ ID NO: 1862678 - DNA, 12 bp, Homo sapiens
gacggccaggct

SEQ ID NO: 1862679 - DNA, 13 bp, Homo sapiens
gacggccaggctc

SEQ ID NO: 1862680 - DNA, 15 bp, Homo sapiens
gacggccaggctccc

SEQ ID NO: 1862681 - DNA, 17 bp, Homo sapiens
gacggccaggctccctg

SEQ ID NO: 1862682 - DNA, 16 bp, Homo sapiens
gactatttaagtacta

SEQ ID NO: 1862683 - DNA, 19 bp, Homo sapiens
gactccagcacgttttctg

SEQ ID NO: 1862684 - DNA, 13 bp, Homo sapiens
gactctgttattg

SEQ ID NO: 1862685 - DNA, 20 bp, Homo sapiens
gactgcaagcatttttccat

SEQ ID NO: 1862686 - DNA, 21 bp, Homo sapiens
gactggacagccagggcaggg

SEQ ID NO: 1862687 - DNA, 22 bp, Homo sapiens
gactggacagccagggcagggc

SEQ ID NO: 1862688 - DNA, 17 bp, Homo sapiens
gactgggccgggcccag

SEQ ID NO: 1862689 - DNA, 18 bp, Homo sapiens
gactgtcaaatgaacttt

SEQ ID NO: 1862690 - DNA, 15 bp, Homo sapiens
gactgtgaatttcaa

SEQ ID NO: 1862691 - DNA, 18 bp, Homo sapiens
gactgtgaatttcaaaaa

SEQ ID NO: 1862692 - DNA, 22 bp, Homo sapiens
gactgtggccatatatgctgta

SEQ ID NO: 1862693 - DNA, 23 bp, Homo sapiens
gactgtggccatatatgctgtat

SEQ ID NO: 1862694 - DNA, 16 bp, Homo sapiens
gacttgcggccacagc

SEQ ID NO: 1862695 - DNA, 18 bp, Homo sapiens
gacttgcggccacagcac

SEQ ID NO: 1862696 - DNA, 19 bp, Homo sapiens
gacttgcggccacagcact

SEQ ID NO: 1862697 - DNA, 17 bp, Homo sapiens
gacttggcaacagaagc

SEQ ID NO: 1862698 - DNA, 22 bp, Homo sapiens
ggccatttgctgccctggggca

SEQ ID NO: 1862699 - DNA, 23 bp, Homo sapiens
ggccatttgctgccctggggcat

SEQ ID NO: 1862700 - DNA, 13 bp, Homo sapiens
ggcccagggcctc

SEQ ID NO: 1862701 - DNA, 15 bp, Homo sapiens
ggccctcactcagga

SEQ ID NO: 1862702 - DNA, 22 bp, Homo sapiens
ggccctcactcaggaaccctgg

SEQ ID NO: 1862703 - DNA, 20 bp, Homo sapiens
ggccctggggctgccctcgg

SEQ ID NO: 1862704 - DNA, 14 bp, Homo sapiens
ggccgcagccccca

SEQ ID NO: 1862705 - DNA, 20 bp, Homo sapiens
ggccgcagcccccactgacc

SEQ ID NO: 1862706 - DNA, 17 bp, Homo sapiens
ggccgctctccccctgc

SEQ ID NO: 1862707 - DNA, 20 bp, Homo sapiens
ggccgctctccccctgcagc

SEQ ID NO: 1862708 - DNA, 21 bp, Homo sapiens
ggccgctctccccctgcagcc

SEQ ID NO: 1862709 - DNA, 22 bp, Homo sapiens
ggccgctctccccctgcagccg

SEQ ID NO: 1862710 - DNA, 11 bp, Homo sapiens
ggcctccagaa

SEQ ID NO: 1862711 - DNA, 14 bp, Homo sapiens
ggcctctggcttcc

SEQ ID NO: 1862712 - DNA, 18 bp, Homo sapiens
ggcctctggcttccctgc

SEQ ID NO: 1862713 - DNA, 19 bp, Homo sapiens
ggcctctggcttccctgcc

SEQ ID NO: 1862714 - DNA, 20 bp, Homo sapiens
ggcctctggcttccctgccc

SEQ ID NO: 1862715 - DNA, 13 bp, Homo sapiens
ggcctctggggca

SEQ ID NO: 1862716 - DNA, 19 bp, Homo sapiens
ggcctctggggcaggacca

SEQ ID NO: 1862717 - DNA, 18 bp, Homo sapiens
ggcctgtgagcaagagcc

SEQ ID NO: 1862718 - DNA, 14 bp, Homo sapiens
ggcgaggaaaaaca

SEQ ID NO: 1862719 - DNA, 22 bp, Homo sapiens
ggcgctggacacctacagcagc

SEQ ID NO: 1862720 - DNA, 13 bp, Homo sapiens
ggcgggtggctgg

SEQ ID NO: 1862721 - DNA, 23 bp, Homo sapiens
ggctactgcagctttacatgcaa

SEQ ID NO: 1862722 - DNA, 14 bp, Homo sapiens
ggctccctgaccac

SEQ ID NO: 1862723 - DNA, 19 bp, Homo sapiens
ggctccctgaccaccctgc

SEQ ID NO: 1862724 - DNA, 14 bp, Homo sapiens
ggctgccctcggca

SEQ ID NO: 1862725 - DNA, 15 bp, Homo sapiens
ggctggatgaaattt

SEQ ID NO: 1862726 - DNA, 14 bp, Homo sapiens
ggctggggggatga

SEQ ID NO: 1862727 - DNA, 15 bp, Homo sapiens
ggctgtcttctccca

SEQ ID NO: 1862728 - DNA, 18 bp, Homo sapiens
ggctgtcttctcccagag

SEQ ID NO: 1862729 - DNA, 20 bp, Homo sapiens
ggctgtcttctcccagagca

SEQ ID NO: 1862730 - DNA, 21 bp, Homo sapiens
ggctgtcttctcccagagcac

SEQ ID NO: 1862731 - DNA, 12 bp, Homo sapiens
ggctgtgaggcg

SEQ ID NO: 1862732 - DNA, 13 bp, Homo sapiens
ggcttccctgccc

SEQ ID NO: 1862733 - DNA, 14 bp, Homo sapiens
ggcttccctgccca

SEQ ID NO: 1862734 - DNA, 12 bp, Homo sapiens
ggcttctgcttc

SEQ ID NO: 1862735 - DNA, 15 bp, Homo sapiens
ggcttcttaaaaact

SEQ ID NO: 1862736 - DNA, 19 bp, Homo sapiens
ggcttcttaaaaactgtgt

SEQ ID NO: 1862737 - DNA, 21 bp, Homo sapiens
ggcttgctgtttactcccttc

SEQ ID NO: 1862738 - DNA, 20 bp, Homo sapiens
gggaattttccccgtgacat

SEQ ID NO: 1862739 - DNA, 14 bp, Homo sapiens
gggactggacagcc

SEQ ID NO: 1862740 - DNA, 19 bp, Homo sapiens
gggagacaattagcagaat

SEQ ID NO: 1862741 - DNA, 18 bp, Homo sapiens
gggaggccatttgctgcc

SEQ ID NO: 1862742 - DNA, 23 bp, Homo sapiens
gggaggccatttgctgccctggg

SEQ ID NO: 1862743 - DNA, 16 bp, Homo sapiens
gggatgaaaagccata

SEQ ID NO: 1862744 - DNA, 21 bp, Homo sapiens
gggcaactcgtgacagcctct

SEQ ID NO: 1862745 - DNA, 21 bp, Homo sapiens
gggcagagcttgtagccctgg

SEQ ID NO: 1862746 - DNA, 19 bp, Homo sapiens
gggcagagtggcctgtgag

SEQ ID NO: 1862747 - DNA, 11 bp, Homo sapiens
gggccctgggg

SEQ ID NO: 1862748 - DNA, 17 bp, Homo sapiens
gggccctggggctgccc

SEQ ID NO: 1862749 - DNA, 19 bp, Homo sapiens
gggccgctctccccctgca

SEQ ID NO: 1862750 - DNA, 13 bp, Homo sapiens
gggccgggcccag

SEQ ID NO: 1862751 - DNA, 20 bp, Homo sapiens
gggctactgcagctttacat

SEQ ID NO: 1862752 - DNA, 20 bp, Homo sapiens
ggggaggccatttgctgccc

SEQ ID NO: 1862753 - DNA, 19 bp, Homo sapiens
ggggatgacggccaggctc

SEQ ID NO: 1862754 - DNA, 11 bp, Homo sapiens
ggggcagagct

SEQ ID NO: 1862755 - DNA, 21 bp, Homo sapiens
ggggccgctctccccctgcag

SEQ ID NO: 1862756 - DNA, 12 bp, Homo sapiens
ggggctgccctc

SEQ ID NO: 1862757 - DNA, 18 bp, Homo sapiens
gggggcagagtggcctgt

SEQ ID NO: 1862758 - DNA, 12 bp, Homo sapiens
ggggggccgctc

SEQ ID NO: 1862759 - DNA, 14 bp, Homo sapiens
ggggtgtcccagtc

SEQ ID NO: 1862760 - DNA, 19 bp, Homo sapiens
gggtgtcccagtcccagcc

SEQ ID NO: 1862761 - DNA, 22 bp, Homo sapiens
gggttcaaggactaacgaacgt

SEQ ID NO: 1862762 - DNA, 17 bp, Homo sapiens
ggtaaatttttgaaaaa

SEQ ID NO: 1862763 - DNA, 14 bp, Homo sapiens
ggtaagtgaattta

SEQ ID NO: 1862764 - DNA, 17 bp, Homo sapiens
ggtaatttttttttgta

SEQ ID NO: 1862765 - DNA, 14 bp, Homo sapiens
ggtcatggagcagc

SEQ ID NO: 1862766 - DNA, 17 bp, Homo sapiens
ggtcccgcttagttctt

SEQ ID NO: 1862767 - DNA, 12 bp, Homo sapiens
ggtctcatgccc

SEQ ID NO: 1862768 - DNA, 12 bp, Homo sapiens
ggtcttctgcat

SEQ ID NO: 1862769 - DNA, 19 bp, Homo sapiens
ggtgtcccagtcccagcct

SEQ ID NO: 1862770 - DNA, 13 bp, Homo sapiens
ggttctataataa

SEQ ID NO: 1862771 - DNA, 21 bp, Homo sapiens
ggttgtcttgaaacctttcta

SEQ ID NO: 1862772 - DNA, 18 bp, Homo sapiens
ggtttctcattaaactct

SEQ ID NO: 1862773 - DNA, 12 bp, Homo sapiens
ggtttgtttgct

SEQ ID NO: 1862774 - DNA, 15 bp, Homo sapiens
ggtttgtttgcttaa

SEQ ID NO: 1862775 - DNA, 19 bp, Homo sapiens
ggtttgtttgcttaatttc

SEQ ID NO: 1862776 - DNA, 21 bp, Homo sapiens
gtaaaactacacatccctaat

SEQ ID NO: 1862777 - DNA, 19 bp, Homo sapiens
gtaaaagttataataactg

SEQ ID NO: 1862778 - DNA, 21 bp, Homo sapiens
gtaaaagttataataactgaa

SEQ ID NO: 1862779 - DNA, 15 bp, Homo sapiens
gtaaactcaaaactt

SEQ ID NO: 1862780 - DNA, 16 bp, Homo sapiens
gtaaactgtggatgat

SEQ ID NO: 1862781 - DNA, 15 bp, Homo sapiens
gtaaacttgtgtatt

SEQ ID NO: 1862782 - DNA, 19 bp, Homo sapiens
gtaaatgagacacatacaa

SEQ ID NO: 1862783 - DNA, 16 bp, Homo sapiens
gtaaatttttgaaaaa

SEQ ID NO: 1862784 - DNA, 21 bp, Homo sapiens
gtaaatttttgaaaaatattg

SEQ ID NO: 1862785 - DNA, 21 bp, Homo sapiens
gtaacgtgattgattcagtat

SEQ ID NO: 1862786 - DNA, 23 bp, Homo sapiens
gtaactttgcttgattaaacagc

SEQ ID NO: 1862787 - DNA, 17 bp, Homo sapiens
gtaagacttgattggtt

SEQ ID NO: 1862788 - DNA, 23 bp, Homo sapiens
gtaagtcttttttttttccaaat

SEQ ID NO: 1862789 - DNA, 15 bp, Homo sapiens
gtaatagaaaactga

SEQ ID NO: 1862790 - DNA, 20 bp, Homo sapiens
gtaatctgtaaatgaacaca

SEQ ID NO: 1862791 - DNA, 20 bp, Homo sapiens
gtaatgtagggttatatttg

SEQ ID NO: 1862792 - DNA, 21 bp, Homo sapiens
gtaatgtagggttatatttgg

SEQ ID NO: 1862793 - DNA, 16 bp, Homo sapiens
gtaccagcaatatgta

SEQ ID NO: 1862794 - DNA, 13 bp, Homo sapiens
gtaccatattgct

SEQ ID NO: 1862795 - DNA, 12 bp, Homo sapiens
gtaccctgcagg

SEQ ID NO: 1862796 - DNA, 13 bp, Homo sapiens
gtaccctgcaggc

SEQ ID NO: 1862797 - DNA, 15 bp, Homo sapiens
gtaccctgcaggcca

SEQ ID NO: 1862798 - DNA, 18 bp, Homo sapiens
gtaccctgcaggccaggc

SEQ ID NO: 1862799 - DNA, 19 bp, Homo sapiens
gtaccctgcaggccaggcc

SEQ ID NO: 1862800 - DNA, 14 bp, Homo sapiens
gtacttaaatgagt

SEQ ID NO: 1862801 - DNA, 20 bp, Homo sapiens
gtagaaagacatctgcctgt

SEQ ID NO: 1862802 - DNA, 21 bp, Homo sapiens
gtagtagccctttctgtgtgc

SEQ ID NO: 1862803 - DNA, 15 bp, Homo sapiens
gtataaaaaggaaat

SEQ ID NO: 1862804 - DNA, 19 bp, Homo sapiens
gtataaattatgaaggacc

SEQ ID NO: 1862805 - DNA, 21 bp, Homo sapiens
gtataatctcctctgctcatt

SEQ ID NO: 1862806 - DNA, 21 bp, Homo sapiens
gtataatgtgtctgtgttgct

SEQ ID NO: 1862807 - DNA, 15 bp, Homo sapiens
gtatactgtaaaagt

SEQ ID NO: 1862808 - DNA, 15 bp, Homo sapiens
gtatagatggccaaa

SEQ ID NO: 1862809 - DNA, 13 bp, Homo sapiens
gtatagtgtaaaa

SEQ ID NO: 1862810 - DNA, 14 bp, Homo sapiens
gtatattataatag

SEQ ID NO: 1862811 - DNA, 18 bp, Homo sapiens
gtatatttagttacgtat

SEQ ID NO: 1862812 - DNA, 12 bp, Homo sapiens
gtatatttgcaa

SEQ ID NO: 1862813 - DNA, 21 bp, Homo sapiens
gtatatttgcaaaccctttgt

SEQ ID NO: 1862814 - DNA, 15 bp, Homo sapiens
gtatcattaaaatat

SEQ ID NO: 1862815 - DNA, 16 bp, Homo sapiens
tacggtgcacagtaat

SEQ ID NO: 1862816 - DNA, 16 bp, Homo sapiens
tactaaaatatgcagg

SEQ ID NO: 1862817 - DNA, 20 bp, Homo sapiens
tactatctttgtctaaacaa

SEQ ID NO: 1862818 - DNA, 22 bp, Homo sapiens
tactcttaaatcatttggttaa

SEQ ID NO: 1862819 - DNA, 15 bp, Homo sapiens
tactgatttttgtga

SEQ ID NO: 1862820 - DNA, 22 bp, Homo sapiens
tactggcactgtggcactgcca

SEQ ID NO: 1862821 - DNA, 20 bp, Homo sapiens
tactgtaaaagttataataa

SEQ ID NO: 1862822 - DNA, 21 bp, Homo sapiens
tactgtaaaagttataataac

SEQ ID NO: 1862823 - DNA, 22 bp, Homo sapiens
tactgtaaaagttataataact

SEQ ID NO: 1862824 - DNA, 21 bp, Homo sapiens
tactgtctggttttaacaatt

SEQ ID NO: 1862825 - DNA, 18 bp, Homo sapiens
tacttatcatttttgtat

SEQ ID NO: 1862826 - DNA, 18 bp, Homo sapiens
tacttttctggttccaaa

SEQ ID NO: 1862827 - DNA, 22 bp, Homo sapiens
tacttttgagtatggctatcta

SEQ ID NO: 1862828 - DNA, 14 bp, Homo sapiens
tactttttctgtac

SEQ ID NO: 1862829 - DNA, 21 bp, Homo sapiens
tactttttctgtactttttgt

SEQ ID NO: 1862830 - DNA, 23 bp, Homo sapiens
tactttttctgtactttttgttt

SEQ ID NO: 1862831 - DNA, 14 bp, Homo sapiens
tactttttttcaca

SEQ ID NO: 1862832 - DNA, 16 bp, Homo sapiens
tagaaaactgaaaatc

SEQ ID NO: 1862833 - DNA, 17 bp, Homo sapiens
tagaaagacatctgcct

SEQ ID NO: 1862834 - DNA, 11 bp, Homo sapiens
tagaagcagaa

SEQ ID NO: 1862835 - DNA, 15 bp, Homo sapiens
tagaataaatggttt

SEQ ID NO: 1862836 - DNA, 17 bp, Homo sapiens
tagaattgcaatctata

SEQ ID NO: 1862837 - DNA, 20 bp, Homo sapiens
tagaattgcaatctataata

SEQ ID NO: 1862838 - DNA, 20 bp, Homo sapiens
tagaggccaaattaatcttt

SEQ ID NO: 1862839 - DNA, 14 bp, Homo sapiens
tagaggggttttag

SEQ ID NO: 1862840 - DNA, 19 bp, Homo sapiens
tagagtcacccccccaggc

SEQ ID NO: 1862841 - DNA, 21 bp, Homo sapiens
tagagtcacccccccaggcct

SEQ ID NO: 1862842 - DNA, 16 bp, Homo sapiens
tagagttctattagaa

SEQ ID NO: 1862843 - DNA, 12 bp, Homo sapiens
tagagtttaaca

SEQ ID NO: 1862844 - DNA, 13 bp, Homo sapiens
tagagtttaacac

SEQ ID NO: 1862845 - DNA, 18 bp, Homo sapiens
tagatcaacacttttctc

SEQ ID NO: 1862846 - DNA, 18 bp, Homo sapiens
tagattaaatcatactcc

SEQ ID NO: 1862847 - DNA, 22 bp, Homo sapiens
tagattagtactggattattca

SEQ ID NO: 1862848 - DNA, 15 bp, Homo sapiens
tagattgtcttaatg

SEQ ID NO: 1862849 - DNA, 15 bp, Homo sapiens
tagatttgaaaaact

SEQ ID NO: 1862850 - DNA, 12 bp, Homo sapiens
tagcatttattt

SEQ ID NO: 1862851 - DNA, 18 bp, Homo sapiens
tagcatttatttctctgg

SEQ ID NO: 1862852 - DNA, 20 bp, Homo sapiens
tagcatttttgatttatgca

SEQ ID NO: 1862853 - DNA, 21 bp, Homo sapiens
tagccctggatggcctctggg

SEQ ID NO: 1862854 - DNA, 22 bp, Homo sapiens
tagccctggatggcctctgggg

SEQ ID NO: 1862855 - DNA, 14 bp, Homo sapiens
tagccctttctgtg

SEQ ID NO: 1862856 - DNA, 15 bp, Homo sapiens
tagctaagcaagcca

SEQ ID NO: 1862857 - DNA, 19 bp, Homo sapiens
tagctaagcaagccaggag

SEQ ID NO: 1862858 - DNA, 20 bp, Homo sapiens
tagctaagcaagccaggaga

SEQ ID NO: 1862859 - DNA, 13 bp, Homo sapiens
tagcttgtatagt

SEQ ID NO: 1862860 - DNA, 19 bp, Homo sapiens
tagcttgtatagtgtaaaa

SEQ ID NO: 1862861 - DNA, 18 bp, Homo sapiens
tagcttttaaaaaatatt

SEQ ID NO: 1862862 - DNA, 17 bp, Homo sapiens
taggatgaatgggaaag

SEQ ID NO: 1862863 - DNA, 20 bp, Homo sapiens
taggatgaatgggaaagtat

SEQ ID NO: 1862864 - DNA, 22 bp, Homo sapiens
taggcacttttattttcattgt

SEQ ID NO: 1862865 - DNA, 20 bp, Homo sapiens
tagggaaaatggatatagaa

SEQ ID NO: 1862866 - DNA, 13 bp, Homo sapiens
tagggtataatgt

SEQ ID NO: 1862867 - DNA, 17 bp, Homo sapiens
tagggttatatttggga

SEQ ID NO: 1862868 - DNA, 15 bp, Homo sapiens
taggtcaagtaataa

SEQ ID NO: 1862869 - DNA, 20 bp, Homo sapiens
taggtcaagtaataaaaaga

SEQ ID NO: 1862870 - DNA, 20 bp, Homo sapiens
taggtctcatgcccactccc

SEQ ID NO: 1862871 - DNA, 22 bp, Homo sapiens
taggttgttaccaagtatgaag

SEQ ID NO: 1862872 - DNA, 19 bp, Homo sapiens
tagtaccctgcaggccagg

SEQ ID NO: 1862873 - DNA, 22 bp, Homo sapiens
tagtaccctgcaggccaggcca

SEQ ID NO: 1862874 - DNA, 19 bp, Homo sapiens
tagtcaataactctgattt

SEQ ID NO: 1862875 - DNA, 15 bp, Homo sapiens
tagtctttttttcct

SEQ ID NO: 1862876 - DNA, 11 bp, Homo sapiens
tagtgtaaaat

SEQ ID NO: 1862877 - DNA, 13 bp, Homo sapiens
tagtgtaaaataa

SEQ ID NO: 1862878 - DNA, 18 bp, Homo sapiens
tagttacgtataatgctt

SEQ ID NO: 1862879 - DNA, 22 bp, Homo sapiens
tagttacgtataatgctttctg

SEQ ID NO: 1862880 - DNA, 15 bp, Homo sapiens
tagttaggatagcat

SEQ ID NO: 1862881 - DNA, 16 bp, Homo sapiens
tagttatagtttcaga

SEQ ID NO: 1862882 - DNA, 15 bp, Homo sapiens
tagttcgtagctttc

SEQ ID NO: 1862883 - DNA, 18 bp, Homo sapiens
tagttcttgaattgttat

SEQ ID NO: 1862884 - DNA, 22 bp, Homo sapiens
tagttcttgaattgttatgaaa

SEQ ID NO: 1862885 - DNA, 18 bp, Homo sapiens
tagtttaagggtggaaaa

SEQ ID NO: 1862886 - DNA, 17 bp, Homo sapiens
tagtttgtataacttct

SEQ ID NO: 1862887 - DNA, 22 bp, Homo sapiens
tagtttttaattaaaaacttta

SEQ ID NO: 1862888 - DNA, 19 bp, Homo sapiens
tataaactatcagtttgtc

SEQ ID NO: 1862889 - DNA, 22 bp, Homo sapiens
tataaatctggggaagaggttt

SEQ ID NO: 1862890 - DNA, 13 bp, Homo sapiens
tataactacatat

SEQ ID NO: 1862891 - DNA, 18 bp, Homo sapiens
tataactacatattgaat

SEQ ID NO: 1862892 - DNA, 16 bp, Homo sapiens
tataacttcttaaaag

SEQ ID NO: 1862893 - DNA, 15 bp, Homo sapiens
tataagcaagacagt

SEQ ID NO: 1862894 - DNA, 22 bp, Homo sapiens
tataagcaagacagtggcacta

SEQ ID NO: 1862895 - DNA, 20 bp, Homo sapiens
tataagcgtatttagactgt

SEQ ID NO: 1862896 - DNA, 14 bp, Homo sapiens
tataaggtaatgta

SEQ ID NO: 1862897 - DNA, 17 bp, Homo sapiens
tataataactgaactgt

SEQ ID NO: 1862898 - DNA, 20 bp, Homo sapiens
tataataactgaactgtttg

SEQ ID NO: 1862899 - DNA, 20 bp, Homo sapiens
tataataagttttgatataa

SEQ ID NO: 1862900 - DNA, 22 bp, Homo sapiens
tataatcttggcttcttaaaaa

SEQ ID NO: 1862901 - DNA, 13 bp, Homo sapiens
tataatgctttct

SEQ ID NO: 1862902 - DNA, 14 bp, Homo sapiens
tataatttaaagaa

SEQ ID NO: 1862903 - DNA, 12 bp, Homo sapiens
tatacataaaca

SEQ ID NO: 1862904 - DNA, 15 bp, Homo sapiens
tatacataaacagtt

SEQ ID NO: 1862905 - DNA, 13 bp, Homo sapiens
tatacctgccttt

SEQ ID NO: 1862906 - DNA, 15 bp, Homo sapiens
tatactgtaaaagtt

SEQ ID NO: 1862907 - DNA, 16 bp, Homo sapiens
tatactgtaaaagtta

SEQ ID NO: 1862908 - DNA, 19 bp, Homo sapiens
tatactgtaaaagttataa

SEQ ID NO: 1862909 - DNA, 17 bp, Homo sapiens
tatactttttttgttat

SEQ ID NO: 1862910 - DNA, 13 bp, Homo sapiens
tatagaaaatctt

SEQ ID NO: 1862911 - DNA, 17 bp, Homo sapiens
tatagaaaatcttagta

SEQ ID NO: 1862912 - DNA, 22 bp, Homo sapiens
tatagaaagcaagatgtactat

SEQ ID NO: 1862913 - DNA, 14 bp, Homo sapiens
tatagattgtctta

SEQ ID NO: 1862914 - DNA, 15 bp, Homo sapiens
tataggttgtgcaaa

SEQ ID NO: 1862915 - DNA, 23 bp, Homo sapiens
tatagtagaaagacatctgcctg

SEQ ID NO: 1862916 - DNA, 13 bp, Homo sapiens
tatagtgtaaaat

SEQ ID NO: 1862917 - DNA, 19 bp, Homo sapiens
tatagttaggatagcattt

SEQ ID NO: 1862918 - DNA, 13 bp, Homo sapiens
tatagtttcagat

SEQ ID NO: 1862919 - DNA, 15 bp, Homo sapiens
tatagtttgtacatg

SEQ ID NO: 1862920 - DNA, 20 bp, Homo sapiens
tatataatcatgctcatgta

SEQ ID NO: 1862921 - DNA, 19 bp, Homo sapiens
tatatattgaaagttgctt

SEQ ID NO: 1862922 - DNA, 20 bp, Homo sapiens
tatatctataaacactgttt

SEQ ID NO: 1862923 - DNA, 17 bp, Homo sapiens
tatatctcaaattgtaa

SEQ ID NO: 1862924 - DNA, 16 bp, Homo sapiens
tatatctgcttcagtg

SEQ ID NO: 1862925 - DNA, 17 bp, Homo sapiens
tatatctttatgcaaaa

SEQ ID NO: 1862926 - DNA, 22 bp, Homo sapiens
tatatctttatgcaaaaacata

SEQ ID NO: 1862927 - DNA, 21 bp, Homo sapiens
tatatgatttatagtttgtac

SEQ ID NO: 1862928 - DNA, 14 bp, Homo sapiens
tatatgctgtattt

SEQ ID NO: 1862929 - DNA, 19 bp, Homo sapiens
tatatgctgtatttctttg

SEQ ID NO: 1862930 - DNA, 16 bp, Homo sapiens
tatatggcaagaaagc

SEQ ID NO: 1862931 - DNA, 16 bp, Homo sapiens
tctactttttctgtac

SEQ ID NO: 1862932 - DNA, 13 bp, Homo sapiens
tctagaagcagaa

SEQ ID NO: 1862933 - DNA, 19 bp, Homo sapiens
tctagcatttatttctctg

SEQ ID NO: 1862934 - DNA, 14 bp, Homo sapiens
tctagctgttcttt

SEQ ID NO: 1862935 - DNA, 15 bp, Homo sapiens
tctagtatctattgt

SEQ ID NO: 1862936 - DNA, 14 bp, Homo sapiens
tctatggagacttt

SEQ ID NO: 1862937 - DNA, 22 bp, Homo sapiens
tctattttgctggagactattt

SEQ ID NO: 1862938 - DNA, 13 bp, Homo sapiens
tctcactaaactt

SEQ ID NO: 1862939 - DNA, 15 bp, Homo sapiens
tctcatgcccactcc

SEQ ID NO: 1862940 - DNA, 16 bp, Homo sapiens
tctcatgcccactccc

SEQ ID NO: 1862941 - DNA, 21 bp, Homo sapiens
tctccccaatccatgcttcac

SEQ ID NO: 1862942 - DNA, 14 bp, Homo sapiens
tctcctctgctcat

SEQ ID NO: 1862943 - DNA, 18 bp, Homo sapiens
tctcctgccctttcccag

SEQ ID NO: 1862944 - DNA, 13 bp, Homo sapiens
tctctctgttaaa

SEQ ID NO: 1862945 - DNA, 23 bp, Homo sapiens
tctctgatacttttttgaaatca

SEQ ID NO: 1862946 - DNA, 15 bp, Homo sapiens
tctctggcaaacttt

SEQ ID NO: 1862947 - DNA, 15 bp, Homo sapiens
tctctgttaaagatc

SEQ ID NO: 1862948 - DNA, 16 bp, Homo sapiens
tctcttggacattgta

SEQ ID NO: 1862949 - DNA, 15 bp, Homo sapiens
tctctttgtgcagtg

SEQ ID NO: 1862950 - DNA, 15 bp, Homo sapiens
tctgaataagcactt

SEQ ID NO: 1862951 - DNA, 18 bp, Homo sapiens
tctgaataagcacttttt

SEQ ID NO: 1862952 - DNA, 15 bp, Homo sapiens
tctgaatcttctgaa

SEQ ID NO: 1862953 - DNA, 13 bp, Homo sapiens
tctgatacttttt

SEQ ID NO: 1862954 - DNA, 14 bp, Homo sapiens
tctgatatgtttgt

SEQ ID NO: 1862955 - DNA, 21 bp, Homo sapiens
tctgattataccatgtgtgct

SEQ ID NO: 1862956 - DNA, 15 bp, Homo sapiens
tctgcagctcctgga

SEQ ID NO: 1862957 - DNA, 14 bp, Homo sapiens
tctgcttcagtgga

SEQ ID NO: 1862958 - DNA, 15 bp, Homo sapiens
tctggcttctgcttc

SEQ ID NO: 1862959 - DNA, 20 bp, Homo sapiens
tctggggcaggaccactagc

SEQ ID NO: 1862960 - DNA, 17 bp, Homo sapiens
tctggttccaaaccagt

SEQ ID NO: 1862961 - DNA, 16 bp, Homo sapiens
tctgtaaatgaacaca

SEQ ID NO: 1862962 - DNA, 14 bp, Homo sapiens
tctgtactttgtgt

SEQ ID NO: 1862963 - DNA, 15 bp, Homo sapiens
tctgtatactgtaaa

SEQ ID NO: 1862964 - DNA, 17 bp, Homo sapiens
tctgtatactgtaaaag

SEQ ID NO: 1862965 - DNA, 19 bp, Homo sapiens
tctgtcaccaattggttaa

SEQ ID NO: 1862966 - DNA, 13 bp, Homo sapiens
tctgtctgctctt

SEQ ID NO: 1862967 - DNA, 15 bp, Homo sapiens
tctgtctgctcttat

SEQ ID NO: 1862968 - DNA, 15 bp, Homo sapiens
tctgtggttctataa

SEQ ID NO: 1862969 - DNA, 19 bp, Homo sapiens
tctgtggttctataataag

SEQ ID NO: 1862970 - DNA, 13 bp, Homo sapiens
tcttaaaaactgt

SEQ ID NO: 1862971 - DNA, 20 bp, Homo sapiens
tcttaaaaactgtgtatcat

SEQ ID NO: 1862972 - DNA, 23 bp, Homo sapiens
tcttaaaagttgtgattccagat

SEQ ID NO: 1862973 - DNA, 15 bp, Homo sapiens
tcttaaatcatttgg

SEQ ID NO: 1862974 - DNA, 18 bp, Homo sapiens
tcttaaatcatttggtta

SEQ ID NO: 1862975 - DNA, 14 bp, Homo sapiens
tcttaactgtattt

SEQ ID NO: 1862976 - DNA, 16 bp, Homo sapiens
tcttaactgtatttca

SEQ ID NO: 1862977 - DNA, 18 bp, Homo sapiens
tcttacataatttgcaat

SEQ ID NO: 1862978 - DNA, 22 bp, Homo sapiens
tcttagagtttacagtttgtgt

SEQ ID NO: 1862979 - DNA, 14 bp, Homo sapiens
tcttatttttgtac

SEQ ID NO: 1862980 - DNA, 13 bp, Homo sapiens
tcttcatactttt

SEQ ID NO: 1862981 - DNA, 15 bp, Homo sapiens
tcttcatactttttt

SEQ ID NO: 1862982 - DNA, 16 bp, Homo sapiens
tcttgaaccagaacca

SEQ ID NO: 1862983 - DNA, 21 bp, Homo sapiens
tcttgaattgttatgaaaatc

SEQ ID NO: 1862984 - DNA, 15 bp, Homo sapiens
tcttggcttcttaaa

SEQ ID NO: 1862985 - DNA, 21 bp, Homo sapiens
tcttggcttcttaaaaactgt

SEQ ID NO: 1862986 - DNA, 13 bp, Homo sapiens
tcttggtctcccg

SEQ ID NO: 1862987 - DNA, 13 bp, Homo sapiens
tctttaaatacag

SEQ ID NO: 1862988 - DNA, 16 bp, Homo sapiens
tctttatgcaaaaaca

SEQ ID NO: 1862989 - DNA, 24 bp, Homo sapiens
tctttcttttcttttttaaagtaa

SEQ ID NO: 1862990 - DNA, 14 bp, Homo sapiens
tctttgaatgcttt

SEQ ID NO: 1862991 - DNA, 16 bp, Homo sapiens
tctttgtagaataaat

SEQ ID NO: 1862992 - DNA, 20 bp, Homo sapiens
tctttgtagaataaatggtt

SEQ ID NO: 1862993 - DNA, 15 bp, Homo sapiens
tctttgtgcagtgtt

SEQ ID NO: 1862994 - DNA, 15 bp, Homo sapiens
tctttgtgtaatcta

SEQ ID NO: 1862995 - DNA, 14 bp, Homo sapiens
tctttgtgtgttat

SEQ ID NO: 1862996 - DNA, 18 bp, Homo sapiens
tcttttctgaatcttctg

SEQ ID NO: 1862997 - DNA, 17 bp, Homo sapiens
tcttttgtaaatgagac

SEQ ID NO: 1862998 - DNA, 20 bp, Homo sapiens
tcttttttaaagtaaacttg

SEQ ID NO: 1862999 - DNA, 17 bp, Homo sapiens
tctttttttccttcctt

SEQ ID NO: 1863000 - DNA, 22 bp, Homo sapiens
tctttttttggtaaatttttga

SEQ ID NO: 1863001 - DNA, 17 bp, Homo sapiens
tgaaaaaaagtttacaa

SEQ ID NO: 1863002 - DNA, 11 bp, Homo sapiens
tgaaaaatatt

SEQ ID NO: 1863003 - DNA, 22 bp, Homo sapiens
tgaaaaatattgctaaaagtgc

SEQ ID NO: 1863004 - DNA, 24 bp, Homo sapiens
tgaaaaatattgctaaaagtgcat

SEQ ID NO: 1863005 - DNA, 18 bp, Homo sapiens
tgaaaagccatatctagt

SEQ ID NO: 1863006 - DNA, 19 bp, Homo sapiens
tgaaaataccataggaaga

SEQ ID NO: 1863007 - DNA, 20 bp, Homo sapiens
tgaaaataccataggaagac

SEQ ID NO: 1863008 - DNA, 16 bp, Homo sapiens
tgaaaatcctatatct

SEQ ID NO: 1863009 - DNA, 17 bp, Homo sapiens
tgaaaatcctatatctg

SEQ ID NO: 1863010 - DNA, 18 bp, Homo sapiens
tgaaaatcctatatctgt

SEQ ID NO: 1863011 - DNA, 14 bp, Homo sapiens
tgaaaatctaatat

SEQ ID NO: 1863012 - DNA, 21 bp, Homo sapiens
tgaaaatctaatattaaaaat

SEQ ID NO: 1863013 - DNA, 15 bp, Homo sapiens
tgaaaattattttaa

SEQ ID NO: 1863014 - DNA, 19 bp, Homo sapiens
tgaaaattattttaaacaa

SEQ ID NO: 1863015 - DNA, 21 bp, Homo sapiens
tgaaaattattttaaacaaaa

SEQ ID NO: 1863016 - DNA, 15 bp, Homo sapiens
tgaaacagagaaaga

SEQ ID NO: 1863017 - DNA, 20 bp, Homo sapiens
tgaaacatgcttgtgtttct

SEQ ID NO: 1863018 - DNA, 21 bp, Homo sapiens
tgaaaggctatcctgctgaaa

SEQ ID NO: 1863019 - DNA, 13 bp, Homo sapiens
tgaaagtattcag

SEQ ID NO: 1863020 - DNA, 15 bp, Homo sapiens
tgaaagtattcagaa

SEQ ID NO: 1863021 - DNA, 16 bp, Homo sapiens
tgaaagttgcttttat

SEQ ID NO: 1863022 - DNA, 18 bp, Homo sapiens
tgaaatacttttgagtat

SEQ ID NO: 1863023 - DNA, 14 bp, Homo sapiens
tgaaatcagcatga

SEQ ID NO: 1863024 - DNA, 20 bp, Homo sapiens
tgaaatttattagttaatat

SEQ ID NO: 1863025 - DNA, 19 bp, Homo sapiens
tgaaattttctagactttc

SEQ ID NO: 1863026 - DNA, 20 bp, Homo sapiens
tgaacatttagtaccctgca

SEQ ID NO: 1863027 - DNA, 22 bp, Homo sapiens
tgaacatttagtaccctgcagg

SEQ ID NO: 1863028 - DNA, 23 bp, Homo sapiens
tgaactgtttggtcgagtctttg

SEQ ID NO: 1863029 - DNA, 11 bp, Homo sapiens
tgaactttctc

SEQ ID NO: 1863030 - DNA, 14 bp, Homo sapiens
tgaacttttacaga

SEQ ID NO: 1863031 - DNA, 17 bp, Homo sapiens
tgaacttttgtaatttg

SEQ ID NO: 1863032 - DNA, 21 bp, Homo sapiens
tgaacttttgtaatttgaatt

SEQ ID NO: 1863033 - DNA, 21 bp, Homo sapiens
tgaaggtaataaatacacagc

SEQ ID NO: 1863034 - DNA, 21 bp, Homo sapiens
tgaaggttttttttttaagtg

SEQ ID NO: 1863035 - DNA, 15 bp, Homo sapiens
tgaagtagtttgtat

SEQ ID NO: 1863036 - DNA, 20 bp, Homo sapiens
tgaagtcaaaccttaagata

SEQ ID NO: 1863037 - DNA, 18 bp, Homo sapiens
tgaagtcgagcactctaa

SEQ ID NO: 1863038 - DNA, 19 bp, Homo sapiens
tgaatagaggccaaattaa

SEQ ID NO: 1863039 - DNA, 22 bp, Homo sapiens
tgaatagaggccaaattaatct

SEQ ID NO: 1863040 - DNA, 14 bp, Homo sapiens
tgaatcttctgaaa

SEQ ID NO: 1863041 - DNA, 16 bp, Homo sapiens
tgaatggcatggagac

SEQ ID NO: 1863042 - DNA, 14 bp, Homo sapiens
tgaatgttatttgt

SEQ ID NO: 1863043 - DNA, 18 bp, Homo sapiens
tgaattaccatagagtaa

SEQ ID NO: 1863044 - DNA, 20 bp, Homo sapiens
tgaatttatgagatttactg

SEQ ID NO: 1863045 - DNA, 20 bp, Homo sapiens
tgaatttcttcactgttgaa

SEQ ID NO: 1863046 - DNA, 23 bp, Homo sapiens
tgaatttcttcactgttgaaaat

SEQ ID NO: 1863047 - DNA, 16 bp, Homo sapiens
tgacaaaaataacact

SEQ ID NO: 1863048 - DNA, 17 bp, Homo sapiens
ttaaacagcaaagccat

SEQ ID NO: 1863049 - DNA, 14 bp, Homo sapiens
ttaaagtaaacttg

SEQ ID NO: 1863050 - DNA, 19 bp, Homo sapiens
ttaaatacgcactacatgt

SEQ ID NO: 1863051 - DNA, 12 bp, Homo sapiens
ttaaatcatttg

SEQ ID NO: 1863052 - DNA, 22 bp, Homo sapiens
ttaaatcatttggttaaatcat

SEQ ID NO: 1863053 - DNA, 22 bp, Homo sapiens
ttaaatgccaaaatgtacttaa

SEQ ID NO: 1863054 - DNA, 12 bp, Homo sapiens
ttaactgtattt

SEQ ID NO: 1863055 - DNA, 14 bp, Homo sapiens
ttaactgtatttca

SEQ ID NO: 1863056 - DNA, 22 bp, Homo sapiens
ttaagaaagagaatgaactgtg

SEQ ID NO: 1863057 - DNA, 24 bp, Homo sapiens
ttaagaaagagaatgaactgtgga

SEQ ID NO: 1863058 - DNA, 21 bp, Homo sapiens
ttaagaaaggatataaaagga

SEQ ID NO: 1863059 - DNA, 20 bp, Homo sapiens
ttaagaaagggaaagctgtg

SEQ ID NO: 1863060 - DNA, 20 bp, Homo sapiens
ttaagtgcaacatttctgta

SEQ ID NO: 1863061 - DNA, 23 bp, Homo sapiens
ttaagtgcaacatttctgtatac

SEQ ID NO: 1863062 - DNA, 16 bp, Homo sapiens
ttaatcagacaaagta

SEQ ID NO: 1863063 - DNA, 14 bp, Homo sapiens
ttaatggactgtga

SEQ ID NO: 1863064 - DNA, 15 bp, Homo sapiens
ttaatggactgtgaa

SEQ ID NO: 1863065 - DNA, 17 bp, Homo sapiens
ttaatggactgtgaatt

SEQ ID NO: 1863066 - DNA, 22 bp, Homo sapiens
ttaatggactgtgaatttcaaa

SEQ ID NO: 1863067 - DNA, 14 bp, Homo sapiens
ttaattaaaaactt

SEQ ID NO: 1863068 - DNA, 16 bp, Homo sapiens
ttaattgtcctgtgtc

SEQ ID NO: 1863069 - DNA, 15 bp, Homo sapiens
ttaatttccttctgt

SEQ ID NO: 1863070 - DNA, 18 bp, Homo sapiens
ttaatttccttctgttaa

SEQ ID NO: 1863071 - DNA, 22 bp, Homo sapiens
ttaatttccttctgttaagaaa

SEQ ID NO: 1863072 - DNA, 13 bp, Homo sapiens
ttacaacctagaa

SEQ ID NO: 1863073 - DNA, 18 bp, Homo sapiens
ttacaagcttaaagcttg

SEQ ID NO: 1863074 - DNA, 18 bp, Homo sapiens
ttacaagtggtgaccaaa

SEQ ID NO: 1863075 - DNA, 14 bp, Homo sapiens
ttacaagtgtatat

SEQ ID NO: 1863076 - DNA, 20 bp, Homo sapiens
ttacaagtttgctaaaagaa

SEQ ID NO: 1863077 - DNA, 15 bp, Homo sapiens
ttacagaatgcatta

SEQ ID NO: 1863078 - DNA, 17 bp, Homo sapiens
ttacagtctctgttgta

SEQ ID NO: 1863079 - DNA, 15 bp, Homo sapiens
ttacagtgtatttaa

SEQ ID NO: 1863080 - DNA, 21 bp, Homo sapiens
ttacagtttgtgttttaaaaa

SEQ ID NO: 1863081 - DNA, 22 bp, Homo sapiens
ttacagtttgtgttttaaaaaa

SEQ ID NO: 1863082 - DNA, 13 bp, Homo sapiens
ttaccaactttct

SEQ ID NO: 1863083 - DNA, 21 bp, Homo sapiens
ttactaagccacaagaaattt

SEQ ID NO: 1863084 - DNA, 17 bp, Homo sapiens
ttactcagtgaaatcat

SEQ ID NO: 1863085 - DNA, 20 bp, Homo sapiens
ttactcccttctgtagtttt

SEQ ID NO: 1863086 - DNA, 21 bp, Homo sapiens
ttactcccttctgtagttttt

SEQ ID NO: 1863087 - DNA, 21 bp, Homo sapiens
ttactcttaaatcatttggtt

SEQ ID NO: 1863088 - DNA, 22 bp, Homo sapiens
ttactcttaaatcatttggtta

SEQ ID NO: 1863089 - DNA, 17 bp, Homo sapiens
ttactggcactgtggca

SEQ ID NO: 1863090 - DNA, 22 bp, Homo sapiens
ttactgtctggttttaacaatt

SEQ ID NO: 1863091 - DNA, 16 bp, Homo sapiens
ttacttaaccaggttt

SEQ ID NO: 1863092 - DNA, 23 bp, Homo sapiens
ttacttagaatgccataaaattg

SEQ ID NO: 1863093 - DNA, 14 bp, Homo sapiens
ttagaaaatcagat

SEQ ID NO: 1863094 - DNA, 12 bp, Homo sapiens
ttagaaacatgt

SEQ ID NO: 1863095 - DNA, 12 bp, Homo sapiens
ttagaatgccat

SEQ ID NO: 1863096 - DNA, 15 bp, Homo sapiens
ttagactgtggccat

SEQ ID NO: 1863097 - DNA, 13 bp, Homo sapiens
ttagagaactgga

SEQ ID NO: 1863098 - DNA, 14 bp, Homo sapiens
ttagatcaacactt

SEQ ID NO: 1863099 - DNA, 19 bp, Homo sapiens
ttagatcaacacttttctc

SEQ ID NO: 1863100 - DNA, 20 bp, Homo sapiens
ttagatgtgctgctttgata

SEQ ID NO: 1863101 - DNA, 13 bp, Homo sapiens
ttagcagaatgga

SEQ ID NO: 1863102 - DNA, 22 bp, Homo sapiens
ttagcagaatggagaaagtaag

SEQ ID NO: 1863103 - DNA, 15 bp, Homo sapiens
ttaggtctcatgccc

SEQ ID NO: 1863104 - DNA, 15 bp, Homo sapiens
ttagtatagtagaaa

SEQ ID NO: 1863105 - DNA, 18 bp, Homo sapiens
ttagttacgtataatgct

SEQ ID NO: 1863106 - DNA, 15 bp, Homo sapiens
ttagttcttgaattg

SEQ ID NO: 1863107 - DNA, 20 bp, Homo sapiens
ttagttcttgaattgttatg

SEQ ID NO: 1863108 - DNA, 21 bp, Homo sapiens
ttagttgatattcaaggcttt

SEQ ID NO: 1863109 - DNA, 15 bp, Homo sapiens
ttataataactgaac

SEQ ID NO: 1863110 - DNA, 16 bp, Homo sapiens
ttataataactgaact

SEQ ID NO: 1863111 - DNA, 18 bp, Homo sapiens
ttataataactgaactgt

SEQ ID NO: 1863112 - DNA, 15 bp, Homo sapiens
ttatacataaacagt

SEQ ID NO: 1863113 - DNA, 17 bp, Homo sapiens
ttatacataaacagttt

SEQ ID NO: 1863114 - DNA, 19 bp, Homo sapiens
ttataccatgtgtgctaat

SEQ ID NO: 1863115 - DNA, 18 bp, Homo sapiens
ttataggcagatctttaa

SEQ ID NO: 1863116 - DNA, 15 bp, Homo sapiens
ttataggtaacgtga

SEQ ID NO: 1863117 - DNA, 17 bp, Homo sapiens
ttatagttaatctataa

SEQ ID NO: 1863118 - DNA, 16 bp, Homo sapiens
ttatagtttgtacatg

SEQ ID NO: 1863119 - DNA, 21 bp, Homo sapiens
ttatatattgaaagttgcttt

SEQ ID NO: 1863120 - DNA, 17 bp, Homo sapiens
ttatatccatttttatc

SEQ ID NO: 1863121 - DNA, 12 bp, Homo sapiens
ttatatctttat

SEQ ID NO: 1863122 - DNA, 13 bp, Homo sapiens
ttatatctttatg

SEQ ID NO: 1863123 - DNA, 22 bp, Homo sapiens
ttatatctttatgcaaaaacat

SEQ ID NO: 1863124 - DNA, 21 bp, Homo sapiens
ttatattccaaggaaaattga

SEQ ID NO: 1863125 - DNA, 16 bp, Homo sapiens
ttatcatttttgtata

SEQ ID NO: 1863126 - DNA, 19 bp, Homo sapiens
ttatcatttttgtataaaa

SEQ ID NO: 1863127 - DNA, 19 bp, Homo sapiens
ttatccagctagtgccaaa

SEQ ID NO: 1863128 - DNA, 17 bp, Homo sapiens
ttatcgtccagtgactt

SEQ ID NO: 1863129 - DNA, 12 bp, Homo sapiens
ttatgtgttaca

SEQ ID NO: 1863130 - DNA, 20 bp, Homo sapiens
ttattaaaatgattgtaaaa

SEQ ID NO: 1863131 - DNA, 15 bp, Homo sapiens
ttattaatgtttctt

SEQ ID NO: 1863132 - DNA, 13 bp, Homo sapiens
ttattaattgtcc

SEQ ID NO: 1863133 - DNA, 15 bp, Homo sapiens
ttattagttaatata

SEQ ID NO: 1863134 - DNA, 18 bp, Homo sapiens
ttattctgtggttctata

SEQ ID NO: 1863135 - DNA, 19 bp, Homo sapiens
ttattggcagccaaggaat

SEQ ID NO: 1863136 - DNA, 23 bp, Homo sapiens
ttattggcagccaaggaatgtgt

SEQ ID NO: 1863137 - DNA, 19 bp, Homo sapiens
ttatttccaaataaaatga

SEQ ID NO: 1863138 - DNA, 18 bp, Homo sapiens
ttatttgttattttcagt

SEQ ID NO: 1863139 - DNA, 14 bp, Homo sapiens
ttattttaaacaaa

SEQ ID NO: 1863140 - DNA, 13 bp, Homo sapiens
ttattttacagtc

SEQ ID NO: 1863141 - DNA, 15 bp, Homo sapiens
ttattttcattgtga

SEQ ID NO: 1863142 - DNA, 16 bp, Homo sapiens
ttattttccaaaatct

SEQ ID NO: 1863143 - DNA, 13 bp, Homo sapiens
ttattttttattg

SEQ ID NO: 1863144 - DNA, 21 bp, Homo sapiens
ttcaaattggtctgaaaggct

SEQ ID NO: 1863145 - DNA, 14 bp, Homo sapiens
ttcaacagtttctc

SEQ ID NO: 1863146 - DNA, 13 bp, Homo sapiens
ttcaaggctttaa

SEQ ID NO: 1863147 - DNA, 17 bp, Homo sapiens
ttcaaggtggccaaatt

SEQ ID NO: 1863148 - DNA, 18 bp, Homo sapiens
ttcaaggtggccaaatta

SEQ ID NO: 1863149 - DNA, 17 bp, Homo sapiens
ttcaagttattgtacag

SEQ ID NO: 1863150 - DNA, 20 bp, Homo sapiens
ttcaagttattgtacagctg

SEQ ID NO: 1863151 - DNA, 18 bp, Homo sapiens
ttcacacttgttcaacag

SEQ ID NO: 1863152 - DNA, 19 bp, Homo sapiens
ttcacagatggaagaagtt

SEQ ID NO: 1863153 - DNA, 20 bp, Homo sapiens
ttcacagttctgtaatgtag

SEQ ID NO: 1863154 - DNA, 23 bp, Homo sapiens
ttcacagttggctggatgaaatt

SEQ ID NO: 1863155 - DNA, 13 bp, Homo sapiens
ttcaccatgcagg

SEQ ID NO: 1863156 - DNA, 14 bp, Homo sapiens
ttcaccctgggcag

SEQ ID NO: 1863157 - DNA, 21 bp, Homo sapiens
ttcactcatgcaaactgcttt

SEQ ID NO: 1863158 - DNA, 19 bp, Homo sapiens
ttcactggggcatgagatt

SEQ ID NO: 1863159 - DNA, 20 bp, Homo sapiens
ttcagaagtttggcaatagt

SEQ ID NO: 1863160 - DNA, 14 bp, Homo sapiens
ttcaggaatttaat

SEQ ID NO: 1863161 - DNA, 15 bp, Homo sapiens
ttcaggaatttaatt

SEQ ID NO: 1863162 - DNA, 20 bp, Homo sapiens
ttcaggaatttaatttatag

SEQ ID NO: 1863163 - DNA, 15 bp, Homo sapiens
ttcagtattttccag

SEQ ID NO: 1863164 - DNA, 15 bp, Homo sapiens
aaagtcctgctttcc

SEQ ID NO: 1863165 - DNA, 21 bp, Homo sapiens
aaagtgaaacgtaattgtaca

SEQ ID NO: 1863166 - DNA, 17 bp, Homo sapiens
aaagtgaacttttgtaa

SEQ ID NO: 1863167 - DNA, 23 bp, Homo sapiens
aaagtgaacttttgtaatttgaa

SEQ ID NO: 1863168 - DNA, 16 bp, Homo sapiens
aaagtgcaatgtcctg

SEQ ID NO: 1863169 - DNA, 15 bp, Homo sapiens
aaagtgcatttaagg

SEQ ID NO: 1863170 - DNA, 14 bp, Homo sapiens
aaagttataataac

SEQ ID NO: 1863171 - DNA, 19 bp, Homo sapiens
aaagttataataactgaac

SEQ ID NO: 1863172 - DNA, 24 bp, Homo sapiens
aaagttataataactgaactgttt

SEQ ID NO: 1863173 - DNA, 12 bp, Homo sapiens
aaagttgctttt

SEQ ID NO: 1863174 - DNA, 18 bp, Homo sapiens
aaataaagaatagcaatt

SEQ ID NO: 1863175 - DNA, 15 bp, Homo sapiens
aaataaatagaaaga

SEQ ID NO: 1863176 - DNA, 19 bp, Homo sapiens
aaataacactgttggcact

SEQ ID NO: 1863177 - DNA, 21 bp, Homo sapiens
aaataattttttgcagtcttt

SEQ ID NO: 1863178 - DNA, 16 bp, Homo sapiens
aaatacaacagaagtt

SEQ ID NO: 1863179 - DNA, 15 bp, Homo sapiens
aaataccattgaaat

SEQ ID NO: 1863180 - DNA, 18 bp, Homo sapiens
aaataccattgaaatcag

SEQ ID NO: 1863181 - DNA, 15 bp, Homo sapiens
aaatagcttgtatag

SEQ ID NO: 1863182 - DNA, 16 bp, Homo sapiens
aaatatggaacttcta

SEQ ID NO: 1863183 - DNA, 17 bp, Homo sapiens
aaatatggaacttctaa

SEQ ID NO: 1863184 - DNA, 19 bp, Homo sapiens
aaatattatttgatatctg

SEQ ID NO: 1863185 - DNA, 21 bp, Homo sapiens
aaatattgctaaaagtgcatt

SEQ ID NO: 1863186 - DNA, 18 bp, Homo sapiens
aaatattttaagaaagag

SEQ ID NO: 1863187 - DNA, 12 bp, Homo sapiens
aaatcacaaaca

SEQ ID NO: 1863188 - DNA, 15 bp, Homo sapiens
aaatcacaaacatat

SEQ ID NO: 1863189 - DNA, 15 bp, Homo sapiens
aaatcagattttctc

SEQ ID NO: 1863190 - DNA, 23 bp, Homo sapiens
aaatcagcatgacaaaaataaca

SEQ ID NO: 1863191 - DNA, 20 bp, Homo sapiens
aaatcatttggcttgctgtt

SEQ ID NO: 1863192 - DNA, 18 bp, Homo sapiens
aaatctaatattaaaaat

SEQ ID NO: 1863193 - DNA, 20 bp, Homo sapiens
aaatcttagtatagtagaaa

SEQ ID NO: 1863194 - DNA, 23 bp, Homo sapiens
aaatcttagtatagtagaaagac

SEQ ID NO: 1863195 - DNA, 13 bp, Homo sapiens
aaatcttggtttg

SEQ ID NO: 1863196 - DNA, 18 bp, Homo sapiens
aaatcttggtttggtaca

SEQ ID NO: 1863197 - DNA, 12 bp, Homo sapiens
aaatgaactttt

SEQ ID NO: 1863198 - DNA, 13 bp, Homo sapiens
aaatgaactttta

SEQ ID NO: 1863199 - DNA, 17 bp, Homo sapiens
aaatgaacttttacaga

SEQ ID NO: 1863200 - DNA, 23 bp, Homo sapiens
aactgagtccatgaaaataccat

SEQ ID NO: 1863201 - DNA, 18 bp, Homo sapiens
aactgctttattttccct

SEQ ID NO: 1863202 - DNA, 20 bp, Homo sapiens
aactggaggaaccacatata

SEQ ID NO: 1863203 - DNA, 14 bp, Homo sapiens
aactgtatgtcaga

SEQ ID NO: 1863204 - DNA, 14 bp, Homo sapiens
aactgtatttcagt

SEQ ID NO: 1863205 - DNA, 15 bp, Homo sapiens
aactgtatttcagta

SEQ ID NO: 1863206 - DNA, 22 bp, Homo sapiens
aactgtatttcagtattttcca

SEQ ID NO: 1863207 - DNA, 13 bp, Homo sapiens
aactgtggaattt

SEQ ID NO: 1863208 - DNA, 14 bp, Homo sapiens
aactgtgtatcatt

SEQ ID NO: 1863209 - DNA, 14 bp, Homo sapiens
aacttctaatatat

SEQ ID NO: 1863210 - DNA, 23 bp, Homo sapiens
aacttgattcttgtgattgactt

SEQ ID NO: 1863211 - DNA, 19 bp, Homo sapiens
aacttgctacttatcattt

SEQ ID NO: 1863212 - DNA, 18 bp, Homo sapiens
aacttgtaataaaccctt

SEQ ID NO: 1863213 - DNA, 12 bp, Homo sapiens
aactttaaaagg

SEQ ID NO: 1863214 - DNA, 17 bp, Homo sapiens
aactttaaagataagtc

SEQ ID NO: 1863215 - DNA, 20 bp, Homo sapiens
aactttacccaaaaactaaa

SEQ ID NO: 1863216 - DNA, 18 bp, Homo sapiens
aactttctcttcatactt

SEQ ID NO: 1863217 - DNA, 15 bp, Homo sapiens
aactttctgtaaact

SEQ ID NO: 1863218 - DNA, 15 bp, Homo sapiens
aactttgccttaagt

SEQ ID NO: 1863219 - DNA, 13 bp, Homo sapiens
aacttttacagaa

SEQ ID NO: 1863220 - DNA, 15 bp, Homo sapiens
aacttttacagaatg

SEQ ID NO: 1863221 - DNA, 18 bp, Homo sapiens
aacttttaggttgttacc

SEQ ID NO: 1863222 - DNA, 14 bp, Homo sapiens
aacttttgtaattt

SEQ ID NO: 1863223 - DNA, 20 bp, Homo sapiens
aacttttgtaatttgaattg

SEQ ID NO: 1863224 - DNA, 14 bp, Homo sapiens
aagaaaccatgaca

SEQ ID NO: 1863225 - DNA, 16 bp, Homo sapiens
aagaaaccatgacaaa

SEQ ID NO: 1863226 - DNA, 17 bp, Homo sapiens
aagaaagagaatgaact

SEQ ID NO: 1863227 - DNA, 10 bp, Homo sapiens
aagaaaggat

SEQ ID NO: 1863228 - DNA, 17 bp, Homo sapiens
aagaaaggatataaaag

SEQ ID NO: 1863229 - DNA, 16 bp, Homo sapiens
aagaaatttgatttct

SEQ ID NO: 1863230 - DNA, 14 bp, Homo sapiens
aagaagttttaact

SEQ ID NO: 1863231 - DNA, 12 bp, Homo sapiens
aagaattaaaac

SEQ ID NO: 1863232 - DNA, 14 bp, Homo sapiens
aagaattaaaactg

SEQ ID NO: 1863233 - DNA, 16 bp, Homo sapiens
aagaattaaaactgag

SEQ ID NO: 1863234 - DNA, 18 bp, Homo sapiens
aagaattaaaactgagtc

SEQ ID NO: 1863235 - DNA, 20 bp, Homo sapiens
aagaattctattttgctgga

SEQ ID NO: 1863236 - DNA, 13 bp, Homo sapiens
aagacataaaact

SEQ ID NO: 1863237 - DNA, 18 bp, Homo sapiens
aagacataaaactttaaa

SEQ ID NO: 1863238 - DNA, 13 bp, Homo sapiens
aagacccctgccc

SEQ ID NO: 1863239 - DNA, 15 bp, Homo sapiens
aagacccctgcccaa

SEQ ID NO: 1863240 - DNA, 17 bp, Homo sapiens
aagactggtttgtttgc

SEQ ID NO: 1863241 - DNA, 14 bp, Homo sapiens
aataaatagaaaga

SEQ ID NO: 1863242 - DNA, 22 bp, Homo sapiens
aataacactgttggcacttata

SEQ ID NO: 1863243 - DNA, 10 bp, Homo sapiens
aataacagaa

SEQ ID NO: 1863244 - DNA, 19 bp, Homo sapiens
aataactctgattttgata

SEQ ID NO: 1863245 - DNA, 14 bp, Homo sapiens
aataactgaactgt

SEQ ID NO: 1863246 - DNA, 15 bp, Homo sapiens
aataactgaactgtt

SEQ ID NO: 1863247 - DNA, 14 bp, Homo sapiens
aataagaatgattt

SEQ ID NO: 1863248 - DNA, 23 bp, Homo sapiens
aataagttttatacataaacagt

SEQ ID NO: 1863249 - DNA, 17 bp, Homo sapiens
aataagttttgatataa

SEQ ID NO: 1863250 - DNA, 18 bp, Homo sapiens
aataagttttgatataat

SEQ ID NO: 1863251 - DNA, 21 bp, Homo sapiens
aataagttttgatataatctt

SEQ ID NO: 1863252 - DNA, 14 bp, Homo sapiens
aataatacactaat

SEQ ID NO: 1863253 - DNA, 13 bp, Homo sapiens
aataatctatatt

SEQ ID NO: 1863254 - DNA, 19 bp, Homo sapiens
aataatctatattaaatga

SEQ ID NO: 1863255 - DNA, 14 bp, Homo sapiens
aataattttttgca

SEQ ID NO: 1863256 - DNA, 22 bp, Homo sapiens
aataattttttgcagtcttttg

SEQ ID NO: 1863257 - DNA, 23 bp, Homo sapiens
aatacaatccgagctacaaagca

SEQ ID NO: 1863258 - DNA, 19 bp, Homo sapiens
aatacacagcatgcagact

SEQ ID NO: 1863259 - DNA, 16 bp, Homo sapiens
aatacgcactacatgt

SEQ ID NO: 1863260 - DNA, 18 bp, Homo sapiens
aatacgcactacatgtgg

SEQ ID NO: 1863261 - DNA, 18 bp, Homo sapiens
aatagaaaactgaaaatc

SEQ ID NO: 1863262 - DNA, 19 bp, Homo sapiens
aataggatgaatgggaaag

SEQ ID NO: 1863263 - DNA, 18 bp, Homo sapiens
aatatactttttttgtta

SEQ ID NO: 1863264 - DNA, 19 bp, Homo sapiens
aatatagattaaatcatac

SEQ ID NO: 1863265 - DNA, 19 bp, Homo sapiens
aatatatacagattcctgt

SEQ ID NO: 1863266 - DNA, 16 bp, Homo sapiens
aatatatcccagaaat

SEQ ID NO: 1863267 - DNA, 17 bp, Homo sapiens
aatatatgttctgcaag

SEQ ID NO: 1863268 - DNA, 14 bp, Homo sapiens
aatatggaacttct

SEQ ID NO: 1863269 - DNA, 17 bp, Homo sapiens
aatattaatggaaacat

SEQ ID NO: 1863270 - DNA, 18 bp, Homo sapiens
aatattatttgatatctg

SEQ ID NO: 1863271 - DNA, 17 bp, Homo sapiens
aatattcagagaaaact

SEQ ID NO: 1863272 - DNA, 13 bp, Homo sapiens
aatattcttttgt

SEQ ID NO: 1863273 - DNA, 13 bp, Homo sapiens
aatattgctaaaa

SEQ ID NO: 1863274 - DNA, 14 bp, Homo sapiens
aatattttaagaaa

SEQ ID NO: 1863275 - DNA, 17 bp, Homo sapiens
aatattttaagaaagag

SEQ ID NO: 1863276 - DNA, 18 bp, Homo sapiens
aatattttaagaaagaga

SEQ ID NO: 1863277 - DNA, 16 bp, Homo sapiens
aatcacaaacatatgt

SEQ ID NO: 1863278 - DNA, 13 bp, Homo sapiens
aatcagacaaagt

SEQ ID NO: 1863279 - DNA, 15 bp, Homo sapiens
aatcagcatgacaaa

SEQ ID NO: 1863280 - DNA, 23 bp, Homo sapiens
aatcagcatgacaaaaataacac

SEQ ID NO: 1863281 - DNA, 16 bp, Homo sapiens
aatcagtaaacactgt

SEQ ID NO: 1863282 - DNA, 19 bp, Homo sapiens
aatcatactcctatgcttt

SEQ ID NO: 1863283 - DNA, 22 bp, Homo sapiens
aatcatattaattattttccaa

SEQ ID NO: 1863284 - DNA, 19 bp, Homo sapiens
aatcatgctcatgtatatt

SEQ ID NO: 1863285 - DNA, 22 bp, Homo sapiens
aattgtctgtctgctcttattt

SEQ ID NO: 1863286 - DNA, 14 bp, Homo sapiens
aattgttgatattt

SEQ ID NO: 1863287 - DNA, 18 bp, Homo sapiens
aatttaatggactgtgaa

SEQ ID NO: 1863288 - DNA, 23 bp, Homo sapiens
aatttaatggactgtgaatttca

SEQ ID NO: 1863289 - DNA, 21 bp, Homo sapiens
aatttataggcagatctttaa

SEQ ID NO: 1863290 - DNA, 22 bp, Homo sapiens
aatttataggcagatctttaaa

SEQ ID NO: 1863291 - DNA, 23 bp, Homo sapiens
aatttataggcagatctttaaat

SEQ ID NO: 1863292 - DNA, 12 bp, Homo sapiens
aatttatatctt

SEQ ID NO: 1863293 - DNA, 13 bp, Homo sapiens
aatttatatcttt

SEQ ID NO: 1863294 - DNA, 14 bp, Homo sapiens
aatttatatcttta

SEQ ID NO: 1863295 - DNA, 20 bp, Homo sapiens
aatttatatctttatgcaaa

SEQ ID NO: 1863296 - DNA, 22 bp, Homo sapiens
aatttatatctttatgcaaaaa

SEQ ID NO: 1863297 - DNA, 14 bp, Homo sapiens
aatttattggcagc

SEQ ID NO: 1863298 - DNA, 12 bp, Homo sapiens
aatttcacagtt

SEQ ID NO: 1863299 - DNA, 17 bp, Homo sapiens
aatttcaggaatttaat

SEQ ID NO: 1863300 - DNA, 21 bp, Homo sapiens
aatttcaggaatttaatttat

SEQ ID NO: 1863301 - DNA, 22 bp, Homo sapiens
aatttccaaaataatctatatt

SEQ ID NO: 1863302 - DNA, 16 bp, Homo sapiens
aatttcctttatattt

SEQ ID NO: 1863303 - DNA, 21 bp, Homo sapiens
aatttcctttatatttagtga

SEQ ID NO: 1863304 - DNA, 15 bp, Homo sapiens
aattttctagacttt

SEQ ID NO: 1863305 - DNA, 11 bp, Homo sapiens
aatttttgaaa

SEQ ID NO: 1863306 - DNA, 19 bp, Homo sapiens
acaaaaataacactgttgg

SEQ ID NO: 1863307 - DNA, 15 bp, Homo sapiens
acaaaaattgactca

SEQ ID NO: 1863308 - DNA, 18 bp, Homo sapiens
acaaaagcagcttttagt

SEQ ID NO: 1863309 - DNA, 18 bp, Homo sapiens
acaaaatagaagctgtag

SEQ ID NO: 1863310 - DNA, 19 bp, Homo sapiens
acaaagcatgggaaaaaga

SEQ ID NO: 1863311 - DNA, 14 bp, Homo sapiens
acaaagtaattcct

SEQ ID NO: 1863312 - DNA, 15 bp, Homo sapiens
acaaatacactttat

SEQ ID NO: 1863313 - DNA, 21 bp, Homo sapiens
acaaatggcttacttacaaaa

SEQ ID NO: 1863314 - DNA, 23 bp, Homo sapiens
acaaattccgattagacctttat

SEQ ID NO: 1863315 - DNA, 14 bp, Homo sapiens
acaagaaggccagc

SEQ ID NO: 1863316 - DNA, 17 bp, Homo sapiens
acaagaaggccagccca

SEQ ID NO: 1863317 - DNA, 21 bp, Homo sapiens
acaagaaggccagcccactgg

SEQ ID NO: 1863318 - DNA, 22 bp, Homo sapiens
acaagaaggccagcccactggg

SEQ ID NO: 1863319 - DNA, 15 bp, Homo sapiens
acaagacaacattgt

SEQ ID NO: 1863320 - DNA, 17 bp, Homo sapiens
acaagtcctgtgaattt

SEQ ID NO: 1863321 - DNA, 20 bp, Homo sapiens
acaagtgtatatcagaaaag

SEQ ID NO: 1863322 - DNA, 14 bp, Homo sapiens
acaagtttgctaaa

SEQ ID NO: 1863323 - DNA, 20 bp, Homo sapiens
acaatatgattgcactaaat

SEQ ID NO: 1863324 - DNA, 23 bp, Homo sapiens
acaatttcctttatatttagtga

SEQ ID NO: 1863325 - DNA, 19 bp, Homo sapiens
acacactgcggtgtctgca

SEQ ID NO: 1863326 - DNA, 13 bp, Homo sapiens
acacatacaaaaa

SEQ ID NO: 1863327 - DNA, 21 bp, Homo sapiens
acacatacaaaaaaaatcttt

SEQ ID NO: 1863328 - DNA, 19 bp, Homo sapiens
acacatccctaatgtgtgc

SEQ ID NO: 1863329 - DNA, 20 bp, Homo sapiens
acacatccctaatgtgtgcc

SEQ ID NO: 1863330 - DNA, 16 bp, Homo sapiens
acacatgctgaggttt

SEQ ID NO: 1863331 - DNA, 14 bp, Homo sapiens
accatattgctctt

SEQ ID NO: 1863332 - DNA, 16 bp, Homo sapiens
accatattgctcttaa

SEQ ID NO: 1863333 - DNA, 22 bp, Homo sapiens
accattattttacagtctctgt

SEQ ID NO: 1863334 - DNA, 22 bp, Homo sapiens
accattgaaatcagcatgacaa

SEQ ID NO: 1863335 - DNA, 15 bp, Homo sapiens
accattttcaatttg

SEQ ID NO: 1863336 - DNA, 16 bp, Homo sapiens
acccaagaaaacctgt

SEQ ID NO: 1863337 - DNA, 18 bp, Homo sapiens
acccccaaatttaattaa

SEQ ID NO: 1863338 - DNA, 12 bp, Homo sapiens
acccccccaggc

SEQ ID NO: 1863339 - DNA, 14 bp, Homo sapiens
acccccccaggcct

SEQ ID NO: 1863340 - DNA, 19 bp, Homo sapiens
acccccccaggcctccaga

SEQ ID NO: 1863341 - DNA, 17 bp, Homo sapiens
acccctgcccaagtggc

SEQ ID NO: 1863342 - DNA, 13 bp, Homo sapiens
accctgcaggcca

SEQ ID NO: 1863343 - DNA, 14 bp, Homo sapiens
accctgcaggccag

SEQ ID NO: 1863344 - DNA, 16 bp, Homo sapiens
accctgcaggccaggc

SEQ ID NO: 1863345 - DNA, 18 bp, Homo sapiens
accctgcaggccaggcca

SEQ ID NO: 1863346 - DNA, 20 bp, Homo sapiens
acccttggtttgcacataaa

SEQ ID NO: 1863347 - DNA, 15 bp, Homo sapiens
accggccgcagcccc

SEQ ID NO: 1863348 - DNA, 22 bp, Homo sapiens
accggccgcagcccccactgac

SEQ ID NO: 1863349 - DNA, 12 bp, Homo sapiens
accgtggggagg

SEQ ID NO: 1863350 - DNA, 16 bp, Homo sapiens
accgtggggaggccat

SEQ ID NO: 1863351 - DNA, 14 bp, Homo sapiens
accgttttgtattg

SEQ ID NO: 1863352 - DNA, 16 bp, Homo sapiens
acctacaggactgggc

SEQ ID NO: 1863353 - DNA, 20 bp, Homo sapiens
acctagcttttaaaaaatat

SEQ ID NO: 1863354 - DNA, 14 bp, Homo sapiens
acctattgaattac

SEQ ID NO: 1863355 - DNA, 20 bp, Homo sapiens
acctccaatcccccagcgct

SEQ ID NO: 1863356 - DNA, 19 bp, Homo sapiens
acctgaaaaaaagtttaca

SEQ ID NO: 1863357 - DNA, 16 bp, Homo sapiens
acctgccttttaagtt

SEQ ID NO: 1863358 - DNA, 16 bp, Homo sapiens
acctgggccaaggact

SEQ ID NO: 1863359 - DNA, 17 bp, Homo sapiens
acctgggccaaggactc

SEQ ID NO: 1863360 - DNA, 23 bp, Homo sapiens
acctgttaggtctcatgcccact

SEQ ID NO: 1863361 - DNA, 13 bp, Homo sapiens
acctgtttttaac

SEQ ID NO: 1863362 - DNA, 15 bp, Homo sapiens
acctgtttttaacat

SEQ ID NO: 1863363 - DNA, 15 bp, Homo sapiens
accttaccaactttc

SEQ ID NO: 1863364 - DNA, 15 bp, Homo sapiens
acctttttatattta

SEQ ID NO: 1863365 - DNA, 16 bp, Homo sapiens
acgcatgtccctccaa

SEQ ID NO: 1863366 - DNA, 21 bp, Homo sapiens
acgcatgtccctccaaggctg

SEQ ID NO: 1863367 - DNA, 16 bp, Homo sapiens
acgcgcgcacacacac

SEQ ID NO: 1863368 - DNA, 14 bp, Homo sapiens
acggccaggctccc

SEQ ID NO: 1863369 - DNA, 15 bp, Homo sapiens
acggcccatcttggc

SEQ ID NO: 1863370 - DNA, 23 bp, Homo sapiens
acgttcttacaagcttaaagctt

SEQ ID NO: 1863371 - DNA, 13 bp, Homo sapiens
actaaactttacc

SEQ ID NO: 1863372 - DNA, 14 bp, Homo sapiens
actaaagtatgtaa

SEQ ID NO: 1863373 - DNA, 16 bp, Homo sapiens
actaaataaactactt

SEQ ID NO: 1863374 - DNA, 13 bp, Homo sapiens
actaaattagttt

SEQ ID NO: 1863375 - DNA, 16 bp, Homo sapiens
actaaattagtttaaa

SEQ ID NO: 1863376 - DNA, 17 bp, Homo sapiens
actaacgaacgttttaa

SEQ ID NO: 1863377 - DNA, 18 bp, Homo sapiens
actaacgaacgttttaaa

SEQ ID NO: 1863378 - DNA, 16 bp, Homo sapiens
actaagccacaagaaa

SEQ ID NO: 1863379 - DNA, 15 bp, Homo sapiens
actaatttaaaaaat

SEQ ID NO: 1863380 - DNA, 20 bp, Homo sapiens
actacacatccctaatgtgt

SEQ ID NO: 1863381 - DNA, 19 bp, Homo sapiens
actagagtcacccccccag

SEQ ID NO: 1863382 - DNA, 21 bp, Homo sapiens
agaagggggagtgaaacagag

SEQ ID NO: 1863383 - DNA, 22 bp, Homo sapiens
agaagggggagtgaaacagaga

SEQ ID NO: 1863384 - DNA, 20 bp, Homo sapiens
agaatgaactgtggaattta

SEQ ID NO: 1863385 - DNA, 23 bp, Homo sapiens
agaatgaactgtggaatttattg

SEQ ID NO: 1863386 - DNA, 13 bp, Homo sapiens
agaatgcattaaa

SEQ ID NO: 1863387 - DNA, 22 bp, Homo sapiens
agaatggataagatgatgttaa

SEQ ID NO: 1863388 - DNA, 21 bp, Homo sapiens
agaatggttgccttaaagaaa

SEQ ID NO: 1863389 - DNA, 13 bp, Homo sapiens
agaattatatagg

SEQ ID NO: 1863390 - DNA, 22 bp, Homo sapiens
agaattctattttgctggagac

SEQ ID NO: 1863391 - DNA, 18 bp, Homo sapiens
agaattggcataatttgt

SEQ ID NO: 1863392 - DNA, 23 bp, Homo sapiens
agaatttaatggactgtgaattt

SEQ ID NO: 1863393 - DNA, 12 bp, Homo sapiens
agacaattagca

SEQ ID NO: 1863394 - DNA, 21 bp, Homo sapiens
agacacatgctgaggttttga

SEQ ID NO: 1863395 - DNA, 16 bp, Homo sapiens
agacagtggcactaaa

SEQ ID NO: 1863396 - DNA, 17 bp, Homo sapiens
agacagtggcactaaaa

SEQ ID NO: 1863397 - DNA, 13 bp, Homo sapiens
agacataaaactt

SEQ ID NO: 1863398 - DNA, 14 bp, Homo sapiens
agacataaaacttt

SEQ ID NO: 1863399 - DNA, 17 bp, Homo sapiens
agacataaaactttaaa

SEQ ID NO: 1863400 - DNA, 23 bp, Homo sapiens
agacataaaactttaaaaggcaa

SEQ ID NO: 1863401 - DNA, 13 bp, Homo sapiens
agacatctgcctg

SEQ ID NO: 1863402 - DNA, 15 bp, Homo sapiens
agacatctgcctgta

SEQ ID NO: 1863403 - DNA, 22 bp, Homo sapiens
agacccctgcccaagtggctct

SEQ ID NO: 1863404 - DNA, 15 bp, Homo sapiens
agactggtttgtttg

SEQ ID NO: 1863405 - DNA, 15 bp, Homo sapiens
agactgtcaaatgaa

SEQ ID NO: 1863406 - DNA, 18 bp, Homo sapiens
agactgtcaaatgaactt

SEQ ID NO: 1863407 - DNA, 20 bp, Homo sapiens
agactgtcaaatgaactttt

SEQ ID NO: 1863408 - DNA, 14 bp, Homo sapiens
agactgtgtttcta

SEQ ID NO: 1863409 - DNA, 18 bp, Homo sapiens
agacttgcggccacagca

SEQ ID NO: 1863410 - DNA, 12 bp, Homo sapiens
agactttctgtt

SEQ ID NO: 1863411 - DNA, 17 bp, Homo sapiens
agactttgctgttactg

SEQ ID NO: 1863412 - DNA, 14 bp, Homo sapiens
agagaatgaactgt

SEQ ID NO: 1863413 - DNA, 22 bp, Homo sapiens
agagaatgaactgtggaattta

SEQ ID NO: 1863414 - DNA, 16 bp, Homo sapiens
agagacttttaatcag

SEQ ID NO: 1863415 - DNA, 20 bp, Homo sapiens
agagagcatcttttcctccc

SEQ ID NO: 1863416 - DNA, 21 bp, Homo sapiens
agagagctcatcatcagtctt

SEQ ID NO: 1863417 - DNA, 17 bp, Homo sapiens
agagcacaagaaggcca

SEQ ID NO: 1863418 - DNA, 18 bp, Homo sapiens
agagcacaagaaggccag

SEQ ID NO: 1863419 - DNA, 22 bp, Homo sapiens
agagccaggggtgtcccagtcc

SEQ ID NO: 1863420 - DNA, 15 bp, Homo sapiens
agagctgtggctggg

SEQ ID NO: 1863421 - DNA, 18 bp, Homo sapiens
agagctgtggctgggggg

SEQ ID NO: 1863422 - DNA, 17 bp, Homo sapiens
agagcttgtagccctgg

SEQ ID NO: 1863423 - DNA, 18 bp, Homo sapiens
agagcttgtagccctgga

SEQ ID NO: 1863424 - DNA, 19 bp, Homo sapiens
agagcttgtagccctggat

SEQ ID NO: 1863425 - DNA, 17 bp, Homo sapiens
agagggactggacagcc

SEQ ID NO: 1863426 - DNA, 18 bp, Homo sapiens
agagggactggacagcca

SEQ ID NO: 1863427 - DNA, 21 bp, Homo sapiens
agagggactggacagccaggg

SEQ ID NO: 1863428 - DNA, 19 bp, Homo sapiens
agagggaggagtttttctt

SEQ ID NO: 1863429 - DNA, 22 bp, Homo sapiens
agaggggttttagatttttaaa

SEQ ID NO: 1863430 - DNA, 13 bp, Homo sapiens
agaggttctgcac

SEQ ID NO: 1863431 - DNA, 18 bp, Homo sapiens
agaggttctgcactcctg

SEQ ID NO: 1863432 - DNA, 22 bp, Homo sapiens
agaggtttggagccgggaaagc

SEQ ID NO: 1863433 - DNA, 13 bp, Homo sapiens
agagtagaaaagg

SEQ ID NO: 1863434 - DNA, 18 bp, Homo sapiens
agagtcacccccccaggc

SEQ ID NO: 1863435 - DNA, 20 bp, Homo sapiens
agagtcacccccccaggcct

SEQ ID NO: 1863436 - DNA, 23 bp, Homo sapiens
agagtcacccccccaggcctcca

SEQ ID NO: 1863437 - DNA, 14 bp, Homo sapiens
agagtggcctgtga

SEQ ID NO: 1863438 - DNA, 16 bp, Homo sapiens
agagtggcctgtgagc

SEQ ID NO: 1863439 - DNA, 14 bp, Homo sapiens
agagtttaacacaa

SEQ ID NO: 1863440 - DNA, 22 bp, Homo sapiens
agagtttaacacaagtcctgtg

SEQ ID NO: 1863441 - DNA, 19 bp, Homo sapiens
agatcattatcttcatgtt

SEQ ID NO: 1863442 - DNA, 14 bp, Homo sapiens
agatgaaataattt

SEQ ID NO: 1863443 - DNA, 19 bp, Homo sapiens
agatgagcacttctaagtt

SEQ ID NO: 1863444 - DNA, 12 bp, Homo sapiens
agcccccactga

SEQ ID NO: 1863445 - DNA, 13 bp, Homo sapiens
agcccccactgac

SEQ ID NO: 1863446 - DNA, 15 bp, Homo sapiens
agcccccactgacct

SEQ ID NO: 1863447 - DNA, 17 bp, Homo sapiens
agcccccactgacctgc

SEQ ID NO: 1863448 - DNA, 20 bp, Homo sapiens
agcccccactgacctgccca

SEQ ID NO: 1863449 - DNA, 22 bp, Homo sapiens
agccctggatggcctctggggc

SEQ ID NO: 1863450 - DNA, 21 bp, Homo sapiens
agccgcggggacaccgggaag

SEQ ID NO: 1863451 - DNA, 12 bp, Homo sapiens
agccgggaaagc

SEQ ID NO: 1863452 - DNA, 13 bp, Homo sapiens
agccgtgcaggac

SEQ ID NO: 1863453 - DNA, 17 bp, Homo sapiens
agcctctggggcagagc

SEQ ID NO: 1863454 - DNA, 19 bp, Homo sapiens
agccttaagcacaattaat

SEQ ID NO: 1863455 - DNA, 17 bp, Homo sapiens
agccttatgtgttacat

SEQ ID NO: 1863456 - DNA, 18 bp, Homo sapiens
agcgcacgcgcgcacaca

SEQ ID NO: 1863457 - DNA, 22 bp, Homo sapiens
agcgcttagaaacatgttcctg

SEQ ID NO: 1863458 - DNA, 15 bp, Homo sapiens
agcgggccaggcagg

SEQ ID NO: 1863459 - DNA, 14 bp, Homo sapiens
agcgtccatttctt

SEQ ID NO: 1863460 - DNA, 15 bp, Homo sapiens
agcgtccatttctta

SEQ ID NO: 1863461 - DNA, 23 bp, Homo sapiens
agctaatctgcctggttttattt

SEQ ID NO: 1863462 - DNA, 22 bp, Homo sapiens
agctacaaagcatgggaaaaag

SEQ ID NO: 1863463 - DNA, 15 bp, Homo sapiens
agctagaatttctgg

SEQ ID NO: 1863464 - DNA, 21 bp, Homo sapiens
agctagtgccaaataattgat

SEQ ID NO: 1863465 - DNA, 17 bp, Homo sapiens
agctagttcgtagcttt

SEQ ID NO: 1863466 - DNA, 16 bp, Homo sapiens
agctataaattatatt

SEQ ID NO: 1863467 - DNA, 20 bp, Homo sapiens
agctatcagaagaccacaaa

SEQ ID NO: 1863468 - DNA, 17 bp, Homo sapiens
agctattcccttctgat

SEQ ID NO: 1863469 - DNA, 14 bp, Homo sapiens
agctcatattttgt

SEQ ID NO: 1863470 - DNA, 17 bp, Homo sapiens
agctcatcatcagtctt

SEQ ID NO: 1863471 - DNA, 15 bp, Homo sapiens
agctgagagactttt

SEQ ID NO: 1863472 - DNA, 21 bp, Homo sapiens
agctggcactgacagcctggg

SEQ ID NO: 1863473 - DNA, 16 bp, Homo sapiens
agctgttcttttttgt

SEQ ID NO: 1863474 - DNA, 16 bp, Homo sapiens
agctgtttaagatggg

SEQ ID NO: 1863475 - DNA, 12 bp, Homo sapiens
agcttaaagctt

SEQ ID NO: 1863476 - DNA, 18 bp, Homo sapiens
agcttaaagcttgatttg

SEQ ID NO: 1863477 - DNA, 15 bp, Homo sapiens
agcttacccttggtt

SEQ ID NO: 1863478 - DNA, 15 bp, Homo sapiens
agcttcccctcactt

SEQ ID NO: 1863479 - DNA, 18 bp, Homo sapiens
agcttcctgtctgtttat

SEQ ID NO: 1863480 - DNA, 15 bp, Homo sapiens
agcttgatttgatct

SEQ ID NO: 1863481 - DNA, 17 bp, Homo sapiens
agcttgatttgatcttt

SEQ ID NO: 1863482 - DNA, 15 bp, Homo sapiens
agctttacatgcaat

SEQ ID NO: 1863483 - DNA, 14 bp, Homo sapiens
agctttatctttgt

SEQ ID NO: 1863484 - DNA, 19 bp, Homo sapiens
agctttatctttgtgtaat

SEQ ID NO: 1863485 - DNA, 20 bp, Homo sapiens
agctttgggaaagctgcctc

SEQ ID NO: 1863486 - DNA, 16 bp, Homo sapiens
agcttttaaaaaatat

SEQ ID NO: 1863487 - DNA, 17 bp, Homo sapiens
agcttttaaaaaatatt

SEQ ID NO: 1863488 - DNA, 18 bp, Homo sapiens
agcttttaaaaaatattt

SEQ ID NO: 1863489 - DNA, 20 bp, Homo sapiens
agcttttaaaaaatatttta

SEQ ID NO: 1863490 - DNA, 22 bp, Homo sapiens
agcttttaaaaaatattttaag

SEQ ID NO: 1863491 - DNA, 15 bp, Homo sapiens
agcttttattgtata

SEQ ID NO: 1863492 - DNA, 17 bp, Homo sapiens
agcttttattgtataaa

SEQ ID NO: 1863493 - DNA, 19 bp, Homo sapiens
agcttttattgtataaact

SEQ ID NO: 1863494 - DNA, 18 bp, Homo sapiens
aggaaaattgaaagtatt

SEQ ID NO: 1863495 - DNA, 24 bp, Homo sapiens
aggaaccacatataacacttaact

SEQ ID NO: 1863496 - DNA, 14 bp, Homo sapiens
aggaagacataaaa

SEQ ID NO: 1863497 - DNA, 20 bp, Homo sapiens
aggaatgtgtccaagacaca

SEQ ID NO: 1863498 - DNA, 13 bp, Homo sapiens
aggacccacctgg

SEQ ID NO: 1863499 - DNA, 21 bp, Homo sapiens
aggactaacgaacgttttaaa

SEQ ID NO: 1863500 - DNA, 15 bp, Homo sapiens
aggactgggccgggc

SEQ ID NO: 1863501 - DNA, 15 bp, Homo sapiens
aggactgtaagcaga

SEQ ID NO: 1863502 - DNA, 20 bp, Homo sapiens
aggagaagacccctgcccaa

SEQ ID NO: 1863503 - DNA, 20 bp, Homo sapiens
aggagcagcccacccagcag

SEQ ID NO: 1863504 - DNA, 12 bp, Homo sapiens
ataatgctttct

SEQ ID NO: 1863505 - DNA, 22 bp, Homo sapiens
ataatgtgtctgtgttgcttca

SEQ ID NO: 1863506 - DNA, 21 bp, Homo sapiens
ataattcaccaaaagttcata

SEQ ID NO: 1863507 - DNA, 15 bp, Homo sapiens
ataattgttgatatt

SEQ ID NO: 1863508 - DNA, 15 bp, Homo sapiens
ataattttttattca

SEQ ID NO: 1863509 - DNA, 17 bp, Homo sapiens
ataattttttattcaag

SEQ ID NO: 1863510 - DNA, 17 bp, Homo sapiens
atacaaaaaaaatcttt

SEQ ID NO: 1863511 - DNA, 18 bp, Homo sapiens
atacaaaaaaaatcttta

SEQ ID NO: 1863512 - DNA, 23 bp, Homo sapiens
atacaatccgagctacaaagcat

SEQ ID NO: 1863513 - DNA, 20 bp, Homo sapiens
atacacagttaaataaatag

SEQ ID NO: 1863514 - DNA, 19 bp, Homo sapiens
atacactaattcctttcta

SEQ ID NO: 1863515 - DNA, 13 bp, Homo sapiens
atacactttatta

SEQ ID NO: 1863516 - DNA, 19 bp, Homo sapiens
atacagatggagcaaatgt

SEQ ID NO: 1863517 - DNA, 20 bp, Homo sapiens
atacagccctcccccagcag

SEQ ID NO: 1863518 - DNA, 17 bp, Homo sapiens
atacataaacagttttg

SEQ ID NO: 1863519 - DNA, 16 bp, Homo sapiens
ataccataggaagaca

SEQ ID NO: 1863520 - DNA, 14 bp, Homo sapiens
ataccattgaaatc

SEQ ID NO: 1863521 - DNA, 15 bp, Homo sapiens
ataccattgaaatca

SEQ ID NO: 1863522 - DNA, 22 bp, Homo sapiens
atacccaacagtttatttttat

SEQ ID NO: 1863523 - DNA, 13 bp, Homo sapiens
atacctgcctttt

SEQ ID NO: 1863524 - DNA, 16 bp, Homo sapiens
atacgcactacatgtg

SEQ ID NO: 1863525 - DNA, 17 bp, Homo sapiens
atactcctatgctttag

SEQ ID NO: 1863526 - DNA, 20 bp, Homo sapiens
atactgtaaaagttataata

SEQ ID NO: 1863527 - DNA, 21 bp, Homo sapiens
atactgtaaaagttataataa

SEQ ID NO: 1863528 - DNA, 17 bp, Homo sapiens
atagaaaactgaaaatc

SEQ ID NO: 1863529 - DNA, 17 bp, Homo sapiens
atagaaaatcttagtat

SEQ ID NO: 1863530 - DNA, 14 bp, Homo sapiens
atagaagctgtagt

SEQ ID NO: 1863531 - DNA, 18 bp, Homo sapiens
atagaattgcaatctata

SEQ ID NO: 1863532 - DNA, 17 bp, Homo sapiens
atagagtaatgatgtaa

SEQ ID NO: 1863533 - DNA, 12 bp, Homo sapiens
atagattaaatc

SEQ ID NO: 1863534 - DNA, 14 bp, Homo sapiens
atagattgtcttaa

SEQ ID NO: 1863535 - DNA, 15 bp, Homo sapiens
atagattgtgaataa

SEQ ID NO: 1863536 - DNA, 18 bp, Homo sapiens
atagattgtgaataatga

SEQ ID NO: 1863537 - DNA, 18 bp, Homo sapiens
atagcatttttgatttat

SEQ ID NO: 1863538 - DNA, 21 bp, Homo sapiens
atagcatttttgatttatgca

SEQ ID NO: 1863539 - DNA, 14 bp, Homo sapiens
atagcttgtatagt

SEQ ID NO: 1863540 - DNA, 15 bp, Homo sapiens
atagcttttattgta

SEQ ID NO: 1863541 - DNA, 21 bp, Homo sapiens
ataggaaatggtatccagaat

SEQ ID NO: 1863542 - DNA, 16 bp, Homo sapiens
ataggaagacataaaa

SEQ ID NO: 1863543 - DNA, 18 bp, Homo sapiens
ataggaagacataaaact

SEQ ID NO: 1863544 - DNA, 22 bp, Homo sapiens
ataggaagacataaaactttaa

SEQ ID NO: 1863545 - DNA, 19 bp, Homo sapiens
ataggatgaatgggaaagt

SEQ ID NO: 1863546 - DNA, 23 bp, Homo sapiens
ataggcagatctttaaatacagt

SEQ ID NO: 1863547 - DNA, 20 bp, Homo sapiens
ataggtaacgtgattgattc

SEQ ID NO: 1863548 - DNA, 16 bp, Homo sapiens
atataatcatgctcat

SEQ ID NO: 1863549 - DNA, 19 bp, Homo sapiens
atataatcttggcttctta

SEQ ID NO: 1863550 - DNA, 20 bp, Homo sapiens
atataatcttggcttcttaa

SEQ ID NO: 1863551 - DNA, 23 bp, Homo sapiens
atataatcttggcttcttaaaaa

SEQ ID NO: 1863552 - DNA, 20 bp, Homo sapiens
atataatttaaagaaacact

SEQ ID NO: 1863553 - DNA, 22 bp, Homo sapiens
atataatttaaagaaacactaa

SEQ ID NO: 1863554 - DNA, 14 bp, Homo sapiens
atatagaaaatctt

SEQ ID NO: 1863555 - DNA, 14 bp, Homo sapiens
atataggacattga

SEQ ID NO: 1863556 - DNA, 14 bp, Homo sapiens
atatatctcaaatt

SEQ ID NO: 1863557 - DNA, 16 bp, Homo sapiens
atatatctcaaattgt

SEQ ID NO: 1863558 - DNA, 12 bp, Homo sapiens
atatatgctgta

SEQ ID NO: 1863559 - DNA, 15 bp, Homo sapiens
atatatgctgtattt

SEQ ID NO: 1863560 - DNA, 21 bp, Homo sapiens
atatatgttctgcaagaatta

SEQ ID NO: 1863561 - DNA, 15 bp, Homo sapiens
atatatttttatatt

SEQ ID NO: 1863562 - DNA, 14 bp, Homo sapiens
atatcagaaaaggg

SEQ ID NO: 1863563 - DNA, 18 bp, Homo sapiens
atatctgtttgtatattt

SEQ ID NO: 1863564 - DNA, 13 bp, Homo sapiens
atatgaaagccac

SEQ ID NO: 1863565 - DNA, 17 bp, Homo sapiens
atatgattgcactaaat

SEQ ID NO: 1863566 - DNA, 14 bp, Homo sapiens
atatgctgtatttc

SEQ ID NO: 1863567 - DNA, 13 bp, Homo sapiens
atatgcttcttta

SEQ ID NO: 1863568 - DNA, 18 bp, Homo sapiens
atatggaacttctaatat

SEQ ID NO: 1863569 - DNA, 19 bp, Homo sapiens
atatgtctgtctttgcaaa

SEQ ID NO: 1863570 - DNA, 14 bp, Homo sapiens
atatgtgagaaatc

SEQ ID NO: 1863571 - DNA, 20 bp, Homo sapiens
atatgttctgcaagaattaa

SEQ ID NO: 1863572 - DNA, 23 bp, Homo sapiens
atatgttctgcaagaattaaaac

SEQ ID NO: 1863573 - DNA, 23 bp, Homo sapiens
atattaaaaatatggaacttcta

SEQ ID NO: 1863574 - DNA, 22 bp, Homo sapiens
atattaaatgagggtttctgat

SEQ ID NO: 1863575 - DNA, 23 bp, Homo sapiens
atattattggtcaagaaaagcat

SEQ ID NO: 1863576 - DNA, 13 bp, Homo sapiens
atattatttgata

SEQ ID NO: 1863577 - DNA, 14 bp, Homo sapiens
atattccaaggaaa

SEQ ID NO: 1863578 - DNA, 15 bp, Homo sapiens
atattccaaggaaaa

SEQ ID NO: 1863579 - DNA, 19 bp, Homo sapiens
atattccaaggaaaattga

SEQ ID NO: 1863580 - DNA, 21 bp, Homo sapiens
atattccaaggaaaattgaaa

SEQ ID NO: 1863581 - DNA, 14 bp, Homo sapiens
atattctaaattca

SEQ ID NO: 1863582 - DNA, 16 bp, Homo sapiens
atattctaaattcact

SEQ ID NO: 1863583 - DNA, 12 bp, Homo sapiens
atattcttttgt

SEQ ID NO: 1863584 - DNA, 14 bp, Homo sapiens
atattgctaaaagt

SEQ ID NO: 1863585 - DNA, 18 bp, Homo sapiens
atattgctcttaaaaatc

SEQ ID NO: 1863586 - DNA, 20 bp, Homo sapiens
atattgctcttaaaaatctt

SEQ ID NO: 1863587 - DNA, 15 bp, Homo sapiens
atattggtattcact

SEQ ID NO: 1863588 - DNA, 22 bp, Homo sapiens
atatttaaaaaattaaaaatga

SEQ ID NO: 1863589 - DNA, 13 bp, Homo sapiens
atatttacaacct

SEQ ID NO: 1863590 - DNA, 22 bp, Homo sapiens
atatttagttacgtataatgct

SEQ ID NO: 1863591 - DNA, 19 bp, Homo sapiens
atatttgcaaaccctttgt

SEQ ID NO: 1863592 - DNA, 16 bp, Homo sapiens
atattttaagaaagag

SEQ ID NO: 1863593 - DNA, 13 bp, Homo sapiens
atattttgtatat

SEQ ID NO: 1863594 - DNA, 21 bp, Homo sapiens
atattttgtatatatctgctt

SEQ ID NO: 1863595 - DNA, 16 bp, Homo sapiens
atatttttatatttag

SEQ ID NO: 1863596 - DNA, 18 bp, Homo sapiens
atatttttatatttagtt

SEQ ID NO: 1863597 - DNA, 21 bp, Homo sapiens
atcaaaataaaaattaaatgt

SEQ ID NO: 1863598 - DNA, 20 bp, Homo sapiens
atcaatcatctgtgtgaaaa

SEQ ID NO: 1863599 - DNA, 13 bp, Homo sapiens
atcacaaacatat

SEQ ID NO: 1863600 - DNA, 18 bp, Homo sapiens
atcacatctaaagcttta

SEQ ID NO: 1863601 - DNA, 14 bp, Homo sapiens
atcagcatgacaaa

SEQ ID NO: 1863602 - DNA, 15 bp, Homo sapiens
atcagcatgacaaaa

SEQ ID NO: 1863603 - DNA, 21 bp, Homo sapiens
atcagcatgacaaaaataaca

SEQ ID NO: 1863604 - DNA, 14 bp, Homo sapiens
atcagtaaacactg

SEQ ID NO: 1863605 - DNA, 18 bp, Homo sapiens
atcatactcctatgcttt

SEQ ID NO: 1863606 - DNA, 14 bp, Homo sapiens
atcatataagcaag

SEQ ID NO: 1863607 - DNA, 12 bp, Homo sapiens
atcatcaggttt

SEQ ID NO: 1863608 - DNA, 13 bp, Homo sapiens
atcattaaaatat

SEQ ID NO: 1863609 - DNA, 17 bp, Homo sapiens
atcattaaaatatatgt

SEQ ID NO: 1863610 - DNA, 19 bp, Homo sapiens
atcattaaaatatatgttc

SEQ ID NO: 1863611 - DNA, 19 bp, Homo sapiens
atcatttacaagacaacat

SEQ ID NO: 1863612 - DNA, 13 bp, Homo sapiens
atcatttgctttt

SEQ ID NO: 1863613 - DNA, 23 bp, Homo sapiens
atcatttttgtataaaaaggaaa

SEQ ID NO: 1863614 - DNA, 10 bp, Homo sapiens
atccatgctt

SEQ ID NO: 1863615 - DNA, 13 bp, Homo sapiens
atccatgcttcac

SEQ ID NO: 1863616 - DNA, 15 bp, Homo sapiens
atccatgcttcactc

SEQ ID NO: 1863617 - DNA, 17 bp, Homo sapiens
atcccagaaattagaaa

SEQ ID NO: 1863618 - DNA, 18 bp, Homo sapiens
atccctaatgtgtgccat

SEQ ID NO: 1863619 - DNA, 18 bp, Homo sapiens
atcctatatctgtttgta

SEQ ID NO: 1863620 - DNA, 14 bp, Homo sapiens
atccttgacttttt

SEQ ID NO: 1863621 - DNA, 13 bp, Homo sapiens
atcgcagcttcct

SEQ ID NO: 1863622 - DNA, 13 bp, Homo sapiens
atctaaaagctgt

SEQ ID NO: 1863623 - DNA, 20 bp, Homo sapiens
atctaaagctttatctttgt

SEQ ID NO: 1863624 - DNA, 23 bp, Homo sapiens
atctaagtatatgtgagaaatca

SEQ ID NO: 1863625 - DNA, 14 bp, Homo sapiens
atctaatattaaaa

SEQ ID NO: 1863626 - DNA, 22 bp, Homo sapiens
atctattgtgttggctttacaa

SEQ ID NO: 1863627 - DNA, 17 bp, Homo sapiens
atctcaaattgtaatta

SEQ ID NO: 1863628 - DNA, 14 bp, Homo sapiens
atctcctctgctca

SEQ ID NO: 1863629 - DNA, 15 bp, Homo sapiens
atctctaatatggca

SEQ ID NO: 1863630 - DNA, 22 bp, Homo sapiens
atctctaatatggcaaaaatgg

SEQ ID NO: 1863631 - DNA, 23 bp, Homo sapiens
atctgcctcctgtgcctcccttt

SEQ ID NO: 1863632 - DNA, 14 bp, Homo sapiens
atctgcctgtaatt

SEQ ID NO: 1863633 - DNA, 11 bp, Homo sapiens
atctgtacttt

SEQ ID NO: 1863634 - DNA, 15 bp, Homo sapiens
atctgtactttgtgt

SEQ ID NO: 1863635 - DNA, 18 bp, Homo sapiens
atctgtactttgtgttta

SEQ ID NO: 1863636 - DNA, 19 bp, Homo sapiens
atctgtatgattctatgga

SEQ ID NO: 1863637 - DNA, 15 bp, Homo sapiens
atctgtgtgaaaatg

SEQ ID NO: 1863638 - DNA, 12 bp, Homo sapiens
atctgtttgtat

SEQ ID NO: 1863639 - DNA, 14 bp, Homo sapiens
atctgtttgtatat

SEQ ID NO: 1863640 - DNA, 15 bp, Homo sapiens
atctgtttgtatatt

SEQ ID NO: 1863641 - DNA, 19 bp, Homo sapiens
atctgtttgtatatttgca

SEQ ID NO: 1863642 - DNA, 15 bp, Homo sapiens
atcttagagtttaca

SEQ ID NO: 1863643 - DNA, 18 bp, Homo sapiens
atcttagagtttacagtt

SEQ ID NO: 1863644 - DNA, 15 bp, Homo sapiens
atcttggcttcttaa

SEQ ID NO: 1863645 - DNA, 22 bp, Homo sapiens
atcttggcttcttaaaaactgt

SEQ ID NO: 1863646 - DNA, 23 bp, Homo sapiens
atcttggtttggtacagttcata

SEQ ID NO: 1863647 - DNA, 16 bp, Homo sapiens
atctttgtctaaacaa

SEQ ID NO: 1863648 - DNA, 18 bp, Homo sapiens
atctttgtttaaatgcca

SEQ ID NO: 1863649 - DNA, 23 bp, Homo sapiens
atcttttcctcccattttagaaa

SEQ ID NO: 1863650 - DNA, 16 bp, Homo sapiens
atcttttctgaatctt

SEQ ID NO: 1863651 - DNA, 14 bp, Homo sapiens
atgaaaagccatat

SEQ ID NO: 1863652 - DNA, 18 bp, Homo sapiens
atgaaaatcctatatctg

SEQ ID NO: 1863653 - DNA, 17 bp, Homo sapiens
atgaaccgtttacagtg

SEQ ID NO: 1863654 - DNA, 20 bp, Homo sapiens
atgaactgtggaatttattg

SEQ ID NO: 1863655 - DNA, 17 bp, Homo sapiens
atgaactttctcttcat

SEQ ID NO: 1863656 - DNA, 18 bp, Homo sapiens
atgaacttttacagaatg

SEQ ID NO: 1863657 - DNA, 16 bp, Homo sapiens
atgaagtataaatctg

SEQ ID NO: 1863658 - DNA, 22 bp, Homo sapiens
atgaatgggaaagtatttttga

SEQ ID NO: 1863659 - DNA, 13 bp, Homo sapiens
atgacaaaaataa

SEQ ID NO: 1863660 - DNA, 15 bp, Homo sapiens
atgacaaaaataaca

SEQ ID NO: 1863661 - DNA, 17 bp, Homo sapiens
atgacaaaaataacact

SEQ ID NO: 1863662 - DNA, 16 bp, Homo sapiens
atgacaaacctagctt

SEQ ID NO: 1863663 - DNA, 21 bp, Homo sapiens
atgacaaacctagcttttaaa

SEQ ID NO: 1863664 - DNA, 15 bp, Homo sapiens
atgacatgttatata

SEQ ID NO: 1863665 - DNA, 17 bp, Homo sapiens
atgacatgttatatatt

SEQ ID NO: 1863666 - DNA, 14 bp, Homo sapiens
atgacgcctctgga

SEQ ID NO: 1863667 - DNA, 19 bp, Homo sapiens
atgagattttggaagaagt

SEQ ID NO: 1863668 - DNA, 19 bp, Homo sapiens
atgagctcctgctcattgt

SEQ ID NO: 1863669 - DNA, 13 bp, Homo sapiens
atgaggacatgtt

SEQ ID NO: 1863670 - DNA, 17 bp, Homo sapiens
atgatacccaacagttt

SEQ ID NO: 1863671 - DNA, 18 bp, Homo sapiens
atgatggttgcaaaagac

SEQ ID NO: 1863672 - DNA, 15 bp, Homo sapiens
atgattgcactaaat

SEQ ID NO: 1863673 - DNA, 17 bp, Homo sapiens
cagtgagtgccatgctt

SEQ ID NO: 1863674 - DNA, 13 bp, Homo sapiens
cagtgatttacat

SEQ ID NO: 1863675 - DNA, 16 bp, Homo sapiens
cagtgatttacatgct

SEQ ID NO: 1863676 - DNA, 19 bp, Homo sapiens
cagtgatttacatgctgat

SEQ ID NO: 1863677 - DNA, 15 bp, Homo sapiens
cagtggcactaaaat

SEQ ID NO: 1863678 - DNA, 19 bp, Homo sapiens
cagtggcactaaaatgttt

SEQ ID NO: 1863679 - DNA, 14 bp, Homo sapiens
cagtgtatttaaga

SEQ ID NO: 1863680 - DNA, 17 bp, Homo sapiens
cagtgttacaagggtat

SEQ ID NO: 1863681 - DNA, 20 bp, Homo sapiens
cagttgaatgacaacagaag

SEQ ID NO: 1863682 - DNA, 21 bp, Homo sapiens
cagttgaatgacaacagaagc

SEQ ID NO: 1863683 - DNA, 18 bp, Homo sapiens
cagtttattctgtggttc

SEQ ID NO: 1863684 - DNA, 20 bp, Homo sapiens
cagtttgtgttttaaaaaaa

SEQ ID NO: 1863685 - DNA, 22 bp, Homo sapiens
cagtttgtgttttaaaaaaact

SEQ ID NO: 1863686 - DNA, 14 bp, Homo sapiens
cataaaactttaaa

SEQ ID NO: 1863687 - DNA, 19 bp, Homo sapiens
cataaaactttaaaaggca

SEQ ID NO: 1863688 - DNA, 17 bp, Homo sapiens
cataaaattgcagtttc

SEQ ID NO: 1863689 - DNA, 21 bp, Homo sapiens
cataaaattgcagtttcatgt

SEQ ID NO: 1863690 - DNA, 15 bp, Homo sapiens
cataattcaccaaaa

SEQ ID NO: 1863691 - DNA, 14 bp, Homo sapiens
cataatttgtctta

SEQ ID NO: 1863692 - DNA, 22 bp, Homo sapiens
catacaaaaaaaatctttaatg

SEQ ID NO: 1863693 - DNA, 12 bp, Homo sapiens
cataccagtcag

SEQ ID NO: 1863694 - DNA, 14 bp, Homo sapiens
catagagtttaaca

SEQ ID NO: 1863695 - DNA, 15 bp, Homo sapiens
catagagtttaacac

SEQ ID NO: 1863696 - DNA, 18 bp, Homo sapiens
catagagtttaacacaag

SEQ ID NO: 1863697 - DNA, 15 bp, Homo sapiens
catatatgctgtatt

SEQ ID NO: 1863698 - DNA, 17 bp, Homo sapiens
catatatgctgtatttc

SEQ ID NO: 1863699 - DNA, 20 bp, Homo sapiens
catatatgctgtatttcttt

SEQ ID NO: 1863700 - DNA, 14 bp, Homo sapiens
catatctagtcaat

SEQ ID NO: 1863701 - DNA, 18 bp, Homo sapiens
catatgtctgtctttgca

SEQ ID NO: 1863702 - DNA, 15 bp, Homo sapiens
catattctaaattca

SEQ ID NO: 1863703 - DNA, 17 bp, Homo sapiens
catattgctcttaaaaa

SEQ ID NO: 1863704 - DNA, 21 bp, Homo sapiens
catattgctcttaaaaatctt

SEQ ID NO: 1863705 - DNA, 22 bp, Homo sapiens
catattgctcttaaaaatcttg

SEQ ID NO: 1863706 - DNA, 19 bp, Homo sapiens
catcatcagacttgcggcc

SEQ ID NO: 1863707 - DNA, 20 bp, Homo sapiens
catcatcagacttgcggcca

SEQ ID NO: 1863708 - DNA, 14 bp, Homo sapiens
catcgcagcttcct

SEQ ID NO: 1863709 - DNA, 15 bp, Homo sapiens
catcgcagcttcctg

SEQ ID NO: 1863710 - DNA, 12 bp, Homo sapiens
catctaaagctt

SEQ ID NO: 1863711 - DNA, 13 bp, Homo sapiens
catctaaagcttt

SEQ ID NO: 1863712 - DNA, 17 bp, Homo sapiens
catctaaagctttatct

SEQ ID NO: 1863713 - DNA, 23 bp, Homo sapiens
catctaaagctttatctttgtgt

SEQ ID NO: 1863714 - DNA, 20 bp, Homo sapiens
catctgtcaccaattggtta

SEQ ID NO: 1863715 - DNA, 14 bp, Homo sapiens
catgacaaacctag

SEQ ID NO: 1863716 - DNA, 15 bp, Homo sapiens
catgacatgttatat

SEQ ID NO: 1863717 - DNA, 18 bp, Homo sapiens
catgcaatttattaaaat

SEQ ID NO: 1863718 - DNA, 13 bp, Homo sapiens
catgcccactccc

SEQ ID NO: 1863719 - DNA, 22 bp, Homo sapiens
catgcccactcccccaggagca

SEQ ID NO: 1863720 - DNA, 17 bp, Homo sapiens
catgctcatgtatattt

SEQ ID NO: 1863721 - DNA, 18 bp, Homo sapiens
catgcttgtgtttcttag

SEQ ID NO: 1863722 - DNA, 17 bp, Homo sapiens
catggaaacctgaaaaa

SEQ ID NO: 1863723 - DNA, 15 bp, Homo sapiens
catggagcagccccc

SEQ ID NO: 1863724 - DNA, 16 bp, Homo sapiens
catggagcagccccca

SEQ ID NO: 1863725 - DNA, 18 bp, Homo sapiens
catggagcagcccccaaa

SEQ ID NO: 1863726 - DNA, 17 bp, Homo sapiens
catgggaaaaagagact

SEQ ID NO: 1863727 - DNA, 20 bp, Homo sapiens
catgggcaactcgtgacagc

SEQ ID NO: 1863728 - DNA, 21 bp, Homo sapiens
catgggcaactcgtgacagcc

SEQ ID NO: 1863729 - DNA, 13 bp, Homo sapiens
catgtccctccaa

SEQ ID NO: 1863730 - DNA, 15 bp, Homo sapiens
catgtggtttataga

SEQ ID NO: 1863731 - DNA, 20 bp, Homo sapiens
catgtggtttatagagggcc

SEQ ID NO: 1863732 - DNA, 13 bp, Homo sapiens
catgtttgtaaaa

SEQ ID NO: 1863733 - DNA, 18 bp, Homo sapiens
cattaactaaatgctcat

SEQ ID NO: 1863734 - DNA, 17 bp, Homo sapiens
cattaatattcttttgt

SEQ ID NO: 1863735 - DNA, 22 bp, Homo sapiens
cattaatcaatcatctgtgtga

SEQ ID NO: 1863736 - DNA, 12 bp, Homo sapiens
cattactgtatg

SEQ ID NO: 1863737 - DNA, 21 bp, Homo sapiens
cattagtgagacatatttaca

SEQ ID NO: 1863738 - DNA, 13 bp, Homo sapiens
cattattttacag

SEQ ID NO: 1863739 - DNA, 15 bp, Homo sapiens
cattattttacagtc

SEQ ID NO: 1863740 - DNA, 23 bp, Homo sapiens
cattattttacagtctctgttgt

SEQ ID NO: 1863741 - DNA, 16 bp, Homo sapiens
cattgaaatcagcatg

SEQ ID NO: 1863742 - DNA, 16 bp, Homo sapiens
cattgatttgattttt

SEQ ID NO: 1863743 - DNA, 22 bp, Homo sapiens
cattgatttgatttttattatt

SEQ ID NO: 1863744 - DNA, 17 bp, Homo sapiens
cattgtttttctgatat

SEQ ID NO: 1863745 - DNA, 15 bp, Homo sapiens
catttagtaccctgc

SEQ ID NO: 1863746 - DNA, 17 bp, Homo sapiens
catttagtaccctgcag

SEQ ID NO: 1863747 - DNA, 19 bp, Homo sapiens
catttagtaccctgcaggc

SEQ ID NO: 1863748 - DNA, 12 bp, Homo sapiens
catttatttctc

SEQ ID NO: 1863749 - DNA, 17 bp, Homo sapiens
catttctgtatactgta

SEQ ID NO: 1863750 - DNA, 18 bp, Homo sapiens
catttctgtatactgtaa

SEQ ID NO: 1863751 - DNA, 19 bp, Homo sapiens
catttctgtatactgtaaa

SEQ ID NO: 1863752 - DNA, 20 bp, Homo sapiens
catttctgtatactgtaaaa

SEQ ID NO: 1863753 - DNA, 13 bp, Homo sapiens
catttgctgccct

SEQ ID NO: 1863754 - DNA, 14 bp, Homo sapiens
catttgctgccctg

SEQ ID NO: 1863755 - DNA, 16 bp, Homo sapiens
catttgctgccctggg

SEQ ID NO: 1863756 - DNA, 18 bp, Homo sapiens
catttgctgccctggggc

SEQ ID NO: 1863757 - DNA, 14 bp, Homo sapiens
catttggcttgctg

SEQ ID NO: 1863758 - DNA, 20 bp, Homo sapiens
catttggcttgctgtttact

SEQ ID NO: 1863759 - DNA, 16 bp, Homo sapiens
catttggttaaatcat

SEQ ID NO: 1863760 - DNA, 17 bp, Homo sapiens
catttggttaaatcatt

SEQ ID NO: 1863761 - DNA, 13 bp, Homo sapiens
cattttagaaaat

SEQ ID NO: 1863762 - DNA, 17 bp, Homo sapiens
cattttagaaaatcaga

SEQ ID NO: 1863763 - DNA, 22 bp, Homo sapiens
catttttatcaggatttcctct

SEQ ID NO: 1863764 - DNA, 13 bp, Homo sapiens
catttttgctaat

SEQ ID NO: 1863765 - DNA, 14 bp, Homo sapiens
catttttgtataaa

SEQ ID NO: 1863766 - DNA, 12 bp, Homo sapiens
ccaaaattttta

SEQ ID NO: 1863767 - DNA, 22 bp, Homo sapiens
ccaaaccagtttattctgtggt

SEQ ID NO: 1863768 - DNA, 23 bp, Homo sapiens
ccaaaccagtttattctgtggtt

SEQ ID NO: 1863769 - DNA, 12 bp, Homo sapiens
ccaaagagctgt

SEQ ID NO: 1863770 - DNA, 17 bp, Homo sapiens
ccaaattattaattgtc

SEQ ID NO: 1863771 - DNA, 12 bp, Homo sapiens
ccaaattatttg

SEQ ID NO: 1863772 - DNA, 21 bp, Homo sapiens
ccaaattgtctgtctgctctt

SEQ ID NO: 1863773 - DNA, 22 bp, Homo sapiens
ccaaattttattaaaagagtag

SEQ ID NO: 1863774 - DNA, 12 bp, Homo sapiens
ccaacagtgagt

SEQ ID NO: 1863775 - DNA, 13 bp, Homo sapiens
ccaacagtttatt

SEQ ID NO: 1863776 - DNA, 22 bp, Homo sapiens
ccaagacttggcaacagaagca

SEQ ID NO: 1863777 - DNA, 15 bp, Homo sapiens
ccaagtggctcttgg

SEQ ID NO: 1863778 - DNA, 17 bp, Homo sapiens
ccaagtggctcttggga

SEQ ID NO: 1863779 - DNA, 18 bp, Homo sapiens
ccaatcccccagcgctta

SEQ ID NO: 1863780 - DNA, 16 bp, Homo sapiens
ccaatcctccctggag

SEQ ID NO: 1863781 - DNA, 17 bp, Homo sapiens
ccaatcctccctggaga

SEQ ID NO: 1863782 - DNA, 18 bp, Homo sapiens
ccaatcctccctggagaa

SEQ ID NO: 1863783 - DNA, 21 bp, Homo sapiens
ccacaagaaatttgatttcta

SEQ ID NO: 1863784 - DNA, 18 bp, Homo sapiens
ccaccagcaatgccctgc

SEQ ID NO: 1863785 - DNA, 19 bp, Homo sapiens
ccaccagcaatgccctgcc

SEQ ID NO: 1863786 - DNA, 13 bp, Homo sapiens
ccaccttgttaca

SEQ ID NO: 1863787 - DNA, 22 bp, Homo sapiens
ccacgatgacgcctctggacct

SEQ ID NO: 1863788 - DNA, 15 bp, Homo sapiens
agtatagatggccaa

SEQ ID NO: 1863789 - DNA, 16 bp, Homo sapiens
agtatattataataga

SEQ ID NO: 1863790 - DNA, 20 bp, Homo sapiens
agtatcttagagtttacagt

SEQ ID NO: 1863791 - DNA, 13 bp, Homo sapiens
agtattcagaaat

SEQ ID NO: 1863792 - DNA, 14 bp, Homo sapiens
agtattcagaaatt

SEQ ID NO: 1863793 - DNA, 15 bp, Homo sapiens
agtattcagaaatta

SEQ ID NO: 1863794 - DNA, 23 bp, Homo sapiens
agtattcagaaattaaaatatta

SEQ ID NO: 1863795 - DNA, 18 bp, Homo sapiens
agtattcttgtcaaaaaa

SEQ ID NO: 1863796 - DNA, 12 bp, Homo sapiens
agtatttttgaa

SEQ ID NO: 1863797 - DNA, 23 bp, Homo sapiens
agtatttttgaaagaattctatt

SEQ ID NO: 1863798 - DNA, 18 bp, Homo sapiens
agtcaataactctgattt

SEQ ID NO: 1863799 - DNA, 23 bp, Homo sapiens
agtcaatatggggcattaatatt

SEQ ID NO: 1863800 - DNA, 18 bp, Homo sapiens
agtcacctacaggactgg

SEQ ID NO: 1863801 - DNA, 19 bp, Homo sapiens
agtcaggtgtcatcatcag

SEQ ID NO: 1863802 - DNA, 15 bp, Homo sapiens
agtcccagcctctgg

SEQ ID NO: 1863803 - DNA, 19 bp, Homo sapiens
agtcccagcctctggggca

SEQ ID NO: 1863804 - DNA, 13 bp, Homo sapiens
agtcctgctttcc

SEQ ID NO: 1863805 - DNA, 13 bp, Homo sapiens
agtcctgtgaatt

SEQ ID NO: 1863806 - DNA, 16 bp, Homo sapiens
agtcctgtgaatttct

SEQ ID NO: 1863807 - DNA, 18 bp, Homo sapiens
agtcgaattaatagcttt

SEQ ID NO: 1863808 - DNA, 21 bp, Homo sapiens
agtcgaattaatagcttttat

SEQ ID NO: 1863809 - DNA, 21 bp, Homo sapiens
agtcgagcactctaattagag

SEQ ID NO: 1863810 - DNA, 15 bp, Homo sapiens
agtctctgttgtaaa

SEQ ID NO: 1863811 - DNA, 16 bp, Homo sapiens
agtctctgttgtaaat

SEQ ID NO: 1863812 - DNA, 14 bp, Homo sapiens
agtctgaatggcat

SEQ ID NO: 1863813 - DNA, 23 bp, Homo sapiens
agtctgattataccatgtgtgct

SEQ ID NO: 1863814 - DNA, 21 bp, Homo sapiens
agtctgtgtgatgaactttct

SEQ ID NO: 1863815 - DNA, 22 bp, Homo sapiens
agtctgtgtgatgaactttctc

SEQ ID NO: 1863816 - DNA, 19 bp, Homo sapiens
agtcttaactgtatttcag

SEQ ID NO: 1863817 - DNA, 19 bp, Homo sapiens
agtctttgtgtgttatatt

SEQ ID NO: 1863818 - DNA, 23 bp, Homo sapiens
agtctttgtgtgttatattccaa

SEQ ID NO: 1863819 - DNA, 13 bp, Homo sapiens
agtcttttgctgt

SEQ ID NO: 1863820 - DNA, 16 bp, Homo sapiens
agtcttttgctgtgct

SEQ ID NO: 1863821 - DNA, 20 bp, Homo sapiens
agtgaaacagagaaagaaaa

SEQ ID NO: 1863822 - DNA, 17 bp, Homo sapiens
agtgaacttttgtaatt

SEQ ID NO: 1863823 - DNA, 19 bp, Homo sapiens
agtgaacttttgtaatttg

SEQ ID NO: 1863824 - DNA, 23 bp, Homo sapiens
agtgaacttttgtaatttgaatt

SEQ ID NO: 1863825 - DNA, 17 bp, Homo sapiens
agtgaatttatgagatt

SEQ ID NO: 1863826 - DNA, 23 bp, Homo sapiens
agtgagttttactcttaaatcat

SEQ ID NO: 1863827 - DNA, 14 bp, Homo sapiens
agtgcaagattttt

SEQ ID NO: 1863828 - DNA, 19 bp, Homo sapiens
agtgcagcgggccaggcag

SEQ ID NO: 1863829 - DNA, 12 bp, Homo sapiens
agtgctgcagct

SEQ ID NO: 1863830 - DNA, 13 bp, Homo sapiens
agtgctgcagctt

SEQ ID NO: 1863831 - DNA, 14 bp, Homo sapiens
agtgctgcagcttt

SEQ ID NO: 1863832 - DNA, 16 bp, Homo sapiens
agtgctgcagctttgg

SEQ ID NO: 1863833 - DNA, 19 bp, Homo sapiens
agtgctgcagctttgggaa

SEQ ID NO: 1863834 - DNA, 20 bp, Homo sapiens
agtgctgcagctttgggaaa

SEQ ID NO: 1863835 - DNA, 17 bp, Homo sapiens
agtggtgaccaaaattt

SEQ ID NO: 1863836 - DNA, 16 bp, Homo sapiens
agtggttttaataaaa

SEQ ID NO: 1863837 - DNA, 22 bp, Homo sapiens
agttaaataaatagaaagagtt

SEQ ID NO: 1863838 - DNA, 17 bp, Homo sapiens
agttacgtataatgctt

SEQ ID NO: 1863839 - DNA, 18 bp, Homo sapiens
agttataagcgtatttag

SEQ ID NO: 1863840 - DNA, 16 bp, Homo sapiens
agttataataactgaa

SEQ ID NO: 1863841 - DNA, 17 bp, Homo sapiens
agttataataactgaac

SEQ ID NO: 1863842 - DNA, 18 bp, Homo sapiens
agttattgtacagctgtt

SEQ ID NO: 1863843 - DNA, 15 bp, Homo sapiens
agttcagacttagtt

SEQ ID NO: 1863844 - DNA, 15 bp, Homo sapiens
ctctggggcaggacc

SEQ ID NO: 1863845 - DNA, 18 bp, Homo sapiens
ctctggggcaggaccact

SEQ ID NO: 1863846 - DNA, 21 bp, Homo sapiens
ctctgttaaagatcagctatt

SEQ ID NO: 1863847 - DNA, 19 bp, Homo sapiens
ctctgttgtaaataaccac

SEQ ID NO: 1863848 - DNA, 15 bp, Homo sapiens
ctcttaaatcatttg

SEQ ID NO: 1863849 - DNA, 14 bp, Homo sapiens
ctcttatttttgta

SEQ ID NO: 1863850 - DNA, 15 bp, Homo sapiens
ctcttatttttgtac

SEQ ID NO: 1863851 - DNA, 13 bp, Homo sapiens
ctcttcatacttt

SEQ ID NO: 1863852 - DNA, 21 bp, Homo sapiens
ctcttgggacaacgtgctgct

SEQ ID NO: 1863853 - DNA, 22 bp, Homo sapiens
ctcttgggacaacgtgctgctt

SEQ ID NO: 1863854 - DNA, 20 bp, Homo sapiens
ctgaaaatctaatattaaaa

SEQ ID NO: 1863855 - DNA, 19 bp, Homo sapiens
ctgaaagtcctgctttcct

SEQ ID NO: 1863856 - DNA, 13 bp, Homo sapiens
ctgaactgtttgg

SEQ ID NO: 1863857 - DNA, 16 bp, Homo sapiens
ctgaataagcactttt

SEQ ID NO: 1863858 - DNA, 18 bp, Homo sapiens
ctgaataagcacttttta

SEQ ID NO: 1863859 - DNA, 15 bp, Homo sapiens
ctgacagcctggggg

SEQ ID NO: 1863860 - DNA, 12 bp, Homo sapiens
ctgaccaccctg

SEQ ID NO: 1863861 - DNA, 13 bp, Homo sapiens
ctgaccaccctgc

SEQ ID NO: 1863862 - DNA, 20 bp, Homo sapiens
ctgaccaccctgcctgtgga

SEQ ID NO: 1863863 - DNA, 20 bp, Homo sapiens
ctgacctgcccatgtccaga

SEQ ID NO: 1863864 - DNA, 13 bp, Homo sapiens
ctgagagactttt

SEQ ID NO: 1863865 - DNA, 18 bp, Homo sapiens
ctgagagacttttaatca

SEQ ID NO: 1863866 - DNA, 18 bp, Homo sapiens
ctgaggttttgaataaaa

SEQ ID NO: 1863867 - DNA, 16 bp, Homo sapiens
ctgagtccatgaaaat

SEQ ID NO: 1863868 - DNA, 17 bp, Homo sapiens
ctgagtccatgaaaata

SEQ ID NO: 1863869 - DNA, 11 bp, Homo sapiens
ctgatcttgga

SEQ ID NO: 1863870 - DNA, 20 bp, Homo sapiens
ctgattataccatgtgtgct

SEQ ID NO: 1863871 - DNA, 16 bp, Homo sapiens
ctgcaagaattaaaac

SEQ ID NO: 1863872 - DNA, 18 bp, Homo sapiens
ctgcaagaattaaaactg

SEQ ID NO: 1863873 - DNA, 20 bp, Homo sapiens
ctgcaagaattaaaactgag

SEQ ID NO: 1863874 - DNA, 17 bp, Homo sapiens
ctgcaagcatttttcca

SEQ ID NO: 1863875 - DNA, 14 bp, Homo sapiens
ctgcactcctggaa

SEQ ID NO: 1863876 - DNA, 16 bp, Homo sapiens
ctgcagccgtgcagga

SEQ ID NO: 1863877 - DNA, 14 bp, Homo sapiens
ctgcagctcctgga

SEQ ID NO: 1863878 - DNA, 13 bp, Homo sapiens
ctgcaggccaggc

SEQ ID NO: 1863879 - DNA, 18 bp, Homo sapiens
ctgcaggccaggccagct

SEQ ID NO: 1863880 - DNA, 19 bp, Homo sapiens
ctgcatcagctttttgtat

SEQ ID NO: 1863881 - DNA, 22 bp, Homo sapiens
ctgcatcagctttttgtattaa

SEQ ID NO: 1863882 - DNA, 21 bp, Homo sapiens
ctgccaccagcaatgccctgc

SEQ ID NO: 1863883 - DNA, 17 bp, Homo sapiens
ctgcccaagtggctctt

SEQ ID NO: 1863884 - DNA, 23 bp, Homo sapiens
ctgcccaagtggctcttgggaca

SEQ ID NO: 1863885 - DNA, 17 bp, Homo sapiens
ctgcccaatcctccctg

SEQ ID NO: 1863886 - DNA, 21 bp, Homo sapiens
ctgcccaatcctccctggaga

SEQ ID NO: 1863887 - DNA, 24 bp, Homo sapiens
ctgccccgtccccctagagactca

SEQ ID NO: 1863888 - DNA, 19 bp, Homo sapiens
ctgcccctccccaaaagaa

SEQ ID NO: 1863889 - DNA, 15 bp, Homo sapiens
ctgcctggttttatt

SEQ ID NO: 1863890 - DNA, 22 bp, Homo sapiens
ctgcctgtaattaaactagttt

SEQ ID NO: 1863891 - DNA, 19 bp, Homo sapiens
ctgcctgtggaggtgacct

SEQ ID NO: 1863892 - DNA, 16 bp, Homo sapiens
ctgccttcaccctgaa

SEQ ID NO: 1863893 - DNA, 13 bp, Homo sapiens
ctgccttgctgcc

SEQ ID NO: 1863894 - DNA, 16 bp, Homo sapiens
ctgccttgctgccttc

SEQ ID NO: 1863895 - DNA, 18 bp, Homo sapiens
ctgccttgctgccttcac

SEQ ID NO: 1863896 - DNA, 21 bp, Homo sapiens
ctgccttttaagtttgaaact

SEQ ID NO: 1863897 - DNA, 13 bp, Homo sapiens
ctgctcattgtgg

SEQ ID NO: 1863898 - DNA, 19 bp, Homo sapiens
ctgctctagaaagtataga

SEQ ID NO: 1863899 - DNA, 14 bp, Homo sapiens
ctgcttctctttgt

SEQ ID NO: 1863900 - DNA, 24 bp, Homo sapiens
ctgctttcctatctagcatttatt

SEQ ID NO: 1863901 - DNA, 14 bp, Homo sapiens
ctggacagccaggg

SEQ ID NO: 1863902 - DNA, 17 bp, Homo sapiens
ctggacagccagggcag

SEQ ID NO: 1863903 - DNA, 19 bp, Homo sapiens
ctggacattaacaagatca

SEQ ID NO: 1863904 - DNA, 19 bp, Homo sapiens
ctggacctcggtgatgcct

SEQ ID NO: 1863905 - DNA, 22 bp, Homo sapiens
ctggagggggcagagtggcctg

SEQ ID NO: 1863906 - DNA, 14 bp, Homo sapiens
ctggatggcctctg

SEQ ID NO: 1863907 - DNA, 15 bp, Homo sapiens
ctggatggcctctgg

SEQ ID NO: 1863908 - DNA, 19 bp, Homo sapiens
ctggatggcctctggggca

SEQ ID NO: 1863909 - DNA, 20 bp, Homo sapiens
ctggatggcctctggggcag

SEQ ID NO: 1863910 - DNA, 12 bp, Homo sapiens
ctggcactgaca

SEQ ID NO: 1863911 - DNA, 14 bp, Homo sapiens
ctggcactgacagc

SEQ ID NO: 1863912 - DNA, 16 bp, Homo sapiens
ctggcactgacagcct

SEQ ID NO: 1863913 - DNA, 20 bp, Homo sapiens
ctggcactgacagcctgggg

SEQ ID NO: 1863914 - DNA, 16 bp, Homo sapiens
ctggcactgtggcact

SEQ ID NO: 1863915 - DNA, 20 bp, Homo sapiens
ctggcactgtggcactgcca

SEQ ID NO: 1863916 - DNA, 23 bp, Homo sapiens
ctggcactgtggcactgccacca

SEQ ID NO: 1863917 - DNA, 17 bp, Homo sapiens
ctggcatcgcagcttcc

SEQ ID NO: 1863918 - DNA, 20 bp, Homo sapiens
ctggctctttgtgtgtctcc

SEQ ID NO: 1863919 - DNA, 21 bp, Homo sapiens
ctggctctttgtgtgtctcca

SEQ ID NO: 1863920 - DNA, 12 bp, Homo sapiens
ctggcttccctg

SEQ ID NO: 1863921 - DNA, 13 bp, Homo sapiens
ctgggcatgtttg

SEQ ID NO: 1863922 - DNA, 21 bp, Homo sapiens
ctgggcatgtttgtctgtgtg

SEQ ID NO: 1863923 - DNA, 12 bp, Homo sapiens
ctgggccctggg

SEQ ID NO: 1863924 - DNA, 13 bp, Homo sapiens
ctgggccctgggg

SEQ ID NO: 1863925 - DNA, 14 bp, Homo sapiens
ctgggccctggggc

SEQ ID NO: 1863926 - DNA, 19 bp, Homo sapiens
ctgggccctggggctgccc

SEQ ID NO: 1863927 - DNA, 22 bp, Homo sapiens
ctgggccctggggctgccctcg

SEQ ID NO: 1863928 - DNA, 16 bp, Homo sapiens
ctgggccgggcccagg

SEQ ID NO: 1863929 - DNA, 20 bp, Homo sapiens
ctgggccgggcccagggcct

SEQ ID NO: 1863930 - DNA, 18 bp, Homo sapiens
ctggggcatcatgggcaa

SEQ ID NO: 1863931 - DNA, 14 bp, Homo sapiens
ctggggctgccctc

SEQ ID NO: 1863932 - DNA, 18 bp, Homo sapiens
ctggggggatgacggcca

SEQ ID NO: 1863933 - DNA, 22 bp, Homo sapiens
ctggggggatgacggccaggct

SEQ ID NO: 1863934 - DNA, 15 bp, Homo sapiens
ctggtgatatatctc

SEQ ID NO: 1863935 - DNA, 21 bp, Homo sapiens
ctgtaaaagttataataactg

SEQ ID NO: 1863936 - DNA, 15 bp, Homo sapiens
ctgtaacacagctga

SEQ ID NO: 1863937 - DNA, 18 bp, Homo sapiens
ctgtaagcagattacaat

SEQ ID NO: 1863938 - DNA, 21 bp, Homo sapiens
ctgtaatgtaggcacttttat

SEQ ID NO: 1863939 - DNA, 21 bp, Homo sapiens
ctgtaattaaactagtttaag

SEQ ID NO: 1863940 - DNA, 13 bp, Homo sapiens
ctgtactttttgt

SEQ ID NO: 1863941 - DNA, 18 bp, Homo sapiens
ctgtagctggagaagccc

SEQ ID NO: 1863942 - DNA, 19 bp, Homo sapiens
ctgtagtagccctttctgt

SEQ ID NO: 1863943 - DNA, 20 bp, Homo sapiens
ctgtgaggcgggtggctggt

SEQ ID NO: 1863944 - DNA, 17 bp, Homo sapiens
ctgtgccttttttagct

SEQ ID NO: 1863945 - DNA, 23 bp, Homo sapiens
ctgtggcactgccaccagcaatg

SEQ ID NO: 1863946 - DNA, 17 bp, Homo sapiens
ctgtggccatatatgct

SEQ ID NO: 1863947 - DNA, 15 bp, Homo sapiens
ctgtgtatcattaaa

SEQ ID NO: 1863948 - DNA, 17 bp, Homo sapiens
ctgtgtatcattaaaat

SEQ ID NO: 1863949 - DNA, 21 bp, Homo sapiens
ctgtgtatcattaaaatatat

SEQ ID NO: 1863950 - DNA, 23 bp, Homo sapiens
ctgtgtatcattaaaatatatgt

SEQ ID NO: 1863951 - DNA, 15 bp, Homo sapiens
ctgtgtgcagtgaag

SEQ ID NO: 1863952 - DNA, 22 bp, Homo sapiens
ctgttaagaaaggatataaaag

SEQ ID NO: 1863953 - DNA, 18 bp, Homo sapiens
ctgttaggtctcatgccc

SEQ ID NO: 1863954 - DNA, 20 bp, Homo sapiens
ctgttaggtctcatgcccac

SEQ ID NO: 1863955 - DNA, 12 bp, Homo sapiens
ctgttgaaaatt

SEQ ID NO: 1863956 - DNA, 21 bp, Homo sapiens
ctgttgaaaattattttaaac

SEQ ID NO: 1863957 - DNA, 18 bp, Homo sapiens
ctgttgaatgcctgtccc

SEQ ID NO: 1863958 - DNA, 22 bp, Homo sapiens
ctgtttactcccttctgtagtt

SEQ ID NO: 1863959 - DNA, 19 bp, Homo sapiens
ctgtttatatattgaaagt

SEQ ID NO: 1863960 - DNA, 17 bp, Homo sapiens
ctgtttgtatatttgca

SEQ ID NO: 1863961 - DNA, 19 bp, Homo sapiens
ctgtttgtatatttgcaaa

SEQ ID NO: 1863962 - DNA, 20 bp, Homo sapiens
cttaaaaactgtgtatcatt

SEQ ID NO: 1863963 - DNA, 23 bp, Homo sapiens
cttaaaaatcttggtttggtaca

SEQ ID NO: 1863964 - DNA, 14 bp, Homo sapiens
cttaaagcttgatt

SEQ ID NO: 1863965 - DNA, 16 bp, Homo sapiens
cttaaatcatttggtt

SEQ ID NO: 1863966 - DNA, 15 bp, Homo sapiens
cttaacatatttact

SEQ ID NO: 1863967 - DNA, 20 bp, Homo sapiens
cttaactgtatttcagtatt

SEQ ID NO: 1863968 - DNA, 13 bp, Homo sapiens
cttaagcacaatt

SEQ ID NO: 1863969 - DNA, 18 bp, Homo sapiens
cttaagtttccctgtgtt

SEQ ID NO: 1863970 - DNA, 19 bp, Homo sapiens
cttacaagcttaaagcttg

SEQ ID NO: 1863971 - DNA, 20 bp, Homo sapiens
cttacaagcttaaagcttga

SEQ ID NO: 1863972 - DNA, 22 bp, Homo sapiens
cttacaagtggtgaccaaaatt

SEQ ID NO: 1863973 - DNA, 14 bp, Homo sapiens
cttaccaactttct

SEQ ID NO: 1863974 - DNA, 14 bp, Homo sapiens
cttacccttggttt

SEQ ID NO: 1863975 - DNA, 23 bp, Homo sapiens
cttacccttggtttgcacataaa

SEQ ID NO: 1863976 - DNA, 18 bp, Homo sapiens
cttactggcactgtggca

SEQ ID NO: 1863977 - DNA, 23 bp, Homo sapiens
cttactggcactgtggcactgcc

SEQ ID NO: 1863978 - DNA, 16 bp, Homo sapiens
cttacttaaccaggtt

SEQ ID NO: 1863979 - DNA, 14 bp, Homo sapiens
cttagaaacatgtt

SEQ ID NO: 1863980 - DNA, 21 bp, Homo sapiens
cttagagtttacagtttgtgt

SEQ ID NO: 1863981 - DNA, 18 bp, Homo sapiens
cttagatgttccaaattt

SEQ ID NO: 1863982 - DNA, 20 bp, Homo sapiens
cttagatgttccaaatttag

SEQ ID NO: 1863983 - DNA, 14 bp, Homo sapiens
cttagctatcagaa

SEQ ID NO: 1863984 - DNA, 12 bp, Homo sapiens
cttagttcttga

SEQ ID NO: 1863985 - DNA, 20 bp, Homo sapiens
cttagttcttgaattgttat

SEQ ID NO: 1863986 - DNA, 15 bp, Homo sapiens
cttagttgatattca

SEQ ID NO: 1863987 - DNA, 23 bp, Homo sapiens
cttagttgatattcaaggcttta

SEQ ID NO: 1863988 - DNA, 17 bp, Homo sapiens
cttataggtaacgtgat

SEQ ID NO: 1863989 - DNA, 14 bp, Homo sapiens
cttatcatttttgt

SEQ ID NO: 1863990 - DNA, 22 bp, Homo sapiens
cttatcatttttgtataaaaag

SEQ ID NO: 1863991 - DNA, 14 bp, Homo sapiens
cttatttttgtacc

SEQ ID NO: 1863992 - DNA, 21 bp, Homo sapiens
cttcactcatgcaaactgctt

SEQ ID NO: 1863993 - DNA, 23 bp, Homo sapiens
cttcactcatgcaaactgcttta

SEQ ID NO: 1863994 - DNA, 18 bp, Homo sapiens
cttcactgttgaaaatta

SEQ ID NO: 1863995 - DNA, 19 bp, Homo sapiens
cttcactgttgaaaattat

SEQ ID NO: 1863996 - DNA, 21 bp, Homo sapiens
cttcatactttttttcacagt

SEQ ID NO: 1863997 - DNA, 13 bp, Homo sapiens
cttccctgcccaa

SEQ ID NO: 1863998 - DNA, 17 bp, Homo sapiens
cttccctgcccaatcct

SEQ ID NO: 1863999 - DNA, 22 bp, Homo sapiens
cttccctgcccaatcctccctg

SEQ ID NO: 1864000 - DNA, 17 bp, Homo sapiens
cttccgacaccactggg

SEQ ID NO: 1864001 - DNA, 14 bp, Homo sapiens
cttcctgtctgttt

SEQ ID NO: 1864002 - DNA, 16 bp, Homo sapiens
cttcctgtctgtttat

SEQ ID NO: 1864003 - DNA, 21 bp, Homo sapiens
cttctaagttgagtatattat

SEQ ID NO: 1864004 - DNA, 16 bp, Homo sapiens
cttctccaattctgaa

SEQ ID NO: 1864005 - DNA, 18 bp, Homo sapiens
cttctccaattctgaaat

SEQ ID NO: 1864006 - DNA, 13 bp, Homo sapiens
cttctcccagagc

SEQ ID NO: 1864007 - DNA, 16 bp, Homo sapiens
cttctgttaagaaagg

SEQ ID NO: 1864008 - DNA, 17 bp, Homo sapiens
cttctgttaagaaagga

SEQ ID NO: 1864009 - DNA, 13 bp, Homo sapiens
cttcttaaaaact

SEQ ID NO: 1864010 - DNA, 19 bp, Homo sapiens
cttcttaaaaactgtgtat

SEQ ID NO: 1864011 - DNA, 20 bp, Homo sapiens
cttcttaaaaactgtgtatc

SEQ ID NO: 1864012 - DNA, 14 bp, Homo sapiens
cttgattaaacagc

SEQ ID NO: 1864013 - DNA, 22 bp, Homo sapiens
cttgatttgatctttgtttaaa

SEQ ID NO: 1864014 - DNA, 20 bp, Homo sapiens
cttgcagcgccaagtggcca

SEQ ID NO: 1864015 - DNA, 14 bp, Homo sapiens
cttgcggccacagc

SEQ ID NO: 1864016 - DNA, 18 bp, Homo sapiens
cttgcggccacagcacta

SEQ ID NO: 1864017 - DNA, 18 bp, Homo sapiens
cttgctgccttcaccctg

SEQ ID NO: 1864018 - DNA, 21 bp, Homo sapiens
cttgcttagatgttccaaatt

SEQ ID NO: 1864019 - DNA, 17 bp, Homo sapiens
cttggagtgctgcagct

SEQ ID NO: 1864020 - DNA, 15 bp, Homo sapiens
cttggcaacagaagc

SEQ ID NO: 1864021 - DNA, 16 bp, Homo sapiens
cttggcttcttaaaaa

SEQ ID NO: 1864022 - DNA, 18 bp, Homo sapiens
cttggcttcttaaaaact

SEQ ID NO: 1864023 - DNA, 17 bp, Homo sapiens
cttggtaagtgaattta

SEQ ID NO: 1864024 - DNA, 19 bp, Homo sapiens
cttggtaagtgaatttatg

SEQ ID NO: 1864025 - DNA, 15 bp, Homo sapiens
cttggttgttaattt

SEQ ID NO: 1864026 - DNA, 14 bp, Homo sapiens
cttgtctttcaaaa

SEQ ID NO: 1864027 - DNA, 22 bp, Homo sapiens
cttgttattaatgtttcttctc

SEQ ID NO: 1864028 - DNA, 14 bp, Homo sapiens
cttgttcaacagtt

SEQ ID NO: 1864029 - DNA, 12 bp, Homo sapiens
ctttaaaaggca

SEQ ID NO: 1864030 - DNA, 21 bp, Homo sapiens
ctttaaaaggcaactcaaaga

SEQ ID NO: 1864031 - DNA, 19 bp, Homo sapiens
ctttaaaagtcattattcc

SEQ ID NO: 1864032 - DNA, 20 bp, Homo sapiens
ctttaaaagtcattattcct

SEQ ID NO: 1864033 - DNA, 21 bp, Homo sapiens
ctttaaagataagtctacatt

SEQ ID NO: 1864034 - DNA, 12 bp, Homo sapiens
ctttacaaataa

SEQ ID NO: 1864035 - DNA, 13 bp, Homo sapiens
ctttacaaataat

SEQ ID NO: 1864036 - DNA, 15 bp, Homo sapiens
ctttacaaataattt

SEQ ID NO: 1864037 - DNA, 19 bp, Homo sapiens
ctttacatgcaatttatta

SEQ ID NO: 1864038 - DNA, 12 bp, Homo sapiens
ctttatatttag

SEQ ID NO: 1864039 - DNA, 14 bp, Homo sapiens
ctttatctttgtgt

SEQ ID NO: 1864040 - DNA, 16 bp, Homo sapiens
ctttatgcaaaaacat

SEQ ID NO: 1864041 - DNA, 17 bp, Homo sapiens
ctttatgcaaaaacata

SEQ ID NO: 1864042 - DNA, 21 bp, Homo sapiens
ctttcccaggtaatttaaatt

SEQ ID NO: 1864043 - DNA, 22 bp, Homo sapiens
ctttcctgatggtacaggaaag

SEQ ID NO: 1864044 - DNA, 20 bp, Homo sapiens
ctttctgagtgagttttact

SEQ ID NO: 1864045 - DNA, 15 bp, Homo sapiens
ctttctgtgtgcacc

SEQ ID NO: 1864046 - DNA, 16 bp, Homo sapiens
ctttgaaaatatatac

SEQ ID NO: 1864047 - DNA, 16 bp, Homo sapiens
ctttgaatagaggcca

SEQ ID NO: 1864048 - DNA, 22 bp, Homo sapiens
ctttgatatataggacattgat

SEQ ID NO: 1864049 - DNA, 18 bp, Homo sapiens
ctttgccttgatgttgtg

SEQ ID NO: 1864050 - DNA, 18 bp, Homo sapiens
ctttgctgttactgcttc

SEQ ID NO: 1864051 - DNA, 23 bp, Homo sapiens
ctttggggggcactagaagatga

SEQ ID NO: 1864052 - DNA, 12 bp, Homo sapiens
ctttgtattata

SEQ ID NO: 1864053 - DNA, 18 bp, Homo sapiens
ctttgtgtaatctaagta

SEQ ID NO: 1864054 - DNA, 15 bp, Homo sapiens
ctttgtgtgttatat

SEQ ID NO: 1864055 - DNA, 21 bp, Homo sapiens
ctttgtgtgttatattccaag

SEQ ID NO: 1864056 - DNA, 17 bp, Homo sapiens
ctttgtttaaatgccaa

SEQ ID NO: 1864057 - DNA, 12 bp, Homo sapiens
cttttaaaaaat

SEQ ID NO: 1864058 - DNA, 15 bp, Homo sapiens
cttttaaaaaatatt

SEQ ID NO: 1864059 - DNA, 23 bp, Homo sapiens
cttttaaaaaatattttaagaaa

SEQ ID NO: 1864060 - DNA, 14 bp, Homo sapiens
cttttaaaaatgat

SEQ ID NO: 1864061 - DNA, 21 bp, Homo sapiens
cttttaagtttgaaactaact

SEQ ID NO: 1864062 - DNA, 14 bp, Homo sapiens
cttttaatcagaca

SEQ ID NO: 1864063 - DNA, 15 bp, Homo sapiens
cttttacagaatgca

SEQ ID NO: 1864064 - DNA, 17 bp, Homo sapiens
cttttacagaatgcatt

SEQ ID NO: 1864065 - DNA, 12 bp, Homo sapiens
cttttatagcta

SEQ ID NO: 1864066 - DNA, 16 bp, Homo sapiens
cttttattgtataaac

SEQ ID NO: 1864067 - DNA, 19 bp, Homo sapiens
cttttattgtataaactat

SEQ ID NO: 1864068 - DNA, 23 bp, Homo sapiens
cttttctcttgccccaaatcaca

SEQ ID NO: 1864069 - DNA, 12 bp, Homo sapiens
cttttctggttc

SEQ ID NO: 1864070 - DNA, 17 bp, Homo sapiens
cttttctggttccaaac

SEQ ID NO: 1864071 - DNA, 17 bp, Homo sapiens
cttttgagtatggctat

SEQ ID NO: 1864072 - DNA, 15 bp, Homo sapiens
cttttgtaaatgaga

SEQ ID NO: 1864073 - DNA, 15 bp, Homo sapiens
cttttgtaatttgaa

SEQ ID NO: 1864074 - DNA, 17 bp, Homo sapiens
cttttgtaatttgaatt

SEQ ID NO: 1864075 - DNA, 18 bp, Homo sapiens
cttttgtaatttgaattg

SEQ ID NO: 1864076 - DNA, 22 bp, Homo sapiens
cttttgtgagaagatgggggct

SEQ ID NO: 1864077 - DNA, 17 bp, Homo sapiens
cttttgttattaaaaaa

SEQ ID NO: 1864078 - DNA, 21 bp, Homo sapiens
cttttgttattaaaaaaacac

SEQ ID NO: 1864079 - DNA, 20 bp, Homo sapiens
ctttttatatttaaaaaatt

SEQ ID NO: 1864080 - DNA, 12 bp, Homo sapiens
cttttttaaagt

SEQ ID NO: 1864081 - DNA, 15 bp, Homo sapiens
cttttttagcttcat

SEQ ID NO: 1864082 - DNA, 19 bp, Homo sapiens
cttttttgtacttttctgg

SEQ ID NO: 1864083 - DNA, 21 bp, Homo sapiens
ctttttttccttcctttttat

SEQ ID NO: 1864084 - DNA, 23 bp, Homo sapiens
ctttttttggtaaatttttgaaa

SEQ ID NO: 1864085 - DNA, 21 bp, Homo sapiens
cttttttttttccaaattatt

SEQ ID NO: 1864086 - DNA, 14 bp, Homo sapiens
gaaaaacaaaacaa

SEQ ID NO: 1864087 - DNA, 13 bp, Homo sapiens
gaaaaagagactc

SEQ ID NO: 1864088 - DNA, 10 bp, Homo sapiens
gaaaaatatt

SEQ ID NO: 1864089 - DNA, 11 bp, Homo sapiens
gaaaaatattg

SEQ ID NO: 1864090 - DNA, 17 bp, Homo sapiens
gaaaaatattgctaaaa

SEQ ID NO: 1864091 - DNA, 21 bp, Homo sapiens
gaaaaatcataaccaccctag

SEQ ID NO: 1864092 - DNA, 20 bp, Homo sapiens
gaaaactgaaaatctaatat

SEQ ID NO: 1864093 - DNA, 12 bp, Homo sapiens
gaaaagccatat

SEQ ID NO: 1864094 - DNA, 15 bp, Homo sapiens
gaaaagccatatcta

SEQ ID NO: 1864095 - DNA, 23 bp, Homo sapiens
gaaaatcctatatctgtttgtat

SEQ ID NO: 1864096 - DNA, 20 bp, Homo sapiens
gaaaatctaatattaaaaat

SEQ ID NO: 1864097 - DNA, 21 bp, Homo sapiens
gaaaatctaatattaaaaata

SEQ ID NO: 1864098 - DNA, 19 bp, Homo sapiens
gaaaatggatatagaaaat

SEQ ID NO: 1864099 - DNA, 21 bp, Homo sapiens
gaaaattgaaagtattcagaa

SEQ ID NO: 1864100 - DNA, 18 bp, Homo sapiens
gaaacagagaaagaaaag

SEQ ID NO: 1864101 - DNA, 22 bp, Homo sapiens
gaaacagagaaagaaaaggcaa

SEQ ID NO: 1864102 - DNA, 12 bp, Homo sapiens
gaaaccatgaca

SEQ ID NO: 1864103 - DNA, 15 bp, Homo sapiens
gaaaccatgacaaac

SEQ ID NO: 1864104 - DNA, 13 bp, Homo sapiens
gaaaccttaatat

SEQ ID NO: 1864105 - DNA, 15 bp, Homo sapiens
gaaagaaaaggcaaa

SEQ ID NO: 1864106 - DNA, 13 bp, Homo sapiens
gaaagacatctgc

SEQ ID NO: 1864107 - DNA, 15 bp, Homo sapiens
gaaagagaatgaact

SEQ ID NO: 1864108 - DNA, 16 bp, Homo sapiens
gaaagaggttctgcac

SEQ ID NO: 1864109 - DNA, 17 bp, Homo sapiens
gaaagccaccttgttac

SEQ ID NO: 1864110 - DNA, 21 bp, Homo sapiens
gaaagctggtaaactatttgt

SEQ ID NO: 1864111 - DNA, 19 bp, Homo sapiens
gaaagtatagatggccaaa

SEQ ID NO: 1864112 - DNA, 15 bp, Homo sapiens
gaaagtattcagaaa

SEQ ID NO: 1864113 - DNA, 23 bp, Homo sapiens
gaaagtattcagaaattaaaata

SEQ ID NO: 1864114 - DNA, 15 bp, Homo sapiens
gaaagtatttttgaa

SEQ ID NO: 1864115 - DNA, 18 bp, Homo sapiens
gaaagtatttttgaaaga

SEQ ID NO: 1864116 - DNA, 18 bp, Homo sapiens
gaaatgctgatggataac

SEQ ID NO: 1864117 - DNA, 13 bp, Homo sapiens
gaaattaaaatat

SEQ ID NO: 1864118 - DNA, 23 bp, Homo sapiens
gaaattaaaatattatttgatat

SEQ ID NO: 1864119 - DNA, 15 bp, Homo sapiens
gaaattatttaataa

SEQ ID NO: 1864120 - DNA, 17 bp, Homo sapiens
gaaattatttaataaaa

SEQ ID NO: 1864121 - DNA, 15 bp, Homo sapiens
gaaatttgatttcta

SEQ ID NO: 1864122 - DNA, 13 bp, Homo sapiens
gaacaacttgcta

SEQ ID NO: 1864123 - DNA, 19 bp, Homo sapiens
gaacatttagtaccctgca

SEQ ID NO: 1864124 - DNA, 23 bp, Homo sapiens
gaaccaagggccctcactcagga

SEQ ID NO: 1864125 - DNA, 12 bp, Homo sapiens
gaaccagctcta

SEQ ID NO: 1864126 - DNA, 14 bp, Homo sapiens
gaaccgtttacagt

SEQ ID NO: 1864127 - DNA, 17 bp, Homo sapiens
gaaccttactggcactg

SEQ ID NO: 1864128 - DNA, 22 bp, Homo sapiens
gaactacgcttgctcatttttt

SEQ ID NO: 1864129 - DNA, 15 bp, Homo sapiens
gaacttctaatatat

SEQ ID NO: 1864130 - DNA, 13 bp, Homo sapiens
gaacttgatggct

SEQ ID NO: 1864131 - DNA, 17 bp, Homo sapiens
gaacttttgtaatttga

SEQ ID NO: 1864132 - DNA, 21 bp, Homo sapiens
gaagaactttgccttaagttt

SEQ ID NO: 1864133 - DNA, 23 bp, Homo sapiens
gaagaactttgccttaagtttcc

SEQ ID NO: 1864134 - DNA, 17 bp, Homo sapiens
gaagaatttaatggact

SEQ ID NO: 1864135 - DNA, 19 bp, Homo sapiens
gaagaatttaatggactgt

SEQ ID NO: 1864136 - DNA, 23 bp, Homo sapiens
gaagaatttaatggactgtgaat

SEQ ID NO: 1864137 - DNA, 16 bp, Homo sapiens
gaagacataaaacttt

SEQ ID NO: 1864138 - DNA, 19 bp, Homo sapiens
gaagacataaaactttaaa

SEQ ID NO: 1864139 - DNA, 15 bp, Homo sapiens
gaagacccctgccca

SEQ ID NO: 1864140 - DNA, 15 bp, Homo sapiens
gaagagaggggaaga

SEQ ID NO: 1864141 - DNA, 16 bp, Homo sapiens
gaagagaggggaagaa

SEQ ID NO: 1864142 - DNA, 22 bp, Homo sapiens
gaagaggttttatttacatttt

SEQ ID NO: 1864143 - DNA, 23 bp, Homo sapiens
gaagctgtagtagccctttctgt

SEQ ID NO: 1864144 - DNA, 12 bp, Homo sapiens
gaaggccagccc

SEQ ID NO: 1864145 - DNA, 16 bp, Homo sapiens
gaaggccagcccactg

SEQ ID NO: 1864146 - DNA, 23 bp, Homo sapiens
gaaggccagcccactgggccctg

SEQ ID NO: 1864147 - DNA, 21 bp, Homo sapiens
gaagggaacccccaaatttaa

SEQ ID NO: 1864148 - DNA, 18 bp, Homo sapiens
gaagggggagtgaaacag

SEQ ID NO: 1864149 - DNA, 22 bp, Homo sapiens
gaaggttttttttttaagtgca

SEQ ID NO: 1864150 - DNA, 23 bp, Homo sapiens
gaaggttttttttttaagtgcaa

SEQ ID NO: 1864151 - DNA, 18 bp, Homo sapiens
gaagtaactggtgatata

SEQ ID NO: 1864152 - DNA, 22 bp, Homo sapiens
gaagtcaggtgtcatcatcaga

SEQ ID NO: 1864153 - DNA, 14 bp, Homo sapiens
gaagttttttactt

SEQ ID NO: 1864154 - DNA, 18 bp, Homo sapiens
gaataaaaagtgaacttt

SEQ ID NO: 1864155 - DNA, 19 bp, Homo sapiens
gaataaaaagtgaactttt

SEQ ID NO: 1864156 - DNA, 17 bp, Homo sapiens
gaataagcactttttaa

SEQ ID NO: 1864157 - DNA, 19 bp, Homo sapiens
gaatagggctaggaatata

SEQ ID NO: 1864158 - DNA, 16 bp, Homo sapiens
gaatctgtatgattct

SEQ ID NO: 1864159 - DNA, 15 bp, Homo sapiens
gaatgaactgtggaa

SEQ ID NO: 1864160 - DNA, 22 bp, Homo sapiens
gaatggataagatgatgttaaa

SEQ ID NO: 1864161 - DNA, 19 bp, Homo sapiens
gaatgggaaagtatttttg

SEQ ID NO: 1864162 - DNA, 22 bp, Homo sapiens
gaatgggaaagtatttttgaaa

SEQ ID NO: 1864163 - DNA, 14 bp, Homo sapiens
gaattaaaactgag

SEQ ID NO: 1864164 - DNA, 18 bp, Homo sapiens
gaattaccatagagtaat

SEQ ID NO: 1864165 - DNA, 16 bp, Homo sapiens
gaattctattttgctg

SEQ ID NO: 1864166 - DNA, 12 bp, Homo sapiens
gaattgggtccc

SEQ ID NO: 1864167 - DNA, 13 bp, Homo sapiens
gaattgttatgaa

SEQ ID NO: 1864168 - DNA, 19 bp, Homo sapiens
gaatttaatggactgtgaa

SEQ ID NO: 1864169 - DNA, 21 bp, Homo sapiens
gaatttatgagatttactgct

SEQ ID NO: 1864170 - DNA, 22 bp, Homo sapiens
gaatttattggcagccaaggaa

SEQ ID NO: 1864171 - DNA, 12 bp, Homo sapiens
gacaaaaataac

SEQ ID NO: 1864172 - DNA, 15 bp, Homo sapiens
gatgacggccaggct

SEQ ID NO: 1864173 - DNA, 22 bp, Homo sapiens
gatgatggttgcaaaagactaa

SEQ ID NO: 1864174 - DNA, 21 bp, Homo sapiens
gatgccttccgacaccactgg

SEQ ID NO: 1864175 - DNA, 11 bp, Homo sapiens
gatggcctctg

SEQ ID NO: 1864176 - DNA, 22 bp, Homo sapiens
ggagggccgagacaggagcagc

SEQ ID NO: 1864177 - DNA, 22 bp, Homo sapiens
gtaaatgaacacatggcagaaa

SEQ ID NO: 1864178 - DNA, 13 bp, Homo sapiens
gtaaatttttgaa

SEQ ID NO: 1864179 - DNA, 17 bp, Homo sapiens
gtaaatttttgaaaaat

SEQ ID NO: 1864180 - DNA, 22 bp, Homo sapiens
gtaacacagctgagagactttt

SEQ ID NO: 1864181 - DNA, 16 bp, Homo sapiens
gtaatatgaaagccac

SEQ ID NO: 1864182 - DNA, 12 bp, Homo sapiens
gtaatttgaatt

SEQ ID NO: 1864183 - DNA, 14 bp, Homo sapiens
gtaatttgaattgg

SEQ ID NO: 1864184 - DNA, 19 bp, Homo sapiens
gtaatttttttttgtaaag

SEQ ID NO: 1864185 - DNA, 20 bp, Homo sapiens
gtaatttttttttgtaaagt

SEQ ID NO: 1864186 - DNA, 22 bp, Homo sapiens
gtacaatgtgactttgaaaata

SEQ ID NO: 1864187 - DNA, 18 bp, Homo sapiens
gtacagttcataattcac

SEQ ID NO: 1864188 - DNA, 12 bp, Homo sapiens
gtactatctttg

SEQ ID NO: 1864189 - DNA, 14 bp, Homo sapiens
gtactatctttgtc

SEQ ID NO: 1864190 - DNA, 13 bp, Homo sapiens
gtacttaaatgag

SEQ ID NO: 1864191 - DNA, 20 bp, Homo sapiens
gtacttttctggttccaaac

SEQ ID NO: 1864192 - DNA, 22 bp, Homo sapiens
gtagaaagacatctgcctgtaa

SEQ ID NO: 1864193 - DNA, 14 bp, Homo sapiens
gtagaggttttgtt

SEQ ID NO: 1864194 - DNA, 19 bp, Homo sapiens
gtagccctggatggcctct

SEQ ID NO: 1864195 - DNA, 20 bp, Homo sapiens
gtaggggtcaaagaaatgct

SEQ ID NO: 1864196 - DNA, 20 bp, Homo sapiens
gtagtagccctttctgtgtg

SEQ ID NO: 1864197 - DNA, 14 bp, Homo sapiens
gtataaaaaggaaa

SEQ ID NO: 1864198 - DNA, 13 bp, Homo sapiens
gtataaactatca

SEQ ID NO: 1864199 - DNA, 17 bp, Homo sapiens
gtataaactatcagttt

SEQ ID NO: 1864200 - DNA, 20 bp, Homo sapiens
gtataacttcttaaaagttg

SEQ ID NO: 1864201 - DNA, 12 bp, Homo sapiens
gtataaggatct

SEQ ID NO: 1864202 - DNA, 17 bp, Homo sapiens
gtataaggatcttttgt

SEQ ID NO: 1864203 - DNA, 19 bp, Homo sapiens
gtataaggatcttttgtaa

SEQ ID NO: 1864204 - DNA, 21 bp, Homo sapiens
gtataaggatcttttgtaaat

SEQ ID NO: 1864205 - DNA, 14 bp, Homo sapiens
gtataatctcctct

SEQ ID NO: 1864206 - DNA, 16 bp, Homo sapiens
gtatactgtaaaagtt

SEQ ID NO: 1864207 - DNA, 23 bp, Homo sapiens
gtatactgtaaaagttataataa

SEQ ID NO: 1864208 - DNA, 14 bp, Homo sapiens
gtatagtgtaaaat

SEQ ID NO: 1864209 - DNA, 16 bp, Homo sapiens
gtatagtgtaaaataa

SEQ ID NO: 1864210 - DNA, 19 bp, Homo sapiens
gtatagttaggatagcatt

SEQ ID NO: 1864211 - DNA, 22 bp, Homo sapiens
gtatatatctgcttcagtggag

SEQ ID NO: 1864212 - DNA, 19 bp, Homo sapiens
gtatatcagaaaagggaag

SEQ ID NO: 1864213 - DNA, 14 bp, Homo sapiens
gtatcattaaaata

SEQ ID NO: 1864214 - DNA, 22 bp, Homo sapiens
gtatcattaaaatatatgttct

SEQ ID NO: 1864215 - DNA, 23 bp, Homo sapiens
gtatgtatataatcatgctcatg

SEQ ID NO: 1864216 - DNA, 17 bp, Homo sapiens
gtatgtccttcagctga

SEQ ID NO: 1864217 - DNA, 13 bp, Homo sapiens
gtattataattgt

SEQ ID NO: 1864218 - DNA, 18 bp, Homo sapiens
gtattcaccctgggcagt

SEQ ID NO: 1864219 - DNA, 15 bp, Homo sapiens
gtattcagaaattaa

SEQ ID NO: 1864220 - DNA, 20 bp, Homo sapiens
gtattcagaaattaaaatat

SEQ ID NO: 1864221 - DNA, 21 bp, Homo sapiens
gtattgagtcttaactgtatt

SEQ ID NO: 1864222 - DNA, 13 bp, Homo sapiens
gtattgcttcctg

SEQ ID NO: 1864223 - DNA, 18 bp, Homo sapiens
gtatttaactacatctgc

SEQ ID NO: 1864224 - DNA, 14 bp, Homo sapiens
gtatttcagtattt

SEQ ID NO: 1864225 - DNA, 23 bp, Homo sapiens
gtattttccagccttatgtgtta

SEQ ID NO: 1864226 - DNA, 16 bp, Homo sapiens
gtattttgatcagtgt

SEQ ID NO: 1864227 - DNA, 13 bp, Homo sapiens
gtcaaatgaactt

SEQ ID NO: 1864228 - DNA, 16 bp, Homo sapiens
gtcacccccccaggcc

SEQ ID NO: 1864229 - DNA, 21 bp, Homo sapiens
gtcacccccccaggcctccag

SEQ ID NO: 1864230 - DNA, 16 bp, Homo sapiens
gtcacctacaggactg

SEQ ID NO: 1864231 - DNA, 20 bp, Homo sapiens
gtcacctacaggactgggcc

SEQ ID NO: 1864232 - DNA, 15 bp, Homo sapiens
gtcacctcctgctcc

SEQ ID NO: 1864233 - DNA, 18 bp, Homo sapiens
gtcagacatccatgtttg

SEQ ID NO: 1864234 - DNA, 16 bp, Homo sapiens
gtcatcacttttcagt

SEQ ID NO: 1864235 - DNA, 23 bp, Homo sapiens
gtcatcatcagacttgcggccac

SEQ ID NO: 1864236 - DNA, 13 bp, Homo sapiens
gtcatggagcagc

SEQ ID NO: 1864237 - DNA, 14 bp, Homo sapiens
gtcatggagcagcc

SEQ ID NO: 1864238 - DNA, 17 bp, Homo sapiens
gtcatggagcagccccc

SEQ ID NO: 1864239 - DNA, 19 bp, Homo sapiens
gtcatggagcagcccccaa

SEQ ID NO: 1864240 - DNA, 16 bp, Homo sapiens
gtcatggtagattttt

SEQ ID NO: 1864241 - DNA, 22 bp, Homo sapiens
gtccaaattgtctgtctgctct

SEQ ID NO: 1864242 - DNA, 19 bp, Homo sapiens
gtccagagggactggacag

SEQ ID NO: 1864243 - DNA, 17 bp, Homo sapiens
gtccagtgacctgctgg

SEQ ID NO: 1864244 - DNA, 15 bp, Homo sapiens
gtcccagcctctggg

SEQ ID NO: 1864245 - DNA, 17 bp, Homo sapiens
gtcccagcctctggggc

SEQ ID NO: 1864246 - DNA, 19 bp, Homo sapiens
gtcccagtcccagcctctg

SEQ ID NO: 1864247 - DNA, 15 bp, Homo sapiens
gtccccctagagact

SEQ ID NO: 1864248 - DNA, 18 bp, Homo sapiens
gtccctccaaggctgtct

SEQ ID NO: 1864249 - DNA, 18 bp, Homo sapiens
gtccttggagtgctgcag

SEQ ID NO: 1864250 - DNA, 22 bp, Homo sapiens
gtcgagtctttgtgtgttatat

SEQ ID NO: 1864251 - DNA, 14 bp, Homo sapiens
gtctcatgcccact

SEQ ID NO: 1864252 - DNA, 22 bp, Homo sapiens
gtctcatgcccactcccccagg

SEQ ID NO: 1864253 - DNA, 12 bp, Homo sapiens
gtctgaaggatt

SEQ ID NO: 1864254 - DNA, 16 bp, Homo sapiens
gtctgcagctcctgga

SEQ ID NO: 1864255 - DNA, 18 bp, Homo sapiens
gtctgcatcagctttttg

SEQ ID NO: 1864256 - DNA, 15 bp, Homo sapiens
gtctgtctgctctta

SEQ ID NO: 1864257 - DNA, 23 bp, Homo sapiens
gtctgtctgctcttatttttgta

SEQ ID NO: 1864258 - DNA, 14 bp, Homo sapiens
gtctgtctttgcaa

SEQ ID NO: 1864259 - DNA, 15 bp, Homo sapiens
gtctgtctttgcaaa

SEQ ID NO: 1864260 - DNA, 15 bp, Homo sapiens
gtctgtgtgctgtaa

SEQ ID NO: 1864261 - DNA, 15 bp, Homo sapiens
gtctgtgttgcttca

SEQ ID NO: 1864262 - DNA, 16 bp, Homo sapiens
gtctgtgttgcttcaa

SEQ ID NO: 1864263 - DNA, 16 bp, Homo sapiens
gtcttaactgtatttc

SEQ ID NO: 1864264 - DNA, 15 bp, Homo sapiens
gtcttagttgatatt

SEQ ID NO: 1864265 - DNA, 16 bp, Homo sapiens
gtctttgcaaaggact

SEQ ID NO: 1864266 - DNA, 19 bp, Homo sapiens
gtctttgtgtgttatattc

SEQ ID NO: 1864267 - DNA, 21 bp, Homo sapiens
gtctttttctttttttggtaa

SEQ ID NO: 1864268 - DNA, 23 bp, Homo sapiens
gtctttttctttttttggtaaat

SEQ ID NO: 1864269 - DNA, 23 bp, Homo sapiens
gtgaaacagagaaagaaaaggca

SEQ ID NO: 1864270 - DNA, 21 bp, Homo sapiens
gtgaaatttattagttaatat

SEQ ID NO: 1864271 - DNA, 14 bp, Homo sapiens
gtgacagcctctga

SEQ ID NO: 1864272 - DNA, 17 bp, Homo sapiens
gtgagaagatgggggct

SEQ ID NO: 1864273 - DNA, 23 bp, Homo sapiens
gtgagaagatgggggctggaggg

SEQ ID NO: 1864274 - DNA, 13 bp, Homo sapiens
gtgagcaagagcc

SEQ ID NO: 1864275 - DNA, 17 bp, Homo sapiens
gtgagcaagagccaggg

SEQ ID NO: 1864276 - DNA, 14 bp, Homo sapiens
gtgatgaactttct

SEQ ID NO: 1864277 - DNA, 15 bp, Homo sapiens
gtgattgactttttg

SEQ ID NO: 1864278 - DNA, 19 bp, Homo sapiens
gtgattgattcagtatctt

SEQ ID NO: 1864279 - DNA, 12 bp, Homo sapiens
gtgatttacatg

SEQ ID NO: 1864280 - DNA, 14 bp, Homo sapiens
gtgcaacatttctg

SEQ ID NO: 1864281 - DNA, 23 bp, Homo sapiens
gtgcacagtaatatgaaagccac

SEQ ID NO: 1864282 - DNA, 21 bp, Homo sapiens
gtgcaccttaccaactttctg

SEQ ID NO: 1864283 - DNA, 11 bp, Homo sapiens
gtgcaggactc

SEQ ID NO: 1864284 - DNA, 19 bp, Homo sapiens
gtgctgtaacctgaagtca

SEQ ID NO: 1864285 - DNA, 15 bp, Homo sapiens
gtggaccggccgcag

SEQ ID NO: 1864286 - DNA, 12 bp, Homo sapiens
gtggcactgcca

SEQ ID NO: 1864287 - DNA, 13 bp, Homo sapiens
gtggcctgtgagc

SEQ ID NO: 1864288 - DNA, 23 bp, Homo sapiens
taaaggtcacttttcacatcctt

SEQ ID NO: 1864289 - DNA, 21 bp, Homo sapiens
taaaggtttctattttctctg

SEQ ID NO: 1864290 - DNA, 16 bp, Homo sapiens
taaagtaaacttgtgt

SEQ ID NO: 1864291 - DNA, 15 bp, Homo sapiens
taaagtatgtaaaca

SEQ ID NO: 1864292 - DNA, 21 bp, Homo sapiens
taaatagaaagagttctatgg

SEQ ID NO: 1864293 - DNA, 15 bp, Homo sapiens
taaatctctaatatg

SEQ ID NO: 1864294 - DNA, 18 bp, Homo sapiens
taaatctctaatatggca

SEQ ID NO: 1864295 - DNA, 19 bp, Homo sapiens
taaatgaacacatggcaga

SEQ ID NO: 1864296 - DNA, 20 bp, Homo sapiens
taaatgagggtttctgatct

SEQ ID NO: 1864297 - DNA, 20 bp, Homo sapiens
taaatgccaaaatgtactta

SEQ ID NO: 1864298 - DNA, 14 bp, Homo sapiens
taaattagtttaaa

SEQ ID NO: 1864299 - DNA, 17 bp, Homo sapiens
taaattagtttaaaatg

SEQ ID NO: 1864300 - DNA, 16 bp, Homo sapiens
taaattatgaaggacc

SEQ ID NO: 1864301 - DNA, 15 bp, Homo sapiens
taaattggtcatggt

SEQ ID NO: 1864302 - DNA, 15 bp, Homo sapiens
taaatttttgaaaaa

SEQ ID NO: 1864303 - DNA, 22 bp, Homo sapiens
taacaatatgattgcactaaat

SEQ ID NO: 1864304 - DNA, 21 bp, Homo sapiens
taacaatttcctttatattta

SEQ ID NO: 1864305 - DNA, 18 bp, Homo sapiens
taacacaagtcctgtgaa

SEQ ID NO: 1864306 - DNA, 21 bp, Homo sapiens
taacagtcctaactggtatag

SEQ ID NO: 1864307 - DNA, 13 bp, Homo sapiens
taacatatttact

SEQ ID NO: 1864308 - DNA, 21 bp, Homo sapiens
taaccacactgaaacctcttc

SEQ ID NO: 1864309 - DNA, 22 bp, Homo sapiens
taacctatatgatttatagttt

SEQ ID NO: 1864310 - DNA, 18 bp, Homo sapiens
taacgaacgttttaaagc

SEQ ID NO: 1864311 - DNA, 13 bp, Homo sapiens
taactaaatgctc

SEQ ID NO: 1864312 - DNA, 15 bp, Homo sapiens
taactaaatgctcat

SEQ ID NO: 1864313 - DNA, 16 bp, Homo sapiens
taactaaatgctcata

SEQ ID NO: 1864314 - DNA, 16 bp, Homo sapiens
taactacatctgcctc

SEQ ID NO: 1864315 - DNA, 15 bp, Homo sapiens
taactgaactgtttg

SEQ ID NO: 1864316 - DNA, 19 bp, Homo sapiens
taactgactctgttattga

SEQ ID NO: 1864317 - DNA, 14 bp, Homo sapiens
taacttgtaataaa

SEQ ID NO: 1864318 - DNA, 21 bp, Homo sapiens
taactttgcttgattaaacag

SEQ ID NO: 1864319 - DNA, 23 bp, Homo sapiens
taactttgcttgattaaacagca

SEQ ID NO: 1864320 - DNA, 22 bp, Homo sapiens
taagaaagagaatgaactgtgg

SEQ ID NO: 1864321 - DNA, 20 bp, Homo sapiens
taagaaagccaccttgttac

SEQ ID NO: 1864322 - DNA, 14 bp, Homo sapiens
taagaaaggatata

SEQ ID NO: 1864323 - DNA, 18 bp, Homo sapiens
taagaaaggatataaaag

SEQ ID NO: 1864324 - DNA, 23 bp, Homo sapiens
taagaaagggaaagctgtgcctt

SEQ ID NO: 1864325 - DNA, 22 bp, Homo sapiens
taagaagggggagtgaaacaga

SEQ ID NO: 1864326 - DNA, 17 bp, Homo sapiens
taagaatggttgcctta

SEQ ID NO: 1864327 - DNA, 23 bp, Homo sapiens
taagaatttgaggtctacattct

SEQ ID NO: 1864328 - DNA, 21 bp, Homo sapiens
taagataatggataatcttcg

SEQ ID NO: 1864329 - DNA, 17 bp, Homo sapiens
taagatgatgttaaatg

SEQ ID NO: 1864330 - DNA, 13 bp, Homo sapiens
taagcaagccagg

SEQ ID NO: 1864331 - DNA, 14 bp, Homo sapiens
taagcaagccagga

SEQ ID NO: 1864332 - DNA, 14 bp, Homo sapiens
taagcacaattaat

SEQ ID NO: 1864333 - DNA, 13 bp, Homo sapiens
taagcacttttta

SEQ ID NO: 1864334 - DNA, 15 bp, Homo sapiens
taagcactttttaaa

SEQ ID NO: 1864335 - DNA, 16 bp, Homo sapiens
taagccacaagaaatt

SEQ ID NO: 1864336 - DNA, 22 bp, Homo sapiens
taagccacaagaaatttgattt

SEQ ID NO: 1864337 - DNA, 18 bp, Homo sapiens
taagggtggaaaaatgcc

SEQ ID NO: 1864338 - DNA, 19 bp, Homo sapiens
taagggtggaaaaatgccc

SEQ ID NO: 1864339 - DNA, 23 bp, Homo sapiens
taaggtataaggatcttttgtaa

SEQ ID NO: 1864340 - DNA, 19 bp, Homo sapiens
taagtactatctttgtcta

SEQ ID NO: 1864341 - DNA, 19 bp, Homo sapiens
taagtgcaacatttctgta

SEQ ID NO: 1864342 - DNA, 20 bp, Homo sapiens
taagtgcaacatttctgtat

SEQ ID NO: 1864343 - DNA, 17 bp, Homo sapiens
taagttttatacataaa

SEQ ID NO: 1864344 - DNA, 18 bp, Homo sapiens
taagttttatacataaac

SEQ ID NO: 1864345 - DNA, 14 bp, Homo sapiens
taagttttgatata

SEQ ID NO: 1864346 - DNA, 15 bp, Homo sapiens
taataactgaactgt

SEQ ID NO: 1864347 - DNA, 15 bp, Homo sapiens
taataagttttgata

SEQ ID NO: 1864348 - DNA, 18 bp, Homo sapiens
taatagcttttattgtat

SEQ ID NO: 1864349 - DNA, 22 bp, Homo sapiens
taatattaaaaatatggaactt

SEQ ID NO: 1864350 - DNA, 22 bp, Homo sapiens
taatattcttttgttattaaaa

SEQ ID NO: 1864351 - DNA, 23 bp, Homo sapiens
taatcaacatggctacttgcttt

SEQ ID NO: 1864352 - DNA, 21 bp, Homo sapiens
taatcatgctcatgtatattt

SEQ ID NO: 1864353 - DNA, 18 bp, Homo sapiens
taatctatattaaatgag

SEQ ID NO: 1864354 - DNA, 19 bp, Homo sapiens
taatctgcctggttttatt

SEQ ID NO: 1864355 - DNA, 17 bp, Homo sapiens
taatcttggcttcttaa

SEQ ID NO: 1864356 - DNA, 23 bp, Homo sapiens
taatcttggcttcttaaaaactg

SEQ ID NO: 1864357 - DNA, 14 bp, Homo sapiens
taatcttttctgaa

SEQ ID NO: 1864358 - DNA, 18 bp, Homo sapiens
taatgatgtaacagtgca

SEQ ID NO: 1864359 - DNA, 16 bp, Homo sapiens
taatgctttctgagtg

SEQ ID NO: 1864360 - DNA, 11 bp, Homo sapiens
taatgctttgg

SEQ ID NO: 1864361 - DNA, 16 bp, Homo sapiens
taatgctttggttctg

SEQ ID NO: 1864362 - DNA, 20 bp, Homo sapiens
taatggactgtgaatttcaa

SEQ ID NO: 1864363 - DNA, 17 bp, Homo sapiens
taatgtagggttatatt

SEQ ID NO: 1864364 - DNA, 14 bp, Homo sapiens
taatgtgtctgtgt

SEQ ID NO: 1864365 - DNA, 15 bp, Homo sapiens
taatgtgtctgtgtt

SEQ ID NO: 1864366 - DNA, 14 bp, Homo sapiens
taattaaaaacttt

SEQ ID NO: 1864367 - DNA, 17 bp, Homo sapiens
taattaaaaactttaaa

SEQ ID NO: 1864368 - DNA, 19 bp, Homo sapiens
taattaaaaactttaaaga

SEQ ID NO: 1864369 - DNA, 17 bp, Homo sapiens
taattaaactagtttaa

SEQ ID NO: 1864370 - DNA, 17 bp, Homo sapiens
taattagagaactggag

SEQ ID NO: 1864371 - DNA, 16 bp, Homo sapiens
taattagatcaacact

SEQ ID NO: 1864372 - DNA, 16 bp, Homo sapiens
taattattttccaaaa

SEQ ID NO: 1864373 - DNA, 19 bp, Homo sapiens
taattattttccaaaatct

SEQ ID NO: 1864374 - DNA, 19 bp, Homo sapiens
taattcaccaaaagttcat

SEQ ID NO: 1864375 - DNA, 21 bp, Homo sapiens
taattcaccaaaagttcatat

SEQ ID NO: 1864376 - DNA, 14 bp, Homo sapiens
taattcattaatct

SEQ ID NO: 1864377 - DNA, 15 bp, Homo sapiens
taattcattaatctg

SEQ ID NO: 1864378 - DNA, 22 bp, Homo sapiens
taattcattaatctgtttgttt

SEQ ID NO: 1864379 - DNA, 23 bp, Homo sapiens
taattgatcagatgctgaattga

SEQ ID NO: 1864380 - DNA, 15 bp, Homo sapiens
taattgttgatattt

SEQ ID NO: 1864381 - DNA, 20 bp, Homo sapiens
taatttaaagaaacactaaa

SEQ ID NO: 1864382 - DNA, 20 bp, Homo sapiens
taatttaccattattttaca

SEQ ID NO: 1864383 - DNA, 20 bp, Homo sapiens
taatttagagcgtttggtta

SEQ ID NO: 1864384 - DNA, 20 bp, Homo sapiens
taatttccttctgttaagaa

SEQ ID NO: 1864385 - DNA, 22 bp, Homo sapiens
taatttccttctgttaagaaag

SEQ ID NO: 1864386 - DNA, 24 bp, Homo sapiens
taatttccttctgttaagaaagga

SEQ ID NO: 1864387 - DNA, 12 bp, Homo sapiens
taatttgaattg

SEQ ID NO: 1864388 - DNA, 18 bp, Homo sapiens
taatttttgtactttgct

SEQ ID NO: 1864389 - DNA, 18 bp, Homo sapiens
taattttttgcagtcttt

SEQ ID NO: 1864390 - DNA, 14 bp, Homo sapiens
tacagctgtttaag

SEQ ID NO: 1864391 - DNA, 22 bp, Homo sapiens
tacaggactgggccgggcccag

SEQ ID NO: 1864392 - DNA, 17 bp, Homo sapiens
tacagtctctgttgtaa

SEQ ID NO: 1864393 - DNA, 16 bp, Homo sapiens
tacagttcataattca

SEQ ID NO: 1864394 - DNA, 18 bp, Homo sapiens
tacagttcataattcacc

SEQ ID NO: 1864395 - DNA, 15 bp, Homo sapiens
tacagtttgtgtttt

SEQ ID NO: 1864396 - DNA, 17 bp, Homo sapiens
tacagtttgtgttttaa

SEQ ID NO: 1864397 - DNA, 20 bp, Homo sapiens
tacagtttgtgttttaaaaa

SEQ ID NO: 1864398 - DNA, 23 bp, Homo sapiens
tacagtttgtgttttaaaaaaac

SEQ ID NO: 1864399 - DNA, 19 bp, Homo sapiens
tacataatttgcaatttca

SEQ ID NO: 1864400 - DNA, 15 bp, Homo sapiens
tacattaaacaatga

SEQ ID NO: 1864401 - DNA, 16 bp, Homo sapiens
tacattactgtatgta

SEQ ID NO: 1864402 - DNA, 19 bp, Homo sapiens
taccaactttctgtaaact

SEQ ID NO: 1864403 - DNA, 16 bp, Homo sapiens
taccaagtatgaagta

SEQ ID NO: 1864404 - DNA, 21 bp, Homo sapiens
taccagtcacctcctgctcct

SEQ ID NO: 1864405 - DNA, 16 bp, Homo sapiens
taccatagagtaatga

SEQ ID NO: 1864406 - DNA, 13 bp, Homo sapiens
taccataggaaga

SEQ ID NO: 1864407 - DNA, 14 bp, Homo sapiens
taccataggaagac

SEQ ID NO: 1864408 - DNA, 19 bp, Homo sapiens
taccataggaagacataaa

SEQ ID NO: 1864409 - DNA, 22 bp, Homo sapiens
taccataggaagacataaaact

SEQ ID NO: 1864410 - DNA, 20 bp, Homo sapiens
taccatattgctcttaaaaa

SEQ ID NO: 1864411 - DNA, 16 bp, Homo sapiens
taccattattttacag

SEQ ID NO: 1864412 - DNA, 16 bp, Homo sapiens
taccattgaaatcagc

SEQ ID NO: 1864413 - DNA, 14 bp, Homo sapiens
taccctgcaggcca

SEQ ID NO: 1864414 - DNA, 19 bp, Homo sapiens
taccctgcaggccaggcca

SEQ ID NO: 1864415 - DNA, 23 bp, Homo sapiens
taccctgcccctccccaaaagaa

SEQ ID NO: 1864416 - DNA, 17 bp, Homo sapiens
tacctctagctgttctt

SEQ ID NO: 1864417 - DNA, 19 bp, Homo sapiens
tacctgccttttaagtttg

SEQ ID NO: 1864418 - DNA, 18 bp, Homo sapiens
tacctttttatatttaaa

SEQ ID NO: 1864419 - DNA, 17 bp, Homo sapiens
tacgtataatgctttct

SEQ ID NO: 1864420 - DNA, 19 bp, Homo sapiens
tactatctttgtctaaaca

SEQ ID NO: 1864421 - DNA, 20 bp, Homo sapiens
tactcagtgaaatcatatta

SEQ ID NO: 1864422 - DNA, 22 bp, Homo sapiens
tactcagtgaaatcatattaat

SEQ ID NO: 1864423 - DNA, 21 bp, Homo sapiens
tactcttaaatcatttggtta

SEQ ID NO: 1864424 - DNA, 23 bp, Homo sapiens
tactgcagctttacatgcaattt

SEQ ID NO: 1864425 - DNA, 17 bp, Homo sapiens
tactgcttctctttgtg

SEQ ID NO: 1864426 - DNA, 21 bp, Homo sapiens
tactgcttctctttgtgcagt

SEQ ID NO: 1864427 - DNA, 16 bp, Homo sapiens
tactggcactgtggca

SEQ ID NO: 1864428 - DNA, 22 bp, Homo sapiens
tactggctctttgtgtgtctcc

SEQ ID NO: 1864429 - DNA, 17 bp, Homo sapiens
tactgtaaaagttataa

SEQ ID NO: 1864430 - DNA, 19 bp, Homo sapiens
tactgtctggttttaacaa

SEQ ID NO: 1864431 - DNA, 20 bp, Homo sapiens
tactgtctggttttaacaat

SEQ ID NO: 1864432 - DNA, 15 bp, Homo sapiens
tacttatcatttttg

SEQ ID NO: 1864433 - DNA, 23 bp, Homo sapiens
tacttatcatttttgtataaaaa

SEQ ID NO: 1864434 - DNA, 19 bp, Homo sapiens
tacttttctggttccaaac

SEQ ID NO: 1864435 - DNA, 21 bp, Homo sapiens
tacttttctggttccaaacca

SEQ ID NO: 1864436 - DNA, 13 bp, Homo sapiens
tacttttgagtat

SEQ ID NO: 1864437 - DNA, 15 bp, Homo sapiens
tactttttttgttat

SEQ ID NO: 1864438 - DNA, 23 bp, Homo sapiens
tactttttttgttatagattgtc

SEQ ID NO: 1864439 - DNA, 15 bp, Homo sapiens
tagaaaactgaaaat

SEQ ID NO: 1864440 - DNA, 21 bp, Homo sapiens
tagaaaactgaaaatctaata

SEQ ID NO: 1864441 - DNA, 23 bp, Homo sapiens
tagaaaatcagattttctcctgt

SEQ ID NO: 1864442 - DNA, 14 bp, Homo sapiens
tagaaaccttaata

SEQ ID NO: 1864443 - DNA, 15 bp, Homo sapiens
tagaaaccttaatat

SEQ ID NO: 1864444 - DNA, 18 bp, Homo sapiens
tagaaagacatctgcctg

SEQ ID NO: 1864445 - DNA, 19 bp, Homo sapiens
tagaaagacatctgcctgt

SEQ ID NO: 1864446 - DNA, 16 bp, Homo sapiens
tagaaagagttctatg

SEQ ID NO: 1864447 - DNA, 22 bp, Homo sapiens
tagaaagtatagatggccaaag

SEQ ID NO: 1864448 - DNA, 19 bp, Homo sapiens
tagaactgtatgtcagaca

SEQ ID NO: 1864449 - DNA, 21 bp, Homo sapiens
tagaagtaactggtgatatat

SEQ ID NO: 1864450 - DNA, 17 bp, Homo sapiens
tagacacccattttcac

SEQ ID NO: 1864451 - DNA, 21 bp, Homo sapiens
tagacattattttgtatggaa

SEQ ID NO: 1864452 - DNA, 12 bp, Homo sapiens
tagactttctgt

SEQ ID NO: 1864453 - DNA, 21 bp, Homo sapiens
tagagaactggaggaaccaca

SEQ ID NO: 1864454 - DNA, 20 bp, Homo sapiens
tagagcacctagtccagtga

SEQ ID NO: 1864455 - DNA, 19 bp, Homo sapiens
tagagcgtttggttaaagt

SEQ ID NO: 1864456 - DNA, 22 bp, Homo sapiens
tagaggccaaattaatctttta

SEQ ID NO: 1864457 - DNA, 16 bp, Homo sapiens
tagaggttttgttgtt

SEQ ID NO: 1864458 - DNA, 22 bp, Homo sapiens
tagagtcacccccccaggcctc

SEQ ID NO: 1864459 - DNA, 23 bp, Homo sapiens
tagagtcacccccccaggcctcc

SEQ ID NO: 1864460 - DNA, 16 bp, Homo sapiens
tagatgtgctgctttg

SEQ ID NO: 1864461 - DNA, 21 bp, Homo sapiens
tagattagtactggattattc

SEQ ID NO: 1864462 - DNA, 23 bp, Homo sapiens
tagatttttaaaaggtaggtttt

SEQ ID NO: 1864463 - DNA, 19 bp, Homo sapiens
tagcagaatggagaaagta

SEQ ID NO: 1864464 - DNA, 13 bp, Homo sapiens
tagccctttctgt

SEQ ID NO: 1864465 - DNA, 15 bp, Homo sapiens
tagcgtccatttctt

SEQ ID NO: 1864466 - DNA, 16 bp, Homo sapiens
tagctaagcaagccag

SEQ ID NO: 1864467 - DNA, 17 bp, Homo sapiens
tagctaagcaagccagg

SEQ ID NO: 1864468 - DNA, 22 bp, Homo sapiens
tagctaagcaagccaggagaag

SEQ ID NO: 1864469 - DNA, 19 bp, Homo sapiens
tagctacctttttatattt

SEQ ID NO: 1864470 - DNA, 14 bp, Homo sapiens
tagctatcagaaga

SEQ ID NO: 1864471 - DNA, 15 bp, Homo sapiens
tagctatcagaagac

SEQ ID NO: 1864472 - DNA, 21 bp, Homo sapiens
tagctatcagaagaccacaaa

SEQ ID NO: 1864473 - DNA, 13 bp, Homo sapiens
tagctattactgt

SEQ ID NO: 1864474 - DNA, 14 bp, Homo sapiens
tagctattactgtc

SEQ ID NO: 1864475 - DNA, 19 bp, Homo sapiens
tagcttatttttacagtta

SEQ ID NO: 1864476 - DNA, 17 bp, Homo sapiens
tagcttgtatagtgtaa

SEQ ID NO: 1864477 - DNA, 16 bp, Homo sapiens
taggaagacataaaac

SEQ ID NO: 1864478 - DNA, 17 bp, Homo sapiens
taggaagacataaaact

SEQ ID NO: 1864479 - DNA, 18 bp, Homo sapiens
taggaagacataaaactt

SEQ ID NO: 1864480 - DNA, 19 bp, Homo sapiens
taggaagacataaaacttt

SEQ ID NO: 1864481 - DNA, 16 bp, Homo sapiens
taggcagatctttaaa

SEQ ID NO: 1864482 - DNA, 18 bp, Homo sapiens
taggcagatctttaaata

SEQ ID NO: 1864483 - DNA, 16 bp, Homo sapiens
taggcatatgcttctt

SEQ ID NO: 1864484 - DNA, 18 bp, Homo sapiens
tagggtataatgtgtctg

SEQ ID NO: 1864485 - DNA, 19 bp, Homo sapiens
tagggtgggtaagaaagcc

SEQ ID NO: 1864486 - DNA, 19 bp, Homo sapiens
taggtcaagtaataaaaag

SEQ ID NO: 1864487 - DNA, 20 bp, Homo sapiens
taggttgccaataatacact

SEQ ID NO: 1864488 - DNA, 14 bp, Homo sapiens
tagtaccctgcagg

SEQ ID NO: 1864489 - DNA, 18 bp, Homo sapiens
tattggcagccaaggaat

SEQ ID NO: 1864490 - DNA, 19 bp, Homo sapiens
tattggcagccaaggaatg

SEQ ID NO: 1864491 - DNA, 21 bp, Homo sapiens
tattggcagccaaggaatgtg

SEQ ID NO: 1864492 - DNA, 22 bp, Homo sapiens
tattggcagccaaggaatgtgt

SEQ ID NO: 1864493 - DNA, 23 bp, Homo sapiens
tattggcagccaaggaatgtgtc

SEQ ID NO: 1864494 - DNA, 19 bp, Homo sapiens
tattgtgttggctttacaa

SEQ ID NO: 1864495 - DNA, 17 bp, Homo sapiens
tatttaaaaaattaaaa

SEQ ID NO: 1864496 - DNA, 17 bp, Homo sapiens
tatttaagtactatctt

SEQ ID NO: 1864497 - DNA, 19 bp, Homo sapiens
tatttagactgtggccata

SEQ ID NO: 1864498 - DNA, 19 bp, Homo sapiens
tatttagttacgtataatg

SEQ ID NO: 1864499 - DNA, 17 bp, Homo sapiens
tatttagttatagtttc

SEQ ID NO: 1864500 - DNA, 13 bp, Homo sapiens
tatttatatcttg

SEQ ID NO: 1864501 - DNA, 16 bp, Homo sapiens
tatttctctggcaaac

SEQ ID NO: 1864502 - DNA, 16 bp, Homo sapiens
tatttctttgtagaat

SEQ ID NO: 1864503 - DNA, 14 bp, Homo sapiens
tatttgtgtaatag

SEQ ID NO: 1864504 - DNA, 17 bp, Homo sapiens
tatttgttattttcagt

SEQ ID NO: 1864505 - DNA, 14 bp, Homo sapiens
tattttaaacaaaa

SEQ ID NO: 1864506 - DNA, 13 bp, Homo sapiens
tattttaagaaag

SEQ ID NO: 1864507 - DNA, 17 bp, Homo sapiens
tattttaagaaagagaa

SEQ ID NO: 1864508 - DNA, 15 bp, Homo sapiens
tattttacagtctct

SEQ ID NO: 1864509 - DNA, 22 bp, Homo sapiens
tattttcacagatggaagaagt

SEQ ID NO: 1864510 - DNA, 14 bp, Homo sapiens
tattttcatttcta

SEQ ID NO: 1864511 - DNA, 19 bp, Homo sapiens
tattttcatttctaacata

SEQ ID NO: 1864512 - DNA, 20 bp, Homo sapiens
tattttccagccttatgtgt

SEQ ID NO: 1864513 - DNA, 16 bp, Homo sapiens
tattttgatcagtgtt

SEQ ID NO: 1864514 - DNA, 16 bp, Homo sapiens
tattttggagaaatta

SEQ ID NO: 1864515 - DNA, 21 bp, Homo sapiens
tatttttatatttagttatag

SEQ ID NO: 1864516 - DNA, 20 bp, Homo sapiens
tatttttgaaagaattctat

SEQ ID NO: 1864517 - DNA, 23 bp, Homo sapiens
tatttttgaaagaattctatttt

SEQ ID NO: 1864518 - DNA, 22 bp, Homo sapiens
tatttttgtaccatattgctct

SEQ ID NO: 1864519 - DNA, 13 bp, Homo sapiens
tattttttattgt

SEQ ID NO: 1864520 - DNA, 22 bp, Homo sapiens
tatttttttaaacaaaatttca

SEQ ID NO: 1864521 - DNA, 12 bp, Homo sapiens
tcaaagaaatgc

SEQ ID NO: 1864522 - DNA, 22 bp, Homo sapiens
tcaaagaaggatggcacctaaa

SEQ ID NO: 1864523 - DNA, 15 bp, Homo sapiens
tcaaagatgatggaa

SEQ ID NO: 1864524 - DNA, 14 bp, Homo sapiens
tcaaatgaactttt

SEQ ID NO: 1864525 - DNA, 19 bp, Homo sapiens
tcaaatgaacttttacaga

SEQ ID NO: 1864526 - DNA, 13 bp, Homo sapiens
tcaaattgtaatt

SEQ ID NO: 1864527 - DNA, 19 bp, Homo sapiens
tcaatcatctgtgtgaaaa

SEQ ID NO: 1864528 - DNA, 12 bp, Homo sapiens
tcaattcattgt

SEQ ID NO: 1864529 - DNA, 13 bp, Homo sapiens
tcaattcattgtg

SEQ ID NO: 1864530 - DNA, 12 bp, Homo sapiens
tcaatttggagc

SEQ ID NO: 1864531 - DNA, 21 bp, Homo sapiens
tcacaaacatatgtatctttg

SEQ ID NO: 1864532 - DNA, 23 bp, Homo sapiens
tcacagatggaagaagttttaac

SEQ ID NO: 1864533 - DNA, 15 bp, Homo sapiens
tcacagttctgtaat

SEQ ID NO: 1864534 - DNA, 14 bp, Homo sapiens
tcacatattattgg

SEQ ID NO: 1864535 - DNA, 16 bp, Homo sapiens
tcacatccttgacttt

SEQ ID NO: 1864536 - DNA, 17 bp, Homo sapiens
tcacatctaaagcttta

SEQ ID NO: 1864537 - DNA, 20 bp, Homo sapiens
tcacatctaaagctttatct

SEQ ID NO: 1864538 - DNA, 19 bp, Homo sapiens
tcacctacaggactgggcc

SEQ ID NO: 1864539 - DNA, 20 bp, Homo sapiens
tcactgttgaaaattatttt

SEQ ID NO: 1864540 - DNA, 14 bp, Homo sapiens
tcagaaaagggaag

SEQ ID NO: 1864541 - DNA, 23 bp, Homo sapiens
tcagaaattaaaatattatttga

SEQ ID NO: 1864542 - DNA, 19 bp, Homo sapiens
tcagaattggcataatttg

SEQ ID NO: 1864543 - DNA, 22 bp, Homo sapiens
tcagaattggcataatttgtct

SEQ ID NO: 1864544 - DNA, 22 bp, Homo sapiens
tcagacatccatgtttgtaaaa

SEQ ID NO: 1864545 - DNA, 18 bp, Homo sapiens
tcagacttgcggccacag

SEQ ID NO: 1864546 - DNA, 20 bp, Homo sapiens
tcagagagcatcttttcctc

SEQ ID NO: 1864547 - DNA, 16 bp, Homo sapiens
tcagatgctgaattga

SEQ ID NO: 1864548 - DNA, 15 bp, Homo sapiens
tcagatttctctttg

SEQ ID NO: 1864549 - DNA, 14 bp, Homo sapiens
tcagatttgtataa

SEQ ID NO: 1864550 - DNA, 12 bp, Homo sapiens
tcagattttctc

SEQ ID NO: 1864551 - DNA, 13 bp, Homo sapiens
tcagcatgacaaa

SEQ ID NO: 1864552 - DNA, 14 bp, Homo sapiens
tcagcatgacaaaa

SEQ ID NO: 1864553 - DNA, 16 bp, Homo sapiens
tcagcatgacaaaaat

SEQ ID NO: 1864554 - DNA, 24 bp, Homo sapiens
tcagcatgacaaaaataacactgt

SEQ ID NO: 1864555 - DNA, 19 bp, Homo sapiens
tcagccattcctgttctct

SEQ ID NO: 1864556 - DNA, 15 bp, Homo sapiens
tcagctactgatttt

SEQ ID NO: 1864557 - DNA, 17 bp, Homo sapiens
tcagcttgcttagatgt

SEQ ID NO: 1864558 - DNA, 14 bp, Homo sapiens
tcagctttttgtat

SEQ ID NO: 1864559 - DNA, 18 bp, Homo sapiens
tcaggaatttaatttata

SEQ ID NO: 1864560 - DNA, 14 bp, Homo sapiens
tcaggaccttttga

SEQ ID NO: 1864561 - DNA, 15 bp, Homo sapiens
tcagtaaacactgtg

SEQ ID NO: 1864562 - DNA, 19 bp, Homo sapiens
tcagtatcttagagtttac

SEQ ID NO: 1864563 - DNA, 21 bp, Homo sapiens
tcagtatcttagagtttacag

SEQ ID NO: 1864564 - DNA, 19 bp, Homo sapiens
tcagtattttggagaaatt

SEQ ID NO: 1864565 - DNA, 14 bp, Homo sapiens
tcagtgaaatcata

SEQ ID NO: 1864566 - DNA, 18 bp, Homo sapiens
tcagtttgtcctgtagag

SEQ ID NO: 1864567 - DNA, 12 bp, Homo sapiens
tcataattcacc

SEQ ID NO: 1864568 - DNA, 16 bp, Homo sapiens
tcatactcctatgctt

SEQ ID NO: 1864569 - DNA, 17 bp, Homo sapiens
tcatactcctatgcttt

SEQ ID NO: 1864570 - DNA, 16 bp, Homo sapiens
tcataggttgccaata

SEQ ID NO: 1864571 - DNA, 14 bp, Homo sapiens
tcatataatttaaa

SEQ ID NO: 1864572 - DNA, 21 bp, Homo sapiens
tcatattaattattttccaaa

SEQ ID NO: 1864573 - DNA, 17 bp, Homo sapiens
tcatcacttttcagtga

SEQ ID NO: 1864574 - DNA, 21 bp, Homo sapiens
tcatgacatgttatatatttt

SEQ ID NO: 1864575 - DNA, 14 bp, Homo sapiens
tcatgcccactccc

SEQ ID NO: 1864576 - DNA, 15 bp, Homo sapiens
tcatgcccactcccc

SEQ ID NO: 1864577 - DNA, 20 bp, Homo sapiens
tcatgcccactcccccagga

SEQ ID NO: 1864578 - DNA, 13 bp, Homo sapiens
tcatggagcagcc

SEQ ID NO: 1864579 - DNA, 16 bp, Homo sapiens
tcatggagcagccccc

SEQ ID NO: 1864580 - DNA, 20 bp, Homo sapiens
tcatggtagatttttttcat

SEQ ID NO: 1864581 - DNA, 21 bp, Homo sapiens
tcatggtagatttttttcata

SEQ ID NO: 1864582 - DNA, 14 bp, Homo sapiens
tcattaaaatatat

SEQ ID NO: 1864583 - DNA, 19 bp, Homo sapiens
tcattaaaatatatgttct

SEQ ID NO: 1864584 - DNA, 17 bp, Homo sapiens
tgaaaatctaatattaa

SEQ ID NO: 1864585 - DNA, 19 bp, Homo sapiens
tgaaaattacgttcttaca

SEQ ID NO: 1864586 - DNA, 16 bp, Homo sapiens
tgaaaattattttaaa

SEQ ID NO: 1864587 - DNA, 16 bp, Homo sapiens
tgaaacagagaaagaa

SEQ ID NO: 1864588 - DNA, 17 bp, Homo sapiens
tgaaagtattcagaaat

SEQ ID NO: 1864589 - DNA, 17 bp, Homo sapiens
tgaaagttgcttttatt

SEQ ID NO: 1864590 - DNA, 18 bp, Homo sapiens
tgaaagttgcttttattg

SEQ ID NO: 1864591 - DNA, 20 bp, Homo sapiens
tgaaagttgcttttattgca

SEQ ID NO: 1864592 - DNA, 19 bp, Homo sapiens
tgaaatcagtaaacactgt

SEQ ID NO: 1864593 - DNA, 20 bp, Homo sapiens
tgaaatcagtaaacactgtg

SEQ ID NO: 1864594 - DNA, 21 bp, Homo sapiens
tgaaatttattagttaatata

SEQ ID NO: 1864595 - DNA, 15 bp, Homo sapiens
tgaacacatggcaga

SEQ ID NO: 1864596 - DNA, 21 bp, Homo sapiens
tgaacatttagtaccctgcag

SEQ ID NO: 1864597 - DNA, 16 bp, Homo sapiens
tgaaccgtttacagtg

SEQ ID NO: 1864598 - DNA, 17 bp, Homo sapiens
tgaaccgtttacagtgt

SEQ ID NO: 1864599 - DNA, 10 bp, Homo sapiens
tgaactgtgg

SEQ ID NO: 1864600 - DNA, 22 bp, Homo sapiens
tgaactttctcttcatactttt

SEQ ID NO: 1864601 - DNA, 15 bp, Homo sapiens
tgaacttttacagaa

SEQ ID NO: 1864602 - DNA, 15 bp, Homo sapiens
tgaacttttgtaatt

SEQ ID NO: 1864603 - DNA, 20 bp, Homo sapiens
tgaagcaatttatatcttta

SEQ ID NO: 1864604 - DNA, 23 bp, Homo sapiens
tgaaggacctgaaataaggtata

SEQ ID NO: 1864605 - DNA, 20 bp, Homo sapiens
tgaaggttttttttttaagt

SEQ ID NO: 1864606 - DNA, 13 bp, Homo sapiens
tgaagtataaatc

SEQ ID NO: 1864607 - DNA, 14 bp, Homo sapiens
tgaagtataaatct

SEQ ID NO: 1864608 - DNA, 19 bp, Homo sapiens
tgaagtcaaaccttaagat

SEQ ID NO: 1864609 - DNA, 22 bp, Homo sapiens
tgaagtcaaaccttaagataat

SEQ ID NO: 1864610 - DNA, 20 bp, Homo sapiens
tgaagtcgagcactctaatt

SEQ ID NO: 1864611 - DNA, 15 bp, Homo sapiens
tgaataaaaagtgaa

SEQ ID NO: 1864612 - DNA, 13 bp, Homo sapiens
tgaataatgattt

SEQ ID NO: 1864613 - DNA, 22 bp, Homo sapiens
tgaatcttctgaaaccaaatgt

SEQ ID NO: 1864614 - DNA, 23 bp, Homo sapiens
tgaatgctttttgaatgttattt

SEQ ID NO: 1864615 - DNA, 15 bp, Homo sapiens
tgaatgttatttgtt

SEQ ID NO: 1864616 - DNA, 23 bp, Homo sapiens
tgaatgttatttgttattttcag

SEQ ID NO: 1864617 - DNA, 13 bp, Homo sapiens
tgaattgagaata

SEQ ID NO: 1864618 - DNA, 11 bp, Homo sapiens
tgaattgttat

SEQ ID NO: 1864619 - DNA, 14 bp, Homo sapiens
tgaattgttatgaa

SEQ ID NO: 1864620 - DNA, 17 bp, Homo sapiens
tgaattgttatgaaaat

SEQ ID NO: 1864621 - DNA, 12 bp, Homo sapiens
tgaatttcaaaa

SEQ ID NO: 1864622 - DNA, 15 bp, Homo sapiens
tgacaaaaataacac

SEQ ID NO: 1864623 - DNA, 14 bp, Homo sapiens
tgacaacagaagct

SEQ ID NO: 1864624 - DNA, 20 bp, Homo sapiens
tgacagcctctgactcacca

SEQ ID NO: 1864625 - DNA, 18 bp, Homo sapiens
tgacatgttatatatttt

SEQ ID NO: 1864626 - DNA, 14 bp, Homo sapiens
tgaccaccctgcct

SEQ ID NO: 1864627 - DNA, 17 bp, Homo sapiens
tgaccaccctgcctgtg

SEQ ID NO: 1864628 - DNA, 13 bp, Homo sapiens
tgacccagtgaga

SEQ ID NO: 1864629 - DNA, 22 bp, Homo sapiens
tgacctgttaggtctcatgccc

SEQ ID NO: 1864630 - DNA, 14 bp, Homo sapiens
tgacgcctctggac

SEQ ID NO: 1864631 - DNA, 13 bp, Homo sapiens
tgacggccaggct

SEQ ID NO: 1864632 - DNA, 14 bp, Homo sapiens
tgacggccaggctc

SEQ ID NO: 1864633 - DNA, 22 bp, Homo sapiens
tgacggccaggctccctgacca

SEQ ID NO: 1864634 - DNA, 18 bp, Homo sapiens
tgactccagtataatctc

SEQ ID NO: 1864635 - DNA, 21 bp, Homo sapiens
tgactgcaagcatttttccat

SEQ ID NO: 1864636 - DNA, 21 bp, Homo sapiens
tgacttacttaaccaggtttg

SEQ ID NO: 1864637 - DNA, 15 bp, Homo sapiens
tgactttcaggaatt

SEQ ID NO: 1864638 - DNA, 14 bp, Homo sapiens
tgactttgaaaata

SEQ ID NO: 1864639 - DNA, 12 bp, Homo sapiens
tgagagactttt

SEQ ID NO: 1864640 - DNA, 19 bp, Homo sapiens
tgagattacagaggaagtt

SEQ ID NO: 1864641 - DNA, 22 bp, Homo sapiens
tgagattttggaagaagttttt

SEQ ID NO: 1864642 - DNA, 16 bp, Homo sapiens
tgaggcgggtggctgg

SEQ ID NO: 1864643 - DNA, 15 bp, Homo sapiens
tgaggttttgaataa

SEQ ID NO: 1864644 - DNA, 16 bp, Homo sapiens
tgaggttttgaataaa

SEQ ID NO: 1864645 - DNA, 22 bp, Homo sapiens
tgaggttttgaataaaaagtga

SEQ ID NO: 1864646 - DNA, 23 bp, Homo sapiens
tgagtcttaactgtatttcagta

SEQ ID NO: 1864647 - DNA, 14 bp, Homo sapiens
tgagtgccatgctt

SEQ ID NO: 1864648 - DNA, 19 bp, Homo sapiens
tgagttttactcttaaatc

SEQ ID NO: 1864649 - DNA, 15 bp, Homo sapiens
tgatatatctcaaat

SEQ ID NO: 1864650 - DNA, 22 bp, Homo sapiens
tgatattcaaggctttaaaagt

SEQ ID NO: 1864651 - DNA, 14 bp, Homo sapiens
tgatattttcacag

SEQ ID NO: 1864652 - DNA, 16 bp, Homo sapiens
tgatcagatgctgaat

SEQ ID NO: 1864653 - DNA, 18 bp, Homo sapiens
tgatcccttctcctgccc

SEQ ID NO: 1864654 - DNA, 19 bp, Homo sapiens
tgatcccttctcctgccct

SEQ ID NO: 1864655 - DNA, 20 bp, Homo sapiens
tgatctttgtttaaatgcca

SEQ ID NO: 1864656 - DNA, 21 bp, Homo sapiens
tgatctttgtttaaatgccaa

SEQ ID NO: 1864657 - DNA, 22 bp, Homo sapiens
tgatctttgtttaaatgccaaa

SEQ ID NO: 1864658 - DNA, 14 bp, Homo sapiens
tgatgaactttctc

SEQ ID NO: 1864659 - DNA, 12 bp, Homo sapiens
tgatgccttccg

SEQ ID NO: 1864660 - DNA, 21 bp, Homo sapiens
tgatgccttccgacaccactg

SEQ ID NO: 1864661 - DNA, 12 bp, Homo sapiens
tgattaaacagc

SEQ ID NO: 1864662 - DNA, 15 bp, Homo sapiens
tgattgattcagtat

SEQ ID NO: 1864663 - DNA, 17 bp, Homo sapiens
tgattgattcagtatct

SEQ ID NO: 1864664 - DNA, 10 bp, Homo sapiens
tgattgcact

SEQ ID NO: 1864665 - DNA, 18 bp, Homo sapiens
tgattgcactaaataaac

SEQ ID NO: 1864666 - DNA, 17 bp, Homo sapiens
tgattggttcagttttt

SEQ ID NO: 1864667 - DNA, 17 bp, Homo sapiens
tgattgtaaaatagctt

SEQ ID NO: 1864668 - DNA, 14 bp, Homo sapiens
tgatttacatgctg

SEQ ID NO: 1864669 - DNA, 15 bp, Homo sapiens
tgatttacatgctga

SEQ ID NO: 1864670 - DNA, 22 bp, Homo sapiens
tgatttatgcatggaaacctga

SEQ ID NO: 1864671 - DNA, 21 bp, Homo sapiens
tgatttggggattcagatttc

SEQ ID NO: 1864672 - DNA, 20 bp, Homo sapiens
tgatttttagatgagattgt

SEQ ID NO: 1864673 - DNA, 13 bp, Homo sapiens
tgcaaaaacatat

SEQ ID NO: 1864674 - DNA, 21 bp, Homo sapiens
tgcaaaaacatatgtctgtct

SEQ ID NO: 1864675 - DNA, 18 bp, Homo sapiens
tgcaaaccctttgtatta

SEQ ID NO: 1864676 - DNA, 21 bp, Homo sapiens
tgcaaaccctttgtattataa

SEQ ID NO: 1864677 - DNA, 16 bp, Homo sapiens
tgcaaactgctttatt

SEQ ID NO: 1864678 - DNA, 17 bp, Homo sapiens
tgcaaactgctttattt

SEQ ID NO: 1864679 - DNA, 18 bp, Homo sapiens
tgcaaaggactgtaagca

SEQ ID NO: 1864680 - DNA, 22 bp, Homo sapiens
tgcaaatattggttagtattta

SEQ ID NO: 1864681 - DNA, 14 bp, Homo sapiens
tgcaaattaacagt

SEQ ID NO: 1864682 - DNA, 14 bp, Homo sapiens
tgcaacatttctgt

SEQ ID NO: 1864683 - DNA, 17 bp, Homo sapiens
tgcaacatttctgtata

SEQ ID NO: 1864684 - DNA, 21 bp, Homo sapiens
tgcaacatttctgtatactgt

SEQ ID NO: 1864685 - DNA, 19 bp, Homo sapiens
tgcaactaactgactctgt

SEQ ID NO: 1864686 - DNA, 17 bp, Homo sapiens
tgcaacttgattcttgt

SEQ ID NO: 1864687 - DNA, 14 bp, Homo sapiens
tgcaagaattaaaa

SEQ ID NO: 1864688 - DNA, 17 bp, Homo sapiens
tgcaagaattaaaactg

SEQ ID NO: 1864689 - DNA, 18 bp, Homo sapiens
tgcaagaattaaaactga

SEQ ID NO: 1864690 - DNA, 22 bp, Homo sapiens
tgcaagcatttttccatctgtg

SEQ ID NO: 1864691 - DNA, 17 bp, Homo sapiens
tgcaaggggaaacctgt

SEQ ID NO: 1864692 - DNA, 21 bp, Homo sapiens
tgcaaggggaaacctgtgaaa

SEQ ID NO: 1864693 - DNA, 22 bp, Homo sapiens
tgcaatgtatggcttttctctt

SEQ ID NO: 1864694 - DNA, 18 bp, Homo sapiens
tgcaatttattaaaatga

SEQ ID NO: 1864695 - DNA, 18 bp, Homo sapiens
tgcaatttcaggaattta

SEQ ID NO: 1864696 - DNA, 22 bp, Homo sapiens
tgcacaactagttaaaagcctt

SEQ ID NO: 1864697 - DNA, 21 bp, Homo sapiens
tgcacagtaatatgaaagcca

SEQ ID NO: 1864698 - DNA, 15 bp, Homo sapiens
tgcaccattttcaat

SEQ ID NO: 1864699 - DNA, 13 bp, Homo sapiens
tgcaccttaccaa

SEQ ID NO: 1864700 - DNA, 21 bp, Homo sapiens
tgcaccttaccaactttctgt

SEQ ID NO: 1864701 - DNA, 18 bp, Homo sapiens
tgcactaaagtatgtaaa

SEQ ID NO: 1864702 - DNA, 15 bp, Homo sapiens
tgcagccttaaacag

SEQ ID NO: 1864703 - DNA, 21 bp, Homo sapiens
tgcagccttaaacagtgtcca

SEQ ID NO: 1864704 - DNA, 18 bp, Homo sapiens
tgcagcgggccaggcagg

SEQ ID NO: 1864705 - DNA, 15 bp, Homo sapiens
tgcagctttacatgc

SEQ ID NO: 1864706 - DNA, 16 bp, Homo sapiens
tgcagctttgggaaag

SEQ ID NO: 1864707 - DNA, 15 bp, Homo sapiens
tgcaggccaggccag

SEQ ID NO: 1864708 - DNA, 17 bp, Homo sapiens
tgcaggccaggccagct

SEQ ID NO: 1864709 - DNA, 15 bp, Homo sapiens
tgcagtcttttgctg

SEQ ID NO: 1864710 - DNA, 18 bp, Homo sapiens
tgcagtttcatgtatgta

SEQ ID NO: 1864711 - DNA, 22 bp, Homo sapiens
tgcataatgaaccgtttacagt

SEQ ID NO: 1864712 - DNA, 20 bp, Homo sapiens
tgcatcagctttttgtatta

SEQ ID NO: 1864713 - DNA, 21 bp, Homo sapiens
tgcatgtaatcaacatggcta

SEQ ID NO: 1864714 - DNA, 19 bp, Homo sapiens
tgccaagctaatctgcctg

SEQ ID NO: 1864715 - DNA, 16 bp, Homo sapiens
tgccaccagcaatgcc

SEQ ID NO: 1864716 - DNA, 20 bp, Homo sapiens
tgccaccagcaatgccctgc

SEQ ID NO: 1864717 - DNA, 17 bp, Homo sapiens
tgccataaaattgcagt

SEQ ID NO: 1864718 - DNA, 19 bp, Homo sapiens
tgccatgctttttggtgag

SEQ ID NO: 1864719 - DNA, 17 bp, Homo sapiens
tgcccaagtggctcttg

SEQ ID NO: 1864720 - DNA, 21 bp, Homo sapiens
tgcccaagtggctcttgggac

SEQ ID NO: 1864721 - DNA, 14 bp, Homo sapiens
tgcccaatcctccc

SEQ ID NO: 1864722 - DNA, 20 bp, Homo sapiens
tgcccaatcctccctggaga

SEQ ID NO: 1864723 - DNA, 19 bp, Homo sapiens
tgcccactcccccaggagc

SEQ ID NO: 1864724 - DNA, 21 bp, Homo sapiens
tgcccactcccccaggagcag

SEQ ID NO: 1864725 - DNA, 24 bp, Homo sapiens
tgcccactcccccaggagcagctg

SEQ ID NO: 1864726 - DNA, 23 bp, Homo sapiens
tgcccatgtccagagggactgga

SEQ ID NO: 1864727 - DNA, 14 bp, Homo sapiens
tgccccaaatcaca

SEQ ID NO: 1864728 - DNA, 15 bp, Homo sapiens
tgccccaaatcacaa

SEQ ID NO: 1864729 - DNA, 15 bp, Homo sapiens
tgccctgccttgctg

SEQ ID NO: 1864730 - DNA, 16 bp, Homo sapiens
tgcctcggctcacaaa

SEQ ID NO: 1864731 - DNA, 21 bp, Homo sapiens
tgcctggggtgtaatgagctc

SEQ ID NO: 1864732 - DNA, 18 bp, Homo sapiens
tgcctgtggaggtgacct

SEQ ID NO: 1864733 - DNA, 21 bp, Homo sapiens
tgccttccgacaccactggga

SEQ ID NO: 1864734 - DNA, 11 bp, Homo sapiens
tgccttggttt

SEQ ID NO: 1864735 - DNA, 19 bp, Homo sapiens
tgccttggtttgatttcta

SEQ ID NO: 1864736 - DNA, 20 bp, Homo sapiens
tgccttttaagtttgaaact

SEQ ID NO: 1864737 - DNA, 15 bp, Homo sapiens
tgcggtgtctgcagc

SEQ ID NO: 1864738 - DNA, 16 bp, Homo sapiens
tgcggtgtctgcagct

SEQ ID NO: 1864739 - DNA, 15 bp, Homo sapiens
tgctacttatcattt

SEQ ID NO: 1864740 - DNA, 15 bp, Homo sapiens
tgctcattaaactga

SEQ ID NO: 1864741 - DNA, 12 bp, Homo sapiens
tgctgcagcttt

SEQ ID NO: 1864742 - DNA, 11 bp, Homo sapiens
tgctgccctgg

SEQ ID NO: 1864743 - DNA, 14 bp, Homo sapiens
tgctgccctggggc

SEQ ID NO: 1864744 - DNA, 15 bp, Homo sapiens
tgctgccctggggca

SEQ ID NO: 1864745 - DNA, 15 bp, Homo sapiens
tgctgccttcaccct

SEQ ID NO: 1864746 - DNA, 17 bp, Homo sapiens
tgctgccttcaccctga

SEQ ID NO: 1864747 - DNA, 16 bp, Homo sapiens
tgctgctttgatatat

SEQ ID NO: 1864748 - DNA, 16 bp, Homo sapiens
tgctgggtaaactgtg

SEQ ID NO: 1864749 - DNA, 18 bp, Homo sapiens
tgctgtacattactgtat

SEQ ID NO: 1864750 - DNA, 22 bp, Homo sapiens
tgctgttactgcttctctttgt

SEQ ID NO: 1864751 - DNA, 13 bp, Homo sapiens
tgcttaatttcct

SEQ ID NO: 1864752 - DNA, 18 bp, Homo sapiens
tgcttaatttccttctgt

SEQ ID NO: 1864753 - DNA, 20 bp, Homo sapiens
tgcttaatttccttctgtta

SEQ ID NO: 1864754 - DNA, 20 bp, Homo sapiens
tgcttcactcatgcaaactg

SEQ ID NO: 1864755 - DNA, 21 bp, Homo sapiens
tgcttcactcatgcaaactgc

SEQ ID NO: 1864756 - DNA, 13 bp, Homo sapiens
tgcttcctgatta

SEQ ID NO: 1864757 - DNA, 16 bp, Homo sapiens
tggaaacgcacttaca

SEQ ID NO: 1864758 - DNA, 22 bp, Homo sapiens
tggaaagtcacctacaggactg

SEQ ID NO: 1864759 - DNA, 21 bp, Homo sapiens
tggaacttctaatatattttt

SEQ ID NO: 1864760 - DNA, 18 bp, Homo sapiens
tggaagaagttttttact

SEQ ID NO: 1864761 - DNA, 22 bp, Homo sapiens
tggaagaagttttttactttgg

SEQ ID NO: 1864762 - DNA, 14 bp, Homo sapiens
tggaccggccgcag

SEQ ID NO: 1864763 - DNA, 14 bp, Homo sapiens
tggagaattatata

SEQ ID NO: 1864764 - DNA, 16 bp, Homo sapiens
tggagactttgctgtt

SEQ ID NO: 1864765 - DNA, 14 bp, Homo sapiens
tggagcagccccca

SEQ ID NO: 1864766 - DNA, 20 bp, Homo sapiens
tggagcattaactaaatgct

SEQ ID NO: 1864767 - DNA, 22 bp, Homo sapiens
tggagggggcagagtggcctgt

SEQ ID NO: 1864768 - DNA, 17 bp, Homo sapiens
tggatggcctctggggc

SEQ ID NO: 1864769 - DNA, 12 bp, Homo sapiens
tggatttgctgt

SEQ ID NO: 1864770 - DNA, 15 bp, Homo sapiens
tggcactgccaccag

SEQ ID NO: 1864771 - DNA, 13 bp, Homo sapiens
tggcactgtggca

SEQ ID NO: 1864772 - DNA, 20 bp, Homo sapiens
tggcactgtggcactgccac

SEQ ID NO: 1864773 - DNA, 14 bp, Homo sapiens
tggcagccaaggaa

SEQ ID NO: 1864774 - DNA, 21 bp, Homo sapiens
tggcaggtcatggagcagccc

SEQ ID NO: 1864775 - DNA, 22 bp, Homo sapiens
tggcaggtcatggagcagcccc

SEQ ID NO: 1864776 - DNA, 24 bp, Homo sapiens
tggcaggtcatggagcagccccca

SEQ ID NO: 1864777 - DNA, 22 bp, Homo sapiens
tggccaaaggaccgttttgtat

SEQ ID NO: 1864778 - DNA, 17 bp, Homo sapiens
tggccatatatgctgta

SEQ ID NO: 1864779 - DNA, 21 bp, Homo sapiens
tggccatatatgctgtatttc

SEQ ID NO: 1864780 - DNA, 18 bp, Homo sapiens
tggcctctggggcaggac

SEQ ID NO: 1864781 - DNA, 19 bp, Homo sapiens
tggcctgtgagcaagagcc

SEQ ID NO: 1864782 - DNA, 23 bp, Homo sapiens
tggcctgtgagcaagagccaggg

SEQ ID NO: 1864783 - DNA, 20 bp, Homo sapiens
tggctatctatacctgcctt

SEQ ID NO: 1864784 - DNA, 23 bp, Homo sapiens
tggctcttgggacaacgtgctgc

SEQ ID NO: 1864785 - DNA, 23 bp, Homo sapiens
tggctctttgtgtgtctccaggt

SEQ ID NO: 1864786 - DNA, 22 bp, Homo sapiens
tggctggatgaaattttctaga

SEQ ID NO: 1864787 - DNA, 14 bp, Homo sapiens
tggcttccctgccc

SEQ ID NO: 1864788 - DNA, 13 bp, Homo sapiens
tggcttcttaaaa

SEQ ID NO: 1864789 - DNA, 22 bp, Homo sapiens
tcccagcctctggggcagagct

SEQ ID NO: 1864790 - DNA, 23 bp, Homo sapiens
tccccaaaagaaaccatgacaaa

SEQ ID NO: 1864791 - DNA, 18 bp, Homo sapiens
tcccccagcgcttagaaa

SEQ ID NO: 1864792 - DNA, 16 bp, Homo sapiens
tcccccaggagcagct

SEQ ID NO: 1864793 - DNA, 17 bp, Homo sapiens
tcccccccctgtatagt

SEQ ID NO: 1864794 - DNA, 13 bp, Homo sapiens
tccccctagagac

SEQ ID NO: 1864795 - DNA, 15 bp, Homo sapiens
tccccctagagactc

SEQ ID NO: 1864796 - DNA, 18 bp, Homo sapiens
tccccctgcagccgtgca

SEQ ID NO: 1864797 - DNA, 20 bp, Homo sapiens
tcccctcacttaaccacccc

SEQ ID NO: 1864798 - DNA, 21 bp, Homo sapiens
tcccctcacttaaccacccca

SEQ ID NO: 1864799 - DNA, 15 bp, Homo sapiens
tccctgaccaccctg

SEQ ID NO: 1864800 - DNA, 16 bp, Homo sapiens
tccctgaccaccctgc

SEQ ID NO: 1864801 - DNA, 17 bp, Homo sapiens
tccctgaccaccctgcc

SEQ ID NO: 1864802 - DNA, 11 bp, Homo sapiens
tccctgcccaa

SEQ ID NO: 1864803 - DNA, 23 bp, Homo sapiens
tccctgcccaatcctccctggag

SEQ ID NO: 1864804 - DNA, 22 bp, Homo sapiens
tccctggagaagggacatggga

SEQ ID NO: 1864805 - DNA, 14 bp, Homo sapiens
tcccttctgatctt

SEQ ID NO: 1864806 - DNA, 17 bp, Homo sapiens
tcccttttcctctagaa

SEQ ID NO: 1864807 - DNA, 15 bp, Homo sapiens
tccgacaccactggg

SEQ ID NO: 1864808 - DNA, 13 bp, Homo sapiens
tcctatatctgtt

SEQ ID NO: 1864809 - DNA, 19 bp, Homo sapiens
tcctatatctgtttgtata

SEQ ID NO: 1864810 - DNA, 15 bp, Homo sapiens
tcctatctagcattt

SEQ ID NO: 1864811 - DNA, 23 bp, Homo sapiens
tcctatctagcatttatttctct

SEQ ID NO: 1864812 - DNA, 13 bp, Homo sapiens
tcctatgctttag

SEQ ID NO: 1864813 - DNA, 22 bp, Homo sapiens
tcctcccattttagaaaatcag

SEQ ID NO: 1864814 - DNA, 13 bp, Homo sapiens
tcctccctggaga

SEQ ID NO: 1864815 - DNA, 20 bp, Homo sapiens
tcctcgggatgaaaagccat

SEQ ID NO: 1864816 - DNA, 15 bp, Homo sapiens
tcctcttttgtgaga

SEQ ID NO: 1864817 - DNA, 21 bp, Homo sapiens
tcctcttttgtgagaagatgg

SEQ ID NO: 1864818 - DNA, 20 bp, Homo sapiens
tcctgctccttttcctcttt

SEQ ID NO: 1864819 - DNA, 12 bp, Homo sapiens
tcctgtctgttt

SEQ ID NO: 1864820 - DNA, 17 bp, Homo sapiens
tcctgttgtgtaataac

SEQ ID NO: 1864821 - DNA, 22 bp, Homo sapiens
tcctgttgtgtaataacagaac

SEQ ID NO: 1864822 - DNA, 16 bp, Homo sapiens
tccttcctttttattc

SEQ ID NO: 1864823 - DNA, 16 bp, Homo sapiens
tccttctgttaagaaa

SEQ ID NO: 1864824 - DNA, 20 bp, Homo sapiens
tccttggagtgctgcagctt

SEQ ID NO: 1864825 - DNA, 21 bp, Homo sapiens
tcgaattaatagcttttattg

SEQ ID NO: 1864826 - DNA, 15 bp, Homo sapiens
tcggtgatgccttcc

SEQ ID NO: 1864827 - DNA, 15 bp, Homo sapiens
tctaaagctttatct

SEQ ID NO: 1864828 - DNA, 19 bp, Homo sapiens
tctaaagctttatctttgt

SEQ ID NO: 1864829 - DNA, 19 bp, Homo sapiens
tctaacataagtaagactt

SEQ ID NO: 1864830 - DNA, 15 bp, Homo sapiens
tctaagtatatgtga

SEQ ID NO: 1864831 - DNA, 17 bp, Homo sapiens
tctaatattaaaaatat

SEQ ID NO: 1864832 - DNA, 12 bp, Homo sapiens
tctaattagaga

SEQ ID NO: 1864833 - DNA, 15 bp, Homo sapiens
tctacattcttggtt

SEQ ID NO: 1864834 - DNA, 20 bp, Homo sapiens
tctacattcttggttgttaa

SEQ ID NO: 1864835 - DNA, 15 bp, Homo sapiens
tctactcattttaat

SEQ ID NO: 1864836 - DNA, 15 bp, Homo sapiens
tctactttttctgta

SEQ ID NO: 1864837 - DNA, 15 bp, Homo sapiens
tctagactttctgtt

SEQ ID NO: 1864838 - DNA, 15 bp, Homo sapiens
tctagcatttatttc

SEQ ID NO: 1864839 - DNA, 17 bp, Homo sapiens
tctagctgttctttttt

SEQ ID NO: 1864840 - DNA, 11 bp, Homo sapiens
tctagtcaata

SEQ ID NO: 1864841 - DNA, 13 bp, Homo sapiens
tctataaacactg

SEQ ID NO: 1864842 - DNA, 14 bp, Homo sapiens
tctataaacactgt

SEQ ID NO: 1864843 - DNA, 15 bp, Homo sapiens
tctataaacactgtt

SEQ ID NO: 1864844 - DNA, 14 bp, Homo sapiens
tctataataagttt

SEQ ID NO: 1864845 - DNA, 19 bp, Homo sapiens
tctataataagttttgata

SEQ ID NO: 1864846 - DNA, 14 bp, Homo sapiens
tctatattaaatga

SEQ ID NO: 1864847 - DNA, 20 bp, Homo sapiens
tctattttctctgatacttt

SEQ ID NO: 1864848 - DNA, 23 bp, Homo sapiens
tctcaaattgtaattaataatag

SEQ ID NO: 1864849 - DNA, 15 bp, Homo sapiens
tctccaattctgaaa

SEQ ID NO: 1864850 - DNA, 20 bp, Homo sapiens
tctccaattctgaaatactt

SEQ ID NO: 1864851 - DNA, 14 bp, Homo sapiens
tctctgttgtaaat

SEQ ID NO: 1864852 - DNA, 17 bp, Homo sapiens
tctgaatcttctgaaac

SEQ ID NO: 1864853 - DNA, 13 bp, Homo sapiens
tctgagtgagttt

SEQ ID NO: 1864854 - DNA, 19 bp, Homo sapiens
tctgatacttttttgaaat

SEQ ID NO: 1864855 - DNA, 17 bp, Homo sapiens
tctgatctgtactttgt

SEQ ID NO: 1864856 - DNA, 19 bp, Homo sapiens
tctgatctgtactttgtgt

SEQ ID NO: 1864857 - DNA, 22 bp, Homo sapiens
tctgattataccatgtgtgcta

SEQ ID NO: 1864858 - DNA, 18 bp, Homo sapiens
tctgattcccagaaatac

SEQ ID NO: 1864859 - DNA, 19 bp, Homo sapiens
tctgcaagaattaaaactg

SEQ ID NO: 1864860 - DNA, 20 bp, Homo sapiens
tctgcaagaattaaaactga

SEQ ID NO: 1864861 - DNA, 21 bp, Homo sapiens
tctgcaagaattaaaactgag

SEQ ID NO: 1864862 - DNA, 16 bp, Homo sapiens
tctgcatcagcttttt

SEQ ID NO: 1864863 - DNA, 17 bp, Homo sapiens
tctgcctggttttattt

SEQ ID NO: 1864864 - DNA, 21 bp, Homo sapiens
tctgcctggttttatttatat

SEQ ID NO: 1864865 - DNA, 16 bp, Homo sapiens
tctgctcattaaactg

SEQ ID NO: 1864866 - DNA, 20 bp, Homo sapiens
tctggacctcggtgatgcct

SEQ ID NO: 1864867 - DNA, 18 bp, Homo sapiens
tctggcaaacttttcttt

SEQ ID NO: 1864868 - DNA, 19 bp, Homo sapiens
tctggcaaacttttctttc

SEQ ID NO: 1864869 - DNA, 14 bp, Homo sapiens
tctggcttccctgc

SEQ ID NO: 1864870 - DNA, 15 bp, Homo sapiens
tctggcttccctgcc

SEQ ID NO: 1864871 - DNA, 13 bp, Homo sapiens
tctggcttctgct

SEQ ID NO: 1864872 - DNA, 20 bp, Homo sapiens
tctggggaagaggttttatt

SEQ ID NO: 1864873 - DNA, 23 bp, Homo sapiens
tctggggcagagcttgtagccct

SEQ ID NO: 1864874 - DNA, 14 bp, Homo sapiens
tctgtatactgtaa

SEQ ID NO: 1864875 - DNA, 21 bp, Homo sapiens
tctgtatactgtaaaagttat

SEQ ID NO: 1864876 - DNA, 21 bp, Homo sapiens
tctgtcagcgcaggtttagtt

SEQ ID NO: 1864877 - DNA, 13 bp, Homo sapiens
tctgtgtgaaaat

SEQ ID NO: 1864878 - DNA, 18 bp, Homo sapiens
tctgtgtgatgaactttc

SEQ ID NO: 1864879 - DNA, 14 bp, Homo sapiens
tctgttaaagatca

SEQ ID NO: 1864880 - DNA, 23 bp, Homo sapiens
tcttaaaaatcttggtttggtac

SEQ ID NO: 1864881 - DNA, 16 bp, Homo sapiens
attttttttttaagtg

SEQ ID NO: 1864882 - DNA, 21 bp, Homo sapiens
caaaaaaaaaaaaaaagactg

SEQ ID NO: 1864883 - DNA, 14 bp, Homo sapiens
caaaaaaaagaacc

SEQ ID NO: 1864884 - DNA, 13 bp, Homo sapiens
caaaaaaaatctt

SEQ ID NO: 1864885 - DNA, 21 bp, Homo sapiens
caaaaacatatgtctgtcttt

SEQ ID NO: 1864886 - DNA, 12 bp, Homo sapiens
caaaacaaacaa

SEQ ID NO: 1864887 - DNA, 16 bp, Homo sapiens
caaaagaaaccatgac

SEQ ID NO: 1864888 - DNA, 17 bp, Homo sapiens
caaaagaaaccatgaca

SEQ ID NO: 1864889 - DNA, 18 bp, Homo sapiens
caaaagaaaccatgacaa

SEQ ID NO: 1864890 - DNA, 20 bp, Homo sapiens
caaaagaaaccatgacaaac

SEQ ID NO: 1864891 - DNA, 18 bp, Homo sapiens
caaaagttcatataattt

SEQ ID NO: 1864892 - DNA, 22 bp, Homo sapiens
caaaagttcatataatttaaag

SEQ ID NO: 1864893 - DNA, 18 bp, Homo sapiens
caaaatgtacttaaatga

SEQ ID NO: 1864894 - DNA, 19 bp, Homo sapiens
caaaatgtacttaaatgag

SEQ ID NO: 1864895 - DNA, 18 bp, Homo sapiens
caaaatttcacagttctg

SEQ ID NO: 1864896 - DNA, 23 bp, Homo sapiens
caaaatttttaggtgaagtcgag

SEQ ID NO: 1864897 - DNA, 15 bp, Homo sapiens
caaacaaaaaaaaga

SEQ ID NO: 1864898 - DNA, 16 bp, Homo sapiens
caaaccagtttattct

SEQ ID NO: 1864899 - DNA, 16 bp, Homo sapiens
caaaccctttgtatta

SEQ ID NO: 1864900 - DNA, 18 bp, Homo sapiens
caaacctagcttttaaaa

SEQ ID NO: 1864901 - DNA, 15 bp, Homo sapiens
caaactgctttattt

SEQ ID NO: 1864902 - DNA, 17 bp, Homo sapiens
caaagagctgtggctgg

SEQ ID NO: 1864903 - DNA, 17 bp, Homo sapiens
caaagcatgggaaaaag

SEQ ID NO: 1864904 - DNA, 19 bp, Homo sapiens
caaagttactggctctttg

SEQ ID NO: 1864905 - DNA, 17 bp, Homo sapiens
caaataaactctaaaca

SEQ ID NO: 1864906 - DNA, 16 bp, Homo sapiens
caaatgaacttttaca

SEQ ID NO: 1864907 - DNA, 17 bp, Homo sapiens
caaatgaacttttacag

SEQ ID NO: 1864908 - DNA, 19 bp, Homo sapiens
caaatgaacttttacagaa

SEQ ID NO: 1864909 - DNA, 12 bp, Homo sapiens
caaatgtaacta

SEQ ID NO: 1864910 - DNA, 21 bp, Homo sapiens
caaatgtcctaacagagaaat

SEQ ID NO: 1864911 - DNA, 15 bp, Homo sapiens
caaattaatctttta

SEQ ID NO: 1864912 - DNA, 17 bp, Homo sapiens
caaattattaattgtcc

SEQ ID NO: 1864913 - DNA, 12 bp, Homo sapiens
caaattatttgt

SEQ ID NO: 1864914 - DNA, 14 bp, Homo sapiens
caaattatttgtgt

SEQ ID NO: 1864915 - DNA, 20 bp, Homo sapiens
caaattatttgtgtaataga

SEQ ID NO: 1864916 - DNA, 21 bp, Homo sapiens
caaattgtctgtctgctctta

SEQ ID NO: 1864917 - DNA, 20 bp, Homo sapiens
caaatttaattaaagcctta

SEQ ID NO: 1864918 - DNA, 20 bp, Homo sapiens
caacacatgtgggagaggag

SEQ ID NO: 1864919 - DNA, 20 bp, Homo sapiens
caacagtttatttttattat

SEQ ID NO: 1864920 - DNA, 12 bp, Homo sapiens
caacagtttctc

SEQ ID NO: 1864921 - DNA, 19 bp, Homo sapiens
caacatttctgtatactgt

SEQ ID NO: 1864922 - DNA, 12 bp, Homo sapiens
caacgtgctgct

SEQ ID NO: 1864923 - DNA, 20 bp, Homo sapiens
caacttgctacttatcattt

SEQ ID NO: 1864924 - DNA, 12 bp, Homo sapiens
caactttctgta

SEQ ID NO: 1864925 - DNA, 23 bp, Homo sapiens
caactttctgtaaactcaaaact

SEQ ID NO: 1864926 - DNA, 16 bp, Homo sapiens
caagaaagctggtaaa

SEQ ID NO: 1864927 - DNA, 13 bp, Homo sapiens
caagaaatttgat

SEQ ID NO: 1864928 - DNA, 17 bp, Homo sapiens
caagaaggccagcccac

SEQ ID NO: 1864929 - DNA, 17 bp, Homo sapiens
caagaattaaaactgag

SEQ ID NO: 1864930 - DNA, 13 bp, Homo sapiens
caagacacatgct

SEQ ID NO: 1864931 - DNA, 21 bp, Homo sapiens
caagattttttttttaagtga

SEQ ID NO: 1864932 - DNA, 14 bp, Homo sapiens
caagcatttttcca

SEQ ID NO: 1864933 - DNA, 15 bp, Homo sapiens
caagccaggagaaga

SEQ ID NO: 1864934 - DNA, 14 bp, Homo sapiens
caagcttaaagctt

SEQ ID NO: 1864935 - DNA, 14 bp, Homo sapiens
caaggaaaattgaa

SEQ ID NO: 1864936 - DNA, 16 bp, Homo sapiens
caaggaaaattgaaag

SEQ ID NO: 1864937 - DNA, 17 bp, Homo sapiens
caaggaaaattgaaagt

SEQ ID NO: 1864938 - DNA, 19 bp, Homo sapiens
caaggaaaattgaaagtat

SEQ ID NO: 1864939 - DNA, 22 bp, Homo sapiens
caaggaaaattgaaagtattca

SEQ ID NO: 1864940 - DNA, 17 bp, Homo sapiens
caaggtggccaaattat

SEQ ID NO: 1864941 - DNA, 19 bp, Homo sapiens
caaggtggccaaattattt

SEQ ID NO: 1864942 - DNA, 21 bp, Homo sapiens
caagtatgaagtataaatctg

SEQ ID NO: 1864943 - DNA, 15 bp, Homo sapiens
caagtggctcttggg

SEQ ID NO: 1864944 - DNA, 16 bp, Homo sapiens
caagtggctcttggga

SEQ ID NO: 1864945 - DNA, 17 bp, Homo sapiens
caagtggctcttgggac

SEQ ID NO: 1864946 - DNA, 19 bp, Homo sapiens
caagtggtgaccaaaattt

SEQ ID NO: 1864947 - DNA, 14 bp, Homo sapiens
caagtgtatatcag

SEQ ID NO: 1864948 - DNA, 20 bp, Homo sapiens
caagttattgtacagctgtt

SEQ ID NO: 1864949 - DNA, 20 bp, Homo sapiens
agtactatctttgtctaaac

SEQ ID NO: 1864950 - DNA, 16 bp, Homo sapiens
agtagaaagacatctg

SEQ ID NO: 1864951 - DNA, 20 bp, Homo sapiens
agtagccctttctgtgtgca

SEQ ID NO: 1864952 - DNA, 15 bp, Homo sapiens
agtataatctcctct

SEQ ID NO: 1864953 - DNA, 19 bp, Homo sapiens
agtatctattgtgttggct

SEQ ID NO: 1864954 - DNA, 22 bp, Homo sapiens
agtatcttagagtttacagttt

SEQ ID NO: 1864955 - DNA, 15 bp, Homo sapiens
agtatgtaaagtatg

SEQ ID NO: 1864956 - DNA, 14 bp, Homo sapiens
agtatgtccttcag

SEQ ID NO: 1864957 - DNA, 21 bp, Homo sapiens
agtattcagaaattaaaatat

SEQ ID NO: 1864958 - DNA, 22 bp, Homo sapiens
agtatttaactacatctgcctc

SEQ ID NO: 1864959 - DNA, 20 bp, Homo sapiens
agtatttttgaaagaattct

SEQ ID NO: 1864960 - DNA, 21 bp, Homo sapiens
agtatttttgaaagaattcta

SEQ ID NO: 1864961 - DNA, 15 bp, Homo sapiens
agtcacccccccagg

SEQ ID NO: 1864962 - DNA, 17 bp, Homo sapiens
agtcacccccccaggcc

SEQ ID NO: 1864963 - DNA, 17 bp, Homo sapiens
agtcacctcctgctcct

SEQ ID NO: 1864964 - DNA, 14 bp, Homo sapiens
agtcagatttgtat

SEQ ID NO: 1864965 - DNA, 12 bp, Homo sapiens
agtcagtattcc

SEQ ID NO: 1864966 - DNA, 17 bp, Homo sapiens
agtcagtattcccagcc

SEQ ID NO: 1864967 - DNA, 18 bp, Homo sapiens
agtccaaattgtctgtct

SEQ ID NO: 1864968 - DNA, 13 bp, Homo sapiens
agtccatgaaaat

SEQ ID NO: 1864969 - DNA, 15 bp, Homo sapiens
agtccatgaaaatac

SEQ ID NO: 1864970 - DNA, 14 bp, Homo sapiens
agtctctgttgtaa

SEQ ID NO: 1864971 - DNA, 18 bp, Homo sapiens
agtctgtgtgatgaactt

SEQ ID NO: 1864972 - DNA, 16 bp, Homo sapiens
agtcttaactgtattt

SEQ ID NO: 1864973 - DNA, 12 bp, Homo sapiens
agtctttgtgtg

SEQ ID NO: 1864974 - DNA, 15 bp, Homo sapiens
agtctttgtgtgtta

SEQ ID NO: 1864975 - DNA, 16 bp, Homo sapiens
agtctttgtgtgttat

SEQ ID NO: 1864976 - DNA, 17 bp, Homo sapiens
agtctttgtgtgttata

SEQ ID NO: 1864977 - DNA, 21 bp, Homo sapiens
agtctttgtgtgttatattcc

SEQ ID NO: 1864978 - DNA, 12 bp, Homo sapiens
agtcttttgctg

SEQ ID NO: 1864979 - DNA, 19 bp, Homo sapiens
agtctttttctttttttgg

SEQ ID NO: 1864980 - DNA, 14 bp, Homo sapiens
agtctttttttcct

SEQ ID NO: 1864981 - DNA, 20 bp, Homo sapiens
agtcttttttttttccaaat

SEQ ID NO: 1864982 - DNA, 12 bp, Homo sapiens
agtgaaacagag

SEQ ID NO: 1864983 - DNA, 15 bp, Homo sapiens
agtgaaacagagaaa

SEQ ID NO: 1864984 - DNA, 19 bp, Homo sapiens
agtgaaacagagaaagaaa

SEQ ID NO: 1864985 - DNA, 14 bp, Homo sapiens
agtgaacttttgta

SEQ ID NO: 1864986 - DNA, 15 bp, Homo sapiens
agtgaacttttgtaa

SEQ ID NO: 1864987 - DNA, 21 bp, Homo sapiens
agtgaacttttgtaatttgaa

SEQ ID NO: 1864988 - DNA, 20 bp, Homo sapiens
agtgagactgggaacttgat

SEQ ID NO: 1864989 - DNA, 16 bp, Homo sapiens
agtgcaacatttctgt

SEQ ID NO: 1864990 - DNA, 17 bp, Homo sapiens
agtgcaacatttctgta

SEQ ID NO: 1864991 - DNA, 18 bp, Homo sapiens
agtgcaacatttctgtat

SEQ ID NO: 1864992 - DNA, 22 bp, Homo sapiens
agtgcaacatttctgtatactg

SEQ ID NO: 1864993 - DNA, 15 bp, Homo sapiens
agtgcagcgggccag

SEQ ID NO: 1864994 - DNA, 17 bp, Homo sapiens
agtgcatttaaggagat

SEQ ID NO: 1864995 - DNA, 16 bp, Homo sapiens
agtggagaattatata

SEQ ID NO: 1864996 - DNA, 17 bp, Homo sapiens
agtggaggtttatagtt

SEQ ID NO: 1864997 - DNA, 12 bp, Homo sapiens
agtggcactaaa

SEQ ID NO: 1864998 - DNA, 13 bp, Homo sapiens
agtggcactaaaa

SEQ ID NO: 1864999 - DNA, 16 bp, Homo sapiens
agtggctcttgggaca

SEQ ID NO: 1865000 - DNA, 21 bp, Homo sapiens
agtggtgaccaaaatttttag

SEQ ID NO: 1865001 - DNA, 13 bp, Homo sapiens
agtgtaaaataag

SEQ ID NO: 1865002 - DNA, 13 bp, Homo sapiens
agttaatctataa

SEQ ID NO: 1865003 - DNA, 21 bp, Homo sapiens
agttacgtataatgctttctg

SEQ ID NO: 1865004 - DNA, 22 bp, Homo sapiens
agttacgtataatgctttctga

SEQ ID NO: 1865005 - DNA, 19 bp, Homo sapiens
agttactggctctttgtgt

SEQ ID NO: 1865006 - DNA, 16 bp, Homo sapiens
agttaggatagcattt

SEQ ID NO: 1865007 - DNA, 13 bp, Homo sapiens
agttatagtttca

SEQ ID NO: 1865008 - DNA, 16 bp, Homo sapiens
agttatagtttcagat

SEQ ID NO: 1865009 - DNA, 18 bp, Homo sapiens
agttatagtttcagatat

SEQ ID NO: 1865010 - DNA, 13 bp, Homo sapiens
agttattgtacag

SEQ ID NO: 1865011 - DNA, 19 bp, Homo sapiens
agttattgtacagctgttt

SEQ ID NO: 1865012 - DNA, 22 bp, Homo sapiens
agttctatggagactttgctgt

SEQ ID NO: 1865013 - DNA, 21 bp, Homo sapiens
agttgaatgacaacagaagct

SEQ ID NO: 1865014 - DNA, 23 bp, Homo sapiens
agttgtgccttttatagctatta

SEQ ID NO: 1865015 - DNA, 14 bp, Homo sapiens
attgaaagtattca

SEQ ID NO: 1865016 - DNA, 19 bp, Homo sapiens
attgaaagttgcttttatt

SEQ ID NO: 1865017 - DNA, 22 bp, Homo sapiens
attgaaagttgcttttattgca

SEQ ID NO: 1865018 - DNA, 20 bp, Homo sapiens
attgaaatggggcgctggac

SEQ ID NO: 1865019 - DNA, 18 bp, Homo sapiens
attgagaataagaatttg

SEQ ID NO: 1865020 - DNA, 15 bp, Homo sapiens
attgatttgattttt

SEQ ID NO: 1865021 - DNA, 15 bp, Homo sapiens
attgcaccattttca

SEQ ID NO: 1865022 - DNA, 12 bp, Homo sapiens
attgcactaaat

SEQ ID NO: 1865023 - DNA, 19 bp, Homo sapiens
attgcactaaataaactac

SEQ ID NO: 1865024 - DNA, 11 bp, Homo sapiens
attgctaaaag

SEQ ID NO: 1865025 - DNA, 15 bp, Homo sapiens
attgctaaaagtgca

SEQ ID NO: 1865026 - DNA, 16 bp, Homo sapiens
attgctaaaagtgcat

SEQ ID NO: 1865027 - DNA, 18 bp, Homo sapiens
attgctaaaagtgcattt

SEQ ID NO: 1865028 - DNA, 19 bp, Homo sapiens
attgctaaaagtgcattta

SEQ ID NO: 1865029 - DNA, 14 bp, Homo sapiens
attgctcttaaaaa

SEQ ID NO: 1865030 - DNA, 18 bp, Homo sapiens
attgctcttaaaaatctt

SEQ ID NO: 1865031 - DNA, 15 bp, Homo sapiens
attggatttgctgtg

SEQ ID NO: 1865032 - DNA, 16 bp, Homo sapiens
attggcagccaaggaa

SEQ ID NO: 1865033 - DNA, 19 bp, Homo sapiens
attggcagccaaggaatgt

SEQ ID NO: 1865034 - DNA, 18 bp, Homo sapiens
attgggagacaattagca

SEQ ID NO: 1865035 - DNA, 17 bp, Homo sapiens
attggtttaaaagtcac

SEQ ID NO: 1865036 - DNA, 15 bp, Homo sapiens
attgtaaaatagctt

SEQ ID NO: 1865037 - DNA, 22 bp, Homo sapiens
attgtaaaatagcttgtatagt

SEQ ID NO: 1865038 - DNA, 17 bp, Homo sapiens
attgtacagctgtttaa

SEQ ID NO: 1865039 - DNA, 14 bp, Homo sapiens
attgtctgtctgct

SEQ ID NO: 1865040 - DNA, 18 bp, Homo sapiens
attgtctgtctgctctta

SEQ ID NO: 1865041 - DNA, 18 bp, Homo sapiens
attgtgttggctttacaa

SEQ ID NO: 1865042 - DNA, 20 bp, Homo sapiens
attgtgttggctttacaaat

SEQ ID NO: 1865043 - DNA, 15 bp, Homo sapiens
atttaaaaaataact

SEQ ID NO: 1865044 - DNA, 21 bp, Homo sapiens
atttaaagaaacactaaatta

SEQ ID NO: 1865045 - DNA, 16 bp, Homo sapiens
atttaaggagattggg

SEQ ID NO: 1865046 - DNA, 16 bp, Homo sapiens
atttaagtactatctt

SEQ ID NO: 1865047 - DNA, 14 bp, Homo sapiens
atttaatggactgt

SEQ ID NO: 1865048 - DNA, 18 bp, Homo sapiens
atttaatggactgtgaat

SEQ ID NO: 1865049 - DNA, 18 bp, Homo sapiens
atttaccattattttaca

SEQ ID NO: 1865050 - DNA, 19 bp, Homo sapiens
atttaccattattttacag

SEQ ID NO: 1865051 - DNA, 19 bp, Homo sapiens
atttactgctctagaaagt

SEQ ID NO: 1865052 - DNA, 20 bp, Homo sapiens
atttagagcgtttggttaaa

SEQ ID NO: 1865053 - DNA, 16 bp, Homo sapiens
atttagtaccctgcag

SEQ ID NO: 1865054 - DNA, 21 bp, Homo sapiens
atttagttacgtataatgctt

SEQ ID NO: 1865055 - DNA, 18 bp, Homo sapiens
atttataggcagatcttt

SEQ ID NO: 1865056 - DNA, 14 bp, Homo sapiens
atttatagtttgta

SEQ ID NO: 1865057 - DNA, 22 bp, Homo sapiens
atttatagtttgtacatgcatt

SEQ ID NO: 1865058 - DNA, 18 bp, Homo sapiens
atttatatcttgttatta

SEQ ID NO: 1865059 - DNA, 13 bp, Homo sapiens
atttatatcttta

SEQ ID NO: 1865060 - DNA, 14 bp, Homo sapiens
atttatatctttat

SEQ ID NO: 1865061 - DNA, 17 bp, Homo sapiens
atttatatctttatgca

SEQ ID NO: 1865062 - DNA, 12 bp, Homo sapiens
atttatgagatt

SEQ ID NO: 1865063 - DNA, 19 bp, Homo sapiens
atttattaaaatgattgta

SEQ ID NO: 1865064 - DNA, 23 bp, Homo sapiens
atttattaaaatgattgtaaaat

SEQ ID NO: 1865065 - DNA, 19 bp, Homo sapiens
atttattggcagccaagga

SEQ ID NO: 1865066 - DNA, 22 bp, Homo sapiens
atttattggcagccaaggaatg

SEQ ID NO: 1865067 - DNA, 23 bp, Homo sapiens
atttatttctctggcaaactttt

SEQ ID NO: 1865068 - DNA, 17 bp, Homo sapiens
atttcaggaatttaatt

SEQ ID NO: 1865069 - DNA, 17 bp, Homo sapiens
atttcagtattttccag

SEQ ID NO: 1865070 - DNA, 18 bp, Homo sapiens
atttcagtattttccagc

SEQ ID NO: 1865071 - DNA, 18 bp, Homo sapiens
atttccaaaataatctat

SEQ ID NO: 1865072 - DNA, 22 bp, Homo sapiens
atttccaaaataatctatatta

SEQ ID NO: 1865073 - DNA, 13 bp, Homo sapiens
atttccaaataaa

SEQ ID NO: 1865074 - DNA, 17 bp, Homo sapiens
atttcccctaatctttt

SEQ ID NO: 1865075 - DNA, 13 bp, Homo sapiens
atttccttctgtt

SEQ ID NO: 1865076 - DNA, 18 bp, Homo sapiens
atttccttctgttaagaa

SEQ ID NO: 1865077 - DNA, 17 bp, Homo sapiens
atttctagtatctattg

SEQ ID NO: 1865078 - DNA, 19 bp, Homo sapiens
atttctagtatctattgtg

SEQ ID NO: 1865079 - DNA, 21 bp, Homo sapiens
gcacgttttctggcttctgct

SEQ ID NO: 1865080 - DNA, 14 bp, Homo sapiens
gcactaaaatgttt

SEQ ID NO: 1865081 - DNA, 20 bp, Homo sapiens
gcactaaagtatgtaaagta

SEQ ID NO: 1865082 - DNA, 13 bp, Homo sapiens
gcactacatgtgg

SEQ ID NO: 1865083 - DNA, 17 bp, Homo sapiens
gcactctaattagagaa

SEQ ID NO: 1865084 - DNA, 23 bp, Homo sapiens
gcactctaattagagaactggag

SEQ ID NO: 1865085 - DNA, 19 bp, Homo sapiens
gcacttagctatcagaaga

SEQ ID NO: 1865086 - DNA, 19 bp, Homo sapiens
gcacttttattttcattgt

SEQ ID NO: 1865087 - DNA, 16 bp, Homo sapiens
gcagagcttgtagccc

SEQ ID NO: 1865088 - DNA, 19 bp, Homo sapiens
gcagagtggcctgtgagca

SEQ ID NO: 1865089 - DNA, 15 bp, Homo sapiens
gcagatctttaaata

SEQ ID NO: 1865090 - DNA, 16 bp, Homo sapiens
gcagattacaataaat

SEQ ID NO: 1865091 - DNA, 13 bp, Homo sapiens
gcagcccccaaag

SEQ ID NO: 1865092 - DNA, 21 bp, Homo sapiens
gcagcccccaaagagctgtgg

SEQ ID NO: 1865093 - DNA, 22 bp, Homo sapiens
gcagcccccaaagagctgtggc

SEQ ID NO: 1865094 - DNA, 13 bp, Homo sapiens
gcagcccccactg

SEQ ID NO: 1865095 - DNA, 17 bp, Homo sapiens
gcagcccccactgacct

SEQ ID NO: 1865096 - DNA, 20 bp, Homo sapiens
gcagcccccactgacctgcc

SEQ ID NO: 1865097 - DNA, 15 bp, Homo sapiens
gcagccgtgcaggac

SEQ ID NO: 1865098 - DNA, 20 bp, Homo sapiens
gcagccttaaacagtgtcca

SEQ ID NO: 1865099 - DNA, 23 bp, Homo sapiens
gcagctggcactgacagcctggg

SEQ ID NO: 1865100 - DNA, 17 bp, Homo sapiens
gcagcttcctgtctgtt

SEQ ID NO: 1865101 - DNA, 19 bp, Homo sapiens
gcagctttgggaaagctgc

SEQ ID NO: 1865102 - DNA, 13 bp, Homo sapiens
gcaggccaggcca

SEQ ID NO: 1865103 - DNA, 15 bp, Homo sapiens
gcaggccaggccagc

SEQ ID NO: 1865104 - DNA, 17 bp, Homo sapiens
gcaggtcatggagcagc

SEQ ID NO: 1865105 - DNA, 18 bp, Homo sapiens
gcaggtcatggagcagcc

SEQ ID NO: 1865106 - DNA, 21 bp, Homo sapiens
gcaggtcatggagcagccccc

SEQ ID NO: 1865107 - DNA, 15 bp, Homo sapiens
gcagtcttttgctgt

SEQ ID NO: 1865108 - DNA, 15 bp, Homo sapiens
gcatgacaaaaataa

SEQ ID NO: 1865109 - DNA, 18 bp, Homo sapiens
gcatgacaaaaataacac

SEQ ID NO: 1865110 - DNA, 15 bp, Homo sapiens
gcatgggaaaaagag

SEQ ID NO: 1865111 - DNA, 16 bp, Homo sapiens
gcatgtccctccaagg

SEQ ID NO: 1865112 - DNA, 20 bp, Homo sapiens
gcattaactaaatgctcata

SEQ ID NO: 1865113 - DNA, 15 bp, Homo sapiens
gcatttaaggagatt

SEQ ID NO: 1865114 - DNA, 15 bp, Homo sapiens
gcatttatttctctg

SEQ ID NO: 1865115 - DNA, 17 bp, Homo sapiens
gccaagctaatctgcct

SEQ ID NO: 1865116 - DNA, 23 bp, Homo sapiens
gccaagtggccactggcatcgca

SEQ ID NO: 1865117 - DNA, 16 bp, Homo sapiens
gccacaagaaatttga

SEQ ID NO: 1865118 - DNA, 18 bp, Homo sapiens
gccaccagcaatgccctg

SEQ ID NO: 1865119 - DNA, 20 bp, Homo sapiens
gccactggcatcgcagcttc

SEQ ID NO: 1865120 - DNA, 19 bp, Homo sapiens
gccagcccactgggccctg

SEQ ID NO: 1865121 - DNA, 21 bp, Homo sapiens
gccagcccactgggccctggg

SEQ ID NO: 1865122 - DNA, 22 bp, Homo sapiens
gccagcccactgggccctgggg

SEQ ID NO: 1865123 - DNA, 23 bp, Homo sapiens
gccagcccactgggccctggggc

SEQ ID NO: 1865124 - DNA, 18 bp, Homo sapiens
gccagcttcccctcactt

SEQ ID NO: 1865125 - DNA, 21 bp, Homo sapiens
gccaggagaagacccctgccc

SEQ ID NO: 1865126 - DNA, 12 bp, Homo sapiens
gccaggccagct

SEQ ID NO: 1865127 - DNA, 12 bp, Homo sapiens
gccaggctccct

SEQ ID NO: 1865128 - DNA, 14 bp, Homo sapiens
gccaggctccctga

SEQ ID NO: 1865129 - DNA, 18 bp, Homo sapiens
gccaggctccctgaccac

SEQ ID NO: 1865130 - DNA, 22 bp, Homo sapiens
gccaggctccctgaccaccctg

SEQ ID NO: 1865131 - DNA, 23 bp, Homo sapiens
gccaggctccctgaccaccctgc

SEQ ID NO: 1865132 - DNA, 22 bp, Homo sapiens
gccaggggtgtcccagtcccag

SEQ ID NO: 1865133 - DNA, 22 bp, Homo sapiens
gccataaaattgcagtttcatg

SEQ ID NO: 1865134 - DNA, 14 bp, Homo sapiens
gccatatatgctgt

SEQ ID NO: 1865135 - DNA, 18 bp, Homo sapiens
gccatattctaaattcac

SEQ ID NO: 1865136 - DNA, 16 bp, Homo sapiens
gccatgctttttggtg

SEQ ID NO: 1865137 - DNA, 21 bp, Homo sapiens
gccattcctgttctctttgcc

SEQ ID NO: 1865138 - DNA, 20 bp, Homo sapiens
gccatttgctgccctggggc

SEQ ID NO: 1865139 - DNA, 19 bp, Homo sapiens
gcccaagtggctcttggga

SEQ ID NO: 1865140 - DNA, 20 bp, Homo sapiens
gcccaagtggctcttgggac

SEQ ID NO: 1865141 - DNA, 21 bp, Homo sapiens
gcccaagtggctcttgggaca

SEQ ID NO: 1865142 - DNA, 14 bp, Homo sapiens
gcccactcccccag

SEQ ID NO: 1865143 - DNA, 19 bp, Homo sapiens
gcccactcccccaggagca

SEQ ID NO: 1865144 - DNA, 21 bp, Homo sapiens
gcccactcccccaggagcagc

SEQ ID NO: 1865145 - DNA, 11 bp, Homo sapiens
gcccactgggc

SEQ ID NO: 1865146 - DNA, 14 bp, Homo sapiens
gcccactgggccct

SEQ ID NO: 1865147 - DNA, 17 bp, Homo sapiens
gcccagaagaactttgc

SEQ ID NO: 1865148 - DNA, 15 bp, Homo sapiens
gcccagggcctctgg

SEQ ID NO: 1865149 - DNA, 16 bp, Homo sapiens
gcccagggcctctggc

SEQ ID NO: 1865150 - DNA, 17 bp, Homo sapiens
gcccccaaagagctgtg

SEQ ID NO: 1865151 - DNA, 20 bp, Homo sapiens
gcccccactgacctgcccat

SEQ ID NO: 1865152 - DNA, 24 bp, Homo sapiens
gcccccactgacctgcccatgtcc

SEQ ID NO: 1865153 - DNA, 19 bp, Homo sapiens
gcccctccccaaaagaaac

SEQ ID NO: 1865154 - DNA, 16 bp, Homo sapiens
gccctggatggcctct

SEQ ID NO: 1865155 - DNA, 17 bp, Homo sapiens
gccctggatggcctctg

SEQ ID NO: 1865156 - DNA, 20 bp, Homo sapiens
gccctggatggcctctgggg

SEQ ID NO: 1865157 - DNA, 14 bp, Homo sapiens
gccctggggctgcc

SEQ ID NO: 1865158 - DNA, 18 bp, Homo sapiens
gccgcagcccccactgac

SEQ ID NO: 1865159 - DNA, 19 bp, Homo sapiens
gccgcagcccccactgacc

SEQ ID NO: 1865160 - DNA, 14 bp, Homo sapiens
gccgggcccagggc

SEQ ID NO: 1865161 - DNA, 15 bp, Homo sapiens
gccgggcccagggcc

SEQ ID NO: 1865162 - DNA, 16 bp, Homo sapiens
gccgtgcaggactcta

SEQ ID NO: 1865163 - DNA, 18 bp, Homo sapiens
gcctccagaaccttactg

SEQ ID NO: 1865164 - DNA, 22 bp, Homo sapiens
gcctccagaaccttactggcac

SEQ ID NO: 1865165 - DNA, 15 bp, Homo sapiens
gcctcccttttctcc

SEQ ID NO: 1865166 - DNA, 14 bp, Homo sapiens
gcctccttttggtt

SEQ ID NO: 1865167 - DNA, 16 bp, Homo sapiens
gcctctggcttccctg

SEQ ID NO: 1865168 - DNA, 20 bp, Homo sapiens
gcctctggggcaggaccact

SEQ ID NO: 1865169 - DNA, 14 bp, Homo sapiens
gcctgtgagcaaga

SEQ ID NO: 1865170 - DNA, 19 bp, Homo sapiens
gcctgtggaggtgacctgt

SEQ ID NO: 1865171 - DNA, 13 bp, Homo sapiens
gccttaagtttcc

SEQ ID NO: 1865172 - DNA, 13 bp, Homo sapiens
gccttatgtgtta

SEQ ID NO: 1865173 - DNA, 16 bp, Homo sapiens
gccttatgtgttacat

SEQ ID NO: 1865174 - DNA, 23 bp, Homo sapiens
gccttatgtgttacattattcca

SEQ ID NO: 1865175 - DNA, 12 bp, Homo sapiens
gccttgctgcct

SEQ ID NO: 1865176 - DNA, 21 bp, Homo sapiens
gccttgctgccttcaccctga

SEQ ID NO: 1865177 - DNA, 11 bp, Homo sapiens
gcgctggacac

SEQ ID NO: 1865178 - DNA, 21 bp, Homo sapiens
gcgctggacacctacagcagc

SEQ ID NO: 1865179 - DNA, 23 bp, Homo sapiens
gcgctggacacctacagcagcac

SEQ ID NO: 1865180 - DNA, 14 bp, Homo sapiens
gcgcttcccacctg

SEQ ID NO: 1865181 - DNA, 15 bp, Homo sapiens
gcgcttcccacctgc

SEQ ID NO: 1865182 - DNA, 15 bp, Homo sapiens
gcgggccaggcaggc

SEQ ID NO: 1865183 - DNA, 18 bp, Homo sapiens
gctaaaagtgcatttaag

SEQ ID NO: 1865184 - DNA, 20 bp, Homo sapiens
gctaaagggagaaatgccag

SEQ ID NO: 1865185 - DNA, 14 bp, Homo sapiens
gctaagcaagccag

SEQ ID NO: 1865186 - DNA, 13 bp, Homo sapiens
gctaatctgcctg

SEQ ID NO: 1865187 - DNA, 23 bp, Homo sapiens
gctaatctgcctggttttattta

SEQ ID NO: 1865188 - DNA, 13 bp, Homo sapiens
gctacctttttat

SEQ ID NO: 1865189 - DNA, 19 bp, Homo sapiens
gctactgcagctttacatg

SEQ ID NO: 1865190 - DNA, 14 bp, Homo sapiens
gctacttatcattt

SEQ ID NO: 1865191 - DNA, 20 bp, Homo sapiens
gctacttatcatttttgtat

SEQ ID NO: 1865192 - DNA, 15 bp, Homo sapiens
gctagaatttctggt

SEQ ID NO: 1865193 - DNA, 13 bp, Homo sapiens
gctagtgccaaat

SEQ ID NO: 1865194 - DNA, 19 bp, Homo sapiens
gctcattaaactgattcca

SEQ ID NO: 1865195 - DNA, 13 bp, Homo sapiens
gctccctgaccac

SEQ ID NO: 1865196 - DNA, 17 bp, Homo sapiens
gctccctgaccaccctg

SEQ ID NO: 1865197 - DNA, 23 bp, Homo sapiens
gctccctgaccaccctgcctgtg

SEQ ID NO: 1865198 - DNA, 21 bp, Homo sapiens
gctcgtccacggtcttctgca

SEQ ID NO: 1865199 - DNA, 14 bp, Homo sapiens
gctctccccctgca

SEQ ID NO: 1865200 - DNA, 18 bp, Homo sapiens
gctctccccctgcagccg

SEQ ID NO: 1865201 - DNA, 17 bp, Homo sapiens
gctctgacccagtgaga

SEQ ID NO: 1865202 - DNA, 13 bp, Homo sapiens
gctcttgggacaa

SEQ ID NO: 1865203 - DNA, 22 bp, Homo sapiens
gctcttgggacaacgtgctgct

SEQ ID NO: 1865204 - DNA, 15 bp, Homo sapiens
gctgaggttttgaat

SEQ ID NO: 1865205 - DNA, 23 bp, Homo sapiens
gctgatggataacctatatgatt

SEQ ID NO: 1865206 - DNA, 13 bp, Homo sapiens
gctgcagctttgg

SEQ ID NO: 1865207 - DNA, 14 bp, Homo sapiens
gctgccctggggca

SEQ ID NO: 1865208 - DNA, 23 bp, Homo sapiens
gctgccctggggcatcatgggca

SEQ ID NO: 1865209 - DNA, 18 bp, Homo sapiens
gctgccttcaccctgaac

SEQ ID NO: 1865210 - DNA, 20 bp, Homo sapiens
gctggacacctacagcagca

SEQ ID NO: 1865211 - DNA, 21 bp, Homo sapiens
gctggacacctacagcagcac

SEQ ID NO: 1865212 - DNA, 18 bp, Homo sapiens
gctggagactatttaagt

SEQ ID NO: 1865213 - DNA, 15 bp, Homo sapiens
gctggagggggcaga

SEQ ID NO: 1865214 - DNA, 13 bp, Homo sapiens
gctggcactgaca

SEQ ID NO: 1865215 - DNA, 16 bp, Homo sapiens
gctggcactgacagcc

SEQ ID NO: 1865216 - DNA, 18 bp, Homo sapiens
gctggcactgacagcctg

SEQ ID NO: 1865217 - DNA, 19 bp, Homo sapiens
gctggcactgacagcctgg

SEQ ID NO: 1865218 - DNA, 23 bp, Homo sapiens
cctccaaggctgtcttctcccag

SEQ ID NO: 1865219 - DNA, 22 bp, Homo sapiens
cctcctgggcatgtttgtctgt

SEQ ID NO: 1865220 - DNA, 19 bp, Homo sapiens
cctcctgtgcctccctttt

SEQ ID NO: 1865221 - DNA, 21 bp, Homo sapiens
cctcgggatgaaaagccatat

SEQ ID NO: 1865222 - DNA, 22 bp, Homo sapiens
cctctagctgttcttttttgta

SEQ ID NO: 1865223 - DNA, 20 bp, Homo sapiens
cctctccccaatccatgctt

SEQ ID NO: 1865224 - DNA, 21 bp, Homo sapiens
cctctccccaatccatgcttc

SEQ ID NO: 1865225 - DNA, 23 bp, Homo sapiens
cctctccccaatccatgcttcac

SEQ ID NO: 1865226 - DNA, 12 bp, Homo sapiens
cctctggcttcc

SEQ ID NO: 1865227 - DNA, 15 bp, Homo sapiens
cctctggggcagagc

SEQ ID NO: 1865228 - DNA, 16 bp, Homo sapiens
cctctggggcagagct

SEQ ID NO: 1865229 - DNA, 20 bp, Homo sapiens
cctcttcggttgtcttgaaa

SEQ ID NO: 1865230 - DNA, 22 bp, Homo sapiens
cctgaacatttagtaccctgca

SEQ ID NO: 1865231 - DNA, 19 bp, Homo sapiens
cctgaccaccctgcctgtg

SEQ ID NO: 1865232 - DNA, 22 bp, Homo sapiens
cctgattaccagtctgattata

SEQ ID NO: 1865233 - DNA, 12 bp, Homo sapiens
cctgcagccgtg

SEQ ID NO: 1865234 - DNA, 13 bp, Homo sapiens
cctgcccaagtgg

SEQ ID NO: 1865235 - DNA, 20 bp, Homo sapiens
cctgcccaagtggctcttgg

SEQ ID NO: 1865236 - DNA, 21 bp, Homo sapiens
cctgcccaatcctccctggag

SEQ ID NO: 1865237 - DNA, 22 bp, Homo sapiens
cctgcccaatcctccctggaga

SEQ ID NO: 1865238 - DNA, 17 bp, Homo sapiens
cctgctcattgtggcca

SEQ ID NO: 1865239 - DNA, 17 bp, Homo sapiens
cctgctgggtaaactgt

SEQ ID NO: 1865240 - DNA, 21 bp, Homo sapiens
cctggaaccggtcacaggaac

SEQ ID NO: 1865241 - DNA, 14 bp, Homo sapiens
cctggatggcctct

SEQ ID NO: 1865242 - DNA, 16 bp, Homo sapiens
cctggatggcctctgg

SEQ ID NO: 1865243 - DNA, 19 bp, Homo sapiens
cctggatggcctctggggc

SEQ ID NO: 1865244 - DNA, 20 bp, Homo sapiens
cctggatggcctctggggca

SEQ ID NO: 1865245 - DNA, 15 bp, Homo sapiens
cctgggcagtgagtg

SEQ ID NO: 1865246 - DNA, 16 bp, Homo sapiens
cctgggccaaggactc

SEQ ID NO: 1865247 - DNA, 18 bp, Homo sapiens
cctggggcatcatgggca

SEQ ID NO: 1865248 - DNA, 18 bp, Homo sapiens
cctggggctgccctcggc

SEQ ID NO: 1865249 - DNA, 15 bp, Homo sapiens
cctgggggggccgct

SEQ ID NO: 1865250 - DNA, 13 bp, Homo sapiens
cctggttttattt

SEQ ID NO: 1865251 - DNA, 16 bp, Homo sapiens
cctggttttatttata

SEQ ID NO: 1865252 - DNA, 15 bp, Homo sapiens
cctgtgagcaagagc

SEQ ID NO: 1865253 - DNA, 20 bp, Homo sapiens
cctgtgagcaagagccaggg

SEQ ID NO: 1865254 - DNA, 18 bp, Homo sapiens
cctgtgcctcccttttct

SEQ ID NO: 1865255 - DNA, 14 bp, Homo sapiens
cctgtgtctatgta

SEQ ID NO: 1865256 - DNA, 22 bp, Homo sapiens
ccttaaaggcaccatctaatag

SEQ ID NO: 1865257 - DNA, 18 bp, Homo sapiens
ccttaagcacaattaatt

SEQ ID NO: 1865258 - DNA, 14 bp, Homo sapiens
ccttactggcactg

SEQ ID NO: 1865259 - DNA, 18 bp, Homo sapiens
ccttatgtgttacattat

SEQ ID NO: 1865260 - DNA, 12 bp, Homo sapiens
ccttcaccctga

SEQ ID NO: 1865261 - DNA, 19 bp, Homo sapiens
ccttccgacaccactggga

SEQ ID NO: 1865262 - DNA, 16 bp, Homo sapiens
ccttctcctgcccttt

SEQ ID NO: 1865263 - DNA, 13 bp, Homo sapiens
ccttgacttttta

SEQ ID NO: 1865264 - DNA, 11 bp, Homo sapiens
ccttgctgcct

SEQ ID NO: 1865265 - DNA, 20 bp, Homo sapiens
ccttggagtgctgcagcttt

SEQ ID NO: 1865266 - DNA, 21 bp, Homo sapiens
ccttgggcgcttcccacctgc

SEQ ID NO: 1865267 - DNA, 13 bp, Homo sapiens
cctttctgtgtgc

SEQ ID NO: 1865268 - DNA, 11 bp, Homo sapiens
cctttgtatta

SEQ ID NO: 1865269 - DNA, 15 bp, Homo sapiens
cctttgtattataat

SEQ ID NO: 1865270 - DNA, 11 bp, Homo sapiens
ccttttatagc

SEQ ID NO: 1865271 - DNA, 23 bp, Homo sapiens
ccttttgaagtagtttgtataac

SEQ ID NO: 1865272 - DNA, 15 bp, Homo sapiens
cctttttaaaaaata

SEQ ID NO: 1865273 - DNA, 23 bp, Homo sapiens
cgaaacccccttttcccttcagc

SEQ ID NO: 1865274 - DNA, 14 bp, Homo sapiens
cgacaccactggga

SEQ ID NO: 1865275 - DNA, 23 bp, Homo sapiens
cgacaccactgggaaccaagggc

SEQ ID NO: 1865276 - DNA, 22 bp, Homo sapiens
cgagcactctaattagagaact

SEQ ID NO: 1865277 - DNA, 19 bp, Homo sapiens
cgaggaagcagcaattaat

SEQ ID NO: 1865278 - DNA, 20 bp, Homo sapiens
cgaggaagcagcaattaatt

SEQ ID NO: 1865279 - DNA, 16 bp, Homo sapiens
cgcagcccccactgac

SEQ ID NO: 1865280 - DNA, 12 bp, Homo sapiens
cgcatgtccctc

SEQ ID NO: 1865281 - DNA, 15 bp, Homo sapiens
cgcatgtccctccaa

SEQ ID NO: 1865282 - DNA, 18 bp, Homo sapiens
cgcatgtccctccaaggc

SEQ ID NO: 1865283 - DNA, 18 bp, Homo sapiens
cgctctccccctgcagcc

SEQ ID NO: 1865284 - DNA, 17 bp, Homo sapiens
cgctggacacctacagc

SEQ ID NO: 1865285 - DNA, 21 bp, Homo sapiens
cgctggacacctacagcagca

SEQ ID NO: 1865286 - DNA, 23 bp, Homo sapiens
cgctgggacggcccatcttggca

SEQ ID NO: 1865287 - DNA, 19 bp, Homo sapiens
cgcttagttcttgaattgt

SEQ ID NO: 1865288 - DNA, 14 bp, Homo sapiens
cgcttgttttaaaa

SEQ ID NO: 1865289 - DNA, 15 bp, Homo sapiens
cggccaggctccctg

SEQ ID NO: 1865290 - DNA, 13 bp, Homo sapiens
cggccgcagcccc

SEQ ID NO: 1865291 - DNA, 11 bp, Homo sapiens
cggctgtgagg

SEQ ID NO: 1865292 - DNA, 17 bp, Homo sapiens
cgggatgaaaagccata

SEQ ID NO: 1865293 - DNA, 12 bp, Homo sapiens
cgggccaggcag

SEQ ID NO: 1865294 - DNA, 13 bp, Homo sapiens
cgggcccagggcc

SEQ ID NO: 1865295 - DNA, 19 bp, Homo sapiens
cggtgtctgcagctcctgg

SEQ ID NO: 1865296 - DNA, 13 bp, Homo sapiens
cgtataatgcttt

SEQ ID NO: 1865297 - DNA, 14 bp, Homo sapiens
cgtataatgctttc

SEQ ID NO: 1865298 - DNA, 13 bp, Homo sapiens
cgtatagtcaata

SEQ ID NO: 1865299 - DNA, 19 bp, Homo sapiens
cgtgacagcctctgactca

SEQ ID NO: 1865300 - DNA, 18 bp, Homo sapiens
cgttagcgtccatttctt

SEQ ID NO: 1865301 - DNA, 14 bp, Homo sapiens
cgttttgtattgct

SEQ ID NO: 1865302 - DNA, 18 bp, Homo sapiens
cgttttgtattgcttcct

SEQ ID NO: 1865303 - DNA, 13 bp, Homo sapiens
ctaaaagaagaga

SEQ ID NO: 1865304 - DNA, 14 bp, Homo sapiens
ctaaaagaagagag

SEQ ID NO: 1865305 - DNA, 15 bp, Homo sapiens
ctaaaagaagagagg

SEQ ID NO: 1865306 - DNA, 14 bp, Homo sapiens
ctaaaagtgcattt

SEQ ID NO: 1865307 - DNA, 17 bp, Homo sapiens
ctaaaagtgcatttaag

SEQ ID NO: 1865308 - DNA, 21 bp, Homo sapiens
ctaaaagtgcatttaaggaga

SEQ ID NO: 1865309 - DNA, 19 bp, Homo sapiens
ctaaagggagaaatgccag

SEQ ID NO: 1865310 - DNA, 15 bp, Homo sapiens
ctaaattagtttaaa

SEQ ID NO: 1865311 - DNA, 17 bp, Homo sapiens
ctaaattagtttaaaat

SEQ ID NO: 1865312 - DNA, 19 bp, Homo sapiens
ctaaattagtttaaaatga

SEQ ID NO: 1865313 - DNA, 23 bp, Homo sapiens
ctaacaatatgattgcactaaat

SEQ ID NO: 1865314 - DNA, 16 bp, Homo sapiens
ctaacgaacgttttaa

SEQ ID NO: 1865315 - DNA, 18 bp, Homo sapiens
ctaacgaacgttttaaag

SEQ ID NO: 1865316 - DNA, 21 bp, Homo sapiens
ctaactgactctgttattgat

SEQ ID NO: 1865317 - DNA, 18 bp, Homo sapiens
ctaagcaagccaggagaa

SEQ ID NO: 1865318 - DNA, 20 bp, Homo sapiens
ctaagcaagccaggagaaga

SEQ ID NO: 1865319 - DNA, 23 bp, Homo sapiens
ctaatagcgggttactttcacat

SEQ ID NO: 1865320 - DNA, 13 bp, Homo sapiens
ctaatatactttt

SEQ ID NO: 1865321 - DNA, 11 bp, Homo sapiens
ctaatatattt

SEQ ID NO: 1865322 - DNA, 12 bp, Homo sapiens
ctaatatatttt

SEQ ID NO: 1865323 - DNA, 15 bp, Homo sapiens
ctaatatatttttat

SEQ ID NO: 1865324 - DNA, 13 bp, Homo sapiens
ctaatatggcaaa

SEQ ID NO: 1865325 - DNA, 16 bp, Homo sapiens
ctaatattaaaaatat

SEQ ID NO: 1865326 - DNA, 11 bp, Homo sapiens
ctaatctgcct

SEQ ID NO: 1865327 - DNA, 16 bp, Homo sapiens
ctacaacaagagttta

SEQ ID NO: 1865328 - DNA, 13 bp, Homo sapiens
ctacaggactggg

SEQ ID NO: 1865329 - DNA, 23 bp, Homo sapiens
ctacaggactgggccgggcccag

SEQ ID NO: 1865330 - DNA, 13 bp, Homo sapiens
ctacatctgcctc

SEQ ID NO: 1865331 - DNA, 13 bp, Homo sapiens
ctacattaaacaa

SEQ ID NO: 1865332 - DNA, 20 bp, Homo sapiens
ctacattaaacaatgatcac

SEQ ID NO: 1865333 - DNA, 16 bp, Homo sapiens
ctactcattttaatga

SEQ ID NO: 1865334 - DNA, 14 bp, Homo sapiens
ctactgcagcttta

SEQ ID NO: 1865335 - DNA, 21 bp, Homo sapiens
aaaaagtgaacttttgtaatt

SEQ ID NO: 1865336 - DNA, 22 bp, Homo sapiens
aaaaagtgaacttttgtaattt

SEQ ID NO: 1865337 - DNA, 15 bp, Homo sapiens
aaaaataacactgtt

SEQ ID NO: 1865338 - DNA, 12 bp, Homo sapiens
aaaaataagttt

SEQ ID NO: 1865339 - DNA, 22 bp, Homo sapiens
aaaaataccattgaaatcagca

SEQ ID NO: 1865340 - DNA, 14 bp, Homo sapiens
aaaaatattgctaa

SEQ ID NO: 1865341 - DNA, 19 bp, Homo sapiens
aaaaatattgctaaaagtg

SEQ ID NO: 1865342 - DNA, 23 bp, Homo sapiens
aaaaatattttaagaaagagaat

SEQ ID NO: 1865343 - DNA, 14 bp, Homo sapiens
aaaaatcttggttt

SEQ ID NO: 1865344 - DNA, 20 bp, Homo sapiens
aaaaatcttggtttggtaca

SEQ ID NO: 1865345 - DNA, 22 bp, Homo sapiens
aaaaatgcccatttttgctaat

SEQ ID NO: 1865346 - DNA, 21 bp, Homo sapiens
aaaaattacagatcatataag

SEQ ID NO: 1865347 - DNA, 15 bp, Homo sapiens
aaaacctgtttttaa

SEQ ID NO: 1865348 - DNA, 22 bp, Homo sapiens
aaaacctgtttttaacatgtga

SEQ ID NO: 1865349 - DNA, 10 bp, Homo sapiens
aaaactgaag

SEQ ID NO: 1865350 - DNA, 19 bp, Homo sapiens
aaaactgtgtatcattaaa

SEQ ID NO: 1865351 - DNA, 20 bp, Homo sapiens
aaaactgtgtatcattaaaa

SEQ ID NO: 1865352 - DNA, 21 bp, Homo sapiens
aaaactgtgtatcattaaaat

SEQ ID NO: 1865353 - DNA, 23 bp, Homo sapiens
aaaactgtgtatcattaaaatat

SEQ ID NO: 1865354 - DNA, 13 bp, Homo sapiens
actacatctgcct

SEQ ID NO: 1865355 - DNA, 15 bp, Homo sapiens
actacatgtggttta

SEQ ID NO: 1865356 - DNA, 19 bp, Homo sapiens
actacatgtggtttataga

SEQ ID NO: 1865357 - DNA, 13 bp, Homo sapiens
actatctttgtct

SEQ ID NO: 1865358 - DNA, 22 bp, Homo sapiens
actatgttttatcgtccagtga

SEQ ID NO: 1865359 - DNA, 14 bp, Homo sapiens
actatttaagtact

SEQ ID NO: 1865360 - DNA, 16 bp, Homo sapiens
actatttaagtactat

SEQ ID NO: 1865361 - DNA, 18 bp, Homo sapiens
actatttgtctttcagga

SEQ ID NO: 1865362 - DNA, 15 bp, Homo sapiens
actcaaaacttaaca

SEQ ID NO: 1865363 - DNA, 19 bp, Homo sapiens
actcagaggacccacctgg

SEQ ID NO: 1865364 - DNA, 18 bp, Homo sapiens
actcaggaaccctggaga

SEQ ID NO: 1865365 - DNA, 16 bp, Homo sapiens
actcagtgaaatcata

SEQ ID NO: 1865366 - DNA, 20 bp, Homo sapiens
actcagtgaaatcatattaa

SEQ ID NO: 1865367 - DNA, 21 bp, Homo sapiens
actcatagattgcaaatattg

SEQ ID NO: 1865368 - DNA, 17 bp, Homo sapiens
actcatgcaaactgctt

SEQ ID NO: 1865369 - DNA, 18 bp, Homo sapiens
actcatgcaaactgcttt

SEQ ID NO: 1865370 - DNA, 20 bp, Homo sapiens
actccaggtgtggaccggcc

SEQ ID NO: 1865371 - DNA, 13 bp, Homo sapiens
actcccccaggag

SEQ ID NO: 1865372 - DNA, 16 bp, Homo sapiens
actcccccaggagcag

SEQ ID NO: 1865373 - DNA, 14 bp, Homo sapiens
actcccttctgtag

SEQ ID NO: 1865374 - DNA, 18 bp, Homo sapiens
actcgtgacagcctctga

SEQ ID NO: 1865375 - DNA, 20 bp, Homo sapiens
actcgtgacagcctctgact

SEQ ID NO: 1865376 - DNA, 12 bp, Homo sapiens
actctaaagatt

SEQ ID NO: 1865377 - DNA, 22 bp, Homo sapiens
actctgaataagcactttttaa

SEQ ID NO: 1865378 - DNA, 16 bp, Homo sapiens
actcttaaatcatttg

SEQ ID NO: 1865379 - DNA, 17 bp, Homo sapiens
actcttaaatcatttgg

SEQ ID NO: 1865380 - DNA, 16 bp, Homo sapiens
actgaaaatctaatat

SEQ ID NO: 1865381 - DNA, 23 bp, Homo sapiens
actgaaaatctaatattaaaaat

SEQ ID NO: 1865382 - DNA, 21 bp, Homo sapiens
actgaaggttttttttttaag

SEQ ID NO: 1865383 - DNA, 14 bp, Homo sapiens
actgacctgcccat

SEQ ID NO: 1865384 - DNA, 19 bp, Homo sapiens
actgagtccatgaaaatac

SEQ ID NO: 1865385 - DNA, 19 bp, Homo sapiens
actgatgcaatgtatggct

SEQ ID NO: 1865386 - DNA, 15 bp, Homo sapiens
actgatttttgtgat

SEQ ID NO: 1865387 - DNA, 22 bp, Homo sapiens
actgcaagcatttttccatctg

SEQ ID NO: 1865388 - DNA, 15 bp, Homo sapiens
actgcggtgtctgca

SEQ ID NO: 1865389 - DNA, 18 bp, Homo sapiens
actgcggtgtctgcagct

SEQ ID NO: 1865390 - DNA, 16 bp, Homo sapiens
actgcttctctttgtg

SEQ ID NO: 1865391 - DNA, 15 bp, Homo sapiens
actggacagccaggg

SEQ ID NO: 1865392 - DNA, 16 bp, Homo sapiens
actggacagccagggc

SEQ ID NO: 1865393 - DNA, 14 bp, Homo sapiens
actggcactgtggc

SEQ ID NO: 1865394 - DNA, 15 bp, Homo sapiens
actggcactgtggca

SEQ ID NO: 1865395 - DNA, 17 bp, Homo sapiens
actggcactgtggcact

SEQ ID NO: 1865396 - DNA, 12 bp, Homo sapiens
actgggccctgg

SEQ ID NO: 1865397 - DNA, 22 bp, Homo sapiens
actgggccctggggctgccctc

SEQ ID NO: 1865398 - DNA, 19 bp, Homo sapiens
actgggccgggcccagggc

SEQ ID NO: 1865399 - DNA, 20 bp, Homo sapiens
actgggccgggcccagggcc

SEQ ID NO: 1865400 - DNA, 15 bp, Homo sapiens
actggtatacacact

SEQ ID NO: 1865401 - DNA, 14 bp, Homo sapiens
actggtcctgtgtg

SEQ ID NO: 1865402 - DNA, 19 bp, Homo sapiens
actggtttgtttgcttaat

SEQ ID NO: 1865403 - DNA, 16 bp, Homo sapiens
actgtaaaagttataa

SEQ ID NO: 1865404 - DNA, 15 bp, Homo sapiens
actgtatttcagtat

SEQ ID NO: 1865405 - DNA, 13 bp, Homo sapiens
actgtctggtttt

SEQ ID NO: 1865406 - DNA, 17 bp, Homo sapiens
actgtctggttttaaca

SEQ ID NO: 1865407 - DNA, 14 bp, Homo sapiens
actgtgaatttcaa

SEQ ID NO: 1865408 - DNA, 15 bp, Homo sapiens
actgtgaatttcaaa

SEQ ID NO: 1865409 - DNA, 16 bp, Homo sapiens
actgtggaatttattg

SEQ ID NO: 1865410 - DNA, 17 bp, Homo sapiens
actgtggcactgccacc

SEQ ID NO: 1865411 - DNA, 23 bp, Homo sapiens
actgtggccatatatgctgtatt

SEQ ID NO: 1865412 - DNA, 17 bp, Homo sapiens
actgtgtatcattaaaa

SEQ ID NO: 1865413 - DNA, 20 bp, Homo sapiens
actgtgtatcattaaaatat

SEQ ID NO: 1865414 - DNA, 13 bp, Homo sapiens
actgttgaaaatt

SEQ ID NO: 1865415 - DNA, 14 bp, Homo sapiens
actgttgaaaatta

SEQ ID NO: 1865416 - DNA, 17 bp, Homo sapiens
actgttggcacttatag

SEQ ID NO: 1865417 - DNA, 20 bp, Homo sapiens
acttacaaaagcagctttta

SEQ ID NO: 1865418 - DNA, 20 bp, Homo sapiens
acttacaagtggtgaccaaa

SEQ ID NO: 1865419 - DNA, 17 bp, Homo sapiens
acttagaatgccataaa

SEQ ID NO: 1865420 - DNA, 16 bp, Homo sapiens
acttagctatcagaag

SEQ ID NO: 1865421 - DNA, 23 bp, Homo sapiens
acttataggtaacgtgattgatt

SEQ ID NO: 1865422 - DNA, 23 bp, Homo sapiens
acttatcatttttgtataaaaag

SEQ ID NO: 1865423 - DNA, 23 bp, Homo sapiens
acttctaagttgagtatattata

SEQ ID NO: 1865424 - DNA, 11 bp, Homo sapiens
acttctaatat

SEQ ID NO: 1865425 - DNA, 22 bp, Homo sapiens
acttctaatatatttttatatt

SEQ ID NO: 1865426 - DNA, 20 bp, Homo sapiens
acttgcggccacagcactag

SEQ ID NO: 1865427 - DNA, 21 bp, Homo sapiens
acttgcggccacagcactaga

SEQ ID NO: 1865428 - DNA, 14 bp, Homo sapiens
actttaaaaggcaa

SEQ ID NO: 1865429 - DNA, 18 bp, Homo sapiens
actttctgtaaactcaaa

SEQ ID NO: 1865430 - DNA, 19 bp, Homo sapiens
actttctgtaaactcaaaa

SEQ ID NO: 1865431 - DNA, 14 bp, Homo sapiens
agcaacctttccct

SEQ ID NO: 1865432 - DNA, 12 bp, Homo sapiens
agcaagagccag

SEQ ID NO: 1865433 - DNA, 12 bp, Homo sapiens
agcaagccagga

SEQ ID NO: 1865434 - DNA, 14 bp, Homo sapiens
agcaagccaggaga

SEQ ID NO: 1865435 - DNA, 13 bp, Homo sapiens
agcaatgccctgc

SEQ ID NO: 1865436 - DNA, 14 bp, Homo sapiens
agcaatgccctgcc

SEQ ID NO: 1865437 - DNA, 23 bp, Homo sapiens
agcaatgccctgccttgctgcct

SEQ ID NO: 1865438 - DNA, 21 bp, Homo sapiens
agcaatttatatctttatgca

SEQ ID NO: 1865439 - DNA, 17 bp, Homo sapiens
agcacaagaaggccagc

SEQ ID NO: 1865440 - DNA, 19 bp, Homo sapiens
agcacaagaaggccagccc

SEQ ID NO: 1865441 - DNA, 21 bp, Homo sapiens
agcacaagaaggccagcccac

SEQ ID NO: 1865442 - DNA, 24 bp, Homo sapiens
agcacaagaaggccagcccactgg

SEQ ID NO: 1865443 - DNA, 15 bp, Homo sapiens
agcacaattaattaa

SEQ ID NO: 1865444 - DNA, 16 bp, Homo sapiens
agcacgcatgtccctc

SEQ ID NO: 1865445 - DNA, 21 bp, Homo sapiens
agcacgcatgtccctccaagg

SEQ ID NO: 1865446 - DNA, 16 bp, Homo sapiens
agcacgttggcgagga

SEQ ID NO: 1865447 - DNA, 20 bp, Homo sapiens
agcacgttggcgaggaaaaa

SEQ ID NO: 1865448 - DNA, 13 bp, Homo sapiens
agcacgttttctg

SEQ ID NO: 1865449 - DNA, 15 bp, Homo sapiens
agcacgttttctggc

SEQ ID NO: 1865450 - DNA, 20 bp, Homo sapiens
agcactctaattagagaact

SEQ ID NO: 1865451 - DNA, 17 bp, Homo sapiens
agcacttctaagttgag

SEQ ID NO: 1865452 - DNA, 20 bp, Homo sapiens
agcacttctaagttgagtat

SEQ ID NO: 1865453 - DNA, 19 bp, Homo sapiens
agcagctggcactgacagc

SEQ ID NO: 1865454 - DNA, 23 bp, Homo sapiens
agcagctggcactgacagcctgg

SEQ ID NO: 1865455 - DNA, 15 bp, Homo sapiens
agcagtctgaaggat

SEQ ID NO: 1865456 - DNA, 23 bp, Homo sapiens
agcagttaatcacccaccatagg

SEQ ID NO: 1865457 - DNA, 15 bp, Homo sapiens
agcatcttttcctcc

SEQ ID NO: 1865458 - DNA, 21 bp, Homo sapiens
agcatgacaaaaataacactg

SEQ ID NO: 1865459 - DNA, 19 bp, Homo sapiens
agcatgggaaaaagagact

SEQ ID NO: 1865460 - DNA, 20 bp, Homo sapiens
agcatgggaaaaagagactc

SEQ ID NO: 1865461 - DNA, 21 bp, Homo sapiens
agcattaactaaatgctcata

SEQ ID NO: 1865462 - DNA, 13 bp, Homo sapiens
agcatttatttct

SEQ ID NO: 1865463 - DNA, 22 bp, Homo sapiens
agcatttatttctctggcaaac

SEQ ID NO: 1865464 - DNA, 18 bp, Homo sapiens
agcatttttgatttatgc

SEQ ID NO: 1865465 - DNA, 17 bp, Homo sapiens
agccaaggaatgtgtcc

SEQ ID NO: 1865466 - DNA, 18 bp, Homo sapiens
agccaaggaatgtgtcca

SEQ ID NO: 1865467 - DNA, 19 bp, Homo sapiens
agccacaagaaatttgatt

SEQ ID NO: 1865468 - DNA, 16 bp, Homo sapiens
agccagggcagggctt

SEQ ID NO: 1865469 - DNA, 11 bp, Homo sapiens
agccatatcta

SEQ ID NO: 1865470 - DNA, 17 bp, Homo sapiens
agccatattctaaattc

SEQ ID NO: 1865471 - DNA, 19 bp, Homo sapiens
agccatattctaaattcac

SEQ ID NO: 1865472 - DNA, 12 bp, Homo sapiens
agcccactgggc

SEQ ID NO: 1865473 - DNA, 17 bp, Homo sapiens
agcccactgggccctgg

SEQ ID NO: 1865474 - DNA, 19 bp, Homo sapiens
agcccccaaagagctgtgg

SEQ ID NO: 1865475 - DNA, 20 bp, Homo sapiens
agcccccaaagagctgtggc

SEQ ID NO: 1865476 - DNA, 21 bp, Homo sapiens
agcccccactgacctgcccat

SEQ ID NO: 1865477 - DNA, 16 bp, Homo sapiens
agccctggatggcctc

SEQ ID NO: 1865478 - DNA, 18 bp, Homo sapiens
agccctggatggcctctg

SEQ ID NO: 1865479 - DNA, 19 bp, Homo sapiens
agccctggatggcctctgg

SEQ ID NO: 1865480 - DNA, 23 bp, Homo sapiens
agccctggatggcctctggggca

SEQ ID NO: 1865481 - DNA, 16 bp, Homo sapiens
agccctttctgtgtgc

SEQ ID NO: 1865482 - DNA, 18 bp, Homo sapiens
agccctttctgtgtgcac

SEQ ID NO: 1865483 - DNA, 14 bp, Homo sapiens
agccgtgcaggact

SEQ ID NO: 1865484 - DNA, 12 bp, Homo sapiens
agcctctgactc

SEQ ID NO: 1865485 - DNA, 16 bp, Homo sapiens
agcctctgactcacca

SEQ ID NO: 1865486 - DNA, 17 bp, Homo sapiens
agcctctgactcaccac

SEQ ID NO: 1865487 - DNA, 11 bp, Homo sapiens
agcctctgggg

SEQ ID NO: 1865488 - DNA, 14 bp, Homo sapiens
agcctctggggcag

SEQ ID NO: 1865489 - DNA, 18 bp, Homo sapiens
agccttaagcacaattaa

SEQ ID NO: 1865490 - DNA, 18 bp, Homo sapiens
agccttatgtgttacatt

SEQ ID NO: 1865491 - DNA, 19 bp, Homo sapiens
agcgcacgcgcgcacacac

SEQ ID NO: 1865492 - DNA, 19 bp, Homo sapiens
agcgcaggtttagtttact

SEQ ID NO: 1865493 - DNA, 20 bp, Homo sapiens
agcgccaagtggccactggc

SEQ ID NO: 1865494 - DNA, 15 bp, Homo sapiens
agctaagcaagccag

SEQ ID NO: 1865495 - DNA, 16 bp, Homo sapiens
agctaagcaagccagg

SEQ ID NO: 1865496 - DNA, 17 bp, Homo sapiens
agctaagcaagccagga

SEQ ID NO: 1865497 - DNA, 19 bp, Homo sapiens
agctaagcaagccaggaga

SEQ ID NO: 1865498 - DNA, 13 bp, Homo sapiens
agctagaatttct

SEQ ID NO: 1865499 - DNA, 18 bp, Homo sapiens
agctagttcgtagctttc

SEQ ID NO: 1865500 - DNA, 22 bp, Homo sapiens
agctatcaatcaccttgcattt

SEQ ID NO: 1865501 - DNA, 15 bp, Homo sapiens
agctattactgtctg

SEQ ID NO: 1865502 - DNA, 15 bp, Homo sapiens
agctcatattttgta

SEQ ID NO: 1865503 - DNA, 17 bp, Homo sapiens
agctcatgagtggaaag

SEQ ID NO: 1865504 - DNA, 23 bp, Homo sapiens
agctcatgagtggaaagtcacct

SEQ ID NO: 1865505 - DNA, 18 bp, Homo sapiens
agctcctgctcattgtgg

SEQ ID NO: 1865506 - DNA, 14 bp, Homo sapiens
agctggcactgaca

SEQ ID NO: 1865507 - DNA, 22 bp, Homo sapiens
agctgtagtagccctttctgtg

SEQ ID NO: 1865508 - DNA, 23 bp, Homo sapiens
agctgtagtagccctttctgtgt

SEQ ID NO: 1865509 - DNA, 20 bp, Homo sapiens
agctgtgccttttttagctt

SEQ ID NO: 1865510 - DNA, 21 bp, Homo sapiens
agctgttcttttttgtacttt

SEQ ID NO: 1865511 - DNA, 12 bp, Homo sapiens
agctgtttaaga

SEQ ID NO: 1865512 - DNA, 16 bp, Homo sapiens
agcttcagaagtttgg

SEQ ID NO: 1865513 - DNA, 13 bp, Homo sapiens
agcttcatatcta

SEQ ID NO: 1865514 - DNA, 14 bp, Homo sapiens
agcttcatatctaa

SEQ ID NO: 1865515 - DNA, 18 bp, Homo sapiens
agcttcatatctaattta

SEQ ID NO: 1865516 - DNA, 16 bp, Homo sapiens
agcttcctgtctgttt

SEQ ID NO: 1865517 - DNA, 18 bp, Homo sapiens
agcttgatttgatctttg

SEQ ID NO: 1865518 - DNA, 19 bp, Homo sapiens
agcttgatttgatctttgt

SEQ ID NO: 1865519 - DNA, 14 bp, Homo sapiens
agcttgtagccctg

SEQ ID NO: 1865520 - DNA, 16 bp, Homo sapiens
agcttgtagccctgga

SEQ ID NO: 1865521 - DNA, 17 bp, Homo sapiens
agcttgtagccctggat

SEQ ID NO: 1865522 - DNA, 18 bp, Homo sapiens
agcttgtatagtgtaaaa

SEQ ID NO: 1865523 - DNA, 19 bp, Homo sapiens
agctttacatgcaatttat

SEQ ID NO: 1865524 - DNA, 13 bp, Homo sapiens
agctttatctttg

SEQ ID NO: 1865525 - DNA, 23 bp, Homo sapiens
agctttatctttgtgtaatctaa

SEQ ID NO: 1865526 - DNA, 12 bp, Homo sapiens
agcttttaaaaa

SEQ ID NO: 1865527 - DNA, 14 bp, Homo sapiens
agcttttaaaaaat

SEQ ID NO: 1865528 - DNA, 15 bp, Homo sapiens
agcttttaaaaaata

SEQ ID NO: 1865529 - DNA, 21 bp, Homo sapiens
agcttttaaaaaatattttaa

SEQ ID NO: 1865530 - DNA, 19 bp, Homo sapiens
agctttttgtattaacaaa

SEQ ID NO: 1865531 - DNA, 15 bp, Homo sapiens
aggaaaattgaaagt

SEQ ID NO: 1865532 - DNA, 19 bp, Homo sapiens
aggaaaattgaaagtattc

SEQ ID NO: 1865533 - DNA, 17 bp, Homo sapiens
aggaaattagtcttttt

SEQ ID NO: 1865534 - DNA, 21 bp, Homo sapiens
aggaaccacatataacactta

SEQ ID NO: 1865535 - DNA, 20 bp, Homo sapiens
aggaagacataaaactttaa

SEQ ID NO: 1865536 - DNA, 19 bp, Homo sapiens
aggaatatagattaaatca

SEQ ID NO: 1865537 - DNA, 14 bp, Homo sapiens
aggaatgtgtccaa

SEQ ID NO: 1865538 - DNA, 21 bp, Homo sapiens
aggacatgtttttgttttctt

SEQ ID NO: 1865539 - DNA, 22 bp, Homo sapiens
aggacattgatttgatttttat

SEQ ID NO: 1865540 - DNA, 14 bp, Homo sapiens
aggaccgttttgta

SEQ ID NO: 1865541 - DNA, 20 bp, Homo sapiens
aggacctgaaataaggtata

SEQ ID NO: 1865542 - DNA, 23 bp, Homo sapiens
aggagaagacccctgcccaagtg

SEQ ID NO: 1865543 - DNA, 20 bp, Homo sapiens
aggagattggatttgctgtg

SEQ ID NO: 1865544 - DNA, 22 bp, Homo sapiens
aggagattgggagacaattagc

SEQ ID NO: 1865545 - DNA, 11 bp, Homo sapiens
aggagcagctg

SEQ ID NO: 1865546 - DNA, 18 bp, Homo sapiens
aggagcagctggcactga

SEQ ID NO: 1865547 - DNA, 14 bp, Homo sapiens
aatcttttctgaat

SEQ ID NO: 1865548 - DNA, 19 bp, Homo sapiens
aatgaaccgtttacagtgt

SEQ ID NO: 1865549 - DNA, 17 bp, Homo sapiens
aatgaactgtggaattt

SEQ ID NO: 1865550 - DNA, 18 bp, Homo sapiens
aatgaactgtggaattta

SEQ ID NO: 1865551 - DNA, 14 bp, Homo sapiens
aatgaacttttaca

SEQ ID NO: 1865552 - DNA, 17 bp, Homo sapiens
aatgaacttttacagaa

SEQ ID NO: 1865553 - DNA, 18 bp, Homo sapiens
aatgaacttttacagaat

SEQ ID NO: 1865554 - DNA, 21 bp, Homo sapiens
aatgaacttttacagaatgca

SEQ ID NO: 1865555 - DNA, 22 bp, Homo sapiens
aatgaacttttacagaatgcat

SEQ ID NO: 1865556 - DNA, 17 bp, Homo sapiens
aatgaagcaatttatat

SEQ ID NO: 1865557 - DNA, 16 bp, Homo sapiens
aatgacaacagaagct

SEQ ID NO: 1865558 - DNA, 14 bp, Homo sapiens
aatgaggacatgtt

SEQ ID NO: 1865559 - DNA, 23 bp, Homo sapiens
aatgagggtttctgatctgtact

SEQ ID NO: 1865560 - DNA, 17 bp, Homo sapiens
aatgatcacatctaaag

SEQ ID NO: 1865561 - DNA, 23 bp, Homo sapiens
aatgatcacatctaaagctttat

SEQ ID NO: 1865562 - DNA, 17 bp, Homo sapiens
aatgccaaaatgtactt

SEQ ID NO: 1865563 - DNA, 17 bp, Homo sapiens
aatgcccatttttgcta

SEQ ID NO: 1865564 - DNA, 12 bp, Homo sapiens
aatgccctgcct

SEQ ID NO: 1865565 - DNA, 19 bp, Homo sapiens
aatgccctgccttgctgcc

SEQ ID NO: 1865566 - DNA, 20 bp, Homo sapiens
aatgccctgccttgctgcct

SEQ ID NO: 1865567 - DNA, 13 bp, Homo sapiens
aatgccttggttt

SEQ ID NO: 1865568 - DNA, 22 bp, Homo sapiens
aatggatatagaaaatcttagt

SEQ ID NO: 1865569 - DNA, 21 bp, Homo sapiens
aatgggaaagtatttttgaaa

SEQ ID NO: 1865570 - DNA, 14 bp, Homo sapiens
aatggggcgctgga

SEQ ID NO: 1865571 - DNA, 20 bp, Homo sapiens
aatggtaggtcaagtaataa

SEQ ID NO: 1865572 - DNA, 15 bp, Homo sapiens
aatggttgccttaaa

SEQ ID NO: 1865573 - DNA, 15 bp, Homo sapiens
aatgtacttaaatga

SEQ ID NO: 1865574 - DNA, 18 bp, Homo sapiens
aatgtaggcacttttatt

SEQ ID NO: 1865575 - DNA, 23 bp, Homo sapiens
aatgtaggcacttttattttcat

SEQ ID NO: 1865576 - DNA, 19 bp, Homo sapiens
aatgtagggttatatttgg

SEQ ID NO: 1865577 - DNA, 12 bp, Homo sapiens
aatgtgtccaag

SEQ ID NO: 1865578 - DNA, 15 bp, Homo sapiens
aatgtgtccaagaca

SEQ ID NO: 1865579 - DNA, 22 bp, Homo sapiens
aatgttatttgttattttcagt

SEQ ID NO: 1865580 - DNA, 13 bp, Homo sapiens
aatgtttaattca

SEQ ID NO: 1865581 - DNA, 16 bp, Homo sapiens
aattaaaaactttaaa

SEQ ID NO: 1865582 - DNA, 14 bp, Homo sapiens
aattaaaaatgaaa

SEQ ID NO: 1865583 - DNA, 13 bp, Homo sapiens
aattaaaactgag

SEQ ID NO: 1865584 - DNA, 22 bp, Homo sapiens
aattaaaactgagtccatgaaa

SEQ ID NO: 1865585 - DNA, 21 bp, Homo sapiens
aattaaaatattatttgatat

SEQ ID NO: 1865586 - DNA, 16 bp, Homo sapiens
aattaaactagtttaa

SEQ ID NO: 1865587 - DNA, 17 bp, Homo sapiens
aattaaagccttaagca

SEQ ID NO: 1865588 - DNA, 22 bp, Homo sapiens
aattaaagccttaagcacaatt

SEQ ID NO: 1865589 - DNA, 15 bp, Homo sapiens
aattaatcttttaaa

SEQ ID NO: 1865590 - DNA, 19 bp, Homo sapiens
aattaccatagagtaatga

SEQ ID NO: 1865591 - DNA, 22 bp, Homo sapiens
aattacgttcttacaagcttaa

SEQ ID NO: 1865592 - DNA, 23 bp, Homo sapiens
aattacgttcttacaagcttaaa

SEQ ID NO: 1865593 - DNA, 21 bp, Homo sapiens
aattagtttaaaatgaagcaa

SEQ ID NO: 1865594 - DNA, 12 bp, Homo sapiens
aattattaattg

SEQ ID NO: 1865595 - DNA, 19 bp, Homo sapiens
aattattaattgtcctgtg

SEQ ID NO: 1865596 - DNA, 14 bp, Homo sapiens
aattattttaaaca

SEQ ID NO: 1865597 - DNA, 13 bp, Homo sapiens
aattcactgttga

SEQ ID NO: 1865598 - DNA, 14 bp, Homo sapiens
aattcattaatctg

SEQ ID NO: 1865599 - DNA, 17 bp, Homo sapiens
aattcattaatctgttt

SEQ ID NO: 1865600 - DNA, 21 bp, Homo sapiens
aattcctctcactaaacttta

SEQ ID NO: 1865601 - DNA, 16 bp, Homo sapiens
aattctattttgctgg

SEQ ID NO: 1865602 - DNA, 18 bp, Homo sapiens
aattgaaagtattcagaa

SEQ ID NO: 1865603 - DNA, 14 bp, Homo sapiens
aattggcataattt

SEQ ID NO: 1865604 - DNA, 18 bp, Homo sapiens
aattggcataatttgtct

SEQ ID NO: 1865605 - DNA, 16 bp, Homo sapiens
aattggtcatggtaga

SEQ ID NO: 1865606 - DNA, 13 bp, Homo sapiens
aattgtcctgtgt

SEQ ID NO: 1865607 - DNA, 15 bp, Homo sapiens
aattgtcctgtgtct

SEQ ID NO: 1865608 - DNA, 13 bp, Homo sapiens
aatttaaaaaata

SEQ ID NO: 1865609 - DNA, 20 bp, Homo sapiens
aatttaaagaaacactaaat

SEQ ID NO: 1865610 - DNA, 21 bp, Homo sapiens
aatttaatggactgtgaattt

SEQ ID NO: 1865611 - DNA, 20 bp, Homo sapiens
aatttaccattattttacag

SEQ ID NO: 1865612 - DNA, 19 bp, Homo sapiens
aatttataggcagatcttt

SEQ ID NO: 1865613 - DNA, 20 bp, Homo sapiens
aatttataggcagatcttta

SEQ ID NO: 1865614 - DNA, 15 bp, Homo sapiens
aatttatatctttat

SEQ ID NO: 1865615 - DNA, 19 bp, Homo sapiens
aatttatatctttatgcaa

SEQ ID NO: 1865616 - DNA, 15 bp, Homo sapiens
aatttattaaaatga

SEQ ID NO: 1865617 - DNA, 18 bp, Homo sapiens
aatttattagttaatata

SEQ ID NO: 1865618 - DNA, 22 bp, Homo sapiens
aatttattggcagccaaggaat

SEQ ID NO: 1865619 - DNA, 19 bp, Homo sapiens
aatttcacagttctgtaat

SEQ ID NO: 1865620 - DNA, 20 bp, Homo sapiens
aatttcacagttctgtaatg

SEQ ID NO: 1865621 - DNA, 11 bp, Homo sapiens
aatttccaaaa

SEQ ID NO: 1865622 - DNA, 14 bp, Homo sapiens
aatttccaaaataa

SEQ ID NO: 1865623 - DNA, 18 bp, Homo sapiens
aatttcccctaatctttt

SEQ ID NO: 1865624 - DNA, 15 bp, Homo sapiens
aatttccttctgtta

SEQ ID NO: 1865625 - DNA, 16 bp, Homo sapiens
aatttccttctgttaa

SEQ ID NO: 1865626 - DNA, 17 bp, Homo sapiens
aatttccttctgttaag

SEQ ID NO: 1865627 - DNA, 18 bp, Homo sapiens
aatttccttctgttaaga

SEQ ID NO: 1865628 - DNA, 20 bp, Homo sapiens
aatttccttctgttaagaaa

SEQ ID NO: 1865629 - DNA, 22 bp, Homo sapiens
aatttccttctgttaagaaagg

SEQ ID NO: 1865630 - DNA, 14 bp, Homo sapiens
tttagggtgggtaa

SEQ ID NO: 1865631 - DNA, 18 bp, Homo sapiens
tttagggtgggtaagaaa

SEQ ID NO: 1865632 - DNA, 20 bp, Homo sapiens
tttagtaccctgcaggccag

SEQ ID NO: 1865633 - DNA, 19 bp, Homo sapiens
tttagttacgtataatgct

SEQ ID NO: 1865634 - DNA, 21 bp, Homo sapiens
tttagttacgtataatgcttt

SEQ ID NO: 1865635 - DNA, 22 bp, Homo sapiens
tttagttacgtataatgctttc

SEQ ID NO: 1865636 - DNA, 13 bp, Homo sapiens
tttagttatagtt

SEQ ID NO: 1865637 - DNA, 14 bp, Homo sapiens
tttagtttactcaa

SEQ ID NO: 1865638 - DNA, 14 bp, Homo sapiens
tttatacataaaca

SEQ ID NO: 1865639 - DNA, 17 bp, Homo sapiens
tttatagctattactgt

SEQ ID NO: 1865640 - DNA, 18 bp, Homo sapiens
tttatagttaatctataa

SEQ ID NO: 1865641 - DNA, 14 bp, Homo sapiens
tttatatataaggt

SEQ ID NO: 1865642 - DNA, 14 bp, Homo sapiens
tttatatattgaaa

SEQ ID NO: 1865643 - DNA, 13 bp, Homo sapiens
tttatatcttgtt

SEQ ID NO: 1865644 - DNA, 14 bp, Homo sapiens
tttatcatgacatg

SEQ ID NO: 1865645 - DNA, 23 bp, Homo sapiens
tttatcatgacatgttatatatt

SEQ ID NO: 1865646 - DNA, 15 bp, Homo sapiens
tttatctttgtgtaa

SEQ ID NO: 1865647 - DNA, 23 bp, Homo sapiens
tttattaaaatgattgtaaaata

SEQ ID NO: 1865648 - DNA, 13 bp, Homo sapiens
tttattctgtggt

SEQ ID NO: 1865649 - DNA, 23 bp, Homo sapiens
tttattctgtggttctataataa

SEQ ID NO: 1865650 - DNA, 20 bp, Homo sapiens
tttattggcagccaaggaat

SEQ ID NO: 1865651 - DNA, 13 bp, Homo sapiens
tttattgtataaa

SEQ ID NO: 1865652 - DNA, 23 bp, Homo sapiens
tttcaaaaaaaaaaaaaaagact

SEQ ID NO: 1865653 - DNA, 16 bp, Homo sapiens
tttcaactcattgcat

SEQ ID NO: 1865654 - DNA, 18 bp, Homo sapiens
tttcaactcattgcatca

SEQ ID NO: 1865655 - DNA, 23 bp, Homo sapiens
tttcacagatggaagaagtttta

SEQ ID NO: 1865656 - DNA, 19 bp, Homo sapiens
tttcacagttctgtaatgt

SEQ ID NO: 1865657 - DNA, 16 bp, Homo sapiens
tttcaggaatttaatt

SEQ ID NO: 1865658 - DNA, 13 bp, Homo sapiens
tttcattgtgatt

SEQ ID NO: 1865659 - DNA, 19 bp, Homo sapiens
tttccaaaataatctatat

SEQ ID NO: 1865660 - DNA, 21 bp, Homo sapiens
tttccaaaatctaaaagctgt

SEQ ID NO: 1865661 - DNA, 17 bp, Homo sapiens
tttcctcttttgtgaga

SEQ ID NO: 1865662 - DNA, 13 bp, Homo sapiens
tttccttctgtta

SEQ ID NO: 1865663 - DNA, 16 bp, Homo sapiens
tgtttaaatgccaaaa

SEQ ID NO: 1865664 - DNA, 22 bp, Homo sapiens
tgtttcttctccaattctgaaa

SEQ ID NO: 1865665 - DNA, 18 bp, Homo sapiens
tgtttgtacaagattgtc

SEQ ID NO: 1865666 - DNA, 15 bp, Homo sapiens
tgtttgtatatttgc

SEQ ID NO: 1865667 - DNA, 16 bp, Homo sapiens
tgtttgtatatttgca

SEQ ID NO: 1865668 - DNA, 17 bp, Homo sapiens
tgttttaaaaaaactga

SEQ ID NO: 1865669 - DNA, 22 bp, Homo sapiens
tgttttaaatacgcactacatg

SEQ ID NO: 1865670 - DNA, 12 bp, Homo sapiens
tgttttatcatg

SEQ ID NO: 1865671 - DNA, 23 bp, Homo sapiens
tgttttatcatgacatgttatat

SEQ ID NO: 1865672 - DNA, 18 bp, Homo sapiens
tgttttattttttattgt

SEQ ID NO: 1865673 - DNA, 23 bp, Homo sapiens
tgttttattttttattgttttca

SEQ ID NO: 1865674 - DNA, 17 bp, Homo sapiens
ttaaaaaaaactcttta

SEQ ID NO: 1865675 - DNA, 13 bp, Homo sapiens
ttaaaaaaacaca

SEQ ID NO: 1865676 - DNA, 13 bp, Homo sapiens
ttaaaaaaactga

SEQ ID NO: 1865677 - DNA, 14 bp, Homo sapiens
ttaaaaaaactgaa

SEQ ID NO: 1865678 - DNA, 22 bp, Homo sapiens
ttaaaaaactttctactcattt

SEQ ID NO: 1865679 - DNA, 11 bp, Homo sapiens
ttaaaaaatac

SEQ ID NO: 1865680 - DNA, 15 bp, Homo sapiens
ttaaaaaataccatt

SEQ ID NO: 1865681 - DNA, 11 bp, Homo sapiens
ttaaaaaatat

SEQ ID NO: 1865682 - DNA, 14 bp, Homo sapiens
ttaaaaaatatttt

SEQ ID NO: 1865683 - DNA, 19 bp, Homo sapiens
ttaaaaaatattttaagaa

SEQ ID NO: 1865684 - DNA, 22 bp, Homo sapiens
ttaaaaaatattttaagaaaga

SEQ ID NO: 1865685 - DNA, 14 bp, Homo sapiens
ttaaaaaattaaaa

SEQ ID NO: 1865686 - DNA, 13 bp, Homo sapiens
ttaaaaactgtgt

SEQ ID NO: 1865687 - DNA, 12 bp, Homo sapiens
ttaaaaacttta

SEQ ID NO: 1865688 - DNA, 18 bp, Homo sapiens
ttaaaaactttaaagata

SEQ ID NO: 1865689 - DNA, 11 bp, Homo sapiens
ttaaaactgag

SEQ ID NO: 1865690 - DNA, 20 bp, Homo sapiens
ttaaaactgagtccatgaaa

SEQ ID NO: 1865691 - DNA, 21 bp, Homo sapiens
ttaaaactgagtccatgaaaa

SEQ ID NO: 1865692 - DNA, 11 bp, Homo sapiens
ttaaaaggcaa

SEQ ID NO: 1865693 - DNA, 16 bp, Homo sapiens
ttaaaatattatttga

SEQ ID NO: 1865694 - DNA, 14 bp, Homo sapiens
ttaaaatgaagcaa

SEQ ID NO: 1865695 - DNA, 19 bp, Homo sapiens
ttaaaatgaagcaatttat

SEQ ID NO: 1865696 - DNA, 16 bp, Homo sapiens
ttaaaatgattgtaaa

SEQ ID NO: 1865697 - DNA, 18 bp, Homo sapiens
ttaaaatgattgtaaaat

SEQ ID NO: 1865698 - DNA, 18 bp, Homo sapiens
ttaaacaaaatttcacag

SEQ ID NO: 1865699 - DNA, 14 bp, Homo sapiens
ttaaacaatgatca

SEQ ID NO: 1865700 - DNA, 16 bp, Homo sapiens
ttaaactagtttaagg

SEQ ID NO: 1865701 - DNA, 14 bp, Homo sapiens
ttaaagaaacacta

SEQ ID NO: 1865702 - DNA, 11 bp, Homo sapiens
ttaaagaaagt

SEQ ID NO: 1865703 - DNA, 14 bp, Homo sapiens
ttaaagcttgattt

SEQ ID NO: 1865704 - DNA, 19 bp, Homo sapiens
ttaaagcttgatttgatct

SEQ ID NO: 1865705 - DNA, 18 bp, Homo sapiens
ttaaaggcaccatctaat

SEQ ID NO: 1865706 - DNA, 13 bp, Homo sapiens
ttaaagtaaactt

SEQ ID NO: 1865707 - DNA, 18 bp, Homo sapiens
ttaaagtaaacttgtgta

SEQ ID NO: 1865708 - DNA, 19 bp, Homo sapiens
ttaaatcatttggttaaat

SEQ ID NO: 1865709 - DNA, 12 bp, Homo sapiens
ttaaatgccaaa

SEQ ID NO: 1865710 - DNA, 20 bp, Homo sapiens
ttaaatgccaaaatgtactt

SEQ ID NO: 1865711 - DNA, 15 bp, Homo sapiens
ttaaatgtgagcaaa

SEQ ID NO: 1865712 - DNA, 21 bp, Homo sapiens
ttaacaaagttactggctctt

SEQ ID NO: 1865713 - DNA, 11 bp, Homo sapiens
ttaacatgtga

SEQ ID NO: 1865714 - DNA, 17 bp, Homo sapiens
ttaactacatctgcctc

SEQ ID NO: 1865715 - DNA, 19 bp, Homo sapiens
ttaactgtatttcagtatt

SEQ ID NO: 1865716 - DNA, 13 bp, Homo sapiens
ttaagaaagagaa

SEQ ID NO: 1865717 - DNA, 16 bp, Homo sapiens
ttaagtgcaacatttc

SEQ ID NO: 1865718 - DNA, 19 bp, Homo sapiens
ttaagtgcaacatttctgt

SEQ ID NO: 1865719 - DNA, 21 bp, Homo sapiens
ttaagtgcaacatttctgtat

SEQ ID NO: 1865720 - DNA, 20 bp, Homo sapiens
ttaatagcttttattgtata

SEQ ID NO: 1865721 - DNA, 20 bp, Homo sapiens
ttaatatatcccagaaatta

SEQ ID NO: 1865722 - DNA, 14 bp, Homo sapiens
ttaatattcttttg

SEQ ID NO: 1865723 - DNA, 16 bp, Homo sapiens
ttaattaaagccttaa

SEQ ID NO: 1865724 - DNA, 21 bp, Homo sapiens
ttaattaaagccttaagcaca

SEQ ID NO: 1865725 - DNA, 12 bp, Homo sapiens
ttaattcattaa

SEQ ID NO: 1865726 - DNA, 20 bp, Homo sapiens
ttaatttagagcgtttggtt

SEQ ID NO: 1865727 - DNA, 16 bp, Homo sapiens
ttacaacctagaagta

SEQ ID NO: 1865728 - DNA, 16 bp, Homo sapiens
ttacaagtttgctaaa

SEQ ID NO: 1865729 - DNA, 18 bp, Homo sapiens
ttacagaatgcattaaaa

SEQ ID NO: 1865730 - DNA, 19 bp, Homo sapiens
ttacagaatgcattaaaaa

SEQ ID NO: 1865731 - DNA, 15 bp, Homo sapiens
ttacagatcatataa

SEQ ID NO: 1865732 - DNA, 13 bp, Homo sapiens
ttacagtttgtgt

SEQ ID NO: 1865733 - DNA, 16 bp, Homo sapiens
ttacataatttgcaat

SEQ ID NO: 1865734 - DNA, 22 bp, Homo sapiens
ttacatgcaatttattaaaatg

SEQ ID NO: 1865735 - DNA, 23 bp, Homo sapiens
ttacatgcaatttattaaaatga

SEQ ID NO: 1865736 - DNA, 18 bp, Homo sapiens
ttaccaactttctgtaaa

SEQ ID NO: 1865737 - DNA, 15 bp, Homo sapiens
ttaccagtctgatta

SEQ ID NO: 1865738 - DNA, 18 bp, Homo sapiens
ttaccattattttacagt

SEQ ID NO: 1865739 - DNA, 20 bp, Homo sapiens
ttaccattattttacagtct

SEQ ID NO: 1865740 - DNA, 18 bp, Homo sapiens
ttactaagccacaagaaa

SEQ ID NO: 1865741 - DNA, 20 bp, Homo sapiens
ttactaagccacaagaaatt

SEQ ID NO: 1865742 - DNA, 22 bp, Homo sapiens
ttactaagccacaagaaatttg

SEQ ID NO: 1865743 - DNA, 17 bp, Homo sapiens
ttactgctctagaaagt

SEQ ID NO: 1865744 - DNA, 15 bp, Homo sapiens
ttactggcactgtgg

SEQ ID NO: 1865745 - DNA, 23 bp, Homo sapiens
ttactggcactgtggcactgcca

SEQ ID NO: 1865746 - DNA, 12 bp, Homo sapiens
ttactgtatgta

SEQ ID NO: 1865747 - DNA, 22 bp, Homo sapiens
ttactgtatgtataaattatga

SEQ ID NO: 1865748 - DNA, 14 bp, Homo sapiens
ttacttagaatgcc

SEQ ID NO: 1865749 - DNA, 13 bp, Homo sapiens
ttactttggttta

SEQ ID NO: 1865750 - DNA, 18 bp, Homo sapiens
ttactttggtttagtctt

SEQ ID NO: 1865751 - DNA, 16 bp, Homo sapiens
ttagaaaatcagattt

SEQ ID NO: 1865752 - DNA, 18 bp, Homo sapiens
ttagaaaccttaatatgt

SEQ ID NO: 1865753 - DNA, 21 bp, Homo sapiens
ttagaatgccataaaattgca

SEQ ID NO: 1865754 - DNA, 15 bp, Homo sapiens
ttagagaactggagg

SEQ ID NO: 1865755 - DNA, 18 bp, Homo sapiens
ttagagtttacagtttgt

SEQ ID NO: 1865756 - DNA, 19 bp, Homo sapiens
ttagcagaatggagaaagt

SEQ ID NO: 1865757 - DNA, 18 bp, Homo sapiens
ttagcttcatatctaatt

SEQ ID NO: 1865758 - DNA, 20 bp, Homo sapiens
ttagcttcatatctaattta

SEQ ID NO: 1865759 - DNA, 15 bp, Homo sapiens
ttagggtgggtaaga

SEQ ID NO: 1865760 - DNA, 15 bp, Homo sapiens
tccctttttaaaaaa

SEQ ID NO: 1865761 - DNA, 19 bp, Homo sapiens
tccctttttaaaaaatacc

SEQ ID NO: 1865762 - DNA, 16 bp, Homo sapiens
tccgacaccactggga

SEQ ID NO: 1865763 - DNA, 16 bp, Homo sapiens
tcctatatctgtttgt

SEQ ID NO: 1865764 - DNA, 12 bp, Homo sapiens
tcctccctggag

SEQ ID NO: 1865765 - DNA, 18 bp, Homo sapiens
tcctctcactaaacttta

SEQ ID NO: 1865766 - DNA, 22 bp, Homo sapiens
tcctgggcatgtttgtctgtgt

SEQ ID NO: 1865767 - DNA, 16 bp, Homo sapiens
tcctgttctctttgcc

SEQ ID NO: 1865768 - DNA, 20 bp, Homo sapiens
tccttcagctgactccagta

SEQ ID NO: 1865769 - DNA, 18 bp, Homo sapiens
tccttctgttaagaaagg

SEQ ID NO: 1865770 - DNA, 21 bp, Homo sapiens
tccttggagtgctgcagcttt

SEQ ID NO: 1865771 - DNA, 14 bp, Homo sapiens
tcgagcactctaat

SEQ ID NO: 1865772 - DNA, 13 bp, Homo sapiens
tcgagtctttgtg

SEQ ID NO: 1865773 - DNA, 17 bp, Homo sapiens
tcgcttgttttaaaagg

SEQ ID NO: 1865774 - DNA, 14 bp, Homo sapiens
tcgggaattttccc

SEQ ID NO: 1865775 - DNA, 12 bp, Homo sapiens
tcgtagctttcc

SEQ ID NO: 1865776 - DNA, 22 bp, Homo sapiens
tcgtagctttcccaaataaact

SEQ ID NO: 1865777 - DNA, 13 bp, Homo sapiens
tctaaacattaat

SEQ ID NO: 1865778 - DNA, 14 bp, Homo sapiens
tctaaacattaatc

SEQ ID NO: 1865779 - DNA, 17 bp, Homo sapiens
tctaaacattaatcaat

SEQ ID NO: 1865780 - DNA, 13 bp, Homo sapiens
tctaaagctttat

SEQ ID NO: 1865781 - DNA, 23 bp, Homo sapiens
tctaaagctttatctttgtgtaa

SEQ ID NO: 1865782 - DNA, 13 bp, Homo sapiens
tctaaattcactg

SEQ ID NO: 1865783 - DNA, 17 bp, Homo sapiens
tctaacataagtaagac

SEQ ID NO: 1865784 - DNA, 15 bp, Homo sapiens
tctaatatattttta

SEQ ID NO: 1865785 - DNA, 18 bp, Homo sapiens
tctaatattaaaaatatg

SEQ ID NO: 1865786 - DNA, 13 bp, Homo sapiens
tctagactttctg

SEQ ID NO: 1865787 - DNA, 14 bp, Homo sapiens
tctagactttctgt

SEQ ID NO: 1865788 - DNA, 18 bp, Homo sapiens
tctagcatttatttctct

SEQ ID NO: 1865789 - DNA, 23 bp, Homo sapiens
tctagtatctattgtgttggctt

SEQ ID NO: 1865790 - DNA, 14 bp, Homo sapiens
tctatacctgcctt

SEQ ID NO: 1865791 - DNA, 17 bp, Homo sapiens
tctatggagactttgct

SEQ ID NO: 1865792 - DNA, 13 bp, Homo sapiens
tctatgtacctct

SEQ ID NO: 1865793 - DNA, 19 bp, Homo sapiens
tctattttctctgatactt

SEQ ID NO: 1865794 - DNA, 12 bp, Homo sapiens
tctattttgctg

SEQ ID NO: 1865795 - DNA, 15 bp, Homo sapiens
tctcactaaacttta

SEQ ID NO: 1865796 - DNA, 13 bp, Homo sapiens
tctcatgcccact

SEQ ID NO: 1865797 - DNA, 17 bp, Homo sapiens
tctcattccaacagtga

SEQ ID NO: 1865798 - DNA, 19 bp, Homo sapiens
tctcattccaacagtgagt

SEQ ID NO: 1865799 - DNA, 16 bp, Homo sapiens
tctccaggtaactttg

SEQ ID NO: 1865800 - DNA, 12 bp, Homo sapiens
tctcccagagca

SEQ ID NO: 1865801 - DNA, 18 bp, Homo sapiens
tctccccaatccatgctt

SEQ ID NO: 1865802 - DNA, 19 bp, Homo sapiens
tctccccctgcagccgtgc

SEQ ID NO: 1865803 - DNA, 21 bp, Homo sapiens
tctcctctgctcattaaactg

SEQ ID NO: 1865804 - DNA, 11 bp, Homo sapiens
tctctaatatg

SEQ ID NO: 1865805 - DNA, 17 bp, Homo sapiens
tctctctgttaaagatc

SEQ ID NO: 1865806 - DNA, 15 bp, Homo sapiens
tctctgttgtaaata

SEQ ID NO: 1865807 - DNA, 17 bp, Homo sapiens
tctctgttgtaaataac

SEQ ID NO: 1865808 - DNA, 21 bp, Homo sapiens
tctcttgccccaaatcacaaa

SEQ ID NO: 1865809 - DNA, 23 bp, Homo sapiens
tctcttgccccaaatcacaaaca

SEQ ID NO: 1865810 - DNA, 12 bp, Homo sapiens
tctctttgaaac

SEQ ID NO: 1865811 - DNA, 14 bp, Homo sapiens
tctctttgaaacat

SEQ ID NO: 1865812 - DNA, 21 bp, Homo sapiens
tctgaaaggctatcctgctga

SEQ ID NO: 1865813 - DNA, 14 bp, Homo sapiens
tctgacccagtgag

SEQ ID NO: 1865814 - DNA, 21 bp, Homo sapiens
tctgacccagtgagattacag

SEQ ID NO: 1865815 - DNA, 23 bp, Homo sapiens
tctgactcaccacgatgacgcct

SEQ ID NO: 1865816 - DNA, 19 bp, Homo sapiens
tctgacttacttaaccagg

SEQ ID NO: 1865817 - DNA, 18 bp, Homo sapiens
tctgagtgagttttactc

SEQ ID NO: 1865818 - DNA, 18 bp, Homo sapiens
tctgatctgtactttgtg

SEQ ID NO: 1865819 - DNA, 22 bp, Homo sapiens
tctgatctgtactttgtgttta

SEQ ID NO: 1865820 - DNA, 17 bp, Homo sapiens
tctgattttgatatttt

SEQ ID NO: 1865821 - DNA, 23 bp, Homo sapiens
tctgattttgatattttcacaga

SEQ ID NO: 1865822 - DNA, 17 bp, Homo sapiens
tctgcaagaattaaaac

SEQ ID NO: 1865823 - DNA, 18 bp, Homo sapiens
tctgcaagaattaaaact

SEQ ID NO: 1865824 - DNA, 14 bp, Homo sapiens
tctgcactcctgga

SEQ ID NO: 1865825 - DNA, 17 bp, Homo sapiens
tctgcactcctggaacc

SEQ ID NO: 1865826 - DNA, 14 bp, Homo sapiens
tctgcatcagcttt

SEQ ID NO: 1865827 - DNA, 18 bp, Homo sapiens
tctgctcttatttttgta

SEQ ID NO: 1865828 - DNA, 13 bp, Homo sapiens
tctgcttcagtgg

SEQ ID NO: 1865829 - DNA, 20 bp, Homo sapiens
tctggcaaacttttctttct

SEQ ID NO: 1865830 - DNA, 19 bp, Homo sapiens
tctggcttccctgcccaat

SEQ ID NO: 1865831 - DNA, 12 bp, Homo sapiens
tctggcttctgc

SEQ ID NO: 1865832 - DNA, 14 bp, Homo sapiens
tctgggaagggaag

SEQ ID NO: 1865833 - DNA, 21 bp, Homo sapiens
tctggggaagaggttttattt

SEQ ID NO: 1865834 - DNA, 12 bp, Homo sapiens
tctggttccaaa

SEQ ID NO: 1865835 - DNA, 13 bp, Homo sapiens
tctggttttaaca

SEQ ID NO: 1865836 - DNA, 15 bp, Homo sapiens
tctggttttaacaat

SEQ ID NO: 1865837 - DNA, 18 bp, Homo sapiens
tctgtaaactcaaaactt

SEQ ID NO: 1865838 - DNA, 14 bp, Homo sapiens
tctgtatgattcta

SEQ ID NO: 1865839 - DNA, 13 bp, Homo sapiens
tctgtctttgcaa

SEQ ID NO: 1865840 - DNA, 18 bp, Homo sapiens
tctgtgtgcaccttacca

SEQ ID NO: 1865841 - DNA, 19 bp, Homo sapiens
tctgtgtgcaccttaccaa

SEQ ID NO: 1865842 - DNA, 22 bp, Homo sapiens
tctgtgtgcaccttaccaactt

SEQ ID NO: 1865843 - DNA, 13 bp, Homo sapiens
tctgtgttgcttc

SEQ ID NO: 1865844 - DNA, 13 bp, Homo sapiens
tctgttaagaaag

SEQ ID NO: 1865845 - DNA, 15 bp, Homo sapiens
tctgttaagaaagga

SEQ ID NO: 1865846 - DNA, 13 bp, Homo sapiens
tctgtttgtatat

SEQ ID NO: 1865847 - DNA, 19 bp, Homo sapiens
tctgtttgtatatttgcaa

SEQ ID NO: 1865848 - DNA, 14 bp, Homo sapiens
tcttaaaaactgtg

SEQ ID NO: 1865849 - DNA, 18 bp, Homo sapiens
tcttaaaaactgtgtatc

SEQ ID NO: 1865850 - DNA, 21 bp, Homo sapiens
tcttaaaaactgtgtatcatt

SEQ ID NO: 1865851 - DNA, 23 bp, Homo sapiens
tcttaaaaactgtgtatcattaa

SEQ ID NO: 1865852 - DNA, 17 bp, Homo sapiens
tcttaactgtatttcag

SEQ ID NO: 1865853 - DNA, 18 bp, Homo sapiens
tcttaactgtatttcagt

SEQ ID NO: 1865854 - DNA, 23 bp, Homo sapiens
tcttaactgtatttcagtatttt

SEQ ID NO: 1865855 - DNA, 16 bp, Homo sapiens
tcttctccaattctga

SEQ ID NO: 1865856 - DNA, 23 bp, Homo sapiens
tcttctccaattctgaaatactt

SEQ ID NO: 1865857 - DNA, 16 bp, Homo sapiens
tcttgccccaaatcac

SEQ ID NO: 1865858 - DNA, 17 bp, Homo sapiens
tcttgccccaaatcaca

SEQ ID NO: 1865859 - DNA, 17 bp, Homo sapiens
tcttggcttcttaaaaa

SEQ ID NO: 1865860 - DNA, 18 bp, Homo sapiens
tcttggcttcttaaaaac

SEQ ID NO: 1865861 - DNA, 22 bp, Homo sapiens
tcttggcttcttaaaaactgtg

SEQ ID NO: 1865862 - DNA, 23 bp, Homo sapiens
tcttggcttcttaaaaactgtgt

SEQ ID NO: 1865863 - DNA, 12 bp, Homo sapiens
tctttaacttgt

SEQ ID NO: 1865864 - DNA, 22 bp, Homo sapiens
tctttaatggttaataggatga

SEQ ID NO: 1865865 - DNA, 19 bp, Homo sapiens
tctttatgcaaaaacatat

SEQ ID NO: 1865866 - DNA, 21 bp, Homo sapiens
tctttatgcaaaaacatatgt

SEQ ID NO: 1865867 - DNA, 20 bp, Homo sapiens
tctttgcaaaggactgtaag

SEQ ID NO: 1865868 - DNA, 17 bp, Homo sapiens
tctttgccttgatgttg

SEQ ID NO: 1865869 - DNA, 14 bp, Homo sapiens
tctttggggaaact

SEQ ID NO: 1865870 - DNA, 18 bp, Homo sapiens
tctttgtctaaacaaggt

SEQ ID NO: 1865871 - DNA, 13 bp, Homo sapiens
tctttgtgtaatc

SEQ ID NO: 1865872 - DNA, 13 bp, Homo sapiens
tctttgtgtgtta

SEQ ID NO: 1865873 - DNA, 16 bp, Homo sapiens
tctttgtttaaatgcc

SEQ ID NO: 1865874 - DNA, 13 bp, Homo sapiens
tcttttaaaaatg

SEQ ID NO: 1865875 - DNA, 18 bp, Homo sapiens
tcttttaggatcagatct

SEQ ID NO: 1865876 - DNA, 14 bp, Homo sapiens
tcttttctgaatct

SEQ ID NO: 1865877 - DNA, 18 bp, Homo sapiens
tgcactaaataaactact

SEQ ID NO: 1865878 - DNA, 15 bp, Homo sapiens
tgcagccgtgcagga

SEQ ID NO: 1865879 - DNA, 22 bp, Homo sapiens
tgcagccttaaacagtgtccag

SEQ ID NO: 1865880 - DNA, 17 bp, Homo sapiens
tgcagcgggccaggcag

SEQ ID NO: 1865881 - DNA, 17 bp, Homo sapiens
tgcagctttgggaaagc

SEQ ID NO: 1865882 - DNA, 14 bp, Homo sapiens
tgcaggactctagc

SEQ ID NO: 1865883 - DNA, 14 bp, Homo sapiens
tgcaggccaggcca

SEQ ID NO: 1865884 - DNA, 15 bp, Homo sapiens
tgcagtgttagtatt

SEQ ID NO: 1865885 - DNA, 19 bp, Homo sapiens
tgcagtttcatgtatgtat

SEQ ID NO: 1865886 - DNA, 23 bp, Homo sapiens
tgcataatgaaccgtttacagtg

SEQ ID NO: 1865887 - DNA, 12 bp, Homo sapiens
tgcatgtaatca

SEQ ID NO: 1865888 - DNA, 16 bp, Homo sapiens
gtattcagaaattaaa

SEQ ID NO: 1865889 - DNA, 19 bp, Homo sapiens
gtatttcagtattttccag

SEQ ID NO: 1865890 - DNA, 13 bp, Homo sapiens
gtattttccagcc

SEQ ID NO: 1865891 - DNA, 17 bp, Homo sapiens
gtattttgatcagtgtt

SEQ ID NO: 1865892 - DNA, 16 bp, Homo sapiens
gtcaaagaaatgctga

SEQ ID NO: 1865893 - DNA, 15 bp, Homo sapiens
gtcaaatgaactttt

SEQ ID NO: 1865894 - DNA, 14 bp, Homo sapiens
gtcaataactctga

SEQ ID NO: 1865895 - DNA, 19 bp, Homo sapiens
gtcacccccccaggcctcc

SEQ ID NO: 1865896 - DNA, 15 bp, Homo sapiens
gtcacctacaggact

SEQ ID NO: 1865897 - DNA, 18 bp, Homo sapiens
gtcacctacaggactggg

SEQ ID NO: 1865898 - DNA, 18 bp, Homo sapiens
gtcaggtgtcatcatcag

SEQ ID NO: 1865899 - DNA, 20 bp, Homo sapiens
gtcatttgacaacacatgtg

SEQ ID NO: 1865900 - DNA, 21 bp, Homo sapiens
gtcatttgacaacacatgtgg

SEQ ID NO: 1865901 - DNA, 15 bp, Homo sapiens
gtccagagggactgg

SEQ ID NO: 1865902 - DNA, 12 bp, Homo sapiens
gtccatgaaaat

SEQ ID NO: 1865903 - DNA, 23 bp, Homo sapiens
ctgtgtttctagttgcattttca

SEQ ID NO: 1865904 - DNA, 14 bp, Homo sapiens
ctgttaagaaagga

SEQ ID NO: 1865905 - DNA, 13 bp, Homo sapiens
ctgttactgcttc

SEQ ID NO: 1865906 - DNA, 20 bp, Homo sapiens
ctgttactgcttctctttgt

SEQ ID NO: 1865907 - DNA, 13 bp, Homo sapiens
ctgttggcactta

SEQ ID NO: 1865908 - DNA, 16 bp, Homo sapiens
ctgttgttttgtttta

SEQ ID NO: 1865909 - DNA, 20 bp, Homo sapiens
ctgttgttttgttttaaata

SEQ ID NO: 1865910 - DNA, 22 bp, Homo sapiens
ctgtttggtcgagtctttgtgt

SEQ ID NO: 1865911 - DNA, 15 bp, Homo sapiens
ctgtttgtatatttg

SEQ ID NO: 1865912 - DNA, 17 bp, Homo sapiens
ctgtttgtttggcactg

SEQ ID NO: 1865913 - DNA, 12 bp, Homo sapiens
ctgtttttaaca

SEQ ID NO: 1865914 - DNA, 19 bp, Homo sapiens
cttaaaaaaaactctttaa

SEQ ID NO: 1865915 - DNA, 13 bp, Homo sapiens
cttaaaaactgtg

SEQ ID NO: 1865916 - DNA, 16 bp, Homo sapiens
cttaaaaactgtgtat

SEQ ID NO: 1865917 - DNA, 19 bp, Homo sapiens
cttaaaaactgtgtatcat

SEQ ID NO: 1865918 - DNA, 21 bp, Homo sapiens
cttaaaaactgtgtatcatta

SEQ ID NO: 1865919 - DNA, 15 bp, Homo sapiens
cttaaaaatcttggt

SEQ ID NO: 1865920 - DNA, 19 bp, Homo sapiens
cttaaatgagttacttaga

SEQ ID NO: 1865921 - DNA, 21 bp, Homo sapiens
cttaaccaccccataccagtc

SEQ ID NO: 1865922 - DNA, 18 bp, Homo sapiens
cttaactgtatttcagta

SEQ ID NO: 1865923 - DNA, 20 bp, Homo sapiens
cttaaggtactctggacttt

SEQ ID NO: 1865924 - DNA, 17 bp, Homo sapiens
cttaatttccttctgtt

SEQ ID NO: 1865925 - DNA, 22 bp, Homo sapiens
cttaatttccttctgttaagaa

SEQ ID NO: 1865926 - DNA, 13 bp, Homo sapiens
cttacaaaagcag

SEQ ID NO: 1865927 - DNA, 17 bp, Homo sapiens
cttacaaaagcagcttt

SEQ ID NO: 1865928 - DNA, 18 bp, Homo sapiens
cttacaagcttaaagctt

SEQ ID NO: 1865929 - DNA, 19 bp, Homo sapiens
cttacaagtggtgaccaaa

SEQ ID NO: 1865930 - DNA, 16 bp, Homo sapiens
cttacataatttttta

SEQ ID NO: 1865931 - DNA, 15 bp, Homo sapiens
cttaccaactttctg

SEQ ID NO: 1865932 - DNA, 16 bp, Homo sapiens
cttaccaactttctgt

SEQ ID NO: 1865933 - DNA, 21 bp, Homo sapiens
cttacccttggtttgcacata

SEQ ID NO: 1865934 - DNA, 22 bp, Homo sapiens
cttacggtgcacagtaatatga

SEQ ID NO: 1865935 - DNA, 19 bp, Homo sapiens
ttatgaaaatcctatatct

SEQ ID NO: 1865936 - DNA, 23 bp, Homo sapiens
ttatgaaggacctgaaataaggt

SEQ ID NO: 1865937 - DNA, 13 bp, Homo sapiens
ttatgcaaaaaca

SEQ ID NO: 1865938 - DNA, 13 bp, Homo sapiens
ttatgtttgtaat

SEQ ID NO: 1865939 - DNA, 14 bp, Homo sapiens
ttattaatgctttg

SEQ ID NO: 1865940 - DNA, 14 bp, Homo sapiens
ttattaatgtttct

SEQ ID NO: 1865941 - DNA, 16 bp, Homo sapiens
ttattcaagttattgt

SEQ ID NO: 1865942 - DNA, 19 bp, Homo sapiens
ttattcagctagaatttct

SEQ ID NO: 1865943 - DNA, 21 bp, Homo sapiens
ttattcagctagaatttctgg

SEQ ID NO: 1865944 - DNA, 22 bp, Homo sapiens
ttattgtataaactatcagttt

SEQ ID NO: 1865945 - DNA, 15 bp, Homo sapiens
ttatttaattagaat

SEQ ID NO: 1865946 - DNA, 21 bp, Homo sapiens
ttatttctctggcaaactttt

SEQ ID NO: 1865947 - DNA, 12 bp, Homo sapiens
ttattttacagt

SEQ ID NO: 1865948 - DNA, 13 bp, Homo sapiens
ttattttcattgt

SEQ ID NO: 1865949 - DNA, 15 bp, Homo sapiens
ttatttttgtaccat

SEQ ID NO: 1865950 - DNA, 21 bp, Homo sapiens
ttcaaggactaacgaacgttt

SEQ ID NO: 1865951 - DNA, 19 bp, Homo sapiens
ttcaaggctttaaaagtca

SEQ ID NO: 1865952 - DNA, 22 bp, Homo sapiens
ttcaaggtggccaaattatttg

SEQ ID NO: 1865953 - DNA, 22 bp, Homo sapiens
ttcaatttggagcattaactaa

SEQ ID NO: 1865954 - DNA, 20 bp, Homo sapiens
ttcacacttgttcaacagtt

SEQ ID NO: 1865955 - DNA, 21 bp, Homo sapiens
ttcactgttgaaaattatttt

SEQ ID NO: 1865956 - DNA, 21 bp, Homo sapiens
ttcactgttgaatgcctgtcc

SEQ ID NO: 1865957 - DNA, 13 bp, Homo sapiens
ttcagaaattaaa

SEQ ID NO: 1865958 - DNA, 17 bp, Homo sapiens
ttcagatttctctttga

SEQ ID NO: 1865959 - DNA, 19 bp, Homo sapiens
ttcagtttttttttttcca

SEQ ID NO: 1865960 - DNA, 20 bp, Homo sapiens
ttcagtttttttttttccag

SEQ ID NO: 1865961 - DNA, 16 bp, Homo sapiens
ttcatataatttaaag

SEQ ID NO: 1865962 - DNA, 21 bp, Homo sapiens
ttcatataatttaaagaaaca

SEQ ID NO: 1865963 - DNA, 17 bp, Homo sapiens
ttcatatctaatttacc

SEQ ID NO: 1865964 - DNA, 14 bp, Homo sapiens
ttcattgtgattta

SEQ ID NO: 1865965 - DNA, 14 bp, Homo sapiens
ttcattgtgtatga

SEQ ID NO: 1865966 - DNA, 23 bp, Homo sapiens
ttcatttctaacataagtaagac

SEQ ID NO: 1865967 - DNA, 23 bp, Homo sapiens
ttccaaaataatctatattaaat

SEQ ID NO: 1865968 - DNA, 17 bp, Homo sapiens
ttccaaaccagtttatt

SEQ ID NO: 1865969 - DNA, 12 bp, Homo sapiens
ttccaaattatt

SEQ ID NO: 1865970 - DNA, 13 bp, Homo sapiens
ttccaaattatta

SEQ ID NO: 1865971 - DNA, 23 bp, Homo sapiens
ttccaaattattaattgtcctgt

SEQ ID NO: 1865972 - DNA, 16 bp, Homo sapiens
ttccaaggaaaattga

SEQ ID NO: 1865973 - DNA, 20 bp, Homo sapiens
ttccaaggaaaattgaaagt

SEQ ID NO: 1865974 - DNA, 17 bp, Homo sapiens
ttccagccttatgtgtt

SEQ ID NO: 1865975 - DNA, 10 bp, Homo sapiens
ttccctgccc

SEQ ID NO: 1865976 - DNA, 23 bp, Homo sapiens
ttccctgcccaatcctccctgga

SEQ ID NO: 1865977 - DNA, 22 bp, Homo sapiens
ttcccttctgatcttggaaaga

SEQ ID NO: 1865978 - DNA, 20 bp, Homo sapiens
ttccctttttaaaaaatacc

SEQ ID NO: 1865979 - DNA, 16 bp, Homo sapiens
ttccgacaccactggg

SEQ ID NO: 1865980 - DNA, 23 bp, Homo sapiens
ttcctcgggatgaaaagccatat

SEQ ID NO: 1865981 - DNA, 18 bp, Homo sapiens
ttcctctcactaaacttt

SEQ ID NO: 1865982 - DNA, 13 bp, Homo sapiens
ttcctcttgaacc

SEQ ID NO: 1865983 - DNA, 23 bp, Homo sapiens
ttcctcttttgtgagaagatggg

SEQ ID NO: 1865984 - DNA, 19 bp, Homo sapiens
ttcctgatggtacaggaaa

SEQ ID NO: 1865985 - DNA, 15 bp, Homo sapiens
ttcctgtctgtttat

SEQ ID NO: 1865986 - DNA, 17 bp, Homo sapiens
ttcctgtctgtttatat

SEQ ID NO: 1865987 - DNA, 13 bp, Homo sapiens
ttccttctgttaa

SEQ ID NO: 1865988 - DNA, 14 bp, Homo sapiens
ttccttctgttaag

SEQ ID NO: 1865989 - DNA, 18 bp, Homo sapiens
ttcgcttgttttaaaagg

SEQ ID NO: 1865990 - DNA, 13 bp, Homo sapiens
ttctaaattcact

SEQ ID NO: 1865991 - DNA, 18 bp, Homo sapiens
ttctaacataagtaagac

SEQ ID NO: 1865992 - DNA, 16 bp, Homo sapiens
ttctataataagtttt

SEQ ID NO: 1865993 - DNA, 22 bp, Homo sapiens
ttctataataagttttgatata

SEQ ID NO: 1865994 - DNA, 23 bp, Homo sapiens
ttctataataagttttgatataa

SEQ ID NO: 1865995 - DNA, 21 bp, Homo sapiens
ttctatggagactttgctgtt

SEQ ID NO: 1865996 - DNA, 22 bp, Homo sapiens
ttctattcaaggtggccaaatt

SEQ ID NO: 1865997 - DNA, 16 bp, Homo sapiens
ttctattttctctgat

SEQ ID NO: 1865998 - DNA, 15 bp, Homo sapiens
ttctattttgctgga

SEQ ID NO: 1865999 - DNA, 18 bp, Homo sapiens
ttctcattccaacagtga

SEQ ID NO: 1866000 - DNA, 20 bp, Homo sapiens
ttctcattccaacagtgagt

SEQ ID NO: 1866001 - DNA, 15 bp, Homo sapiens
ttctcccagagcaca

SEQ ID NO: 1866002 - DNA, 12 bp, Homo sapiens
ttctctttgaaa

SEQ ID NO: 1866003 - DNA, 16 bp, Homo sapiens
ttctgaaatacttttg

SEQ ID NO: 1866004 - DNA, 21 bp, Homo sapiens
ttctgacttacttaaccaggt

SEQ ID NO: 1866005 - DNA, 14 bp, Homo sapiens
ttctgatctgtact

SEQ ID NO: 1866006 - DNA, 15 bp, Homo sapiens
ttctgcaagaattaa

SEQ ID NO: 1866007 - DNA, 14 bp, Homo sapiens
ttctggtgggttga

SEQ ID NO: 1866008 - DNA, 23 bp, Homo sapiens
ttctgtaaactcaaaacttaaca

SEQ ID NO: 1866009 - DNA, 14 bp, Homo sapiens
ttctgtagttttta

SEQ ID NO: 1866010 - DNA, 18 bp, Homo sapiens
ttcttaaaaactgtgtat

SEQ ID NO: 1866011 - DNA, 22 bp, Homo sapiens
ttcttaaaaactgtgtatcatt

SEQ ID NO: 1866012 - DNA, 20 bp, Homo sapiens
ttcttacaagcttaaagctt

SEQ ID NO: 1866013 - DNA, 13 bp, Homo sapiens
ttcttacataatt

SEQ ID NO: 1866014 - DNA, 14 bp, Homo sapiens
ttcttgaattgtta

SEQ ID NO: 1866015 - DNA, 15 bp, Homo sapiens
ttcttggttgttaat

SEQ ID NO: 1866016 - DNA, 14 bp, Homo sapiens
ttcttgtcaaaaaa

SEQ ID NO: 1866017 - DNA, 18 bp, Homo sapiens
ttgaaaaatattgctaaa

SEQ ID NO: 1866018 - DNA, 18 bp, Homo sapiens
ttgaaacctttctacttt

SEQ ID NO: 1866019 - DNA, 16 bp, Homo sapiens
ttgaaagtattcagaa

SEQ ID NO: 1866020 - DNA, 17 bp, Homo sapiens
ttgaaagtattcagaaa

SEQ ID NO: 1866021 - DNA, 20 bp, Homo sapiens
ttgaaagtattcagaaatta

SEQ ID NO: 1866022 - DNA, 15 bp, Homo sapiens
ttgaaagttgctttt

SEQ ID NO: 1866023 - DNA, 23 bp, Homo sapiens
ttgaaatcagtaaacactgtgta

SEQ ID NO: 1866024 - DNA, 18 bp, Homo sapiens
ttgaaggtaataaataca

SEQ ID NO: 1866025 - DNA, 21 bp, Homo sapiens
ttgaataaaaagtgaactttt

SEQ ID NO: 1866026 - DNA, 15 bp, Homo sapiens
aaatttttgaaaaat

SEQ ID NO: 1866027 - DNA, 22 bp, Homo sapiens
aaatttttgaaaaatattgcta

SEQ ID NO: 1866028 - DNA, 12 bp, Homo sapiens
aacaaaatagaa

SEQ ID NO: 1866029 - DNA, 19 bp, Homo sapiens
aacaaagttactggctctt

SEQ ID NO: 1866030 - DNA, 15 bp, Homo sapiens
aacaacttgctactt

SEQ ID NO: 1866031 - DNA, 17 bp, Homo sapiens
aacaagatcattatctt

SEQ ID NO: 1866032 - DNA, 17 bp, Homo sapiens
aacacaaaaaaataata

SEQ ID NO: 1866033 - DNA, 14 bp, Homo sapiens
aacacatggcagaa

SEQ ID NO: 1866034 - DNA, 22 bp, Homo sapiens
aacactgttggcacttataggt

SEQ ID NO: 1866035 - DNA, 14 bp, Homo sapiens
aacagagaaagaaa

SEQ ID NO: 1866036 - DNA, 15 bp, Homo sapiens
aacagagaaagaaaa

SEQ ID NO: 1866037 - DNA, 20 bp, Homo sapiens
aacagagaaagaaaaggcaa

SEQ ID NO: 1866038 - DNA, 16 bp, Homo sapiens
aacagtgcaagatttt

SEQ ID NO: 1866039 - DNA, 20 bp, Homo sapiens
aacatggctacttgctttga

SEQ ID NO: 1866040 - DNA, 17 bp, Homo sapiens
aacatttagtaccctgc

SEQ ID NO: 1866041 - DNA, 12 bp, Homo sapiens
aacatttctgta

SEQ ID NO: 1866042 - DNA, 13 bp, Homo sapiens
aacatttctgtat

SEQ ID NO: 1866043 - DNA, 14 bp, Homo sapiens
aaccaagggccctc

SEQ ID NO: 1866044 - DNA, 22 bp, Homo sapiens
aaccacactgaaacctcttcgg

SEQ ID NO: 1866045 - DNA, 22 bp, Homo sapiens
aaccaccccataccagtcacct

SEQ ID NO: 1866046 - DNA, 21 bp, Homo sapiens
aaccagtctttcaactcattg

SEQ ID NO: 1866047 - DNA, 18 bp, Homo sapiens
aaccagtttattctgtgg

SEQ ID NO: 1866048 - DNA, 20 bp, Homo sapiens
aaccagtttattctgtggtt

SEQ ID NO: 1866049 - DNA, 17 bp, Homo sapiens
aaccctttgtattataa

SEQ ID NO: 1866050 - DNA, 12 bp, Homo sapiens
aaccgtggggag

SEQ ID NO: 1866051 - DNA, 17 bp, Homo sapiens
aacctagcttttaaaaa

SEQ ID NO: 1866052 - DNA, 19 bp, Homo sapiens
aatgatcacatctaaagct

SEQ ID NO: 1866053 - DNA, 20 bp, Homo sapiens
aatgatcacatctaaagctt

SEQ ID NO: 1866054 - DNA, 22 bp, Homo sapiens
aatgatcacatctaaagcttta

SEQ ID NO: 1866055 - DNA, 12 bp, Homo sapiens
aatgatgataat

SEQ ID NO: 1866056 - DNA, 14 bp, Homo sapiens
aatgattgtaaaat

SEQ ID NO: 1866057 - DNA, 18 bp, Homo sapiens
aatgattgtttaaaggtt

SEQ ID NO: 1866058 - DNA, 20 bp, Homo sapiens
aatgccaggcggacaaagtt

SEQ ID NO: 1866059 - DNA, 23 bp, Homo sapiens
aatgccctgccttgctgccttca

SEQ ID NO: 1866060 - DNA, 24 bp, Homo sapiens
aatgccttggtttgatttctagta

SEQ ID NO: 1866061 - DNA, 16 bp, Homo sapiens
aatgctcatacacagt

SEQ ID NO: 1866062 - DNA, 11 bp, Homo sapiens
aatgctttctg

SEQ ID NO: 1866063 - DNA, 18 bp, Homo sapiens
aatggactgtgaatttca

SEQ ID NO: 1866064 - DNA, 14 bp, Homo sapiens
aatgggaaagtatt

SEQ ID NO: 1866065 - DNA, 17 bp, Homo sapiens
aatggggcgctggacac

SEQ ID NO: 1866066 - DNA, 18 bp, Homo sapiens
aatggttgccttaaagaa

SEQ ID NO: 1866067 - DNA, 16 bp, Homo sapiens
aatgtacttaaatgag

SEQ ID NO: 1866068 - DNA, 22 bp, Homo sapiens
aatgtacttaaatgagttactt

SEQ ID NO: 1866069 - DNA, 20 bp, Homo sapiens
aatgtaggcacttttatttt

SEQ ID NO: 1866070 - DNA, 18 bp, Homo sapiens
aatgtcctgcatgcataa

SEQ ID NO: 1866071 - DNA, 23 bp, Homo sapiens
aatgttatttgttattttcagta

SEQ ID NO: 1866072 - DNA, 14 bp, Homo sapiens
aatgtttaattcat

SEQ ID NO: 1866073 - DNA, 17 bp, Homo sapiens
aattaaaaatgaaaatt

SEQ ID NO: 1866074 - DNA, 15 bp, Homo sapiens
aattaaaactgagtc

SEQ ID NO: 1866075 - DNA, 21 bp, Homo sapiens
aattaaaactgagtccatgaa

SEQ ID NO: 1866076 - DNA, 11 bp, Homo sapiens
aattaaaatat

SEQ ID NO: 1866077 - DNA, 17 bp, Homo sapiens
aattaaaatattatttg

SEQ ID NO: 1866078 - DNA, 20 bp, Homo sapiens
aattaaaatattatttgata

SEQ ID NO: 1866079 - DNA, 12 bp, Homo sapiens
aattaatctttt

SEQ ID NO: 1866080 - DNA, 13 bp, Homo sapiens
aattaatctttta

SEQ ID NO: 1866081 - DNA, 17 bp, Homo sapiens
aattaatcttttaaaaa

SEQ ID NO: 1866082 - DNA, 20 bp, Homo sapiens
aattaatcttttaaaaatga

SEQ ID NO: 1866083 - DNA, 13 bp, Homo sapiens
aattaattaaaag

SEQ ID NO: 1866084 - DNA, 20 bp, Homo sapiens
aattagcagaatggagaaag

SEQ ID NO: 1866085 - DNA, 20 bp, Homo sapiens
aattatataggttgtgcaaa

SEQ ID NO: 1866086 - DNA, 14 bp, Homo sapiens
aattatttaataaa

SEQ ID NO: 1866087 - DNA, 14 bp, Homo sapiens
agaaattaaaatat

SEQ ID NO: 1866088 - DNA, 16 bp, Homo sapiens
agaaatttgatttcta

SEQ ID NO: 1866089 - DNA, 11 bp, Homo sapiens
agaacaacttg

SEQ ID NO: 1866090 - DNA, 18 bp, Homo sapiens
agaacaacttgctactta

SEQ ID NO: 1866091 - DNA, 17 bp, Homo sapiens
agaaccagtctttcaac

SEQ ID NO: 1866092 - DNA, 23 bp, Homo sapiens
agaaccttactggcactgtggca

SEQ ID NO: 1866093 - DNA, 15 bp, Homo sapiens
agaagacccctgccc

SEQ ID NO: 1866094 - DNA, 16 bp, Homo sapiens
agaagacccctgccca

SEQ ID NO: 1866095 - DNA, 19 bp, Homo sapiens
agaagacccctgcccaagt

SEQ ID NO: 1866096 - DNA, 19 bp, Homo sapiens
agaagagaggggaagaatt

SEQ ID NO: 1866097 - DNA, 21 bp, Homo sapiens
agaagagaggggaagaattta

SEQ ID NO: 1866098 - DNA, 13 bp, Homo sapiens
agaagatgagggt

SEQ ID NO: 1866099 - DNA, 13 bp, Homo sapiens
agaaggccagccc

SEQ ID NO: 1866100 - DNA, 17 bp, Homo sapiens
agaaggccagcccactg

SEQ ID NO: 1866101 - DNA, 14 bp, Homo sapiens
agaagggacatggg

SEQ ID NO: 1866102 - DNA, 20 bp, Homo sapiens
agaagggggagtgaaacaga

SEQ ID NO: 1866103 - DNA, 13 bp, Homo sapiens
agaagttttaact

SEQ ID NO: 1866104 - DNA, 17 bp, Homo sapiens
agaagttttttactttg

SEQ ID NO: 1866105 - DNA, 16 bp, Homo sapiens
agaatgatttttagat

SEQ ID NO: 1866106 - DNA, 14 bp, Homo sapiens
agaatgcattaaaa

SEQ ID NO: 1866107 - DNA, 22 bp, Homo sapiens
agaatgccataaaattgcagtt

SEQ ID NO: 1866108 - DNA, 15 bp, Homo sapiens
agaatggagaaagta

SEQ ID NO: 1866109 - DNA, 19 bp, Homo sapiens
agaatggagaaagtaagtc

SEQ ID NO: 1866110 - DNA, 23 bp, Homo sapiens
agaatggttgccttaaagaaagt

SEQ ID NO: 1866111 - DNA, 12 bp, Homo sapiens
agaattaaaact

SEQ ID NO: 1866112 - DNA, 13 bp, Homo sapiens
agaattaaaactg

SEQ ID NO: 1866113 - DNA, 22 bp, Homo sapiens
agaattatataggttgtgcaaa

SEQ ID NO: 1866114 - DNA, 15 bp, Homo sapiens
agaattgcaatctat

SEQ ID NO: 1866115 - DNA, 17 bp, Homo sapiens
agaattgcaatctataa

SEQ ID NO: 1866116 - DNA, 15 bp, Homo sapiens
agacaattagcagaa

SEQ ID NO: 1866117 - DNA, 19 bp, Homo sapiens
agacaattagcagaatgga

SEQ ID NO: 1866118 - DNA, 17 bp, Homo sapiens
agacacatacaaaaaaa

SEQ ID NO: 1866119 - DNA, 18 bp, Homo sapiens
agacacatgctgaggttt

SEQ ID NO: 1866120 - DNA, 20 bp, Homo sapiens
agacataaaactttaaaagg

SEQ ID NO: 1866121 - DNA, 22 bp, Homo sapiens
agacataaaactttaaaaggca

SEQ ID NO: 1866122 - DNA, 14 bp, Homo sapiens
agacatctgcctgt

SEQ ID NO: 1866123 - DNA, 19 bp, Homo sapiens
agacatctgcctgtaatta

SEQ ID NO: 1866124 - DNA, 13 bp, Homo sapiens
agacccctgccca

SEQ ID NO: 1866125 - DNA, 14 bp, Homo sapiens
agacccctgcccaa

SEQ ID NO: 1866126 - DNA, 13 bp, Homo sapiens
agacctttatcca

SEQ ID NO: 1866127 - DNA, 14 bp, Homo sapiens
agactcagaggacc

SEQ ID NO: 1866128 - DNA, 17 bp, Homo sapiens
agactggtcctgtgtgc

SEQ ID NO: 1866129 - DNA, 13 bp, Homo sapiens
agactggtttgtt

SEQ ID NO: 1866130 - DNA, 16 bp, Homo sapiens
agactggtttgtttgc

SEQ ID NO: 1866131 - DNA, 17 bp, Homo sapiens
agactggtttgtttgct

SEQ ID NO: 1866132 - DNA, 21 bp, Homo sapiens
agactggtttgtttgcttaat

SEQ ID NO: 1866133 - DNA, 16 bp, Homo sapiens
agactgtcaaatgaac

SEQ ID NO: 1866134 - DNA, 19 bp, Homo sapiens
agactgtcaaatgaacttt

SEQ ID NO: 1866135 - DNA, 14 bp, Homo sapiens
agacttgcggccac

SEQ ID NO: 1866136 - DNA, 18 bp, Homo sapiens
agacttggcaacagaagc

SEQ ID NO: 1866137 - DNA, 12 bp, Homo sapiens
agagaaagaaaa

SEQ ID NO: 1866138 - DNA, 19 bp, Homo sapiens
agagaatgaactgtggaat

SEQ ID NO: 1866139 - DNA, 20 bp, Homo sapiens
agagaatgaactgtggaatt

SEQ ID NO: 1866140 - DNA, 18 bp, Homo sapiens
agagactcagaggaccca

SEQ ID NO: 1866141 - DNA, 17 bp, Homo sapiens
agagacttttaatcaga

SEQ ID NO: 1866142 - DNA, 23 bp, Homo sapiens
agagagcatcttttcctcccatt

SEQ ID NO: 1866143 - DNA, 18 bp, Homo sapiens
agagaggggaagaattta

SEQ ID NO: 1866144 - DNA, 19 bp, Homo sapiens
agagaggggaagaatttaa

SEQ ID NO: 1866145 - DNA, 20 bp, Homo sapiens
agagaggggaagaatttaat

SEQ ID NO: 1866146 - DNA, 15 bp, Homo sapiens
agagatgaaataatt

SEQ ID NO: 1866147 - DNA, 16 bp, Homo sapiens
agagatgaaataattt

SEQ ID NO: 1866148 - DNA, 22 bp, Homo sapiens
agagcacaagaaggccagccca

SEQ ID NO: 1866149 - DNA, 18 bp, Homo sapiens
agagcacctagtccagtg

SEQ ID NO: 1866150 - DNA, 19 bp, Homo sapiens
agagcacctagtccagtga

SEQ ID NO: 1866151 - DNA, 16 bp, Homo sapiens
agtgagtgccatgctt

SEQ ID NO: 1866152 - DNA, 22 bp, Homo sapiens
agtgagttttactcttaaatca

SEQ ID NO: 1866153 - DNA, 16 bp, Homo sapiens
agtgatttacatgctg

SEQ ID NO: 1866154 - DNA, 14 bp, Homo sapiens
agtgcagcgggcca

SEQ ID NO: 1866155 - DNA, 21 bp, Homo sapiens
agtgcatttaaggagattggg

SEQ ID NO: 1866156 - DNA, 14 bp, Homo sapiens
agtgccaaataatt

SEQ ID NO: 1866157 - DNA, 18 bp, Homo sapiens
agtggaaagtcacctaca

SEQ ID NO: 1866158 - DNA, 20 bp, Homo sapiens
agtggcactaaaatgtttaa

SEQ ID NO: 1866159 - DNA, 13 bp, Homo sapiens
agtggctcttggg

SEQ ID NO: 1866160 - DNA, 23 bp, Homo sapiens
agtgtatttaagaaagggaaagc

SEQ ID NO: 1866161 - DNA, 17 bp, Homo sapiens
agtgtcgggaattttcc

SEQ ID NO: 1866162 - DNA, 20 bp, Homo sapiens
agttaatatatcccagaaat

SEQ ID NO: 1866163 - DNA, 15 bp, Homo sapiens
agttacttagaatgc

SEQ ID NO: 1866164 - DNA, 17 bp, Homo sapiens
agttataagcgtattta

SEQ ID NO: 1866165 - DNA, 15 bp, Homo sapiens
agttataataactga

SEQ ID NO: 1866166 - DNA, 19 bp, Homo sapiens
agttataataactgaactg

SEQ ID NO: 1866167 - DNA, 20 bp, Homo sapiens
agttataataactgaactgt

SEQ ID NO: 1866168 - DNA, 15 bp, Homo sapiens
agttatagaaagcaa

SEQ ID NO: 1866169 - DNA, 15 bp, Homo sapiens
agttatagtttcaga

SEQ ID NO: 1866170 - DNA, 12 bp, Homo sapiens
agttattgtaca

SEQ ID NO: 1866171 - DNA, 16 bp, Homo sapiens
agttcatataatttaa

SEQ ID NO: 1866172 - DNA, 18 bp, Homo sapiens
agttcatataatttaaag

SEQ ID NO: 1866173 - DNA, 21 bp, Homo sapiens
agttctatggagactttgctg

SEQ ID NO: 1866174 - DNA, 23 bp, Homo sapiens
agttctatggagactttgctgtt

SEQ ID NO: 1866175 - DNA, 12 bp, Homo sapiens
agttcttgaatt

SEQ ID NO: 1866176 - DNA, 13 bp, Homo sapiens
agttcttgaattg

SEQ ID NO: 1866177 - DNA, 14 bp, Homo sapiens
agttcttgaattgt

SEQ ID NO: 1866178 - DNA, 16 bp, Homo sapiens
agttcttgaattgtta

SEQ ID NO: 1866179 - DNA, 19 bp, Homo sapiens
agttgagtatattataata

SEQ ID NO: 1866180 - DNA, 20 bp, Homo sapiens
agttgagtcgtcatcacttt

SEQ ID NO: 1866181 - DNA, 17 bp, Homo sapiens
agttgatattcaaggct

SEQ ID NO: 1866182 - DNA, 14 bp, Homo sapiens
agttgctagcaaac

SEQ ID NO: 1866183 - DNA, 15 bp, Homo sapiens
agttgtgccttttat

SEQ ID NO: 1866184 - DNA, 14 bp, Homo sapiens
agttgttgtttgcc

SEQ ID NO: 1866185 - DNA, 15 bp, Homo sapiens
agtttacaagtgtat

SEQ ID NO: 1866186 - DNA, 16 bp, Homo sapiens
agtttacaagtgtata

SEQ ID NO: 1866187 - DNA, 23 bp, Homo sapiens
agtttacaagtgtatatcagaaa

SEQ ID NO: 1866188 - DNA, 16 bp, Homo sapiens
agtttacagtttgtgt

SEQ ID NO: 1866189 - DNA, 13 bp, Homo sapiens
agtttattctgtg

SEQ ID NO: 1866190 - DNA, 17 bp, Homo sapiens
agtttattctgtggttc

SEQ ID NO: 1866191 - DNA, 23 bp, Homo sapiens
agtttattctgtggttctataat

SEQ ID NO: 1866192 - DNA, 15 bp, Homo sapiens
agtttcagatatata

SEQ ID NO: 1866193 - DNA, 17 bp, Homo sapiens
agtttcagatatatatc

SEQ ID NO: 1866194 - DNA, 23 bp, Homo sapiens
agtttcagatatatatcatattg

SEQ ID NO: 1866195 - DNA, 15 bp, Homo sapiens
agtttctcaagttta

SEQ ID NO: 1866196 - DNA, 15 bp, Homo sapiens
agtttgctaaaagaa

SEQ ID NO: 1866197 - DNA, 16 bp, Homo sapiens
agtttgctaaaagaag

SEQ ID NO: 1866198 - DNA, 17 bp, Homo sapiens
agtttgctaaaagaaga

SEQ ID NO: 1866199 - DNA, 18 bp, Homo sapiens
agtttgctaaaagaagag

SEQ ID NO: 1866200 - DNA, 21 bp, Homo sapiens
agtttgctaaaagaagagagg

SEQ ID NO: 1866201 - DNA, 15 bp, Homo sapiens
agtttgtacatgcat

SEQ ID NO: 1866202 - DNA, 17 bp, Homo sapiens
agtttgtataacttctt

SEQ ID NO: 1866203 - DNA, 21 bp, Homo sapiens
agtttgtgttttaaaaaaact

SEQ ID NO: 1866204 - DNA, 22 bp, Homo sapiens
agtttgtgttttaaaaaaactg

SEQ ID NO: 1866205 - DNA, 23 bp, Homo sapiens
agtttgtgttttaaaaaaactga

SEQ ID NO: 1866206 - DNA, 20 bp, Homo sapiens
agttttactcttaaatcatt

SEQ ID NO: 1866207 - DNA, 23 bp, Homo sapiens
agttttactcttaaatcatttgg

SEQ ID NO: 1866208 - DNA, 21 bp, Homo sapiens
agtttttaattaaaaacttta

SEQ ID NO: 1866209 - DNA, 16 bp, Homo sapiens
agtttttttttttcca

SEQ ID NO: 1866210 - DNA, 17 bp, Homo sapiens
ataaaaaaatatataca

SEQ ID NO: 1866211 - DNA, 19 bp, Homo sapiens
ataaaaaaatatatacaga

SEQ ID NO: 1866212 - DNA, 20 bp, Homo sapiens
ataaaaaaatatatacagat

SEQ ID NO: 1866213 - DNA, 13 bp, Homo sapiens
ataaaaaggaaat

SEQ ID NO: 1866214 - DNA, 20 bp, Homo sapiens
ataaaaaggaaattagtctt

SEQ ID NO: 1866215 - DNA, 15 bp, Homo sapiens
ataaaactttaaaag

SEQ ID NO: 1866216 - DNA, 21 bp, Homo sapiens
ataaaatgggaattctgactt

SEQ ID NO: 1866217 - DNA, 22 bp, Homo sapiens
ataaaattgcagtttcatgtat

SEQ ID NO: 1866218 - DNA, 15 bp, Homo sapiens
ataaacagttttgga

SEQ ID NO: 1866219 - DNA, 14 bp, Homo sapiens
ataaactatcagtt

SEQ ID NO: 1866220 - DNA, 20 bp, Homo sapiens
ataacactgttggcacttat

SEQ ID NO: 1866221 - DNA, 12 bp, Homo sapiens
ataacatagaat

SEQ ID NO: 1866222 - DNA, 12 bp, Homo sapiens
ataactgaactg

SEQ ID NO: 1866223 - DNA, 17 bp, Homo sapiens
ataacttcttaaaagtt

SEQ ID NO: 1866224 - DNA, 18 bp, Homo sapiens
ataagaatggttgcctta

SEQ ID NO: 1866225 - DNA, 19 bp, Homo sapiens
ataaggatcttttgtaaat

SEQ ID NO: 1866226 - DNA, 19 bp, Homo sapiens
ataagttttatacataaac

SEQ ID NO: 1866227 - DNA, 15 bp, Homo sapiens
ataataactgaactg

SEQ ID NO: 1866228 - DNA, 17 bp, Homo sapiens
ataataactgaactgtt

SEQ ID NO: 1866229 - DNA, 22 bp, Homo sapiens
ataataagttttgatataatct

SEQ ID NO: 1866230 - DNA, 18 bp, Homo sapiens
ataatcatgctcatgtat

SEQ ID NO: 1866231 - DNA, 15 bp, Homo sapiens
ataatctatattaaa

SEQ ID NO: 1866232 - DNA, 17 bp, Homo sapiens
ataatctatattaaatg

SEQ ID NO: 1866233 - DNA, 18 bp, Homo sapiens
ataatcttggcttcttaa

SEQ ID NO: 1866234 - DNA, 19 bp, Homo sapiens
ataatcttggcttcttaaa

SEQ ID NO: 1866235 - DNA, 20 bp, Homo sapiens
ataatcttggcttcttaaaa

SEQ ID NO: 1866236 - DNA, 18 bp, Homo sapiens
ataatgaaccgtttacag

SEQ ID NO: 1866237 - DNA, 21 bp, Homo sapiens
ataatgaaccgtttacagtgt

SEQ ID NO: 1866238 - DNA, 14 bp, Homo sapiens
ataatgtgtctgtg

SEQ ID NO: 1866239 - DNA, 20 bp, Homo sapiens
ataattcaccaaaagttcat

SEQ ID NO: 1866240 - DNA, 21 bp, Homo sapiens
ataatttaaagaaacactaaa

SEQ ID NO: 1866241 - DNA, 22 bp, Homo sapiens
ataatttaaagaaacactaaat

SEQ ID NO: 1866242 - DNA, 12 bp, Homo sapiens
ataatttgcaat

SEQ ID NO: 1866243 - DNA, 20 bp, Homo sapiens
ataatttgcaatttcaggaa

SEQ ID NO: 1866244 - DNA, 13 bp, Homo sapiens
ataatttgtctta

SEQ ID NO: 1866245 - DNA, 15 bp, Homo sapiens
ataatttgtcttagt

SEQ ID NO: 1866246 - DNA, 16 bp, Homo sapiens
ataattttttattcaa

SEQ ID NO: 1866247 - DNA, 13 bp, Homo sapiens
ataattttttgca

SEQ ID NO: 1866248 - DNA, 15 bp, Homo sapiens
ataattttttgcagt

SEQ ID NO: 1866249 - DNA, 19 bp, Homo sapiens
ataattttttgcagtcttt

SEQ ID NO: 1866250 - DNA, 23 bp, Homo sapiens
ataattttttgcagtcttttgct

SEQ ID NO: 1866251 - DNA, 16 bp, Homo sapiens
atacaaaaaaaatctt

SEQ ID NO: 1866252 - DNA, 10 bp, Homo sapiens
atacacacac

SEQ ID NO: 1866253 - DNA, 15 bp, Homo sapiens
atacataaacagttt

SEQ ID NO: 1866254 - DNA, 20 bp, Homo sapiens
ataccataggaagacataaa

SEQ ID NO: 1866255 - DNA, 13 bp, Homo sapiens
atacccaacagtt

SEQ ID NO: 1866256 - DNA, 22 bp, Homo sapiens
atacttttgagtatggctatct

SEQ ID NO: 1866257 - DNA, 14 bp, Homo sapiens
atacttttttgaaa

SEQ ID NO: 1866258 - DNA, 17 bp, Homo sapiens
atacttttttgaaatca

SEQ ID NO: 1866259 - DNA, 14 bp, Homo sapiens
atactttttttcac

SEQ ID NO: 1866260 - DNA, 13 bp, Homo sapiens
atagaagctgtag

SEQ ID NO: 1866261 - DNA, 23 bp, Homo sapiens
atagaggccaaattaatctttta

SEQ ID NO: 1866262 - DNA, 17 bp, Homo sapiens
atagaggggttttagat

SEQ ID NO: 1866263 - DNA, 16 bp, Homo sapiens
atagaggtaccagcaa

SEQ ID NO: 1866264 - DNA, 14 bp, Homo sapiens
atagattaaatcat

SEQ ID NO: 1866265 - DNA, 16 bp, Homo sapiens
atagattgtcttaatg

SEQ ID NO: 1866266 - DNA, 19 bp, Homo sapiens
atagcatttttgatttatg

SEQ ID NO: 1866267 - DNA, 14 bp, Homo sapiens
atagctattactgt

SEQ ID NO: 1866268 - DNA, 22 bp, Homo sapiens
atagctattactgtctggtttt

SEQ ID NO: 1866269 - DNA, 17 bp, Homo sapiens
atagcttgtatagtgta

SEQ ID NO: 1866270 - DNA, 13 bp, Homo sapiens
agagcgtttggtt

SEQ ID NO: 1866271 - DNA, 16 bp, Homo sapiens
agagcttgtagccctg

SEQ ID NO: 1866272 - DNA, 18 bp, Homo sapiens
agagggccaagacttggc

SEQ ID NO: 1866273 - DNA, 12 bp, Homo sapiens
agaggggaagaa

SEQ ID NO: 1866274 - DNA, 17 bp, Homo sapiens
agaggttttatttacat

SEQ ID NO: 1866275 - DNA, 19 bp, Homo sapiens
agaggttttgttgttttat

SEQ ID NO: 1866276 - DNA, 21 bp, Homo sapiens
agagtagatggtgaaatttat

SEQ ID NO: 1866277 - DNA, 17 bp, Homo sapiens
agagtcacccccccagg

SEQ ID NO: 1866278 - DNA, 19 bp, Homo sapiens
agagtcacccccccaggcc

SEQ ID NO: 1866279 - DNA, 22 bp, Homo sapiens
agagtcacccccccaggcctcc

SEQ ID NO: 1866280 - DNA, 20 bp, Homo sapiens
agagtcagccattcctgttc

SEQ ID NO: 1866281 - DNA, 15 bp, Homo sapiens
agagtggcctgtgag

SEQ ID NO: 1866282 - DNA, 19 bp, Homo sapiens
agagttgttgtttgccaag

SEQ ID NO: 1866283 - DNA, 20 bp, Homo sapiens
agagttgttgtttgccaagc

SEQ ID NO: 1866284 - DNA, 21 bp, Homo sapiens
agataagtctacattaaacaa

SEQ ID NO: 1866285 - DNA, 21 bp, Homo sapiens
agatacagatggagcaaatgt

SEQ ID NO: 1866286 - DNA, 17 bp, Homo sapiens
agatagaggggttttag

SEQ ID NO: 1866287 - DNA, 21 bp, Homo sapiens
agatcatataagcaagacagt

SEQ ID NO: 1866288 - DNA, 15 bp, Homo sapiens
agatctttaaataca

SEQ ID NO: 1866289 - DNA, 19 bp, Homo sapiens
agatctttaaatacagtca

SEQ ID NO: 1866290 - DNA, 13 bp, Homo sapiens
agatgatggaaac

SEQ ID NO: 1866291 - DNA, 16 bp, Homo sapiens
agatgatggaaacgca

SEQ ID NO: 1866292 - DNA, 23 bp, Homo sapiens
agatgctgaaggtgagaggaaat

SEQ ID NO: 1866293 - DNA, 18 bp, Homo sapiens
agatgggggctggagggg

SEQ ID NO: 1866294 - DNA, 21 bp, Homo sapiens
agatggtctgcatcagctttt

SEQ ID NO: 1866295 - DNA, 16 bp, Homo sapiens
agatgttccaaattta

SEQ ID NO: 1866296 - DNA, 17 bp, Homo sapiens
agatgttccaaatttag

SEQ ID NO: 1866297 - DNA, 13 bp, Homo sapiens
agattacaataaa

SEQ ID NO: 1866298 - DNA, 17 bp, Homo sapiens
agattcctgttgtgtaa

SEQ ID NO: 1866299 - DNA, 22 bp, Homo sapiens
agattcctgttgtgtaataaca

SEQ ID NO: 1866300 - DNA, 20 bp, Homo sapiens
agattgggagacaattagca

SEQ ID NO: 1866301 - DNA, 22 bp, Homo sapiens
agatttactgctctagaaagta

SEQ ID NO: 1866302 - DNA, 15 bp, Homo sapiens
agatttctctttgaa

SEQ ID NO: 1866303 - DNA, 15 bp, Homo sapiens
agcaaaatgcatgta

SEQ ID NO: 1866304 - DNA, 20 bp, Homo sapiens
agcaaaatgcatgtaatcaa

SEQ ID NO: 1866305 - DNA, 13 bp, Homo sapiens
agcaaagccatat

SEQ ID NO: 1866306 - DNA, 14 bp, Homo sapiens
agcaagagccaggg

SEQ ID NO: 1866307 - DNA, 17 bp, Homo sapiens
agcaagccaggagaaga

SEQ ID NO: 1866308 - DNA, 15 bp, Homo sapiens
agcaatatgtaaata

SEQ ID NO: 1866309 - DNA, 15 bp, Homo sapiens
agcaatgccctgcct

SEQ ID NO: 1866310 - DNA, 17 bp, Homo sapiens
agcaatgccctgccttg

SEQ ID NO: 1866311 - DNA, 20 bp, Homo sapiens
agcaatgccctgccttgctg

SEQ ID NO: 1866312 - DNA, 21 bp, Homo sapiens
agggactggacagccagggca

SEQ ID NO: 1866313 - DNA, 12 bp, Homo sapiens
agggagaaatgc

SEQ ID NO: 1866314 - DNA, 14 bp, Homo sapiens
agggaggagggccg

SEQ ID NO: 1866315 - DNA, 21 bp, Homo sapiens
agggatgcaaaggttgcagtg

SEQ ID NO: 1866316 - DNA, 16 bp, Homo sapiens
agggccctcactcagg

SEQ ID NO: 1866317 - DNA, 17 bp, Homo sapiens
agggccctcactcagga

SEQ ID NO: 1866318 - DNA, 20 bp, Homo sapiens
agggccctcactcaggaacc

SEQ ID NO: 1866319 - DNA, 14 bp, Homo sapiens
agggccgagacagg

SEQ ID NO: 1866320 - DNA, 11 bp, Homo sapiens
agggcctctgg

SEQ ID NO: 1866321 - DNA, 17 bp, Homo sapiens
agggcctctggcttccc

SEQ ID NO: 1866322 - DNA, 20 bp, Homo sapiens
aggggaaacctgtgaaagct

SEQ ID NO: 1866323 - DNA, 16 bp, Homo sapiens
agggggagtgaaacag

SEQ ID NO: 1866324 - DNA, 23 bp, Homo sapiens
agggggagtgaaacagagaaaga

SEQ ID NO: 1866325 - DNA, 22 bp, Homo sapiens
aggggtgtcccagtcccagcct

SEQ ID NO: 1866326 - DNA, 17 bp, Homo sapiens
agggtgtcggctgtgag

SEQ ID NO: 1866327 - DNA, 14 bp, Homo sapiens
agggttatatttgg

SEQ ID NO: 1866328 - DNA, 22 bp, Homo sapiens
aggtaacgtgattgattcagta

SEQ ID NO: 1866329 - DNA, 15 bp, Homo sapiens
aggtaataaatacac

SEQ ID NO: 1866330 - DNA, 19 bp, Homo sapiens
aggtaatttttttttgtaa

SEQ ID NO: 1866331 - DNA, 16 bp, Homo sapiens
aggtataaggatcttt

SEQ ID NO: 1866332 - DNA, 17 bp, Homo sapiens
aggtcatggagcagccc

SEQ ID NO: 1866333 - DNA, 18 bp, Homo sapiens
aggtcatggagcagcccc

SEQ ID NO: 1866334 - DNA, 20 bp, Homo sapiens
aggtctacattcttggttgt

SEQ ID NO: 1866335 - DNA, 22 bp, Homo sapiens
aggtctcatgcccactccccca

SEQ ID NO: 1866336 - DNA, 23 bp, Homo sapiens
aggtctcatgcccactcccccag

SEQ ID NO: 1866337 - DNA, 21 bp, Homo sapiens
aggtgaagtcgagcactctaa

SEQ ID NO: 1866338 - DNA, 15 bp, Homo sapiens
aggtgacctgttagg

SEQ ID NO: 1866339 - DNA, 16 bp, Homo sapiens
aggtgtcatttgacaa

SEQ ID NO: 1866340 - DNA, 23 bp, Homo sapiens
aggtgtggaccggccgcagcccc

SEQ ID NO: 1866341 - DNA, 21 bp, Homo sapiens
aggttttaaaaataagtttta

SEQ ID NO: 1866342 - DNA, 23 bp, Homo sapiens
aggttttgaataaaaagtgaact

SEQ ID NO: 1866343 - DNA, 20 bp, Homo sapiens
aggttttttttttaagtgca

SEQ ID NO: 1866344 - DNA, 21 bp, Homo sapiens
aggttttttttttaagtgcaa

SEQ ID NO: 1866345 - DNA, 16 bp, Homo sapiens
agtaaacactgtgtat

SEQ ID NO: 1866346 - DNA, 18 bp, Homo sapiens
agtaaacttgtgtattga

SEQ ID NO: 1866347 - DNA, 18 bp, Homo sapiens
agtacaatgtgactttga

SEQ ID NO: 1866348 - DNA, 14 bp, Homo sapiens
agtaccctgcaggc

SEQ ID NO: 1866349 - DNA, 14 bp, Homo sapiens
agtactatctttgt

SEQ ID NO: 1866350 - DNA, 22 bp, Homo sapiens
agtagaaagacatctgcctgta

SEQ ID NO: 1866351 - DNA, 15 bp, Homo sapiens
agtatagtagaaaga

SEQ ID NO: 1866352 - DNA, 18 bp, Homo sapiens
agtatcttagagtttaca

SEQ ID NO: 1866353 - DNA, 21 bp, Homo sapiens
agtatgtaaagtatgtaaaca

SEQ ID NO: 1866354 - DNA, 18 bp, Homo sapiens
agtatgtccttcagctga

SEQ ID NO: 1866355 - DNA, 18 bp, Homo sapiens
agtattcagaaattaaaa

SEQ ID NO: 1866356 - DNA, 15 bp, Homo sapiens
agtattcttgtcaaa

SEQ ID NO: 1866357 - DNA, 17 bp, Homo sapiens
agtattttccagcctta

SEQ ID NO: 1866358 - DNA, 21 bp, Homo sapiens
agtattttccagccttatgtg

SEQ ID NO: 1866359 - DNA, 13 bp, Homo sapiens
agtatttttgaaa

SEQ ID NO: 1866360 - DNA, 16 bp, Homo sapiens
agtatttttgaaagaa

SEQ ID NO: 1866361 - DNA, 17 bp, Homo sapiens
agtatttttgaaagaat

SEQ ID NO: 1866362 - DNA, 22 bp, Homo sapiens
agtatttttgaaagaattctat

SEQ ID NO: 1866363 - DNA, 15 bp, Homo sapiens
agtcaattacatgtt

SEQ ID NO: 1866364 - DNA, 18 bp, Homo sapiens
agtcacccccccaggcct

SEQ ID NO: 1866365 - DNA, 23 bp, Homo sapiens
agtcacccccccaggcctccaga

SEQ ID NO: 1866366 - DNA, 17 bp, Homo sapiens
agtcacctacaggactg

SEQ ID NO: 1866367 - DNA, 19 bp, Homo sapiens
agtcacctacaggactggg

SEQ ID NO: 1866368 - DNA, 13 bp, Homo sapiens
agtcacctcctgc

SEQ ID NO: 1866369 - DNA, 17 bp, Homo sapiens
agtccagtgacctgctg

SEQ ID NO: 1866370 - DNA, 14 bp, Homo sapiens
agtccatgaaaata

SEQ ID NO: 1866371 - DNA, 16 bp, Homo sapiens
agtccatgaaaatacc

SEQ ID NO: 1866372 - DNA, 16 bp, Homo sapiens
agtcccagcctctggg

SEQ ID NO: 1866373 - DNA, 17 bp, Homo sapiens
agtcccagcctctgggg

SEQ ID NO: 1866374 - DNA, 19 bp, Homo sapiens
agtcctgctttcctatcta

SEQ ID NO: 1866375 - DNA, 14 bp, Homo sapiens
agtcctgtgaattt

SEQ ID NO: 1866376 - DNA, 17 bp, Homo sapiens
agtctgaatggcatgga

SEQ ID NO: 1866377 - DNA, 22 bp, Homo sapiens
agtctgattataccatgtgtgc

SEQ ID NO: 1866378 - DNA, 15 bp, Homo sapiens
agtcttaactgtatt

SEQ ID NO: 1866379 - DNA, 17 bp, Homo sapiens
agtcttaactgtatttc

SEQ ID NO: 1866380 - DNA, 18 bp, Homo sapiens
agtcttaactgtatttca

SEQ ID NO: 1866381 - DNA, 18 bp, Homo sapiens
agtctttgtgtgttatat

SEQ ID NO: 1866382 - DNA, 19 bp, Homo sapiens
agtcttttttttttccaaa

SEQ ID NO: 1866383 - DNA, 14 bp, Homo sapiens
agtgaaacagagaa

SEQ ID NO: 1866384 - DNA, 16 bp, Homo sapiens
agtgaaacagagaaag

SEQ ID NO: 1866385 - DNA, 17 bp, Homo sapiens
agtgaaacagagaaaga

SEQ ID NO: 1866386 - DNA, 21 bp, Homo sapiens
agtgaaacagagaaagaaaag

SEQ ID NO: 1866387 - DNA, 20 bp, Homo sapiens
agtgaactacgcttgctcat

SEQ ID NO: 1866388 - DNA, 18 bp, Homo sapiens
agtgaacttttgtaattt

SEQ ID NO: 1866389 - DNA, 22 bp, Homo sapiens
agtgaacttttgtaatttgaat

SEQ ID NO: 1866390 - DNA, 18 bp, Homo sapiens
agtgaatttatgagattt

SEQ ID NO: 1866391 - DNA, 15 bp, Homo sapiens
agtgagtctgtcagc

SEQ ID NO: 1866392 - DNA, 14 bp, Homo sapiens
atgaatgggaaagt

SEQ ID NO: 1866393 - DNA, 17 bp, Homo sapiens
atgaatgggaaagtatt

SEQ ID NO: 1866394 - DNA, 14 bp, Homo sapiens
atgacaacagaagc

SEQ ID NO: 1866395 - DNA, 13 bp, Homo sapiens
atgacggccaggc

SEQ ID NO: 1866396 - DNA, 20 bp, Homo sapiens
attcagaaattaaaatatta

SEQ ID NO: 1866397 - DNA, 21 bp, Homo sapiens
attcagaaattaaaatattat

SEQ ID NO: 1866398 - DNA, 14 bp, Homo sapiens
attcagatttctct

SEQ ID NO: 1866399 - DNA, 13 bp, Homo sapiens
attcattaatctg

SEQ ID NO: 1866400 - DNA, 16 bp, Homo sapiens
attcattaatctgttt

SEQ ID NO: 1866401 - DNA, 11 bp, Homo sapiens
attcattgtgt

SEQ ID NO: 1866402 - DNA, 13 bp, Homo sapiens
attccaaggaaaa

SEQ ID NO: 1866403 - DNA, 19 bp, Homo sapiens
attccaaggaaaattgaaa

SEQ ID NO: 1866404 - DNA, 21 bp, Homo sapiens
attccaaggaaaattgaaagt

SEQ ID NO: 1866405 - DNA, 19 bp, Homo sapiens
attccgattagacctttat

SEQ ID NO: 1866406 - DNA, 23 bp, Homo sapiens
attccgattagacctttatccag

SEQ ID NO: 1866407 - DNA, 13 bp, Homo sapiens
attcctgttgtgt

SEQ ID NO: 1866408 - DNA, 20 bp, Homo sapiens
attctattttgctggagact

SEQ ID NO: 1866409 - DNA, 15 bp, Homo sapiens
attctgaaatacttt

SEQ ID NO: 1866410 - DNA, 22 bp, Homo sapiens
attctgaaatacttttgagtat

SEQ ID NO: 1866411 - DNA, 16 bp, Homo sapiens
attctgacttacttaa

SEQ ID NO: 1866412 - DNA, 20 bp, Homo sapiens
attctgtggttctataataa

SEQ ID NO: 1866413 - DNA, 21 bp, Homo sapiens
attctgtggttctataataag

SEQ ID NO: 1866414 - DNA, 14 bp, Homo sapiens
attcttttgttatt

SEQ ID NO: 1866415 - DNA, 22 bp, Homo sapiens
attgaaagtattcagaaattaa

SEQ ID NO: 1866416 - DNA, 20 bp, Homo sapiens
attgaaatcagcatgacaaa

SEQ ID NO: 1866417 - DNA, 17 bp, Homo sapiens
attgaaatggggcgctg

SEQ ID NO: 1866418 - DNA, 22 bp, Homo sapiens
attgactcaaatctccagtatt

SEQ ID NO: 1866419 - DNA, 18 bp, Homo sapiens
attgagtcttaactgtat

SEQ ID NO: 1866420 - DNA, 20 bp, Homo sapiens
attgagtcttaactgtattt

SEQ ID NO: 1866421 - DNA, 16 bp, Homo sapiens
attgatcccttctcct

SEQ ID NO: 1866422 - DNA, 13 bp, Homo sapiens
attgattcagtat

SEQ ID NO: 1866423 - DNA, 16 bp, Homo sapiens
attgattcagtatctt

SEQ ID NO: 1866424 - DNA, 20 bp, Homo sapiens
attgctaaaagtgcatttaa

SEQ ID NO: 1866425 - DNA, 21 bp, Homo sapiens
attgctcttaaaaatcttggt

SEQ ID NO: 1866426 - DNA, 15 bp, Homo sapiens
attgcttcctgatta

SEQ ID NO: 1866427 - DNA, 15 bp, Homo sapiens
attgggagacaatta

SEQ ID NO: 1866428 - DNA, 18 bp, Homo sapiens
attggtattcactaatct

SEQ ID NO: 1866429 - DNA, 15 bp, Homo sapiens
attggttagtattta

SEQ ID NO: 1866430 - DNA, 21 bp, Homo sapiens
attgtacaagcagttaatcac

SEQ ID NO: 1866431 - DNA, 20 bp, Homo sapiens
attgtacagctgtttaagat

SEQ ID NO: 1866432 - DNA, 22 bp, Homo sapiens
attgtataaactatcagtttgt

SEQ ID NO: 1866433 - DNA, 10 bp, Homo sapiens
attgttttca

SEQ ID NO: 1866434 - DNA, 18 bp, Homo sapiens
atttaaaaaattaaaaat

SEQ ID NO: 1866435 - DNA, 17 bp, Homo sapiens
atttaagtactatcttt

SEQ ID NO: 1866436 - DNA, 19 bp, Homo sapiens
atttaagtactatctttgt

SEQ ID NO: 1866437 - DNA, 16 bp, Homo sapiens
atttaataaaaaaaca

SEQ ID NO: 1866438 - DNA, 16 bp, Homo sapiens
atttaatggactgtga

SEQ ID NO: 1866439 - DNA, 19 bp, Homo sapiens
atttaatggactgtgaatt

SEQ ID NO: 1866440 - DNA, 23 bp, Homo sapiens
atttaatttataggcagatcttt

SEQ ID NO: 1866441 - DNA, 20 bp, Homo sapiens
atttaccattattttacagt

SEQ ID NO: 1866442 - DNA, 21 bp, Homo sapiens
atttaccattattttacagtc

SEQ ID NO: 1866443 - DNA, 21 bp, Homo sapiens
atttactaagccacaagaaat

SEQ ID NO: 1866444 - DNA, 19 bp, Homo sapiens
atttagagcgtttggttaa

SEQ ID NO: 1866445 - DNA, 22 bp, Homo sapiens
atttagagcgtttggttaaagt

SEQ ID NO: 1866446 - DNA, 14 bp, Homo sapiens
atttagtaccctgc

SEQ ID NO: 1866447 - DNA, 20 bp, Homo sapiens
atttagtaccctgcaggcca

SEQ ID NO: 1866448 - DNA, 21 bp, Homo sapiens
atttagtaccctgcaggccag

SEQ ID NO: 1866449 - DNA, 13 bp, Homo sapiens
atttagttatagt

SEQ ID NO: 1866450 - DNA, 12 bp, Homo sapiens
atttatagtttg

SEQ ID NO: 1866451 - DNA, 16 bp, Homo sapiens
atttatagtttgtaca

SEQ ID NO: 1866452 - DNA, 16 bp, Homo sapiens
atttatatctttatgc

SEQ ID NO: 1866453 - DNA, 18 bp, Homo sapiens
atttatatctttatgcaa

SEQ ID NO: 1866454 - DNA, 16 bp, Homo sapiens
atttattagttaatat

SEQ ID NO: 1866455 - DNA, 21 bp, Homo sapiens
atttattggcagccaaggaat

SEQ ID NO: 1866456 - DNA, 14 bp, Homo sapiens
atttatttctctgg

SEQ ID NO: 1866457 - DNA, 14 bp, Homo sapiens
atttcaaaaaaaaa

SEQ ID NO: 1866458 - DNA, 22 bp, Homo sapiens
atttcaaaaaaaaaaaaaaaga

SEQ ID NO: 1866459 - DNA, 23 bp, Homo sapiens
atttcaaaaaaaaaaaaaaagac

SEQ ID NO: 1866460 - DNA, 17 bp, Homo sapiens
atttcacagttctgtaa

SEQ ID NO: 1866461 - DNA, 23 bp, Homo sapiens
atttcacttgagtggaggtttat

SEQ ID NO: 1866462 - DNA, 13 bp, Homo sapiens
atttcaggaattt

SEQ ID NO: 1866463 - DNA, 20 bp, Homo sapiens
atttcaggaatttaatttat

SEQ ID NO: 1866464 - DNA, 15 bp, Homo sapiens
atttcagtattttcc

SEQ ID NO: 1866465 - DNA, 17 bp, Homo sapiens
atttccaaaataatcta

SEQ ID NO: 1866466 - DNA, 15 bp, Homo sapiens
atttccaaataaaat

SEQ ID NO: 1866467 - DNA, 14 bp, Homo sapiens
atttccttctgtta

SEQ ID NO: 1866468 - DNA, 20 bp, Homo sapiens
atttccttctgttaagaaag

SEQ ID NO: 1866469 - DNA, 16 bp, Homo sapiens
atttctctggcaaact

SEQ ID NO: 1866470 - DNA, 16 bp, Homo sapiens
atttctctttgaaaca

SEQ ID NO: 1866471 - DNA, 15 bp, Homo sapiens
atttcttatttaatt

SEQ ID NO: 1866472 - DNA, 18 bp, Homo sapiens
atttgatctttgtttaaa

SEQ ID NO: 1866473 - DNA, 23 bp, Homo sapiens
atttgatctttgtttaaatgcca

SEQ ID NO: 1866474 - DNA, 19 bp, Homo sapiens
atttgatttttattattaa

SEQ ID NO: 1866475 - DNA, 18 bp, Homo sapiens
atttgcaaaccctttgta

SEQ ID NO: 1866476 - DNA, 21 bp, Homo sapiens
atttgcaaaccctttgtatta

SEQ ID NO: 1866477 - DNA, 13 bp, Homo sapiens
atttgctgccctg

SEQ ID NO: 1866478 - DNA, 14 bp, Homo sapiens
atttgctgccctgg

SEQ ID NO: 1866479 - DNA, 23 bp, Homo sapiens
atttggagcattaactaaatgct

SEQ ID NO: 1866480 - DNA, 19 bp, Homo sapiens
atttggcttgctgtttact

SEQ ID NO: 1866481 - DNA, 20 bp, Homo sapiens
atttggcttgctgtttactc

SEQ ID NO: 1866482 - DNA, 15 bp, Homo sapiens
atttgtctttcagga

SEQ ID NO: 1866483 - DNA, 20 bp, Homo sapiens
attttaagaaagagaatgaa

SEQ ID NO: 1866484 - DNA, 14 bp, Homo sapiens
attttacagtctct

SEQ ID NO: 1866485 - DNA, 22 bp, Homo sapiens
attttcacattcccatctgtca

SEQ ID NO: 1866486 - DNA, 12 bp, Homo sapiens
attttcagtatt

SEQ ID NO: 1866487 - DNA, 14 bp, Homo sapiens
attttcagtatttt

SEQ ID NO: 1866488 - DNA, 15 bp, Homo sapiens
attttcattgtgatt

SEQ ID NO: 1866489 - DNA, 23 bp, Homo sapiens
attttccaaaatctaaaagctgt

SEQ ID NO: 1866490 - DNA, 15 bp, Homo sapiens
attttccagccttat

SEQ ID NO: 1866491 - DNA, 18 bp, Homo sapiens
attttccctttttaaaaa

SEQ ID NO: 1866492 - DNA, 20 bp, Homo sapiens
attttccctttttaaaaaat

SEQ ID NO: 1866493 - DNA, 21 bp, Homo sapiens
attttccctttttaaaaaata

SEQ ID NO: 1866494 - DNA, 22 bp, Homo sapiens
attttccctttttaaaaaatac

SEQ ID NO: 1866495 - DNA, 16 bp, Homo sapiens
attttctagactttct

SEQ ID NO: 1866496 - DNA, 19 bp, Homo sapiens
attttctagactttctgtt

SEQ ID NO: 1866497 - DNA, 15 bp, Homo sapiens
attttgatcagtgtt

SEQ ID NO: 1866498 - DNA, 14 bp, Homo sapiens
attttgatgcacaa

SEQ ID NO: 1866499 - DNA, 20 bp, Homo sapiens
attttgctggagactattta

SEQ ID NO: 1866500 - DNA, 21 bp, Homo sapiens
attttgctggagactatttaa

SEQ ID NO: 1866501 - DNA, 14 bp, Homo sapiens
attttgtatatatc

SEQ ID NO: 1866502 - DNA, 16 bp, Homo sapiens
atttttacagttatag

SEQ ID NO: 1866503 - DNA, 15 bp, Homo sapiens
atttttccatctgtg

SEQ ID NO: 1866504 - DNA, 10 bp, Homo sapiens
atttttgaaa

SEQ ID NO: 1866505 - DNA, 13 bp, Homo sapiens
atttttgaaagaa

SEQ ID NO: 1866506 - DNA, 21 bp, Homo sapiens
atttttgaaagaattctattt

SEQ ID NO: 1866507 - DNA, 13 bp, Homo sapiens
atttttgatttat

SEQ ID NO: 1866508 - DNA, 23 bp, Homo sapiens
atttttgatttatgcatggaaac

SEQ ID NO: 1866509 - DNA, 13 bp, Homo sapiens
atttttgtaccat

SEQ ID NO: 1866510 - DNA, 23 bp, Homo sapiens
atttttgtaccatattgctctta

SEQ ID NO: 1866511 - DNA, 12 bp, Homo sapiens
atttttgtataa

SEQ ID NO: 1866512 - DNA, 13 bp, Homo sapiens
attttaagaaaga

SEQ ID NO: 1866513 - DNA, 14 bp, Homo sapiens
attttaagaaagag

SEQ ID NO: 1866514 - DNA, 17 bp, Homo sapiens
attttaagaaagagaat

SEQ ID NO: 1866515 - DNA, 19 bp, Homo sapiens
attttaagaaagagaatga

SEQ ID NO: 1866516 - DNA, 16 bp, Homo sapiens
attttacagtctctgt

SEQ ID NO: 1866517 - DNA, 22 bp, Homo sapiens
attttagggtgggtaagaaagc

SEQ ID NO: 1866518 - DNA, 12 bp, Homo sapiens
attttcattgtg

SEQ ID NO: 1866519 - DNA, 16 bp, Homo sapiens
attttcatttctaaca

SEQ ID NO: 1866520 - DNA, 18 bp, Homo sapiens
attttcatttctaacata

SEQ ID NO: 1866521 - DNA, 13 bp, Homo sapiens
attttccagcctt

SEQ ID NO: 1866522 - DNA, 19 bp, Homo sapiens
attttccagccttatgtgt

SEQ ID NO: 1866523 - DNA, 23 bp, Homo sapiens
attttccctttttaaaaaatacc

SEQ ID NO: 1866524 - DNA, 19 bp, Homo sapiens
attttgatattttcacaga

SEQ ID NO: 1866525 - DNA, 14 bp, Homo sapiens
attttgatcagtgt

SEQ ID NO: 1866526 - DNA, 15 bp, Homo sapiens
attttgctggagact

SEQ ID NO: 1866527 - DNA, 19 bp, Homo sapiens
attttgctggagactattt

SEQ ID NO: 1866528 - DNA, 14 bp, Homo sapiens
attttggagaaatt

SEQ ID NO: 1866529 - DNA, 20 bp, Homo sapiens
atttttaaaggaaaaatcat

SEQ ID NO: 1866530 - DNA, 14 bp, Homo sapiens
atttttaagtggtt

SEQ ID NO: 1866531 - DNA, 13 bp, Homo sapiens
atttttattatta

SEQ ID NO: 1866532 - DNA, 15 bp, Homo sapiens
atttttgaaaaatat

SEQ ID NO: 1866533 - DNA, 22 bp, Homo sapiens
atttttgaaaaatattgctaaa

SEQ ID NO: 1866534 - DNA, 14 bp, Homo sapiens
atttttgtataaaa

SEQ ID NO: 1866535 - DNA, 20 bp, Homo sapiens
atttttgtataaaaaggaaa

SEQ ID NO: 1866536 - DNA, 15 bp, Homo sapiens
atttttttttgtaaa

SEQ ID NO: 1866537 - DNA, 23 bp, Homo sapiens
caaaaaaaaaaaaaaagactgtc

SEQ ID NO: 1866538 - DNA, 16 bp, Homo sapiens
caaaaaaaatctttaa

SEQ ID NO: 1866539 - DNA, 16 bp, Homo sapiens
caaaaaaataataaaa

SEQ ID NO: 1866540 - DNA, 16 bp, Homo sapiens
caaaaataacactgtt

SEQ ID NO: 1866541 - DNA, 20 bp, Homo sapiens
caaaaataacactgttggca

SEQ ID NO: 1866542 - DNA, 23 bp, Homo sapiens
caaaaataacactgttggcactt

SEQ ID NO: 1866543 - DNA, 15 bp, Homo sapiens
caaaagcagctttta

SEQ ID NO: 1866544 - DNA, 19 bp, Homo sapiens
caaaataaagaatagcaat

SEQ ID NO: 1866545 - DNA, 13 bp, Homo sapiens
caaaatagaagct

SEQ ID NO: 1866546 - DNA, 17 bp, Homo sapiens
caaaatctaaaagctgt

SEQ ID NO: 1866547 - DNA, 20 bp, Homo sapiens
caaaatttcacagttctgta

SEQ ID NO: 1866548 - DNA, 18 bp, Homo sapiens
caaacaaaaaaaagaacc

SEQ ID NO: 1866549 - DNA, 18 bp, Homo sapiens
caaaccagtttattctgt

SEQ ID NO: 1866550 - DNA, 21 bp, Homo sapiens
caaaccctttgtattataatt

SEQ ID NO: 1866551 - DNA, 13 bp, Homo sapiens
caaactgctttat

SEQ ID NO: 1866552 - DNA, 14 bp, Homo sapiens
caaactgctttatt

SEQ ID NO: 1866553 - DNA, 18 bp, Homo sapiens
caaactgctttattttcc

SEQ ID NO: 1866554 - DNA, 15 bp, Homo sapiens
caaagagctgtggct

SEQ ID NO: 1866555 - DNA, 22 bp, Homo sapiens
cacagatggaagaagttttaac

SEQ ID NO: 1866556 - DNA, 14 bp, Homo sapiens
cacagcatgcagac

SEQ ID NO: 1866557 - DNA, 22 bp, Homo sapiens
cacataaaacgtatagtcaata

SEQ ID NO: 1866558 - DNA, 22 bp, Homo sapiens
cacatacaaaaaaaatctttaa

SEQ ID NO: 1866559 - DNA, 15 bp, Homo sapiens
cacatataacactta

SEQ ID NO: 1866560 - DNA, 18 bp, Homo sapiens
cacatctaaagctttatc

SEQ ID NO: 1866561 - DNA, 19 bp, Homo sapiens
cacatctaaagctttatct

SEQ ID NO: 1866562 - DNA, 23 bp, Homo sapiens
cacatctaaagctttatctttgt

SEQ ID NO: 1866563 - DNA, 19 bp, Homo sapiens
caccaaaagttcatataat

SEQ ID NO: 1866564 - DNA, 14 bp, Homo sapiens
caccactgggaacc

SEQ ID NO: 1866565 - DNA, 19 bp, Homo sapiens
caccccataccagtcacct

SEQ ID NO: 1866566 - DNA, 15 bp, Homo sapiens
cacccccccaggcct

SEQ ID NO: 1866567 - DNA, 21 bp, Homo sapiens
caccctagctttatattttgt

SEQ ID NO: 1866568 - DNA, 16 bp, Homo sapiens
caccctgcctgtggag

SEQ ID NO: 1866569 - DNA, 15 bp, Homo sapiens
cacctacaggactgg

SEQ ID NO: 1866570 - DNA, 16 bp, Homo sapiens
cacctacaggactggg

SEQ ID NO: 1866571 - DNA, 13 bp, Homo sapiens
cacctcctgctcc

SEQ ID NO: 1866572 - DNA, 14 bp, Homo sapiens
cacctcctgctcct

SEQ ID NO: 1866573 - DNA, 17 bp, Homo sapiens
caccttaccaactttct

SEQ ID NO: 1866574 - DNA, 18 bp, Homo sapiens
caccttaccaactttctg

SEQ ID NO: 1866575 - DNA, 12 bp, Homo sapiens
caccttgttaca

SEQ ID NO: 1866576 - DNA, 19 bp, Homo sapiens
cacgttggcgaggaaaaac

SEQ ID NO: 1866577 - DNA, 20 bp, Homo sapiens
cacgttttctggcttctgct

SEQ ID NO: 1866578 - DNA, 15 bp, Homo sapiens
cactaaaatgtttaa

SEQ ID NO: 1866579 - DNA, 16 bp, Homo sapiens
cactaaactctgaata

SEQ ID NO: 1866580 - DNA, 22 bp, Homo sapiens
cactaaactctgaataagcact

SEQ ID NO: 1866581 - DNA, 22 bp, Homo sapiens
cactaaactttacccaaaaact

SEQ ID NO: 1866582 - DNA, 16 bp, Homo sapiens
cactaaagtatgtaaa

SEQ ID NO: 1866583 - DNA, 20 bp, Homo sapiens
cactaaattagtttaaaatg

SEQ ID NO: 1866584 - DNA, 12 bp, Homo sapiens
cactagaagatg

SEQ ID NO: 1866585 - DNA, 14 bp, Homo sapiens
cactagagtcaccc

SEQ ID NO: 1866586 - DNA, 15 bp, Homo sapiens
cactcaggaaccctg

SEQ ID NO: 1866587 - DNA, 19 bp, Homo sapiens
cactcatgcaaactgcttt

SEQ ID NO: 1866588 - DNA, 15 bp, Homo sapiens
cactcccccaggagc

SEQ ID NO: 1866589 - DNA, 13 bp, Homo sapiens
cactgacagcctg

SEQ ID NO: 1866590 - DNA, 16 bp, Homo sapiens
cactgacagcctgggg

SEQ ID NO: 1866591 - DNA, 17 bp, Homo sapiens
cactgacagcctggggg

SEQ ID NO: 1866592 - DNA, 18 bp, Homo sapiens
cactgacagcctgggggg

SEQ ID NO: 1866593 - DNA, 20 bp, Homo sapiens
cactgacagcctgggggggc

SEQ ID NO: 1866594 - DNA, 24 bp, Homo sapiens
atgattgcactaaataaactactt

SEQ ID NO: 1866595 - DNA, 16 bp, Homo sapiens
atgattggttcagttt

SEQ ID NO: 1866596 - DNA, 14 bp, Homo sapiens
atgatttatagttt

SEQ ID NO: 1866597 - DNA, 20 bp, Homo sapiens
atgatttatagtttgtacat

SEQ ID NO: 1866598 - DNA, 20 bp, Homo sapiens
atgatttggggattcagatt

SEQ ID NO: 1866599 - DNA, 17 bp, Homo sapiens
atgattttgatgcacaa

SEQ ID NO: 1866600 - DNA, 16 bp, Homo sapiens
atgcaaactgctttat

SEQ ID NO: 1866601 - DNA, 20 bp, Homo sapiens
atgcactctctctctgttaa

SEQ ID NO: 1866602 - DNA, 12 bp, Homo sapiens
atgcatggaaac

SEQ ID NO: 1866603 - DNA, 20 bp, Homo sapiens
atgcatggaaacctgaaaaa

SEQ ID NO: 1866604 - DNA, 13 bp, Homo sapiens
atgcatgtaatca

SEQ ID NO: 1866605 - DNA, 19 bp, Homo sapiens
atgccaggcggacaaagtt

SEQ ID NO: 1866606 - DNA, 16 bp, Homo sapiens
atgcccactcccccag

SEQ ID NO: 1866607 - DNA, 18 bp, Homo sapiens
atgcccactcccccagga

SEQ ID NO: 1866608 - DNA, 21 bp, Homo sapiens
atgcccactcccccaggagca

SEQ ID NO: 1866609 - DNA, 17 bp, Homo sapiens
atgcccatttttgctaa

SEQ ID NO: 1866610 - DNA, 19 bp, Homo sapiens
atgccttccgacaccactg

SEQ ID NO: 1866611 - DNA, 22 bp, Homo sapiens
atgccttccgacaccactggga

SEQ ID NO: 1866612 - DNA, 13 bp, Homo sapiens
atgctgtatttct

SEQ ID NO: 1866613 - DNA, 18 bp, Homo sapiens
atgctgtatttctttgta

SEQ ID NO: 1866614 - DNA, 14 bp, Homo sapiens
atgcttctttaaaa

SEQ ID NO: 1866615 - DNA, 15 bp, Homo sapiens
atgcttgtgtttctt

SEQ ID NO: 1866616 - DNA, 13 bp, Homo sapiens
atggagcagcccc

SEQ ID NO: 1866617 - DNA, 16 bp, Homo sapiens
atggagcagcccccaa

SEQ ID NO: 1866618 - DNA, 18 bp, Homo sapiens
atggataacctatatgat

SEQ ID NO: 1866619 - DNA, 18 bp, Homo sapiens
atggatatagaaaatctt

SEQ ID NO: 1866620 - DNA, 23 bp, Homo sapiens
atggcaagaaagctggtaaacta

SEQ ID NO: 1866621 - DNA, 15 bp, Homo sapiens
atggcctctggggca

SEQ ID NO: 1866622 - DNA, 20 bp, Homo sapiens
atggcctctggggcaggacc

SEQ ID NO: 1866623 - DNA, 13 bp, Homo sapiens
atgggaaaaagag

SEQ ID NO: 1866624 - DNA, 22 bp, Homo sapiens
atgggaaagtatttttgaaaga

SEQ ID NO: 1866625 - DNA, 22 bp, Homo sapiens
atgggcaactcgtgacagcctc

SEQ ID NO: 1866626 - DNA, 14 bp, Homo sapiens
atgggggctggagg

SEQ ID NO: 1866627 - DNA, 18 bp, Homo sapiens
atggtctcagaaaccaaa

SEQ ID NO: 1866628 - DNA, 14 bp, Homo sapiens
atgtactataacat

SEQ ID NO: 1866629 - DNA, 15 bp, Homo sapiens
atgtacttaaatgag

SEQ ID NO: 1866630 - DNA, 18 bp, Homo sapiens
atgtccagagggactgga

SEQ ID NO: 1866631 - DNA, 20 bp, Homo sapiens
atgtccagagggactggaca

SEQ ID NO: 1866632 - DNA, 12 bp, Homo sapiens
atgtgagaaatc

SEQ ID NO: 1866633 - DNA, 19 bp, Homo sapiens
atgtgctgctttgatatat

SEQ ID NO: 1866634 - DNA, 19 bp, Homo sapiens
atgtgtctgtgttgcttca

SEQ ID NO: 1866635 - DNA, 18 bp, Homo sapiens
atgttaaatgccttggtt

SEQ ID NO: 1866636 - DNA, 12 bp, Homo sapiens
atgttacaagtt

SEQ ID NO: 1866637 - DNA, 17 bp, Homo sapiens
atgttacaagtttgcta

SEQ ID NO: 1866638 - DNA, 18 bp, Homo sapiens
atgttacaagtttgctaa

SEQ ID NO: 1866639 - DNA, 19 bp, Homo sapiens
atgttacaagtttgctaaa

SEQ ID NO: 1866640 - DNA, 19 bp, Homo sapiens
atgttgtgttgttatcatt

SEQ ID NO: 1866641 - DNA, 14 bp, Homo sapiens
atgtttaattcatt

SEQ ID NO: 1866642 - DNA, 19 bp, Homo sapiens
atgtttgtctgtgtgctgt

SEQ ID NO: 1866643 - DNA, 19 bp, Homo sapiens
attaaaaaaaaaaaaaaac

SEQ ID NO: 1866644 - DNA, 15 bp, Homo sapiens
attaaaaaaacacaa

SEQ ID NO: 1866645 - DNA, 14 bp, Homo sapiens
attaaaaactttaa

SEQ ID NO: 1866646 - DNA, 21 bp, Homo sapiens
attaaaaatatggaacttcta

SEQ ID NO: 1866647 - DNA, 12 bp, Homo sapiens
attaaaactgag

SEQ ID NO: 1866648 - DNA, 21 bp, Homo sapiens
attaaaatatatgttctgcaa

SEQ ID NO: 1866649 - DNA, 12 bp, Homo sapiens
attaaaatatta

SEQ ID NO: 1866650 - DNA, 14 bp, Homo sapiens
attaaaatattatt

SEQ ID NO: 1866651 - DNA, 16 bp, Homo sapiens
attaaaatattatttg

SEQ ID NO: 1866652 - DNA, 18 bp, Homo sapiens
attaaaatattatttgat

SEQ ID NO: 1866653 - DNA, 13 bp, Homo sapiens
attaaacagcaaa

SEQ ID NO: 1866654 - DNA, 18 bp, Homo sapiens
attaaacagcaaagccat

SEQ ID NO: 1866655 - DNA, 15 bp, Homo sapiens
attaaactgattcca

SEQ ID NO: 1866656 - DNA, 15 bp, Homo sapiens
attaaagccttaagc

SEQ ID NO: 1866657 - DNA, 20 bp, Homo sapiens
attaacaaagttactggctc

SEQ ID NO: 1866658 - DNA, 13 bp, Homo sapiens
attaactaaatgc

SEQ ID NO: 1866659 - DNA, 13 bp, Homo sapiens
attaatagctttt

SEQ ID NO: 1866660 - DNA, 18 bp, Homo sapiens
attaatagcttttattgt

SEQ ID NO: 1866661 - DNA, 22 bp, Homo sapiens
attaatataaccataaatcaat

SEQ ID NO: 1866662 - DNA, 13 bp, Homo sapiens
attaatattcttt

SEQ ID NO: 1866663 - DNA, 17 bp, Homo sapiens
acattcccatctgtcac

SEQ ID NO: 1866664 - DNA, 23 bp, Homo sapiens
acattgtaagagagatgagcact

SEQ ID NO: 1866665 - DNA, 17 bp, Homo sapiens
acatttagtaccctgca

SEQ ID NO: 1866666 - DNA, 22 bp, Homo sapiens
acatttagtaccctgcaggcca

SEQ ID NO: 1866667 - DNA, 15 bp, Homo sapiens
accaaaagttcatat

SEQ ID NO: 1866668 - DNA, 12 bp, Homo sapiens
accaaaattttt

SEQ ID NO: 1866669 - DNA, 14 bp, Homo sapiens
accaactttctgta

SEQ ID NO: 1866670 - DNA, 21 bp, Homo sapiens
accaagggccctcactcagga

SEQ ID NO: 1866671 - DNA, 16 bp, Homo sapiens
accaattggttaatct

SEQ ID NO: 1866672 - DNA, 16 bp, Homo sapiens
accacatataacactt

SEQ ID NO: 1866673 - DNA, 12 bp, Homo sapiens
accaccctgcct

SEQ ID NO: 1866674 - DNA, 14 bp, Homo sapiens
accaccctgcctgt

SEQ ID NO: 1866675 - DNA, 13 bp, Homo sapiens
accagcaatgccc

SEQ ID NO: 1866676 - DNA, 15 bp, Homo sapiens
accagcaatgccctg

SEQ ID NO: 1866677 - DNA, 16 bp, Homo sapiens
accagcaatgccctgc

SEQ ID NO: 1866678 - DNA, 16 bp, Homo sapiens
accaggtttgggatgg

SEQ ID NO: 1866679 - DNA, 18 bp, Homo sapiens
accagtcacctcctgctc

SEQ ID NO: 1866680 - DNA, 22 bp, Homo sapiens
accagtgcccaaagtctgtgtg

SEQ ID NO: 1866681 - DNA, 21 bp, Homo sapiens
accataggaagacataaaact

SEQ ID NO: 1866682 - DNA, 17 bp, Homo sapiens
accatagggcatgatta

SEQ ID NO: 1866683 - DNA, 20 bp, Homo sapiens
accatattgctcttaaaaat

SEQ ID NO: 1866684 - DNA, 18 bp, Homo sapiens
accattattttacagtct

SEQ ID NO: 1866685 - DNA, 16 bp, Homo sapiens
accattgaaatcagca

SEQ ID NO: 1866686 - DNA, 12 bp, Homo sapiens
acccaacagttt

SEQ ID NO: 1866687 - DNA, 13 bp, Homo sapiens
acccaacagttta

SEQ ID NO: 1866688 - DNA, 15 bp, Homo sapiens
acccaacagtttatt

SEQ ID NO: 1866689 - DNA, 14 bp, Homo sapiens
acccacctgggcca

SEQ ID NO: 1866690 - DNA, 14 bp, Homo sapiens
acccattttcacat

SEQ ID NO: 1866691 - DNA, 17 bp, Homo sapiens
acccccttttcccttca

SEQ ID NO: 1866692 - DNA, 15 bp, Homo sapiens
accctgcaggccagg

SEQ ID NO: 1866693 - DNA, 17 bp, Homo sapiens
accctgcaggccaggcc

SEQ ID NO: 1866694 - DNA, 14 bp, Homo sapiens
accctgcctgtgga

SEQ ID NO: 1866695 - DNA, 23 bp, Homo sapiens
accctgcctgtggaggtgacctg

SEQ ID NO: 1866696 - DNA, 17 bp, Homo sapiens
accctgggcagtgagtg

SEQ ID NO: 1866697 - DNA, 16 bp, Homo sapiens
acccttggtttgcaca

SEQ ID NO: 1866698 - DNA, 16 bp, Homo sapiens
accggccgcagccccc

SEQ ID NO: 1866699 - DNA, 13 bp, Homo sapiens
accgtttacagtg

SEQ ID NO: 1866700 - DNA, 17 bp, Homo sapiens
acctatatgatttatag

SEQ ID NO: 1866701 - DNA, 16 bp, Homo sapiens
acctattgaattacca

SEQ ID NO: 1866702 - DNA, 18 bp, Homo sapiens
acctcggtgatgccttcc

SEQ ID NO: 1866703 - DNA, 15 bp, Homo sapiens
acctgaagtcaaacc

SEQ ID NO: 1866704 - DNA, 14 bp, Homo sapiens
acctgcccatgtcc

SEQ ID NO: 1866705 - DNA, 16 bp, Homo sapiens
acctgcccatgtccag

SEQ ID NO: 1866706 - DNA, 17 bp, Homo sapiens
acctgctgggtaaactg

SEQ ID NO: 1866707 - DNA, 21 bp, Homo sapiens
acctgttaggtctcatgccca

SEQ ID NO: 1866708 - DNA, 22 bp, Homo sapiens
acctgttaggtctcatgcccac

SEQ ID NO: 1866709 - DNA, 15 bp, Homo sapiens
accttactggcactg

SEQ ID NO: 1866710 - DNA, 13 bp, Homo sapiens
accttgcatttca

SEQ ID NO: 1866711 - DNA, 16 bp, Homo sapiens
accttgtctttcaaaa

SEQ ID NO: 1866712 - DNA, 17 bp, Homo sapiens
accttgtctttcaaaag

SEQ ID NO: 1866713 - DNA, 23 bp, Homo sapiens
acctttttatatttaaaaaatta

SEQ ID NO: 1866714 - DNA, 14 bp, Homo sapiens
acgaacgttttaaa

SEQ ID NO: 1866715 - DNA, 20 bp, Homo sapiens
acgatgacgcctctggacct

SEQ ID NO: 1866716 - DNA, 22 bp, Homo sapiens
acggccaggctccctgaccacc

SEQ ID NO: 1866717 - DNA, 20 bp, Homo sapiens
acggcccatcttggcaaggt

SEQ ID NO: 1866718 - DNA, 16 bp, Homo sapiens
acgtataatgctttct

SEQ ID NO: 1866719 - DNA, 19 bp, Homo sapiens
acgtgattgattcagtatc

SEQ ID NO: 1866720 - DNA, 20 bp, Homo sapiens
acgtgattgattcagtatct

SEQ ID NO: 1866721 - DNA, 18 bp, Homo sapiens
acgttggcgaggaaaaac

SEQ ID NO: 1866722 - DNA, 22 bp, Homo sapiens
acgttggcgaggaaaaacaaaa

SEQ ID NO: 1866723 - DNA, 21 bp, Homo sapiens
actaaactctgaataagcact

SEQ ID NO: 1866724 - DNA, 22 bp, Homo sapiens
actaaagtatgtaaagtatgta

SEQ ID NO: 1866725 - DNA, 16 bp, Homo sapiens
actaaatctctaatat

SEQ ID NO: 1866726 - DNA, 14 bp, Homo sapiens
actaaattagttta

SEQ ID NO: 1866727 - DNA, 18 bp, Homo sapiens
actaaattagtttaaaat

SEQ ID NO: 1866728 - DNA, 20 bp, Homo sapiens
actaacgaacgttttaaagc

SEQ ID NO: 1866729 - DNA, 19 bp, Homo sapiens
actaatctgggaagggaag

SEQ ID NO: 1866730 - DNA, 23 bp, Homo sapiens
actacacatccctaatgtgtgcc

SEQ ID NO: 1866731 - DNA, 16 bp, Homo sapiens
actacatattgaatag

SEQ ID NO: 1866732 - DNA, 13 bp, Homo sapiens
aaaaaaactgaag

SEQ ID NO: 1866733 - DNA, 11 bp, Homo sapiens
aaaaaaatata

SEQ ID NO: 1866734 - DNA, 13 bp, Homo sapiens
aaaaaactcctgt

SEQ ID NO: 1866735 - DNA, 11 bp, Homo sapiens
aaaaaactctt

SEQ ID NO: 1866736 - DNA, 11 bp, Homo sapiens
aaaaaactgaa

SEQ ID NO: 1866737 - DNA, 9 bp, Homo sapiens
aaaaaagaa

SEQ ID NO: 1866738 - DNA, 11 bp, Homo sapiens
aaaaaagaacc

SEQ ID NO: 1866739 - DNA, 20 bp, Homo sapiens
aaaaaagtttacaagtgtat

SEQ ID NO: 1866740 - DNA, 16 bp, Homo sapiens
aaaaaataccattgaa

SEQ ID NO: 1866741 - DNA, 17 bp, Homo sapiens
aaaaaataccattgaaa

SEQ ID NO: 1866742 - DNA, 24 bp, Homo sapiens
aaaaacatatgtctgtctttgcaa

SEQ ID NO: 1866743 - DNA, 20 bp, Homo sapiens
aaaaactaaatctctaatat

SEQ ID NO: 1866744 - DNA, 15 bp, Homo sapiens
aaaaactgaaggttt

SEQ ID NO: 1866745 - DNA, 17 bp, Homo sapiens
aaaaactgaaggttttt

SEQ ID NO: 1866746 - DNA, 11 bp, Homo sapiens
aaaaactgtgt

SEQ ID NO: 1866747 - DNA, 19 bp, Homo sapiens
aaaaactttctactcattt

SEQ ID NO: 1866748 - DNA, 21 bp, Homo sapiens
aaaaacttttaggttgttacc

SEQ ID NO: 1866749 - DNA, 22 bp, Homo sapiens
aaaaagactgtcaaatgaactt

SEQ ID NO: 1866750 - DNA, 23 bp, Homo sapiens
aaaaagactgtcaaatgaacttt

SEQ ID NO: 1866751 - DNA, 19 bp, Homo sapiens
aaaaagctcatattttgta

SEQ ID NO: 1866752 - DNA, 12 bp, Homo sapiens
aaaaagtgaact

SEQ ID NO: 1866753 - DNA, 20 bp, Homo sapiens
aaaaagtgaacttttgtaat

SEQ ID NO: 1866754 - DNA, 14 bp, Homo sapiens
aaaaataccattga

SEQ ID NO: 1866755 - DNA, 18 bp, Homo sapiens
aaaactaaatctctaata

SEQ ID NO: 1866756 - DNA, 19 bp, Homo sapiens
aaaactaaatctctaatat

SEQ ID NO: 1866757 - DNA, 14 bp, Homo sapiens
aaaactcctgtgtc

SEQ ID NO: 1866758 - DNA, 22 bp, Homo sapiens
aaaactcctgtgtcggtcagaa

SEQ ID NO: 1866759 - DNA, 12 bp, Homo sapiens
aaaactctttaa

SEQ ID NO: 1866760 - DNA, 18 bp, Homo sapiens
aaaactgaaaatctaata

SEQ ID NO: 1866761 - DNA, 14 bp, Homo sapiens
aaaactgaaggttt

SEQ ID NO: 1866762 - DNA, 14 bp, Homo sapiens
aaaactgagtccat

SEQ ID NO: 1866763 - DNA, 12 bp, Homo sapiens
aaaactgtgtat

SEQ ID NO: 1866764 - DNA, 17 bp, Homo sapiens
aaaactgtgtatcatta

SEQ ID NO: 1866765 - DNA, 22 bp, Homo sapiens
aaaactgtgtatcattaaaata

SEQ ID NO: 1866766 - DNA, 17 bp, Homo sapiens
aaaacttaacatattta

SEQ ID NO: 1866767 - DNA, 19 bp, Homo sapiens
aaaacttaacatatttact

SEQ ID NO: 1866768 - DNA, 14 bp, Homo sapiens
aaaactttaaaagg

SEQ ID NO: 1866769 - DNA, 18 bp, Homo sapiens
aaaactttaaaaggcaac

SEQ ID NO: 1866770 - DNA, 14 bp, Homo sapiens
aaaactttaaagat

SEQ ID NO: 1866771 - DNA, 10 bp, Homo sapiens
aaaagaaacc

SEQ ID NO: 1866772 - DNA, 24 bp, Homo sapiens
aaaagactggtttgtttgcttaat

SEQ ID NO: 1866773 - DNA, 10 bp, Homo sapiens
aaaagccata

SEQ ID NO: 1866774 - DNA, 23 bp, Homo sapiens
aaaagcctttcataccagtcagt

SEQ ID NO: 1866775 - DNA, 16 bp, Homo sapiens
aaaagctataaattat

SEQ ID NO: 1866776 - DNA, 17 bp, Homo sapiens
aaaaggatgttacaagt

SEQ ID NO: 1866777 - DNA, 13 bp, Homo sapiens
aaaagtgaacttt

SEQ ID NO: 1866778 - DNA, 18 bp, Homo sapiens
aaaagtgaacttttgtaa

SEQ ID NO: 1866779 - DNA, 14 bp, Homo sapiens
aaaagtgcatttaa

SEQ ID NO: 1866780 - DNA, 15 bp, Homo sapiens
aaaagttataataac

SEQ ID NO: 1866781 - DNA, 18 bp, Homo sapiens
aaaagttataataactga

SEQ ID NO: 1866782 - DNA, 20 bp, Homo sapiens
aaaataaagaatagcaatta

SEQ ID NO: 1866783 - DNA, 13 bp, Homo sapiens
aaaataacactgt

SEQ ID NO: 1866784 - DNA, 12 bp, Homo sapiens
aaaataagtttt

SEQ ID NO: 1866785 - DNA, 18 bp, Homo sapiens
aaaataagttttatacat

SEQ ID NO: 1866786 - DNA, 23 bp, Homo sapiens
aaaataccataggaagacataaa

SEQ ID NO: 1866787 - DNA, 14 bp, Homo sapiens
aaaataccattgaa

SEQ ID NO: 1866788 - DNA, 14 bp, Homo sapiens
aaaatatatacaga

SEQ ID NO: 1866789 - DNA, 13 bp, Homo sapiens
aaaatattatttg

SEQ ID NO: 1866790 - DNA, 16 bp, Homo sapiens
aaaatattatttgata

SEQ ID NO: 1866791 - DNA, 14 bp, Homo sapiens
aaaatattgctaaa

SEQ ID NO: 1866792 - DNA, 15 bp, Homo sapiens
aaaatattgctaaaa

SEQ ID NO: 1866793 - DNA, 23 bp, Homo sapiens
aaaatattttaagaaagagaatg

SEQ ID NO: 1866794 - DNA, 13 bp, Homo sapiens
aaaatcagatttt

SEQ ID NO: 1866795 - DNA, 20 bp, Homo sapiens
aaaatcctatatctgtttgt

SEQ ID NO: 1866796 - DNA, 13 bp, Homo sapiens
aaaatgaaaatta

SEQ ID NO: 1866797 - DNA, 13 bp, Homo sapiens
aaaatgaagcaat

SEQ ID NO: 1866798 - DNA, 17 bp, Homo sapiens
aaaatgaagcaatttat

SEQ ID NO: 1866799 - DNA, 22 bp, Homo sapiens
aaaatgaagcaatttatatctt

SEQ ID NO: 1866800 - DNA, 16 bp, Homo sapiens
aaaatgaggacatgtt

SEQ ID NO: 1866801 - DNA, 18 bp, Homo sapiens
aaaatgtacttaaatgag

SEQ ID NO: 1866802 - DNA, 12 bp, Homo sapiens
aaaattgaaagt

SEQ ID NO: 1866803 - DNA, 19 bp, Homo sapiens
aaaattgcagtttcatgta

SEQ ID NO: 1866804 - DNA, 12 bp, Homo sapiens
aaacaaaataga

SEQ ID NO: 1866805 - DNA, 17 bp, Homo sapiens
aaacaaaatttcacagt

SEQ ID NO: 1866806 - DNA, 18 bp, Homo sapiens
aaacaaaatttcacagtt

SEQ ID NO: 1866807 - DNA, 14 bp, Homo sapiens
aaacagagaaagaa

SEQ ID NO: 1866808 - DNA, 15 bp, Homo sapiens
aaacagagaaagaaa

SEQ ID NO: 1866809 - DNA, 17 bp, Homo sapiens
aaacagagaaagaaaag

SEQ ID NO: 1866810 - DNA, 23 bp, Homo sapiens
aaacagagaaagaaaaggcaaaa

SEQ ID NO: 1866811 - DNA, 15 bp, Homo sapiens
aaacagcaaagccat

SEQ ID NO: 1866812 - DNA, 17 bp, Homo sapiens
aaacaggagacaggaag

SEQ ID NO: 1866813 - DNA, 15 bp, Homo sapiens
aaacatatgtatctt

SEQ ID NO: 1866814 - DNA, 17 bp, Homo sapiens
aaacatatgtatctttg

SEQ ID NO: 1866815 - DNA, 16 bp, Homo sapiens
aaaccagtttattctg

SEQ ID NO: 1866816 - DNA, 12 bp, Homo sapiens
aaaccatgacaa

SEQ ID NO: 1866817 - DNA, 13 bp, Homo sapiens
aaaccatgacaaa

SEQ ID NO: 1866818 - DNA, 21 bp, Homo sapiens
aaacccccttttcccttcagc

SEQ ID NO: 1866819 - DNA, 15 bp, Homo sapiens
aaaccctttgtatta

SEQ ID NO: 1866820 - DNA, 15 bp, Homo sapiens
aaacctagcttttaa

SEQ ID NO: 1866821 - DNA, 21 bp, Homo sapiens
aaacctagcttttaaaaaata

SEQ ID NO: 1866822 - DNA, 16 bp, Homo sapiens
aaacctgaaaaaaagt

SEQ ID NO: 1866823 - DNA, 17 bp, Homo sapiens
aaacctgtgaaagctgc

SEQ ID NO: 1866824 - DNA, 16 bp, Homo sapiens
aaacctgtttttaaca

SEQ ID NO: 1866825 - DNA, 19 bp, Homo sapiens
aaacgcacttacaagtggt

SEQ ID NO: 1866826 - DNA, 22 bp, Homo sapiens
aaactacacatccctaatgtgt

SEQ ID NO: 1866827 - DNA, 11 bp, Homo sapiens
aaactatcagt

SEQ ID NO: 1866828 - DNA, 18 bp, Homo sapiens
aaactcaaaacttaacat

SEQ ID NO: 1866829 - DNA, 11 bp, Homo sapiens
aaactcctgtg

SEQ ID NO: 1866830 - DNA, 12 bp, Homo sapiens
aaactcctgtgt

SEQ ID NO: 1866831 - DNA, 23 bp, Homo sapiens
aaactctttaacttgtaataaac

SEQ ID NO: 1866832 - DNA, 16 bp, Homo sapiens
aaactgagtccatgaa

SEQ ID NO: 1866833 - DNA, 12 bp, Homo sapiens
aaactgctttat

SEQ ID NO: 1866834 - DNA, 17 bp, Homo sapiens
aaacttaacatatttac

SEQ ID NO: 1866835 - DNA, 21 bp, Homo sapiens
aaactttctactcattttaat

SEQ ID NO: 1866836 - DNA, 20 bp, Homo sapiens
aaacttttctttcttttctt

SEQ ID NO: 1866837 - DNA, 13 bp, Homo sapiens
aaagaaacactaa

SEQ ID NO: 1866838 - DNA, 15 bp, Homo sapiens
aaagaaacactaaat

SEQ ID NO: 1866839 - DNA, 18 bp, Homo sapiens
aaagaattctattttgct

SEQ ID NO: 1866840 - DNA, 21 bp, Homo sapiens
aaagaattctattttgctgga

SEQ ID NO: 1866841 - DNA, 20 bp, Homo sapiens
aaagactaatttaaaaaata

SEQ ID NO: 1866842 - DNA, 22 bp, Homo sapiens
aaagactggtttgtttgcttaa

SEQ ID NO: 1866843 - DNA, 20 bp, Homo sapiens
aaagactgtcaaatgaactt

SEQ ID NO: 1866844 - DNA, 21 bp, Homo sapiens
aaagactgtcaaatgaacttt

SEQ ID NO: 1866845 - DNA, 22 bp, Homo sapiens
aaagactgtcaaatgaactttt

SEQ ID NO: 1866846 - DNA, 23 bp, Homo sapiens
aaagactgtcaaatgaactttta

SEQ ID NO: 1866847 - DNA, 17 bp, Homo sapiens
aaagagctgtggctggg

SEQ ID NO: 1866848 - DNA, 18 bp, Homo sapiens
aaagaggttctgcactcc

SEQ ID NO: 1866849 - DNA, 14 bp, Homo sapiens
aaagatcagctatt

SEQ ID NO: 1866850 - DNA, 15 bp, Homo sapiens
aaagatcagctattc

SEQ ID NO: 1866851 - DNA, 23 bp, Homo sapiens
aaagcatgggaaaaagagactct

SEQ ID NO: 1866852 - DNA, 17 bp, Homo sapiens
aaagccatattctaaat

SEQ ID NO: 1866853 - DNA, 22 bp, Homo sapiens
aaagccatattctaaattcact

SEQ ID NO: 1866854 - DNA, 21 bp, Homo sapiens
aaagctcatattttgtatata

SEQ ID NO: 1866855 - DNA, 14 bp, Homo sapiens
aaagctgtgccttt

SEQ ID NO: 1866856 - DNA, 17 bp, Homo sapiens
aaagctgtgcctttttt

SEQ ID NO: 1866857 - DNA, 13 bp, Homo sapiens
aaagctttatctt

SEQ ID NO: 1866858 - DNA, 15 bp, Homo sapiens
aaagctttatctttg

SEQ ID NO: 1866859 - DNA, 17 bp, Homo sapiens
aaagctttatctttgtg

SEQ ID NO: 1866860 - DNA, 15 bp, Homo sapiens
aaaggaaattagtct

SEQ ID NO: 1866861 - DNA, 16 bp, Homo sapiens
aaaggaccgttttgta

SEQ ID NO: 1866862 - DNA, 22 bp, Homo sapiens
aaaggaccgttttgtattgctt

SEQ ID NO: 1866863 - DNA, 23 bp, Homo sapiens
aaaggatataaaaggatgttaca

SEQ ID NO: 1866864 - DNA, 16 bp, Homo sapiens
aaaggatgttacaagt

SEQ ID NO: 1866865 - DNA, 18 bp, Homo sapiens
aaaggcaactcaaagatg

SEQ ID NO: 1866866 - DNA, 16 bp, Homo sapiens
aaagggagaaatgcca

SEQ ID NO: 1866867 - DNA, 17 bp, Homo sapiens
aaagggagaaatgccag

SEQ ID NO: 1866868 - DNA, 16 bp, Homo sapiens
aaaggtaggttttaaa

SEQ ID NO: 1866869 - DNA, 12 bp, Homo sapiens
aaagtaaacttg

SEQ ID NO: 1866870 - DNA, 22 bp, Homo sapiens
aaagtattcagaaattaaaata

SEQ ID NO: 1866871 - DNA, 16 bp, Homo sapiens
aaagtatttttgaaag

SEQ ID NO: 1866872 - DNA, 17 bp, Homo sapiens
aaagtatttttgaaaga

SEQ ID NO: 1866873 - DNA, 20 bp, Homo sapiens
aaagtcacctacaggactgg

SEQ ID NO: 1866874 - DNA, 12 bp, Homo sapiens
aaagtcattatt

SEQ ID NO: 1866875 - DNA, 15 bp, Homo sapiens
aaagtcattattcct

SEQ ID NO: 1866876 - DNA, 17 bp, Homo sapiens
aaagtcattattcctgg

SEQ ID NO: 1866877 - DNA, 19 bp, Homo sapiens
aaatgaacttttacagaat

SEQ ID NO: 1866878 - DNA, 22 bp, Homo sapiens
aaatgattgtaaaatagcttgt

SEQ ID NO: 1866879 - DNA, 15 bp, Homo sapiens
aaatgccttggtttg

SEQ ID NO: 1866880 - DNA, 22 bp, Homo sapiens
aaatgggttggtgcttctaacc

SEQ ID NO: 1866881 - DNA, 18 bp, Homo sapiens
aaatgtaactatgtttta

SEQ ID NO: 1866882 - DNA, 16 bp, Homo sapiens
aaatgtttaattcatt

SEQ ID NO: 1866883 - DNA, 14 bp, Homo sapiens
aaattaaaatatta

SEQ ID NO: 1866884 - DNA, 17 bp, Homo sapiens
aaattaaaatattattt

SEQ ID NO: 1866885 - DNA, 16 bp, Homo sapiens
aaattaatcttttaaa

SEQ ID NO: 1866886 - DNA, 21 bp, Homo sapiens
aaattaatcttttaaaaatga

SEQ ID NO: 1866887 - DNA, 23 bp, Homo sapiens
aaattaatcttttaaaaatgatg

SEQ ID NO: 1866888 - DNA, 15 bp, Homo sapiens
aaattaatttgtgca

SEQ ID NO: 1866889 - DNA, 12 bp, Homo sapiens
aaattagtcttt

SEQ ID NO: 1866890 - DNA, 17 bp, Homo sapiens
aaattagtttaaaatga

SEQ ID NO: 1866891 - DNA, 15 bp, Homo sapiens
aaattattaattgtc

SEQ ID NO: 1866892 - DNA, 22 bp, Homo sapiens
aaattattaattgtcctgtgtc

SEQ ID NO: 1866893 - DNA, 23 bp, Homo sapiens
aaattattaattgtcctgtgtct

SEQ ID NO: 1866894 - DNA, 15 bp, Homo sapiens
aaattatttaataaa

SEQ ID NO: 1866895 - DNA, 22 bp, Homo sapiens
aaattatttgtgtaatagaaaa

SEQ ID NO: 1866896 - DNA, 15 bp, Homo sapiens
aaattattttaaaca

SEQ ID NO: 1866897 - DNA, 19 bp, Homo sapiens
aaattccgattagaccttt

SEQ ID NO: 1866898 - DNA, 17 bp, Homo sapiens
aaattgaaagtattcag

SEQ ID NO: 1866899 - DNA, 18 bp, Homo sapiens
aaattgcagtttcatgta

SEQ ID NO: 1866900 - DNA, 19 bp, Homo sapiens
aaattgcagtttcatgtat

SEQ ID NO: 1866901 - DNA, 21 bp, Homo sapiens
aaattgcagtttcatgtatgt

SEQ ID NO: 1866902 - DNA, 22 bp, Homo sapiens
aaattgcagtttcatgtatgta

SEQ ID NO: 1866903 - DNA, 14 bp, Homo sapiens
aaattttctagact

SEQ ID NO: 1866904 - DNA, 20 bp, Homo sapiens
aaattttctagactttctgt

SEQ ID NO: 1866905 - DNA, 16 bp, Homo sapiens
aaatttttgaaaaata

SEQ ID NO: 1866906 - DNA, 17 bp, Homo sapiens
aaatttttgaaaaatat

SEQ ID NO: 1866907 - DNA, 18 bp, Homo sapiens
aaatttttgaaaaatatt

SEQ ID NO: 1866908 - DNA, 13 bp, Homo sapiens
aacaaaatttcac

SEQ ID NO: 1866909 - DNA, 22 bp, Homo sapiens
aacaaagttactggctctttgt

SEQ ID NO: 1866910 - DNA, 21 bp, Homo sapiens
aacaaatggcttacttacaaa

SEQ ID NO: 1866911 - DNA, 15 bp, Homo sapiens
aacaatatgattgca

SEQ ID NO: 1866912 - DNA, 22 bp, Homo sapiens
aacaatttcctttatatttagt

SEQ ID NO: 1866913 - DNA, 16 bp, Homo sapiens
aacacaagtcctgtga

SEQ ID NO: 1866914 - DNA, 13 bp, Homo sapiens
aacacatggcaga

SEQ ID NO: 1866915 - DNA, 17 bp, Homo sapiens
aacagagaaagaaaagg

SEQ ID NO: 1866916 - DNA, 14 bp, Homo sapiens
aacagcaaagccat

SEQ ID NO: 1866917 - DNA, 15 bp, Homo sapiens
aacagcaaagccata

SEQ ID NO: 1866918 - DNA, 20 bp, Homo sapiens
aacagtttctcaagtttaaa

SEQ ID NO: 1866919 - DNA, 19 bp, Homo sapiens
aacagttttggagaaaaat

SEQ ID NO: 1866920 - DNA, 20 bp, Homo sapiens
aacagttttggagaaaaatt

SEQ ID NO: 1866921 - DNA, 21 bp, Homo sapiens
aacagttttggagaaaaatta

SEQ ID NO: 1866922 - DNA, 21 bp, Homo sapiens
aacatagaattgcaatctata

SEQ ID NO: 1866923 - DNA, 17 bp, Homo sapiens
aacatatgtatctttgg

SEQ ID NO: 1866924 - DNA, 20 bp, Homo sapiens
aacatatgtctgtctttgca

SEQ ID NO: 1866925 - DNA, 22 bp, Homo sapiens
aacatatgtctgtctttgcaaa

SEQ ID NO: 1866926 - DNA, 18 bp, Homo sapiens
aacatttagtaccctgca

SEQ ID NO: 1866927 - DNA, 19 bp, Homo sapiens
aacatttagtaccctgcag

SEQ ID NO: 1866928 - DNA, 23 bp, Homo sapiens
aaccacactgaaacctcttcggt

SEQ ID NO: 1866929 - DNA, 18 bp, Homo sapiens
aaccacatataacactta

SEQ ID NO: 1866930 - DNA, 22 bp, Homo sapiens
aaccagctgtaacacagctgag

SEQ ID NO: 1866931 - DNA, 12 bp, Homo sapiens
aaccatgacaaa

SEQ ID NO: 1866932 - DNA, 13 bp, Homo sapiens
aacccccttttcc

SEQ ID NO: 1866933 - DNA, 17 bp, Homo sapiens
aacccccttttcccttc

SEQ ID NO: 1866934 - DNA, 15 bp, Homo sapiens
aacctagcttttaaa

SEQ ID NO: 1866935 - DNA, 19 bp, Homo sapiens
aacctagcttttaaaaaat

SEQ ID NO: 1866936 - DNA, 22 bp, Homo sapiens
aacctagcttttaaaaaatatt

SEQ ID NO: 1866937 - DNA, 11 bp, Homo sapiens
aacctgaaaaa

SEQ ID NO: 1866938 - DNA, 21 bp, Homo sapiens
aacctgaaaaaaagtttacaa

SEQ ID NO: 1866939 - DNA, 18 bp, Homo sapiens
aacctgtttttaacatgt

SEQ ID NO: 1866940 - DNA, 18 bp, Homo sapiens
aacctttctactttttct

SEQ ID NO: 1866941 - DNA, 14 bp, Homo sapiens
aacgaacgttttaa

SEQ ID NO: 1866942 - DNA, 14 bp, Homo sapiens
aacgcacttacaag

SEQ ID NO: 1866943 - DNA, 13 bp, Homo sapiens
aactactttgaat

SEQ ID NO: 1866944 - DNA, 22 bp, Homo sapiens
aactatgccgtgtagtttctgg

SEQ ID NO: 1866945 - DNA, 19 bp, Homo sapiens
aactatttgtctttcagga

SEQ ID NO: 1866946 - DNA, 19 bp, Homo sapiens
aactcaaaacttaacatat

SEQ ID NO: 1866947 - DNA, 20 bp, Homo sapiens
aactcaaagatgatggaaac

SEQ ID NO: 1866948 - DNA, 22 bp, Homo sapiens
aactcaaagatgatggaaacgc

SEQ ID NO: 1866949 - DNA, 13 bp, Homo sapiens
aactcctgtgtcg

SEQ ID NO: 1866950 - DNA, 17 bp, Homo sapiens
aactcgtgacagcctct

SEQ ID NO: 1866951 - DNA, 11 bp, Homo sapiens
aactctttaac

SEQ ID NO: 1866952 - DNA, 12 bp, Homo sapiens
aactgaactgtt

SEQ ID NO: 1866953 - DNA, 23 bp, Homo sapiens
aactgaaggttttttttttaagt

SEQ ID NO: 1866954 - DNA, 18 bp, Homo sapiens
aactgagtccatgaaaat

SEQ ID NO: 1866955 - DNA, 20 bp, Homo sapiens
aagactgtcaaatgaacttt

SEQ ID NO: 1866956 - DNA, 20 bp, Homo sapiens
aagacttggcaacagaagca

SEQ ID NO: 1866957 - DNA, 17 bp, Homo sapiens
aagagaatgaactgtgg

SEQ ID NO: 1866958 - DNA, 22 bp, Homo sapiens
aagagaatgaactgtggaattt

SEQ ID NO: 1866959 - DNA, 19 bp, Homo sapiens
aagagaggggaagaattta

SEQ ID NO: 1866960 - DNA, 15 bp, Homo sapiens
aagagatgaaataat

SEQ ID NO: 1866961 - DNA, 12 bp, Homo sapiens
aagagctgtggc

SEQ ID NO: 1866962 - DNA, 18 bp, Homo sapiens
aagagggagatggagact

SEQ ID NO: 1866963 - DNA, 20 bp, Homo sapiens
aagagttctatggagacttt

SEQ ID NO: 1866964 - DNA, 16 bp, Homo sapiens
aagatgatgttaaatg

SEQ ID NO: 1866965 - DNA, 17 bp, Homo sapiens
aagatgtactataacat

SEQ ID NO: 1866966 - DNA, 14 bp, Homo sapiens
aagcaacctttccc

SEQ ID NO: 1866967 - DNA, 13 bp, Homo sapiens
aagcaagccagga

SEQ ID NO: 1866968 - DNA, 17 bp, Homo sapiens
aagcaatttatatcttt

SEQ ID NO: 1866969 - DNA, 15 bp, Homo sapiens
aagcatgggaaaaag

SEQ ID NO: 1866970 - DNA, 18 bp, Homo sapiens
aagccacaagaaatttga

SEQ ID NO: 1866971 - DNA, 19 bp, Homo sapiens
aagccaccttgttacaaat

SEQ ID NO: 1866972 - DNA, 20 bp, Homo sapiens
aagccaggagaagacccctg

SEQ ID NO: 1866973 - DNA, 21 bp, Homo sapiens
aagccaggagaagacccctgc

SEQ ID NO: 1866974 - DNA, 22 bp, Homo sapiens
aagccaggagaagacccctgcc

SEQ ID NO: 1866975 - DNA, 23 bp, Homo sapiens
aagctcatattttgtatatatct

SEQ ID NO: 1866976 - DNA, 12 bp, Homo sapiens
aagctgcactca

SEQ ID NO: 1866977 - DNA, 14 bp, Homo sapiens
aagctttatctttg

SEQ ID NO: 1866978 - DNA, 15 bp, Homo sapiens
aagctttatctttgt

SEQ ID NO: 1866979 - DNA, 17 bp, Homo sapiens
aagctttatctttgtgt

SEQ ID NO: 1866980 - DNA, 14 bp, Homo sapiens
aaggaaaattgaaa

SEQ ID NO: 1866981 - DNA, 16 bp, Homo sapiens
aaggaaaattgaaagt

SEQ ID NO: 1866982 - DNA, 18 bp, Homo sapiens
aaggaaaattgaaagtat

SEQ ID NO: 1866983 - DNA, 16 bp, Homo sapiens
aaggacctgaaataag

SEQ ID NO: 1866984 - DNA, 15 bp, Homo sapiens
aaggatataaaagga

SEQ ID NO: 1866985 - DNA, 23 bp, Homo sapiens
aaggatataaaaggatgttacaa

SEQ ID NO: 1866986 - DNA, 23 bp, Homo sapiens
aaggatgttacaagtttgctaaa

SEQ ID NO: 1866987 - DNA, 13 bp, Homo sapiens
aaggcaaaagact

SEQ ID NO: 1866988 - DNA, 12 bp, Homo sapiens
aaggcaactcaa

SEQ ID NO: 1866989 - DNA, 20 bp, Homo sapiens
aaggccagcccactgggccc

SEQ ID NO: 1866990 - DNA, 22 bp, Homo sapiens
aaggccagcccactgggccctg

SEQ ID NO: 1866991 - DNA, 14 bp, Homo sapiens
aagggccctcactc

SEQ ID NO: 1866992 - DNA, 18 bp, Homo sapiens
aaggggaaacctgtgaaa

SEQ ID NO: 1866993 - DNA, 17 bp, Homo sapiens
aagggtatcctgtgcta

SEQ ID NO: 1866994 - DNA, 14 bp, Homo sapiens
aaggtaataaatac

SEQ ID NO: 1866995 - DNA, 22 bp, Homo sapiens
aaggtataaggatcttttgtaa

SEQ ID NO: 1866996 - DNA, 14 bp, Homo sapiens
aaggtgtcatttga

SEQ ID NO: 1866997 - DNA, 19 bp, Homo sapiens
aaggttttttttttaagtg

SEQ ID NO: 1866998 - DNA, 22 bp, Homo sapiens
aaggttttttttttaagtgcaa

SEQ ID NO: 1866999 - DNA, 20 bp, Homo sapiens
aagtaagtcttttttttttc

SEQ ID NO: 1867000 - DNA, 14 bp, Homo sapiens
aagtaataaaaaga

SEQ ID NO: 1867001 - DNA, 14 bp, Homo sapiens
aagtaattcctctc

SEQ ID NO: 1867002 - DNA, 15 bp, Homo sapiens
aagtactatctttgt

SEQ ID NO: 1867003 - DNA, 19 bp, Homo sapiens
aagtactatctttgtctaa

SEQ ID NO: 1867004 - DNA, 12 bp, Homo sapiens
aagtagtttgta

SEQ ID NO: 1867005 - DNA, 21 bp, Homo sapiens
aagtattcagaaattaaaata

SEQ ID NO: 1867006 - DNA, 23 bp, Homo sapiens
aagtattcagaaattaaaatatt

SEQ ID NO: 1867007 - DNA, 13 bp, Homo sapiens
aagtatttttgaa

SEQ ID NO: 1867008 - DNA, 14 bp, Homo sapiens
aagtatttttgaaa

SEQ ID NO: 1867009 - DNA, 16 bp, Homo sapiens
aagtatttttgaaaga

SEQ ID NO: 1867010 - DNA, 12 bp, Homo sapiens
aagtcctgcttt

SEQ ID NO: 1867011 - DNA, 22 bp, Homo sapiens
aagtctgtgtgatgaactttct

SEQ ID NO: 1867012 - DNA, 23 bp, Homo sapiens
aagtctgtgtgatgaactttctc

SEQ ID NO: 1867013 - DNA, 19 bp, Homo sapiens
aagtcttttttttttccaa

SEQ ID NO: 1867014 - DNA, 15 bp, Homo sapiens
aagtgaacttttgta

SEQ ID NO: 1867015 - DNA, 16 bp, Homo sapiens
aagtgaacttttgtaa

SEQ ID NO: 1867016 - DNA, 12 bp, Homo sapiens
aagtgacataat

SEQ ID NO: 1867017 - DNA, 14 bp, Homo sapiens
aagtgcaacatttc

SEQ ID NO: 1867018 - DNA, 13 bp, Homo sapiens
aagtgcatttaag

SEQ ID NO: 1867019 - DNA, 14 bp, Homo sapiens
aagtgcatttaagg

SEQ ID NO: 1867020 - DNA, 15 bp, Homo sapiens
aagtggctcttggga

SEQ ID NO: 1867021 - DNA, 14 bp, Homo sapiens
aagtggttttaata

SEQ ID NO: 1867022 - DNA, 20 bp, Homo sapiens
aagttgtgccttttatagct

SEQ ID NO: 1867023 - DNA, 21 bp, Homo sapiens
aagtttacaagtgtatatcag

SEQ ID NO: 1867024 - DNA, 23 bp, Homo sapiens
aagtttacaagtgtatatcagaa

SEQ ID NO: 1867025 - DNA, 15 bp, Homo sapiens
aagttttatacataa

SEQ ID NO: 1867026 - DNA, 17 bp, Homo sapiens
aagttttatacataaac

SEQ ID NO: 1867027 - DNA, 20 bp, Homo sapiens
aagttttatacataaacagt

SEQ ID NO: 1867028 - DNA, 20 bp, Homo sapiens
aataaaaaaatatatacaga

SEQ ID NO: 1867029 - DNA, 11 bp, Homo sapiens
aataaaaagtg

SEQ ID NO: 1867030 - DNA, 21 bp, Homo sapiens
aatcccccagcgcttagaaac

SEQ ID NO: 1867031 - DNA, 19 bp, Homo sapiens
aatcctatatctgtttgta

SEQ ID NO: 1867032 - DNA, 12 bp, Homo sapiens
aatcctccctgg

SEQ ID NO: 1867033 - DNA, 13 bp, Homo sapiens
aatcctccctgga

SEQ ID NO: 1867034 - DNA, 17 bp, Homo sapiens
aatctaatattaaaaat

SEQ ID NO: 1867035 - DNA, 17 bp, Homo sapiens
aatctatattaaatgag

SEQ ID NO: 1867036 - DNA, 19 bp, Homo sapiens
aatctggggaagaggtttt

SEQ ID NO: 1867037 - DNA, 22 bp, Homo sapiens
aatctggggaagaggttttatt

SEQ ID NO: 1867038 - DNA, 19 bp, Homo sapiens
aatcttagtatagtagaaa

SEQ ID NO: 1867039 - DNA, 21 bp, Homo sapiens
aatcttagtatagtagaaaga

SEQ ID NO: 1867040 - DNA, 23 bp, Homo sapiens
aatcttagtatagtagaaagaca

SEQ ID NO: 1867041 - DNA, 14 bp, Homo sapiens
aatcttggcttctt

SEQ ID NO: 1867042 - DNA, 18 bp, Homo sapiens
aatcttggcttcttaaaa

SEQ ID NO: 1867043 - DNA, 21 bp, Homo sapiens
aatcttggcttcttaaaaact

SEQ ID NO: 1867044 - DNA, 22 bp, Homo sapiens
aatgaaccgtttacagtgtatt

SEQ ID NO: 1867045 - DNA, 16 bp, Homo sapiens
aatgaacttttacaga

SEQ ID NO: 1867046 - DNA, 14 bp, Homo sapiens
aatgacaacagaag

SEQ ID NO: 1867047 - DNA, 23 bp, Homo sapiens
aatgacacactgcggtgtctgca

SEQ ID NO: 1867048 - DNA, 13 bp, Homo sapiens
aatgagacacata

SEQ ID NO: 1867049 - DNA, 16 bp, Homo sapiens
aatgagggtttctgat

SEQ ID NO: 1867050 - DNA, 21 bp, Homo sapiens
aatgatcacatctaaagcttt

SEQ ID NO: 1867051 - DNA, 15 bp, Homo sapiens
aatgatgataatcat

SEQ ID NO: 1867052 - DNA, 14 bp, Homo sapiens
aatgatttttagat

SEQ ID NO: 1867053 - DNA, 13 bp, Homo sapiens
aatgcattaaaaa

SEQ ID NO: 1867054 - DNA, 18 bp, Homo sapiens
aatgccaaaatgtactta

SEQ ID NO: 1867055 - DNA, 19 bp, Homo sapiens
aatgccaggcggacaaagt

SEQ ID NO: 1867056 - DNA, 17 bp, Homo sapiens
aatgccataaaattgca

SEQ ID NO: 1867057 - DNA, 14 bp, Homo sapiens
aatgcccatttttg

SEQ ID NO: 1867058 - DNA, 17 bp, Homo sapiens
aatgccctgccttgctg

SEQ ID NO: 1867059 - DNA, 11 bp, Homo sapiens
aatgctttttg

SEQ ID NO: 1867060 - DNA, 14 bp, Homo sapiens
aatggactgtgaat

SEQ ID NO: 1867061 - DNA, 21 bp, Homo sapiens
aatggactgtgaatttcaaaa

SEQ ID NO: 1867062 - DNA, 22 bp, Homo sapiens
aatggataagatgatgttaaat

SEQ ID NO: 1867063 - DNA, 22 bp, Homo sapiens
aatggcttacttacaaaagcag

SEQ ID NO: 1867064 - DNA, 17 bp, Homo sapiens
aatgggaattctgactt

SEQ ID NO: 1867065 - DNA, 15 bp, Homo sapiens
aatggggcgctggac

SEQ ID NO: 1867066 - DNA, 17 bp, Homo sapiens
aatgtacttaaatgagt

SEQ ID NO: 1867067 - DNA, 22 bp, Homo sapiens
aatgtaggcacttttattttca

SEQ ID NO: 1867068 - DNA, 18 bp, Homo sapiens
aatgtgtctgtgttgctt

SEQ ID NO: 1867069 - DNA, 19 bp, Homo sapiens
aatgtgtgccatagagttt

SEQ ID NO: 1867070 - DNA, 22 bp, Homo sapiens
aatgtttaattcattaatctgt

SEQ ID NO: 1867071 - DNA, 12 bp, Homo sapiens
aattaaaactga

SEQ ID NO: 1867072 - DNA, 15 bp, Homo sapiens
aattaaaatattatt

SEQ ID NO: 1867073 - DNA, 23 bp, Homo sapiens
aattaaaatattatttgatatct

SEQ ID NO: 1867074 - DNA, 18 bp, Homo sapiens
aattaaagccttaagcac

SEQ ID NO: 1867075 - DNA, 14 bp, Homo sapiens
aattaatcttttaa

SEQ ID NO: 1867076 - DNA, 15 bp, Homo sapiens
aattagagaactgga

SEQ ID NO: 1867077 - DNA, 23 bp, Homo sapiens
aattagatcaacacttttctcca

SEQ ID NO: 1867078 - DNA, 14 bp, Homo sapiens
aattagcagaatgg

SEQ ID NO: 1867079 - DNA, 15 bp, Homo sapiens
aattagcagaatgga

SEQ ID NO: 1867080 - DNA, 21 bp, Homo sapiens
aattagcagaatggagaaagt

SEQ ID NO: 1867081 - DNA, 22 bp, Homo sapiens
aattagcagaatggagaaagta

SEQ ID NO: 1867082 - DNA, 13 bp, Homo sapiens
aattagtcttttt

SEQ ID NO: 1867083 - DNA, 14 bp, Homo sapiens
aattagtttaaaat

SEQ ID NO: 1867084 - DNA, 16 bp, Homo sapiens
aattagtttaaaatga

SEQ ID NO: 1867085 - DNA, 21 bp, Homo sapiens
aattatataggttgtgcaaat

SEQ ID NO: 1867086 - DNA, 11 bp, Homo sapiens
aattatattcc

SEQ ID NO: 1867087 - DNA, 14 bp, Homo sapiens
aattattaattgtc

SEQ ID NO: 1867088 - DNA, 17 bp, Homo sapiens
aattattaattgtcctg

SEQ ID NO: 1867089 - DNA, 15 bp, Homo sapiens
aattatttgtgtaat

SEQ ID NO: 1867090 - DNA, 21 bp, Homo sapiens
aattatttgtgtaatagaaaa

SEQ ID NO: 1867091 - DNA, 19 bp, Homo sapiens
aattattttccaaaatcta

SEQ ID NO: 1867092 - DNA, 16 bp, Homo sapiens
aattcaccaaaagttc

SEQ ID NO: 1867093 - DNA, 16 bp, Homo sapiens
aattcattgtgtatga

SEQ ID NO: 1867094 - DNA, 15 bp, Homo sapiens
aattccatgcactct

SEQ ID NO: 1867095 - DNA, 14 bp, Homo sapiens
aattctattttgct

SEQ ID NO: 1867096 - DNA, 16 bp, Homo sapiens
aattctgaaatacttt

SEQ ID NO: 1867097 - DNA, 17 bp, Homo sapiens
aattctgaaatactttt

SEQ ID NO: 1867098 - DNA, 12 bp, Homo sapiens
aattgaaagtat

SEQ ID NO: 1867099 - DNA, 15 bp, Homo sapiens
aattgaaagtattca

SEQ ID NO: 1867100 - DNA, 20 bp, Homo sapiens
aattgcagtttcatgtatgt

SEQ ID NO: 1867101 - DNA, 17 bp, Homo sapiens
aattggtctgaaaggct

SEQ ID NO: 1867102 - DNA, 16 bp, Homo sapiens
actagctaagcaagcc

SEQ ID NO: 1867103 - DNA, 17 bp, Homo sapiens
actagctaagcaagcca

SEQ ID NO: 1867104 - DNA, 23 bp, Homo sapiens
actataacatagaattgcaatct

SEQ ID NO: 1867105 - DNA, 22 bp, Homo sapiens
actatgccgtgtagtttctggt

SEQ ID NO: 1867106 - DNA, 20 bp, Homo sapiens
actatttaagtactatcttt

SEQ ID NO: 1867107 - DNA, 16 bp, Homo sapiens
actatttgtctttcag

SEQ ID NO: 1867108 - DNA, 15 bp, Homo sapiens
actcaaagatgatgg

SEQ ID NO: 1867109 - DNA, 23 bp, Homo sapiens
actcaatctccccttgcactaaa

SEQ ID NO: 1867110 - DNA, 17 bp, Homo sapiens
actcaggaaccctggag

SEQ ID NO: 1867111 - DNA, 20 bp, Homo sapiens
actcaggaaccctggagaca

SEQ ID NO: 1867112 - DNA, 22 bp, Homo sapiens
actcaggaaccctggagacaga

SEQ ID NO: 1867113 - DNA, 17 bp, Homo sapiens
actcatagattgcaaat

SEQ ID NO: 1867114 - DNA, 19 bp, Homo sapiens
actcatgcaaactgcttta

SEQ ID NO: 1867115 - DNA, 20 bp, Homo sapiens
actcattgcatcatttacaa

SEQ ID NO: 1867116 - DNA, 22 bp, Homo sapiens
actccagcacgttttctggctt

SEQ ID NO: 1867117 - DNA, 12 bp, Homo sapiens
actcccccagga

SEQ ID NO: 1867118 - DNA, 14 bp, Homo sapiens
actcccccaggagc

SEQ ID NO: 1867119 - DNA, 19 bp, Homo sapiens
actcgtgacagcctctgac

SEQ ID NO: 1867120 - DNA, 13 bp, Homo sapiens
actctaattagag

SEQ ID NO: 1867121 - DNA, 15 bp, Homo sapiens
actctaattagagaa

SEQ ID NO: 1867122 - DNA, 20 bp, Homo sapiens
actcttaaatcatttggtta

SEQ ID NO: 1867123 - DNA, 15 bp, Homo sapiens
actgaaaatctaata

SEQ ID NO: 1867124 - DNA, 22 bp, Homo sapiens
actgaaacctcttcggttgtct

SEQ ID NO: 1867125 - DNA, 15 bp, Homo sapiens
actgaactgtttggt

SEQ ID NO: 1867126 - DNA, 23 bp, Homo sapiens
actgaactgtttggtcgagtctt

SEQ ID NO: 1867127 - DNA, 16 bp, Homo sapiens
actgacctgcccatgt

SEQ ID NO: 1867128 - DNA, 14 bp, Homo sapiens
actgactctgttat

SEQ ID NO: 1867129 - DNA, 15 bp, Homo sapiens
actgactctgttatt

SEQ ID NO: 1867130 - DNA, 18 bp, Homo sapiens
actgagtccatgaaaata

SEQ ID NO: 1867131 - DNA, 17 bp, Homo sapiens
actgcaagcatttttcc

SEQ ID NO: 1867132 - DNA, 18 bp, Homo sapiens
actgcaagcatttttcca

SEQ ID NO: 1867133 - DNA, 15 bp, Homo sapiens
actgcagctttacat

SEQ ID NO: 1867134 - DNA, 22 bp, Homo sapiens
actgccaccagcaatgccctgc

SEQ ID NO: 1867135 - DNA, 15 bp, Homo sapiens
actgctctagaaagt

SEQ ID NO: 1867136 - DNA, 15 bp, Homo sapiens
actgctttattttcc

SEQ ID NO: 1867137 - DNA, 20 bp, Homo sapiens
actggcactgtggcactgcc

SEQ ID NO: 1867138 - DNA, 21 bp, Homo sapiens
actggcactgtggcactgcca

SEQ ID NO: 1867139 - DNA, 23 bp, Homo sapiens
actggcactgtggcactgccacc

SEQ ID NO: 1867140 - DNA, 19 bp, Homo sapiens
actggctctttgtgtgtct

SEQ ID NO: 1867141 - DNA, 21 bp, Homo sapiens
actgggaaccaagggccctca

SEQ ID NO: 1867142 - DNA, 13 bp, Homo sapiens
actgggccctggg

SEQ ID NO: 1867143 - DNA, 18 bp, Homo sapiens
actgggccctggggctgc

SEQ ID NO: 1867144 - DNA, 23 bp, Homo sapiens
actgggccgggcccagggcctct

SEQ ID NO: 1867145 - DNA, 15 bp, Homo sapiens
actggtcctgtgtgc

SEQ ID NO: 1867146 - DNA, 13 bp, Homo sapiens
actggtgatatat

SEQ ID NO: 1867147 - DNA, 17 bp, Homo sapiens
actggtttgtttgctta

SEQ ID NO: 1867148 - DNA, 12 bp, Homo sapiens
actgtaaaagtt

SEQ ID NO: 1867149 - DNA, 22 bp, Homo sapiens
actgtaaaagttataataactg

SEQ ID NO: 1867150 - DNA, 17 bp, Homo sapiens
actgtatttcagtattt

SEQ ID NO: 1867151 - DNA, 20 bp, Homo sapiens
actgtatttcagtattttcc

SEQ ID NO: 1867152 - DNA, 21 bp, Homo sapiens
actgtatttcagtattttcca

SEQ ID NO: 1867153 - DNA, 22 bp, Homo sapiens
actgtatttcagtattttccag

SEQ ID NO: 1867154 - DNA, 16 bp, Homo sapiens
actgtcaaatgaactt

SEQ ID NO: 1867155 - DNA, 17 bp, Homo sapiens
actgtcaaatgaacttt

SEQ ID NO: 1867156 - DNA, 19 bp, Homo sapiens
actgtcaaatgaactttta

SEQ ID NO: 1867157 - DNA, 21 bp, Homo sapiens
actgtcaaatgaacttttaca

SEQ ID NO: 1867158 - DNA, 23 bp, Homo sapiens
actgtcaaatgaacttttacaga

SEQ ID NO: 1867159 - DNA, 20 bp, Homo sapiens
actgtggcactgccaccagc

SEQ ID NO: 1867160 - DNA, 22 bp, Homo sapiens
actgtggcactgccaccagcaa

SEQ ID NO: 1867161 - DNA, 22 bp, Homo sapiens
actgtggccatatatgctgtat

SEQ ID NO: 1867162 - DNA, 14 bp, Homo sapiens
actgtgtatcatta

SEQ ID NO: 1867163 - DNA, 12 bp, Homo sapiens
actgtgtttcta

SEQ ID NO: 1867164 - DNA, 21 bp, Homo sapiens
actgtgtttctagttgcattt

SEQ ID NO: 1867165 - DNA, 11 bp, Homo sapiens
acttaaatgag

SEQ ID NO: 1867166 - DNA, 16 bp, Homo sapiens
acttacaaaagcagct

SEQ ID NO: 1867167 - DNA, 15 bp, Homo sapiens
acttagaatgccata

SEQ ID NO: 1867168 - DNA, 21 bp, Homo sapiens
acttagaatgccataaaattg

SEQ ID NO: 1867169 - DNA, 17 bp, Homo sapiens
acttagtttttataaaa

SEQ ID NO: 1867170 - DNA, 18 bp, Homo sapiens
acttagtttttataaaat

SEQ ID NO: 1867171 - DNA, 22 bp, Homo sapiens
acttgagtggaggtttatagtt

SEQ ID NO: 1867172 - DNA, 13 bp, Homo sapiens
acttgattcttgt

SEQ ID NO: 1867173 - DNA, 20 bp, Homo sapiens
acttgcagcgccaagtggcc

SEQ ID NO: 1867174 - DNA, 18 bp, Homo sapiens
acttgctacttatcattt

SEQ ID NO: 1867175 - DNA, 23 bp, Homo sapiens
acttgttcaacagtttctcaagt

SEQ ID NO: 1867176 - DNA, 15 bp, Homo sapiens
actttaaaaggcaac

SEQ ID NO: 1867177 - DNA, 16 bp, Homo sapiens
actttaaaaggcaact

SEQ ID NO: 1867178 - DNA, 17 bp, Homo sapiens
actttctactcatttta

SEQ ID NO: 1867179 - DNA, 17 bp, Homo sapiens
actttctcttggacatt

SEQ ID NO: 1867180 - DNA, 21 bp, Homo sapiens
actttgctgttactgcttctc

SEQ ID NO: 1867181 - DNA, 20 bp, Homo sapiens
actttgcttgattaaacagc

SEQ ID NO: 1867182 - DNA, 23 bp, Homo sapiens
acttttacagaatgcattaaaaa

SEQ ID NO: 1867183 - DNA, 16 bp, Homo sapiens
acttttattttcattg

SEQ ID NO: 1867184 - DNA, 14 bp, Homo sapiens
acttttctccaggg

SEQ ID NO: 1867185 - DNA, 21 bp, Homo sapiens
acttttgagtatggctatcta

SEQ ID NO: 1867186 - DNA, 17 bp, Homo sapiens
acttttgtaatttgaat

SEQ ID NO: 1867187 - DNA, 19 bp, Homo sapiens
acttttgtaatttgaattg

SEQ ID NO: 1867188 - DNA, 21 bp, Homo sapiens
actttttgttttgttcttggt

SEQ ID NO: 1867189 - DNA, 14 bp, Homo sapiens
agaaaaattacaga

SEQ ID NO: 1867190 - DNA, 19 bp, Homo sapiens
agaaaacctgtttttaaca

SEQ ID NO: 1867191 - DNA, 17 bp, Homo sapiens
agaaaaggcaaaagact

SEQ ID NO: 1867192 - DNA, 17 bp, Homo sapiens
agaaaccttaatatgtg

SEQ ID NO: 1867193 - DNA, 13 bp, Homo sapiens
agaaagaaaaggc

SEQ ID NO: 1867194 - DNA, 14 bp, Homo sapiens
agaaagaaaaggca

SEQ ID NO: 1867195 - DNA, 15 bp, Homo sapiens
agaaagaaaaggcaa

SEQ ID NO: 1867196 - DNA, 17 bp, Homo sapiens
agaaagaaaaggcaaaa

SEQ ID NO: 1867197 - DNA, 23 bp, Homo sapiens
agaaagaaaaggcaaaagactgg

SEQ ID NO: 1867198 - DNA, 13 bp, Homo sapiens
agaaagagaatga

SEQ ID NO: 1867199 - DNA, 17 bp, Homo sapiens
agaaagagaatgaactg

SEQ ID NO: 1867200 - DNA, 24 bp, Homo sapiens
agaaagagaatgaactgtggaatt

SEQ ID NO: 1867201 - DNA, 20 bp, Homo sapiens
agaaagctggtaaactattt

SEQ ID NO: 1867202 - DNA, 11 bp, Homo sapiens
agaaatgccag

SEQ ID NO: 1867203 - DNA, 22 bp, Homo sapiens
agaaattaaaatattatttgat

SEQ ID NO: 1867204 - DNA, 17 bp, Homo sapiens
agaaattagaaacctta

SEQ ID NO: 1867205 - DNA, 14 bp, Homo sapiens
agaacaaatacact

SEQ ID NO: 1867206 - DNA, 16 bp, Homo sapiens
agaacaacttgctact

SEQ ID NO: 1867207 - DNA, 19 bp, Homo sapiens
agaaccagtctttcaactc

SEQ ID NO: 1867208 - DNA, 17 bp, Homo sapiens
agaaccttactggcact

SEQ ID NO: 1867209 - DNA, 18 bp, Homo sapiens
agaaccttactggcactg

SEQ ID NO: 1867210 - DNA, 19 bp, Homo sapiens
agaaccttactggcactgt

SEQ ID NO: 1867211 - DNA, 23 bp, Homo sapiens
agaactttgccttaagtttccct

SEQ ID NO: 1867212 - DNA, 17 bp, Homo sapiens
agaagaactttgcctta

SEQ ID NO: 1867213 - DNA, 21 bp, Homo sapiens
agaagaccacaaaaattgact

SEQ ID NO: 1867214 - DNA, 17 bp, Homo sapiens
agaagacccctgcccaa

SEQ ID NO: 1867215 - DNA, 19 bp, Homo sapiens
agaagatgggggctggagg

SEQ ID NO: 1867216 - DNA, 10 bp, Homo sapiens
agaagcagaa

SEQ ID NO: 1867217 - DNA, 14 bp, Homo sapiens
agaaggccagccca

SEQ ID NO: 1867218 - DNA, 23 bp, Homo sapiens
agaaggccagcccactgggccct

SEQ ID NO: 1867219 - DNA, 20 bp, Homo sapiens
acacatgctgaggttttgaa

SEQ ID NO: 1867220 - DNA, 16 bp, Homo sapiens
acacatgtgggagagg

SEQ ID NO: 1867221 - DNA, 13 bp, Homo sapiens
acaccactgggaa

SEQ ID NO: 1867222 - DNA, 13 bp, Homo sapiens
acacctacagcag

SEQ ID NO: 1867223 - DNA, 14 bp, Homo sapiens
acacctacagcagc

SEQ ID NO: 1867224 - DNA, 23 bp, Homo sapiens
acactaaattagtttaaaatgaa

SEQ ID NO: 1867225 - DNA, 17 bp, Homo sapiens
acactaattcctttcta

SEQ ID NO: 1867226 - DNA, 20 bp, Homo sapiens
acactgcggtgtctgcagct

SEQ ID NO: 1867227 - DNA, 22 bp, Homo sapiens
acacttgttcaacagtttctca

SEQ ID NO: 1867228 - DNA, 18 bp, Homo sapiens
acagaagcttcagaagtt

SEQ ID NO: 1867229 - DNA, 13 bp, Homo sapiens
acagaatgcatta

SEQ ID NO: 1867230 - DNA, 10 bp, Homo sapiens
acagagaaag

SEQ ID NO: 1867231 - DNA, 12 bp, Homo sapiens
acagagaaagaa

SEQ ID NO: 1867232 - DNA, 16 bp, Homo sapiens
acagagaaagaaaagg

SEQ ID NO: 1867233 - DNA, 16 bp, Homo sapiens
acagatcatggcagga

SEQ ID NO: 1867234 - DNA, 20 bp, Homo sapiens
acagatggaagaagttttaa

SEQ ID NO: 1867235 - DNA, 21 bp, Homo sapiens
acagatggaagaagttttaac

SEQ ID NO: 1867236 - DNA, 20 bp, Homo sapiens
acagatggagcaaatgtcct

SEQ ID NO: 1867237 - DNA, 15 bp, Homo sapiens
acagcaaagccatat

SEQ ID NO: 1867238 - DNA, 13 bp, Homo sapiens
acagccagggcag

SEQ ID NO: 1867239 - DNA, 16 bp, Homo sapiens
acagctgagagacttt

SEQ ID NO: 1867240 - DNA, 14 bp, Homo sapiens
acagctgtttaaga

SEQ ID NO: 1867241 - DNA, 17 bp, Homo sapiens
acagctgtttaagatgg

SEQ ID NO: 1867242 - DNA, 21 bp, Homo sapiens
acaggactgggccgggcccag

SEQ ID NO: 1867243 - DNA, 22 bp, Homo sapiens
acaggcagcgatggtctcagaa

SEQ ID NO: 1867244 - DNA, 13 bp, Homo sapiens
acagtctctgttg

SEQ ID NO: 1867245 - DNA, 14 bp, Homo sapiens
acagtggcactaaa

SEQ ID NO: 1867246 - DNA, 19 bp, Homo sapiens
acagtggcactaaaatgtt

SEQ ID NO: 1867247 - DNA, 17 bp, Homo sapiens
acagttcataattcacc

SEQ ID NO: 1867248 - DNA, 21 bp, Homo sapiens
acagttcataattcaccaaaa

SEQ ID NO: 1867249 - DNA, 13 bp, Homo sapiens
acagttctgtaat

SEQ ID NO: 1867250 - DNA, 19 bp, Homo sapiens
acagtttgtgttttaaaaa

SEQ ID NO: 1867251 - DNA, 21 bp, Homo sapiens
acagtttgtgttttaaaaaaa

SEQ ID NO: 1867252 - DNA, 23 bp, Homo sapiens
acagtttgtgttttaaaaaaact

SEQ ID NO: 1867253 - DNA, 16 bp, Homo sapiens
acataaaactttaaaa

SEQ ID NO: 1867254 - DNA, 21 bp, Homo sapiens
acataaaactttaaaaggcaa

SEQ ID NO: 1867255 - DNA, 18 bp, Homo sapiens
acataattttttattcaa

SEQ ID NO: 1867256 - DNA, 18 bp, Homo sapiens
acatacaaaaaaaatctt

SEQ ID NO: 1867257 - DNA, 13 bp, Homo sapiens
acatacacacacg

SEQ ID NO: 1867258 - DNA, 16 bp, Homo sapiens
acatatgtctgtcttt

SEQ ID NO: 1867259 - DNA, 18 bp, Homo sapiens
acatccatgtttgtaaaa

SEQ ID NO: 1867260 - DNA, 16 bp, Homo sapiens
acatctaaagctttat

SEQ ID NO: 1867261 - DNA, 20 bp, Homo sapiens
acatctaaagctttatcttt

SEQ ID NO: 1867262 - DNA, 22 bp, Homo sapiens
acatctaaagctttatctttgt

SEQ ID NO: 1867263 - DNA, 22 bp, Homo sapiens
acatctgcctgtaattaaacta

SEQ ID NO: 1867264 - DNA, 19 bp, Homo sapiens
acatgctgaggttttgaat

SEQ ID NO: 1867265 - DNA, 20 bp, Homo sapiens
acatgctgaggttttgaata

SEQ ID NO: 1867266 - DNA, 22 bp, Homo sapiens
acatgctgaggttttgaataaa

SEQ ID NO: 1867267 - DNA, 21 bp, Homo sapiens
acatgctgtactaaaatatgc

SEQ ID NO: 1867268 - DNA, 20 bp, Homo sapiens
acatgcttgtgtttcttagt

SEQ ID NO: 1867269 - DNA, 23 bp, Homo sapiens
acatgtttttgttttctttgaat

SEQ ID NO: 1867270 - DNA, 18 bp, Homo sapiens
acattaaacaatgatcac

SEQ ID NO: 1867271 - DNA, 15 bp, Homo sapiens
acattaacaagatca

SEQ ID NO: 1867272 - DNA, 21 bp, Homo sapiens
acattaatcaatcatctgtgt

SEQ ID NO: 1867273 - DNA, 11 bp, Homo sapiens
acattcactgg

SEQ ID NO: 1867274 - DNA, 22 bp, Homo sapiens
acattcttggttgttaatttag

SEQ ID NO: 1867275 - DNA, 18 bp, Homo sapiens
acatttagtaccctgcag

SEQ ID NO: 1867276 - DNA, 19 bp, Homo sapiens
acatttagtaccctgcagg

SEQ ID NO: 1867277 - DNA, 12 bp, Homo sapiens
acatttctgtat

SEQ ID NO: 1867278 - DNA, 20 bp, Homo sapiens
accaaaaactagacattatt

SEQ ID NO: 1867279 - DNA, 13 bp, Homo sapiens
accaagggccctc

SEQ ID NO: 1867280 - DNA, 17 bp, Homo sapiens
accaagggccctcactc

SEQ ID NO: 1867281 - DNA, 14 bp, Homo sapiens
accacaaaaattga

SEQ ID NO: 1867282 - DNA, 18 bp, Homo sapiens
accaccctgcctgtggag

SEQ ID NO: 1867283 - DNA, 17 bp, Homo sapiens
accagcaatgccctgcc

SEQ ID NO: 1867284 - DNA, 23 bp, Homo sapiens
accagcaatgccctgccttgctg

SEQ ID NO: 1867285 - DNA, 20 bp, Homo sapiens
accagtcacctcctgctcct

SEQ ID NO: 1867286 - DNA, 19 bp, Homo sapiens
accataggaagacataaaa

SEQ ID NO: 1867287 - DNA, 22 bp, Homo sapiens
agatgagggtgtcggctgtgag

SEQ ID NO: 1867288 - DNA, 23 bp, Homo sapiens
agatgagggtgtcggctgtgagg

SEQ ID NO: 1867289 - DNA, 23 bp, Homo sapiens
agatgatggaaacgcacttacaa

SEQ ID NO: 1867290 - DNA, 22 bp, Homo sapiens
agatgtactataacatagaatt

SEQ ID NO: 1867291 - DNA, 15 bp, Homo sapiens
agattacaataaatc

SEQ ID NO: 1867292 - DNA, 17 bp, Homo sapiens
agattagggaaaatgga

SEQ ID NO: 1867293 - DNA, 16 bp, Homo sapiens
agattggatttgctgt

SEQ ID NO: 1867294 - DNA, 14 bp, Homo sapiens
agattgtgaataat

SEQ ID NO: 1867295 - DNA, 18 bp, Homo sapiens
agattgtgaataatgatt

SEQ ID NO: 1867296 - DNA, 22 bp, Homo sapiens
agattgttttatcatgacatgt

SEQ ID NO: 1867297 - DNA, 23 bp, Homo sapiens
agattgttttatcatgacatgtt

SEQ ID NO: 1867298 - DNA, 17 bp, Homo sapiens
agatttgaaaaactttt

SEQ ID NO: 1867299 - DNA, 21 bp, Homo sapiens
agatttttttcatagatttga

SEQ ID NO: 1867300 - DNA, 18 bp, Homo sapiens
agattttttttttaagtg

SEQ ID NO: 1867301 - DNA, 11 bp, Homo sapiens
agcaaagccat

SEQ ID NO: 1867302 - DNA, 13 bp, Homo sapiens
agcaagccaggag

SEQ ID NO: 1867303 - DNA, 16 bp, Homo sapiens
agcaatgccctgcctt

SEQ ID NO: 1867304 - DNA, 13 bp, Homo sapiens
agcaattaattag

SEQ ID NO: 1867305 - DNA, 16 bp, Homo sapiens
agcacaagaaggccag

SEQ ID NO: 1867306 - DNA, 18 bp, Homo sapiens
agcacaagaaggccagcc

SEQ ID NO: 1867307 - DNA, 20 bp, Homo sapiens
agcacaagaaggccagccca

SEQ ID NO: 1867308 - DNA, 11 bp, Homo sapiens
agcacaattaa

SEQ ID NO: 1867309 - DNA, 18 bp, Homo sapiens
agcacgcatgtccctcca

SEQ ID NO: 1867310 - DNA, 19 bp, Homo sapiens
agcacgcatgtccctccaa

SEQ ID NO: 1867311 - DNA, 20 bp, Homo sapiens
agcacgcatgtccctccaag

SEQ ID NO: 1867312 - DNA, 16 bp, Homo sapiens
agcactagagtcaccc

SEQ ID NO: 1867313 - DNA, 22 bp, Homo sapiens
agcactagagtcacccccccag

SEQ ID NO: 1867314 - DNA, 17 bp, Homo sapiens
agcactctaattagaga

SEQ ID NO: 1867315 - DNA, 14 bp, Homo sapiens
agcactttttaaaa

SEQ ID NO: 1867316 - DNA, 15 bp, Homo sapiens
agcagaatggagaaa

SEQ ID NO: 1867317 - DNA, 17 bp, Homo sapiens
agcagattacaataaat

SEQ ID NO: 1867318 - DNA, 14 bp, Homo sapiens
agcagcaattaatt

SEQ ID NO: 1867319 - DNA, 21 bp, Homo sapiens
agcagcacgcatgtccctcca

SEQ ID NO: 1867320 - DNA, 18 bp, Homo sapiens
agcagcccacccagcaga

SEQ ID NO: 1867321 - DNA, 15 bp, Homo sapiens
agcagctggcactga

SEQ ID NO: 1867322 - DNA, 17 bp, Homo sapiens
agcagctggcactgaca

SEQ ID NO: 1867323 - DNA, 14 bp, Homo sapiens
agcatgacaaaaat

SEQ ID NO: 1867324 - DNA, 18 bp, Homo sapiens
agcatgacaaaaataaca

SEQ ID NO: 1867325 - DNA, 15 bp, Homo sapiens
agcatgggaaaaaga

SEQ ID NO: 1867326 - DNA, 16 bp, Homo sapiens
agcatgggaaaaagag

SEQ ID NO: 1867327 - DNA, 15 bp, Homo sapiens
agcattaactaaatg

SEQ ID NO: 1867328 - DNA, 16 bp, Homo sapiens
agcatttatttctctg

SEQ ID NO: 1867329 - DNA, 13 bp, Homo sapiens
agccaaattttat

SEQ ID NO: 1867330 - DNA, 14 bp, Homo sapiens
agccaaggaatgtg

SEQ ID NO: 1867331 - DNA, 15 bp, Homo sapiens
agccaccttgttaca

SEQ ID NO: 1867332 - DNA, 15 bp, Homo sapiens
agccaggagaagacc

SEQ ID NO: 1867333 - DNA, 21 bp, Homo sapiens
agccaggagaagacccctgcc

SEQ ID NO: 1867334 - DNA, 23 bp, Homo sapiens
agccaggagaagacccctgccca

SEQ ID NO: 1867335 - DNA, 15 bp, Homo sapiens
agccagggcagggct

SEQ ID NO: 1867336 - DNA, 20 bp, Homo sapiens
agccaggggtgtcccagtcc

SEQ ID NO: 1867337 - DNA, 23 bp, Homo sapiens
agccaggggtgtcccagtcccag

SEQ ID NO: 1867338 - DNA, 16 bp, Homo sapiens
agccattcctgttctc

SEQ ID NO: 1867339 - DNA, 17 bp, Homo sapiens
agccattcctgttctct

SEQ ID NO: 1867340 - DNA, 14 bp, Homo sapiens
agcccactgggccc

SEQ ID NO: 1867341 - DNA, 20 bp, Homo sapiens
agcccactgggccctggggc

SEQ ID NO: 1867342 - DNA, 16 bp, Homo sapiens
agcccccaaagagctg

SEQ ID NO: 1867343 - DNA, 10 bp, Homo sapiens
aggagcagct

SEQ ID NO: 1867344 - DNA, 16 bp, Homo sapiens
aggagcagctggcact

SEQ ID NO: 1867345 - DNA, 14 bp, Homo sapiens
aggatagcattttt

SEQ ID NO: 1867346 - DNA, 14 bp, Homo sapiens
aggatataaaagga

SEQ ID NO: 1867347 - DNA, 13 bp, Homo sapiens
aggatcttttgta

SEQ ID NO: 1867348 - DNA, 20 bp, Homo sapiens
aggatgttacaagtttgcta

SEQ ID NO: 1867349 - DNA, 23 bp, Homo sapiens
aggatgttacaagtttgctaaaa

SEQ ID NO: 1867350 - DNA, 16 bp, Homo sapiens
aggcaaaagactggtt

SEQ ID NO: 1867351 - DNA, 16 bp, Homo sapiens
aggcaactcaaagatg

SEQ ID NO: 1867352 - DNA, 15 bp, Homo sapiens
aggcagatctttaaa

SEQ ID NO: 1867353 - DNA, 18 bp, Homo sapiens
aggcagatctttaaatac

SEQ ID NO: 1867354 - DNA, 21 bp, Homo sapiens
aggcaggctgggtgggaggga

SEQ ID NO: 1867355 - DNA, 17 bp, Homo sapiens
aggccaaattaatcttt

SEQ ID NO: 1867356 - DNA, 13 bp, Homo sapiens
aggccagcttccc

SEQ ID NO: 1867357 - DNA, 14 bp, Homo sapiens
aggccaggccagct

SEQ ID NO: 1867358 - DNA, 18 bp, Homo sapiens
aggccatttgctgccctg

SEQ ID NO: 1867359 - DNA, 19 bp, Homo sapiens
aggccatttgctgccctgg

SEQ ID NO: 1867360 - DNA, 20 bp, Homo sapiens
aggccatttgctgccctggg

SEQ ID NO: 1867361 - DNA, 21 bp, Homo sapiens
aggccatttgctgccctgggg

SEQ ID NO: 1867362 - DNA, 23 bp, Homo sapiens
aggccatttgctgccctggggca

SEQ ID NO: 1867363 - DNA, 18 bp, Homo sapiens
aggctgtcttctcccaga

SEQ ID NO: 1867364 - DNA, 16 bp, Homo sapiens
agggactggacagcca

SEQ ID NO: 1867365 - DNA, 15 bp, Homo sapiens
agggccgagacagga

SEQ ID NO: 1867366 - DNA, 16 bp, Homo sapiens
agggctaggaatatag

SEQ ID NO: 1867367 - DNA, 21 bp, Homo sapiens
agggctaggaatatagattaa

SEQ ID NO: 1867368 - DNA, 16 bp, Homo sapiens
agggctttggggggca

SEQ ID NO: 1867369 - DNA, 19 bp, Homo sapiens
agggctttggggggcacta

SEQ ID NO: 1867370 - DNA, 21 bp, Homo sapiens
agggctttggggggcactaga

SEQ ID NO: 1867371 - DNA, 17 bp, Homo sapiens
aggggaaacctgtgaaa

SEQ ID NO: 1867372 - DNA, 22 bp, Homo sapiens
agggggcagagtggcctgtgag

SEQ ID NO: 1867373 - DNA, 14 bp, Homo sapiens
aggggtcaaagaaa

SEQ ID NO: 1867374 - DNA, 13 bp, Homo sapiens
aggggtgtcccag

SEQ ID NO: 1867375 - DNA, 17 bp, Homo sapiens
agggtggaaaaatgccc

SEQ ID NO: 1867376 - DNA, 17 bp, Homo sapiens
aggtaatttttttttgt

SEQ ID NO: 1867377 - DNA, 16 bp, Homo sapiens
aggtaggttttaaaaa

SEQ ID NO: 1867378 - DNA, 16 bp, Homo sapiens
aggtcatggagcagcc

SEQ ID NO: 1867379 - DNA, 19 bp, Homo sapiens
aggtcatggagcagccccc

SEQ ID NO: 1867380 - DNA, 22 bp, Homo sapiens
aggtccttggagtgctgcagct

SEQ ID NO: 1867381 - DNA, 13 bp, Homo sapiens
aggtctcatgccc

SEQ ID NO: 1867382 - DNA, 19 bp, Homo sapiens
aggtgtggaccggccgcag

SEQ ID NO: 1867383 - DNA, 21 bp, Homo sapiens
aggttctgcactcctggaacc

SEQ ID NO: 1867384 - DNA, 21 bp, Homo sapiens
aggttttgaataaaaagtgaa

SEQ ID NO: 1867385 - DNA, 17 bp, Homo sapiens
aggttttgttgttttat

SEQ ID NO: 1867386 - DNA, 12 bp, Homo sapiens
agtaaacactgt

SEQ ID NO: 1867387 - DNA, 15 bp, Homo sapiens
agtaaacttgtgtat

SEQ ID NO: 1867388 - DNA, 23 bp, Homo sapiens
agtaagtcttttttttttccaaa

SEQ ID NO: 1867389 - DNA, 14 bp, Homo sapiens
agtaatatgaaagc

SEQ ID NO: 1867390 - DNA, 12 bp, Homo sapiens
agtaccctgcag

SEQ ID NO: 1867391 - DNA, 13 bp, Homo sapiens
agtaccctgcagg

SEQ ID NO: 1867392 - DNA, 15 bp, Homo sapiens
agtaccctgcaggcc

SEQ ID NO: 1867393 - DNA, 16 bp, Homo sapiens
agtaccctgcaggcca

SEQ ID NO: 1867394 - DNA, 19 bp, Homo sapiens
agtaccctgcaggccaggc

SEQ ID NO: 1867395 - DNA, 20 bp, Homo sapiens
agtaccctgcaggccaggcc

SEQ ID NO: 1867396 - DNA, 17 bp, Homo sapiens
agtagatggtgaaattt

SEQ ID NO: 1867397 - DNA, 15 bp, Homo sapiens
agtagccctttctgt

SEQ ID NO: 1867398 - DNA, 16 bp, Homo sapiens
agtagccctttctgtg

SEQ ID NO: 1867399 - DNA, 17 bp, Homo sapiens
agtagccctttctgtgt

SEQ ID NO: 1867400 - DNA, 19 bp, Homo sapiens
agtagccctttctgtgtgc

SEQ ID NO: 1867401 - DNA, 12 bp, Homo sapiens
agtagtttgtat

SEQ ID NO: 1867402 - DNA, 18 bp, Homo sapiens
agttcagacttagttttt

SEQ ID NO: 1867403 - DNA, 19 bp, Homo sapiens
agttcatataatttaaaga

SEQ ID NO: 1867404 - DNA, 20 bp, Homo sapiens
agttcatataatttaaagaa

SEQ ID NO: 1867405 - DNA, 18 bp, Homo sapiens
agttctatggagactttg

SEQ ID NO: 1867406 - DNA, 19 bp, Homo sapiens
agttcttgaattgttatga

SEQ ID NO: 1867407 - DNA, 20 bp, Homo sapiens
agttcttgaattgttatgaa

SEQ ID NO: 1867408 - DNA, 18 bp, Homo sapiens
agttgtgccttttatagc

SEQ ID NO: 1867409 - DNA, 19 bp, Homo sapiens
agttgtgccttttatagct

SEQ ID NO: 1867410 - DNA, 17 bp, Homo sapiens
agttgttgtttgccaag

SEQ ID NO: 1867411 - DNA, 19 bp, Homo sapiens
agtttacaagtgtatatca

SEQ ID NO: 1867412 - DNA, 21 bp, Homo sapiens
agtttacaagtgtatatcaga

SEQ ID NO: 1867413 - DNA, 16 bp, Homo sapiens
agtttattctgtggtt

SEQ ID NO: 1867414 - DNA, 16 bp, Homo sapiens
agtttcatgtatgtat

SEQ ID NO: 1867415 - DNA, 19 bp, Homo sapiens
agtttcatgtatgtatata

SEQ ID NO: 1867416 - DNA, 17 bp, Homo sapiens
agtttctcaagtttaaa

SEQ ID NO: 1867417 - DNA, 18 bp, Homo sapiens
agtttctcaagtttaaag

SEQ ID NO: 1867418 - DNA, 21 bp, Homo sapiens
agtttctcaagtttaaagtca

SEQ ID NO: 1867419 - DNA, 16 bp, Homo sapiens
agtttcttttattttc

SEQ ID NO: 1867420 - DNA, 20 bp, Homo sapiens
agtttgctaaaagaagagag

SEQ ID NO: 1867421 - DNA, 22 bp, Homo sapiens
agttttatacataaacagtttt

SEQ ID NO: 1867422 - DNA, 17 bp, Homo sapiens
agttttgatataatctt

SEQ ID NO: 1867423 - DNA, 21 bp, Homo sapiens
agttttgatataatcttggct

SEQ ID NO: 1867424 - DNA, 23 bp, Homo sapiens
agtttttcttacataatttgcaa

SEQ ID NO: 1867425 - DNA, 15 bp, Homo sapiens
agttttttactttgg

SEQ ID NO: 1867426 - DNA, 17 bp, Homo sapiens
ataaaaaaacaatcatt

SEQ ID NO: 1867427 - DNA, 16 bp, Homo sapiens
ataaaaaggaaattag

SEQ ID NO: 1867428 - DNA, 16 bp, Homo sapiens
ataaaaagtgaacttt

SEQ ID NO: 1867429 - DNA, 20 bp, Homo sapiens
ataaaaagtgaacttttgta

SEQ ID NO: 1867430 - DNA, 16 bp, Homo sapiens
ataaaactttaaaagg

SEQ ID NO: 1867431 - DNA, 17 bp, Homo sapiens
ataaaaggatgttacaa

SEQ ID NO: 1867432 - DNA, 20 bp, Homo sapiens
ataaaattgcagtttcatgt

SEQ ID NO: 1867433 - DNA, 13 bp, Homo sapiens
ataaactactttg

SEQ ID NO: 1867434 - DNA, 21 bp, Homo sapiens
ataaatacacagcatgcagac

SEQ ID NO: 1867435 - DNA, 15 bp, Homo sapiens
ataaatcaattcatt

SEQ ID NO: 1867436 - DNA, 14 bp, Homo sapiens
ataaattatattcc

SEQ ID NO: 1867437 - DNA, 14 bp, Homo sapiens
ataacacttaactt

SEQ ID NO: 1867438 - DNA, 22 bp, Homo sapiens
ataacatagaattgcaatctat

SEQ ID NO: 1867439 - DNA, 19 bp, Homo sapiens
ataaccagctgtaacacag

SEQ ID NO: 1867440 - DNA, 18 bp, Homo sapiens
ataacctatatgatttat

SEQ ID NO: 1867441 - DNA, 14 bp, Homo sapiens
ataactgaactgtt

SEQ ID NO: 1867442 - DNA, 16 bp, Homo sapiens
ataacttcttaaaagt

SEQ ID NO: 1867443 - DNA, 19 bp, Homo sapiens
ataacttcttaaaagttgt

SEQ ID NO: 1867444 - DNA, 17 bp, Homo sapiens
ataagatgatgttaaat

SEQ ID NO: 1867445 - DNA, 16 bp, Homo sapiens
ataagcaagacagtgg

SEQ ID NO: 1867446 - DNA, 18 bp, Homo sapiens
ataagcgtatttagactg

SEQ ID NO: 1867447 - DNA, 15 bp, Homo sapiens
ataaggatcttttgt

SEQ ID NO: 1867448 - DNA, 14 bp, Homo sapiens
ataaggtaatgtag

SEQ ID NO: 1867449 - DNA, 14 bp, Homo sapiens
ataaggtataagga

SEQ ID NO: 1867450 - DNA, 19 bp, Homo sapiens
ataaggtataaggatcttt

SEQ ID NO: 1867451 - DNA, 18 bp, Homo sapiens
ataagtaagacttgattg

SEQ ID NO: 1867452 - DNA, 17 bp, Homo sapiens
ataagttttatacataa

SEQ ID NO: 1867453 - DNA, 18 bp, Homo sapiens
ataagttttgatataatc

SEQ ID NO: 1867454 - DNA, 13 bp, Homo sapiens
ataataagttttg

SEQ ID NO: 1867455 - DNA, 17 bp, Homo sapiens
ataataagttttgatat

SEQ ID NO: 1867456 - DNA, 15 bp, Homo sapiens
ataatcatcaggttt

SEQ ID NO: 1867457 - DNA, 14 bp, Homo sapiens
ataatcatgctcat

SEQ ID NO: 1867458 - DNA, 18 bp, Homo sapiens
ataatctatattaaatga

SEQ ID NO: 1867459 - DNA, 19 bp, Homo sapiens
ataatctatattaaatgag

SEQ ID NO: 1867460 - DNA, 20 bp, Homo sapiens
ataatctatattaaatgagg

SEQ ID NO: 1867461 - DNA, 15 bp, Homo sapiens
ataatctcctctgct

SEQ ID NO: 1867462 - DNA, 19 bp, Homo sapiens
ataatgaaccgtttacagt

SEQ ID NO: 1867463 - DNA, 23 bp, Homo sapiens
ataatgaaccgtttacagtgtat

SEQ ID NO: 1867464 - DNA, 13 bp, Homo sapiens
ccacggtcttctg

SEQ ID NO: 1867465 - DNA, 16 bp, Homo sapiens
ccacggtcttctgcat

SEQ ID NO: 1867466 - DNA, 14 bp, Homo sapiens
ccactcccccagga

SEQ ID NO: 1867467 - DNA, 15 bp, Homo sapiens
ccactgacctgccca

SEQ ID NO: 1867468 - DNA, 19 bp, Homo sapiens
ccactgacctgcccatgtc

SEQ ID NO: 1867469 - DNA, 13 bp, Homo sapiens
ccactgggccctg

SEQ ID NO: 1867470 - DNA, 19 bp, Homo sapiens
ccactgggccctggggctg

SEQ ID NO: 1867471 - DNA, 16 bp, Homo sapiens
ccagaaatacaacaga

SEQ ID NO: 1867472 - DNA, 14 bp, Homo sapiens
ccagaaccttactg

SEQ ID NO: 1867473 - DNA, 20 bp, Homo sapiens
ccagaaccttactggcactg

SEQ ID NO: 1867474 - DNA, 21 bp, Homo sapiens
ccagaaccttactggcactgt

SEQ ID NO: 1867475 - DNA, 23 bp, Homo sapiens
ccagaaccttactggcactgtgg

SEQ ID NO: 1867476 - DNA, 18 bp, Homo sapiens
ccagaagaactttgcctt

SEQ ID NO: 1867477 - DNA, 21 bp, Homo sapiens
ccagagcacaagaaggccagc

SEQ ID NO: 1867478 - DNA, 17 bp, Homo sapiens
ccagagggactggacag

SEQ ID NO: 1867479 - DNA, 19 bp, Homo sapiens
ccagagggactggacagcc

SEQ ID NO: 1867480 - DNA, 20 bp, Homo sapiens
ccagagggactggacagcca

SEQ ID NO: 1867481 - DNA, 21 bp, Homo sapiens
ccagagggactggacagccag

SEQ ID NO: 1867482 - DNA, 23 bp, Homo sapiens
ccagagggactggacagccaggg

SEQ ID NO: 1867483 - DNA, 18 bp, Homo sapiens
ccagcaatgccctgcctt

SEQ ID NO: 1867484 - DNA, 19 bp, Homo sapiens
ccagcacgttttctggctt

SEQ ID NO: 1867485 - DNA, 13 bp, Homo sapiens
ccagcccactggg

SEQ ID NO: 1867486 - DNA, 15 bp, Homo sapiens
ccagcccactgggcc

SEQ ID NO: 1867487 - DNA, 17 bp, Homo sapiens
ccagcccactgggccct

SEQ ID NO: 1867488 - DNA, 20 bp, Homo sapiens
ccagcccactgggccctggg

SEQ ID NO: 1867489 - DNA, 12 bp, Homo sapiens
ccagcctctggg

SEQ ID NO: 1867490 - DNA, 14 bp, Homo sapiens
ccagcctctggggc

SEQ ID NO: 1867491 - DNA, 15 bp, Homo sapiens
ccagcctctggggca

SEQ ID NO: 1867492 - DNA, 17 bp, Homo sapiens
ccagcctctggggcaga

SEQ ID NO: 1867493 - DNA, 18 bp, Homo sapiens
ccagcctctggggcagag

SEQ ID NO: 1867494 - DNA, 14 bp, Homo sapiens
ccagccttatgtgt

SEQ ID NO: 1867495 - DNA, 13 bp, Homo sapiens
ccaggagaagacc

SEQ ID NO: 1867496 - DNA, 19 bp, Homo sapiens
ccaggagaagacccctgcc

SEQ ID NO: 1867497 - DNA, 21 bp, Homo sapiens
ccaggagcagctggcactgac

SEQ ID NO: 1867498 - DNA, 16 bp, Homo sapiens
ccaggcctccagaacc

SEQ ID NO: 1867499 - DNA, 21 bp, Homo sapiens
ccaggctccctgaccaccctg

SEQ ID NO: 1867500 - DNA, 13 bp, Homo sapiens
ccagggcctctgg

SEQ ID NO: 1867501 - DNA, 14 bp, Homo sapiens
ccagggcctctggc

SEQ ID NO: 1867502 - DNA, 18 bp, Homo sapiens
ccaggggtgtcccagtcc

SEQ ID NO: 1867503 - DNA, 12 bp, Homo sapiens
ccagtattcttg

SEQ ID NO: 1867504 - DNA, 14 bp, Homo sapiens
ccagtattcttgtc

SEQ ID NO: 1867505 - DNA, 15 bp, Homo sapiens
ccagtcacctcctgc

SEQ ID NO: 1867506 - DNA, 12 bp, Homo sapiens
ccagtcccagcc

SEQ ID NO: 1867507 - DNA, 17 bp, Homo sapiens
ccagtcccagcctctgg

SEQ ID NO: 1867508 - DNA, 18 bp, Homo sapiens
ccagtcccagcctctggg

SEQ ID NO: 1867509 - DNA, 20 bp, Homo sapiens
ccagtcccagcctctggggc

SEQ ID NO: 1867510 - DNA, 22 bp, Homo sapiens
ccagtcccagcctctggggcag

SEQ ID NO: 1867511 - DNA, 12 bp, Homo sapiens
ccagtctgatta

SEQ ID NO: 1867512 - DNA, 15 bp, Homo sapiens
ccataccagtcacct

SEQ ID NO: 1867513 - DNA, 20 bp, Homo sapiens
ccataggaagacataaaact

SEQ ID NO: 1867514 - DNA, 15 bp, Homo sapiens
ccatatatgctgtat

SEQ ID NO: 1867515 - DNA, 18 bp, Homo sapiens
ccatatatgctgtatttc

SEQ ID NO: 1867516 - DNA, 21 bp, Homo sapiens
ccatatatgctgtatttcttt

SEQ ID NO: 1867517 - DNA, 16 bp, Homo sapiens
ccatatctagtcaata

SEQ ID NO: 1867518 - DNA, 22 bp, Homo sapiens
ccatattgctcttaaaaatctt

SEQ ID NO: 1867519 - DNA, 11 bp, Homo sapiens
ccatgaaaata

SEQ ID NO: 1867520 - DNA, 18 bp, Homo sapiens
ccatgtccagagggactg

SEQ ID NO: 1867521 - DNA, 14 bp, Homo sapiens
ccatgtgtgctaat

SEQ ID NO: 1867522 - DNA, 15 bp, Homo sapiens
ccattcctgttctct

SEQ ID NO: 1867523 - DNA, 10 bp, Homo sapiens
ccattgaaat

SEQ ID NO: 1867524 - DNA, 19 bp, Homo sapiens
ccattgaaatcagcatgac

SEQ ID NO: 1867525 - DNA, 12 bp, Homo sapiens
ccatttgctgcc

SEQ ID NO: 1867526 - DNA, 13 bp, Homo sapiens
cccaaagagctgt

SEQ ID NO: 1867527 - DNA, 15 bp, Homo sapiens
cccaatcctccctgg

SEQ ID NO: 1867528 - DNA, 13 bp, Homo sapiens
cccacccagcaga

SEQ ID NO: 1867529 - DNA, 15 bp, Homo sapiens
cccactcccccagga

SEQ ID NO: 1867530 - DNA, 20 bp, Homo sapiens
cccactcccccaggagcagc

SEQ ID NO: 1867531 - DNA, 17 bp, Homo sapiens
cccactgacctgcccat

SEQ ID NO: 1867532 - DNA, 14 bp, Homo sapiens
cccactgggccctg

SEQ ID NO: 1867533 - DNA, 20 bp, Homo sapiens
cccagagcacaagaaggcca

SEQ ID NO: 1867534 - DNA, 23 bp, Homo sapiens
cccagagcacaagaaggccagcc

SEQ ID NO: 1867535 - DNA, 13 bp, Homo sapiens
cccagcctctggg

SEQ ID NO: 1867536 - DNA, 23 bp, Homo sapiens
cccagcctctggggcagagcttg

SEQ ID NO: 1867537 - DNA, 12 bp, Homo sapiens
cccaggagcagc

SEQ ID NO: 1867538 - DNA, 13 bp, Homo sapiens
cccaggagcagct

SEQ ID NO: 1867539 - DNA, 20 bp, Homo sapiens
cccaggagcagctggcactg

SEQ ID NO: 1867540 - DNA, 18 bp, Homo sapiens
cccaggcctccagaacct

SEQ ID NO: 1867541 - DNA, 14 bp, Homo sapiens
cccagggcctctgg

SEQ ID NO: 1867542 - DNA, 19 bp, Homo sapiens
cccagggcctctggcttcc

SEQ ID NO: 1867543 - DNA, 23 bp, Homo sapiens
cccagggcctctggcttccctgc

SEQ ID NO: 1867544 - DNA, 18 bp, Homo sapiens
cccagtcccagcctctgg

SEQ ID NO: 1867545 - DNA, 21 bp, Homo sapiens
cccagtcccagcctctggggc

SEQ ID NO: 1867546 - DNA, 19 bp, Homo sapiens
cccagtgagattacagagg

SEQ ID NO: 1867547 - DNA, 19 bp, Homo sapiens
cccagtgatttacatgctg

SEQ ID NO: 1867548 - DNA, 19 bp, Homo sapiens
cccataccagtcacctcct

SEQ ID NO: 1867549 - DNA, 23 bp, Homo sapiens
cccataccagtcacctcctgctc

SEQ ID NO: 1867550 - DNA, 20 bp, Homo sapiens
cccattttagaaaatcagat

SEQ ID NO: 1867551 - DNA, 20 bp, Homo sapiens
ccccaaaagaaaccatgaca

SEQ ID NO: 1867552 - DNA, 11 bp, Homo sapiens
ccccactgacc

SEQ ID NO: 1867553 - DNA, 14 bp, Homo sapiens
ccccactgacctgc

SEQ ID NO: 1867554 - DNA, 13 bp, Homo sapiens
ccccaggagcagc

SEQ ID NO: 1867555 - DNA, 18 bp, Homo sapiens
ccccaggagcagctggca

SEQ ID NO: 1867556 - DNA, 21 bp, Homo sapiens
ccccaggagcagctggcactg

SEQ ID NO: 1867557 - DNA, 15 bp, Homo sapiens
cccccaaagagctgt

SEQ ID NO: 1867558 - DNA, 17 bp, Homo sapiens
cccccaaagagctgtgg

SEQ ID NO: 1867559 - DNA, 11 bp, Homo sapiens
cccccaggcct

SEQ ID NO: 1867560 - DNA, 13 bp, Homo sapiens
cccccaggcctcc

SEQ ID NO: 1867561 - DNA, 13 bp, Homo sapiens
ccccctagagact

SEQ ID NO: 1867562 - DNA, 14 bp, Homo sapiens
ccccctagagactc

SEQ ID NO: 1867563 - DNA, 21 bp, Homo sapiens
cccctgcagccgtgcaggact

SEQ ID NO: 1867564 - DNA, 19 bp, Homo sapiens
cccctgcccaagtggctct

SEQ ID NO: 1867565 - DNA, 21 bp, Homo sapiens
ccctcactcaggaaccctgga

SEQ ID NO: 1867566 - DNA, 22 bp, Homo sapiens
ccctcactcaggaaccctggag

SEQ ID NO: 1867567 - DNA, 22 bp, Homo sapiens
ccctgaacatttagtaccctgc

SEQ ID NO: 1867568 - DNA, 19 bp, Homo sapiens
ccctgaccaccctgcctgt

SEQ ID NO: 1867569 - DNA, 20 bp, Homo sapiens
ccctgaccaccctgcctgtg

SEQ ID NO: 1867570 - DNA, 14 bp, Homo sapiens
ccctgcagccgtgc

SEQ ID NO: 1867571 - DNA, 19 bp, Homo sapiens
ccctgcaggccaggccagc

SEQ ID NO: 1867572 - DNA, 21 bp, Homo sapiens
ccctgcaggccaggccagctt

SEQ ID NO: 1867573 - DNA, 21 bp, Homo sapiens
ccctgcccaatcctccctgga

SEQ ID NO: 1867574 - DNA, 23 bp, Homo sapiens
ccctgcccaatcctccctggaga

SEQ ID NO: 1867575 - DNA, 23 bp, Homo sapiens
ccctgcctgtggaggtgacctgt

SEQ ID NO: 1867576 - DNA, 14 bp, Homo sapiens
ccctggatggcctc

SEQ ID NO: 1867577 - DNA, 12 bp, Homo sapiens
ccctggggctgc

SEQ ID NO: 1867578 - DNA, 15 bp, Homo sapiens
ccctggggctgccct

SEQ ID NO: 1867579 - DNA, 16 bp, Homo sapiens
ccctggggctgccctc

SEQ ID NO: 1867580 - DNA, 22 bp, Homo sapiens
cccttggtttgcacataaaacg

SEQ ID NO: 1867581 - DNA, 18 bp, Homo sapiens
ccctttgtattataattg

SEQ ID NO: 1867582 - DNA, 17 bp, Homo sapiens
ccctttttaaaaaatac

SEQ ID NO: 1867583 - DNA, 17 bp, Homo sapiens
ccgcagcccccactgac

SEQ ID NO: 1867584 - DNA, 16 bp, Homo sapiens
ccgctctccccctgca

SEQ ID NO: 1867585 - DNA, 20 bp, Homo sapiens
ccgctctccccctgcagccg

SEQ ID NO: 1867586 - DNA, 22 bp, Homo sapiens
ccggccgcagcccccactgacc

SEQ ID NO: 1867587 - DNA, 23 bp, Homo sapiens
ccggccgcagcccccactgacct

SEQ ID NO: 1867588 - DNA, 18 bp, Homo sapiens
ccgtccccctagagactc

SEQ ID NO: 1867589 - DNA, 15 bp, Homo sapiens
ccgtgtagtttctgg

SEQ ID NO: 1867590 - DNA, 13 bp, Homo sapiens
cctacagcagcac

SEQ ID NO: 1867591 - DNA, 12 bp, Homo sapiens
cctacaggactg

SEQ ID NO: 1867592 - DNA, 23 bp, Homo sapiens
cctacaggactgggccgggccca

SEQ ID NO: 1867593 - DNA, 18 bp, Homo sapiens
cctagagactcagaggac

SEQ ID NO: 1867594 - DNA, 20 bp, Homo sapiens
cctagagactcagaggaccc

SEQ ID NO: 1867595 - DNA, 21 bp, Homo sapiens
cctagagactcagaggaccca

SEQ ID NO: 1867596 - DNA, 14 bp, Homo sapiens
cctagcttttaaaa

SEQ ID NO: 1867597 - DNA, 16 bp, Homo sapiens
cctagcttttaaaaaa

SEQ ID NO: 1867598 - DNA, 16 bp, Homo sapiens
cctatctagcatttat

SEQ ID NO: 1867599 - DNA, 15 bp, Homo sapiens
cctcactcaggaacc

SEQ ID NO: 1867600 - DNA, 20 bp, Homo sapiens
cctcactcaggaaccctgga

SEQ ID NO: 1867601 - DNA, 23 bp, Homo sapiens
cctcactcaggaaccctggagac

SEQ ID NO: 1867602 - DNA, 13 bp, Homo sapiens
cctccaaggctgt

SEQ ID NO: 1867603 - DNA, 21 bp, Homo sapiens
cctccagaaccttactggcac

SEQ ID NO: 1867604 - DNA, 23 bp, Homo sapiens
cctccagaaccttactggcactg

SEQ ID NO: 1867605 - DNA, 13 bp, Homo sapiens
cctcctaggagta

SEQ ID NO: 1867606 - DNA, 18 bp, Homo sapiens
cctcctgtgcctcccttt

SEQ ID NO: 1867607 - DNA, 20 bp, Homo sapiens
cctccttttggttcctcaca

SEQ ID NO: 1867608 - DNA, 24 bp, Homo sapiens
cctcgggatgaaaagccatatcta

SEQ ID NO: 1867609 - DNA, 16 bp, Homo sapiens
cctctcactaaacttt

SEQ ID NO: 1867610 - DNA, 22 bp, Homo sapiens
cctctccccaatccatgcttca

SEQ ID NO: 1867611 - DNA, 21 bp, Homo sapiens
cctctggacctcggtgatgcc

SEQ ID NO: 1867612 - DNA, 12 bp, Homo sapiens
cctctggggcag

SEQ ID NO: 1867613 - DNA, 23 bp, Homo sapiens
cctgaacatttagtaccctgcag

SEQ ID NO: 1867614 - DNA, 22 bp, Homo sapiens
cctgaagtcaaaccttaagata

SEQ ID NO: 1867615 - DNA, 13 bp, Homo sapiens
cctgaccaccctg

SEQ ID NO: 1867616 - DNA, 15 bp, Homo sapiens
cctgaccaccctgcc

SEQ ID NO: 1867617 - DNA, 18 bp, Homo sapiens
cctgatggtacaggaaag

SEQ ID NO: 1867618 - DNA, 20 bp, Homo sapiens
cctgattaccagtctgatta

SEQ ID NO: 1867619 - DNA, 14 bp, Homo sapiens
cctgcagccgtgca

SEQ ID NO: 1867620 - DNA, 20 bp, Homo sapiens
cctgcagccgtgcaggactc

SEQ ID NO: 1867621 - DNA, 13 bp, Homo sapiens
cctgcaggccagg

SEQ ID NO: 1867622 - DNA, 15 bp, Homo sapiens
cctgcaggccaggcc

SEQ ID NO: 1867623 - DNA, 20 bp, Homo sapiens
cctgcaggccaggccagctt

SEQ ID NO: 1867624 - DNA, 19 bp, Homo sapiens
cctgcccaatcctccctgg

SEQ ID NO: 1867625 - DNA, 20 bp, Homo sapiens
cctgcccaatcctccctgga

SEQ ID NO: 1867626 - DNA, 23 bp, Homo sapiens
cctgcccaatcctccctggagaa

SEQ ID NO: 1867627 - DNA, 12 bp, Homo sapiens
cctgcctgtgga

SEQ ID NO: 1867628 - DNA, 13 bp, Homo sapiens
cctgcctgtggag

SEQ ID NO: 1867629 - DNA, 21 bp, Homo sapiens
cctgcctgtggaggtgacctg

SEQ ID NO: 1867630 - DNA, 15 bp, Homo sapiens
cctgccttgctgcct

SEQ ID NO: 1867631 - DNA, 21 bp, Homo sapiens
cctgctgaaagtcctgctttc

SEQ ID NO: 1867632 - DNA, 12 bp, Homo sapiens
cctggagacaga

SEQ ID NO: 1867633 - DNA, 20 bp, Homo sapiens
cctggagacagaagtcaggt

SEQ ID NO: 1867634 - DNA, 15 bp, Homo sapiens
cctggatggcctctg

SEQ ID NO: 1867635 - DNA, 17 bp, Homo sapiens
cctggatggcctctggg

SEQ ID NO: 1867636 - DNA, 18 bp, Homo sapiens
cctggatggcctctgggg

SEQ ID NO: 1867637 - DNA, 17 bp, Homo sapiens
cctgggcagtgagtgcc

SEQ ID NO: 1867638 - DNA, 19 bp, Homo sapiens
cctgggcagtgagtgccat

SEQ ID NO: 1867639 - DNA, 23 bp, Homo sapiens
cctgggcagtgagtgccatgctt

SEQ ID NO: 1867640 - DNA, 20 bp, Homo sapiens
cctgggcttggtaagtgaat

SEQ ID NO: 1867641 - DNA, 14 bp, Homo sapiens
cctggggctgccct

SEQ ID NO: 1867642 - DNA, 17 bp, Homo sapiens
cctgtgagcaagagcca

SEQ ID NO: 1867643 - DNA, 18 bp, Homo sapiens
cctgtgagcaagagccag

SEQ ID NO: 1867644 - DNA, 19 bp, Homo sapiens
cctgtgagcaagagccagg

SEQ ID NO: 1867645 - DNA, 18 bp, Homo sapiens
cctgtggaggtgacctgt

SEQ ID NO: 1867646 - DNA, 21 bp, Homo sapiens
cctgtggaggtgacctgttag

SEQ ID NO: 1867647 - DNA, 17 bp, Homo sapiens
cctgttaggtctcatgc

SEQ ID NO: 1867648 - DNA, 18 bp, Homo sapiens
cctgtttttaacatgtga

SEQ ID NO: 1867649 - DNA, 15 bp, Homo sapiens
ccttaccaactttct

SEQ ID NO: 1867650 - DNA, 17 bp, Homo sapiens
ccttaccaactttctgt

SEQ ID NO: 1867651 - DNA, 18 bp, Homo sapiens
ccttaccaactttctgta

SEQ ID NO: 1867652 - DNA, 15 bp, Homo sapiens
ccttactggcactgt

SEQ ID NO: 1867653 - DNA, 19 bp, Homo sapiens
ccttactggcactgtggca

SEQ ID NO: 1867654 - DNA, 20 bp, Homo sapiens
ccttccgacaccactgggaa

SEQ ID NO: 1867655 - DNA, 19 bp, Homo sapiens
ccttctgttaagaaaggat

SEQ ID NO: 1867656 - DNA, 17 bp, Homo sapiens
ccttgatgttgtgttgt

SEQ ID NO: 1867657 - DNA, 20 bp, Homo sapiens
ccttgctgccttcaccctga

SEQ ID NO: 1867658 - DNA, 21 bp, Homo sapiens
ccttgctgccttcaccctgaa

SEQ ID NO: 1867659 - DNA, 16 bp, Homo sapiens
ccttggagtgctgcag

SEQ ID NO: 1867660 - DNA, 20 bp, Homo sapiens
ccttgggcgcttcccacctg

SEQ ID NO: 1867661 - DNA, 19 bp, Homo sapiens
cctttatatttagtgaact

SEQ ID NO: 1867662 - DNA, 20 bp, Homo sapiens
cctttgtattataattgttg

SEQ ID NO: 1867663 - DNA, 19 bp, Homo sapiens
cctttttaaaaaataccat

SEQ ID NO: 1867664 - DNA, 21 bp, Homo sapiens
cctttttaaaaaataccattg

SEQ ID NO: 1867665 - DNA, 19 bp, Homo sapiens
cctttttatatttaaaaaa

SEQ ID NO: 1867666 - DNA, 14 bp, Homo sapiens
cgaattaatagctt

SEQ ID NO: 1867667 - DNA, 22 bp, Homo sapiens
cgaattaatagcttttattgta

SEQ ID NO: 1867668 - DNA, 13 bp, Homo sapiens
cgacaccactggg

SEQ ID NO: 1867669 - DNA, 15 bp, Homo sapiens
cgagctacaaagcat

SEQ ID NO: 1867670 - DNA, 14 bp, Homo sapiens
cgagtctttgtgtg

SEQ ID NO: 1867671 - DNA, 13 bp, Homo sapiens
cgcacttacaagt

SEQ ID NO: 1867672 - DNA, 15 bp, Homo sapiens
cgcacttacaagtgg

SEQ ID NO: 1867673 - DNA, 21 bp, Homo sapiens
cgcagcccccactgacctgcc

SEQ ID NO: 1867674 - DNA, 21 bp, Homo sapiens
cgcagcttcctgtctgtttat

SEQ ID NO: 1867675 - DNA, 19 bp, Homo sapiens
cgcatgtccctccaaggct

SEQ ID NO: 1867676 - DNA, 16 bp, Homo sapiens
cgctctccccctgcag

SEQ ID NO: 1867677 - DNA, 17 bp, Homo sapiens
cgctctccccctgcagc

SEQ ID NO: 1867678 - DNA, 15 bp, Homo sapiens
cgctggacacctaca

SEQ ID NO: 1867679 - DNA, 14 bp, Homo sapiens
cgcttagaaacatg

SEQ ID NO: 1867680 - DNA, 17 bp, Homo sapiens
cgcttagttcttgaatt

SEQ ID NO: 1867681 - DNA, 22 bp, Homo sapiens
cgcttggggcatttgtgggact

SEQ ID NO: 1867682 - DNA, 20 bp, Homo sapiens
cggcaaccgtggggaggcca

SEQ ID NO: 1867683 - DNA, 14 bp, Homo sapiens
cggcactatttctg

SEQ ID NO: 1867684 - DNA, 18 bp, Homo sapiens
cggccaggctccctgacc

SEQ ID NO: 1867685 - DNA, 19 bp, Homo sapiens
cggccaggctccctgacca

SEQ ID NO: 1867686 - DNA, 20 bp, Homo sapiens
cggccaggctccctgaccac

SEQ ID NO: 1867687 - DNA, 12 bp, Homo sapiens
cgggtggctggt

SEQ ID NO: 1867688 - DNA, 23 bp, Homo sapiens
cggtgatgccttccgacaccact

SEQ ID NO: 1867689 - DNA, 14 bp, Homo sapiens
cggtgtctgcagct

SEQ ID NO: 1867690 - DNA, 15 bp, Homo sapiens
cggttgtcttgaaac

SEQ ID NO: 1867691 - DNA, 17 bp, Homo sapiens
cgtataatgctttctga

SEQ ID NO: 1867692 - DNA, 19 bp, Homo sapiens
cgtcatcacttttcagtga

SEQ ID NO: 1867693 - DNA, 16 bp, Homo sapiens
cgtccatttcttattt

SEQ ID NO: 1867694 - DNA, 15 bp, Homo sapiens
cgtgacagcctctga

SEQ ID NO: 1867695 - DNA, 17 bp, Homo sapiens
cgtgacagcctctgact

SEQ ID NO: 1867696 - DNA, 21 bp, Homo sapiens
cgtgattgattcagtatctta

SEQ ID NO: 1867697 - DNA, 19 bp, Homo sapiens
cgtgctgcttacactccag

SEQ ID NO: 1867698 - DNA, 20 bp, Homo sapiens
cgtgctgcttacactccagg

SEQ ID NO: 1867699 - DNA, 15 bp, Homo sapiens
cgtggggcagcagct

SEQ ID NO: 1867700 - DNA, 13 bp, Homo sapiens
cgtgtagtttctg

SEQ ID NO: 1867701 - DNA, 16 bp, Homo sapiens
cgttcgcttgttttaa

SEQ ID NO: 1867702 - DNA, 19 bp, Homo sapiens
cgttcgcttgttttaaaag

SEQ ID NO: 1867703 - DNA, 14 bp, Homo sapiens
cgtttacagtgtat

SEQ ID NO: 1867704 - DNA, 15 bp, Homo sapiens
cgtttggttaaagta

SEQ ID NO: 1867705 - DNA, 22 bp, Homo sapiens
ctaaagctttatctttgtgtaa

SEQ ID NO: 1867706 - DNA, 20 bp, Homo sapiens
ctaaagtatgtaaagtatgt

SEQ ID NO: 1867707 - DNA, 19 bp, Homo sapiens
ctaaataaactactttgaa

SEQ ID NO: 1867708 - DNA, 15 bp, Homo sapiens
ctaaatctctaatat

SEQ ID NO: 1867709 - DNA, 15 bp, Homo sapiens
ctaaatgctcataca

SEQ ID NO: 1867710 - DNA, 20 bp, Homo sapiens
ctaacaatatgattgcacta

SEQ ID NO: 1867711 - DNA, 17 bp, Homo sapiens
ctaacgaacgttttaaa

SEQ ID NO: 1867712 - DNA, 20 bp, Homo sapiens
ctaacgaacgttttaaagct

SEQ ID NO: 1867713 - DNA, 16 bp, Homo sapiens
ctaactgactctgtta

SEQ ID NO: 1867714 - DNA, 13 bp, Homo sapiens
ctaagcaagccag

SEQ ID NO: 1867715 - DNA, 22 bp, Homo sapiens
ctaagttgagtatattataata

SEQ ID NO: 1867716 - DNA, 12 bp, Homo sapiens
ctaatatacttt

SEQ ID NO: 1867717 - DNA, 21 bp, Homo sapiens
ctaatatatttttatatttag

SEQ ID NO: 1867718 - DNA, 14 bp, Homo sapiens
ctaatattaaaaat

SEQ ID NO: 1867719 - DNA, 12 bp, Homo sapiens
ctaatctgcctg

SEQ ID NO: 1867720 - DNA, 15 bp, Homo sapiens
ctaattagagaactg

SEQ ID NO: 1867721 - DNA, 12 bp, Homo sapiens
ctaatttaaaaa

SEQ ID NO: 1867722 - DNA, 14 bp, Homo sapiens
ctaatttaaaaaat

SEQ ID NO: 1867723 - DNA, 22 bp, Homo sapiens
ctacaaagcatgggaaaaagag

SEQ ID NO: 1867724 - DNA, 20 bp, Homo sapiens
ctacagcagcacgcatgtcc

SEQ ID NO: 1867725 - DNA, 13 bp, Homo sapiens
ctacattcttggt

SEQ ID NO: 1867726 - DNA, 21 bp, Homo sapiens
ctacattcttggttgttaatt

SEQ ID NO: 1867727 - DNA, 12 bp, Homo sapiens
ctactcatttta

SEQ ID NO: 1867728 - DNA, 17 bp, Homo sapiens
ctactgcagctttacat

SEQ ID NO: 1867729 - DNA, 14 bp, Homo sapiens
ctacttatcatttt

SEQ ID NO: 1867730 - DNA, 18 bp, Homo sapiens
ctagaaatcacaagaaca

SEQ ID NO: 1867731 - DNA, 10 bp, Homo sapiens
ctagagactc

SEQ ID NO: 1867732 - DNA, 22 bp, Homo sapiens
ctagagtcacccccccaggcct

SEQ ID NO: 1867733 - DNA, 15 bp, Homo sapiens
ctagcatttatttct

SEQ ID NO: 1867734 - DNA, 18 bp, Homo sapiens
ctagctttatattttgtt

SEQ ID NO: 1867735 - DNA, 13 bp, Homo sapiens
ctagcttttaaaa

SEQ ID NO: 1867736 - DNA, 16 bp, Homo sapiens
ctagcttttaaaaaat

SEQ ID NO: 1867737 - DNA, 19 bp, Homo sapiens
ctagcttttaaaaaatatt

SEQ ID NO: 1867738 - DNA, 17 bp, Homo sapiens
ctagtgccaaataattg

SEQ ID NO: 1867739 - DNA, 14 bp, Homo sapiens
ctataaacactgtt

SEQ ID NO: 1867740 - DNA, 19 bp, Homo sapiens
ctataacatagaattgcaa

SEQ ID NO: 1867741 - DNA, 20 bp, Homo sapiens
ctataactacatattgaata

SEQ ID NO: 1867742 - DNA, 20 bp, Homo sapiens
ctataataagttttgatata

SEQ ID NO: 1867743 - DNA, 13 bp, Homo sapiens
ctatacctgcctt

SEQ ID NO: 1867744 - DNA, 14 bp, Homo sapiens
ctatacctgccttt

SEQ ID NO: 1867745 - DNA, 18 bp, Homo sapiens
ctatatctataaacactg

SEQ ID NO: 1867746 - DNA, 19 bp, Homo sapiens
ctatatctataaacactgt

SEQ ID NO: 1867747 - DNA, 17 bp, Homo sapiens
ctatatctgtttgtata

SEQ ID NO: 1867748 - DNA, 13 bp, Homo sapiens
ctatatgatttat

SEQ ID NO: 1867749 - DNA, 13 bp, Homo sapiens
ctatatggcaaga

SEQ ID NO: 1867750 - DNA, 19 bp, Homo sapiens
ctatattaaatgagggttt

SEQ ID NO: 1867751 - DNA, 17 bp, Homo sapiens
ctatctatacctgcctt

SEQ ID NO: 1867752 - DNA, 23 bp, Homo sapiens
ctatgccgtgtagtttctggtat

SEQ ID NO: 1867753 - DNA, 17 bp, Homo sapiens
ctatggagactttgctg

SEQ ID NO: 1867754 - DNA, 23 bp, Homo sapiens
ctatggagactttgctgttactg

SEQ ID NO: 1867755 - DNA, 23 bp, Homo sapiens
ctattactgtctggttttaacaa

SEQ ID NO: 1867756 - DNA, 22 bp, Homo sapiens
ctattcaaggtggccaaattat

SEQ ID NO: 1867757 - DNA, 23 bp, Homo sapiens
ctattgtgttggctttacaaata

SEQ ID NO: 1867758 - DNA, 18 bp, Homo sapiens
ctcaaagatgatggaaac

SEQ ID NO: 1867759 - DNA, 18 bp, Homo sapiens
ctcaaattgtaattaata

SEQ ID NO: 1867760 - DNA, 12 bp, Homo sapiens
ctcaagtttaaa

SEQ ID NO: 1867761 - DNA, 16 bp, Homo sapiens
ctcaccagaattattt

SEQ ID NO: 1867762 - DNA, 21 bp, Homo sapiens
ctcactcaggaaccctggaga

SEQ ID NO: 1867763 - DNA, 21 bp, Homo sapiens
ctcagagggaggagtttttct

SEQ ID NO: 1867764 - DNA, 14 bp, Homo sapiens
ctcaggaaccctgg

SEQ ID NO: 1867765 - DNA, 18 bp, Homo sapiens
ctcaggaaccctggagac

SEQ ID NO: 1867766 - DNA, 21 bp, Homo sapiens
ctcaggaaccctggagacaga

SEQ ID NO: 1867767 - DNA, 12 bp, Homo sapiens
ctcatattttgt

SEQ ID NO: 1867768 - DNA, 16 bp, Homo sapiens
ctcatattttgtatat

SEQ ID NO: 1867769 - DNA, 22 bp, Homo sapiens
ctcatgagtggaaagtcaccta

SEQ ID NO: 1867770 - DNA, 23 bp, Homo sapiens
ctcatgcccactcccccaggagc

SEQ ID NO: 1867771 - DNA, 18 bp, Homo sapiens
ctcattaaactctaaaga

SEQ ID NO: 1867772 - DNA, 20 bp, Homo sapiens
ctcattaaactctaaagatt

SEQ ID NO: 1867773 - DNA, 17 bp, Homo sapiens
ctcattccaacagtgag

SEQ ID NO: 1867774 - DNA, 15 bp, Homo sapiens
ctcattgtggccagt

SEQ ID NO: 1867775 - DNA, 21 bp, Homo sapiens
ctcattttaatgattgtttaa

SEQ ID NO: 1867776 - DNA, 17 bp, Homo sapiens
ctccaaggctgtcttct

SEQ ID NO: 1867777 - DNA, 22 bp, Homo sapiens
ctccaaggctgtcttctcccag

SEQ ID NO: 1867778 - DNA, 18 bp, Homo sapiens
ctccaattctgaaatact

SEQ ID NO: 1867779 - DNA, 19 bp, Homo sapiens
ctccaattctgaaatactt

SEQ ID NO: 1867780 - DNA, 19 bp, Homo sapiens
ctccagaaccttactggca

SEQ ID NO: 1867781 - DNA, 20 bp, Homo sapiens
ctccagaaccttactggcac

SEQ ID NO: 1867782 - DNA, 21 bp, Homo sapiens
ctccagcacgttttctggctt

SEQ ID NO: 1867783 - DNA, 22 bp, Homo sapiens
ctccagcacgttttctggcttc

SEQ ID NO: 1867784 - DNA, 16 bp, Homo sapiens
ctccaggtgtggaccg

SEQ ID NO: 1867785 - DNA, 19 bp, Homo sapiens
ctccaggtgtggaccggcc

SEQ ID NO: 1867786 - DNA, 21 bp, Homo sapiens
ctccctgaccaccctgcctgt

SEQ ID NO: 1867787 - DNA, 23 bp, Homo sapiens
ctccctgaccaccctgcctgtgg

SEQ ID NO: 1867788 - DNA, 16 bp, Homo sapiens
ctgtatactgtaaaag

SEQ ID NO: 1867789 - DNA, 18 bp, Homo sapiens
ctgtatactgtaaaagtt

SEQ ID NO: 1867790 - DNA, 16 bp, Homo sapiens
ctgtatgtataaatta

SEQ ID NO: 1867791 - DNA, 13 bp, Homo sapiens
ctgtatttcagta

SEQ ID NO: 1867792 - DNA, 18 bp, Homo sapiens
ctgtatttcagtattttc

SEQ ID NO: 1867793 - DNA, 22 bp, Homo sapiens
ctgtatttctttgtagaataaa

SEQ ID NO: 1867794 - DNA, 13 bp, Homo sapiens
ctgtcaaatgaac

SEQ ID NO: 1867795 - DNA, 20 bp, Homo sapiens
ctgtctgctcttatttttgt

SEQ ID NO: 1867796 - DNA, 22 bp, Homo sapiens
ctgtctgctcttatttttgtac

SEQ ID NO: 1867797 - DNA, 16 bp, Homo sapiens
ctgtctggttttaaca

SEQ ID NO: 1867798 - DNA, 17 bp, Homo sapiens
ctgtctggttttaacaa

SEQ ID NO: 1867799 - DNA, 13 bp, Homo sapiens
ctgtcttctccca

SEQ ID NO: 1867800 - DNA, 17 bp, Homo sapiens
ctgtcttctcccagagc

SEQ ID NO: 1867801 - DNA, 18 bp, Homo sapiens
ctgtcttctcccagagca

SEQ ID NO: 1867802 - DNA, 11 bp, Homo sapiens
ctgtgaaagct

SEQ ID NO: 1867803 - DNA, 20 bp, Homo sapiens
gacaaacctagcttttaaaa

SEQ ID NO: 1867804 - DNA, 23 bp, Homo sapiens
gacaaacctagcttttaaaaaat

SEQ ID NO: 1867805 - DNA, 14 bp, Homo sapiens
gacaacacatgtgg

SEQ ID NO: 1867806 - DNA, 14 bp, Homo sapiens
gacaacattgtaag

SEQ ID NO: 1867807 - DNA, 12 bp, Homo sapiens
gacaccactggg

SEQ ID NO: 1867808 - DNA, 15 bp, Homo sapiens
gacaccactgggaac

SEQ ID NO: 1867809 - DNA, 22 bp, Homo sapiens
gacaccactgggaaccaagggc

SEQ ID NO: 1867810 - DNA, 18 bp, Homo sapiens
gacacctacagcagcacg

SEQ ID NO: 1867811 - DNA, 19 bp, Homo sapiens
gacacctacagcagcacgc

SEQ ID NO: 1867812 - DNA, 16 bp, Homo sapiens
gacagaagtcaggtgt

SEQ ID NO: 1867813 - DNA, 13 bp, Homo sapiens
gacagcctctgac

SEQ ID NO: 1867814 - DNA, 14 bp, Homo sapiens
gacagcctgggggg

SEQ ID NO: 1867815 - DNA, 15 bp, Homo sapiens
gacagcctggggggg

SEQ ID NO: 1867816 - DNA, 16 bp, Homo sapiens
gacaggagcagcccac

SEQ ID NO: 1867817 - DNA, 13 bp, Homo sapiens
gacagtggcacta

SEQ ID NO: 1867818 - DNA, 16 bp, Homo sapiens
gacagtggcactaaaa

SEQ ID NO: 1867819 - DNA, 14 bp, Homo sapiens
gacataaaacttta

SEQ ID NO: 1867820 - DNA, 17 bp, Homo sapiens
gacataaaactttaaaa

SEQ ID NO: 1867821 - DNA, 15 bp, Homo sapiens
gacataattgtccag

SEQ ID NO: 1867822 - DNA, 13 bp, Homo sapiens
gacatctgcctgt

SEQ ID NO: 1867823 - DNA, 17 bp, Homo sapiens
gacatctgcctgtaatt

SEQ ID NO: 1867824 - DNA, 12 bp, Homo sapiens
gacattcactgg

SEQ ID NO: 1867825 - DNA, 12 bp, Homo sapiens
gaccaccctgcc

SEQ ID NO: 1867826 - DNA, 17 bp, Homo sapiens
gaccaccctgcctgtgg

SEQ ID NO: 1867827 - DNA, 12 bp, Homo sapiens
gacccagtgaga

SEQ ID NO: 1867828 - DNA, 13 bp, Homo sapiens
gacccctgcccaa

SEQ ID NO: 1867829 - DNA, 23 bp, Homo sapiens
gacccctgcccaagtggctcttg

SEQ ID NO: 1867830 - DNA, 17 bp, Homo sapiens
gaccgttttgtattgct

SEQ ID NO: 1867831 - DNA, 18 bp, Homo sapiens
gacctcggtgatgccttc

SEQ ID NO: 1867832 - DNA, 11 bp, Homo sapiens
gacctgcccat

SEQ ID NO: 1867833 - DNA, 18 bp, Homo sapiens
gacgcctctggacctcgg

SEQ ID NO: 1867834 - DNA, 22 bp, Homo sapiens
gacggccaggctccctgaccac

SEQ ID NO: 1867835 - DNA, 13 bp, Homo sapiens
gactatttaagta

SEQ ID NO: 1867836 - DNA, 19 bp, Homo sapiens
gactcaaatctccagtatt

SEQ ID NO: 1867837 - DNA, 15 bp, Homo sapiens
gactccagcacgttt

SEQ ID NO: 1867838 - DNA, 19 bp, Homo sapiens
gactgcaagcatttttcca

SEQ ID NO: 1867839 - DNA, 18 bp, Homo sapiens
gactggacagccagggca

SEQ ID NO: 1867840 - DNA, 21 bp, Homo sapiens
gactgggccgggcccagggcc

SEQ ID NO: 1867841 - DNA, 23 bp, Homo sapiens
gactgggccgggcccagggcctc

SEQ ID NO: 1867842 - DNA, 14 bp, Homo sapiens
gactgtaagcagat

SEQ ID NO: 1867843 - DNA, 15 bp, Homo sapiens
gactgtaagcagatt

SEQ ID NO: 1867844 - DNA, 15 bp, Homo sapiens
gactgtcaaatgaac

SEQ ID NO: 1867845 - DNA, 17 bp, Homo sapiens
gactgtcaaatgaactt

SEQ ID NO: 1867846 - DNA, 19 bp, Homo sapiens
gactgtgaatttcaaaaaa

SEQ ID NO: 1867847 - DNA, 13 bp, Homo sapiens
gactttgctgtta

SEQ ID NO: 1867848 - DNA, 21 bp, Homo sapiens
gactttgctgttactgcttct

SEQ ID NO: 1867849 - DNA, 16 bp, Homo sapiens
gagaaaacttcagaga

SEQ ID NO: 1867850 - DNA, 22 bp, Homo sapiens
gagaaagaaaaggcaaaagact

SEQ ID NO: 1867851 - DNA, 11 bp, Homo sapiens
gagaaatgcca

SEQ ID NO: 1867852 - DNA, 17 bp, Homo sapiens
gagaagacccctgccca

SEQ ID NO: 1867853 - DNA, 18 bp, Homo sapiens
gagacaattagcagaatg

SEQ ID NO: 1867854 - DNA, 15 bp, Homo sapiens
gagacaggagcagcc

SEQ ID NO: 1867855 - DNA, 22 bp, Homo sapiens
gagacaggagcagcccacccag

SEQ ID NO: 1867856 - DNA, 16 bp, Homo sapiens
gagactggtcctgtgt

SEQ ID NO: 1867857 - DNA, 23 bp, Homo sapiens
gagactggtcctgtgtgcagtga

SEQ ID NO: 1867858 - DNA, 17 bp, Homo sapiens
gagactttgctgttact

SEQ ID NO: 1867859 - DNA, 20 bp, Homo sapiens
gagactttgctgttactgct

SEQ ID NO: 1867860 - DNA, 15 bp, Homo sapiens
gagatggtctgcatc

SEQ ID NO: 1867861 - DNA, 18 bp, Homo sapiens
gagcaaaatgcatgtaat

SEQ ID NO: 1867862 - DNA, 15 bp, Homo sapiens
gagcaagagccaggg

SEQ ID NO: 1867863 - DNA, 15 bp, Homo sapiens
gagcacaagaaggcc

SEQ ID NO: 1867864 - DNA, 17 bp, Homo sapiens
gagcacaagaaggccag

SEQ ID NO: 1867865 - DNA, 18 bp, Homo sapiens
gagcacaagaaggccagc

SEQ ID NO: 1867866 - DNA, 19 bp, Homo sapiens
gagcacaagaaggccagcc

SEQ ID NO: 1867867 - DNA, 21 bp, Homo sapiens
gagcacgttggcgaggaaaaa

SEQ ID NO: 1867868 - DNA, 15 bp, Homo sapiens
gagcagcccccaaag

SEQ ID NO: 1867869 - DNA, 16 bp, Homo sapiens
gagcagcccccaaaga

SEQ ID NO: 1867870 - DNA, 22 bp, Homo sapiens
gagcagctggcactgacagcct

SEQ ID NO: 1867871 - DNA, 18 bp, Homo sapiens
gagcattaactaaatgct

SEQ ID NO: 1867872 - DNA, 21 bp, Homo sapiens
gagctacaaagcatgggaaaa

SEQ ID NO: 1867873 - DNA, 11 bp, Homo sapiens
gagctgtggct

SEQ ID NO: 1867874 - DNA, 13 bp, Homo sapiens
gagctgtggctgg

SEQ ID NO: 1867875 - DNA, 16 bp, Homo sapiens
gagctgtggctggggg

SEQ ID NO: 1867876 - DNA, 16 bp, Homo sapiens
gagcttgtagccctgg

SEQ ID NO: 1867877 - DNA, 20 bp, Homo sapiens
gaggaaccacatataacact

SEQ ID NO: 1867878 - DNA, 21 bp, Homo sapiens
gaggacatgtttttgttttct

SEQ ID NO: 1867879 - DNA, 19 bp, Homo sapiens
gaggccatttgctgccctg

SEQ ID NO: 1867880 - DNA, 21 bp, Homo sapiens
gaggccatttgctgccctggg

SEQ ID NO: 1867881 - DNA, 14 bp, Homo sapiens
gagggactggacag

SEQ ID NO: 1867882 - DNA, 18 bp, Homo sapiens
gagggccaagacttggca

SEQ ID NO: 1867883 - DNA, 20 bp, Homo sapiens
gaggggaagaatttaatgga

SEQ ID NO: 1867884 - DNA, 13 bp, Homo sapiens
gagggggcagagt

SEQ ID NO: 1867885 - DNA, 13 bp, Homo sapiens
gagggtttctgat

SEQ ID NO: 1867886 - DNA, 22 bp, Homo sapiens
gaggtccttggagtgctgcagc

SEQ ID NO: 1867887 - DNA, 18 bp, Homo sapiens
gaggtttatagttaatct

SEQ ID NO: 1867888 - DNA, 13 bp, Homo sapiens
gagtaatgatgta

SEQ ID NO: 1867889 - DNA, 18 bp, Homo sapiens
gagtcacccccccaggcc

SEQ ID NO: 1867890 - DNA, 23 bp, Homo sapiens
gagtcgtcatcacttttcagtga

SEQ ID NO: 1867891 - DNA, 11 bp, Homo sapiens
gagtgaaacag

SEQ ID NO: 1867892 - DNA, 13 bp, Homo sapiens
gagtgaaacagag

SEQ ID NO: 1867893 - DNA, 23 bp, Homo sapiens
gagtgctgcagctttgggaaagc

SEQ ID NO: 1867894 - DNA, 18 bp, Homo sapiens
gagttacttagaatgcca

SEQ ID NO: 1867895 - DNA, 22 bp, Homo sapiens
gagttacttagaatgccataaa

SEQ ID NO: 1867896 - DNA, 23 bp, Homo sapiens
gagttctatggagactttgctgt

SEQ ID NO: 1867897 - DNA, 23 bp, Homo sapiens
gataacctatatgatttatagtt

SEQ ID NO: 1867898 - DNA, 18 bp, Homo sapiens
gataatcttcggccaatt

SEQ ID NO: 1867899 - DNA, 14 bp, Homo sapiens
gatataaaaggatg

SEQ ID NO: 1867900 - DNA, 21 bp, Homo sapiens
gatataaaaggatgttacaag

SEQ ID NO: 1867901 - DNA, 23 bp, Homo sapiens
gatataaaaggatgttacaagtt

SEQ ID NO: 1867902 - DNA, 18 bp, Homo sapiens
gatattcaaggctttaaa

SEQ ID NO: 1867903 - DNA, 21 bp, Homo sapiens
gatattttccctttttaaaaa

SEQ ID NO: 1867904 - DNA, 17 bp, Homo sapiens
gatcattatcttcatgt

SEQ ID NO: 1867905 - DNA, 15 bp, Homo sapiens
gatctttaaatacag

SEQ ID NO: 1867906 - DNA, 13 bp, Homo sapiens
gatctttgtttaa

SEQ ID NO: 1867907 - DNA, 18 bp, Homo sapiens
gatctttgtttaaatgcc

SEQ ID NO: 1867908 - DNA, 20 bp, Homo sapiens
gatctttgtttaaatgccaa

SEQ ID NO: 1867909 - DNA, 23 bp, Homo sapiens
gatgaaaagccatatctagtcaa

SEQ ID NO: 1867910 - DNA, 23 bp, Homo sapiens
gatgaaattttctagactttctg

SEQ ID NO: 1867911 - DNA, 13 bp, Homo sapiens
gatgaactttctc

SEQ ID NO: 1867912 - DNA, 15 bp, Homo sapiens
gatgaatgggaaagt

SEQ ID NO: 1867913 - DNA, 14 bp, Homo sapiens
gatgacgcctctgg

SEQ ID NO: 1867914 - DNA, 14 bp, Homo sapiens
gatggcctctgggg

SEQ ID NO: 1867915 - DNA, 12 bp, Homo sapiens
gatgggggctgg

SEQ ID NO: 1867916 - DNA, 23 bp, Homo sapiens
gatggtctgcatcagctttttgt

SEQ ID NO: 1867917 - DNA, 15 bp, Homo sapiens
gatgtgctgctttga

SEQ ID NO: 1867918 - DNA, 18 bp, Homo sapiens
gatgttacaagtttgcta

SEQ ID NO: 1867919 - DNA, 22 bp, Homo sapiens
gatgttacaagtttgctaaaag

SEQ ID NO: 1867920 - DNA, 19 bp, Homo sapiens
gattaccagtctgattata

SEQ ID NO: 1867921 - DNA, 22 bp, Homo sapiens
gattgattcagtatcttagagt

SEQ ID NO: 1867922 - DNA, 13 bp, Homo sapiens
gattgcactaaat

SEQ ID NO: 1867923 - DNA, 14 bp, Homo sapiens
gattgcactaaata

SEQ ID NO: 1867924 - DNA, 18 bp, Homo sapiens
gattggatttgctgtgac

SEQ ID NO: 1867925 - DNA, 14 bp, Homo sapiens
gatttatatataag

SEQ ID NO: 1867926 - DNA, 22 bp, Homo sapiens
gatttctctttgaaacatgctt

SEQ ID NO: 1867927 - DNA, 14 bp, Homo sapiens
gatttgaaaaactt

SEQ ID NO: 1867928 - DNA, 15 bp, Homo sapiens
gatttgaaaaacttt

SEQ ID NO: 1867929 - DNA, 18 bp, Homo sapiens
gatttgaaaaacttttag

SEQ ID NO: 1867930 - DNA, 20 bp, Homo sapiens
gattttgatattttcacaga

SEQ ID NO: 1867931 - DNA, 14 bp, Homo sapiens
gatttttaaaaggt

SEQ ID NO: 1867932 - DNA, 17 bp, Homo sapiens
gattttttttttaagtg

SEQ ID NO: 1867933 - DNA, 23 bp, Homo sapiens
gattttttttttttggtaattat

SEQ ID NO: 1867934 - DNA, 18 bp, Homo sapiens
gcaaaaacatatgtctgt

SEQ ID NO: 1867935 - DNA, 11 bp, Homo sapiens
gcaaaagactg

SEQ ID NO: 1867936 - DNA, 21 bp, Homo sapiens
gcaaaataaagaatagcaatt

SEQ ID NO: 1867937 - DNA, 18 bp, Homo sapiens
gcaactcgtgacagcctc

SEQ ID NO: 1867938 - DNA, 20 bp, Homo sapiens
gcaactcgtgacagcctctg

SEQ ID NO: 1867939 - DNA, 20 bp, Homo sapiens
gcaagaattaaaactgagtc

SEQ ID NO: 1867940 - DNA, 13 bp, Homo sapiens
gcaagccaggaga

SEQ ID NO: 1867941 - DNA, 12 bp, Homo sapiens
gcaatgccctgc

SEQ ID NO: 1867942 - DNA, 14 bp, Homo sapiens
gcaatgccctgcct

SEQ ID NO: 1867943 - DNA, 21 bp, Homo sapiens
gcaatgccctgccttgctgcc

SEQ ID NO: 1867944 - DNA, 22 bp, Homo sapiens
gcaatgccctgccttgctgcct

SEQ ID NO: 1867945 - DNA, 17 bp, Homo sapiens
gcaatttattaaaatga

SEQ ID NO: 1867946 - DNA, 17 bp, Homo sapiens
gcacaagaaggccagcc

SEQ ID NO: 1867947 - DNA, 19 bp, Homo sapiens
gcacctaaaccaccagtgc

SEQ ID NO: 1867948 - DNA, 18 bp, Homo sapiens
gcaccttaccaactttct

SEQ ID NO: 1867949 - DNA, 21 bp, Homo sapiens
gcactaaaatgtttaattcat

SEQ ID NO: 1867950 - DNA, 19 bp, Homo sapiens
gcactaaagtatgtaaagt

SEQ ID NO: 1867951 - DNA, 15 bp, Homo sapiens
gcactgacagcctgg

SEQ ID NO: 1867952 - DNA, 18 bp, Homo sapiens
gcactgacagcctggggg

SEQ ID NO: 1867953 - DNA, 19 bp, Homo sapiens
gcactgacagcctgggggg

SEQ ID NO: 1867954 - DNA, 14 bp, Homo sapiens
gcactgccaccagc

SEQ ID NO: 1867955 - DNA, 16 bp, Homo sapiens
gcactgtggcactgcc

SEQ ID NO: 1867956 - DNA, 21 bp, Homo sapiens
gcactgtggcactgccaccag

SEQ ID NO: 1867957 - DNA, 12 bp, Homo sapiens
gcacttacaagt

SEQ ID NO: 1867958 - DNA, 12 bp, Homo sapiens
gcacttttattt

SEQ ID NO: 1867959 - DNA, 18 bp, Homo sapiens
gcagaatggagaaagtaa

SEQ ID NO: 1867960 - DNA, 18 bp, Homo sapiens
gcagagcttgtagccctg

SEQ ID NO: 1867961 - DNA, 22 bp, Homo sapiens
gcagagtcagccattcctgttc

SEQ ID NO: 1867962 - DNA, 13 bp, Homo sapiens
gcagagtggcctg

SEQ ID NO: 1867963 - DNA, 18 bp, Homo sapiens
gcagagtggcctgtgagc

SEQ ID NO: 1867964 - DNA, 21 bp, Homo sapiens
gcagatctttaaatacagtca

SEQ ID NO: 1867965 - DNA, 21 bp, Homo sapiens
gcagcacgcatgtccctccaa

SEQ ID NO: 1867966 - DNA, 22 bp, Homo sapiens
gcagcacgcatgtccctccaag

SEQ ID NO: 1867967 - DNA, 23 bp, Homo sapiens
gcagcacgcatgtccctccaagg

SEQ ID NO: 1867968 - DNA, 20 bp, Homo sapiens
gcagccaaggaatgtgtcca

SEQ ID NO: 1867969 - DNA, 14 bp, Homo sapiens
gcagcccccaaaga

SEQ ID NO: 1867970 - DNA, 15 bp, Homo sapiens
gcagcccccactgac

SEQ ID NO: 1867971 - DNA, 16 bp, Homo sapiens
gcagcccccactgacc

SEQ ID NO: 1867972 - DNA, 22 bp, Homo sapiens
gcagcccccactgacctgccca

SEQ ID NO: 1867973 - DNA, 14 bp, Homo sapiens
gcagccgtgcagga

SEQ ID NO: 1867974 - DNA, 12 bp, Homo sapiens
gcagctggcact

SEQ ID NO: 1867975 - DNA, 15 bp, Homo sapiens
gcagctggcactgac

SEQ ID NO: 1867976 - DNA, 19 bp, Homo sapiens
gcagctggcactgacagcc

SEQ ID NO: 1867977 - DNA, 21 bp, Homo sapiens
gcagctggcactgacagcctg

SEQ ID NO: 1867978 - DNA, 12 bp, Homo sapiens
gcaggccaggcc

SEQ ID NO: 1867979 - DNA, 14 bp, Homo sapiens
gcaggccaggccag

SEQ ID NO: 1867980 - DNA, 16 bp, Homo sapiens
gcaggccaggccagct

SEQ ID NO: 1867981 - DNA, 22 bp, Homo sapiens
gcagggctttggggggcactag

SEQ ID NO: 1867982 - DNA, 19 bp, Homo sapiens
gcaggtcatggagcagccc

SEQ ID NO: 1867983 - DNA, 12 bp, Homo sapiens
gcagtcttttgc

SEQ ID NO: 1867984 - DNA, 18 bp, Homo sapiens
gcagtcttttgctgtgct

SEQ ID NO: 1867985 - DNA, 22 bp, Homo sapiens
gcataatgaaccgtttacagtg

SEQ ID NO: 1867986 - DNA, 17 bp, Homo sapiens
gcatgacaaaaataaca

SEQ ID NO: 1867987 - DNA, 21 bp, Homo sapiens
gcatgacaaaaataacactgt

SEQ ID NO: 1867988 - DNA, 15 bp, Homo sapiens
gcatgagattttgga

SEQ ID NO: 1867989 - DNA, 19 bp, Homo sapiens
gcatgggaaaaagagactc

SEQ ID NO: 1867990 - DNA, 23 bp, Homo sapiens
gcatgtccctccaaggctgtctt

SEQ ID NO: 1867991 - DNA, 23 bp, Homo sapiens
gcatgtttgtctgtgtgctgtaa

SEQ ID NO: 1867992 - DNA, 16 bp, Homo sapiens
gcatttaaggagattg

SEQ ID NO: 1867993 - DNA, 19 bp, Homo sapiens
gcatttcacttgagtggag

SEQ ID NO: 1867994 - DNA, 21 bp, Homo sapiens
gcatttttgatttatgcatgg

SEQ ID NO: 1867995 - DNA, 11 bp, Homo sapiens
gccaaattatt

SEQ ID NO: 1867996 - DNA, 18 bp, Homo sapiens
gccaaattatttgtgtaa

SEQ ID NO: 1867997 - DNA, 14 bp, Homo sapiens
gccacaagaaattt

SEQ ID NO: 1867998 - DNA, 16 bp, Homo sapiens
gccacactttgaaggt

SEQ ID NO: 1867999 - DNA, 21 bp, Homo sapiens
gccacagcactagagtcaccc

SEQ ID NO: 1868000 - DNA, 16 bp, Homo sapiens
gccaccagcaatgccc

SEQ ID NO: 1868001 - DNA, 19 bp, Homo sapiens
gccaccagcaatgccctgc

SEQ ID NO: 1868002 - DNA, 20 bp, Homo sapiens
gccaccagcaatgccctgcc

SEQ ID NO: 1868003 - DNA, 21 bp, Homo sapiens
gccaccagcaatgccctgcct

SEQ ID NO: 1868004 - DNA, 22 bp, Homo sapiens
gccaccagcaatgccctgcctt

SEQ ID NO: 1868005 - DNA, 15 bp, Homo sapiens
gccagcccactgggc

SEQ ID NO: 1868006 - DNA, 18 bp, Homo sapiens
gccaggagaagacccctg

SEQ ID NO: 1868007 - DNA, 22 bp, Homo sapiens
gccaggagaagacccctgccca

SEQ ID NO: 1868008 - DNA, 18 bp, Homo sapiens
gccaggccagcttcccct

SEQ ID NO: 1868009 - DNA, 21 bp, Homo sapiens
gccaggccagcttcccctcac

SEQ ID NO: 1868010 - DNA, 22 bp, Homo sapiens
gccaggcggacaaagttcagtg

SEQ ID NO: 1868011 - DNA, 23 bp, Homo sapiens
gccaggcggacaaagttcagtgt

SEQ ID NO: 1868012 - DNA, 16 bp, Homo sapiens
gccaggctccctgacc

SEQ ID NO: 1868013 - DNA, 16 bp, Homo sapiens
gccatagagtttaaca

SEQ ID NO: 1868014 - DNA, 19 bp, Homo sapiens
gccatattctaaattcact

SEQ ID NO: 1868015 - DNA, 18 bp, Homo sapiens
gccattgtgtatgatttt

SEQ ID NO: 1868016 - DNA, 14 bp, Homo sapiens
gccatttgctgccc

SEQ ID NO: 1868017 - DNA, 15 bp, Homo sapiens
gccatttgctgccct

SEQ ID NO: 1868018 - DNA, 18 bp, Homo sapiens
gcccaatcctccctggag

SEQ ID NO: 1868019 - DNA, 22 bp, Homo sapiens
gcccaatcctccctggagaagg

SEQ ID NO: 1868020 - DNA, 13 bp, Homo sapiens
gcccactccccca

SEQ ID NO: 1868021 - DNA, 17 bp, Homo sapiens
gcccactcccccaggag

SEQ ID NO: 1868022 - DNA, 20 bp, Homo sapiens
gcccactcccccaggagcag

SEQ ID NO: 1868023 - DNA, 22 bp, Homo sapiens
gcccactcccccaggagcagct

SEQ ID NO: 1868024 - DNA, 23 bp, Homo sapiens
gcccactcccccaggagcagctg

SEQ ID NO: 1868025 - DNA, 15 bp, Homo sapiens
gcccactgggccctg

SEQ ID NO: 1868026 - DNA, 16 bp, Homo sapiens
gcccactgggccctgg

SEQ ID NO: 1868027 - DNA, 13 bp, Homo sapiens
gcccagggcctct

SEQ ID NO: 1868028 - DNA, 14 bp, Homo sapiens
gcccagggcctctg

SEQ ID NO: 1868029 - DNA, 17 bp, Homo sapiens
gcccagggcctctggct

SEQ ID NO: 1868030 - DNA, 20 bp, Homo sapiens
gcccagggcctctggcttcc

SEQ ID NO: 1868031 - DNA, 16 bp, Homo sapiens
gcccatttttgctaat

SEQ ID NO: 1868032 - DNA, 17 bp, Homo sapiens
gcccccactgacctgcc

SEQ ID NO: 1868033 - DNA, 21 bp, Homo sapiens
gcccccactgacctgcccatg

SEQ ID NO: 1868034 - DNA, 15 bp, Homo sapiens
gccctcactcaggaa

SEQ ID NO: 1868035 - DNA, 21 bp, Homo sapiens
gccctcactcaggaaccctgg

SEQ ID NO: 1868036 - DNA, 13 bp, Homo sapiens
gccctgccttgct

SEQ ID NO: 1868037 - DNA, 14 bp, Homo sapiens
gccctggatggcct

SEQ ID NO: 1868038 - DNA, 23 bp, Homo sapiens
gccctggatggcctctggggcag

SEQ ID NO: 1868039 - DNA, 21 bp, Homo sapiens
gccctggggcatcatgggcaa

SEQ ID NO: 1868040 - DNA, 14 bp, Homo sapiens
gccgcagcccccac

SEQ ID NO: 1868041 - DNA, 20 bp, Homo sapiens
gccgcggggacaccgggaag

SEQ ID NO: 1868042 - DNA, 14 bp, Homo sapiens
gccgggaaagctgt

SEQ ID NO: 1868043 - DNA, 20 bp, Homo sapiens
gccgggcccagggcctctgg

SEQ ID NO: 1868044 - DNA, 13 bp, Homo sapiens
gccgtgcaggact

SEQ ID NO: 1868045 - DNA, 15 bp, Homo sapiens
gccgtgtagtttctg

SEQ ID NO: 1868046 - DNA, 19 bp, Homo sapiens
gcctcctgtgcctcccttt

SEQ ID NO: 1868047 - DNA, 16 bp, Homo sapiens
gcctctgactcaccac

SEQ ID NO: 1868048 - DNA, 21 bp, Homo sapiens
gcctctggcttccctgcccaa

SEQ ID NO: 1868049 - DNA, 13 bp, Homo sapiens
gcctctggggcag

SEQ ID NO: 1868050 - DNA, 16 bp, Homo sapiens
gcctctggggcagagc

SEQ ID NO: 1868051 - DNA, 17 bp, Homo sapiens
gcctctggggcagagct

SEQ ID NO: 1868052 - DNA, 18 bp, Homo sapiens
gcctctggggcagagctt

SEQ ID NO: 1868053 - DNA, 17 bp, Homo sapiens
gcctctggggcaggacc

SEQ ID NO: 1868054 - DNA, 18 bp, Homo sapiens
gcctctggggcaggacca

SEQ ID NO: 1868055 - DNA, 23 bp, Homo sapiens
gcctctggggcaggaccactagc

SEQ ID NO: 1868056 - DNA, 18 bp, Homo sapiens
gcctgggggggccgctct

SEQ ID NO: 1868057 - DNA, 13 bp, Homo sapiens
gcctgtgagcaag

SEQ ID NO: 1868058 - DNA, 17 bp, Homo sapiens
gcctgtgagcaagagcc

SEQ ID NO: 1868059 - DNA, 18 bp, Homo sapiens
gcctgtgagcaagagcca

SEQ ID NO: 1868060 - DNA, 19 bp, Homo sapiens
gcctgtgagcaagagccag

SEQ ID NO: 1868061 - DNA, 20 bp, Homo sapiens
gcctgtgagcaagagccagg

SEQ ID NO: 1868062 - DNA, 21 bp, Homo sapiens
gcctgtgagcaagagccaggg

SEQ ID NO: 1868063 - DNA, 19 bp, Homo sapiens
gccttgctgccttcaccct

SEQ ID NO: 1868064 - DNA, 19 bp, Homo sapiens
gcctttcataccagtcagt

SEQ ID NO: 1868065 - DNA, 14 bp, Homo sapiens
gccttttaagtttg

SEQ ID NO: 1868066 - DNA, 21 bp, Homo sapiens
gcgaaacccccttttcccttc

SEQ ID NO: 1868067 - DNA, 22 bp, Homo sapiens
gcgctggacacctacagcagca

SEQ ID NO: 1868068 - DNA, 14 bp, Homo sapiens
gcgggccaggcagg

SEQ ID NO: 1868069 - DNA, 17 bp, Homo sapiens
gcggggacaccgggaag

SEQ ID NO: 1868070 - DNA, 22 bp, Homo sapiens
gcgtatttagactgtggccata

SEQ ID NO: 1868071 - DNA, 14 bp, Homo sapiens
gctaaaagaagaga

SEQ ID NO: 1868072 - DNA, 13 bp, Homo sapiens
gctaagcaagcca

SEQ ID NO: 1868073 - DNA, 16 bp, Homo sapiens
gctaagcaagccagga

SEQ ID NO: 1868074 - DNA, 13 bp, Homo sapiens
gctaatatacttt

SEQ ID NO: 1868075 - DNA, 20 bp, Homo sapiens
gctaatctgcctggttttat

SEQ ID NO: 1868076 - DNA, 23 bp, Homo sapiens
gctacttatcatttttgtataaa

SEQ ID NO: 1868077 - DNA, 17 bp, Homo sapiens
gctataaattatattcc

SEQ ID NO: 1868078 - DNA, 17 bp, Homo sapiens
gctatcctgctgaaagt

SEQ ID NO: 1868079 - DNA, 17 bp, Homo sapiens
gctatctatacctgcct

SEQ ID NO: 1868080 - DNA, 18 bp, Homo sapiens
gctattcccttctgatct

SEQ ID NO: 1868081 - DNA, 14 bp, Homo sapiens
gctcacaaattccg

SEQ ID NO: 1868082 - DNA, 15 bp, Homo sapiens
gctcattttttctta

SEQ ID NO: 1868083 - DNA, 19 bp, Homo sapiens
gctccctgaccaccctgcc

SEQ ID NO: 1868084 - DNA, 20 bp, Homo sapiens
gctccctgaccaccctgcct

SEQ ID NO: 1868085 - DNA, 13 bp, Homo sapiens
gctctccccctgc

SEQ ID NO: 1868086 - DNA, 14 bp, Homo sapiens
gctcttatttttgt

SEQ ID NO: 1868087 - DNA, 21 bp, Homo sapiens
gctcttatttttgtaccatat

SEQ ID NO: 1868088 - DNA, 16 bp, Homo sapiens
gctgatagctaagtga

SEQ ID NO: 1868089 - DNA, 17 bp, Homo sapiens
gctgccttcaccctgaa

SEQ ID NO: 1868090 - DNA, 16 bp, Homo sapiens
gctggagaagcccatg

SEQ ID NO: 1868091 - DNA, 18 bp, Homo sapiens
gctggagggggcagagtg

SEQ ID NO: 1868092 - DNA, 17 bp, Homo sapiens
gctggcactgacagcct

SEQ ID NO: 1868093 - DNA, 14 bp, Homo sapiens
gctggggggatgac

SEQ ID NO: 1868094 - DNA, 14 bp, Homo sapiens
gctgtcttctccca

SEQ ID NO: 1868095 - DNA, 16 bp, Homo sapiens
gctgtcttctcccaga

SEQ ID NO: 1868096 - DNA, 19 bp, Homo sapiens
gctgtcttctcccagagca

SEQ ID NO: 1868097 - DNA, 16 bp, Homo sapiens
gctgtggctgggggga

SEQ ID NO: 1868098 - DNA, 15 bp, Homo sapiens
gctgttactgcttct

SEQ ID NO: 1868099 - DNA, 20 bp, Homo sapiens
gctgtttactcccttctgta

SEQ ID NO: 1868100 - DNA, 21 bp, Homo sapiens
gctgtttactcccttctgtag

SEQ ID NO: 1868101 - DNA, 10 bp, Homo sapiens
gcttaatttc

SEQ ID NO: 1868102 - DNA, 23 bp, Homo sapiens
gcttaatttccttctgttaagaa

SEQ ID NO: 1868103 - DNA, 14 bp, Homo sapiens
gcttagaaacatgt

SEQ ID NO: 1868104 - DNA, 15 bp, Homo sapiens
gcttagatgttccaa

SEQ ID NO: 1868105 - DNA, 19 bp, Homo sapiens
gcttagttcttgaattgtt

SEQ ID NO: 1868106 - DNA, 20 bp, Homo sapiens
gcttagttcttgaattgtta

SEQ ID NO: 1868107 - DNA, 16 bp, Homo sapiens
gcttcactcatgcaaa

SEQ ID NO: 1868108 - DNA, 23 bp, Homo sapiens
gcttcactcatgcaaactgcttt

SEQ ID NO: 1868109 - DNA, 12 bp, Homo sapiens
gcttcatatcta

SEQ ID NO: 1868110 - DNA, 16 bp, Homo sapiens
gcttccctgcccaatc

SEQ ID NO: 1868111 - DNA, 14 bp, Homo sapiens
gcttctctttgtgc

SEQ ID NO: 1868112 - DNA, 17 bp, Homo sapiens
gcttcttaaaaactgtg

SEQ ID NO: 1868113 - DNA, 18 bp, Homo sapiens
gctttaaaagtcattatt

SEQ ID NO: 1868114 - DNA, 20 bp, Homo sapiens
gctttaaaagtcattattcc

SEQ ID NO: 1868115 - DNA, 20 bp, Homo sapiens
gctttaggcatatgcttctt

SEQ ID NO: 1868116 - DNA, 14 bp, Homo sapiens
gcttttattgcacc

SEQ ID NO: 1868117 - DNA, 22 bp, Homo sapiens
gcttttctcttgccccaaatca

SEQ ID NO: 1868118 - DNA, 17 bp, Homo sapiens
ggaaaattgaaagtatt

SEQ ID NO: 1868119 - DNA, 18 bp, Homo sapiens
ggaaagctgtgccttttt

SEQ ID NO: 1868120 - DNA, 16 bp, Homo sapiens
ggaaccaagggccctc

SEQ ID NO: 1868121 - DNA, 22 bp, Homo sapiens
ggaaccacatataacacttaac

SEQ ID NO: 1868122 - DNA, 13 bp, Homo sapiens
ggaaccctggaga

SEQ ID NO: 1868123 - DNA, 15 bp, Homo sapiens
ggaacttctaatata

SEQ ID NO: 1868124 - DNA, 13 bp, Homo sapiens
ggaagaatttaat

SEQ ID NO: 1868125 - DNA, 23 bp, Homo sapiens
ggaagacataaaactttaaaagg

SEQ ID NO: 1868126 - DNA, 19 bp, Homo sapiens
ggaatgtgtccaagacaca

SEQ ID NO: 1868127 - DNA, 21 bp, Homo sapiens
ggacatgtttttgttttcttt

SEQ ID NO: 1868128 - DNA, 21 bp, Homo sapiens
ggaccactagctaagcaagcc

SEQ ID NO: 1868129 - DNA, 23 bp, Homo sapiens
ggaccactagctaagcaagccag

SEQ ID NO: 1868130 - DNA, 13 bp, Homo sapiens
ggaccggccgcag

SEQ ID NO: 1868131 - DNA, 16 bp, Homo sapiens
ggaccggccgcagccc

SEQ ID NO: 1868132 - DNA, 16 bp, Homo sapiens
ggacctcggtgatgcc

SEQ ID NO: 1868133 - DNA, 13 bp, Homo sapiens
ggactggacagcc

SEQ ID NO: 1868134 - DNA, 17 bp, Homo sapiens
ggactggacagccaggg

SEQ ID NO: 1868135 - DNA, 18 bp, Homo sapiens
ggactgggccgggcccag

SEQ ID NO: 1868136 - DNA, 21 bp, Homo sapiens
ggactgggccgggcccagggc

SEQ ID NO: 1868137 - DNA, 21 bp, Homo sapiens
ggagacaattagcagaatgga

SEQ ID NO: 1868138 - DNA, 13 bp, Homo sapiens
ggagcagccccca

SEQ ID NO: 1868139 - DNA, 14 bp, Homo sapiens
ggagcagctggcac

SEQ ID NO: 1868140 - DNA, 16 bp, Homo sapiens
ggagcagctggcactg

SEQ ID NO: 1868141 - DNA, 22 bp, Homo sapiens
ggagcagctggcactgacagcc

SEQ ID NO: 1868142 - DNA, 14 bp, Homo sapiens
ggagccgggaaagc

SEQ ID NO: 1868143 - DNA, 17 bp, Homo sapiens
ggaggccatttgctgcc

SEQ ID NO: 1868144 - DNA, 20 bp, Homo sapiens
ggaggccatttgctgccctg

SEQ ID NO: 1868145 - DNA, 17 bp, Homo sapiens
gtaaaagttataataac

SEQ ID NO: 1868146 - DNA, 22 bp, Homo sapiens
gtaaaagttataataactgaac

SEQ ID NO: 1868147 - DNA, 21 bp, Homo sapiens
gtaaactcaaaacttaacata

SEQ ID NO: 1868148 - DNA, 21 bp, Homo sapiens
gtaaagtatgtaaacaggaga

SEQ ID NO: 1868149 - DNA, 14 bp, Homo sapiens
gtgtctgcagctcc

SEQ ID NO: 1868150 - DNA, 17 bp, Homo sapiens
gtgtgatgaactttctc

SEQ ID NO: 1868151 - DNA, 22 bp, Homo sapiens
gtgtgcaactaactgactctgt

SEQ ID NO: 1868152 - DNA, 18 bp, Homo sapiens
gtgtggaccggccgcagc

SEQ ID NO: 1868153 - DNA, 22 bp, Homo sapiens
gtgtgttatattccaaggaaaa

SEQ ID NO: 1868154 - DNA, 19 bp, Homo sapiens
gtgttatattccaaggaaa

SEQ ID NO: 1868155 - DNA, 15 bp, Homo sapiens
gtgttggctttacaa

SEQ ID NO: 1868156 - DNA, 18 bp, Homo sapiens
gttaaataaatagaaaga

SEQ ID NO: 1868157 - DNA, 18 bp, Homo sapiens
gttacaagtttgctaaaa

SEQ ID NO: 1868158 - DNA, 17 bp, Homo sapiens
gttactgcttctctttg

SEQ ID NO: 1868159 - DNA, 23 bp, Homo sapiens
gttactgcttctctttgtgcagt

SEQ ID NO: 1868160 - DNA, 22 bp, Homo sapiens
gttactggctctttgtgtgtct

SEQ ID NO: 1868161 - DNA, 16 bp, Homo sapiens
gttacttagaatgcca

SEQ ID NO: 1868162 - DNA, 17 bp, Homo sapiens
gttacttagaatgccat

SEQ ID NO: 1868163 - DNA, 21 bp, Homo sapiens
gttagcgtccatttcttattt

SEQ ID NO: 1868164 - DNA, 17 bp, Homo sapiens
gttatatattttttgta

SEQ ID NO: 1868165 - DNA, 16 bp, Homo sapiens
gttatattccaaggaa

SEQ ID NO: 1868166 - DNA, 16 bp, Homo sapiens
gttattaatgtttctt

SEQ ID NO: 1868167 - DNA, 18 bp, Homo sapiens
gttatttgttattttcag

SEQ ID NO: 1868168 - DNA, 17 bp, Homo sapiens
gttattttcagtatttt

SEQ ID NO: 1868169 - DNA, 16 bp, Homo sapiens
gttcactaaactctga

SEQ ID NO: 1868170 - DNA, 21 bp, Homo sapiens
gttctgcaagaattaaaactg

SEQ ID NO: 1868171 - DNA, 23 bp, Homo sapiens
gttctgcaagaattaaaactgag

SEQ ID NO: 1868172 - DNA, 16 bp, Homo sapiens
gttctgcactcctgga

SEQ ID NO: 1868173 - DNA, 17 bp, Homo sapiens
gttcttacaagcttaaa

SEQ ID NO: 1868174 - DNA, 21 bp, Homo sapiens
gttcttacaagcttaaagctt

SEQ ID NO: 1868175 - DNA, 15 bp, Homo sapiens
gttcttgaattgtta

SEQ ID NO: 1868176 - DNA, 18 bp, Homo sapiens
gttcttgaattgttatga

SEQ ID NO: 1868177 - DNA, 12 bp, Homo sapiens
gttggcacttat

SEQ ID NO: 1868178 - DNA, 14 bp, Homo sapiens
gttggctttacaaa

SEQ ID NO: 1868179 - DNA, 15 bp, Homo sapiens
gttgtcttgaaacct

SEQ ID NO: 1868180 - DNA, 17 bp, Homo sapiens
gttgtgcaaattaacag

SEQ ID NO: 1868181 - DNA, 19 bp, Homo sapiens
gtttaaaagtcacataaaa

SEQ ID NO: 1868182 - DNA, 19 bp, Homo sapiens
gtttaaatgccaaaatgta

SEQ ID NO: 1868183 - DNA, 17 bp, Homo sapiens
gtttaagggtggaaaaa

SEQ ID NO: 1868184 - DNA, 21 bp, Homo sapiens
gtttaagggtggaaaaatgcc

SEQ ID NO: 1868185 - DNA, 14 bp, Homo sapiens
gtttacagtttgtg

SEQ ID NO: 1868186 - DNA, 16 bp, Homo sapiens
gtttacagtttgtgtt

SEQ ID NO: 1868187 - DNA, 13 bp, Homo sapiens
gtttactcccttc

SEQ ID NO: 1868188 - DNA, 17 bp, Homo sapiens
gtttatagttaatctat

SEQ ID NO: 1868189 - DNA, 18 bp, Homo sapiens
gtttatagttaatctata

SEQ ID NO: 1868190 - DNA, 17 bp, Homo sapiens
gtttatatattgaaagt

SEQ ID NO: 1868191 - DNA, 21 bp, Homo sapiens
gtttatatattgaaagttgct

SEQ ID NO: 1868192 - DNA, 23 bp, Homo sapiens
gtttatatattgaaagttgcttt

SEQ ID NO: 1868193 - DNA, 18 bp, Homo sapiens
gtttattctgtggttcta

SEQ ID NO: 1868194 - DNA, 21 bp, Homo sapiens
gtttattctgtggttctataa

SEQ ID NO: 1868195 - DNA, 15 bp, Homo sapiens
gtttcatgtatgtat

SEQ ID NO: 1868196 - DNA, 22 bp, Homo sapiens
gtttcctaaaatatctgggtgg

SEQ ID NO: 1868197 - DNA, 17 bp, Homo sapiens
gtttggcaatagtttgc

SEQ ID NO: 1868198 - DNA, 16 bp, Homo sapiens
gttttaaaaaaactga

SEQ ID NO: 1868199 - DNA, 18 bp, Homo sapiens
gttttaaaaaaactgaag

SEQ ID NO: 1868200 - DNA, 23 bp, Homo sapiens
gttttaaaaaaactgaaggtttt

SEQ ID NO: 1868201 - DNA, 15 bp, Homo sapiens
gttttaaaaataagt

SEQ ID NO: 1868202 - DNA, 15 bp, Homo sapiens
gttttatacataaac

SEQ ID NO: 1868203 - DNA, 18 bp, Homo sapiens
gttttatacataaacagt

SEQ ID NO: 1868204 - DNA, 13 bp, Homo sapiens
gttttatttatat

SEQ ID NO: 1868205 - DNA, 24 bp, Homo sapiens
gttttatttatatcttgttattaa

SEQ ID NO: 1868206 - DNA, 19 bp, Homo sapiens
gttttggagaaaaattaca

SEQ ID NO: 1868207 - DNA, 21 bp, Homo sapiens
gttttggagaaaaattacaga

SEQ ID NO: 1868208 - DNA, 15 bp, Homo sapiens
gtttttctgatatgt

SEQ ID NO: 1868209 - DNA, 13 bp, Homo sapiens
gttttttactttg

SEQ ID NO: 1868210 - DNA, 20 bp, Homo sapiens
taaaaaaaactctttaactt

SEQ ID NO: 1868211 - DNA, 21 bp, Homo sapiens
taaaaaaacaatcatttgctt

SEQ ID NO: 1868212 - DNA, 14 bp, Homo sapiens
taaaaaaactgaag

SEQ ID NO: 1868213 - DNA, 18 bp, Homo sapiens
taaaaaaatatatacaga

SEQ ID NO: 1868214 - DNA, 18 bp, Homo sapiens
taaaaaatattttaagaa

SEQ ID NO: 1868215 - DNA, 18 bp, Homo sapiens
taaaaaattaaaaatgaa

SEQ ID NO: 1868216 - DNA, 13 bp, Homo sapiens
taaaaactgtgta

SEQ ID NO: 1868217 - DNA, 15 bp, Homo sapiens
taaaaactgtgtatc

SEQ ID NO: 1868218 - DNA, 14 bp, Homo sapiens
taaaaagtgaactt

SEQ ID NO: 1868219 - DNA, 21 bp, Homo sapiens
taaaaagtgaacttttgtaat

SEQ ID NO: 1868220 - DNA, 22 bp, Homo sapiens
taaaaagtgaacttttgtaatt

SEQ ID NO: 1868221 - DNA, 18 bp, Homo sapiens
taaaagaagagaggggaa

SEQ ID NO: 1868222 - DNA, 21 bp, Homo sapiens
taaaagaagagaggggaagaa

SEQ ID NO: 1868223 - DNA, 22 bp, Homo sapiens
taaaagaagagaggggaagaat

SEQ ID NO: 1868224 - DNA, 17 bp, Homo sapiens
taaaagagtagaaaagg

SEQ ID NO: 1868225 - DNA, 20 bp, Homo sapiens
taaaaggatgttacaagttt

SEQ ID NO: 1868226 - DNA, 12 bp, Homo sapiens
taaaagggttca

SEQ ID NO: 1868227 - DNA, 20 bp, Homo sapiens
taaaagtcacataaaatgcg

SEQ ID NO: 1868228 - DNA, 21 bp, Homo sapiens
taaaagttataataactgaac

SEQ ID NO: 1868229 - DNA, 21 bp, Homo sapiens
taaaagttgtgattccagata

SEQ ID NO: 1868230 - DNA, 12 bp, Homo sapiens
taaaataataaa

SEQ ID NO: 1868231 - DNA, 14 bp, Homo sapiens
taaaatatatgttc

SEQ ID NO: 1868232 - DNA, 22 bp, Homo sapiens
taaaatatatgttctgcaagaa

SEQ ID NO: 1868233 - DNA, 18 bp, Homo sapiens
taaaatattatttgatat

SEQ ID NO: 1868234 - DNA, 19 bp, Homo sapiens
taaaatattatttgatatc

SEQ ID NO: 1868235 - DNA, 20 bp, Homo sapiens
taaaatattatttgatatct

SEQ ID NO: 1868236 - DNA, 21 bp, Homo sapiens
taaaatattatttgatatctg

SEQ ID NO: 1868237 - DNA, 14 bp, Homo sapiens
taaaatgaagcaat

SEQ ID NO: 1868238 - DNA, 18 bp, Homo sapiens
taaaatgaagcaatttat

SEQ ID NO: 1868239 - DNA, 20 bp, Homo sapiens
taaaatgattgtaaaatagc

SEQ ID NO: 1868240 - DNA, 17 bp, Homo sapiens
taaaattaatttgtgca

SEQ ID NO: 1868241 - DNA, 17 bp, Homo sapiens
taaaattgcagtttcat

SEQ ID NO: 1868242 - DNA, 18 bp, Homo sapiens
taaaattgcagtttcatg

SEQ ID NO: 1868243 - DNA, 21 bp, Homo sapiens
taaaattgcagtttcatgtat

SEQ ID NO: 1868244 - DNA, 19 bp, Homo sapiens
taaacaaaatttcacagtt

SEQ ID NO: 1868245 - DNA, 15 bp, Homo sapiens
taaacagcaaagcca

SEQ ID NO: 1868246 - DNA, 20 bp, Homo sapiens
taaacagcaaagccatattc

SEQ ID NO: 1868247 - DNA, 18 bp, Homo sapiens
taaacaggagacaggaag

SEQ ID NO: 1868248 - DNA, 22 bp, Homo sapiens
taaacattaatcaatcatctgt

SEQ ID NO: 1868249 - DNA, 18 bp, Homo sapiens
taaactactttgaataga

SEQ ID NO: 1868250 - DNA, 17 bp, Homo sapiens
taaactagtttaagggt

SEQ ID NO: 1868251 - DNA, 17 bp, Homo sapiens
taaactatcagtttgtc

SEQ ID NO: 1868252 - DNA, 15 bp, Homo sapiens
taaactatttgtctt

SEQ ID NO: 1868253 - DNA, 13 bp, Homo sapiens
taaacttgtgtat

SEQ ID NO: 1868254 - DNA, 20 bp, Homo sapiens
taaactttacccaaaaacta

SEQ ID NO: 1868255 - DNA, 23 bp, Homo sapiens
taattttttgcagtcttttgctg

SEQ ID NO: 1868256 - DNA, 18 bp, Homo sapiens
taatttttttttgtaaag

SEQ ID NO: 1868257 - DNA, 21 bp, Homo sapiens
tacaaagcatgggaaaaagag

SEQ ID NO: 1868258 - DNA, 24 bp, Homo sapiens
tacaaagcatgggaaaaagagact

SEQ ID NO: 1868259 - DNA, 20 bp, Homo sapiens
tacaaattttttaatttcca

SEQ ID NO: 1868260 - DNA, 19 bp, Homo sapiens
tacaacaagagtttatttc

SEQ ID NO: 1868261 - DNA, 17 bp, Homo sapiens
tacaagacaacattgta

SEQ ID NO: 1868262 - DNA, 19 bp, Homo sapiens
tacaagtggtgaccaaaat

SEQ ID NO: 1868263 - DNA, 14 bp, Homo sapiens
tacaagtgtatatc

SEQ ID NO: 1868264 - DNA, 17 bp, Homo sapiens
tacaagtttgctaaaag

SEQ ID NO: 1868265 - DNA, 21 bp, Homo sapiens
tacaagtttgctaaaagaaga

SEQ ID NO: 1868266 - DNA, 14 bp, Homo sapiens
tacaatgtgacttt

SEQ ID NO: 1868267 - DNA, 11 bp, Homo sapiens
tacactttatt

SEQ ID NO: 1868268 - DNA, 16 bp, Homo sapiens
tacagaatgcattaaa

SEQ ID NO: 1868269 - DNA, 19 bp, Homo sapiens
tacagaatgcattaaaaaa

SEQ ID NO: 1868270 - DNA, 22 bp, Homo sapiens
tttgatctttgtttaaatgcca

SEQ ID NO: 1868271 - DNA, 15 bp, Homo sapiens
tttgatttctagtat

SEQ ID NO: 1868272 - DNA, 23 bp, Homo sapiens
tttgcaaaccctttgtattataa

SEQ ID NO: 1868273 - DNA, 19 bp, Homo sapiens
tttgcaatggctatatggc

SEQ ID NO: 1868274 - DNA, 19 bp, Homo sapiens
tttgcaatttcaggaattt

SEQ ID NO: 1868275 - DNA, 12 bp, Homo sapiens
tttgcacataaa

SEQ ID NO: 1868276 - DNA, 17 bp, Homo sapiens
tttgcagtcttttgctg

SEQ ID NO: 1868277 - DNA, 18 bp, Homo sapiens
tttgcagtcttttgctgt

SEQ ID NO: 1868278 - DNA, 14 bp, Homo sapiens
tttgctaaaagaag

SEQ ID NO: 1868279 - DNA, 19 bp, Homo sapiens
tttgctaaaagaagagagg

SEQ ID NO: 1868280 - DNA, 13 bp, Homo sapiens
tttgctgccctgg

SEQ ID NO: 1868281 - DNA, 16 bp, Homo sapiens
tttgctgccctggggc

SEQ ID NO: 1868282 - DNA, 23 bp, Homo sapiens
tttgctgtgctgtacattactgt

SEQ ID NO: 1868283 - DNA, 16 bp, Homo sapiens
tttgctgttactgctt

SEQ ID NO: 1868284 - DNA, 17 bp, Homo sapiens
tttgctgttactgcttc

SEQ ID NO: 1868285 - DNA, 21 bp, Homo sapiens
tttggaagaagttttttactt

SEQ ID NO: 1868286 - DNA, 22 bp, Homo sapiens
tttggagaaattatttaataaa

SEQ ID NO: 1868287 - DNA, 22 bp, Homo sapiens
tttggagcattaactaaatgct

SEQ ID NO: 1868288 - DNA, 11 bp, Homo sapiens
tttgggaaagc

SEQ ID NO: 1868289 - DNA, 16 bp, Homo sapiens
tttggtaaatttttga

SEQ ID NO: 1868290 - DNA, 23 bp, Homo sapiens
tttggtacagttcataattcacc

SEQ ID NO: 1868291 - DNA, 13 bp, Homo sapiens
tttgtaatttgaa

SEQ ID NO: 1868292 - DNA, 16 bp, Homo sapiens
tttgtaatttgaattg

SEQ ID NO: 1868293 - DNA, 18 bp, Homo sapiens
tttgtacttttctggttc

SEQ ID NO: 1868294 - DNA, 23 bp, Homo sapiens
tttgtacttttctggttccaaac

SEQ ID NO: 1868295 - DNA, 16 bp, Homo sapiens
tttgtattgcttcctg

SEQ ID NO: 1868296 - DNA, 22 bp, Homo sapiens
tttgtattgcttcctgattacc

SEQ ID NO: 1868297 - DNA, 20 bp, Homo sapiens
tttgtgttttaaaaaaactg

SEQ ID NO: 1868298 - DNA, 20 bp, Homo sapiens
tttgttatagattgtcttaa

SEQ ID NO: 1868299 - DNA, 18 bp, Homo sapiens
tttgttattaaaaaaaca

SEQ ID NO: 1868300 - DNA, 20 bp, Homo sapiens
tttgtttgcttaatttcctt

SEQ ID NO: 1868301 - DNA, 13 bp, Homo sapiens
tttgttttctttg

SEQ ID NO: 1868302 - DNA, 14 bp, Homo sapiens
ttttaaaaaacttt

SEQ ID NO: 1868303 - DNA, 18 bp, Homo sapiens
ttttaaaaaataccattg

SEQ ID NO: 1868304 - DNA, 22 bp, Homo sapiens
ttttaaaaaataccattgaaat

SEQ ID NO: 1868305 - DNA, 23 bp, Homo sapiens
ttttaaaaaataccattgaaatc

SEQ ID NO: 1868306 - DNA, 24 bp, Homo sapiens
ttttaaaaaataccattgaaatca

SEQ ID NO: 1868307 - DNA, 14 bp, Homo sapiens
ttttaaaaaatatt

SEQ ID NO: 1868308 - DNA, 16 bp, Homo sapiens
ttttaaacaaaataga

SEQ ID NO: 1868309 - DNA, 23 bp, Homo sapiens
ttttaaacaaaatagaagctgta

SEQ ID NO: 1868310 - DNA, 23 bp, Homo sapiens
ttttaaacaaaatttcacagttc

SEQ ID NO: 1868311 - DNA, 9 bp, Homo sapiens
ttttaaagt

SEQ ID NO: 1868312 - DNA, 14 bp, Homo sapiens
ttttaaagtaaact

SEQ ID NO: 1868313 - DNA, 19 bp, Homo sapiens
ttttaaagtaaacttgtgt

SEQ ID NO: 1868314 - DNA, 13 bp, Homo sapiens
ttttaacatgtga

SEQ ID NO: 1868315 - DNA, 11 bp, Homo sapiens
ttttaagaaag

SEQ ID NO: 1868316 - DNA, 13 bp, Homo sapiens
ttttaagaaagag

SEQ ID NO: 1868317 - DNA, 21 bp, Homo sapiens
ttttaagaaagagaatgaact

SEQ ID NO: 1868318 - DNA, 23 bp, Homo sapiens
ttttaagaaagagaatgaactgt

SEQ ID NO: 1868319 - DNA, 21 bp, Homo sapiens
ttttaagtgcaacatttctgt

SEQ ID NO: 1868320 - DNA, 15 bp, Homo sapiens
ttttaattaaaaact

SEQ ID NO: 1868321 - DNA, 14 bp, Homo sapiens
ttttagaaaatcag

SEQ ID NO: 1868322 - DNA, 17 bp, Homo sapiens
ttttagcttcatatcta

SEQ ID NO: 1868323 - DNA, 15 bp, Homo sapiens
ttttaggttgttacc

SEQ ID NO: 1868324 - DNA, 21 bp, Homo sapiens
ttttatatttaaaaaattaaa

SEQ ID NO: 1868325 - DNA, 23 bp, Homo sapiens
ttttatatttagttatagtttca

SEQ ID NO: 1868326 - DNA, 14 bp, Homo sapiens
ttttattcaagtta

SEQ ID NO: 1868327 - DNA, 20 bp, Homo sapiens
ttttattgtataaactatca

SEQ ID NO: 1868328 - DNA, 15 bp, Homo sapiens
ttttattttcattgt

SEQ ID NO: 1868329 - DNA, 15 bp, Homo sapiens
ttttcacatccttga

SEQ ID NO: 1868330 - DNA, 18 bp, Homo sapiens
ttttcacatccttgactt

SEQ ID NO: 1868331 - DNA, 16 bp, Homo sapiens
ttttcatagatttgaa

SEQ ID NO: 1868332 - DNA, 22 bp, Homo sapiens
ttttccccgtgacattcactgg

SEQ ID NO: 1868333 - DNA, 19 bp, Homo sapiens
ttttccctttttaaaaaat

SEQ ID NO: 1868334 - DNA, 14 bp, Homo sapiens
ttttcctctagaag

SEQ ID NO: 1868335 - DNA, 13 bp, Homo sapiens
ttttctagacttt

SEQ ID NO: 1868336 - DNA, 18 bp, Homo sapiens
ttttctagactttctgtt

SEQ ID NO: 1868337 - DNA, 16 bp, Homo sapiens
ttttctgaatcttctg

SEQ ID NO: 1868338 - DNA, 17 bp, Homo sapiens
ttttctgaatcttctga

SEQ ID NO: 1868339 - DNA, 23 bp, Homo sapiens
ttttctggcttctgcttcatcct

SEQ ID NO: 1868340 - DNA, 13 bp, Homo sapiens
ttttcttacataa

SEQ ID NO: 1868341 - DNA, 17 bp, Homo sapiens
ttttctttgaatgcttt

SEQ ID NO: 1868342 - DNA, 21 bp, Homo sapiens
ttttgaaaaatattgctaaaa

SEQ ID NO: 1868343 - DNA, 19 bp, Homo sapiens
ttttgaagtagtttgtata

SEQ ID NO: 1868344 - DNA, 11 bp, Homo sapiens
ttttgaataaa

SEQ ID NO: 1868345 - DNA, 14 bp, Homo sapiens
ttttgaataaaaag

SEQ ID NO: 1868346 - DNA, 17 bp, Homo sapiens
ttttgcagtcttttgct

SEQ ID NO: 1868347 - DNA, 21 bp, Homo sapiens
ttttgctggagactatttaag

SEQ ID NO: 1868348 - DNA, 22 bp, Homo sapiens
ttttgctggagactatttaagt

SEQ ID NO: 1868349 - DNA, 15 bp, Homo sapiens
ttttgctgtgctgta

SEQ ID NO: 1868350 - DNA, 22 bp, Homo sapiens
ttttggaagaagttttttactt

SEQ ID NO: 1868351 - DNA, 15 bp, Homo sapiens
ttttgtaatttgaat

SEQ ID NO: 1868352 - DNA, 20 bp, Homo sapiens
ttttgtaatttgaattgggt

SEQ ID NO: 1868353 - DNA, 23 bp, Homo sapiens
ttttgtaccatattgctcttaaa

SEQ ID NO: 1868354 - DNA, 17 bp, Homo sapiens
ttttgtattaacaaagt

SEQ ID NO: 1868355 - DNA, 19 bp, Homo sapiens
ttttgtgatttagaactgt

SEQ ID NO: 1868356 - DNA, 17 bp, Homo sapiens
tttttaaaaaataccat

SEQ ID NO: 1868357 - DNA, 16 bp, Homo sapiens
tttttaaagtaaactt

SEQ ID NO: 1868358 - DNA, 20 bp, Homo sapiens
tttttaagtgcaacatttct

SEQ ID NO: 1868359 - DNA, 17 bp, Homo sapiens
tttttaattaaaaactt

SEQ ID NO: 1868360 - DNA, 18 bp, Homo sapiens
tttttagcttcatatcta

SEQ ID NO: 1868361 - DNA, 10 bp, Homo sapiens
tttttattca

SEQ ID NO: 1868362 - DNA, 15 bp, Homo sapiens
tttttgaaaaatatt

SEQ ID NO: 1868363 - DNA, 20 bp, Homo sapiens
tttttggtaaatttttgaaa

SEQ ID NO: 1868364 - DNA, 23 bp, Homo sapiens
tttttggtaaatttttgaaaaat

SEQ ID NO: 1868365 - DNA, 15 bp, Homo sapiens
tttttgtattaacaa

SEQ ID NO: 1868366 - DNA, 12 bp, Homo sapiens
tttttttccaaa

SEQ ID NO: 1868367 - DNA, 21 bp, Homo sapiens
tagtagaaagacatctgcctg

SEQ ID NO: 1868368 - DNA, 18 bp, Homo sapiens
tagtagccctttctgtgt

SEQ ID NO: 1868369 - DNA, 19 bp, Homo sapiens
tagtagccctttctgtgtg

SEQ ID NO: 1868370 - DNA, 16 bp, Homo sapiens
tagtatagtagaaaga

SEQ ID NO: 1868371 - DNA, 18 bp, Homo sapiens
tagtatttaactacatct

SEQ ID NO: 1868372 - DNA, 20 bp, Homo sapiens
tagtatttaactacatctgc

SEQ ID NO: 1868373 - DNA, 22 bp, Homo sapiens
tagtatttaactacatctgcct

SEQ ID NO: 1868374 - DNA, 23 bp, Homo sapiens
tagtatttaactacatctgcctc

SEQ ID NO: 1868375 - DNA, 14 bp, Homo sapiens
tagttaaaagcctt

SEQ ID NO: 1868376 - DNA, 15 bp, Homo sapiens
tagttacgtataatg

SEQ ID NO: 1868377 - DNA, 20 bp, Homo sapiens
tagttaggatagcatttttg

SEQ ID NO: 1868378 - DNA, 14 bp, Homo sapiens
tagttcttgaattg

SEQ ID NO: 1868379 - DNA, 21 bp, Homo sapiens
tagttcttgaattgttatgaa

SEQ ID NO: 1868380 - DNA, 18 bp, Homo sapiens
tagtttcagatatatatc

SEQ ID NO: 1868381 - DNA, 18 bp, Homo sapiens
tagtttgtataacttctt

SEQ ID NO: 1868382 - DNA, 19 bp, Homo sapiens
tagttttaccctatatcta

SEQ ID NO: 1868383 - DNA, 16 bp, Homo sapiens
tagtttttaattaaaa

SEQ ID NO: 1868384 - DNA, 12 bp, Homo sapiens
tataaaaaggaa

SEQ ID NO: 1868385 - DNA, 19 bp, Homo sapiens
ctccctggagaagggacat

SEQ ID NO: 1868386 - DNA, 23 bp, Homo sapiens
ctccctggagaagggacatggga

SEQ ID NO: 1868387 - DNA, 17 bp, Homo sapiens
ctcctgccctttcccag

SEQ ID NO: 1868388 - DNA, 17 bp, Homo sapiens
ctcgtgacagcctctga

SEQ ID NO: 1868389 - DNA, 23 bp, Homo sapiens
ctcgtggcgtggggcagcagctg

SEQ ID NO: 1868390 - DNA, 17 bp, Homo sapiens
ctctaattagagaactg

SEQ ID NO: 1868391 - DNA, 21 bp, Homo sapiens
ctctcactaaactttacccaa

SEQ ID NO: 1868392 - DNA, 22 bp, Homo sapiens
ctctccccaatccatgcttcac

SEQ ID NO: 1868393 - DNA, 13 bp, Homo sapiens
ctctccccctgca

SEQ ID NO: 1868394 - DNA, 20 bp, Homo sapiens
ctctccccctgcagccgtgc

SEQ ID NO: 1868395 - DNA, 19 bp, Homo sapiens
ctctgaataagcacttttt

SEQ ID NO: 1868396 - DNA, 14 bp, Homo sapiens
ctctgatacttttt

SEQ ID NO: 1868397 - DNA, 13 bp, Homo sapiens
ctctggcttccct

SEQ ID NO: 1868398 - DNA, 15 bp, Homo sapiens
ctctggcttccctgc

SEQ ID NO: 1868399 - DNA, 17 bp, Homo sapiens
ctctggcttccctgccc

SEQ ID NO: 1868400 - DNA, 18 bp, Homo sapiens
ctctggcttccctgccca

SEQ ID NO: 1868401 - DNA, 19 bp, Homo sapiens
ctctggcttccctgcccaa

SEQ ID NO: 1868402 - DNA, 21 bp, Homo sapiens
ctctggcttccctgcccaatc

SEQ ID NO: 1868403 - DNA, 15 bp, Homo sapiens
ctctggggcagagct

SEQ ID NO: 1868404 - DNA, 18 bp, Homo sapiens
aaacccccttttcccttc

SEQ ID NO: 1868405 - DNA, 19 bp, Homo sapiens
aaaccctttgtattataat

SEQ ID NO: 1868406 - DNA, 16 bp, Homo sapiens
aaacctagcttttaaa

SEQ ID NO: 1868407 - DNA, 20 bp, Homo sapiens
aaacctagcttttaaaaaat

SEQ ID NO: 1868408 - DNA, 23 bp, Homo sapiens
aaacctagcttttaaaaaatatt

SEQ ID NO: 1868409 - DNA, 16 bp, Homo sapiens
aaacgcacttacaagt

SEQ ID NO: 1868410 - DNA, 13 bp, Homo sapiens
aaactaaatctct

SEQ ID NO: 1868411 - DNA, 14 bp, Homo sapiens
aaactaacaatatg

SEQ ID NO: 1868412 - DNA, 15 bp, Homo sapiens
aaactaacaatatga

SEQ ID NO: 1868413 - DNA, 16 bp, Homo sapiens
aaactaacaatatgat

SEQ ID NO: 1868414 - DNA, 20 bp, Homo sapiens
aaactatttgtctttcagga

SEQ ID NO: 1868415 - DNA, 12 bp, Homo sapiens
aaactctttaac

SEQ ID NO: 1868416 - DNA, 14 bp, Homo sapiens
aaactgaaaatcta

SEQ ID NO: 1868417 - DNA, 17 bp, Homo sapiens
aaactgaaaatctaata

SEQ ID NO: 1868418 - DNA, 14 bp, Homo sapiens
aaactgaaggtttt

SEQ ID NO: 1868419 - DNA, 21 bp, Homo sapiens
aaactgagtccatgaaaatac

SEQ ID NO: 1868420 - DNA, 15 bp, Homo sapiens
aaactgtgtatcatt

SEQ ID NO: 1868421 - DNA, 18 bp, Homo sapiens
aaactgtgtatcattaaa

SEQ ID NO: 1868422 - DNA, 20 bp, Homo sapiens
aaactgtgtatcattaaaat

SEQ ID NO: 1868423 - DNA, 23 bp, Homo sapiens
aaactgtgtatcattaaaatata

SEQ ID NO: 1868424 - DNA, 19 bp, Homo sapiens
aaacttcagagaaattatg

SEQ ID NO: 1868425 - DNA, 16 bp, Homo sapiens
aaactttaaaaggcaa

SEQ ID NO: 1868426 - DNA, 13 bp, Homo sapiens
aaagaaaaggcaa

SEQ ID NO: 1868427 - DNA, 18 bp, Homo sapiens
aaagaaacactaaattag

SEQ ID NO: 1868428 - DNA, 15 bp, Homo sapiens
aaagaaaccatgaca

SEQ ID NO: 1868429 - DNA, 20 bp, Homo sapiens
aaagaagagaggggaagaat

SEQ ID NO: 1868430 - DNA, 13 bp, Homo sapiens
aaagaattctatt

SEQ ID NO: 1868431 - DNA, 15 bp, Homo sapiens
aaagaattctatttt

SEQ ID NO: 1868432 - DNA, 16 bp, Homo sapiens
aaagaattctattttg

SEQ ID NO: 1868433 - DNA, 16 bp, Homo sapiens
aaagacatctgcctgt

SEQ ID NO: 1868434 - DNA, 20 bp, Homo sapiens
aaagacatctgcctgtaatt

SEQ ID NO: 1868435 - DNA, 21 bp, Homo sapiens
aaagagaatgaactgtggaat

SEQ ID NO: 1868436 - DNA, 15 bp, Homo sapiens
aaagatgatggaaac

SEQ ID NO: 1868437 - DNA, 11 bp, Homo sapiens
aaagcagcttt

SEQ ID NO: 1868438 - DNA, 21 bp, Homo sapiens
aaagcatgggaaaaagagact

SEQ ID NO: 1868439 - DNA, 22 bp, Homo sapiens
aaagcatgggaaaaagagactc

SEQ ID NO: 1868440 - DNA, 16 bp, Homo sapiens
aaagccacactttgaa

SEQ ID NO: 1868441 - DNA, 15 bp, Homo sapiens
aaagccatattctaa

SEQ ID NO: 1868442 - DNA, 23 bp, Homo sapiens
aaagcttacccttggtttgcaca

SEQ ID NO: 1868443 - DNA, 22 bp, Homo sapiens
aaagcttgatttgatctttgtt

SEQ ID NO: 1868444 - DNA, 19 bp, Homo sapiens
aaagctttatctttgtgta

SEQ ID NO: 1868445 - DNA, 15 bp, Homo sapiens
aaaggactgtaagca

SEQ ID NO: 1868446 - DNA, 16 bp, Homo sapiens
aaaggatataaaagga

SEQ ID NO: 1868447 - DNA, 14 bp, Homo sapiens
aaaggatgttacaa

SEQ ID NO: 1868448 - DNA, 17 bp, Homo sapiens
aaaggatgttacaagtt

SEQ ID NO: 1868449 - DNA, 13 bp, Homo sapiens
aaaggcaaaagac

SEQ ID NO: 1868450 - DNA, 14 bp, Homo sapiens
aaaggcaaaagact

SEQ ID NO: 1868451 - DNA, 17 bp, Homo sapiens
aaaggcaccatctaata

SEQ ID NO: 1868452 - DNA, 13 bp, Homo sapiens
aaagtattcagaa

SEQ ID NO: 1868453 - DNA, 16 bp, Homo sapiens
aaagtcacctacagga

SEQ ID NO: 1868454 - DNA, 15 bp, Homo sapiens
aaagtgaacttttgt

SEQ ID NO: 1868455 - DNA, 18 bp, Homo sapiens
aaagtgaacttttgtaat

SEQ ID NO: 1868456 - DNA, 19 bp, Homo sapiens
aaagttactggctctttgt

SEQ ID NO: 1868457 - DNA, 15 bp, Homo sapiens
aaagttataataact

SEQ ID NO: 1868458 - DNA, 19 bp, Homo sapiens
aaagttcatataatttaaa

SEQ ID NO: 1868459 - DNA, 14 bp, Homo sapiens
aaagttgcttttat

SEQ ID NO: 1868460 - DNA, 16 bp, Homo sapiens
aaataaactactttga

SEQ ID NO: 1868461 - DNA, 17 bp, Homo sapiens
aaataaactactttgaa

SEQ ID NO: 1868462 - DNA, 14 bp, Homo sapiens
aaataaactctaaa

SEQ ID NO: 1868463 - DNA, 16 bp, Homo sapiens
aaataaccacactgaa

SEQ ID NO: 1868464 - DNA, 20 bp, Homo sapiens
aaataagaagggggagtgaa

SEQ ID NO: 1868465 - DNA, 21 bp, Homo sapiens
aaataagaagggggagtgaaa

SEQ ID NO: 1868466 - DNA, 22 bp, Homo sapiens
aaataagaagggggagtgaaac

SEQ ID NO: 1868467 - DNA, 17 bp, Homo sapiens
aaataagttttatacat

SEQ ID NO: 1868468 - DNA, 20 bp, Homo sapiens
aaataagttttatacataaa

SEQ ID NO: 1868469 - DNA, 18 bp, Homo sapiens
aaataccataggaagaca

SEQ ID NO: 1868470 - DNA, 19 bp, Homo sapiens
aaataccataggaagacat

SEQ ID NO: 1868471 - DNA, 20 bp, Homo sapiens
aaataccattgaaatcagca

SEQ ID NO: 1868472 - DNA, 21 bp, Homo sapiens
aaatagtgcagaatctcatag

SEQ ID NO: 1868473 - DNA, 15 bp, Homo sapiens
aaatatatgttctgc

SEQ ID NO: 1868474 - DNA, 18 bp, Homo sapiens
aaatatatgttctgcaag

SEQ ID NO: 1868475 - DNA, 20 bp, Homo sapiens
aaatatatgttctgcaagaa

SEQ ID NO: 1868476 - DNA, 23 bp, Homo sapiens
aaatatatgttctgcaagaatta

SEQ ID NO: 1868477 - DNA, 12 bp, Homo sapiens
aaatattgctaa

SEQ ID NO: 1868478 - DNA, 14 bp, Homo sapiens
aaatattgctaaaa

SEQ ID NO: 1868479 - DNA, 16 bp, Homo sapiens
aaatattgctaaaagt

SEQ ID NO: 1868480 - DNA, 18 bp, Homo sapiens
aaatattgctaaaagtgc

SEQ ID NO: 1868481 - DNA, 14 bp, Homo sapiens
aaatattttaagaa

SEQ ID NO: 1868482 - DNA, 15 bp, Homo sapiens
aaatattttaagaaa

SEQ ID NO: 1868483 - DNA, 15 bp, Homo sapiens
aaatcagcatgacaa

SEQ ID NO: 1868484 - DNA, 20 bp, Homo sapiens
aaatcagcatgacaaaaata

SEQ ID NO: 1868485 - DNA, 22 bp, Homo sapiens
aaatcagcatgacaaaaataac

SEQ ID NO: 1868486 - DNA, 22 bp, Homo sapiens
aaatcatattaattattttcca

SEQ ID NO: 1868487 - DNA, 21 bp, Homo sapiens
aaatcatttggcttgctgttt

SEQ ID NO: 1868488 - DNA, 14 bp, Homo sapiens
aaatcctatatctg

SEQ ID NO: 1868489 - DNA, 17 bp, Homo sapiens
aaatctaatattaaaaa

SEQ ID NO: 1868490 - DNA, 19 bp, Homo sapiens
aaatctaatattaaaaata

SEQ ID NO: 1868491 - DNA, 13 bp, Homo sapiens
aaatctctaatat

SEQ ID NO: 1868492 - DNA, 19 bp, Homo sapiens
aaatctggggaagaggttt

SEQ ID NO: 1868493 - DNA, 22 bp, Homo sapiens
aaatctggggaagaggttttat

SEQ ID NO: 1868494 - DNA, 19 bp, Homo sapiens
aaatgaaaattacgttctt

SEQ ID NO: 1868495 - DNA, 17 bp, Homo sapiens
aaatgaacacatggcag

SEQ ID NO: 1868496 - DNA, 20 bp, Homo sapiens
aaatgaacttttacagaatg

SEQ ID NO: 1868497 - DNA, 22 bp, Homo sapiens
aaatgaacttttacagaatgca

SEQ ID NO: 1868498 - DNA, 13 bp, Homo sapiens
aaatgagttactt

SEQ ID NO: 1868499 - DNA, 18 bp, Homo sapiens
aaatgccaaaatgtactt

SEQ ID NO: 1868500 - DNA, 14 bp, Homo sapiens
aaatggcttactta

SEQ ID NO: 1868501 - DNA, 18 bp, Homo sapiens
aaatggtatccagaatgg

SEQ ID NO: 1868502 - DNA, 21 bp, Homo sapiens
aaatggtttctcattaaactc

SEQ ID NO: 1868503 - DNA, 16 bp, Homo sapiens
aaatgtacttaaatga

SEQ ID NO: 1868504 - DNA, 23 bp, Homo sapiens
aaatgtttaattcattaatctgt

SEQ ID NO: 1868505 - DNA, 13 bp, Homo sapiens
aaattaaaatatt

SEQ ID NO: 1868506 - DNA, 12 bp, Homo sapiens
aaattaatcttt

SEQ ID NO: 1868507 - DNA, 22 bp, Homo sapiens
aaattaatcttttaaaaatgat

SEQ ID NO: 1868508 - DNA, 16 bp, Homo sapiens
aaattagtttaaaatg

SEQ ID NO: 1868509 - DNA, 21 bp, Homo sapiens
aaattattaattgtcctgtgt

SEQ ID NO: 1868510 - DNA, 16 bp, Homo sapiens
aaattatttgtgtaat

SEQ ID NO: 1868511 - DNA, 21 bp, Homo sapiens
aaattatttgtgtaatagaaa

SEQ ID NO: 1868512 - DNA, 23 bp, Homo sapiens
aaattatttgtgtaatagaaaac

SEQ ID NO: 1868513 - DNA, 15 bp, Homo sapiens
aaattgaaagtattc

SEQ ID NO: 1868514 - DNA, 18 bp, Homo sapiens
aaattgaaagtattcaga

SEQ ID NO: 1868515 - DNA, 20 bp, Homo sapiens
aaattgaaagtattcagaaa

SEQ ID NO: 1868516 - DNA, 15 bp, Homo sapiens
aaattgcagtttcat

SEQ ID NO: 1868517 - DNA, 21 bp, Homo sapiens
aaattgtctgtctgctcttat

SEQ ID NO: 1868518 - DNA, 13 bp, Homo sapiens
aaatttttgaaaa

SEQ ID NO: 1868519 - DNA, 14 bp, Homo sapiens
aaatttttgaaaaa

SEQ ID NO: 1868520 - DNA, 17 bp, Homo sapiens
accatattgctcttaaa

SEQ ID NO: 1868521 - DNA, 12 bp, Homo sapiens
accatgacaaac

SEQ ID NO: 1868522 - DNA, 17 bp, Homo sapiens
accattattttacagtc

SEQ ID NO: 1868523 - DNA, 23 bp, Homo sapiens
acccaacagtttatttttattat

SEQ ID NO: 1868524 - DNA, 22 bp, Homo sapiens
acccaagaaaacctgtttttaa

SEQ ID NO: 1868525 - DNA, 22 bp, Homo sapiens
acccacctgggccaaggactcc

SEQ ID NO: 1868526 - DNA, 14 bp, Homo sapiens
acccccaaatttaa

SEQ ID NO: 1868527 - DNA, 15 bp, Homo sapiens
acccccccaggcctc

SEQ ID NO: 1868528 - DNA, 12 bp, Homo sapiens
acccctgcccaa

SEQ ID NO: 1868529 - DNA, 18 bp, Homo sapiens
accctagctttatatttt

SEQ ID NO: 1868530 - DNA, 15 bp, Homo sapiens
accctatatctataa

SEQ ID NO: 1868531 - DNA, 23 bp, Homo sapiens
accctgaacatttagtaccctgc

SEQ ID NO: 1868532 - DNA, 10 bp, Homo sapiens
accctgcagg

SEQ ID NO: 1868533 - DNA, 21 bp, Homo sapiens
accctgcaggccaggccagct

SEQ ID NO: 1868534 - DNA, 22 bp, Homo sapiens
accctgcccctccccaaaagaa

SEQ ID NO: 1868535 - DNA, 14 bp, Homo sapiens
accctggagacaga

SEQ ID NO: 1868536 - DNA, 19 bp, Homo sapiens
accctggagacagaagtca

SEQ ID NO: 1868537 - DNA, 12 bp, Homo sapiens
accctttgtatt

SEQ ID NO: 1868538 - DNA, 14 bp, Homo sapiens
accggccgcagccc

SEQ ID NO: 1868539 - DNA, 18 bp, Homo sapiens
accggccgcagcccccac

SEQ ID NO: 1868540 - DNA, 14 bp, Homo sapiens
accgtggggaggcc

SEQ ID NO: 1868541 - DNA, 14 bp, Homo sapiens
accgtttacagtgt

SEQ ID NO: 1868542 - DNA, 19 bp, Homo sapiens
accgtttacagtgtattta

SEQ ID NO: 1868543 - DNA, 13 bp, Homo sapiens
acctacagcagca

SEQ ID NO: 1868544 - DNA, 14 bp, Homo sapiens
acctacagcagcac

SEQ ID NO: 1868545 - DNA, 17 bp, Homo sapiens
acctagcttttaaaaaa

SEQ ID NO: 1868546 - DNA, 18 bp, Homo sapiens
acctagcttttaaaaaat

SEQ ID NO: 1868547 - DNA, 13 bp, Homo sapiens
acctatatgattt

SEQ ID NO: 1868548 - DNA, 14 bp, Homo sapiens
acctcctgctcctt

SEQ ID NO: 1868549 - DNA, 16 bp, Homo sapiens
acctctagctgttctt

SEQ ID NO: 1868550 - DNA, 21 bp, Homo sapiens
acctcttcggttgtcttgaaa

SEQ ID NO: 1868551 - DNA, 15 bp, Homo sapiens
acctgaaaaaaagtt

SEQ ID NO: 1868552 - DNA, 21 bp, Homo sapiens
acctgaaaaaaagtttacaag

SEQ ID NO: 1868553 - DNA, 20 bp, Homo sapiens
acctgcccatgtccagaggg

SEQ ID NO: 1868554 - DNA, 18 bp, Homo sapiens
acctgccttttaagtttg

SEQ ID NO: 1868555 - DNA, 17 bp, Homo sapiens
accttaccaactttctg

SEQ ID NO: 1868556 - DNA, 18 bp, Homo sapiens
accttaccaactttctgt

SEQ ID NO: 1868557 - DNA, 19 bp, Homo sapiens
accttaccaactttctgta

SEQ ID NO: 1868558 - DNA, 20 bp, Homo sapiens
accttaccaactttctgtaa

SEQ ID NO: 1868559 - DNA, 16 bp, Homo sapiens
accttactggcactgt

SEQ ID NO: 1868560 - DNA, 19 bp, Homo sapiens
accttactggcactgtggc

SEQ ID NO: 1868561 - DNA, 15 bp, Homo sapiens
accttgtctttcaaa

SEQ ID NO: 1868562 - DNA, 19 bp, Homo sapiens
accttttgaagtagtttgt

SEQ ID NO: 1868563 - DNA, 16 bp, Homo sapiens
acgatgacgcctctgg

SEQ ID NO: 1868564 - DNA, 15 bp, Homo sapiens
acgcacttacaagtg

SEQ ID NO: 1868565 - DNA, 15 bp, Homo sapiens
acgcatgtccctcca

SEQ ID NO: 1868566 - DNA, 19 bp, Homo sapiens
acgcatgtccctccaaggc

SEQ ID NO: 1868567 - DNA, 19 bp, Homo sapiens
acgcctctggacctcggtg

SEQ ID NO: 1868568 - DNA, 19 bp, Homo sapiens
acggccaggctccctgacc

SEQ ID NO: 1868569 - DNA, 19 bp, Homo sapiens
acgtattttgatcagtgtt

SEQ ID NO: 1868570 - DNA, 22 bp, Homo sapiens
acgtattttgatcagtgttaca

SEQ ID NO: 1868571 - DNA, 19 bp, Homo sapiens
acgttcttacaagcttaaa

SEQ ID NO: 1868572 - DNA, 19 bp, Homo sapiens
actaaaatgtttaattcat

SEQ ID NO: 1868573 - DNA, 22 bp, Homo sapiens
actaaaatgtttaattcattaa

SEQ ID NO: 1868574 - DNA, 18 bp, Homo sapiens
actaaataaactactttg

SEQ ID NO: 1868575 - DNA, 21 bp, Homo sapiens
actaaatgctcatacacagtt

SEQ ID NO: 1868576 - DNA, 23 bp, Homo sapiens
actaaattagtttaaaatgaagc

SEQ ID NO: 1868577 - DNA, 18 bp, Homo sapiens
actaagccacaagaaatt

SEQ ID NO: 1868578 - DNA, 21 bp, Homo sapiens
actaccaagaggccctgtctg

SEQ ID NO: 1868579 - DNA, 13 bp, Homo sapiens
actactttgaata

SEQ ID NO: 1868580 - DNA, 22 bp, Homo sapiens
actagacattattttgtatgga

SEQ ID NO: 1868581 - DNA, 22 bp, Homo sapiens
actagagtcacccccccaggcc

SEQ ID NO: 1868582 - DNA, 22 bp, Homo sapiens
actatcagtttgtcctgtagag

SEQ ID NO: 1868583 - DNA, 17 bp, Homo sapiens
actatgccgtgtagttt

SEQ ID NO: 1868584 - DNA, 23 bp, Homo sapiens
actatgccgtgtagtttctggta

SEQ ID NO: 1868585 - DNA, 22 bp, Homo sapiens
actatttaagtactatctttgt

SEQ ID NO: 1868586 - DNA, 15 bp, Homo sapiens
actcaggaaccctgg

SEQ ID NO: 1868587 - DNA, 19 bp, Homo sapiens
actcaggaaccctggagac

SEQ ID NO: 1868588 - DNA, 21 bp, Homo sapiens
actcaggaaccctggagacag

SEQ ID NO: 1868589 - DNA, 19 bp, Homo sapiens
actcattttaatgattgtt

SEQ ID NO: 1868590 - DNA, 15 bp, Homo sapiens
actcccccaggagca

SEQ ID NO: 1868591 - DNA, 20 bp, Homo sapiens
actcccccaggagcagctgg

SEQ ID NO: 1868592 - DNA, 16 bp, Homo sapiens
actcccttctgtagtt

SEQ ID NO: 1868593 - DNA, 14 bp, Homo sapiens
actcctatgcttta

SEQ ID NO: 1868594 - DNA, 14 bp, Homo sapiens
actcgtgacagcct

SEQ ID NO: 1868595 - DNA, 16 bp, Homo sapiens
actctctctctgttaa

SEQ ID NO: 1868596 - DNA, 17 bp, Homo sapiens
actctctctctgttaaa

SEQ ID NO: 1868597 - DNA, 20 bp, Homo sapiens
actctgaataagcacttttt

SEQ ID NO: 1868598 - DNA, 15 bp, Homo sapiens
actctgattttgata

SEQ ID NO: 1868599 - DNA, 14 bp, Homo sapiens
actgaactgtttgg

SEQ ID NO: 1868600 - DNA, 15 bp, Homo sapiens
actgacagcctgggg

SEQ ID NO: 1868601 - DNA, 23 bp, Homo sapiens
actgacagcctgggggggccgct

SEQ ID NO: 1868602 - DNA, 15 bp, Homo sapiens
actgagtccatgaaa

SEQ ID NO: 1868603 - DNA, 16 bp, Homo sapiens
actgagtccatgaaaa

SEQ ID NO: 1868604 - DNA, 21 bp, Homo sapiens
actgagtccatgaaaatacca

SEQ ID NO: 1868605 - DNA, 19 bp, Homo sapiens
actgcaagcatttttccat

SEQ ID NO: 1868606 - DNA, 15 bp, Homo sapiens
actgccaccagcaat

SEQ ID NO: 1868607 - DNA, 21 bp, Homo sapiens
actgccaccagcaatgccctg

SEQ ID NO: 1868608 - DNA, 15 bp, Homo sapiens
actgcttctctttgt

SEQ ID NO: 1868609 - DNA, 21 bp, Homo sapiens
actgcttctctttgtgcagtg

SEQ ID NO: 1868610 - DNA, 20 bp, Homo sapiens
actgctttattttccctact

SEQ ID NO: 1868611 - DNA, 13 bp, Homo sapiens
actggacagccag

SEQ ID NO: 1868612 - DNA, 24 bp, Homo sapiens
actggaggaaccacatataacact

SEQ ID NO: 1868613 - DNA, 13 bp, Homo sapiens
actggcactgtgg

SEQ ID NO: 1868614 - DNA, 16 bp, Homo sapiens
actgggaaccaagggc

SEQ ID NO: 1868615 - DNA, 14 bp, Homo sapiens
actgggccctgggg

SEQ ID NO: 1868616 - DNA, 16 bp, Homo sapiens
actgggccctggggct

SEQ ID NO: 1868617 - DNA, 12 bp, Homo sapiens
actgggccgggc

SEQ ID NO: 1868618 - DNA, 16 bp, Homo sapiens
actgggccgggcccag

SEQ ID NO: 1868619 - DNA, 20 bp, Homo sapiens
actggtcctgtgtgcagtga

SEQ ID NO: 1868620 - DNA, 15 bp, Homo sapiens
actggtgatatatct

SEQ ID NO: 1868621 - DNA, 18 bp, Homo sapiens
actggtttgtttgcttaa

SEQ ID NO: 1868622 - DNA, 20 bp, Homo sapiens
actgtaaaagttataataac

SEQ ID NO: 1868623 - DNA, 16 bp, Homo sapiens
actgtatgtataaatt

SEQ ID NO: 1868624 - DNA, 14 bp, Homo sapiens
actgtatttcagta

SEQ ID NO: 1868625 - DNA, 18 bp, Homo sapiens
actgtctggttttaacaa

SEQ ID NO: 1868626 - DNA, 19 bp, Homo sapiens
actgtctggttttaacaat

SEQ ID NO: 1868627 - DNA, 20 bp, Homo sapiens
actgtggccatatatgctgt

SEQ ID NO: 1868628 - DNA, 16 bp, Homo sapiens
actgtgtatcattaaa

SEQ ID NO: 1868629 - DNA, 19 bp, Homo sapiens
actgtgtatcattaaaata

SEQ ID NO: 1868630 - DNA, 24 bp, Homo sapiens
actgtgtatcattaaaatatatgt

SEQ ID NO: 1868631 - DNA, 22 bp, Homo sapiens
actgtttgttccagaatctgta

SEQ ID NO: 1868632 - DNA, 14 bp, Homo sapiens
acttaacatattta

SEQ ID NO: 1868633 - DNA, 14 bp, Homo sapiens
acttacaaaagcag

SEQ ID NO: 1868634 - DNA, 17 bp, Homo sapiens
acttacaaaagcagctt

SEQ ID NO: 1868635 - DNA, 15 bp, Homo sapiens
acttatcatttttgt

SEQ ID NO: 1868636 - DNA, 22 bp, Homo sapiens
agtttgctaaaagaagagaggg

SEQ ID NO: 1868637 - DNA, 16 bp, Homo sapiens
agtttggcaatagttt

SEQ ID NO: 1868638 - DNA, 17 bp, Homo sapiens
agtttggcaatagtttg

SEQ ID NO: 1868639 - DNA, 14 bp, Homo sapiens
agtttgtataactt

SEQ ID NO: 1868640 - DNA, 14 bp, Homo sapiens
agtttgtgttttaa

SEQ ID NO: 1868641 - DNA, 17 bp, Homo sapiens
agtttgtgttttaaaaa

SEQ ID NO: 1868642 - DNA, 18 bp, Homo sapiens
agtttgtgttttaaaaaa

SEQ ID NO: 1868643 - DNA, 17 bp, Homo sapiens
agttttaccctatatct

SEQ ID NO: 1868644 - DNA, 19 bp, Homo sapiens
agttttaccctatatctat

SEQ ID NO: 1868645 - DNA, 18 bp, Homo sapiens
agttttactcttaaatca

SEQ ID NO: 1868646 - DNA, 19 bp, Homo sapiens
agttttatacataaacagt

SEQ ID NO: 1868647 - DNA, 11 bp, Homo sapiens
agttttgatat

SEQ ID NO: 1868648 - DNA, 19 bp, Homo sapiens
agttttttactttggttta

SEQ ID NO: 1868649 - DNA, 17 bp, Homo sapiens
agtttttttttttccag

SEQ ID NO: 1868650 - DNA, 16 bp, Homo sapiens
ataaaaagagatgaaa

SEQ ID NO: 1868651 - DNA, 11 bp, Homo sapiens
ataaaaaggaa

SEQ ID NO: 1868652 - DNA, 12 bp, Homo sapiens
ataaaaaggaaa

SEQ ID NO: 1868653 - DNA, 21 bp, Homo sapiens
ataaaaagtgaacttttgtaa

SEQ ID NO: 1868654 - DNA, 20 bp, Homo sapiens
ataaaacgtatagtcaatat

SEQ ID NO: 1868655 - DNA, 13 bp, Homo sapiens
ataaaactttaaa

SEQ ID NO: 1868656 - DNA, 14 bp, Homo sapiens
ataaaactttaaaa

SEQ ID NO: 1868657 - DNA, 18 bp, Homo sapiens
ataaaactttaaaaggca

SEQ ID NO: 1868658 - DNA, 19 bp, Homo sapiens
ataaaactttaaaaggcaa

SEQ ID NO: 1868659 - DNA, 20 bp, Homo sapiens
ataaaactttaaaaggcaac

SEQ ID NO: 1868660 - DNA, 16 bp, Homo sapiens
ataaaaggatgttaca

SEQ ID NO: 1868661 - DNA, 19 bp, Homo sapiens
ataaaaggatgttacaagt

SEQ ID NO: 1868662 - DNA, 15 bp, Homo sapiens
ataaaataagaaggg

SEQ ID NO: 1868663 - DNA, 23 bp, Homo sapiens
ataaaataagaagggggagtgaa

SEQ ID NO: 1868664 - DNA, 18 bp, Homo sapiens
ataaaatgaggacatgtt

SEQ ID NO: 1868665 - DNA, 12 bp, Homo sapiens
ataaacactgtt

SEQ ID NO: 1868666 - DNA, 12 bp, Homo sapiens
ataaacagtttt

SEQ ID NO: 1868667 - DNA, 19 bp, Homo sapiens
ataaacagttttggagaaa

SEQ ID NO: 1868668 - DNA, 13 bp, Homo sapiens
ataaatagaaaga

SEQ ID NO: 1868669 - DNA, 21 bp, Homo sapiens
ataacactgttggcacttata

SEQ ID NO: 1868670 - DNA, 13 bp, Homo sapiens
ataacctatatga

SEQ ID NO: 1868671 - DNA, 17 bp, Homo sapiens
ataactacatattgaat

SEQ ID NO: 1868672 - DNA, 15 bp, Homo sapiens
ataactgaactgttt

SEQ ID NO: 1868673 - DNA, 19 bp, Homo sapiens
ataagaagggggagtgaaa

SEQ ID NO: 1868674 - DNA, 22 bp, Homo sapiens
ataagaagggggagtgaaacag

SEQ ID NO: 1868675 - DNA, 24 bp, Homo sapiens
ataagaagggggagtgaaacagag

SEQ ID NO: 1868676 - DNA, 16 bp, Homo sapiens
ataagatgatgttaaa

SEQ ID NO: 1868677 - DNA, 22 bp, Homo sapiens
ataagttttatacataaacagt

SEQ ID NO: 1868678 - DNA, 14 bp, Homo sapiens
ataagttttgatat

SEQ ID NO: 1868679 - DNA, 15 bp, Homo sapiens
ataagttttgatata

SEQ ID NO: 1868680 - DNA, 16 bp, Homo sapiens
ataagttttgatataa

SEQ ID NO: 1868681 - DNA, 19 bp, Homo sapiens
ataagttttgatataatct

SEQ ID NO: 1868682 - DNA, 21 bp, Homo sapiens
ataagttttgatataatcttg

SEQ ID NO: 1868683 - DNA, 13 bp, Homo sapiens
ataataactgaac

SEQ ID NO: 1868684 - DNA, 14 bp, Homo sapiens
ataataactgaact

SEQ ID NO: 1868685 - DNA, 14 bp, Homo sapiens
ataataagttttga

SEQ ID NO: 1868686 - DNA, 15 bp, Homo sapiens
ataataagttttgat

SEQ ID NO: 1868687 - DNA, 16 bp, Homo sapiens
ataataagttttgata

SEQ ID NO: 1868688 - DNA, 19 bp, Homo sapiens
ataataagttttgatataa

SEQ ID NO: 1868689 - DNA, 21 bp, Homo sapiens
ataatacactaattcctttct

SEQ ID NO: 1868690 - DNA, 18 bp, Homo sapiens
ataatagattgtgaataa

SEQ ID NO: 1868691 - DNA, 13 bp, Homo sapiens
ataatctatatta

SEQ ID NO: 1868692 - DNA, 18 bp, Homo sapiens
ataatctcctctgctcat

SEQ ID NO: 1868693 - DNA, 21 bp, Homo sapiens
ataatcttggcttcttaaaaa

SEQ ID NO: 1868694 - DNA, 23 bp, Homo sapiens
ataatcttggcttcttaaaaact

SEQ ID NO: 1868695 - DNA, 13 bp, Homo sapiens
ataatgctttctg

SEQ ID NO: 1868696 - DNA, 14 bp, Homo sapiens
ataattcaccaaaa

SEQ ID NO: 1868697 - DNA, 19 bp, Homo sapiens
ataattcaccaaaagttca

SEQ ID NO: 1868698 - DNA, 12 bp, Homo sapiens
ataattgttgat

SEQ ID NO: 1868699 - DNA, 19 bp, Homo sapiens
ataatttgcaatttcagga

SEQ ID NO: 1868700 - DNA, 14 bp, Homo sapiens
ataattttttgcag

SEQ ID NO: 1868701 - DNA, 22 bp, Homo sapiens
atacaaaaaaaatctttaatgg

SEQ ID NO: 1868702 - DNA, 23 bp, Homo sapiens
atacaaaaaaaatctttaatggt

SEQ ID NO: 1868703 - DNA, 17 bp, Homo sapiens
atacacagttaaataaa

SEQ ID NO: 1868704 - DNA, 17 bp, Homo sapiens
atacgcactacatgtgg

SEQ ID NO: 1868705 - DNA, 16 bp, Homo sapiens
atactcctatgcttta

SEQ ID NO: 1868706 - DNA, 14 bp, Homo sapiens
atactgtaaaagtt

SEQ ID NO: 1868707 - DNA, 15 bp, Homo sapiens
atactttttttcaca

SEQ ID NO: 1868708 - DNA, 20 bp, Homo sapiens
atagattaaatcatactcct

SEQ ID NO: 1868709 - DNA, 14 bp, Homo sapiens
atagattgcaaata

SEQ ID NO: 1868710 - DNA, 21 bp, Homo sapiens
atagattgcaaatattggtta

SEQ ID NO: 1868711 - DNA, 19 bp, Homo sapiens
atagattgtgaataatgat

SEQ ID NO: 1868712 - DNA, 20 bp, Homo sapiens
atagcttgtatagtgtaaaa

SEQ ID NO: 1868713 - DNA, 17 bp, Homo sapiens
atagcttttattgtata

SEQ ID NO: 1868714 - DNA, 13 bp, Homo sapiens
ataggtaacgtga

SEQ ID NO: 1868715 - DNA, 20 bp, Homo sapiens
ataggttgccaataatacac

SEQ ID NO: 1868716 - DNA, 14 bp, Homo sapiens
atagtttcagatat

SEQ ID NO: 1868717 - DNA, 21 bp, Homo sapiens
atagtttcagatatatatcat

SEQ ID NO: 1868718 - DNA, 22 bp, Homo sapiens
atataatcttggcttcttaaaa

SEQ ID NO: 1868719 - DNA, 22 bp, Homo sapiens
atataggttgtgcaaattaaca

SEQ ID NO: 1868720 - DNA, 13 bp, Homo sapiens
atatatcatattg

SEQ ID NO: 1868721 - DNA, 16 bp, Homo sapiens
atatatcccagaaatt

SEQ ID NO: 1868722 - DNA, 15 bp, Homo sapiens
atatatctgcttcag

SEQ ID NO: 1868723 - DNA, 15 bp, Homo sapiens
atatatgttctgcaa

SEQ ID NO: 1868724 - DNA, 13 bp, Homo sapiens
atatctaatttac

SEQ ID NO: 1868725 - DNA, 16 bp, Homo sapiens
atatctaatttaccat

SEQ ID NO: 1868726 - DNA, 15 bp, Homo sapiens
atatctgtttgtata

SEQ ID NO: 1868727 - DNA, 22 bp, Homo sapiens
atatctgtttgtatatttgcaa

SEQ ID NO: 1868728 - DNA, 13 bp, Homo sapiens
atatcttgttatt

SEQ ID NO: 1868729 - DNA, 22 bp, Homo sapiens
atatctttatgcaaaaacatat

SEQ ID NO: 1868730 - DNA, 21 bp, Homo sapiens
atatgaaagccacactttgaa

SEQ ID NO: 1868731 - DNA, 13 bp, Homo sapiens
atatgatttatag

SEQ ID NO: 1868732 - DNA, 13 bp, Homo sapiens
atatgctgtattt

SEQ ID NO: 1868733 - DNA, 20 bp, Homo sapiens
atatgctgtatttctttgta

SEQ ID NO: 1868734 - DNA, 15 bp, Homo sapiens
atatgcttctttaaa

SEQ ID NO: 1868735 - DNA, 13 bp, Homo sapiens
atatggcaagaaa

SEQ ID NO: 1868736 - DNA, 19 bp, Homo sapiens
atatggcaagaaagctggt

SEQ ID NO: 1868737 - DNA, 14 bp, Homo sapiens
atatgtatctttgg

SEQ ID NO: 1868738 - DNA, 19 bp, Homo sapiens
atatgttctgcaagaatta

SEQ ID NO: 1868739 - DNA, 22 bp, Homo sapiens
atatgttctgcaagaattaaaa

SEQ ID NO: 1868740 - DNA, 14 bp, Homo sapiens
atattatttgatat

SEQ ID NO: 1868741 - DNA, 14 bp, Homo sapiens
atattcaaggcttt

SEQ ID NO: 1868742 - DNA, 11 bp, Homo sapiens
atattccaagg

SEQ ID NO: 1868743 - DNA, 13 bp, Homo sapiens
atattccaaggaa

SEQ ID NO: 1868744 - DNA, 20 bp, Homo sapiens
atattccaaggaaaattgaa

SEQ ID NO: 1868745 - DNA, 14 bp, Homo sapiens
atattcttttgtta

SEQ ID NO: 1868746 - DNA, 16 bp, Homo sapiens
atattgaaagttgctt

SEQ ID NO: 1868747 - DNA, 19 bp, Homo sapiens
atattgaaagttgctttta

SEQ ID NO: 1868748 - DNA, 11 bp, Homo sapiens
atattgctaaa

SEQ ID NO: 1868749 - DNA, 21 bp, Homo sapiens
atattgctcttaaaaatcttg

SEQ ID NO: 1868750 - DNA, 23 bp, Homo sapiens
atattgctcttaaaaatcttggt

SEQ ID NO: 1868751 - DNA, 23 bp, Homo sapiens
atatttgcaaaccctttgtatta

SEQ ID NO: 1868752 - DNA, 12 bp, Homo sapiens
atattttcacag

SEQ ID NO: 1868753 - DNA, 22 bp, Homo sapiens
cagagggactggacagccaggg

SEQ ID NO: 1868754 - DNA, 17 bp, Homo sapiens
cagataaccagctgtaa

SEQ ID NO: 1868755 - DNA, 23 bp, Homo sapiens
cagatcatataagcaagacagtg

SEQ ID NO: 1868756 - DNA, 12 bp, Homo sapiens
cagatctttaaa

SEQ ID NO: 1868757 - DNA, 18 bp, Homo sapiens
cagatctttaaatacagt

SEQ ID NO: 1868758 - DNA, 19 bp, Homo sapiens
cagatggaagaagttttaa

SEQ ID NO: 1868759 - DNA, 18 bp, Homo sapiens
cagatggagcaaatgtcc

SEQ ID NO: 1868760 - DNA, 15 bp, Homo sapiens
cagattacaataaat

SEQ ID NO: 1868761 - DNA, 21 bp, Homo sapiens
cagattacaataaatccttta

SEQ ID NO: 1868762 - DNA, 14 bp, Homo sapiens
cagattttctcctg

SEQ ID NO: 1868763 - DNA, 14 bp, Homo sapiens
cagcaaacaaataa

SEQ ID NO: 1868764 - DNA, 13 bp, Homo sapiens
cagcaaagccata

SEQ ID NO: 1868765 - DNA, 17 bp, Homo sapiens
cagcaatgccctgcctt

SEQ ID NO: 1868766 - DNA, 22 bp, Homo sapiens
cagcaatgccctgccttgctgc

SEQ ID NO: 1868767 - DNA, 19 bp, Homo sapiens
cagcacgcatgtccctcca

SEQ ID NO: 1868768 - DNA, 21 bp, Homo sapiens
cagcacgcatgtccctccaag

SEQ ID NO: 1868769 - DNA, 22 bp, Homo sapiens
cagcacgcatgtccctccaagg

SEQ ID NO: 1868770 - DNA, 18 bp, Homo sapiens
cagcactagagtcacccc

SEQ ID NO: 1868771 - DNA, 12 bp, Homo sapiens
cagcagcacgca

SEQ ID NO: 1868772 - DNA, 22 bp, Homo sapiens
cagcagcacgcatgtccctcca

SEQ ID NO: 1868773 - DNA, 15 bp, Homo sapiens
cagcagctgcctctg

SEQ ID NO: 1868774 - DNA, 18 bp, Homo sapiens
cagcatgacaaaaataac

SEQ ID NO: 1868775 - DNA, 11 bp, Homo sapiens
cagccaaggaa

SEQ ID NO: 1868776 - DNA, 13 bp, Homo sapiens
cagccattcctgt

SEQ ID NO: 1868777 - DNA, 15 bp, Homo sapiens
cagcccactgggccc

SEQ ID NO: 1868778 - DNA, 18 bp, Homo sapiens
cagcccactgggccctgg

SEQ ID NO: 1868779 - DNA, 21 bp, Homo sapiens
cagcccactgggccctggggc

SEQ ID NO: 1868780 - DNA, 22 bp, Homo sapiens
cagcccactgggccctggggct

SEQ ID NO: 1868781 - DNA, 15 bp, Homo sapiens
cagcccccaaagagc

SEQ ID NO: 1868782 - DNA, 17 bp, Homo sapiens
cagcccccaaagagctg

SEQ ID NO: 1868783 - DNA, 19 bp, Homo sapiens
cagcccccaaagagctgtg

SEQ ID NO: 1868784 - DNA, 15 bp, Homo sapiens
cagcccccactgacc

SEQ ID NO: 1868785 - DNA, 18 bp, Homo sapiens
cagcccccactgacctgc

SEQ ID NO: 1868786 - DNA, 19 bp, Homo sapiens
cagcccccactgacctgcc

SEQ ID NO: 1868787 - DNA, 21 bp, Homo sapiens
cagcccccactgacctgccca

SEQ ID NO: 1868788 - DNA, 15 bp, Homo sapiens
cagccgtgcaggact

SEQ ID NO: 1868789 - DNA, 13 bp, Homo sapiens
cagcctctggggc

SEQ ID NO: 1868790 - DNA, 14 bp, Homo sapiens
cagcctctggggca

SEQ ID NO: 1868791 - DNA, 18 bp, Homo sapiens
cagcctctggggcagagc

SEQ ID NO: 1868792 - DNA, 14 bp, Homo sapiens
cagcgccaagtggc

SEQ ID NO: 1868793 - DNA, 22 bp, Homo sapiens
cagcgcttagaaacatgttcct

SEQ ID NO: 1868794 - DNA, 16 bp, Homo sapiens
cagctactgatttttg

SEQ ID NO: 1868795 - DNA, 20 bp, Homo sapiens
cagctattcccttctgatct

SEQ ID NO: 1868796 - DNA, 17 bp, Homo sapiens
cagctggcactgacagc

SEQ ID NO: 1868797 - DNA, 18 bp, Homo sapiens
cagctggcactgacagcc

SEQ ID NO: 1868798 - DNA, 23 bp, Homo sapiens
cagctggcactgacagcctgggg

SEQ ID NO: 1868799 - DNA, 14 bp, Homo sapiens
cagctgtttaagat

SEQ ID NO: 1868800 - DNA, 18 bp, Homo sapiens
cagcttcctgtctgttta

SEQ ID NO: 1868801 - DNA, 21 bp, Homo sapiens
cagctttacatgcaatttatt

SEQ ID NO: 1868802 - DNA, 18 bp, Homo sapiens
cagctttttgtattaaca

SEQ ID NO: 1868803 - DNA, 20 bp, Homo sapiens
cagctttttgtattaacaaa

SEQ ID NO: 1868804 - DNA, 16 bp, Homo sapiens
caggaaccctggagac

SEQ ID NO: 1868805 - DNA, 23 bp, Homo sapiens
caggaatttaatttataggcaga

SEQ ID NO: 1868806 - DNA, 13 bp, Homo sapiens
caggaccactagc

SEQ ID NO: 1868807 - DNA, 20 bp, Homo sapiens
caggaccttttgaagtagtt

SEQ ID NO: 1868808 - DNA, 14 bp, Homo sapiens
caggagaagacccc

SEQ ID NO: 1868809 - DNA, 19 bp, Homo sapiens
caggagaagacccctgccc

SEQ ID NO: 1868810 - DNA, 15 bp, Homo sapiens
caggagacaggaagg

SEQ ID NO: 1868811 - DNA, 22 bp, Homo sapiens
caggagcagcccacccagcaga

SEQ ID NO: 1868812 - DNA, 15 bp, Homo sapiens
caggagcagctggca

SEQ ID NO: 1868813 - DNA, 19 bp, Homo sapiens
caggagcagctggcactga

SEQ ID NO: 1868814 - DNA, 21 bp, Homo sapiens
caggagcagctggcactgaca

SEQ ID NO: 1868815 - DNA, 12 bp, Homo sapiens
caggcagcgatg

SEQ ID NO: 1868816 - DNA, 15 bp, Homo sapiens
caggccaggccagct

SEQ ID NO: 1868817 - DNA, 16 bp, Homo sapiens
caggccaggccagctt

SEQ ID NO: 1868818 - DNA, 12 bp, Homo sapiens
caggctccctga

SEQ ID NO: 1868819 - DNA, 18 bp, Homo sapiens
caggctccctgaccaccc

SEQ ID NO: 1868820 - DNA, 22 bp, Homo sapiens
caggctccctgaccaccctgcc

SEQ ID NO: 1868821 - DNA, 16 bp, Homo sapiens
cagggcctctggcttc

SEQ ID NO: 1868822 - DNA, 20 bp, Homo sapiens
cagggctttggggggcacta

SEQ ID NO: 1868823 - DNA, 23 bp, Homo sapiens
caggggtgtcccagtcccagcct

SEQ ID NO: 1868824 - DNA, 21 bp, Homo sapiens
caggtcatggagcagccccca

SEQ ID NO: 1868825 - DNA, 16 bp, Homo sapiens
cagtatcttagagttt

SEQ ID NO: 1868826 - DNA, 14 bp, Homo sapiens
cagtattttggaga

SEQ ID NO: 1868827 - DNA, 21 bp, Homo sapiens
cagtattttggagaaattatt

SEQ ID NO: 1868828 - DNA, 23 bp, Homo sapiens
cagtattttggagaaattattta

SEQ ID NO: 1868829 - DNA, 14 bp, Homo sapiens
cagtcacctcctgc

SEQ ID NO: 1868830 - DNA, 19 bp, Homo sapiens
cagtccaaattgtctgtct

SEQ ID NO: 1868831 - DNA, 13 bp, Homo sapiens
cagtcccagcctc

SEQ ID NO: 1868832 - DNA, 15 bp, Homo sapiens
cagtcccagcctctg

SEQ ID NO: 1868833 - DNA, 14 bp, Homo sapiens
cagtcttttgctgt

SEQ ID NO: 1868834 - DNA, 18 bp, Homo sapiens
cagtgagattacagagga

SEQ ID NO: 1868835 - DNA, 20 bp, Homo sapiens
cagtgagattacagaggaag

SEQ ID NO: 1868836 - DNA, 21 bp, Homo sapiens
cagtgagtgccatgctttttg

SEQ ID NO: 1868837 - DNA, 14 bp, Homo sapiens
cagtggagaattat

SEQ ID NO: 1868838 - DNA, 14 bp, Homo sapiens
cagtggcactaaaa

SEQ ID NO: 1868839 - DNA, 14 bp, Homo sapiens
cagtgttagtattc

SEQ ID NO: 1868840 - DNA, 17 bp, Homo sapiens
cagtgttagtattcacc

SEQ ID NO: 1868841 - DNA, 15 bp, Homo sapiens
cagttataagcgtat

SEQ ID NO: 1868842 - DNA, 14 bp, Homo sapiens
cagttcataattca

SEQ ID NO: 1868843 - DNA, 16 bp, Homo sapiens
cagttcataattcacc

SEQ ID NO: 1868844 - DNA, 20 bp, Homo sapiens
cagttgagtcgtcatcactt

SEQ ID NO: 1868845 - DNA, 13 bp, Homo sapiens
cagtttattctgt

SEQ ID NO: 1868846 - DNA, 22 bp, Homo sapiens
cagtttattctgtggttctata

SEQ ID NO: 1868847 - DNA, 16 bp, Homo sapiens
cagtttgtgttttaaa

SEQ ID NO: 1868848 - DNA, 23 bp, Homo sapiens
cagtttgtgttttaaaaaaactg

SEQ ID NO: 1868849 - DNA, 12 bp, Homo sapiens
cataaaacttta

SEQ ID NO: 1868850 - DNA, 23 bp, Homo sapiens
cataaaattgcagtttcatgtat

SEQ ID NO: 1868851 - DNA, 13 bp, Homo sapiens
cataaacagtttt

SEQ ID NO: 1868852 - DNA, 18 bp, Homo sapiens
cataaatcaattcattgt

SEQ ID NO: 1868853 - DNA, 19 bp, Homo sapiens
cataatgaaccgtttacag

SEQ ID NO: 1868854 - DNA, 12 bp, Homo sapiens
catacacacacg

SEQ ID NO: 1868855 - DNA, 18 bp, Homo sapiens
catactcctatgctttag

SEQ ID NO: 1868856 - DNA, 20 bp, Homo sapiens
catagaattgcaatctataa

SEQ ID NO: 1868857 - DNA, 22 bp, Homo sapiens
catagaattgcaatctataata

SEQ ID NO: 1868858 - DNA, 20 bp, Homo sapiens
cataggaagacataaaactt

SEQ ID NO: 1868859 - DNA, 13 bp, Homo sapiens
catataacactta

SEQ ID NO: 1868860 - DNA, 14 bp, Homo sapiens
catataatttaaag

SEQ ID NO: 1868861 - DNA, 21 bp, Homo sapiens
catataatttaaagaaacact

SEQ ID NO: 1868862 - DNA, 19 bp, Homo sapiens
catatatgctgtatttctt

SEQ ID NO: 1868863 - DNA, 19 bp, Homo sapiens
catatctagtcaataactc

SEQ ID NO: 1868864 - DNA, 15 bp, Homo sapiens
catatgtatctttgg

SEQ ID NO: 1868865 - DNA, 13 bp, Homo sapiens
catatgtctgtct

SEQ ID NO: 1868866 - DNA, 14 bp, Homo sapiens
catattgctcttaa

SEQ ID NO: 1868867 - DNA, 16 bp, Homo sapiens
catattggtattcact

SEQ ID NO: 1868868 - DNA, 17 bp, Homo sapiens
catcacttttcagtgat

SEQ ID NO: 1868869 - DNA, 15 bp, Homo sapiens
ccagggcctctggct

SEQ ID NO: 1868870 - DNA, 16 bp, Homo sapiens
ccagggcctctggctt

SEQ ID NO: 1868871 - DNA, 18 bp, Homo sapiens
ccagggcctctggcttcc

SEQ ID NO: 1868872 - DNA, 14 bp, Homo sapiens
ccaggtaactttgc

SEQ ID NO: 1868873 - DNA, 16 bp, Homo sapiens
ccaggtaactttgctt

SEQ ID NO: 1868874 - DNA, 21 bp, Homo sapiens
ccaggtgtggaccggccgcag

SEQ ID NO: 1868875 - DNA, 22 bp, Homo sapiens
ccaggtgtggaccggccgcagc

SEQ ID NO: 1868876 - DNA, 16 bp, Homo sapiens
ccagtcccagcctctg

SEQ ID NO: 1868877 - DNA, 19 bp, Homo sapiens
ccagtcccagcctctgggg

SEQ ID NO: 1868878 - DNA, 22 bp, Homo sapiens
ccagtgcccaaagtctgtgtga

SEQ ID NO: 1868879 - DNA, 11 bp, Homo sapiens
ccataaatcaa

SEQ ID NO: 1868880 - DNA, 16 bp, Homo sapiens
ccataccagtcacctc

SEQ ID NO: 1868881 - DNA, 17 bp, Homo sapiens
ccatagagtaatgatgt

SEQ ID NO: 1868882 - DNA, 13 bp, Homo sapiens
ccatagagtttaa

SEQ ID NO: 1868883 - DNA, 17 bp, Homo sapiens
ccatagagtttaacaca

SEQ ID NO: 1868884 - DNA, 19 bp, Homo sapiens
ccatatatgctgtatttct

SEQ ID NO: 1868885 - DNA, 13 bp, Homo sapiens
ccatattgctctt

SEQ ID NO: 1868886 - DNA, 15 bp, Homo sapiens
ccatattgctcttaa

SEQ ID NO: 1868887 - DNA, 19 bp, Homo sapiens
ccatattgctcttaaaaat

SEQ ID NO: 1868888 - DNA, 22 bp, Homo sapiens
ccatcttggcaaggttcagtct

SEQ ID NO: 1868889 - DNA, 23 bp, Homo sapiens
ccatgaaaataccataggaagac

SEQ ID NO: 1868890 - DNA, 16 bp, Homo sapiens
ccatggccacgaggaa

SEQ ID NO: 1868891 - DNA, 19 bp, Homo sapiens
ccatgtccagagggactgg

SEQ ID NO: 1868892 - DNA, 14 bp, Homo sapiens
ccatgtttgtaaaa

SEQ ID NO: 1868893 - DNA, 16 bp, Homo sapiens
ccattgaaatcagcat

SEQ ID NO: 1868894 - DNA, 14 bp, Homo sapiens
ccatttgctgccct

SEQ ID NO: 1868895 - DNA, 16 bp, Homo sapiens
ccatttgctgccctgg

SEQ ID NO: 1868896 - DNA, 16 bp, Homo sapiens
cccaaagagctgtggc

SEQ ID NO: 1868897 - DNA, 20 bp, Homo sapiens
cccaaagagctgtggctggg

SEQ ID NO: 1868898 - DNA, 18 bp, Homo sapiens
cccaagtggctcttggga

SEQ ID NO: 1868899 - DNA, 16 bp, Homo sapiens
cccaatccatgcttca

SEQ ID NO: 1868900 - DNA, 17 bp, Homo sapiens
cccaatcctccctggag

SEQ ID NO: 1868901 - DNA, 18 bp, Homo sapiens
cccaatcctccctggaga

SEQ ID NO: 1868902 - DNA, 18 bp, Homo sapiens
cccacctgggccaaggac

SEQ ID NO: 1868903 - DNA, 20 bp, Homo sapiens
cccacctgggccaaggactc

SEQ ID NO: 1868904 - DNA, 10 bp, Homo sapiens
cccactgacc

SEQ ID NO: 1868905 - DNA, 13 bp, Homo sapiens
cccactgacctgc

SEQ ID NO: 1868906 - DNA, 15 bp, Homo sapiens
cccactgacctgccc

SEQ ID NO: 1868907 - DNA, 20 bp, Homo sapiens
cccactgacctgcccatgtc

SEQ ID NO: 1868908 - DNA, 18 bp, Homo sapiens
cccactgggccctggggc

SEQ ID NO: 1868909 - DNA, 21 bp, Homo sapiens
cccagagcacaagaaggccag

SEQ ID NO: 1868910 - DNA, 12 bp, Homo sapiens
cccagcctctgg

SEQ ID NO: 1868911 - DNA, 14 bp, Homo sapiens
cccagcctctgggg

SEQ ID NO: 1868912 - DNA, 16 bp, Homo sapiens
cccagggcctctggct

SEQ ID NO: 1868913 - DNA, 18 bp, Homo sapiens
cccagggcctctggcttc

SEQ ID NO: 1868914 - DNA, 21 bp, Homo sapiens
cccagtcaattacatgtttgg

SEQ ID NO: 1868915 - DNA, 15 bp, Homo sapiens
cccagtcccagcctc

SEQ ID NO: 1868916 - DNA, 22 bp, Homo sapiens
cccatttttgctaattatcaat

SEQ ID NO: 1868917 - DNA, 18 bp, Homo sapiens
ccccactgacctgcccat

SEQ ID NO: 1868918 - DNA, 20 bp, Homo sapiens
ccccactgacctgcccatgt

SEQ ID NO: 1868919 - DNA, 23 bp, Homo sapiens
ccccagcagttgaatgacaacag

SEQ ID NO: 1868920 - DNA, 14 bp, Homo sapiens
ccccaggagcagct

SEQ ID NO: 1868921 - DNA, 15 bp, Homo sapiens
ccccaggagcagctg

SEQ ID NO: 1868922 - DNA, 20 bp, Homo sapiens
ccccaggagcagctggcact

SEQ ID NO: 1868923 - DNA, 14 bp, Homo sapiens
cccccaaatttaat

SEQ ID NO: 1868924 - DNA, 12 bp, Homo sapiens
cccccactgacc

SEQ ID NO: 1868925 - DNA, 16 bp, Homo sapiens
cccccaggagcagctg

SEQ ID NO: 1868926 - DNA, 17 bp, Homo sapiens
cccccaggagcagctgg

SEQ ID NO: 1868927 - DNA, 12 bp, Homo sapiens
ccccccaggcct

SEQ ID NO: 1868928 - DNA, 13 bp, Homo sapiens
cccccccaggcct

SEQ ID NO: 1868929 - DNA, 19 bp, Homo sapiens
ccccgtccccctagagact

SEQ ID NO: 1868930 - DNA, 22 bp, Homo sapiens
cccctgcagccgtgcaggactc

SEQ ID NO: 1868931 - DNA, 24 bp, Homo sapiens
cccctgcccaagtggctcttggga

SEQ ID NO: 1868932 - DNA, 14 bp, Homo sapiens
cccgcttagttctt

SEQ ID NO: 1868933 - DNA, 21 bp, Homo sapiens
cccgcttagttcttgaattgt

SEQ ID NO: 1868934 - DNA, 20 bp, Homo sapiens
ccctcggcaaccgtggggag

SEQ ID NO: 1868935 - DNA, 15 bp, Homo sapiens
ccctgaccaccctgc

SEQ ID NO: 1868936 - DNA, 18 bp, Homo sapiens
ccctgaccaccctgcctg

SEQ ID NO: 1868937 - DNA, 20 bp, Homo sapiens
ccctgcagccgtgcaggact

SEQ ID NO: 1868938 - DNA, 12 bp, Homo sapiens
ccctgcaggcca

SEQ ID NO: 1868939 - DNA, 14 bp, Homo sapiens
ccctgcaggccagg

SEQ ID NO: 1868940 - DNA, 16 bp, Homo sapiens
ccctgcaggccaggcc

SEQ ID NO: 1868941 - DNA, 23 bp, Homo sapiens
ccctgcccaagtggctcttggga

SEQ ID NO: 1868942 - DNA, 22 bp, Homo sapiens
ccctgcccaatcctccctggag

SEQ ID NO: 1868943 - DNA, 14 bp, Homo sapiens
ccctgcctgtggag

SEQ ID NO: 1868944 - DNA, 16 bp, Homo sapiens
ccctgccttgctgcct

SEQ ID NO: 1868945 - DNA, 18 bp, Homo sapiens
ccctggatggcctctggg

SEQ ID NO: 1868946 - DNA, 18 bp, Homo sapiens
ccctggggctgccctcgg

SEQ ID NO: 1868947 - DNA, 15 bp, Homo sapiens
cccttcagcttgctt

SEQ ID NO: 1868948 - DNA, 22 bp, Homo sapiens
cccttgcactaaagtatgtaaa

SEQ ID NO: 1868949 - DNA, 12 bp, Homo sapiens
ccctttctgtgt

SEQ ID NO: 1868950 - DNA, 22 bp, Homo sapiens
ccctttttaaaaaataccattg

SEQ ID NO: 1868951 - DNA, 13 bp, Homo sapiens
ccgacaccactgg

SEQ ID NO: 1868952 - DNA, 10 bp, Homo sapiens
ccgcagcccc

SEQ ID NO: 1868953 - DNA, 11 bp, Homo sapiens
ccgcagccccc

SEQ ID NO: 1868954 - DNA, 16 bp, Homo sapiens
ccgcagcccccactga

SEQ ID NO: 1868955 - DNA, 18 bp, Homo sapiens
ccgcagcccccactgacc

SEQ ID NO: 1868956 - DNA, 15 bp, Homo sapiens
ccgctctccccctgc

SEQ ID NO: 1868957 - DNA, 21 bp, Homo sapiens
ccgctctccccctgcagccgt

SEQ ID NO: 1868958 - DNA, 15 bp, Homo sapiens
ccggccgcagccccc

SEQ ID NO: 1868959 - DNA, 15 bp, Homo sapiens
ccgggcccagggcct

SEQ ID NO: 1868960 - DNA, 20 bp, Homo sapiens
ccgggcccagggcctctggc

SEQ ID NO: 1868961 - DNA, 15 bp, Homo sapiens
ccgtggggaggccat

SEQ ID NO: 1868962 - DNA, 14 bp, Homo sapiens
ccgtgtagtttctg

SEQ ID NO: 1868963 - DNA, 19 bp, Homo sapiens
ccgtttacagtgtatttaa

SEQ ID NO: 1868964 - DNA, 11 bp, Homo sapiens
cctagagactc

SEQ ID NO: 1868965 - DNA, 13 bp, Homo sapiens
cctagcttttaaa

SEQ ID NO: 1868966 - DNA, 14 bp, Homo sapiens
cctaggagtacaag

SEQ ID NO: 1868967 - DNA, 16 bp, Homo sapiens
cctatatctgtttgta

SEQ ID NO: 1868968 - DNA, 19 bp, Homo sapiens
cctatatctgtttgtatat

SEQ ID NO: 1868969 - DNA, 22 bp, Homo sapiens
cctatatctgtttgtatatttg

SEQ ID NO: 1868970 - DNA, 18 bp, Homo sapiens
cctatatgatttatagtt

SEQ ID NO: 1868971 - DNA, 19 bp, Homo sapiens
cctcactcaggaaccctgg

SEQ ID NO: 1868972 - DNA, 22 bp, Homo sapiens
cctcactcaggaaccctggaga

SEQ ID NO: 1868973 - DNA, 17 bp, Homo sapiens
cctccaaggctgtcttc

SEQ ID NO: 1868974 - DNA, 21 bp, Homo sapiens
cctcccattttagaaaatcag

SEQ ID NO: 1868975 - DNA, 17 bp, Homo sapiens
cctcctgggcatgtttg

SEQ ID NO: 1868976 - DNA, 17 bp, Homo sapiens
cctcggcaaccgtgggg

SEQ ID NO: 1868977 - DNA, 22 bp, Homo sapiens
cctcggcaaccgtggggaggcc

SEQ ID NO: 1868978 - DNA, 19 bp, Homo sapiens
cctcgggatgaaaagccat

SEQ ID NO: 1868979 - DNA, 20 bp, Homo sapiens
cctcgggatgaaaagccata

SEQ ID NO: 1868980 - DNA, 15 bp, Homo sapiens
cctctgactcaccac

SEQ ID NO: 1868981 - DNA, 20 bp, Homo sapiens
cctctgctcattaaactgat

SEQ ID NO: 1868982 - DNA, 16 bp, Homo sapiens
cctctggcttccctgc

SEQ ID NO: 1868983 - DNA, 19 bp, Homo sapiens
cctctggcttccctgccca

SEQ ID NO: 1868984 - DNA, 17 bp, Homo sapiens
cctctggggcagagctt

SEQ ID NO: 1868985 - DNA, 18 bp, Homo sapiens
cctctggggcagagcttg

SEQ ID NO: 1868986 - DNA, 13 bp, Homo sapiens
cttcagctgactc

SEQ ID NO: 1868987 - DNA, 14 bp, Homo sapiens
cttcatatctaatt

SEQ ID NO: 1868988 - DNA, 16 bp, Homo sapiens
cttccgacaccactgg

SEQ ID NO: 1868989 - DNA, 18 bp, Homo sapiens
cttccgacaccactggga

SEQ ID NO: 1868990 - DNA, 19 bp, Homo sapiens
cttccgacaccactgggaa

SEQ ID NO: 1868991 - DNA, 17 bp, Homo sapiens
cttcctgtctgtttata

SEQ ID NO: 1868992 - DNA, 12 bp, Homo sapiens
cttctaatatat

SEQ ID NO: 1868993 - DNA, 14 bp, Homo sapiens
cttctaatatattt

SEQ ID NO: 1868994 - DNA, 18 bp, Homo sapiens
cttctaatatatttttat

SEQ ID NO: 1868995 - DNA, 14 bp, Homo sapiens
cttctcccagagca

SEQ ID NO: 1868996 - DNA, 15 bp, Homo sapiens
cttctctttgtgcag

SEQ ID NO: 1868997 - DNA, 13 bp, Homo sapiens
cttctgatcttgg

SEQ ID NO: 1868998 - DNA, 18 bp, Homo sapiens
cttctgtagtttttaatt

SEQ ID NO: 1868999 - DNA, 14 bp, Homo sapiens
cttctgttaagaaa

SEQ ID NO: 1869000 - DNA, 15 bp, Homo sapiens
cttcttaaaaactgt

SEQ ID NO: 1869001 - DNA, 16 bp, Homo sapiens
cttcttaaaaactgtg

SEQ ID NO: 1869002 - DNA, 17 bp, Homo sapiens
cttcttaaaaactgtgt

SEQ ID NO: 1869003 - DNA, 17 bp, Homo sapiens
cttgaaacctttctact

SEQ ID NO: 1869004 - DNA, 24 bp, Homo sapiens
cttgatggctcagagagcatcttt

SEQ ID NO: 1869005 - DNA, 12 bp, Homo sapiens
cttgattaaaca

SEQ ID NO: 1869006 - DNA, 22 bp, Homo sapiens
cttgattaaacagcaaagccat

SEQ ID NO: 1869007 - DNA, 22 bp, Homo sapiens
cttgcatttcacttgagtggag

SEQ ID NO: 1869008 - DNA, 16 bp, Homo sapiens
cttgcggccacagcac

SEQ ID NO: 1869009 - DNA, 20 bp, Homo sapiens
cttgctgccttcaccctgaa

SEQ ID NO: 1869010 - DNA, 16 bp, Homo sapiens
cttggagtgctgcagc

SEQ ID NO: 1869011 - DNA, 17 bp, Homo sapiens
cttggcttcttaaaaac

SEQ ID NO: 1869012 - DNA, 20 bp, Homo sapiens
cttgggacaacgtgctgctt

SEQ ID NO: 1869013 - DNA, 19 bp, Homo sapiens
cttgggcgcttcccacctg

SEQ ID NO: 1869014 - DNA, 17 bp, Homo sapiens
cttggttgttaatttag

SEQ ID NO: 1869015 - DNA, 15 bp, Homo sapiens
cttgtagccctggat

SEQ ID NO: 1869016 - DNA, 19 bp, Homo sapiens
cttgtagccctggatggcc

SEQ ID NO: 1869017 - DNA, 22 bp, Homo sapiens
cttgtagccctggatggcctct

SEQ ID NO: 1869018 - DNA, 16 bp, Homo sapiens
cttgtatagtgtaaaa

SEQ ID NO: 1869019 - DNA, 17 bp, Homo sapiens
cttgtatagtgtaaaat

SEQ ID NO: 1869020 - DNA, 22 bp, Homo sapiens
cttgttacaaattttttaattt

SEQ ID NO: 1869021 - DNA, 15 bp, Homo sapiens
cttgttattaatgtt

SEQ ID NO: 1869022 - DNA, 18 bp, Homo sapiens
cttgttattaatgtttct

SEQ ID NO: 1869023 - DNA, 21 bp, Homo sapiens
ctttaaaagtcattattcctg

SEQ ID NO: 1869024 - DNA, 13 bp, Homo sapiens
ctttcaaaagaca

SEQ ID NO: 1869025 - DNA, 10 bp, Homo sapiens
ctttcccttc

SEQ ID NO: 1869026 - DNA, 16 bp, Homo sapiens
ctttctactcatttta

SEQ ID NO: 1869027 - DNA, 20 bp, Homo sapiens
ctttctcttggacattgtaa

SEQ ID NO: 1869028 - DNA, 19 bp, Homo sapiens
ctttctgagtgagttttac

SEQ ID NO: 1869029 - DNA, 21 bp, Homo sapiens
ctttctgtgtgcaccttacca

SEQ ID NO: 1869030 - DNA, 17 bp, Homo sapiens
ctttgaaggtaataaat

SEQ ID NO: 1869031 - DNA, 20 bp, Homo sapiens
ctttgaaggtaataaataca

SEQ ID NO: 1869032 - DNA, 13 bp, Homo sapiens
ctttgaatgcttt

SEQ ID NO: 1869033 - DNA, 19 bp, Homo sapiens
ctttgccttaagtttccct

SEQ ID NO: 1869034 - DNA, 13 bp, Homo sapiens
ctttgctgttact

SEQ ID NO: 1869035 - DNA, 14 bp, Homo sapiens
ctttgctgttactg

SEQ ID NO: 1869036 - DNA, 17 bp, Homo sapiens
ctttgcttgattaaaca

SEQ ID NO: 1869037 - DNA, 15 bp, Homo sapiens
ctttgggaaagctgc

SEQ ID NO: 1869038 - DNA, 19 bp, Homo sapiens
ctttggggaaactaacaat

SEQ ID NO: 1869039 - DNA, 18 bp, Homo sapiens
ctttgtagaataaatggt

SEQ ID NO: 1869040 - DNA, 18 bp, Homo sapiens
ctttgtattataattgtt

SEQ ID NO: 1869041 - DNA, 20 bp, Homo sapiens
ctttgtattataattgttga

SEQ ID NO: 1869042 - DNA, 23 bp, Homo sapiens
ctttgtattataattgttgatat

SEQ ID NO: 1869043 - DNA, 14 bp, Homo sapiens
ctttgtctaaacaa

SEQ ID NO: 1869044 - DNA, 14 bp, Homo sapiens
ctttgtgtgtctcc

SEQ ID NO: 1869045 - DNA, 20 bp, Homo sapiens
ctttgtgtgttatattccaa

SEQ ID NO: 1869046 - DNA, 15 bp, Homo sapiens
ctttgtttaaatgcc

SEQ ID NO: 1869047 - DNA, 13 bp, Homo sapiens
cttttaaaaaata

SEQ ID NO: 1869048 - DNA, 22 bp, Homo sapiens
cttttaaaaaatattttaagaa

SEQ ID NO: 1869049 - DNA, 20 bp, Homo sapiens
cttttacagaatgcattaaa

SEQ ID NO: 1869050 - DNA, 19 bp, Homo sapiens
cttttatagctattactgt

SEQ ID NO: 1869051 - DNA, 21 bp, Homo sapiens
cttttatgtttgtaatctgta

SEQ ID NO: 1869052 - DNA, 22 bp, Homo sapiens
cttttattgcaccattttcaat

SEQ ID NO: 1869053 - DNA, 14 bp, Homo sapiens
cttttattttcatt

SEQ ID NO: 1869054 - DNA, 11 bp, Homo sapiens
cttttcccttc

SEQ ID NO: 1869055 - DNA, 19 bp, Homo sapiens
cttttcctcccattttaga

SEQ ID NO: 1869056 - DNA, 16 bp, Homo sapiens
cttttctggttccaaa

SEQ ID NO: 1869057 - DNA, 21 bp, Homo sapiens
cttttctggttccaaaccagt

SEQ ID NO: 1869058 - DNA, 22 bp, Homo sapiens
cttttgaagtagtttgtataac

SEQ ID NO: 1869059 - DNA, 11 bp, Homo sapiens
cttttgtaaat

SEQ ID NO: 1869060 - DNA, 21 bp, Homo sapiens
cttttgtaaatgagacacata

SEQ ID NO: 1869061 - DNA, 12 bp, Homo sapiens
ctttttaaaaaa

SEQ ID NO: 1869062 - DNA, 14 bp, Homo sapiens
ctttttaaaaaata

SEQ ID NO: 1869063 - DNA, 19 bp, Homo sapiens
ctttttgaatgttatttgt

SEQ ID NO: 1869064 - DNA, 17 bp, Homo sapiens
ctttttgttttgttctt

SEQ ID NO: 1869065 - DNA, 13 bp, Homo sapiens
cttttttaaagta

SEQ ID NO: 1869066 - DNA, 18 bp, Homo sapiens
cttttttaaagtaaactt

SEQ ID NO: 1869067 - DNA, 12 bp, Homo sapiens
ctttttttgtta

SEQ ID NO: 1869068 - DNA, 14 bp, Homo sapiens
ctttttttgttata

SEQ ID NO: 1869069 - DNA, 16 bp, Homo sapiens
gaaaaaaaaattccat

SEQ ID NO: 1869070 - DNA, 22 bp, Homo sapiens
gaaaaacttttaggttgttacc

SEQ ID NO: 1869071 - DNA, 14 bp, Homo sapiens
gaaaaagagactct

SEQ ID NO: 1869072 - DNA, 20 bp, Homo sapiens
gaaaaatattgctaaaagtg

SEQ ID NO: 1869073 - DNA, 22 bp, Homo sapiens
gaaaaatattgctaaaagtgca

SEQ ID NO: 1869074 - DNA, 11 bp, Homo sapiens
gaaaagccata

SEQ ID NO: 1869075 - DNA, 17 bp, Homo sapiens
gaaaagccatatctagt

SEQ ID NO: 1869076 - DNA, 22 bp, Homo sapiens
gaaaagccatatctagtcaata

SEQ ID NO: 1869077 - DNA, 18 bp, Homo sapiens
gaaaaggcaaaagactgg

SEQ ID NO: 1869078 - DNA, 19 bp, Homo sapiens
gaaaagggaagttgtgcct

SEQ ID NO: 1869079 - DNA, 16 bp, Homo sapiens
gaaaatcctatatctg

SEQ ID NO: 1869080 - DNA, 14 bp, Homo sapiens
gaaaatctaatatt

SEQ ID NO: 1869081 - DNA, 23 bp, Homo sapiens
gaaaatctaatattaaaaatatg

SEQ ID NO: 1869082 - DNA, 22 bp, Homo sapiens
gaaaatcttagtatagtagaaa

SEQ ID NO: 1869083 - DNA, 19 bp, Homo sapiens
gaaaatgcagccttaaaca

SEQ ID NO: 1869084 - DNA, 16 bp, Homo sapiens
gaaaattgaaagtatt

SEQ ID NO: 1869085 - DNA, 18 bp, Homo sapiens
gaaaattgaaagtattca

SEQ ID NO: 1869086 - DNA, 15 bp, Homo sapiens
gaaacagagaaagaa

SEQ ID NO: 1869087 - DNA, 19 bp, Homo sapiens
gaaacccccttttcccttc

SEQ ID NO: 1869088 - DNA, 18 bp, Homo sapiens
gaaacctgaaaaaaagtt

SEQ ID NO: 1869089 - DNA, 15 bp, Homo sapiens
gaaacctgtgaaagc

SEQ ID NO: 1869090 - DNA, 15 bp, Homo sapiens
gaaacgcacttacaa

SEQ ID NO: 1869091 - DNA, 13 bp, Homo sapiens
gaaagaaaaggca

SEQ ID NO: 1869092 - DNA, 22 bp, Homo sapiens
gaaagaaaaggcaaaagactgg

SEQ ID NO: 1869093 - DNA, 21 bp, Homo sapiens
gaaagagaatgaactgtggaa

SEQ ID NO: 1869094 - DNA, 19 bp, Homo sapiens
gaaaggctatcctgctgaa

SEQ ID NO: 1869095 - DNA, 12 bp, Homo sapiens
gaaagggaaagc

SEQ ID NO: 1869096 - DNA, 14 bp, Homo sapiens
gaaagtaagtcttt

SEQ ID NO: 1869097 - DNA, 15 bp, Homo sapiens
gaaagtaagtctttt

SEQ ID NO: 1869098 - DNA, 16 bp, Homo sapiens
gaaagtattcagaaat

SEQ ID NO: 1869099 - DNA, 20 bp, Homo sapiens
gaaagtattcagaaattaaa

SEQ ID NO: 1869100 - DNA, 19 bp, Homo sapiens
gaaagtatttttgaaagaa

SEQ ID NO: 1869101 - DNA, 20 bp, Homo sapiens
gaaataaggtataaggatct

SEQ ID NO: 1869102 - DNA, 20 bp, Homo sapiens
gaaatcagcatgacaaaaat

SEQ ID NO: 1869103 - DNA, 22 bp, Homo sapiens
gctaaaagtgcatttaaggaga

SEQ ID NO: 1869104 - DNA, 17 bp, Homo sapiens
gctaagcaagccaggag

SEQ ID NO: 1869105 - DNA, 14 bp, Homo sapiens
gctaatatactttt

SEQ ID NO: 1869106 - DNA, 14 bp, Homo sapiens
gctaatctgcctgg

SEQ ID NO: 1869107 - DNA, 15 bp, Homo sapiens
gctacctttttatat

SEQ ID NO: 1869108 - DNA, 16 bp, Homo sapiens
gctactgatttttgtg

SEQ ID NO: 1869109 - DNA, 17 bp, Homo sapiens
gctactgatttttgtga

SEQ ID NO: 1869110 - DNA, 18 bp, Homo sapiens
gctacttatcatttttgt

SEQ ID NO: 1869111 - DNA, 18 bp, Homo sapiens
gctaggaatatagattaa

SEQ ID NO: 1869112 - DNA, 15 bp, Homo sapiens
gctatcctgctgaaa

SEQ ID NO: 1869113 - DNA, 15 bp, Homo sapiens
gctattcccttctga

SEQ ID NO: 1869114 - DNA, 14 bp, Homo sapiens
gctcatattttgta

SEQ ID NO: 1869115 - DNA, 18 bp, Homo sapiens
gctcatattttgtatata

SEQ ID NO: 1869116 - DNA, 16 bp, Homo sapiens
gctcattgtggccagt

SEQ ID NO: 1869117 - DNA, 12 bp, Homo sapiens
gctccctgacca

SEQ ID NO: 1869118 - DNA, 22 bp, Homo sapiens
gctcctgctcattgtggccagt

SEQ ID NO: 1869119 - DNA, 15 bp, Homo sapiens
gctctccccctgcag

SEQ ID NO: 1869120 - DNA, 20 bp, Homo sapiens
gctctccccctgcagccgtg

SEQ ID NO: 1869121 - DNA, 16 bp, Homo sapiens
gctgaaagtcctgctt

SEQ ID NO: 1869122 - DNA, 19 bp, Homo sapiens
gctgaaagtcctgctttcc

SEQ ID NO: 1869123 - DNA, 14 bp, Homo sapiens
gctgaattgagaat

SEQ ID NO: 1869124 - DNA, 23 bp, Homo sapiens
gctgaggctctgacccagtgaga

SEQ ID NO: 1869125 - DNA, 13 bp, Homo sapiens
gctgccctcggca

SEQ ID NO: 1869126 - DNA, 12 bp, Homo sapiens
gctgccctgggg

SEQ ID NO: 1869127 - DNA, 16 bp, Homo sapiens
gctgccttcaccctga

SEQ ID NO: 1869128 - DNA, 10 bp, Homo sapiens
gctggcactg

SEQ ID NO: 1869129 - DNA, 23 bp, Homo sapiens
gctggggggatgacggccaggct

SEQ ID NO: 1869130 - DNA, 16 bp, Homo sapiens
gctgtacattactgta

SEQ ID NO: 1869131 - DNA, 22 bp, Homo sapiens
gctgtatttctttgtagaataa

SEQ ID NO: 1869132 - DNA, 11 bp, Homo sapiens
gctgtggctgg

SEQ ID NO: 1869133 - DNA, 14 bp, Homo sapiens
gctgtggctggggg

SEQ ID NO: 1869134 - DNA, 13 bp, Homo sapiens
gctgttactgctt

SEQ ID NO: 1869135 - DNA, 20 bp, Homo sapiens
gctgttactgcttctctttg

SEQ ID NO: 1869136 - DNA, 23 bp, Homo sapiens
gctgttcttttttgtacttttct

SEQ ID NO: 1869137 - DNA, 17 bp, Homo sapiens
gcttaaaaaaaactctt

SEQ ID NO: 1869138 - DNA, 11 bp, Homo sapiens
gcttaaagctt

SEQ ID NO: 1869139 - DNA, 21 bp, Homo sapiens
gcttaatttccttctgttaag

SEQ ID NO: 1869140 - DNA, 14 bp, Homo sapiens
gcttcagtggagaa

SEQ ID NO: 1869141 - DNA, 13 bp, Homo sapiens
gcttccctgccca

SEQ ID NO: 1869142 - DNA, 17 bp, Homo sapiens
gcttccctgcccaatcc

SEQ ID NO: 1869143 - DNA, 15 bp, Homo sapiens
gcttcctgtctgttt

SEQ ID NO: 1869144 - DNA, 19 bp, Homo sapiens
gcttcctgtctgtttatat

SEQ ID NO: 1869145 - DNA, 24 bp, Homo sapiens
gcttcctgtctgtttatatattga

SEQ ID NO: 1869146 - DNA, 11 bp, Homo sapiens
gcttctgcttc

SEQ ID NO: 1869147 - DNA, 13 bp, Homo sapiens
gcttcttaaaaac

SEQ ID NO: 1869148 - DNA, 16 bp, Homo sapiens
gcttcttaaaaactgt

SEQ ID NO: 1869149 - DNA, 20 bp, Homo sapiens
gcttcttaaaaactgtgtat

SEQ ID NO: 1869150 - DNA, 24 bp, Homo sapiens
gcttcttaaaaactgtgtatcatt

SEQ ID NO: 1869151 - DNA, 14 bp, Homo sapiens
gcttgattaaacag

SEQ ID NO: 1869152 - DNA, 23 bp, Homo sapiens
gcttgatttgatctttgtttaaa

SEQ ID NO: 1869153 - DNA, 14 bp, Homo sapiens
gcttgtagccctgg

SEQ ID NO: 1869154 - DNA, 15 bp, Homo sapiens
gcttgtagccctgga

SEQ ID NO: 1869155 - DNA, 21 bp, Homo sapiens
gcttgtagccctggatggcct

SEQ ID NO: 1869156 - DNA, 13 bp, Homo sapiens
gctttatctttgt

SEQ ID NO: 1869157 - DNA, 15 bp, Homo sapiens
gctttatctttgtgt

SEQ ID NO: 1869158 - DNA, 18 bp, Homo sapiens
gctttcctatctagcatt

SEQ ID NO: 1869159 - DNA, 12 bp, Homo sapiens
gcttttaaaaaa

SEQ ID NO: 1869160 - DNA, 23 bp, Homo sapiens
gcttttaaaaaatattttaagaa

SEQ ID NO: 1869161 - DNA, 21 bp, Homo sapiens
gcttttattgcaccattttca

SEQ ID NO: 1869162 - DNA, 17 bp, Homo sapiens
gctttttgtattaacaa

SEQ ID NO: 1869163 - DNA, 14 bp, Homo sapiens
ggaaaattgaaagt

SEQ ID NO: 1869164 - DNA, 15 bp, Homo sapiens
ggaaaattgaaagta

SEQ ID NO: 1869165 - DNA, 16 bp, Homo sapiens
ggaaaattgaaagtat

SEQ ID NO: 1869166 - DNA, 15 bp, Homo sapiens
ggaaacgcacttaca

SEQ ID NO: 1869167 - DNA, 17 bp, Homo sapiens
ggaaacgcacttacaag

SEQ ID NO: 1869168 - DNA, 18 bp, Homo sapiens
ggaaatggtatccagaat

SEQ ID NO: 1869169 - DNA, 17 bp, Homo sapiens
ggaaccaagggccctca

SEQ ID NO: 1869170 - DNA, 24 bp, Homo sapiens
ggaaccaagggccctcactcagga

SEQ ID NO: 1869171 - DNA, 21 bp, Homo sapiens
ggaagaatttaatggactgtg

SEQ ID NO: 1869172 - DNA, 15 bp, Homo sapiens
ggaagacataaaact

SEQ ID NO: 1869173 - DNA, 15 bp, Homo sapiens
ggaagtgcagcgggc

SEQ ID NO: 1869174 - DNA, 13 bp, Homo sapiens
ggacacctacagc

SEQ ID NO: 1869175 - DNA, 14 bp, Homo sapiens
ggacacctacagca

SEQ ID NO: 1869176 - DNA, 13 bp, Homo sapiens
ggacagccagggc

SEQ ID NO: 1869177 - DNA, 20 bp, Homo sapiens
ggacctcggtgatgccttcc

SEQ ID NO: 1869178 - DNA, 19 bp, Homo sapiens
ggactggacagccagggca

SEQ ID NO: 1869179 - DNA, 16 bp, Homo sapiens
ggagaaaaattacaga

SEQ ID NO: 1869180 - DNA, 16 bp, Homo sapiens
ggagaagggacatggg

SEQ ID NO: 1869181 - DNA, 21 bp, Homo sapiens
ggagaagggacatgggaatga

SEQ ID NO: 1869182 - DNA, 17 bp, Homo sapiens
ggagacagaagtcaggt

SEQ ID NO: 1869183 - DNA, 22 bp, Homo sapiens
ggagactttgctgttactgctt

SEQ ID NO: 1869184 - DNA, 23 bp, Homo sapiens
ggagactttgctgttactgcttc

SEQ ID NO: 1869185 - DNA, 12 bp, Homo sapiens
ggagctatttta

SEQ ID NO: 1869186 - DNA, 18 bp, Homo sapiens
ggaggccatttgctgccc

SEQ ID NO: 1869187 - DNA, 19 bp, Homo sapiens
ggaggccatttgctgccct

SEQ ID NO: 1869188 - DNA, 23 bp, Homo sapiens
ggaggccatttgctgccctgggg

SEQ ID NO: 1869189 - DNA, 15 bp, Homo sapiens
ggagggccgagacag

SEQ ID NO: 1869190 - DNA, 13 bp, Homo sapiens
ggatataaaagga

SEQ ID NO: 1869191 - DNA, 14 bp, Homo sapiens
ggatgaaaagccat

SEQ ID NO: 1869192 - DNA, 17 bp, Homo sapiens
ggatgaaattttctaga

SEQ ID NO: 1869193 - DNA, 16 bp, Homo sapiens
ggatgacggccaggct

SEQ ID NO: 1869194 - DNA, 23 bp, Homo sapiens
ggatgacggccaggctccctgac

SEQ ID NO: 1869195 - DNA, 15 bp, Homo sapiens
ggatggcctctgggg

SEQ ID NO: 1869196 - DNA, 18 bp, Homo sapiens
ggatggcctctggggcag

SEQ ID NO: 1869197 - DNA, 13 bp, Homo sapiens
ggcaaaagactgg

SEQ ID NO: 1869198 - DNA, 16 bp, Homo sapiens
ggcaactcaaagatga

SEQ ID NO: 1869199 - DNA, 21 bp, Homo sapiens
ggcaactcgtgacagcctctg

SEQ ID NO: 1869200 - DNA, 18 bp, Homo sapiens
ggcactaaaatgtttaat

SEQ ID NO: 1869201 - DNA, 16 bp, Homo sapiens
ggcactgacagcctgg

SEQ ID NO: 1869202 - DNA, 18 bp, Homo sapiens
ggcactgacagcctgggg

SEQ ID NO: 1869203 - DNA, 18 bp, Homo sapiens
ggcactgtggcactgcca

SEQ ID NO: 1869204 - DNA, 19 bp, Homo sapiens
ggcactgtggcactgccac

SEQ ID NO: 1869205 - DNA, 21 bp, Homo sapiens
ggcactgtggcactgccacca

SEQ ID NO: 1869206 - DNA, 18 bp, Homo sapiens
ggcagagcttgtagccct

SEQ ID NO: 1869207 - DNA, 23 bp, Homo sapiens
ggcagagcttgtagccctggatg

SEQ ID NO: 1869208 - DNA, 20 bp, Homo sapiens
ggcagagtggcctgtgagca

SEQ ID NO: 1869209 - DNA, 15 bp, Homo sapiens
ggcagccaaggaatg

SEQ ID NO: 1869210 - DNA, 18 bp, Homo sapiens
ggcaggtcatggagcagc

SEQ ID NO: 1869211 - DNA, 15 bp, Homo sapiens
ggcatcatgggcaac

SEQ ID NO: 1869212 - DNA, 15 bp, Homo sapiens
ggcattaatattctt

SEQ ID NO: 1869213 - DNA, 23 bp, Homo sapiens
ggccaagacttggcaacagaagc

SEQ ID NO: 1869214 - DNA, 14 bp, Homo sapiens
ggccagcccactgg

SEQ ID NO: 1869215 - DNA, 16 bp, Homo sapiens
ggccagcccactgggc

SEQ ID NO: 1869216 - DNA, 16 bp, Homo sapiens
ggccaggctccctgac

SEQ ID NO: 1869217 - DNA, 19 bp, Homo sapiens
ggccaggctccctgaccac

SEQ ID NO: 1869218 - DNA, 19 bp, Homo sapiens
ggccatatatgctgtattt

SEQ ID NO: 1869219 - DNA, 20 bp, Homo sapiens
ggccatatatgctgtatttc

SEQ ID NO: 1869220 - DNA, 23 bp, Homo sapiens
gttgatattcaaggctttaaaag

SEQ ID NO: 1869221 - DNA, 14 bp, Homo sapiens
gttggctggatgaa

SEQ ID NO: 1869222 - DNA, 19 bp, Homo sapiens
gttggctttacaaataatt

SEQ ID NO: 1869223 - DNA, 13 bp, Homo sapiens
gttgtgtaataac

SEQ ID NO: 1869224 - DNA, 21 bp, Homo sapiens
gttgtgttgttatcatttaag

SEQ ID NO: 1869225 - DNA, 13 bp, Homo sapiens
gttgttaatttag

SEQ ID NO: 1869226 - DNA, 14 bp, Homo sapiens
gtttaaatgccaaa

SEQ ID NO: 1869227 - DNA, 15 bp, Homo sapiens
gtttaaatgccaaaa

SEQ ID NO: 1869228 - DNA, 18 bp, Homo sapiens
gtttacaagtgtatatca

SEQ ID NO: 1869229 - DNA, 23 bp, Homo sapiens
gtttacaagtgtatatcagaaaa

SEQ ID NO: 1869230 - DNA, 16 bp, Homo sapiens
gtttactcagtgaaat

SEQ ID NO: 1869231 - DNA, 20 bp, Homo sapiens
gtttatagagggccaagact

SEQ ID NO: 1869232 - DNA, 17 bp, Homo sapiens
gtttcagatatatatca

SEQ ID NO: 1869233 - DNA, 14 bp, Homo sapiens
gtttctcattaaac

SEQ ID NO: 1869234 - DNA, 17 bp, Homo sapiens
gtttctcattaaactct

SEQ ID NO: 1869235 - DNA, 19 bp, Homo sapiens
gtttctgatctgtactttg

SEQ ID NO: 1869236 - DNA, 21 bp, Homo sapiens
gtttctgatctgtactttgtg

SEQ ID NO: 1869237 - DNA, 23 bp, Homo sapiens
gtttctgatctgtactttgtgtt

SEQ ID NO: 1869238 - DNA, 16 bp, Homo sapiens
gtttgctaaaagaaga

SEQ ID NO: 1869239 - DNA, 19 bp, Homo sapiens
gtttggcaatagtttgcat

SEQ ID NO: 1869240 - DNA, 15 bp, Homo sapiens
gtttgtataacttct

SEQ ID NO: 1869241 - DNA, 13 bp, Homo sapiens
gtttgtctgtgtg

SEQ ID NO: 1869242 - DNA, 15 bp, Homo sapiens
gtttgtgttttaaaa

SEQ ID NO: 1869243 - DNA, 21 bp, Homo sapiens
gtttgtgttttaaaaaaactg

SEQ ID NO: 1869244 - DNA, 12 bp, Homo sapiens
gtttgtttgctt

SEQ ID NO: 1869245 - DNA, 15 bp, Homo sapiens
gtttgtttggcactg

SEQ ID NO: 1869246 - DNA, 15 bp, Homo sapiens
gttttaaaaaaactg

SEQ ID NO: 1869247 - DNA, 19 bp, Homo sapiens
gttttaaaaaaactgaagg

SEQ ID NO: 1869248 - DNA, 14 bp, Homo sapiens
gttttatcatgaca

SEQ ID NO: 1869249 - DNA, 22 bp, Homo sapiens
gttttatcatgacatgttatat

SEQ ID NO: 1869250 - DNA, 13 bp, Homo sapiens
gttttatttacat

SEQ ID NO: 1869251 - DNA, 23 bp, Homo sapiens
gttttatttatatcttgttatta

SEQ ID NO: 1869252 - DNA, 14 bp, Homo sapiens
gttttgaataaaaa

SEQ ID NO: 1869253 - DNA, 15 bp, Homo sapiens
gttttgatataatct

SEQ ID NO: 1869254 - DNA, 16 bp, Homo sapiens
gttttggagaaaaatt

SEQ ID NO: 1869255 - DNA, 22 bp, Homo sapiens
gttttggagaaaaattacagat

SEQ ID NO: 1869256 - DNA, 14 bp, Homo sapiens
gtttttaacatgtg

SEQ ID NO: 1869257 - DNA, 19 bp, Homo sapiens
gtttttaattaaaaacttt

SEQ ID NO: 1869258 - DNA, 11 bp, Homo sapiens
taaaaaaactg

SEQ ID NO: 1869259 - DNA, 12 bp, Homo sapiens
taaaaaaactga

SEQ ID NO: 1869260 - DNA, 21 bp, Homo sapiens
taaaaaactttctactcattt

SEQ ID NO: 1869261 - DNA, 12 bp, Homo sapiens
taaaaaatacca

SEQ ID NO: 1869262 - DNA, 18 bp, Homo sapiens
taaaaaataccattgaaa

SEQ ID NO: 1869263 - DNA, 15 bp, Homo sapiens
taaaaaatattttaa

SEQ ID NO: 1869264 - DNA, 21 bp, Homo sapiens
taaaaaatattttaagaaaga

SEQ ID NO: 1869265 - DNA, 16 bp, Homo sapiens
taaaaagtgaactttt

SEQ ID NO: 1869266 - DNA, 17 bp, Homo sapiens
taaaaagtgaacttttg

SEQ ID NO: 1869267 - DNA, 18 bp, Homo sapiens
taaaaagtgaacttttgt

SEQ ID NO: 1869268 - DNA, 20 bp, Homo sapiens
taaaaataagttttatacat

SEQ ID NO: 1869269 - DNA, 19 bp, Homo sapiens
taaaaatgatgataatcat

SEQ ID NO: 1869270 - DNA, 19 bp, Homo sapiens
taaaactgagtccatgaaa

SEQ ID NO: 1869271 - DNA, 17 bp, Homo sapiens
taaaactttaaaaggca

SEQ ID NO: 1869272 - DNA, 20 bp, Homo sapiens
taaaactttaaaaggcaact

SEQ ID NO: 1869273 - DNA, 12 bp, Homo sapiens
taaaagaagaga

SEQ ID NO: 1869274 - DNA, 16 bp, Homo sapiens
taaaaggatgttacaa

SEQ ID NO: 1869275 - DNA, 18 bp, Homo sapiens
taaaagggttcaaggact

SEQ ID NO: 1869276 - DNA, 14 bp, Homo sapiens
taaaagtgcattta

SEQ ID NO: 1869277 - DNA, 15 bp, Homo sapiens
taaaagtgcatttaa

SEQ ID NO: 1869278 - DNA, 16 bp, Homo sapiens
taaaagtgcatttaag

SEQ ID NO: 1869279 - DNA, 17 bp, Homo sapiens
taaaagtgcatttaagg

SEQ ID NO: 1869280 - DNA, 19 bp, Homo sapiens
taaaagtgcatttaaggag

SEQ ID NO: 1869281 - DNA, 20 bp, Homo sapiens
taaaagtgcatttaaggaga

SEQ ID NO: 1869282 - DNA, 21 bp, Homo sapiens
taaaagtgcatttaaggagat

SEQ ID NO: 1869283 - DNA, 14 bp, Homo sapiens
taaaagttataata

SEQ ID NO: 1869284 - DNA, 17 bp, Homo sapiens
taaaagttataataact

SEQ ID NO: 1869285 - DNA, 15 bp, Homo sapiens
taaaagttgtgattc

SEQ ID NO: 1869286 - DNA, 15 bp, Homo sapiens
taaaataagaagggg

SEQ ID NO: 1869287 - DNA, 14 bp, Homo sapiens
taaaatagcttgta

SEQ ID NO: 1869288 - DNA, 18 bp, Homo sapiens
taaaatagcttgtatagt

SEQ ID NO: 1869289 - DNA, 15 bp, Homo sapiens
taaaatatatgttct

SEQ ID NO: 1869290 - DNA, 16 bp, Homo sapiens
taaaatatatgttctg

SEQ ID NO: 1869291 - DNA, 14 bp, Homo sapiens
taaaatattatttg

SEQ ID NO: 1869292 - DNA, 17 bp, Homo sapiens
taaaatgaggacatgtt

SEQ ID NO: 1869293 - DNA, 14 bp, Homo sapiens
taaaatgattgtaa

SEQ ID NO: 1869294 - DNA, 16 bp, Homo sapiens
taaaatgattgtaaaa

SEQ ID NO: 1869295 - DNA, 19 bp, Homo sapiens
taaaatgggaattctgact

SEQ ID NO: 1869296 - DNA, 20 bp, Homo sapiens
taaaatgggaattctgactt

SEQ ID NO: 1869297 - DNA, 12 bp, Homo sapiens
taaaatgtttaa

SEQ ID NO: 1869298 - DNA, 23 bp, Homo sapiens
taaaattgcagtttcatgtatgt

SEQ ID NO: 1869299 - DNA, 24 bp, Homo sapiens
taaaattgcagtttcatgtatgta

SEQ ID NO: 1869300 - DNA, 21 bp, Homo sapiens
taaaatttcccctaatctttt

SEQ ID NO: 1869301 - DNA, 18 bp, Homo sapiens
taaacaaaatttcacagt

SEQ ID NO: 1869302 - DNA, 14 bp, Homo sapiens
taaacactgtgtat

SEQ ID NO: 1869303 - DNA, 16 bp, Homo sapiens
taaacagcaaagccat

SEQ ID NO: 1869304 - DNA, 18 bp, Homo sapiens
taaacagcaaagccatat

SEQ ID NO: 1869305 - DNA, 22 bp, Homo sapiens
taaaccaccagtgcccaaagtc

SEQ ID NO: 1869306 - DNA, 14 bp, Homo sapiens
taaactctaaacat

SEQ ID NO: 1869307 - DNA, 13 bp, Homo sapiens
taaactctgaata

SEQ ID NO: 1869308 - DNA, 19 bp, Homo sapiens
taaactctgaataagcact

SEQ ID NO: 1869309 - DNA, 15 bp, Homo sapiens
taaagctttatcttt

SEQ ID NO: 1869310 - DNA, 18 bp, Homo sapiens
taaagctttatctttgtg

SEQ ID NO: 1869311 - DNA, 19 bp, Homo sapiens
taaagctttatctttgtgt

SEQ ID NO: 1869312 - DNA, 16 bp, Homo sapiens
taaaggaaaaatcata

SEQ ID NO: 1869313 - DNA, 15 bp, Homo sapiens
taaagggagaaatgc

SEQ ID NO: 1869314 - DNA, 17 bp, Homo sapiens
taaagggagaaatgcca

SEQ ID NO: 1869315 - DNA, 13 bp, Homo sapiens
taaagtatgtaaa

SEQ ID NO: 1869316 - DNA, 16 bp, Homo sapiens
taaataaatagaaaga

SEQ ID NO: 1869317 - DNA, 20 bp, Homo sapiens
taaatacacagcatgcagac

SEQ ID NO: 1869318 - DNA, 21 bp, Homo sapiens
taaatcatttggttaaatcat

SEQ ID NO: 1869319 - DNA, 22 bp, Homo sapiens
taaatctggggaagaggtttta

SEQ ID NO: 1869320 - DNA, 18 bp, Homo sapiens
taaatgaacacatggcag

SEQ ID NO: 1869321 - DNA, 20 bp, Homo sapiens
taaatgaacacatggcagaa

SEQ ID NO: 1869322 - DNA, 18 bp, Homo sapiens
taaatgagggtttctgat

SEQ ID NO: 1869323 - DNA, 15 bp, Homo sapiens
taaatgagttactta

SEQ ID NO: 1869324 - DNA, 20 bp, Homo sapiens
taaatgccttggtttgattt

SEQ ID NO: 1869325 - DNA, 14 bp, Homo sapiens
taaattatgaagga

SEQ ID NO: 1869326 - DNA, 16 bp, Homo sapiens
taaattggtcatggta

SEQ ID NO: 1869327 - DNA, 18 bp, Homo sapiens
taaatttttgaaaaatat

SEQ ID NO: 1869328 - DNA, 23 bp, Homo sapiens
taacaaagttactggctctttgt

SEQ ID NO: 1869329 - DNA, 15 bp, Homo sapiens
taacaatttccttta

SEQ ID NO: 1869330 - DNA, 23 bp, Homo sapiens
taacacaagtcctgtgaatttct

SEQ ID NO: 1869331 - DNA, 16 bp, Homo sapiens
taacagagaaatagag

SEQ ID NO: 1869332 - DNA, 23 bp, Homo sapiens
taacatagaattgcaatctataa

SEQ ID NO: 1869333 - DNA, 22 bp, Homo sapiens
taacatatttactaagccacaa

SEQ ID NO: 1869334 - DNA, 16 bp, Homo sapiens
taacgaacgttttaaa

SEQ ID NO: 1869335 - DNA, 18 bp, Homo sapiens
taactggtgatatatctc

SEQ ID NO: 1869336 - DNA, 16 bp, Homo sapiens
taactgtatttcagta

SEQ ID NO: 1869337 - DNA, 15 bp, Homo sapiens
tcagacttgcggcca

SEQ ID NO: 1869338 - DNA, 17 bp, Homo sapiens
tcagagagcatcttttc

SEQ ID NO: 1869339 - DNA, 18 bp, Homo sapiens
tcagatatatatcatatt

SEQ ID NO: 1869340 - DNA, 16 bp, Homo sapiens
tcagatttctctttga

SEQ ID NO: 1869341 - DNA, 13 bp, Homo sapiens
tcagatttgtata

SEQ ID NO: 1869342 - DNA, 20 bp, Homo sapiens
tcagcatgacaaaaataaca

SEQ ID NO: 1869343 - DNA, 15 bp, Homo sapiens
tcaggaaccctggag

SEQ ID NO: 1869344 - DNA, 16 bp, Homo sapiens
tcaggaatttaattta

SEQ ID NO: 1869345 - DNA, 14 bp, Homo sapiens
tcagtaaacactgt

SEQ ID NO: 1869346 - DNA, 17 bp, Homo sapiens
tcagtatcttagagttt

SEQ ID NO: 1869347 - DNA, 15 bp, Homo sapiens
tcagtattttccagc

SEQ ID NO: 1869348 - DNA, 22 bp, Homo sapiens
tcagtattttccagccttatgt

SEQ ID NO: 1869349 - DNA, 23 bp, Homo sapiens
tcagtattttccagccttatgtg

SEQ ID NO: 1869350 - DNA, 20 bp, Homo sapiens
tcagtattttggagaaatta

SEQ ID NO: 1869351 - DNA, 22 bp, Homo sapiens
tcagtattttggagaaattatt

SEQ ID NO: 1869352 - DNA, 15 bp, Homo sapiens
tcataattcaccaaa

SEQ ID NO: 1869353 - DNA, 18 bp, Homo sapiens
tcatacacagttaaataa

SEQ ID NO: 1869354 - DNA, 14 bp, Homo sapiens
tcataccagtcagt

SEQ ID NO: 1869355 - DNA, 20 bp, Homo sapiens
tcatagatttgaaaaacttt

SEQ ID NO: 1869356 - DNA, 18 bp, Homo sapiens
tcatataagcaagacagt

SEQ ID NO: 1869357 - DNA, 18 bp, Homo sapiens
tcatataatttaaagaaa

SEQ ID NO: 1869358 - DNA, 22 bp, Homo sapiens
tcatataatttaaagaaacact

SEQ ID NO: 1869359 - DNA, 23 bp, Homo sapiens
tcatattttgtatatatctgctt

SEQ ID NO: 1869360 - DNA, 15 bp, Homo sapiens
tcatcacttttcagt

SEQ ID NO: 1869361 - DNA, 23 bp, Homo sapiens
tcatcagtcttaatattcagaga

SEQ ID NO: 1869362 - DNA, 23 bp, Homo sapiens
tcatcatcagacttgcggccaca

SEQ ID NO: 1869363 - DNA, 14 bp, Homo sapiens
tcatctgtgtgaaa

SEQ ID NO: 1869364 - DNA, 19 bp, Homo sapiens
tcatctgtgtgaaaatggg

SEQ ID NO: 1869365 - DNA, 17 bp, Homo sapiens
tcatgacatgttatata

SEQ ID NO: 1869366 - DNA, 19 bp, Homo sapiens
tcatgcaaactgctttatt

SEQ ID NO: 1869367 - DNA, 17 bp, Homo sapiens
tcatgcccactccccca

SEQ ID NO: 1869368 - DNA, 22 bp, Homo sapiens
tcatgcccactcccccaggagc

SEQ ID NO: 1869369 - DNA, 14 bp, Homo sapiens
tcatggagcagccc

SEQ ID NO: 1869370 - DNA, 18 bp, Homo sapiens
tcatggagcagcccccaa

SEQ ID NO: 1869371 - DNA, 21 bp, Homo sapiens
tcatggagcagcccccaaaga

SEQ ID NO: 1869372 - DNA, 16 bp, Homo sapiens
tcatgtatatttagtt

SEQ ID NO: 1869373 - DNA, 15 bp, Homo sapiens
tcatgtatgtatata

SEQ ID NO: 1869374 - DNA, 16 bp, Homo sapiens
tcatgtatgtatataa

SEQ ID NO: 1869375 - DNA, 21 bp, Homo sapiens
tcatgtcagaggtttggagcc

SEQ ID NO: 1869376 - DNA, 17 bp, Homo sapiens
tcattaaaatatatgtt

SEQ ID NO: 1869377 - DNA, 21 bp, Homo sapiens
tcattaaaatatatgttctgc

SEQ ID NO: 1869378 - DNA, 23 bp, Homo sapiens
tcattaaaatatatgttctgcaa

SEQ ID NO: 1869379 - DNA, 19 bp, Homo sapiens
tcattaaactctaaagatt

SEQ ID NO: 1869380 - DNA, 15 bp, Homo sapiens
tcattaaactgattc

SEQ ID NO: 1869381 - DNA, 12 bp, Homo sapiens
tcattaatctgt

SEQ ID NO: 1869382 - DNA, 12 bp, Homo sapiens
tcatttaagatt

SEQ ID NO: 1869383 - DNA, 21 bp, Homo sapiens
tccaaaataatctatattaaa

SEQ ID NO: 1869384 - DNA, 21 bp, Homo sapiens
tccaaaccagtttattctgtg

SEQ ID NO: 1869385 - DNA, 13 bp, Homo sapiens
tccaaattattaa

SEQ ID NO: 1869386 - DNA, 15 bp, Homo sapiens
tccaattctgaaata

SEQ ID NO: 1869387 - DNA, 17 bp, Homo sapiens
tccacggtcttctgcat

SEQ ID NO: 1869388 - DNA, 23 bp, Homo sapiens
tccaggagattggatttgctgtg

SEQ ID NO: 1869389 - DNA, 22 bp, Homo sapiens
tccaggtgtggaccggccgcag

SEQ ID NO: 1869390 - DNA, 13 bp, Homo sapiens
tccatgaaaatac

SEQ ID NO: 1869391 - DNA, 16 bp, Homo sapiens
tccatgtttgtaaaac

SEQ ID NO: 1869392 - DNA, 12 bp, Homo sapiens
tcccagaaatta

SEQ ID NO: 1869393 - DNA, 21 bp, Homo sapiens
tcccagagcacaagaaggcca

SEQ ID NO: 1869394 - DNA, 22 bp, Homo sapiens
tcccagagcacaagaaggccag

SEQ ID NO: 1869395 - DNA, 23 bp, Homo sapiens
tcccagagcacaagaaggccagc

SEQ ID NO: 1869396 - DNA, 13 bp, Homo sapiens
tcccagcctctgg

SEQ ID NO: 1869397 - DNA, 14 bp, Homo sapiens
tcccagcctctggg

SEQ ID NO: 1869398 - DNA, 17 bp, Homo sapiens
tcccaggtaatttaaat

SEQ ID NO: 1869399 - DNA, 18 bp, Homo sapiens
tcccaggtaatttaaatt

SEQ ID NO: 1869400 - DNA, 17 bp, Homo sapiens
tcccagtcccagcctct

SEQ ID NO: 1869401 - DNA, 19 bp, Homo sapiens
tcccagtcccagcctctgg

SEQ ID NO: 1869402 - DNA, 14 bp, Homo sapiens
tcccattttagaaa

SEQ ID NO: 1869403 - DNA, 19 bp, Homo sapiens
tcccattttagaaaatcag

SEQ ID NO: 1869404 - DNA, 23 bp, Homo sapiens
tcccattttagaaaatcagattt

SEQ ID NO: 1869405 - DNA, 14 bp, Homo sapiens
tccccaaaagaaac

SEQ ID NO: 1869406 - DNA, 16 bp, Homo sapiens
tccccaatccatgctt

SEQ ID NO: 1869407 - DNA, 17 bp, Homo sapiens
tcccccaggagcagctg

SEQ ID NO: 1869408 - DNA, 20 bp, Homo sapiens
tcccccaggagcagctggca

SEQ ID NO: 1869409 - DNA, 12 bp, Homo sapiens
tccccctgcagc

SEQ ID NO: 1869410 - DNA, 23 bp, Homo sapiens
tccccctgcagccgtgcaggact

SEQ ID NO: 1869411 - DNA, 20 bp, Homo sapiens
tccctccaaggctgtcttct

SEQ ID NO: 1869412 - DNA, 23 bp, Homo sapiens
tccctgaccaccctgcctgtgga

SEQ ID NO: 1869413 - DNA, 14 bp, Homo sapiens
tccctgcccaatcc

SEQ ID NO: 1869414 - DNA, 16 bp, Homo sapiens
tccctttttaaaaaat

SEQ ID NO: 1869415 - DNA, 18 bp, Homo sapiens
tccctttttaaaaaatac

SEQ ID NO: 1869416 - DNA, 14 bp, Homo sapiens
tccgacaccactgg

SEQ ID NO: 1869417 - DNA, 12 bp, Homo sapiens
tcctatatctgt

SEQ ID NO: 1869418 - DNA, 18 bp, Homo sapiens
tcctatatctgtttgtat

SEQ ID NO: 1869419 - DNA, 17 bp, Homo sapiens
tcctcccattttagaaa

SEQ ID NO: 1869420 - DNA, 21 bp, Homo sapiens
tcctcgggatgaaaagccata

SEQ ID NO: 1869421 - DNA, 17 bp, Homo sapiens
tcctcttgcatttcact

SEQ ID NO: 1869422 - DNA, 18 bp, Homo sapiens
tcctgatggtacaggaaa

SEQ ID NO: 1869423 - DNA, 23 bp, Homo sapiens
tcctgatggtacaggaaagctca

SEQ ID NO: 1869424 - DNA, 19 bp, Homo sapiens
tcctgcatgcataatgaac

SEQ ID NO: 1869425 - DNA, 21 bp, Homo sapiens
tcctgctccatcggggaatga

SEQ ID NO: 1869426 - DNA, 20 bp, Homo sapiens
tcctggaaccggtcacagga

SEQ ID NO: 1869427 - DNA, 20 bp, Homo sapiens
tcctgggcatgtttgtctgt

SEQ ID NO: 1869428 - DNA, 19 bp, Homo sapiens
tcctgggcttggtaagtga

SEQ ID NO: 1869429 - DNA, 13 bp, Homo sapiens
tcctgtctgttta

SEQ ID NO: 1869430 - DNA, 21 bp, Homo sapiens
tcctgttgtgtaataacagaa

SEQ ID NO: 1869431 - DNA, 17 bp, Homo sapiens
tccttctgttaagaaag

SEQ ID NO: 1869432 - DNA, 14 bp, Homo sapiens
tccttggagtgctg

SEQ ID NO: 1869433 - DNA, 11 bp, Homo sapiens
tcctttctatc

SEQ ID NO: 1869434 - DNA, 16 bp, Homo sapiens
tcgaattaatagcttt

SEQ ID NO: 1869435 - DNA, 15 bp, Homo sapiens
tcgagtctttgtgtg

SEQ ID NO: 1869436 - DNA, 14 bp, Homo sapiens
tcgcttgttttaaa

SEQ ID NO: 1869437 - DNA, 10 bp, Homo sapiens
tcggctgtga

SEQ ID NO: 1869438 - DNA, 12 bp, Homo sapiens
tcggctgtgagg

SEQ ID NO: 1869439 - DNA, 16 bp, Homo sapiens
tcgggatgaaaagcca

SEQ ID NO: 1869440 - DNA, 17 bp, Homo sapiens
tcgggatgaaaagccat

SEQ ID NO: 1869441 - DNA, 19 bp, Homo sapiens
tcgggatgaaaagccatat

SEQ ID NO: 1869442 - DNA, 22 bp, Homo sapiens
tcgggatgaaaagccatatcta

SEQ ID NO: 1869443 - DNA, 24 bp, Homo sapiens
tcggtcagaacaacttgctactta

SEQ ID NO: 1869444 - DNA, 19 bp, Homo sapiens
tcgtccacggtcttctgca

SEQ ID NO: 1869445 - DNA, 16 bp, Homo sapiens
tcgtgacagcctctga

SEQ ID NO: 1869446 - DNA, 23 bp, Homo sapiens
tcgtgacagcctctgactcacca

SEQ ID NO: 1869447 - DNA, 14 bp, Homo sapiens
tctaaattcactgt

SEQ ID NO: 1869448 - DNA, 19 bp, Homo sapiens
tctaagttgagtatattat

SEQ ID NO: 1869449 - DNA, 20 bp, Homo sapiens
tctaatatggcaaaaatggc

SEQ ID NO: 1869450 - DNA, 18 bp, Homo sapiens
tctaattagagaactgga

SEQ ID NO: 1869451 - DNA, 19 bp, Homo sapiens
tctaatttaccattatttt

SEQ ID NO: 1869452 - DNA, 14 bp, Homo sapiens
tctacattaaacaa

SEQ ID NO: 1869453 - DNA, 13 bp, Homo sapiens
tgtataaaaagga

SEQ ID NO: 1869454 - DNA, 21 bp, Homo sapiens
tgtataaattatgaaggacct

SEQ ID NO: 1869455 - DNA, 18 bp, Homo sapiens
tgtataacttcttaaaag

SEQ ID NO: 1869456 - DNA, 14 bp, Homo sapiens
tgtatactgtaaaa

SEQ ID NO: 1869457 - DNA, 21 bp, Homo sapiens
tgtatactgtaaaagttataa

SEQ ID NO: 1869458 - DNA, 16 bp, Homo sapiens
tgtatagtgtaaaata

SEQ ID NO: 1869459 - DNA, 20 bp, Homo sapiens
tgtatagttaggatagcatt

SEQ ID NO: 1869460 - DNA, 17 bp, Homo sapiens
tgtatatatctgcttca

SEQ ID NO: 1869461 - DNA, 14 bp, Homo sapiens
tgtatatcagaaaa

SEQ ID NO: 1869462 - DNA, 13 bp, Homo sapiens
tgtatatttgcaa

SEQ ID NO: 1869463 - DNA, 22 bp, Homo sapiens
tgtatatttgcaaaccctttgt

SEQ ID NO: 1869464 - DNA, 20 bp, Homo sapiens
tgtatctttggggaaactaa

SEQ ID NO: 1869465 - DNA, 21 bp, Homo sapiens
tgtatgtcagacatccatgtt

SEQ ID NO: 1869466 - DNA, 12 bp, Homo sapiens
tgtattaacaaa

SEQ ID NO: 1869467 - DNA, 15 bp, Homo sapiens
tgtattataattgtt

SEQ ID NO: 1869468 - DNA, 21 bp, Homo sapiens
tgtattataattgttgatatt

SEQ ID NO: 1869469 - DNA, 15 bp, Homo sapiens
tgtattgagtcttaa

SEQ ID NO: 1869470 - DNA, 15 bp, Homo sapiens
tgtattgcttcctga

SEQ ID NO: 1869471 - DNA, 13 bp, Homo sapiens
tgtatttcagtat

SEQ ID NO: 1869472 - DNA, 14 bp, Homo sapiens
tgtcaaaaaaaaaa

SEQ ID NO: 1869473 - DNA, 13 bp, Homo sapiens
tgtcaaatgaact

SEQ ID NO: 1869474 - DNA, 14 bp, Homo sapiens
tgtcaaatgaactt

SEQ ID NO: 1869475 - DNA, 21 bp, Homo sapiens
tgtcaaatgaacttttacaga

SEQ ID NO: 1869476 - DNA, 19 bp, Homo sapiens
tgtcagggcagtacaatgt

SEQ ID NO: 1869477 - DNA, 21 bp, Homo sapiens
tgtcccagtcccagcctctgg

SEQ ID NO: 1869478 - DNA, 10 bp, Homo sapiens
tgtcctgcat

SEQ ID NO: 1869479 - DNA, 14 bp, Homo sapiens
tgtcctgcatgcat

SEQ ID NO: 1869480 - DNA, 13 bp, Homo sapiens
tgtcctgtgtcta

SEQ ID NO: 1869481 - DNA, 16 bp, Homo sapiens
tgtcctgtgtctatgt

SEQ ID NO: 1869482 - DNA, 23 bp, Homo sapiens
tgtcctgtgtctatgtacctcta

SEQ ID NO: 1869483 - DNA, 13 bp, Homo sapiens
tgtcggctgtgag

SEQ ID NO: 1869484 - DNA, 15 bp, Homo sapiens
tgtctccaggtaact

SEQ ID NO: 1869485 - DNA, 22 bp, Homo sapiens
tgtctggttttaacaatttcct

SEQ ID NO: 1869486 - DNA, 15 bp, Homo sapiens
tgtctgtctgctctt

SEQ ID NO: 1869487 - DNA, 16 bp, Homo sapiens
tgtctgtctgctctta

SEQ ID NO: 1869488 - DNA, 12 bp, Homo sapiens
tgtctgtctttg

SEQ ID NO: 1869489 - DNA, 15 bp, Homo sapiens
tgtctgtctttgcaa

SEQ ID NO: 1869490 - DNA, 20 bp, Homo sapiens
tgtctgtgttgcttcaaatt

SEQ ID NO: 1869491 - DNA, 19 bp, Homo sapiens
tgtcttctcccagagcaca

SEQ ID NO: 1869492 - DNA, 20 bp, Homo sapiens
tgtcttgaaacctttctact

SEQ ID NO: 1869493 - DNA, 16 bp, Homo sapiens
tgtctttcaaaagaca

SEQ ID NO: 1869494 - DNA, 12 bp, Homo sapiens
tgtgaaagctgc

SEQ ID NO: 1869495 - DNA, 14 bp, Homo sapiens
tgtgaatttcaaaa

SEQ ID NO: 1869496 - DNA, 17 bp, Homo sapiens
tgtgaatttcaaaaaaa

SEQ ID NO: 1869497 - DNA, 18 bp, Homo sapiens
tgtgatggttgattcaca

SEQ ID NO: 1869498 - DNA, 21 bp, Homo sapiens
tgtgccatagagtttaacaca

SEQ ID NO: 1869499 - DNA, 17 bp, Homo sapiens
tgtgcctcccttttctc

SEQ ID NO: 1869500 - DNA, 18 bp, Homo sapiens
tgtgccttttatagctat

SEQ ID NO: 1869501 - DNA, 18 bp, Homo sapiens
tgtgctgctttgatatat

SEQ ID NO: 1869502 - DNA, 17 bp, Homo sapiens
tgtggaatttattggca

SEQ ID NO: 1869503 - DNA, 16 bp, Homo sapiens
tgtggaccggccgcag

SEQ ID NO: 1869504 - DNA, 18 bp, Homo sapiens
tgtggaccggccgcagcc

SEQ ID NO: 1869505 - DNA, 20 bp, Homo sapiens
tgtggaccggccgcagcccc

SEQ ID NO: 1869506 - DNA, 14 bp, Homo sapiens
tgtggcactgccac

SEQ ID NO: 1869507 - DNA, 15 bp, Homo sapiens
tgtggcactgccacc

SEQ ID NO: 1869508 - DNA, 16 bp, Homo sapiens
tgtggccatatatgct

SEQ ID NO: 1869509 - DNA, 12 bp, Homo sapiens
tgtggctggggg

SEQ ID NO: 1869510 - DNA, 18 bp, Homo sapiens
tgtgtaatagaaaactga

SEQ ID NO: 1869511 - DNA, 21 bp, Homo sapiens
tgtgtaatagaaaactgaaaa

SEQ ID NO: 1869512 - DNA, 19 bp, Homo sapiens
tgtgtaatctaagtatatg

SEQ ID NO: 1869513 - DNA, 18 bp, Homo sapiens
tgtgtatcattaaaatat

SEQ ID NO: 1869514 - DNA, 23 bp, Homo sapiens
tgtgtatgagactgtgtttctag

SEQ ID NO: 1869515 - DNA, 16 bp, Homo sapiens
tgtgtctatgtacctc

SEQ ID NO: 1869516 - DNA, 22 bp, Homo sapiens
tgtgtgcaccttaccaactttc

SEQ ID NO: 1869517 - DNA, 23 bp, Homo sapiens
tgtgtgccatagagtttaacaca

SEQ ID NO: 1869518 - DNA, 22 bp, Homo sapiens
tgtgttggctttacaaataatt

SEQ ID NO: 1869519 - DNA, 14 bp, Homo sapiens
tgtgttttaaaaaa

SEQ ID NO: 1869520 - DNA, 21 bp, Homo sapiens
tgtgttttaaaaaaactgaag

SEQ ID NO: 1869521 - DNA, 22 bp, Homo sapiens
tgtgttttaaaaaaactgaagg

SEQ ID NO: 1869522 - DNA, 16 bp, Homo sapiens
tgttaagaaaggatat

SEQ ID NO: 1869523 - DNA, 21 bp, Homo sapiens
tgttaagaaaggatataaaag

SEQ ID NO: 1869524 - DNA, 22 bp, Homo sapiens
tgttaagaaaggatataaaagg

SEQ ID NO: 1869525 - DNA, 23 bp, Homo sapiens
tgttacaagtttgctaaaagaag

SEQ ID NO: 1869526 - DNA, 19 bp, Homo sapiens
tgttactgcttctctttgt

SEQ ID NO: 1869527 - DNA, 19 bp, Homo sapiens
tgttaggtctcatgcccac

SEQ ID NO: 1869528 - DNA, 17 bp, Homo sapiens
tgttatagattgtctta

SEQ ID NO: 1869529 - DNA, 20 bp, Homo sapiens
tgttatagattgtcttaatg

SEQ ID NO: 1869530 - DNA, 21 bp, Homo sapiens
tgttatattccaaggaaaatt

SEQ ID NO: 1869531 - DNA, 12 bp, Homo sapiens
tgttatgaaaat

SEQ ID NO: 1869532 - DNA, 16 bp, Homo sapiens
tgttattaaaaaaaca

SEQ ID NO: 1869533 - DNA, 19 bp, Homo sapiens
tgttattaaaaaaacacaa

SEQ ID NO: 1869534 - DNA, 20 bp, Homo sapiens
tgttattaaaaaaacacaaa

SEQ ID NO: 1869535 - DNA, 17 bp, Homo sapiens
tgttattaatgtttctt

SEQ ID NO: 1869536 - DNA, 17 bp, Homo sapiens
tgttcactaaactctga

SEQ ID NO: 1869537 - DNA, 23 bp, Homo sapiens
tgttcctcgggatgaaaagccat

SEQ ID NO: 1869538 - DNA, 14 bp, Homo sapiens
tgttctgcaagaat

SEQ ID NO: 1869539 - DNA, 18 bp, Homo sapiens
tgttctgcaagaattaaa

SEQ ID NO: 1869540 - DNA, 21 bp, Homo sapiens
tgttctgcaagaattaaaact

SEQ ID NO: 1869541 - DNA, 22 bp, Homo sapiens
tgttctgcaagaattaaaactg

SEQ ID NO: 1869542 - DNA, 21 bp, Homo sapiens
tgttgaaaattattttaaaca

SEQ ID NO: 1869543 - DNA, 22 bp, Homo sapiens
tgttgaaaattattttaaacaa

SEQ ID NO: 1869544 - DNA, 22 bp, Homo sapiens
tgttggcacttataggtaacgt

SEQ ID NO: 1869545 - DNA, 15 bp, Homo sapiens
tgttggctttacaaa

SEQ ID NO: 1869546 - DNA, 13 bp, Homo sapiens
tgttgtaaaatgt

SEQ ID NO: 1869547 - DNA, 17 bp, Homo sapiens
tgttgtgtaataacaga

SEQ ID NO: 1869548 - DNA, 21 bp, Homo sapiens
tgttgttatcatttaagattt

SEQ ID NO: 1869549 - DNA, 11 bp, Homo sapiens
tgttgttttgt

SEQ ID NO: 1869550 - DNA, 17 bp, Homo sapiens
tgtttaaatgccaaaat

SEQ ID NO: 1869551 - DNA, 20 bp, Homo sapiens
tgtttaattcattaatctgt

SEQ ID NO: 1869552 - DNA, 16 bp, Homo sapiens
tgtttatatattgaaa

SEQ ID NO: 1869553 - DNA, 13 bp, Homo sapiens
tgtttgcttaatt

SEQ ID NO: 1869554 - DNA, 19 bp, Homo sapiens
tgtttggcactgatgcaat

SEQ ID NO: 1869555 - DNA, 16 bp, Homo sapiens
tgtttggtcgagtctt

SEQ ID NO: 1869556 - DNA, 19 bp, Homo sapiens
tgtttgtctgtgtgctgta

SEQ ID NO: 1869557 - DNA, 21 bp, Homo sapiens
tgttttaaagtcagatttgta

SEQ ID NO: 1869558 - DNA, 19 bp, Homo sapiens
ttaaaaaataccattgaaa

SEQ ID NO: 1869559 - DNA, 20 bp, Homo sapiens
ttaaaaaataccattgaaat

SEQ ID NO: 1869560 - DNA, 23 bp, Homo sapiens
ttaaaaactgtgtatcattaaaa

SEQ ID NO: 1869561 - DNA, 17 bp, Homo sapiens
ttaaaaataagttttat

SEQ ID NO: 1869562 - DNA, 20 bp, Homo sapiens
ttaaaaatatggaacttcta

SEQ ID NO: 1869563 - DNA, 14 bp, Homo sapiens
ttaaaaatcttggt

SEQ ID NO: 1869564 - DNA, 14 bp, Homo sapiens
ttaaaaatgaaaat

SEQ ID NO: 1869565 - DNA, 13 bp, Homo sapiens
ttaaaactgagtc

SEQ ID NO: 1869566 - DNA, 21 bp, Homo sapiens
ttaaaatattatttgatatct

SEQ ID NO: 1869567 - DNA, 15 bp, Homo sapiens
ttaaacaaaatttca

SEQ ID NO: 1869568 - DNA, 19 bp, Homo sapiens
ttaaacaaaatttcacagt

SEQ ID NO: 1869569 - DNA, 22 bp, Homo sapiens
tttgcttaatttccttctgtta

SEQ ID NO: 1869570 - DNA, 23 bp, Homo sapiens
tttgcttaatttccttctgttaa

SEQ ID NO: 1869571 - DNA, 18 bp, Homo sapiens
tttggaagaagtttttta

SEQ ID NO: 1869572 - DNA, 20 bp, Homo sapiens
tttggagccgggaaagctgt

SEQ ID NO: 1869573 - DNA, 14 bp, Homo sapiens
tttggcttgctgtt

SEQ ID NO: 1869574 - DNA, 14 bp, Homo sapiens
tttgggaaagctgc

SEQ ID NO: 1869575 - DNA, 19 bp, Homo sapiens
tttggggattcagatttct

SEQ ID NO: 1869576 - DNA, 15 bp, Homo sapiens
tttggtaaatttttg

SEQ ID NO: 1869577 - DNA, 19 bp, Homo sapiens
tttggtcgagtctttgtgt

SEQ ID NO: 1869578 - DNA, 13 bp, Homo sapiens
tttggttaaagta

SEQ ID NO: 1869579 - DNA, 17 bp, Homo sapiens
tttgtacaagattgtca

SEQ ID NO: 1869580 - DNA, 14 bp, Homo sapiens
tttgtaccatattg

SEQ ID NO: 1869581 - DNA, 17 bp, Homo sapiens
tttgtaccatattgctc

SEQ ID NO: 1869582 - DNA, 16 bp, Homo sapiens
tttgtagaataaatgg

SEQ ID NO: 1869583 - DNA, 17 bp, Homo sapiens
tttgtagaataaatggt

SEQ ID NO: 1869584 - DNA, 19 bp, Homo sapiens
tttgtaggggtcaaagaaa

SEQ ID NO: 1869585 - DNA, 18 bp, Homo sapiens
tttgtataaaaaggaaat

SEQ ID NO: 1869586 - DNA, 17 bp, Homo sapiens
tttgtatatttgcaaac

SEQ ID NO: 1869587 - DNA, 16 bp, Homo sapiens
tttgtattataattgt

SEQ ID NO: 1869588 - DNA, 17 bp, Homo sapiens
tttgtattataattgtt

SEQ ID NO: 1869589 - DNA, 13 bp, Homo sapiens
tttgtctaaacaa

SEQ ID NO: 1869590 - DNA, 19 bp, Homo sapiens
tttgtgtaatagaaaactg

SEQ ID NO: 1869591 - DNA, 19 bp, Homo sapiens
tttgtgtgttcactaaact

SEQ ID NO: 1869592 - DNA, 15 bp, Homo sapiens
tttgtgttttaaaaa

SEQ ID NO: 1869593 - DNA, 23 bp, Homo sapiens
tttgtgttttaaaaaaactgaag

SEQ ID NO: 1869594 - DNA, 20 bp, Homo sapiens
tttgttattttcagtatttt

SEQ ID NO: 1869595 - DNA, 11 bp, Homo sapiens
tttgtttgctt

SEQ ID NO: 1869596 - DNA, 14 bp, Homo sapiens
tttgtttgcttaat

SEQ ID NO: 1869597 - DNA, 15 bp, Homo sapiens
ttttaaaaaaactga

SEQ ID NO: 1869598 - DNA, 21 bp, Homo sapiens
ttttaaaaaatattttaagaa

SEQ ID NO: 1869599 - DNA, 23 bp, Homo sapiens
ttttaaaaataagttttatacat

SEQ ID NO: 1869600 - DNA, 20 bp, Homo sapiens
ttttaaaggaaaaatcataa

SEQ ID NO: 1869601 - DNA, 17 bp, Homo sapiens
ttttaaagtaaacttgt

SEQ ID NO: 1869602 - DNA, 14 bp, Homo sapiens
ttttaagaaagaga

SEQ ID NO: 1869603 - DNA, 16 bp, Homo sapiens
ttttaagtgcaacatt

SEQ ID NO: 1869604 - DNA, 16 bp, Homo sapiens
ttttaagtttgaaact

SEQ ID NO: 1869605 - DNA, 22 bp, Homo sapiens
ttttaatcagacaaagtaattc

SEQ ID NO: 1869606 - DNA, 17 bp, Homo sapiens
ttttaatgattgtttaa

SEQ ID NO: 1869607 - DNA, 19 bp, Homo sapiens
ttttaattaaaaactttaa

SEQ ID NO: 1869608 - DNA, 22 bp, Homo sapiens
ttttacagaatgcattaaaaaa

SEQ ID NO: 1869609 - DNA, 11 bp, Homo sapiens
ttttactttgg

SEQ ID NO: 1869610 - DNA, 12 bp, Homo sapiens
ttttactttggt

SEQ ID NO: 1869611 - DNA, 15 bp, Homo sapiens
ttttactttggttta

SEQ ID NO: 1869612 - DNA, 22 bp, Homo sapiens
ttttactttggtttagtctttt

SEQ ID NO: 1869613 - DNA, 19 bp, Homo sapiens
ttttagatgagattgtttt

SEQ ID NO: 1869614 - DNA, 20 bp, Homo sapiens
ttttagatgagattgtttta

SEQ ID NO: 1869615 - DNA, 16 bp, Homo sapiens
ttttaggttgttacca

SEQ ID NO: 1869616 - DNA, 13 bp, Homo sapiens
ttttatatttagt

SEQ ID NO: 1869617 - DNA, 14 bp, Homo sapiens
ttttatcaggattt

SEQ ID NO: 1869618 - DNA, 17 bp, Homo sapiens
ttttatcatgacatgtt

SEQ ID NO: 1869619 - DNA, 13 bp, Homo sapiens
ttttcaatttgga

SEQ ID NO: 1869620 - DNA, 16 bp, Homo sapiens
ttttcagtattttgga

SEQ ID NO: 1869621 - DNA, 14 bp, Homo sapiens
ttttcatagatttg

SEQ ID NO: 1869622 - DNA, 22 bp, Homo sapiens
ttttcatagatttgaaaaactt

SEQ ID NO: 1869623 - DNA, 17 bp, Homo sapiens
ttttcatccattaaaat

SEQ ID NO: 1869624 - DNA, 17 bp, Homo sapiens
ttttccagccttatgtg

SEQ ID NO: 1869625 - DNA, 19 bp, Homo sapiens
ttttccagccttatgtgtt

SEQ ID NO: 1869626 - DNA, 14 bp, Homo sapiens
ttttccctttttaa

SEQ ID NO: 1869627 - DNA, 22 bp, Homo sapiens
ttttctcttgccccaaatcaca

SEQ ID NO: 1869628 - DNA, 18 bp, Homo sapiens
ttttctgatatgtttgta

SEQ ID NO: 1869629 - DNA, 15 bp, Homo sapiens
ttttctggttccaaa

SEQ ID NO: 1869630 - DNA, 20 bp, Homo sapiens
ttttctggttccaaaccagt

SEQ ID NO: 1869631 - DNA, 22 bp, Homo sapiens
ttttcttttttaaagtaaactt

SEQ ID NO: 1869632 - DNA, 21 bp, Homo sapiens
ttttgaaagaattctattttg

SEQ ID NO: 1869633 - DNA, 20 bp, Homo sapiens
ttttgaataaaaagtgaact

SEQ ID NO: 1869634 - DNA, 22 bp, Homo sapiens
ttttgtaggggtcaaagaaatg

SEQ ID NO: 1869635 - DNA, 20 bp, Homo sapiens
ttttgttattaaaaaaacac

SEQ ID NO: 1869636 - DNA, 21 bp, Homo sapiens
ttttgttattaaaaaaacaca

SEQ ID NO: 1869637 - DNA, 12 bp, Homo sapiens
tttttaaaaaat

SEQ ID NO: 1869638 - DNA, 23 bp, Homo sapiens
tttttaaaaaataccattgaaat

SEQ ID NO: 1869639 - DNA, 16 bp, Homo sapiens
tttttaagtgcaacat

SEQ ID NO: 1869640 - DNA, 15 bp, Homo sapiens
tttttagcttcatat

SEQ ID NO: 1869641 - DNA, 11 bp, Homo sapiens
tttttccaaat

SEQ ID NO: 1869642 - DNA, 13 bp, Homo sapiens
tttttccatctgt

SEQ ID NO: 1869643 - DNA, 14 bp, Homo sapiens
tttttggtaattat

SEQ ID NO: 1869644 - DNA, 20 bp, Homo sapiens
tttttgtataaaaaggaaat

SEQ ID NO: 1869645 - DNA, 21 bp, Homo sapiens
tttttgtataaaaaggaaatt

SEQ ID NO: 1869646 - DNA, 13 bp, Homo sapiens
tttttttttccaa

SEQ ID NO: 1869647 - DNA, 15 bp, Homo sapiens
ataggaagacataaa

SEQ ID NO: 1869648 - DNA, 17 bp, Homo sapiens
ataggaagacataaaac

SEQ ID NO: 1869649 - DNA, 20 bp, Homo sapiens
ataggaagacataaaacttt

SEQ ID NO: 1869650 - DNA, 15 bp, Homo sapiens
ataggcagatcttta

SEQ ID NO: 1869651 - DNA, 17 bp, Homo sapiens
ataggcagatctttaaa

SEQ ID NO: 1869652 - DNA, 22 bp, Homo sapiens
ataggcagatctttaaatacag

SEQ ID NO: 1869653 - DNA, 21 bp, Homo sapiens
ataggtaacgtgattgattca

SEQ ID NO: 1869654 - DNA, 13 bp, Homo sapiens
atagtgtaaaata

SEQ ID NO: 1869655 - DNA, 23 bp, Homo sapiens
atagttaggatagcatttttgat

SEQ ID NO: 1869656 - DNA, 14 bp, Homo sapiens
atgacggccaggct

SEQ ID NO: 1869657 - DNA, 18 bp, Homo sapiens
atgagttacttagaatgc

SEQ ID NO: 1869658 - DNA, 22 bp, Homo sapiens
atgatggaaacgcacttacaag

SEQ ID NO: 1869659 - DNA, 18 bp, Homo sapiens
atgatgttaaatgccttg

SEQ ID NO: 1869660 - DNA, 14 bp, Homo sapiens
atgattgcactaaa

SEQ ID NO: 1869661 - DNA, 23 bp, Homo sapiens
atgattgcactaaataaactact

SEQ ID NO: 1869662 - DNA, 14 bp, Homo sapiens
atgattgtaaaata

SEQ ID NO: 1869663 - DNA, 11 bp, Homo sapiens
atgatttttag

SEQ ID NO: 1869664 - DNA, 14 bp, Homo sapiens
atgcaaaaacatat

SEQ ID NO: 1869665 - DNA, 24 bp, Homo sapiens
atgcaaaaacatatgtctgtcttt

SEQ ID NO: 1869666 - DNA, 15 bp, Homo sapiens
atgcaaactgcttta

SEQ ID NO: 1869667 - DNA, 16 bp, Homo sapiens
atgcaatgtatggctt

SEQ ID NO: 1869668 - DNA, 13 bp, Homo sapiens
atgcactctctct

SEQ ID NO: 1869669 - DNA, 17 bp, Homo sapiens
atgcactctctctctgt

SEQ ID NO: 1869670 - DNA, 22 bp, Homo sapiens
atgcaggtctgattcccagaaa

SEQ ID NO: 1869671 - DNA, 22 bp, Homo sapiens
atgcataatgaaccgtttacag

SEQ ID NO: 1869672 - DNA, 23 bp, Homo sapiens
atgcatggaaacctgaaaaaaag

SEQ ID NO: 1869673 - DNA, 12 bp, Homo sapiens
atgcattaaaaa

SEQ ID NO: 1869674 - DNA, 13 bp, Homo sapiens
atgcattaaaaaa

SEQ ID NO: 1869675 - DNA, 23 bp, Homo sapiens
atgccataaaattgcagtttcat

SEQ ID NO: 1869676 - DNA, 20 bp, Homo sapiens
atgcccactcccccaggagc

SEQ ID NO: 1869677 - DNA, 18 bp, Homo sapiens
atgccgtgtagtttctgg

SEQ ID NO: 1869678 - DNA, 20 bp, Homo sapiens
atgccttccgacaccactgg

SEQ ID NO: 1869679 - DNA, 21 bp, Homo sapiens
atgccttccgacaccactggg

SEQ ID NO: 1869680 - DNA, 13 bp, Homo sapiens
atgctcatgtata

SEQ ID NO: 1869681 - DNA, 23 bp, Homo sapiens
atgctgaggttttgaataaaaag

SEQ ID NO: 1869682 - DNA, 21 bp, Homo sapiens
atgctgtatttctttgtagaa

SEQ ID NO: 1869683 - DNA, 22 bp, Homo sapiens
atgctgtatttctttgtagaat

SEQ ID NO: 1869684 - DNA, 22 bp, Homo sapiens
atgctttttgaatgttatttgt

SEQ ID NO: 1869685 - DNA, 20 bp, Homo sapiens
atggaaacgcacttacaagt

SEQ ID NO: 1869686 - DNA, 16 bp, Homo sapiens
atggactgtgaatttc

SEQ ID NO: 1869687 - DNA, 21 bp, Homo sapiens
atggagactggtcctgtgtgc

SEQ ID NO: 1869688 - DNA, 19 bp, Homo sapiens
atggataacctatatgatt

SEQ ID NO: 1869689 - DNA, 19 bp, Homo sapiens
atggataagatgatgttaa

SEQ ID NO: 1869690 - DNA, 14 bp, Homo sapiens
atggataatcttcg

SEQ ID NO: 1869691 - DNA, 14 bp, Homo sapiens
atggcaaaaatggc

SEQ ID NO: 1869692 - DNA, 13 bp, Homo sapiens
atggcatggagac

SEQ ID NO: 1869693 - DNA, 12 bp, Homo sapiens
atggcctctggg

SEQ ID NO: 1869694 - DNA, 21 bp, Homo sapiens
atggcctctggggcaggacca

SEQ ID NO: 1869695 - DNA, 14 bp, Homo sapiens
atggctatatggca

SEQ ID NO: 1869696 - DNA, 16 bp, Homo sapiens
atggcttttctcttgc

SEQ ID NO: 1869697 - DNA, 17 bp, Homo sapiens
atgggaaaaagagactc

SEQ ID NO: 1869698 - DNA, 20 bp, Homo sapiens
atgggatatgattggttcag

SEQ ID NO: 1869699 - DNA, 18 bp, Homo sapiens
atggtagggtataatgtg

SEQ ID NO: 1869700 - DNA, 22 bp, Homo sapiens
atggtagggtataatgtgtctg

SEQ ID NO: 1869701 - DNA, 23 bp, Homo sapiens
atggtctgcatcagctttttgta

SEQ ID NO: 1869702 - DNA, 17 bp, Homo sapiens
atggttgccttaaagaa

SEQ ID NO: 1869703 - DNA, 13 bp, Homo sapiens
atgtaaagtatgt

SEQ ID NO: 1869704 - DNA, 17 bp, Homo sapiens
atgtaaagtatgtaaac

SEQ ID NO: 1869705 - DNA, 18 bp, Homo sapiens
atgtaaagtatgtaaaca

SEQ ID NO: 1869706 - DNA, 17 bp, Homo sapiens
atgtaaatagtgcagaa

SEQ ID NO: 1869707 - DNA, 20 bp, Homo sapiens
atgtacctctagctgttctt

SEQ ID NO: 1869708 - DNA, 17 bp, Homo sapiens
atgtactataacataga

SEQ ID NO: 1869709 - DNA, 14 bp, Homo sapiens
atgtacttaaatga

SEQ ID NO: 1869710 - DNA, 17 bp, Homo sapiens
atgtaggcacttttatt

SEQ ID NO: 1869711 - DNA, 19 bp, Homo sapiens
atgtatggcttttctcttg

SEQ ID NO: 1869712 - DNA, 21 bp, Homo sapiens
atgtccagagggactggacag

SEQ ID NO: 1869713 - DNA, 18 bp, Homo sapiens
atgtccctccaaggctgt

SEQ ID NO: 1869714 - DNA, 17 bp, Homo sapiens
atgtccttcagctgact

SEQ ID NO: 1869715 - DNA, 13 bp, Homo sapiens
atgtgctgctttg

SEQ ID NO: 1869716 - DNA, 20 bp, Homo sapiens
atgtgctgctttgatatata

SEQ ID NO: 1869717 - DNA, 14 bp, Homo sapiens
atgtgtccaagaca

SEQ ID NO: 1869718 - DNA, 20 bp, Homo sapiens
atgtgtctgtgttgcttcaa

SEQ ID NO: 1869719 - DNA, 18 bp, Homo sapiens
atgtgtgccatagagttt

SEQ ID NO: 1869720 - DNA, 20 bp, Homo sapiens
atgtgtgccatagagtttaa

SEQ ID NO: 1869721 - DNA, 22 bp, Homo sapiens
atgtgtgccatagagtttaaca

SEQ ID NO: 1869722 - DNA, 19 bp, Homo sapiens
atgttaaatgccttggttt

SEQ ID NO: 1869723 - DNA, 14 bp, Homo sapiens
atgttctgcaagaa

SEQ ID NO: 1869724 - DNA, 15 bp, Homo sapiens
atgttctgcaagaat

SEQ ID NO: 1869725 - DNA, 17 bp, Homo sapiens
atgttctgcaagaatta

SEQ ID NO: 1869726 - DNA, 18 bp, Homo sapiens
atgttctgcaagaattaa

SEQ ID NO: 1869727 - DNA, 20 bp, Homo sapiens
atgttctgcaagaattaaaa

SEQ ID NO: 1869728 - DNA, 23 bp, Homo sapiens
atgttctgcaagaattaaaactg

SEQ ID NO: 1869729 - DNA, 14 bp, Homo sapiens
atgtttgtacaaga

SEQ ID NO: 1869730 - DNA, 22 bp, Homo sapiens
atgttttatcgtccagtgactt

SEQ ID NO: 1869731 - DNA, 13 bp, Homo sapiens
attaaaaaaacac

SEQ ID NO: 1869732 - DNA, 14 bp, Homo sapiens
attaaaaaaacaca

SEQ ID NO: 1869733 - DNA, 18 bp, Homo sapiens
attaaaaaaacacaaaaa

SEQ ID NO: 1869734 - DNA, 14 bp, Homo sapiens
attaaaaatatgga

SEQ ID NO: 1869735 - DNA, 14 bp, Homo sapiens
attaaaactgagtc

SEQ ID NO: 1869736 - DNA, 17 bp, Homo sapiens
attaaaactgagtccat

SEQ ID NO: 1869737 - DNA, 20 bp, Homo sapiens
attaaaactgagtccatgaa

SEQ ID NO: 1869738 - DNA, 16 bp, Homo sapiens
attaaaatatatgttc

SEQ ID NO: 1869739 - DNA, 17 bp, Homo sapiens
attaaaatatatgttct

SEQ ID NO: 1869740 - DNA, 15 bp, Homo sapiens
attaaaatattattt

SEQ ID NO: 1869741 - DNA, 22 bp, Homo sapiens
attaaaatattatttgatatct

SEQ ID NO: 1869742 - DNA, 19 bp, Homo sapiens
attaaaatgattgtaaaat

SEQ ID NO: 1869743 - DNA, 20 bp, Homo sapiens
attaaaatgattgtaaaata

SEQ ID NO: 1869744 - DNA, 15 bp, Homo sapiens
attaaatcatactcc

SEQ ID NO: 1869745 - DNA, 14 bp, Homo sapiens
attaactaaatgct

SEQ ID NO: 1869746 - DNA, 20 bp, Homo sapiens
attaatcttttaaaaatgat

SEQ ID NO: 1869747 - DNA, 12 bp, Homo sapiens
attaatgctttg

SEQ ID NO: 1869748 - DNA, 16 bp, Homo sapiens
attaattattttccaa

SEQ ID NO: 1869749 - DNA, 18 bp, Homo sapiens
attaattgtcctgtgtct

SEQ ID NO: 1869750 - DNA, 16 bp, Homo sapiens
attacaataaatcctt

SEQ ID NO: 1869751 - DNA, 20 bp, Homo sapiens
attaccttgtctttcaaaag

SEQ ID NO: 1869752 - DNA, 18 bp, Homo sapiens
attactgtctggttttaa

SEQ ID NO: 1869753 - DNA, 20 bp, Homo sapiens
attagaatggataagatgat

SEQ ID NO: 1869754 - DNA, 13 bp, Homo sapiens
attagcagaatgg

SEQ ID NO: 1869755 - DNA, 17 bp, Homo sapiens
attagcagaatggagaa

SEQ ID NO: 1869756 - DNA, 21 bp, Homo sapiens
attagcagaatggagaaagta

SEQ ID NO: 1869757 - DNA, 17 bp, Homo sapiens
attagtactggattatt

SEQ ID NO: 1869758 - DNA, 14 bp, Homo sapiens
attataccatgtgt

SEQ ID NO: 1869759 - DNA, 18 bp, Homo sapiens
attatgaaggacctgaaa

SEQ ID NO: 1869760 - DNA, 14 bp, Homo sapiens
attattaatgcttt

SEQ ID NO: 1869761 - DNA, 20 bp, Homo sapiens
attattaattgtcctgtgtc

SEQ ID NO: 1869762 - DNA, 15 bp, Homo sapiens
attattcaggcttta

SEQ ID NO: 1869763 - DNA, 21 bp, Homo sapiens
attatttaataaaaaaacaat

SEQ ID NO: 1869764 - DNA, 12 bp, Homo sapiens
attatttgatat

SEQ ID NO: 1869765 - DNA, 17 bp, Homo sapiens
attatttgtgtaataga

SEQ ID NO: 1869766 - DNA, 20 bp, Homo sapiens
attatttgtgtaatagaaaa

SEQ ID NO: 1869767 - DNA, 13 bp, Homo sapiens
attattttaaaca

SEQ ID NO: 1869768 - DNA, 18 bp, Homo sapiens
attattttccaaaatcta

SEQ ID NO: 1869769 - DNA, 20 bp, Homo sapiens
attcactgttgaatgcctgt

SEQ ID NO: 1869770 - DNA, 19 bp, Homo sapiens
cagctgactccagtataat

SEQ ID NO: 1869771 - DNA, 21 bp, Homo sapiens
cagctgagagacttttaatca

SEQ ID NO: 1869772 - DNA, 19 bp, Homo sapiens
cagctggcactgacagcct

SEQ ID NO: 1869773 - DNA, 21 bp, Homo sapiens
cagctggcactgacagcctgg

SEQ ID NO: 1869774 - DNA, 22 bp, Homo sapiens
cagctggcactgacagcctggg

SEQ ID NO: 1869775 - DNA, 20 bp, Homo sapiens
cagctgtaacacagctgaga

SEQ ID NO: 1869776 - DNA, 15 bp, Homo sapiens
cagcttcccctcact

SEQ ID NO: 1869777 - DNA, 21 bp, Homo sapiens
cagcttcctgtctgtttatat

SEQ ID NO: 1869778 - DNA, 15 bp, Homo sapiens
caggaaccctggaga

SEQ ID NO: 1869779 - DNA, 20 bp, Homo sapiens
caggactgggccgggcccag

SEQ ID NO: 1869780 - DNA, 21 bp, Homo sapiens
caggagattggatttgctgtg

SEQ ID NO: 1869781 - DNA, 13 bp, Homo sapiens
aaaaaaaaaaact

SEQ ID NO: 1869782 - DNA, 12 bp, Homo sapiens
aaaaaaaaactc

SEQ ID NO: 1869783 - DNA, 13 bp, Homo sapiens
aaaaaaaaagact

SEQ ID NO: 1869784 - DNA, 13 bp, Homo sapiens
aaaaaaaactctt

SEQ ID NO: 1869785 - DNA, 11 bp, Homo sapiens
aaaaaaactga

SEQ ID NO: 1869786 - DNA, 13 bp, Homo sapiens
aaaaaaagactgt

SEQ ID NO: 1869787 - DNA, 12 bp, Homo sapiens
aaaaaactgaag

SEQ ID NO: 1869788 - DNA, 12 bp, Homo sapiens
aaaaaagaacct

SEQ ID NO: 1869789 - DNA, 13 bp, Homo sapiens
aaaaactcctgtg

SEQ ID NO: 1869790 - DNA, 23 bp, Homo sapiens
aaaaactcctgtgtcggtcagaa

SEQ ID NO: 1869791 - DNA, 19 bp, Homo sapiens
aaaaactctttaacttgta

SEQ ID NO: 1869792 - DNA, 20 bp, Homo sapiens
aaaaactctttaacttgtaa

SEQ ID NO: 1869793 - DNA, 11 bp, Homo sapiens
aaaaactgaag

SEQ ID NO: 1869794 - DNA, 21 bp, Homo sapiens
aaaaactgtgtatcattaaaa

SEQ ID NO: 1869795 - DNA, 15 bp, Homo sapiens
aaaaagactgtcaaa

SEQ ID NO: 1869796 - DNA, 14 bp, Homo sapiens
aaaaagtgaacttt

SEQ ID NO: 1869797 - DNA, 18 bp, Homo sapiens
aaagtattcagaaattaa

SEQ ID NO: 1869798 - DNA, 21 bp, Homo sapiens
aaagtattcagaaattaaaat

SEQ ID NO: 1869799 - DNA, 15 bp, Homo sapiens
aaagtcgaattaata

SEQ ID NO: 1869800 - DNA, 12 bp, Homo sapiens
aaagtgaacttt

SEQ ID NO: 1869801 - DNA, 13 bp, Homo sapiens
aaagtgaactttt

SEQ ID NO: 1869802 - DNA, 16 bp, Homo sapiens
aaagtgaacttttgta

SEQ ID NO: 1869803 - DNA, 19 bp, Homo sapiens
aaagtgaacttttgtaatt

SEQ ID NO: 1869804 - DNA, 12 bp, Homo sapiens
aaagtgcattta

SEQ ID NO: 1869805 - DNA, 22 bp, Homo sapiens
aaagttactggctctttgtgtg

SEQ ID NO: 1869806 - DNA, 15 bp, Homo sapiens
aaagttgcttttatt

SEQ ID NO: 1869807 - DNA, 18 bp, Homo sapiens
aaagttgtgattccagat

SEQ ID NO: 1869808 - DNA, 19 bp, Homo sapiens
aaagtttacaagtgtatat

SEQ ID NO: 1869809 - DNA, 19 bp, Homo sapiens
aaataagttttatacataa

SEQ ID NO: 1869810 - DNA, 22 bp, Homo sapiens
aaataagttttatacataaaca

SEQ ID NO: 1869811 - DNA, 15 bp, Homo sapiens
aaataattttttgca

SEQ ID NO: 1869812 - DNA, 17 bp, Homo sapiens
aaataccattgaaatca

SEQ ID NO: 1869813 - DNA, 15 bp, Homo sapiens
aaatagaaagagttc

SEQ ID NO: 1869814 - DNA, 23 bp, Homo sapiens
aaatagaaagagttctatggaga

SEQ ID NO: 1869815 - DNA, 16 bp, Homo sapiens
aaatagcttgtatagt

SEQ ID NO: 1869816 - DNA, 22 bp, Homo sapiens
aaatatatgttctgcaagaatt

SEQ ID NO: 1869817 - DNA, 20 bp, Homo sapiens
aaatatggaacttctaatat

SEQ ID NO: 1869818 - DNA, 15 bp, Homo sapiens
aaatattatttgata

SEQ ID NO: 1869819 - DNA, 12 bp, Homo sapiens
aaatattggtta

SEQ ID NO: 1869820 - DNA, 23 bp, Homo sapiens
aagattttttttttaagtgacat

SEQ ID NO: 1869821 - DNA, 17 bp, Homo sapiens
aagcaacctttcccttc

SEQ ID NO: 1869822 - DNA, 22 bp, Homo sapiens
aagcaatttatatctttatgca

SEQ ID NO: 1869823 - DNA, 23 bp, Homo sapiens
aagcaatttatatctttatgcaa

SEQ ID NO: 1869824 - DNA, 16 bp, Homo sapiens
aagcagattacaataa

SEQ ID NO: 1869825 - DNA, 14 bp, Homo sapiens
aagcagcaattaat

SEQ ID NO: 1869826 - DNA, 15 bp, Homo sapiens
aagccacaagaaatt

SEQ ID NO: 1869827 - DNA, 15 bp, Homo sapiens
aagccacactttgaa

SEQ ID NO: 1869828 - DNA, 23 bp, Homo sapiens
aagccaggagaagacccctgccc

SEQ ID NO: 1869829 - DNA, 17 bp, Homo sapiens
aagctcagctactgatt

SEQ ID NO: 1869830 - DNA, 12 bp, Homo sapiens
aagctcatattt

SEQ ID NO: 1869831 - DNA, 20 bp, Homo sapiens
aagctcatattttgtatata

SEQ ID NO: 1869832 - DNA, 23 bp, Homo sapiens
aagctgtagtagccctttctgtg

SEQ ID NO: 1869833 - DNA, 22 bp, Homo sapiens
aagcttacccttggtttgcaca

SEQ ID NO: 1869834 - DNA, 23 bp, Homo sapiens
aagcttacccttggtttgcacat

SEQ ID NO: 1869835 - DNA, 22 bp, Homo sapiens
aagcttgatttgatctttgttt

SEQ ID NO: 1869836 - DNA, 13 bp, Homo sapiens
aagctttatcttt

SEQ ID NO: 1869837 - DNA, 16 bp, Homo sapiens
aagctttatctttgtg

SEQ ID NO: 1869838 - DNA, 12 bp, Homo sapiens
aaggatcttttg

SEQ ID NO: 1869839 - DNA, 14 bp, Homo sapiens
aaggatcttttgta

SEQ ID NO: 1869840 - DNA, 16 bp, Homo sapiens
aaggatgttacaagtt

SEQ ID NO: 1869841 - DNA, 22 bp, Homo sapiens
aaggatgttacaagtttgctaa

SEQ ID NO: 1869842 - DNA, 12 bp, Homo sapiens
aaggcaaaagac

SEQ ID NO: 1869843 - DNA, 23 bp, Homo sapiens
aaggcaaaagactggtttgtttg

SEQ ID NO: 1869844 - DNA, 23 bp, Homo sapiens
aaggccacaaaagttccctctca

SEQ ID NO: 1869845 - DNA, 14 bp, Homo sapiens
aaggccagcccact

SEQ ID NO: 1869846 - DNA, 15 bp, Homo sapiens
aaggccagcccactg

SEQ ID NO: 1869847 - DNA, 21 bp, Homo sapiens
aaggctgtcttctcccagagc

SEQ ID NO: 1869848 - DNA, 22 bp, Homo sapiens
aaggctgtcttctcccagagca

SEQ ID NO: 1869849 - DNA, 13 bp, Homo sapiens
aagggaaagctgt

SEQ ID NO: 1869850 - DNA, 15 bp, Homo sapiens
aagggagaaatgcca

SEQ ID NO: 1869851 - DNA, 18 bp, Homo sapiens
aagggccctcactcagga

SEQ ID NO: 1869852 - DNA, 17 bp, Homo sapiens
aaggtaataaatacaca

SEQ ID NO: 1869853 - DNA, 21 bp, Homo sapiens
aaggtaatgtagggttatatt

SEQ ID NO: 1869854 - DNA, 20 bp, Homo sapiens
aaggtaatttttttttgtaa

SEQ ID NO: 1869855 - DNA, 18 bp, Homo sapiens
aaggtaggttttaaaaat

SEQ ID NO: 1869856 - DNA, 19 bp, Homo sapiens
aaggtaggttttaaaaata

SEQ ID NO: 1869857 - DNA, 13 bp, Homo sapiens
aaggtgtcatttg

SEQ ID NO: 1869858 - DNA, 16 bp, Homo sapiens
aaggtgtcatttgaca

SEQ ID NO: 1869859 - DNA, 17 bp, Homo sapiens
aaggttttttttttaag

SEQ ID NO: 1869860 - DNA, 21 bp, Homo sapiens
aaggttttttttttaagtgca

SEQ ID NO: 1869861 - DNA, 16 bp, Homo sapiens
aagtaaacttgtgtat

SEQ ID NO: 1869862 - DNA, 22 bp, Homo sapiens
aagtaagtcttttttttttcca

SEQ ID NO: 1869863 - DNA, 15 bp, Homo sapiens
aagtatatgtgagaa

SEQ ID NO: 1869864 - DNA, 21 bp, Homo sapiens
aagtatgtaaacaggagacag

SEQ ID NO: 1869865 - DNA, 13 bp, Homo sapiens
aagtattcagaaa

SEQ ID NO: 1869866 - DNA, 16 bp, Homo sapiens
aagtattcagaaatta

SEQ ID NO: 1869867 - DNA, 17 bp, Homo sapiens
aagtattcagaaattaa

SEQ ID NO: 1869868 - DNA, 19 bp, Homo sapiens
aagtattcagaaattaaaa

SEQ ID NO: 1869869 - DNA, 15 bp, Homo sapiens
aagtatttttgaaag

SEQ ID NO: 1869870 - DNA, 22 bp, Homo sapiens
aagtatttttgaaagaattcta

SEQ ID NO: 1869871 - DNA, 23 bp, Homo sapiens
aagtcacctacaggactgggccg

SEQ ID NO: 1869872 - DNA, 13 bp, Homo sapiens
aagtcctgctttc

SEQ ID NO: 1869873 - DNA, 15 bp, Homo sapiens
aagtcgagcactcta

SEQ ID NO: 1869874 - DNA, 16 bp, Homo sapiens
aagtcgagcactctaa

SEQ ID NO: 1869875 - DNA, 20 bp, Homo sapiens
aagtgaaacgtaattgtaca

SEQ ID NO: 1869876 - DNA, 19 bp, Homo sapiens
aagtgaacttttgtaattt

SEQ ID NO: 1869877 - DNA, 22 bp, Homo sapiens
aagtgaacttttgtaatttgaa

SEQ ID NO: 1869878 - DNA, 16 bp, Homo sapiens
aagtgcaacatttctg

SEQ ID NO: 1869879 - DNA, 17 bp, Homo sapiens
aagtgcatttaaggaga

SEQ ID NO: 1869880 - DNA, 23 bp, Homo sapiens
aagtgtatatcagaaaagggaag

SEQ ID NO: 1869881 - DNA, 20 bp, Homo sapiens
aagttactggctctttgtgt

SEQ ID NO: 1869882 - DNA, 11 bp, Homo sapiens
aagttataata

SEQ ID NO: 1869883 - DNA, 15 bp, Homo sapiens
aagtttgctaaaaga

SEQ ID NO: 1869884 - DNA, 17 bp, Homo sapiens
aagtttgctaaaagaag

SEQ ID NO: 1869885 - DNA, 18 bp, Homo sapiens
aagtttgctaaaagaaga

SEQ ID NO: 1869886 - DNA, 16 bp, Homo sapiens
aataaaaagtgaactt

SEQ ID NO: 1869887 - DNA, 15 bp, Homo sapiens
aataaactctaaaca

SEQ ID NO: 1869888 - DNA, 17 bp, Homo sapiens
aataaatcctttacttt

SEQ ID NO: 1869889 - DNA, 14 bp, Homo sapiens
aataactctgattt

SEQ ID NO: 1869890 - DNA, 13 bp, Homo sapiens
aataactgaactg

SEQ ID NO: 1869891 - DNA, 19 bp, Homo sapiens
aataactgaactgtttggt

SEQ ID NO: 1869892 - DNA, 22 bp, Homo sapiens
aataagaagggggagtgaaaca

SEQ ID NO: 1869893 - DNA, 20 bp, Homo sapiens
aataattttttgcagtcttt

SEQ ID NO: 1869894 - DNA, 18 bp, Homo sapiens
aatacaacagaagttata

SEQ ID NO: 1869895 - DNA, 18 bp, Homo sapiens
aataccattgaaatcagc

SEQ ID NO: 1869896 - DNA, 13 bp, Homo sapiens
aatagaaaactga

SEQ ID NO: 1869897 - DNA, 17 bp, Homo sapiens
aatagaaaactgaaaat

SEQ ID NO: 1869898 - DNA, 19 bp, Homo sapiens
aatagcttgtatagtgtaa

SEQ ID NO: 1869899 - DNA, 23 bp, Homo sapiens
aataggatgaatgggaaagtatt

SEQ ID NO: 1869900 - DNA, 18 bp, Homo sapiens
aatagggctaggaatata

SEQ ID NO: 1869901 - DNA, 19 bp, Homo sapiens
aatagtgcagaatctcata

SEQ ID NO: 1869902 - DNA, 16 bp, Homo sapiens
aatatactttttttgt

SEQ ID NO: 1869903 - DNA, 23 bp, Homo sapiens
aatatatacagattcctgttgtg

SEQ ID NO: 1869904 - DNA, 15 bp, Homo sapiens
aatatatgttctgca

SEQ ID NO: 1869905 - DNA, 22 bp, Homo sapiens
aatatatgttctgcaagaatta

SEQ ID NO: 1869906 - DNA, 15 bp, Homo sapiens
aatatatttttatat

SEQ ID NO: 1869907 - DNA, 16 bp, Homo sapiens
ataattgttgatattt

SEQ ID NO: 1869908 - DNA, 18 bp, Homo sapiens
ataatttaaagaaacact

SEQ ID NO: 1869909 - DNA, 17 bp, Homo sapiens
ataatttgcaatttcag

SEQ ID NO: 1869910 - DNA, 22 bp, Homo sapiens
ataattttttgcagtcttttgc

SEQ ID NO: 1869911 - DNA, 19 bp, Homo sapiens
atacaaaaaaaatctttaa

SEQ ID NO: 1869912 - DNA, 19 bp, Homo sapiens
atacaatccgagctacaaa

SEQ ID NO: 1869913 - DNA, 18 bp, Homo sapiens
atacacagttaaataaat

SEQ ID NO: 1869914 - DNA, 13 bp, Homo sapiens
atacataaacagt

SEQ ID NO: 1869915 - DNA, 14 bp, Homo sapiens
atacataaacagtt

SEQ ID NO: 1869916 - DNA, 19 bp, Homo sapiens
ataccagtcacctcctgct

SEQ ID NO: 1869917 - DNA, 17 bp, Homo sapiens
atacccaacagtttatt

SEQ ID NO: 1869918 - DNA, 16 bp, Homo sapiens
atactgtaaaagttat

SEQ ID NO: 1869919 - DNA, 17 bp, Homo sapiens
atactgtaaaagttata

SEQ ID NO: 1869920 - DNA, 23 bp, Homo sapiens
atactgtaaaagttataataact

SEQ ID NO: 1869921 - DNA, 24 bp, Homo sapiens
atactgtaaaagttataataactg

SEQ ID NO: 1869922 - DNA, 15 bp, Homo sapiens
atagaaagagttcta

SEQ ID NO: 1869923 - DNA, 16 bp, Homo sapiens
atagaagctgtagtag

SEQ ID NO: 1869924 - DNA, 21 bp, Homo sapiens
atagagcacctagtccagtga

SEQ ID NO: 1869925 - DNA, 14 bp, Homo sapiens
atagagggccaaga

SEQ ID NO: 1869926 - DNA, 16 bp, Homo sapiens
atagaggggttttaga

SEQ ID NO: 1869927 - DNA, 18 bp, Homo sapiens
atagaggtgatgctgcta

SEQ ID NO: 1869928 - DNA, 16 bp, Homo sapiens
atagagtttaacacaa

SEQ ID NO: 1869929 - DNA, 13 bp, Homo sapiens
atagattgtgaat

SEQ ID NO: 1869930 - DNA, 13 bp, Homo sapiens
atagatttgaaaa

SEQ ID NO: 1869931 - DNA, 19 bp, Homo sapiens
atagatttgaaaaactttt

SEQ ID NO: 1869932 - DNA, 20 bp, Homo sapiens
atagcgggttactttcacat

SEQ ID NO: 1869933 - DNA, 18 bp, Homo sapiens
atagctattactgtctgg

SEQ ID NO: 1869934 - DNA, 14 bp, Homo sapiens
atagcttttattgt

SEQ ID NO: 1869935 - DNA, 18 bp, Homo sapiens
atagcttttattgtataa

SEQ ID NO: 1869936 - DNA, 23 bp, Homo sapiens
ataggaagacataaaactttaaa

SEQ ID NO: 1869937 - DNA, 14 bp, Homo sapiens
ataggcagatcttt

SEQ ID NO: 1869938 - DNA, 15 bp, Homo sapiens
ataggtaacgtgatt

SEQ ID NO: 1869939 - DNA, 17 bp, Homo sapiens
atagtagaaagacatct

SEQ ID NO: 1869940 - DNA, 23 bp, Homo sapiens
atagtagaaagacatctgcctgt

SEQ ID NO: 1869941 - DNA, 22 bp, Homo sapiens
atagtcaatatggggcattaat

SEQ ID NO: 1869942 - DNA, 14 bp, Homo sapiens
atagtgtaaaataa

SEQ ID NO: 1869943 - DNA, 13 bp, Homo sapiens
atagtttgtacat

SEQ ID NO: 1869944 - DNA, 14 bp, Homo sapiens
atataacacttaac

SEQ ID NO: 1869945 - DNA, 23 bp, Homo sapiens
atataatcatgctcatgtatatt

SEQ ID NO: 1869946 - DNA, 21 bp, Homo sapiens
atataatcttggcttcttaaa

SEQ ID NO: 1869947 - DNA, 14 bp, Homo sapiens
atataatttaaaga

SEQ ID NO: 1869948 - DNA, 15 bp, Homo sapiens
atatagattaaatca

SEQ ID NO: 1869949 - DNA, 19 bp, Homo sapiens
atatatctcaaattgtaat

SEQ ID NO: 1869950 - DNA, 17 bp, Homo sapiens
atatatctgcttcagtg

SEQ ID NO: 1869951 - DNA, 16 bp, Homo sapiens
atatatgctgtatttc

SEQ ID NO: 1869952 - DNA, 18 bp, Homo sapiens
atatatgctgtatttctt

SEQ ID NO: 1869953 - DNA, 13 bp, Homo sapiens
atatatgttctgc

SEQ ID NO: 1869954 - DNA, 18 bp, Homo sapiens
atatatgttctgcaagaa

SEQ ID NO: 1869955 - DNA, 20 bp, Homo sapiens
atatattgaaagttgctttt

SEQ ID NO: 1869956 - DNA, 17 bp, Homo sapiens
atatcagaaaagggaag

SEQ ID NO: 1869957 - DNA, 14 bp, Homo sapiens
atatcatattggta

SEQ ID NO: 1869958 - DNA, 19 bp, Homo sapiens
atatcatattggtattcac

SEQ ID NO: 1869959 - DNA, 15 bp, Homo sapiens
atatctaatttacca

SEQ ID NO: 1869960 - DNA, 14 bp, Homo sapiens
atatcttgttatta

SEQ ID NO: 1869961 - DNA, 21 bp, Homo sapiens
atatcttgttattaatgtttc

SEQ ID NO: 1869962 - DNA, 12 bp, Homo sapiens
atatgatttata

SEQ ID NO: 1869963 - DNA, 19 bp, Homo sapiens
atatgctgtatttctttgt

SEQ ID NO: 1869964 - DNA, 20 bp, Homo sapiens
atatggaacttctaatatat

SEQ ID NO: 1869965 - DNA, 18 bp, Homo sapiens
atatggcaagaaagctgg

SEQ ID NO: 1869966 - DNA, 13 bp, Homo sapiens
atatgttctgcaa

SEQ ID NO: 1869967 - DNA, 20 bp, Homo sapiens
atattaaatgagggtttctg

SEQ ID NO: 1869968 - DNA, 18 bp, Homo sapiens
atattaattattttccaa

SEQ ID NO: 1869969 - DNA, 16 bp, Homo sapiens
atattatttgatatct

SEQ ID NO: 1869970 - DNA, 15 bp, Homo sapiens
atattcagagaaaac

SEQ ID NO: 1869971 - DNA, 16 bp, Homo sapiens
atattccaaggaaaat

SEQ ID NO: 1869972 - DNA, 18 bp, Homo sapiens
atattctaaattcactgt

SEQ ID NO: 1869973 - DNA, 12 bp, Homo sapiens
atattgctaaaa

SEQ ID NO: 1869974 - DNA, 15 bp, Homo sapiens
atattgctaaaagtg

SEQ ID NO: 1869975 - DNA, 16 bp, Homo sapiens
atattgctaccaaaaa

SEQ ID NO: 1869976 - DNA, 13 bp, Homo sapiens
atattgctcttaa

SEQ ID NO: 1869977 - DNA, 16 bp, Homo sapiens
atattgctcttaaaaa

SEQ ID NO: 1869978 - DNA, 17 bp, Homo sapiens
atatttaaaaaattaaa

SEQ ID NO: 1869979 - DNA, 23 bp, Homo sapiens
atatttactaagccacaagaaat

SEQ ID NO: 1869980 - DNA, 22 bp, Homo sapiens
atatttagttatagtttcagat

SEQ ID NO: 1869981 - DNA, 11 bp, Homo sapiens
atatttgcaaa

SEQ ID NO: 1869982 - DNA, 13 bp, Homo sapiens
atattttaagaaa

SEQ ID NO: 1869983 - DNA, 14 bp, Homo sapiens
atattttaagaaag

SEQ ID NO: 1869984 - DNA, 17 bp, Homo sapiens
atattttaagaaagaga

SEQ ID NO: 1869985 - DNA, 18 bp, Homo sapiens
atattttccctttttaaa

SEQ ID NO: 1869986 - DNA, 14 bp, Homo sapiens
atattttgtatata

SEQ ID NO: 1869987 - DNA, 15 bp, Homo sapiens
atcaacacttttctc

SEQ ID NO: 1869988 - DNA, 19 bp, Homo sapiens
atcaatcatctgtgtgaaa

SEQ ID NO: 1869989 - DNA, 15 bp, Homo sapiens
atcaattcattgtgt

SEQ ID NO: 1869990 - DNA, 19 bp, Homo sapiens
atcaattcattgtgtatga

SEQ ID NO: 1869991 - DNA, 18 bp, Homo sapiens
atcactggtatacacact

SEQ ID NO: 1869992 - DNA, 13 bp, Homo sapiens
atcacttttcagt

SEQ ID NO: 1869993 - DNA, 22 bp, Homo sapiens
atcagaagaccacaaaaattga

SEQ ID NO: 1869994 - DNA, 16 bp, Homo sapiens
atcagacttgcggcca

SEQ ID NO: 1869995 - DNA, 19 bp, Homo sapiens
atcagacttgcggccacag

SEQ ID NO: 1869996 - DNA, 21 bp, Homo sapiens
atcagatgctgaattgagaat

SEQ ID NO: 1869997 - DNA, 17 bp, Homo sapiens
atcagattttctcctgt

SEQ ID NO: 1869998 - DNA, 16 bp, Homo sapiens
atcagcatgacaaaaa

SEQ ID NO: 1869999 - DNA, 17 bp, Homo sapiens
atcagcatgacaaaaat

SEQ ID NO: 1870000 - DNA, 20 bp, Homo sapiens
atcagcatgacaaaaataac

SEQ ID NO: 1870001 - DNA, 23 bp, Homo sapiens
atcagcatgacaaaaataacact

SEQ ID NO: 1870002 - DNA, 22 bp, Homo sapiens
atcagctattcccttctgatct

SEQ ID NO: 1870003 - DNA, 23 bp, Homo sapiens
atcagctttttgtattaacaaag

SEQ ID NO: 1870004 - DNA, 19 bp, Homo sapiens
atcagtaaacactgtgtat

SEQ ID NO: 1870005 - DNA, 22 bp, Homo sapiens
atcatattaattattttccaaa

SEQ ID NO: 1870006 - DNA, 21 bp, Homo sapiens
atcatattggtattcactaat

SEQ ID NO: 1870007 - DNA, 13 bp, Homo sapiens
atcatctgtgtga

SEQ ID NO: 1870008 - DNA, 13 bp, Homo sapiens
atcatgacatgtt

SEQ ID NO: 1870009 - DNA, 14 bp, Homo sapiens
atcattaaaatata

SEQ ID NO: 1870010 - DNA, 15 bp, Homo sapiens
atcattaaaatatat

SEQ ID NO: 1870011 - DNA, 22 bp, Homo sapiens
atcattaaaatatatgttctgc

SEQ ID NO: 1870012 - DNA, 23 bp, Homo sapiens
atcattaaaatatatgttctgca

SEQ ID NO: 1870013 - DNA, 17 bp, Homo sapiens
atcattatcttcatgtt

SEQ ID NO: 1870014 - DNA, 14 bp, Homo sapiens
atcatttacaagac

SEQ ID NO: 1870015 - DNA, 18 bp, Homo sapiens
atcatttggcttgctgtt

SEQ ID NO: 1870016 - DNA, 20 bp, Homo sapiens
atcatttttgtataaaaagg

SEQ ID NO: 1870017 - DNA, 13 bp, Homo sapiens
atcctatatctgt

SEQ ID NO: 1870018 - DNA, 15 bp, Homo sapiens
atcctatatctgttt

SEQ ID NO: 1870019 - DNA, 23 bp, Homo sapiens
atcctatatctgtttgtatattt

SEQ ID NO: 1870020 - DNA, 11 bp, Homo sapiens
atcctccctgg

SEQ ID NO: 1870021 - DNA, 13 bp, Homo sapiens
atcctccctggag

SEQ ID NO: 1870022 - DNA, 22 bp, Homo sapiens
atcctgctgaaagtcctgcttt

SEQ ID NO: 1870023 - DNA, 23 bp, Homo sapiens
atcctgtgctatgctggacatta

SEQ ID NO: 1870024 - DNA, 21 bp, Homo sapiens
atctaaagctttatctttgtg

SEQ ID NO: 1870025 - DNA, 15 bp, Homo sapiens
atctaagtatatgtg

SEQ ID NO: 1870026 - DNA, 15 bp, Homo sapiens
agaaggccagcccac

SEQ ID NO: 1870027 - DNA, 22 bp, Homo sapiens
agaagtaactggtgatatatct

SEQ ID NO: 1870028 - DNA, 16 bp, Homo sapiens
agaagttttaactatg

SEQ ID NO: 1870029 - DNA, 15 bp, Homo sapiens
agaagttttttactt

SEQ ID NO: 1870030 - DNA, 20 bp, Homo sapiens
agaataaatggtttctcatt

SEQ ID NO: 1870031 - DNA, 19 bp, Homo sapiens
agaatgaactgtggaattt

SEQ ID NO: 1870032 - DNA, 13 bp, Homo sapiens
agaatggagaaag

SEQ ID NO: 1870033 - DNA, 14 bp, Homo sapiens
agaattaaaactga

SEQ ID NO: 1870034 - DNA, 16 bp, Homo sapiens
agaattaaaactgagt

SEQ ID NO: 1870035 - DNA, 23 bp, Homo sapiens
agaattaaaactgagtccatgaa

SEQ ID NO: 1870036 - DNA, 16 bp, Homo sapiens
agaattctattttgct

SEQ ID NO: 1870037 - DNA, 17 bp, Homo sapiens
agaattctattttgctg

SEQ ID NO: 1870038 - DNA, 20 bp, Homo sapiens
agaattctattttgctggag

SEQ ID NO: 1870039 - DNA, 20 bp, Homo sapiens
agaattgcaatctataatat

SEQ ID NO: 1870040 - DNA, 20 bp, Homo sapiens
agacagtggcactaaaatgt

SEQ ID NO: 1870041 - DNA, 14 bp, Homo sapiens
agacatatttacaa

SEQ ID NO: 1870042 - DNA, 18 bp, Homo sapiens
agacatccatgtttgtaa

SEQ ID NO: 1870043 - DNA, 21 bp, Homo sapiens
agacatccatgtttgtaaaac

SEQ ID NO: 1870044 - DNA, 17 bp, Homo sapiens
agaccagagcagtctga

SEQ ID NO: 1870045 - DNA, 12 bp, Homo sapiens
agacccctgccc

SEQ ID NO: 1870046 - DNA, 13 bp, Homo sapiens
agactatttaagt

SEQ ID NO: 1870047 - DNA, 17 bp, Homo sapiens
agactatttaagtacta

SEQ ID NO: 1870048 - DNA, 21 bp, Homo sapiens
agactcagaggacccacctgg

SEQ ID NO: 1870049 - DNA, 14 bp, Homo sapiens
agactgggaacttg

SEQ ID NO: 1870050 - DNA, 20 bp, Homo sapiens
agactgggaacttgatggct

SEQ ID NO: 1870051 - DNA, 18 bp, Homo sapiens
agactggtttgtttgctt

SEQ ID NO: 1870052 - DNA, 20 bp, Homo sapiens
agactggtttgtttgcttaa

SEQ ID NO: 1870053 - DNA, 21 bp, Homo sapiens
agactgtcaaatgaactttta

SEQ ID NO: 1870054 - DNA, 18 bp, Homo sapiens
agacttagtttttataaa

SEQ ID NO: 1870055 - DNA, 19 bp, Homo sapiens
agacttagtttttataaaa

SEQ ID NO: 1870056 - DNA, 17 bp, Homo sapiens
agacttgattggtttaa

SEQ ID NO: 1870057 - DNA, 22 bp, Homo sapiens
agacttgcggccacagcactag

SEQ ID NO: 1870058 - DNA, 23 bp, Homo sapiens
agacttgcggccacagcactaga

SEQ ID NO: 1870059 - DNA, 19 bp, Homo sapiens
agacttggcaacagaagca

SEQ ID NO: 1870060 - DNA, 13 bp, Homo sapiens
agactttgctgtt

SEQ ID NO: 1870061 - DNA, 16 bp, Homo sapiens
agactttgctgttact

SEQ ID NO: 1870062 - DNA, 18 bp, Homo sapiens
agacttttaatcagacaa

SEQ ID NO: 1870063 - DNA, 17 bp, Homo sapiens
agagaaagaaaaggcaa

SEQ ID NO: 1870064 - DNA, 23 bp, Homo sapiens
agagaaagaaaaggcaaaagact

SEQ ID NO: 1870065 - DNA, 20 bp, Homo sapiens
agagaactggaggaaccaca

SEQ ID NO: 1870066 - DNA, 12 bp, Homo sapiens
agagaatgaact

SEQ ID NO: 1870067 - DNA, 16 bp, Homo sapiens
agagaatgaactgtgg

SEQ ID NO: 1870068 - DNA, 23 bp, Homo sapiens
agagactcagaggacccacctgg

SEQ ID NO: 1870069 - DNA, 19 bp, Homo sapiens
agagactcttttaggatca

SEQ ID NO: 1870070 - DNA, 19 bp, Homo sapiens
agagacttttaatcagaca

SEQ ID NO: 1870071 - DNA, 13 bp, Homo sapiens
agagaggggaaga

SEQ ID NO: 1870072 - DNA, 21 bp, Homo sapiens
agagcacaagaaggccagccc

SEQ ID NO: 1870073 - DNA, 16 bp, Homo sapiens
agagctgtggctgggg

SEQ ID NO: 1870074 - DNA, 14 bp, Homo sapiens
agaggacccacctg

SEQ ID NO: 1870075 - DNA, 19 bp, Homo sapiens
agaggccaaattaatcttt

SEQ ID NO: 1870076 - DNA, 22 bp, Homo sapiens
agaggccaaattaatcttttaa

SEQ ID NO: 1870077 - DNA, 11 bp, Homo sapiens
agagggactgg

SEQ ID NO: 1870078 - DNA, 12 bp, Homo sapiens
agaggttttgtt

SEQ ID NO: 1870079 - DNA, 16 bp, Homo sapiens
agaggttttgttgttt

SEQ ID NO: 1870080 - DNA, 22 bp, Homo sapiens
agagtagatggtgaaatttatt

SEQ ID NO: 1870081 - DNA, 21 bp, Homo sapiens
agagtcacccccccaggcctc

SEQ ID NO: 1870082 - DNA, 15 bp, Homo sapiens
agagtttaacacaag

SEQ ID NO: 1870083 - DNA, 19 bp, Homo sapiens
agataatggataatcttcg

SEQ ID NO: 1870084 - DNA, 17 bp, Homo sapiens
agatctttaaatacagt

SEQ ID NO: 1870085 - DNA, 12 bp, Homo sapiens
agatgaaataat

SEQ ID NO: 1870086 - DNA, 14 bp, Homo sapiens
agatgagcacttct

SEQ ID NO: 1870087 - DNA, 22 bp, Homo sapiens
agatgatggaaacgcacttaca

SEQ ID NO: 1870088 - DNA, 17 bp, Homo sapiens
agatgggggctggaggg

SEQ ID NO: 1870089 - DNA, 13 bp, Homo sapiens
agatggtctgcat

SEQ ID NO: 1870090 - DNA, 20 bp, Homo sapiens
agatggtctgcatcagcttt

SEQ ID NO: 1870091 - DNA, 15 bp, Homo sapiens
agatgttccaaattt

SEQ ID NO: 1870092 - DNA, 14 bp, Homo sapiens
agattacaataaat

SEQ ID NO: 1870093 - DNA, 15 bp, Homo sapiens
agattttctcctgtg

SEQ ID NO: 1870094 - DNA, 22 bp, Homo sapiens
agatttttaaaaggtaggtttt

SEQ ID NO: 1870095 - DNA, 22 bp, Homo sapiens
agattttttttttaagtgacat

SEQ ID NO: 1870096 - DNA, 12 bp, Homo sapiens
agcaaagccata

SEQ ID NO: 1870097 - DNA, 20 bp, Homo sapiens
agcaaagccatattctaaat

SEQ ID NO: 1870098 - DNA, 23 bp, Homo sapiens
agtttaagggtggaaaaatgccc

SEQ ID NO: 1870099 - DNA, 17 bp, Homo sapiens
agtttacaagtgtatat

SEQ ID NO: 1870100 - DNA, 14 bp, Homo sapiens
agtttacagtttgt

SEQ ID NO: 1870101 - DNA, 15 bp, Homo sapiens
agtttacagtttgtg

SEQ ID NO: 1870102 - DNA, 12 bp, Homo sapiens
agtttattctgt

SEQ ID NO: 1870103 - DNA, 14 bp, Homo sapiens
agtttattctgtgg

SEQ ID NO: 1870104 - DNA, 22 bp, Homo sapiens
agtttatttccaaataaaatga

SEQ ID NO: 1870105 - DNA, 14 bp, Homo sapiens
agtttcagatatat

SEQ ID NO: 1870106 - DNA, 13 bp, Homo sapiens
agtttctcaagtt

SEQ ID NO: 1870107 - DNA, 11 bp, Homo sapiens
agtttgctaaa

SEQ ID NO: 1870108 - DNA, 18 bp, Homo sapiens
agtttgtacatgcattca

SEQ ID NO: 1870109 - DNA, 16 bp, Homo sapiens
agtttgtcctgtagag

SEQ ID NO: 1870110 - DNA, 15 bp, Homo sapiens
agttttactcttaaa

SEQ ID NO: 1870111 - DNA, 19 bp, Homo sapiens
agttttactcttaaatcat

SEQ ID NO: 1870112 - DNA, 22 bp, Homo sapiens
agttttactcttaaatcatttg

SEQ ID NO: 1870113 - DNA, 16 bp, Homo sapiens
agttttatacataaac

SEQ ID NO: 1870114 - DNA, 18 bp, Homo sapiens
agttttatacataaacag

SEQ ID NO: 1870115 - DNA, 18 bp, Homo sapiens
agttttgatataatcttg

SEQ ID NO: 1870116 - DNA, 19 bp, Homo sapiens
ataaaaaaacaatcatttg

SEQ ID NO: 1870117 - DNA, 15 bp, Homo sapiens
ataaaaaggaaatta

SEQ ID NO: 1870118 - DNA, 18 bp, Homo sapiens
ataaaaaggaaattagtc

SEQ ID NO: 1870119 - DNA, 15 bp, Homo sapiens
ataaaaagtgaactt

SEQ ID NO: 1870120 - DNA, 17 bp, Homo sapiens
ataaaaagtgaactttt

SEQ ID NO: 1870121 - DNA, 18 bp, Homo sapiens
ataaaaagtgaacttttg

SEQ ID NO: 1870122 - DNA, 16 bp, Homo sapiens
ataaaaattaaatgtg

SEQ ID NO: 1870123 - DNA, 22 bp, Homo sapiens
ataaaaggatgttacaagtttg

SEQ ID NO: 1870124 - DNA, 19 bp, Homo sapiens
ataaaatgaggacatgttt

SEQ ID NO: 1870125 - DNA, 15 bp, Homo sapiens
ataaactctaaacat

SEQ ID NO: 1870126 - DNA, 16 bp, Homo sapiens
ataaatacacagcatg

SEQ ID NO: 1870127 - DNA, 19 bp, Homo sapiens
ataaatcaattcattgtgt

SEQ ID NO: 1870128 - DNA, 16 bp, Homo sapiens
ataaattatgaaggac

SEQ ID NO: 1870129 - DNA, 20 bp, Homo sapiens
ataaccaccctagctttata

SEQ ID NO: 1870130 - DNA, 14 bp, Homo sapiens
ataaccagctgtaa

SEQ ID NO: 1870131 - DNA, 16 bp, Homo sapiens
ataactctgattttga

SEQ ID NO: 1870132 - DNA, 17 bp, Homo sapiens
ataactctgattttgat

SEQ ID NO: 1870133 - DNA, 18 bp, Homo sapiens
ataactctgattttgata

SEQ ID NO: 1870134 - DNA, 13 bp, Homo sapiens
ataactgaactgt

SEQ ID NO: 1870135 - DNA, 16 bp, Homo sapiens
ataactgaactgtttg

SEQ ID NO: 1870136 - DNA, 20 bp, Homo sapiens
ataagatgatgttaaatgcc

SEQ ID NO: 1870137 - DNA, 20 bp, Homo sapiens
ataagtctacattaaacaat

SEQ ID NO: 1870138 - DNA, 16 bp, Homo sapiens
ataataactgaactgt

SEQ ID NO: 1870139 - DNA, 18 bp, Homo sapiens
ataataactgaactgttt

SEQ ID NO: 1870140 - DNA, 20 bp, Homo sapiens
ataataactgaactgtttgg

SEQ ID NO: 1870141 - DNA, 12 bp, Homo sapiens
ataataagtttt

SEQ ID NO: 1870142 - DNA, 20 bp, Homo sapiens
ataataagttttgatataat

SEQ ID NO: 1870143 - DNA, 22 bp, Homo sapiens
ataatacactaattcctttcta

SEQ ID NO: 1870144 - DNA, 22 bp, Homo sapiens
ataatcttggcttcttaaaaac

SEQ ID NO: 1870145 - DNA, 15 bp, Homo sapiens
ataatgctttctgag

SEQ ID NO: 1870146 - DNA, 15 bp, Homo sapiens
ataatgtgtctgtgt

SEQ ID NO: 1870147 - DNA, 20 bp, Homo sapiens
ataatgtgtctgtgttgctt

SEQ ID NO: 1870148 - DNA, 23 bp, Homo sapiens
ataatgtgtctgtgttgcttcaa

SEQ ID NO: 1870149 - DNA, 13 bp, Homo sapiens
ataattgttgata

SEQ ID NO: 1870150 - DNA, 14 bp, Homo sapiens
ataattgttgatat

SEQ ID NO: 1870151 - DNA, 19 bp, Homo sapiens
ccctatatctataaacact

SEQ ID NO: 1870152 - DNA, 16 bp, Homo sapiens
ccctcactcaggaacc

SEQ ID NO: 1870153 - DNA, 24 bp, Homo sapiens
ccctcactcaggaaccctggagac

SEQ ID NO: 1870154 - DNA, 19 bp, Homo sapiens
ccctcggcaaccgtgggga

SEQ ID NO: 1870155 - DNA, 14 bp, Homo sapiens
ccctgaccaccctg

SEQ ID NO: 1870156 - DNA, 16 bp, Homo sapiens
ccctgaccaccctgcc

SEQ ID NO: 1870157 - DNA, 21 bp, Homo sapiens
ccctgaccaccctgcctgtgg

SEQ ID NO: 1870158 - DNA, 22 bp, Homo sapiens
ccctgaccaccctgcctgtgga

SEQ ID NO: 1870159 - DNA, 19 bp, Homo sapiens
ccctgcagccgtgcaggac

SEQ ID NO: 1870160 - DNA, 13 bp, Homo sapiens
ccctgcaggccag

SEQ ID NO: 1870161 - DNA, 17 bp, Homo sapiens
ccctgcaggccaggcca

SEQ ID NO: 1870162 - DNA, 13 bp, Homo sapiens
ccctgcccaagtg

SEQ ID NO: 1870163 - DNA, 17 bp, Homo sapiens
ccctgcccaagtggctc

SEQ ID NO: 1870164 - DNA, 19 bp, Homo sapiens
ccctgcccaagtggctctt

SEQ ID NO: 1870165 - DNA, 19 bp, Homo sapiens
ccctgcccaatcctccctg

SEQ ID NO: 1870166 - DNA, 21 bp, Homo sapiens
ccctgcccctccccaaaagaa

SEQ ID NO: 1870167 - DNA, 17 bp, Homo sapiens
ccctgccttgctgcctt

SEQ ID NO: 1870168 - DNA, 19 bp, Homo sapiens
ccctggagacagaagtcag

SEQ ID NO: 1870169 - DNA, 13 bp, Homo sapiens
ccctggatggcct

SEQ ID NO: 1870170 - DNA, 16 bp, Homo sapiens
ccctggatggcctctg

SEQ ID NO: 1870171 - DNA, 19 bp, Homo sapiens
ccctggatggcctctgggg

SEQ ID NO: 1870172 - DNA, 21 bp, Homo sapiens
ccctggatggcctctggggca

SEQ ID NO: 1870173 - DNA, 22 bp, Homo sapiens
ccctggatggcctctggggcag

SEQ ID NO: 1870174 - DNA, 18 bp, Homo sapiens
ccctggggcatcatgggc

SEQ ID NO: 1870175 - DNA, 19 bp, Homo sapiens
ccctggggctgccctcggc

SEQ ID NO: 1870176 - DNA, 21 bp, Homo sapiens
ccctttgtattataattgttg

SEQ ID NO: 1870177 - DNA, 15 bp, Homo sapiens
ccctttttaaaaaat

SEQ ID NO: 1870178 - DNA, 14 bp, Homo sapiens
ccgacaccactggg

SEQ ID NO: 1870179 - DNA, 12 bp, Homo sapiens
ccgcagccccca

SEQ ID NO: 1870180 - DNA, 13 bp, Homo sapiens
ccggccgcagccc

SEQ ID NO: 1870181 - DNA, 13 bp, Homo sapiens
ccgggaaagctgt

SEQ ID NO: 1870182 - DNA, 12 bp, Homo sapiens
ccgtttacagtg

SEQ ID NO: 1870183 - DNA, 20 bp, Homo sapiens
cctagcttttaaaaaatatt

SEQ ID NO: 1870184 - DNA, 16 bp, Homo sapiens
cctagtccagtgacct

SEQ ID NO: 1870185 - DNA, 15 bp, Homo sapiens
cctatatctgtttgt

SEQ ID NO: 1870186 - DNA, 20 bp, Homo sapiens
cctatatctgtttgtatatt

SEQ ID NO: 1870187 - DNA, 22 bp, Homo sapiens
cctatctagcatttatttctct

SEQ ID NO: 1870188 - DNA, 21 bp, Homo sapiens
cctcactcaggaaccctggag

SEQ ID NO: 1870189 - DNA, 23 bp, Homo sapiens
cctcacttaaccaccccatacca

SEQ ID NO: 1870190 - DNA, 12 bp, Homo sapiens
cttactggcact

SEQ ID NO: 1870191 - DNA, 16 bp, Homo sapiens
cttagagtttacagtt

SEQ ID NO: 1870192 - DNA, 18 bp, Homo sapiens
cttagtatagtagaaaga

SEQ ID NO: 1870193 - DNA, 20 bp, Homo sapiens
cttagtggggttttatatcc

SEQ ID NO: 1870194 - DNA, 15 bp, Homo sapiens
cttagttcttgaatt

SEQ ID NO: 1870195 - DNA, 18 bp, Homo sapiens
cttagttcttgaattgtt

SEQ ID NO: 1870196 - DNA, 22 bp, Homo sapiens
cttatgcaaggggaaacctgtg

SEQ ID NO: 1870197 - DNA, 15 bp, Homo sapiens
cttatgtgttacatt

SEQ ID NO: 1870198 - DNA, 22 bp, Homo sapiens
cttatttttgtaccatattgct

SEQ ID NO: 1870199 - DNA, 17 bp, Homo sapiens
cttcagtggagaattat

SEQ ID NO: 1870200 - DNA, 15 bp, Homo sapiens
cttcatatctaattt

SEQ ID NO: 1870201 - DNA, 16 bp, Homo sapiens
cttcatatctaattta

SEQ ID NO: 1870202 - DNA, 11 bp, Homo sapiens
cttccctgccc

SEQ ID NO: 1870203 - DNA, 22 bp, Homo sapiens
cttcctgattaccagtctgatt

SEQ ID NO: 1870204 - DNA, 11 bp, Homo sapiens
cttctaatata

SEQ ID NO: 1870205 - DNA, 20 bp, Homo sapiens
cttctcattccaacagtgag

SEQ ID NO: 1870206 - DNA, 21 bp, Homo sapiens
cttctcattccaacagtgagt

SEQ ID NO: 1870207 - DNA, 12 bp, Homo sapiens
cttctctttgtg

SEQ ID NO: 1870208 - DNA, 15 bp, Homo sapiens
cttctgcatcactgg

SEQ ID NO: 1870209 - DNA, 16 bp, Homo sapiens
cttctgcttcatcctg

SEQ ID NO: 1870210 - DNA, 16 bp, Homo sapiens
cttctgtagtttttaa

SEQ ID NO: 1870211 - DNA, 13 bp, Homo sapiens
cttctgttaagaa

SEQ ID NO: 1870212 - DNA, 15 bp, Homo sapiens
cttctgttaagaaag

SEQ ID NO: 1870213 - DNA, 14 bp, Homo sapiens
cttcttaaaaactg

SEQ ID NO: 1870214 - DNA, 18 bp, Homo sapiens
cttcttaaaaactgtgta

SEQ ID NO: 1870215 - DNA, 12 bp, Homo sapiens
cttgaattgtta

SEQ ID NO: 1870216 - DNA, 15 bp, Homo sapiens
cttgaattgttatga

SEQ ID NO: 1870217 - DNA, 19 bp, Homo sapiens
cttgaattgttatgaaaat

SEQ ID NO: 1870218 - DNA, 21 bp, Homo sapiens
cttgcactaaagtatgtaaag

SEQ ID NO: 1870219 - DNA, 13 bp, Homo sapiens
cttgcggccacag

SEQ ID NO: 1870220 - DNA, 21 bp, Homo sapiens
cttgctacttatcatttttgt

SEQ ID NO: 1870221 - DNA, 23 bp, Homo sapiens
cttgctacttatcatttttgtat

SEQ ID NO: 1870222 - DNA, 15 bp, Homo sapiens
cttgctgccttcacc

SEQ ID NO: 1870223 - DNA, 19 bp, Homo sapiens
cttgctgccttcaccctga

SEQ ID NO: 1870224 - DNA, 19 bp, Homo sapiens
cttggcttcttaaaaactg

SEQ ID NO: 1870225 - DNA, 20 bp, Homo sapiens
cttggcttcttaaaaactgt

SEQ ID NO: 1870226 - DNA, 22 bp, Homo sapiens
cttggcttcttaaaaactgtgt

SEQ ID NO: 1870227 - DNA, 18 bp, Homo sapiens
cttggtttgcacataaaa

SEQ ID NO: 1870228 - DNA, 15 bp, Homo sapiens
cttgtatagtgtaaa

SEQ ID NO: 1870229 - DNA, 21 bp, Homo sapiens
cttgttacaaattttttaatt

SEQ ID NO: 1870230 - DNA, 12 bp, Homo sapiens
cttgttattaat

SEQ ID NO: 1870231 - DNA, 17 bp, Homo sapiens
cttgttattaatgtttc

SEQ ID NO: 1870232 - DNA, 17 bp, Homo sapiens
cttgttcaacagtttct

SEQ ID NO: 1870233 - DNA, 19 bp, Homo sapiens
cttgttcaacagtttctca

SEQ ID NO: 1870234 - DNA, 19 bp, Homo sapiens
cttgttttaaaagggttca

SEQ ID NO: 1870235 - DNA, 22 bp, Homo sapiens
ctttaaaaaagctataaattat

SEQ ID NO: 1870236 - DNA, 20 bp, Homo sapiens
ctttaaatacagtcaactta

SEQ ID NO: 1870237 - DNA, 17 bp, Homo sapiens
ctttacatgcaatttat

SEQ ID NO: 1870238 - DNA, 21 bp, Homo sapiens
ctttaggcatatgcttcttta

SEQ ID NO: 1870239 - DNA, 13 bp, Homo sapiens
ctttatatttagt

SEQ ID NO: 1870240 - DNA, 22 bp, Homo sapiens
ctttatccagctagtgccaaat

SEQ ID NO: 1870241 - DNA, 13 bp, Homo sapiens
ctttatctttgtg

SEQ ID NO: 1870242 - DNA, 15 bp, Homo sapiens
ctttatctttgtgta

SEQ ID NO: 1870243 - DNA, 12 bp, Homo sapiens
ctttattttccc

SEQ ID NO: 1870244 - DNA, 11 bp, Homo sapiens
ctttcatacca

SEQ ID NO: 1870245 - DNA, 19 bp, Homo sapiens
ctttcccaggtaatttaaa

SEQ ID NO: 1870246 - DNA, 22 bp, Homo sapiens
ctttcccaggtaatttaaattg

SEQ ID NO: 1870247 - DNA, 17 bp, Homo sapiens
ctttcctatctagcatt

SEQ ID NO: 1870248 - DNA, 13 bp, Homo sapiens
ctttctgtaaact

SEQ ID NO: 1870249 - DNA, 12 bp, Homo sapiens
ctttctgtgtgc

SEQ ID NO: 1870250 - DNA, 15 bp, Homo sapiens
ctttctgttggtgta

SEQ ID NO: 1870251 - DNA, 23 bp, Homo sapiens
ctttgaaggtaataaatacacag

SEQ ID NO: 1870252 - DNA, 16 bp, Homo sapiens
ctttgaatgctttttg

SEQ ID NO: 1870253 - DNA, 23 bp, Homo sapiens
ctttgaatgctttttgaatgtta

SEQ ID NO: 1870254 - DNA, 21 bp, Homo sapiens
ctttgctgttactgcttctct

SEQ ID NO: 1870255 - DNA, 23 bp, Homo sapiens
ctttgctgttactgcttctcttt

SEQ ID NO: 1870256 - DNA, 12 bp, Homo sapiens
ctttgggaaagc

SEQ ID NO: 1870257 - DNA, 17 bp, Homo sapiens
ctttggggggcactaga

SEQ ID NO: 1870258 - DNA, 14 bp, Homo sapiens
ctttgtattataat

SEQ ID NO: 1870259 - DNA, 16 bp, Homo sapiens
ctttgtattataattg

SEQ ID NO: 1870260 - DNA, 17 bp, Homo sapiens
ctttgtgtaatctaagt

SEQ ID NO: 1870261 - DNA, 14 bp, Homo sapiens
ctttgtgtttagct

SEQ ID NO: 1870262 - DNA, 16 bp, Homo sapiens
ctttgtttaaatgcca

SEQ ID NO: 1870263 - DNA, 14 bp, Homo sapiens
cttttaaaaaatat

SEQ ID NO: 1870264 - DNA, 19 bp, Homo sapiens
cttttacagaatgcattaa

SEQ ID NO: 1870265 - DNA, 21 bp, Homo sapiens
cttttacagaatgcattaaaa

SEQ ID NO: 1870266 - DNA, 22 bp, Homo sapiens
cttttacagaatgcattaaaaa

SEQ ID NO: 1870267 - DNA, 16 bp, Homo sapiens
cttttaggttgttacc

SEQ ID NO: 1870268 - DNA, 14 bp, Homo sapiens
cttttatagctatt

SEQ ID NO: 1870269 - DNA, 17 bp, Homo sapiens
cttttatagctattact

SEQ ID NO: 1870270 - DNA, 13 bp, Homo sapiens
cttttattgtata

SEQ ID NO: 1870271 - DNA, 16 bp, Homo sapiens
cttttattttcattgt

SEQ ID NO: 1870272 - DNA, 14 bp, Homo sapiens
cttttctttctttt

SEQ ID NO: 1870273 - DNA, 20 bp, Homo sapiens
cttttgaagtagtttgtata

SEQ ID NO: 1870274 - DNA, 11 bp, Homo sapiens
cttttgtaatt

SEQ ID NO: 1870275 - DNA, 14 bp, Homo sapiens
cttttgtaatttga

SEQ ID NO: 1870276 - DNA, 16 bp, Homo sapiens
cttttgtaatttgaat

SEQ ID NO: 1870277 - DNA, 20 bp, Homo sapiens
cttttgttattaaaaaaaca

SEQ ID NO: 1870278 - DNA, 22 bp, Homo sapiens
cttttgttattaaaaaaacaca

SEQ ID NO: 1870279 - DNA, 13 bp, Homo sapiens
ctttttaaaaaat

SEQ ID NO: 1870280 - DNA, 16 bp, Homo sapiens
ctttttaaaaaatacc

SEQ ID NO: 1870281 - DNA, 21 bp, Homo sapiens
ctttttagatgtgctgctttg

SEQ ID NO: 1870282 - DNA, 11 bp, Homo sapiens
ctttttgaatg

SEQ ID NO: 1870283 - DNA, 17 bp, Homo sapiens
ctttttgtattaacaaa

SEQ ID NO: 1870284 - DNA, 15 bp, Homo sapiens
cttttttgaaatcag

SEQ ID NO: 1870285 - DNA, 15 bp, Homo sapiens
ctttttttggtaaat

SEQ ID NO: 1870286 - DNA, 19 bp, Homo sapiens
ctttttttggtaaattttt

SEQ ID NO: 1870287 - DNA, 21 bp, Homo sapiens
ctttttttggtaaatttttga

SEQ ID NO: 1870288 - DNA, 15 bp, Homo sapiens
cttttttttttccaa

SEQ ID NO: 1870289 - DNA, 16 bp, Homo sapiens
cttttttttttccaaa

SEQ ID NO: 1870290 - DNA, 20 bp, Homo sapiens
cttttttttttccaaattat

SEQ ID NO: 1870291 - DNA, 23 bp, Homo sapiens
cttttttttttccaaattattaa

SEQ ID NO: 1870292 - DNA, 23 bp, Homo sapiens
gaaaacttcagagaaattatgtt

SEQ ID NO: 1870293 - DNA, 16 bp, Homo sapiens
gaaaagccatatctag

SEQ ID NO: 1870294 - DNA, 16 bp, Homo sapiens
gaaaaggcaaaagact

SEQ ID NO: 1870295 - DNA, 21 bp, Homo sapiens
gaaaaggcaaaagactggttt

SEQ ID NO: 1870296 - DNA, 20 bp, Homo sapiens
gaaaataccataggaagaca

SEQ ID NO: 1870297 - DNA, 22 bp, Homo sapiens
gaaaataccataggaagacata

SEQ ID NO: 1870298 - DNA, 16 bp, Homo sapiens
gaaaattacgttctta

SEQ ID NO: 1870299 - DNA, 17 bp, Homo sapiens
gaaaattattttaaaca

SEQ ID NO: 1870300 - DNA, 13 bp, Homo sapiens
gaaacactaaatt

SEQ ID NO: 1870301 - DNA, 14 bp, Homo sapiens
gaaacagagaaaga

SEQ ID NO: 1870302 - DNA, 17 bp, Homo sapiens
gaaacagagaaagaaaa

SEQ ID NO: 1870303 - DNA, 21 bp, Homo sapiens
gaaacagagaaagaaaaggca

SEQ ID NO: 1870304 - DNA, 14 bp, Homo sapiens
gaaaccatgacaaa

SEQ ID NO: 1870305 - DNA, 21 bp, Homo sapiens
gaaacctttctactttttctg

SEQ ID NO: 1870306 - DNA, 16 bp, Homo sapiens
gaaagaaaaggcaaaa

SEQ ID NO: 1870307 - DNA, 20 bp, Homo sapiens
gctggggggatgacggccag

SEQ ID NO: 1870308 - DNA, 21 bp, Homo sapiens
gctggggggatgacggccagg

SEQ ID NO: 1870309 - DNA, 21 bp, Homo sapiens
gctgggtaaactgtggatgat

SEQ ID NO: 1870310 - DNA, 16 bp, Homo sapiens
gctgtatttctttgta

SEQ ID NO: 1870311 - DNA, 17 bp, Homo sapiens
gctgtcttctcccagag

SEQ ID NO: 1870312 - DNA, 18 bp, Homo sapiens
gctgtcttctcccagagc

SEQ ID NO: 1870313 - DNA, 15 bp, Homo sapiens
gctgtggctgggggg

SEQ ID NO: 1870314 - DNA, 17 bp, Homo sapiens
gctgttactgcttctct

SEQ ID NO: 1870315 - DNA, 22 bp, Homo sapiens
gctgttactgcttctctttgtg

SEQ ID NO: 1870316 - DNA, 15 bp, Homo sapiens
gctgttcttttttgt

SEQ ID NO: 1870317 - DNA, 23 bp, Homo sapiens
gctgtttactcccttctgtagtt

SEQ ID NO: 1870318 - DNA, 18 bp, Homo sapiens
gcttaatttccttctgtt

SEQ ID NO: 1870319 - DNA, 18 bp, Homo sapiens
gcttacttacaaaagcag

SEQ ID NO: 1870320 - DNA, 15 bp, Homo sapiens
gcttagaaacatgtt

SEQ ID NO: 1870321 - DNA, 21 bp, Homo sapiens
gcttagatgttccaaatttag

SEQ ID NO: 1870322 - DNA, 13 bp, Homo sapiens
gcttagttcttga

SEQ ID NO: 1870323 - DNA, 21 bp, Homo sapiens
gcttcaaattggtctgaaagg

SEQ ID NO: 1870324 - DNA, 21 bp, Homo sapiens
gcttcactcatgcaaactgct

SEQ ID NO: 1870325 - DNA, 22 bp, Homo sapiens
gcttcactcatgcaaactgctt

SEQ ID NO: 1870326 - DNA, 13 bp, Homo sapiens
gcttcatatctaa

SEQ ID NO: 1870327 - DNA, 13 bp, Homo sapiens
gcttcccacctgc

SEQ ID NO: 1870328 - DNA, 15 bp, Homo sapiens
gcttccctgcccaat

SEQ ID NO: 1870329 - DNA, 12 bp, Homo sapiens
gcttcttaaaaa

SEQ ID NO: 1870330 - DNA, 14 bp, Homo sapiens
gcttcttaaaaact

SEQ ID NO: 1870331 - DNA, 21 bp, Homo sapiens
gcttcttaaaaactgtgtatc

SEQ ID NO: 1870332 - DNA, 20 bp, Homo sapiens
gcttctttaaaaaagctata

SEQ ID NO: 1870333 - DNA, 23 bp, Homo sapiens
gcttgattaaacagcaaagccat

SEQ ID NO: 1870334 - DNA, 18 bp, Homo sapiens
gcttgatttgatctttgt

SEQ ID NO: 1870335 - DNA, 14 bp, Homo sapiens
gcttgctcattttt

SEQ ID NO: 1870336 - DNA, 16 bp, Homo sapiens
gcttgtagccctggat

SEQ ID NO: 1870337 - DNA, 14 bp, Homo sapiens
gcttgtatagtgta

SEQ ID NO: 1870338 - DNA, 12 bp, Homo sapiens
gcttgttttaaa

SEQ ID NO: 1870339 - DNA, 13 bp, Homo sapiens
gcttgttttaaaa

SEQ ID NO: 1870340 - DNA, 14 bp, Homo sapiens
gctttacaaataat

SEQ ID NO: 1870341 - DNA, 14 bp, Homo sapiens
gctttatctttgtg

SEQ ID NO: 1870342 - DNA, 12 bp, Homo sapiens
gctttgatatat

SEQ ID NO: 1870343 - DNA, 19 bp, Homo sapiens
gctttgggaaagctgcctc

SEQ ID NO: 1870344 - DNA, 16 bp, Homo sapiens
gcttttaaaaaatatt

SEQ ID NO: 1870345 - DNA, 22 bp, Homo sapiens
gcttttaaaaaatattttaaga

SEQ ID NO: 1870346 - DNA, 22 bp, Homo sapiens
gcttttattgcaccattttcaa

SEQ ID NO: 1870347 - DNA, 15 bp, Homo sapiens
gcttttattgtataa

SEQ ID NO: 1870348 - DNA, 14 bp, Homo sapiens
ggaaaaagagactc

SEQ ID NO: 1870349 - DNA, 16 bp, Homo sapiens
ggaaagccaaatttta

SEQ ID NO: 1870350 - DNA, 18 bp, Homo sapiens
ggaaagtcacctacagga

SEQ ID NO: 1870351 - DNA, 14 bp, Homo sapiens
ggaaattagtcttt

SEQ ID NO: 1870352 - DNA, 15 bp, Homo sapiens
ggaacccccaaattt

SEQ ID NO: 1870353 - DNA, 16 bp, Homo sapiens
ggaagaatttaatgga

SEQ ID NO: 1870354 - DNA, 15 bp, Homo sapiens
ggaagaggttttatt

SEQ ID NO: 1870355 - DNA, 22 bp, Homo sapiens
ggaagtgcagcgggccaggcag

SEQ ID NO: 1870356 - DNA, 23 bp, Homo sapiens
ggaagtgcagcgggccaggcagg

SEQ ID NO: 1870357 - DNA, 17 bp, Homo sapiens
ggaatgtgtccaagaca

SEQ ID NO: 1870358 - DNA, 17 bp, Homo sapiens
ggacacctacagcagca

SEQ ID NO: 1870359 - DNA, 18 bp, Homo sapiens
ggacacctacagcagcac

SEQ ID NO: 1870360 - DNA, 22 bp, Homo sapiens
ggaccactagctaagcaagcca

SEQ ID NO: 1870361 - DNA, 17 bp, Homo sapiens
ggaccggccgcagcccc

SEQ ID NO: 1870362 - DNA, 19 bp, Homo sapiens
ggaccggccgcagccccca

SEQ ID NO: 1870363 - DNA, 22 bp, Homo sapiens
ggaccggccgcagcccccactg

SEQ ID NO: 1870364 - DNA, 16 bp, Homo sapiens
ggactggacagccagg

SEQ ID NO: 1870365 - DNA, 17 bp, Homo sapiens
ggagaaagtaagtcttt

SEQ ID NO: 1870366 - DNA, 13 bp, Homo sapiens
ggagaaatgccag

SEQ ID NO: 1870367 - DNA, 16 bp, Homo sapiens
ggagaagacccctgcc

SEQ ID NO: 1870368 - DNA, 18 bp, Homo sapiens
ggagaagacccctgccca

SEQ ID NO: 1870369 - DNA, 20 bp, Homo sapiens
ggagactggtcctgtgtgca

SEQ ID NO: 1870370 - DNA, 19 bp, Homo sapiens
ggagaggaggtccttggag

SEQ ID NO: 1870371 - DNA, 22 bp, Homo sapiens
ggagattgggagacaattagca

SEQ ID NO: 1870372 - DNA, 20 bp, Homo sapiens
ggagcagcccacccagcaga

SEQ ID NO: 1870373 - DNA, 12 bp, Homo sapiens
ggagcagccccc

SEQ ID NO: 1870374 - DNA, 24 bp, Homo sapiens
ggaggagggccgagacaggagcag

SEQ ID NO: 1870375 - DNA, 21 bp, Homo sapiens
ggaggccatttgctgccctgg

SEQ ID NO: 1870376 - DNA, 22 bp, Homo sapiens
ggaggccatttgctgccctggg

SEQ ID NO: 1870377 - DNA, 14 bp, Homo sapiens
ggatataaaaggat

SEQ ID NO: 1870378 - DNA, 16 bp, Homo sapiens
ggatatgattggttca

SEQ ID NO: 1870379 - DNA, 21 bp, Homo sapiens
ggatgaaaagccatatctagt

SEQ ID NO: 1870380 - DNA, 14 bp, Homo sapiens
ggatgacggccagg

SEQ ID NO: 1870381 - DNA, 17 bp, Homo sapiens
ggatgacggccaggctc

SEQ ID NO: 1870382 - DNA, 22 bp, Homo sapiens
ggatggcctctggggcaggacc

SEQ ID NO: 1870383 - DNA, 15 bp, Homo sapiens
ggatgttacaagttt

SEQ ID NO: 1870384 - DNA, 16 bp, Homo sapiens
ggcaactcgtgacagc

SEQ ID NO: 1870385 - DNA, 19 bp, Homo sapiens
ggcaactcgtgacagcctc

SEQ ID NO: 1870386 - DNA, 23 bp, Homo sapiens
ggcaactcgtgacagcctctgac

SEQ ID NO: 1870387 - DNA, 20 bp, Homo sapiens
ggcactaaaatgtttaattc

SEQ ID NO: 1870388 - DNA, 12 bp, Homo sapiens
ggcactgacagc

SEQ ID NO: 1870389 - DNA, 13 bp, Homo sapiens
ggcactgacagcc

SEQ ID NO: 1870390 - DNA, 17 bp, Homo sapiens
ggcactgtggcactgcc

SEQ ID NO: 1870391 - DNA, 20 bp, Homo sapiens
ggcagagcttgtagccctgg

SEQ ID NO: 1870392 - DNA, 14 bp, Homo sapiens
ggcagatctttaaa

SEQ ID NO: 1870393 - DNA, 13 bp, Homo sapiens
ggccacagcacta

SEQ ID NO: 1870394 - DNA, 18 bp, Homo sapiens
ggccacagcactagagtc

SEQ ID NO: 1870395 - DNA, 13 bp, Homo sapiens
ggccagcccactg

SEQ ID NO: 1870396 - DNA, 15 bp, Homo sapiens
ggccagcccactggg

SEQ ID NO: 1870397 - DNA, 23 bp, Homo sapiens
ggccagcccactgggccctgggg

SEQ ID NO: 1870398 - DNA, 16 bp, Homo sapiens
ggccagcttcccctca

SEQ ID NO: 1870399 - DNA, 14 bp, Homo sapiens
ggccaggccagctt

SEQ ID NO: 1870400 - DNA, 17 bp, Homo sapiens
ggccaggccagcttccc

SEQ ID NO: 1870401 - DNA, 14 bp, Homo sapiens
ggccaggctccctg

SEQ ID NO: 1870402 - DNA, 15 bp, Homo sapiens
ggccatatatgctgt

SEQ ID NO: 1870403 - DNA, 22 bp, Homo sapiens
ggccatatatgctgtatttctt

SEQ ID NO: 1870404 - DNA, 14 bp, Homo sapiens
ggccatttgctgcc

SEQ ID NO: 1870405 - DNA, 19 bp, Homo sapiens
ggccatttgctgccctggg

SEQ ID NO: 1870406 - DNA, 24 bp, Homo sapiens
ggcccagggcctctggcttccctg

SEQ ID NO: 1870407 - DNA, 12 bp, Homo sapiens
ggccctcactca

SEQ ID NO: 1870408 - DNA, 13 bp, Homo sapiens
ggccctggggctg

SEQ ID NO: 1870409 - DNA, 17 bp, Homo sapiens
ggccctggggctgccct

SEQ ID NO: 1870410 - DNA, 22 bp, Homo sapiens
ggccctggggctgccctcggca

SEQ ID NO: 1870411 - DNA, 12 bp, Homo sapiens
ggccgcagcccc

SEQ ID NO: 1870412 - DNA, 19 bp, Homo sapiens
ggccgctctccccctgcag

SEQ ID NO: 1870413 - DNA, 22 bp, Homo sapiens
ggccgggcccagggcctctggc

SEQ ID NO: 1870414 - DNA, 21 bp, Homo sapiens
ggcctctggcttccctgccca

SEQ ID NO: 1870415 - DNA, 24 bp, Homo sapiens
ggcctctggcttccctgcccaatc

SEQ ID NO: 1870416 - DNA, 13 bp, Homo sapiens
ggcctgtgagcaa

SEQ ID NO: 1870417 - DNA, 21 bp, Homo sapiens
ggcctgtgagcaagagccagg

SEQ ID NO: 1870418 - DNA, 12 bp, Homo sapiens
ggcgctggacac

SEQ ID NO: 1870419 - DNA, 19 bp, Homo sapiens
ggcgctggacacctacagc

SEQ ID NO: 1870420 - DNA, 15 bp, Homo sapiens
ggctactgcagcttt

SEQ ID NO: 1870421 - DNA, 16 bp, Homo sapiens
ggctatcctgctgaaa

SEQ ID NO: 1870422 - DNA, 13 bp, Homo sapiens
ggctcaccagaat

SEQ ID NO: 1870423 - DNA, 17 bp, Homo sapiens
gtccatgaaaataccat

SEQ ID NO: 1870424 - DNA, 15 bp, Homo sapiens
gtccatttcttattt

SEQ ID NO: 1870425 - DNA, 13 bp, Homo sapiens
gtcccagcctctg

SEQ ID NO: 1870426 - DNA, 20 bp, Homo sapiens
gtcccagcctctggggcaga

SEQ ID NO: 1870427 - DNA, 13 bp, Homo sapiens
gtccccctagaga

SEQ ID NO: 1870428 - DNA, 16 bp, Homo sapiens
gtccccctagagactc

SEQ ID NO: 1870429 - DNA, 14 bp, Homo sapiens
gtccctccaaggct

SEQ ID NO: 1870430 - DNA, 16 bp, Homo sapiens
gtcctaactggtatag

SEQ ID NO: 1870431 - DNA, 16 bp, Homo sapiens
gtcgagtctttgtgtg

SEQ ID NO: 1870432 - DNA, 20 bp, Homo sapiens
gtcgagtctttgtgtgttat

SEQ ID NO: 1870433 - DNA, 23 bp, Homo sapiens
gtctacattcttggttgttaatt

SEQ ID NO: 1870434 - DNA, 20 bp, Homo sapiens
gtctgcatcagctttttgta

SEQ ID NO: 1870435 - DNA, 14 bp, Homo sapiens
gtctgctcttattt

SEQ ID NO: 1870436 - DNA, 17 bp, Homo sapiens
gtctgctcttatttttg

SEQ ID NO: 1870437 - DNA, 21 bp, Homo sapiens
gtctggttttaacaatttcct

SEQ ID NO: 1870438 - DNA, 20 bp, Homo sapiens
gtctgtctttgcaaaggact

SEQ ID NO: 1870439 - DNA, 20 bp, Homo sapiens
gtctgtgtgatgaactttct

SEQ ID NO: 1870440 - DNA, 16 bp, Homo sapiens
gtcttctcccagagca

SEQ ID NO: 1870441 - DNA, 19 bp, Homo sapiens
gtcttgaaacctttctact

SEQ ID NO: 1870442 - DNA, 18 bp, Homo sapiens
gtctttgtgtgttatatt

SEQ ID NO: 1870443 - DNA, 14 bp, Homo sapiens
gtgaaacagagaaa

SEQ ID NO: 1870444 - DNA, 20 bp, Homo sapiens
gtgaacttttgtaatttgaa

SEQ ID NO: 1870445 - DNA, 14 bp, Homo sapiens
gtgaatttatgaga

SEQ ID NO: 1870446 - DNA, 21 bp, Homo sapiens
gtgacagcctctgactcacca

SEQ ID NO: 1870447 - DNA, 22 bp, Homo sapiens
gtgacctgttaggtctcatgcc

SEQ ID NO: 1870448 - DNA, 14 bp, Homo sapiens
gtgagcaagagcca

SEQ ID NO: 1870449 - DNA, 20 bp, Homo sapiens
gtgagcacgttggcgaggaa

SEQ ID NO: 1870450 - DNA, 15 bp, Homo sapiens
gtgatgaactttctc

SEQ ID NO: 1870451 - DNA, 12 bp, Homo sapiens
gtgatgccttcc

SEQ ID NO: 1870452 - DNA, 22 bp, Homo sapiens
gtgatgccttccgacaccactg

SEQ ID NO: 1870453 - DNA, 18 bp, Homo sapiens
gtgatggttgattcacac

SEQ ID NO: 1870454 - DNA, 15 bp, Homo sapiens
gtgatttacatgctg

SEQ ID NO: 1870455 - DNA, 18 bp, Homo sapiens
gtgatttagaactgtatg

SEQ ID NO: 1870456 - DNA, 23 bp, Homo sapiens
gtgatttagaactgtatgtcaga

SEQ ID NO: 1870457 - DNA, 22 bp, Homo sapiens
gtgcaacatttctgtatactgt

SEQ ID NO: 1870458 - DNA, 23 bp, Homo sapiens
gtgcaacatttctgtatactgta

SEQ ID NO: 1870459 - DNA, 16 bp, Homo sapiens
gtgcagcgggccaggc

SEQ ID NO: 1870460 - DNA, 13 bp, Homo sapiens
gtgcatttaagga

SEQ ID NO: 1870461 - DNA, 16 bp, Homo sapiens
gtgcatttaaggagat

SEQ ID NO: 1870462 - DNA, 23 bp, Homo sapiens
gtgccatagagtttaacacaagt

SEQ ID NO: 1870463 - DNA, 14 bp, Homo sapiens
gtgctaatatactt

SEQ ID NO: 1870464 - DNA, 17 bp, Homo sapiens
gtgctgcttacactcca

SEQ ID NO: 1870465 - DNA, 22 bp, Homo sapiens
gtgctgcttacactccaggtgt

SEQ ID NO: 1870466 - DNA, 23 bp, Homo sapiens
gtggaaaaatgcccatttttgct

SEQ ID NO: 1870467 - DNA, 22 bp, Homo sapiens
gtggaaagtcacctacaggact

SEQ ID NO: 1870468 - DNA, 20 bp, Homo sapiens
gtggaccggccgcagccccc

SEQ ID NO: 1870469 - DNA, 13 bp, Homo sapiens
gtggcactgccac

SEQ ID NO: 1870470 - DNA, 15 bp, Homo sapiens
gtggcactgccacca

SEQ ID NO: 1870471 - DNA, 17 bp, Homo sapiens
gtggcactgccaccagc

SEQ ID NO: 1870472 - DNA, 19 bp, Homo sapiens
gtggccaaattatttgtgt

SEQ ID NO: 1870473 - DNA, 18 bp, Homo sapiens
gtggctcttgggacaacg

SEQ ID NO: 1870474 - DNA, 15 bp, Homo sapiens
gtggctggggggatg

SEQ ID NO: 1870475 - DNA, 17 bp, Homo sapiens
gtggctggggggatgac

SEQ ID NO: 1870476 - DNA, 16 bp, Homo sapiens
gtggttctataataag

SEQ ID NO: 1870477 - DNA, 17 bp, Homo sapiens
gtggttctataataagt

SEQ ID NO: 1870478 - DNA, 13 bp, Homo sapiens
gtgtatcattaaa

SEQ ID NO: 1870479 - DNA, 21 bp, Homo sapiens
gtgtatcattaaaatatatgt

SEQ ID NO: 1870480 - DNA, 20 bp, Homo sapiens
gtgtattgagtcttaactgt

SEQ ID NO: 1870481 - DNA, 21 bp, Homo sapiens
gtgtcccagtcccagcctctg

SEQ ID NO: 1870482 - DNA, 22 bp, Homo sapiens
gtgtcccagtcccagcctctgg

SEQ ID NO: 1870483 - DNA, 18 bp, Homo sapiens
gtgtctgcagctcctgga

SEQ ID NO: 1870484 - DNA, 13 bp, Homo sapiens
gtgtgcagtgaag

SEQ ID NO: 1870485 - DNA, 11 bp, Homo sapiens
gtgtgctgtaa

SEQ ID NO: 1870486 - DNA, 20 bp, Homo sapiens
gtgtggaccggccgcagccc

SEQ ID NO: 1870487 - DNA, 22 bp, Homo sapiens
gtgtggaccggccgcagccccc

SEQ ID NO: 1870488 - DNA, 20 bp, Homo sapiens
gtgtgttatattccaaggaa

SEQ ID NO: 1870489 - DNA, 16 bp, Homo sapiens
gtgttacattattcca

SEQ ID NO: 1870490 - DNA, 21 bp, Homo sapiens
gtgttgttatcatttaagatt

SEQ ID NO: 1870491 - DNA, 20 bp, Homo sapiens
gtgttttaaaaaaactgaag

SEQ ID NO: 1870492 - DNA, 14 bp, Homo sapiens
gttaaataaataga

SEQ ID NO: 1870493 - DNA, 12 bp, Homo sapiens
gttaagaaagga

SEQ ID NO: 1870494 - DNA, 21 bp, Homo sapiens
gttaagaaaggatataaaagg

SEQ ID NO: 1870495 - DNA, 22 bp, Homo sapiens
gttaagaaaggatataaaagga

SEQ ID NO: 1870496 - DNA, 12 bp, Homo sapiens
gttacaagtttg

SEQ ID NO: 1870497 - DNA, 23 bp, Homo sapiens
gttacaagtttgctaaaagaaga

SEQ ID NO: 1870498 - DNA, 20 bp, Homo sapiens
gttaccaagtatgaagtata

SEQ ID NO: 1870499 - DNA, 17 bp, Homo sapiens
gttacgtataatgcttt

SEQ ID NO: 1870500 - DNA, 22 bp, Homo sapiens
gttacttagaatgccataaaat

SEQ ID NO: 1870501 - DNA, 16 bp, Homo sapiens
gttataataactgaac

SEQ ID NO: 1870502 - DNA, 19 bp, Homo sapiens
gttataataactgaactgt

SEQ ID NO: 1870503 - DNA, 21 bp, Homo sapiens
gttataataactgaactgttt

SEQ ID NO: 1870504 - DNA, 22 bp, Homo sapiens
gttatgaaaatcctatatctgt

SEQ ID NO: 1870505 - DNA, 20 bp, Homo sapiens
gttcactaaactctgaataa

SEQ ID NO: 1870506 - DNA, 15 bp, Homo sapiens
gttctgcaagaatta

SEQ ID NO: 1870507 - DNA, 22 bp, Homo sapiens
gttcttgaattgttatgaaaat

SEQ ID NO: 1870508 - DNA, 15 bp, Homo sapiens
gttcttttttgtact

SEQ ID NO: 1870509 - DNA, 19 bp, Homo sapiens
gttgaaaattattttaaac

SEQ ID NO: 1870510 - DNA, 19 bp, Homo sapiens
gttgaatgacaacagaagc

SEQ ID NO: 1870511 - DNA, 15 bp, Homo sapiens
gttgcttttattgca

SEQ ID NO: 1870512 - DNA, 17 bp, Homo sapiens
gttggcgaggaaaaaca

SEQ ID NO: 1870513 - DNA, 22 bp, Homo sapiens
gttggctttacaaataattttt

SEQ ID NO: 1870514 - DNA, 14 bp, Homo sapiens
gttgtgtaataaca

SEQ ID NO: 1870515 - DNA, 15 bp, Homo sapiens
gttgttagtttcttt

SEQ ID NO: 1870516 - DNA, 19 bp, Homo sapiens
gttgttatcatttaagatt

SEQ ID NO: 1870517 - DNA, 15 bp, Homo sapiens
gttgttgtttgccaa

SEQ ID NO: 1870518 - DNA, 21 bp, Homo sapiens
gtttaattcattaatctgttt

SEQ ID NO: 1870519 - DNA, 19 bp, Homo sapiens
gtttacaagtgtatatcag

SEQ ID NO: 1870520 - DNA, 12 bp, Homo sapiens
gtttacagtgta

SEQ ID NO: 1870521 - DNA, 17 bp, Homo sapiens
gtttacagtttgtgttt

SEQ ID NO: 1870522 - DNA, 20 bp, Homo sapiens
gtttacagtttgtgttttaa

SEQ ID NO: 1870523 - DNA, 21 bp, Homo sapiens
gtttatagagggccaagactt

SEQ ID NO: 1870524 - DNA, 16 bp, Homo sapiens
gtttcagatatatatc

SEQ ID NO: 1870525 - DNA, 18 bp, Homo sapiens
gtttcccttttcctctag

SEQ ID NO: 1870526 - DNA, 23 bp, Homo sapiens
gtttctattttctctgatacttt

SEQ ID NO: 1870527 - DNA, 15 bp, Homo sapiens
gtttctcaagtttaa

SEQ ID NO: 1870528 - DNA, 16 bp, Homo sapiens
gtttgatttctagtat

SEQ ID NO: 1870529 - DNA, 14 bp, Homo sapiens
gtttgcacataaaa

SEQ ID NO: 1870530 - DNA, 17 bp, Homo sapiens
gtttgccaagctaatct

SEQ ID NO: 1870531 - DNA, 17 bp, Homo sapiens
gtttgctaaaagaagag

SEQ ID NO: 1870532 - DNA, 18 bp, Homo sapiens
gtttgctaaaagaagaga

SEQ ID NO: 1870533 - DNA, 23 bp, Homo sapiens
gtttggtacagttcataattcac

SEQ ID NO: 1870534 - DNA, 13 bp, Homo sapiens
gtttgtaaaacta

SEQ ID NO: 1870535 - DNA, 16 bp, Homo sapiens
gtttgtataacttctt

SEQ ID NO: 1870536 - DNA, 12 bp, Homo sapiens
gtttgtatattt

SEQ ID NO: 1870537 - DNA, 22 bp, Homo sapiens
gtttgtgttttaaaaaaactga

SEQ ID NO: 1870538 - DNA, 19 bp, Homo sapiens
gttttaaaaataagtttta

SEQ ID NO: 1870539 - DNA, 13 bp, Homo sapiens
atctataaacact

SEQ ID NO: 1870540 - DNA, 17 bp, Homo sapiens
atctataactacatatt

SEQ ID NO: 1870541 - DNA, 11 bp, Homo sapiens
atctataatat

SEQ ID NO: 1870542 - DNA, 23 bp, Homo sapiens
atctattgtgttggctttacaaa

SEQ ID NO: 1870543 - DNA, 19 bp, Homo sapiens
atctcaaattgtaattaat

SEQ ID NO: 1870544 - DNA, 19 bp, Homo sapiens
atctcataggttgccaata

SEQ ID NO: 1870545 - DNA, 23 bp, Homo sapiens
atctcataggttgccaataatac

SEQ ID NO: 1870546 - DNA, 19 bp, Homo sapiens
atctccacagtcaaagaag

SEQ ID NO: 1870547 - DNA, 15 bp, Homo sapiens
atctccagtattctt

SEQ ID NO: 1870548 - DNA, 18 bp, Homo sapiens
atctccagtattcttgtc

SEQ ID NO: 1870549 - DNA, 23 bp, Homo sapiens
atctccccttgcactaaagtatg

SEQ ID NO: 1870550 - DNA, 13 bp, Homo sapiens
atctctaatatgg

SEQ ID NO: 1870551 - DNA, 20 bp, Homo sapiens
atctgcctgtaattaaacta

SEQ ID NO: 1870552 - DNA, 13 bp, Homo sapiens
atctgtactttgt

SEQ ID NO: 1870553 - DNA, 13 bp, Homo sapiens
atctgtgtgaaaa

SEQ ID NO: 1870554 - DNA, 13 bp, Homo sapiens
atctgtttgtata

SEQ ID NO: 1870555 - DNA, 21 bp, Homo sapiens
atcttagagtttacagtttgt

SEQ ID NO: 1870556 - DNA, 16 bp, Homo sapiens
atcttggcttcttaaa

SEQ ID NO: 1870557 - DNA, 18 bp, Homo sapiens
atcttggcttcttaaaaa

SEQ ID NO: 1870558 - DNA, 20 bp, Homo sapiens
atcttggcttcttaaaaact

SEQ ID NO: 1870559 - DNA, 15 bp, Homo sapiens
atctttaaatacagt

SEQ ID NO: 1870560 - DNA, 20 bp, Homo sapiens
atctttaaatacagtcaact

SEQ ID NO: 1870561 - DNA, 18 bp, Homo sapiens
atctttatgcaaaaacat

SEQ ID NO: 1870562 - DNA, 16 bp, Homo sapiens
atctttgtttaaatgc

SEQ ID NO: 1870563 - DNA, 16 bp, Homo sapiens
atcttttaaaaatgat

SEQ ID NO: 1870564 - DNA, 13 bp, Homo sapiens
atcttttgtaaat

SEQ ID NO: 1870565 - DNA, 13 bp, Homo sapiens
atgaaaagccata

SEQ ID NO: 1870566 - DNA, 17 bp, Homo sapiens
atgaaaagccatatcta

SEQ ID NO: 1870567 - DNA, 22 bp, Homo sapiens
atgaaaatcctatatctgtttg

SEQ ID NO: 1870568 - DNA, 19 bp, Homo sapiens
atgaaattttctagacttt

SEQ ID NO: 1870569 - DNA, 23 bp, Homo sapiens
atgaaattttctagactttctgt

SEQ ID NO: 1870570 - DNA, 13 bp, Homo sapiens
atgaactgtggaa

SEQ ID NO: 1870571 - DNA, 15 bp, Homo sapiens
atgaactgtggaatt

SEQ ID NO: 1870572 - DNA, 15 bp, Homo sapiens
atgaacttttacaga

SEQ ID NO: 1870573 - DNA, 20 bp, Homo sapiens
atgaacttttacagaatgca

SEQ ID NO: 1870574 - DNA, 14 bp, Homo sapiens
atgacaaaaataac

SEQ ID NO: 1870575 - DNA, 13 bp, Homo sapiens
atgacgcctctgg

SEQ ID NO: 1870576 - DNA, 15 bp, Homo sapiens
atgacgcctctggac

SEQ ID NO: 1870577 - DNA, 15 bp, Homo sapiens
atgacggccaggctc

SEQ ID NO: 1870578 - DNA, 17 bp, Homo sapiens
atgagacacatacaaaa

SEQ ID NO: 1870579 - DNA, 18 bp, Homo sapiens
atgagattgttttatcat

SEQ ID NO: 1870580 - DNA, 22 bp, Homo sapiens
atgagattgttttatcatgaca

SEQ ID NO: 1870581 - DNA, 20 bp, Homo sapiens
atgagctcctgctcattgtg

SEQ ID NO: 1870582 - DNA, 20 bp, Homo sapiens
atgagggtgtcggctgtgag

SEQ ID NO: 1870583 - DNA, 19 bp, Homo sapiens
atgatacccaacagtttat

SEQ ID NO: 1870584 - DNA, 21 bp, Homo sapiens
atgatggaaacgcacttacaa

SEQ ID NO: 1870585 - DNA, 16 bp, Homo sapiens
atgattgcactaaata

SEQ ID NO: 1870586 - DNA, 19 bp, Homo sapiens
atgattgcactaaataaac

SEQ ID NO: 1870587 - DNA, 13 bp, Homo sapiens
atgattggttcag

SEQ ID NO: 1870588 - DNA, 15 bp, Homo sapiens
atgattggttcagtt

SEQ ID NO: 1870589 - DNA, 15 bp, Homo sapiens
atgattgtaaaatag

SEQ ID NO: 1870590 - DNA, 13 bp, Homo sapiens
atgatttatagtt

SEQ ID NO: 1870591 - DNA, 12 bp, Homo sapiens
atgcaaaaacat

SEQ ID NO: 1870592 - DNA, 16 bp, Homo sapiens
atgcaaaaacatatgt

SEQ ID NO: 1870593 - DNA, 18 bp, Homo sapiens
atgcaaaaacatatgtct

SEQ ID NO: 1870594 - DNA, 23 bp, Homo sapiens
atgcaaaaacatatgtctgtctt

SEQ ID NO: 1870595 - DNA, 14 bp, Homo sapiens
atgcaaactgcttt

SEQ ID NO: 1870596 - DNA, 13 bp, Homo sapiens
cacctacagcagc

SEQ ID NO: 1870597 - DNA, 17 bp, Homo sapiens
cacctacaggactgggc

SEQ ID NO: 1870598 - DNA, 15 bp, Homo sapiens
cacctattgaattac

SEQ ID NO: 1870599 - DNA, 13 bp, Homo sapiens
caccttgttacaa

SEQ ID NO: 1870600 - DNA, 21 bp, Homo sapiens
cacgaggaagcagcaattaat

SEQ ID NO: 1870601 - DNA, 18 bp, Homo sapiens
cacgatgacgcctctgga

SEQ ID NO: 1870602 - DNA, 20 bp, Homo sapiens
cacgcatgtccctccaaggc

SEQ ID NO: 1870603 - DNA, 15 bp, Homo sapiens
cacgcgcgcacacac

SEQ ID NO: 1870604 - DNA, 12 bp, Homo sapiens
cactaaactctg

SEQ ID NO: 1870605 - DNA, 15 bp, Homo sapiens
cactaaagtatgtaa

SEQ ID NO: 1870606 - DNA, 22 bp, Homo sapiens
cactaaattagtttaaaatgaa

SEQ ID NO: 1870607 - DNA, 21 bp, Homo sapiens
cactagctaagcaagccagga

SEQ ID NO: 1870608 - DNA, 17 bp, Homo sapiens
cactccaggtgtggacc

SEQ ID NO: 1870609 - DNA, 12 bp, Homo sapiens
cactcccccagg

SEQ ID NO: 1870610 - DNA, 16 bp, Homo sapiens
cactctaattagagaa

SEQ ID NO: 1870611 - DNA, 12 bp, Homo sapiens
cactgacagcct

SEQ ID NO: 1870612 - DNA, 14 bp, Homo sapiens
cactgacagcctgg

SEQ ID NO: 1870613 - DNA, 15 bp, Homo sapiens
cactgacagcctggg

SEQ ID NO: 1870614 - DNA, 20 bp, Homo sapiens
cactggcatcgcagcttcct

SEQ ID NO: 1870615 - DNA, 22 bp, Homo sapiens
cactgggccctggggctgccct

SEQ ID NO: 1870616 - DNA, 20 bp, Homo sapiens
cactgtggcactgccaccag

SEQ ID NO: 1870617 - DNA, 21 bp, Homo sapiens
cactgttgaaaattattttaa

SEQ ID NO: 1870618 - DNA, 15 bp, Homo sapiens
cacttagctatcaga

SEQ ID NO: 1870619 - DNA, 23 bp, Homo sapiens
cacttgagtggaggtttatagtt

SEQ ID NO: 1870620 - DNA, 21 bp, Homo sapiens
cactttgaaggtaataaatac

SEQ ID NO: 1870621 - DNA, 15 bp, Homo sapiens
cacttttctccaggg

SEQ ID NO: 1870622 - DNA, 17 bp, Homo sapiens
cactttttaaaaaactt

SEQ ID NO: 1870623 - DNA, 20 bp, Homo sapiens
cactttttaaaaaactttct

SEQ ID NO: 1870624 - DNA, 18 bp, Homo sapiens
cagaaaagggaagttgtg

SEQ ID NO: 1870625 - DNA, 15 bp, Homo sapiens
cagaaatacaacaga

SEQ ID NO: 1870626 - DNA, 16 bp, Homo sapiens
cagaaattaaaatatt

SEQ ID NO: 1870627 - DNA, 17 bp, Homo sapiens
cagaaattaaaatatta

SEQ ID NO: 1870628 - DNA, 21 bp, Homo sapiens
cagaaattaaaatattatttg

SEQ ID NO: 1870629 - DNA, 19 bp, Homo sapiens
cagaaccttactggcactg

SEQ ID NO: 1870630 - DNA, 23 bp, Homo sapiens
cagaagcagttgagtcgtcatca

SEQ ID NO: 1870631 - DNA, 18 bp, Homo sapiens
cagaatgcattaaaaaaa

SEQ ID NO: 1870632 - DNA, 16 bp, Homo sapiens
cagaatggagaaagta

SEQ ID NO: 1870633 - DNA, 17 bp, Homo sapiens
cagaatggagaaagtaa

SEQ ID NO: 1870634 - DNA, 18 bp, Homo sapiens
cagaattggcataatttg

SEQ ID NO: 1870635 - DNA, 18 bp, Homo sapiens
cagacttagtttttataa

SEQ ID NO: 1870636 - DNA, 16 bp, Homo sapiens
cagacttgcggccaca

SEQ ID NO: 1870637 - DNA, 20 bp, Homo sapiens
cagacttgcggccacagcac

SEQ ID NO: 1870638 - DNA, 15 bp, Homo sapiens
cagagaaagaaaagg

SEQ ID NO: 1870639 - DNA, 20 bp, Homo sapiens
cagagcttgtagccctggat

SEQ ID NO: 1870640 - DNA, 15 bp, Homo sapiens
cagaggacccacctg

SEQ ID NO: 1870641 - DNA, 16 bp, Homo sapiens
cagaggacccacctgg

SEQ ID NO: 1870642 - DNA, 17 bp, Homo sapiens
cagagggactggacagc

SEQ ID NO: 1870643 - DNA, 21 bp, Homo sapiens
cagagggactggacagccagg

SEQ ID NO: 1870644 - DNA, 23 bp, Homo sapiens
cagagggactggacagccagggc

SEQ ID NO: 1870645 - DNA, 15 bp, Homo sapiens
cagaggtttggagcc

SEQ ID NO: 1870646 - DNA, 20 bp, Homo sapiens
cagatatatatcatattggt

SEQ ID NO: 1870647 - DNA, 13 bp, Homo sapiens
cagattacaataa

SEQ ID NO: 1870648 - DNA, 17 bp, Homo sapiens
cagattacaataaatcc

SEQ ID NO: 1870649 - DNA, 15 bp, Homo sapiens
cagattttctcctgt

SEQ ID NO: 1870650 - DNA, 15 bp, Homo sapiens
cagcaatatgtaaat

SEQ ID NO: 1870651 - DNA, 18 bp, Homo sapiens
cagcaatgccctgccttg

SEQ ID NO: 1870652 - DNA, 19 bp, Homo sapiens
cagcaatgccctgccttgc

SEQ ID NO: 1870653 - DNA, 21 bp, Homo sapiens
cagcaatgccctgccttgctg

SEQ ID NO: 1870654 - DNA, 13 bp, Homo sapiens
cagcaattaatta

SEQ ID NO: 1870655 - DNA, 19 bp, Homo sapiens
cagcacctattgaattacc

SEQ ID NO: 1870656 - DNA, 22 bp, Homo sapiens
cagcacgttttctggcttctgc

SEQ ID NO: 1870657 - DNA, 17 bp, Homo sapiens
cagcactagagtcaccc

SEQ ID NO: 1870658 - DNA, 20 bp, Homo sapiens
cagcactagagtcacccccc

SEQ ID NO: 1870659 - DNA, 23 bp, Homo sapiens
cagcactagagtcacccccccag

SEQ ID NO: 1870660 - DNA, 14 bp, Homo sapiens
cagcatgacaaaaa

SEQ ID NO: 1870661 - DNA, 15 bp, Homo sapiens
cagcatgacaaaaat

SEQ ID NO: 1870662 - DNA, 17 bp, Homo sapiens
cagcatgacaaaaataa

SEQ ID NO: 1870663 - DNA, 19 bp, Homo sapiens
cagcatgacaaaaataaca

SEQ ID NO: 1870664 - DNA, 23 bp, Homo sapiens
cagcatgacaaaaataacactgt

SEQ ID NO: 1870665 - DNA, 18 bp, Homo sapiens
cagccaaggaatgtgtcc

SEQ ID NO: 1870666 - DNA, 14 bp, Homo sapiens
cagccagggcaggg

SEQ ID NO: 1870667 - DNA, 16 bp, Homo sapiens
cagcccacccagcaga

SEQ ID NO: 1870668 - DNA, 13 bp, Homo sapiens
cagcccactgggc

SEQ ID NO: 1870669 - DNA, 14 bp, Homo sapiens
cagcccactgggcc

SEQ ID NO: 1870670 - DNA, 16 bp, Homo sapiens
cagcccccactgacct

SEQ ID NO: 1870671 - DNA, 17 bp, Homo sapiens
cagccgtgcaggactct

SEQ ID NO: 1870672 - DNA, 19 bp, Homo sapiens
cagcctctggggcagagct

SEQ ID NO: 1870673 - DNA, 19 bp, Homo sapiens
cagcctgggggggccgctc

SEQ ID NO: 1870674 - DNA, 17 bp, Homo sapiens
cagcgccaagtggccac

SEQ ID NO: 1870675 - DNA, 15 bp, Homo sapiens
cagcgggccaggcag

SEQ ID NO: 1870676 - DNA, 16 bp, Homo sapiens
cagcgggccaggcagg

SEQ ID NO: 1870677 - DNA, 16 bp, Homo sapiens
cagctagaatttctgg

SEQ ID NO: 1870678 - DNA, 17 bp, Homo sapiens
cagctattcccttctga

SEQ ID NO: 1870679 - DNA, 22 bp, Homo sapiens
cagctattcccttctgatcttg

SEQ ID NO: 1870680 - DNA, 11 bp, Homo sapiens
cagctcctgga

SEQ ID NO: 1870681 - DNA, 12 bp, Homo sapiens
cagctggcactg

SEQ ID NO: 1870682 - DNA, 14 bp, Homo sapiens
cagctggcactgac

SEQ ID NO: 1870683 - DNA, 13 bp, Homo sapiens
cagcttcccctca

SEQ ID NO: 1870684 - DNA, 19 bp, Homo sapiens
cagctttacatgcaattta

SEQ ID NO: 1870685 - DNA, 15 bp, Homo sapiens
cagctttgggaaagc

SEQ ID NO: 1870686 - DNA, 16 bp, Homo sapiens
cagctttttgtattaa

SEQ ID NO: 1870687 - DNA, 19 bp, Homo sapiens
caggaaagctcagctactg

SEQ ID NO: 1870688 - DNA, 12 bp, Homo sapiens
caggactgggcc

SEQ ID NO: 1870689 - DNA, 15 bp, Homo sapiens
caggactgggccggg

SEQ ID NO: 1870690 - DNA, 16 bp, Homo sapiens
caggactgggccgggc

SEQ ID NO: 1870691 - DNA, 16 bp, Homo sapiens
caggagaagacccctg

SEQ ID NO: 1870692 - DNA, 17 bp, Homo sapiens
caggagaagacccctgc

SEQ ID NO: 1870693 - DNA, 18 bp, Homo sapiens
caggagaagacccctgcc

SEQ ID NO: 1870694 - DNA, 20 bp, Homo sapiens
caggagaagacccctgccca

SEQ ID NO: 1870695 - DNA, 13 bp, Homo sapiens
caggagcagctgg

SEQ ID NO: 1870696 - DNA, 18 bp, Homo sapiens
caggagcagctggcactg

SEQ ID NO: 1870697 - DNA, 14 bp, Homo sapiens
caggccaggccagc

SEQ ID NO: 1870698 - DNA, 15 bp, Homo sapiens
caggcctccagaacc

SEQ ID NO: 1870699 - DNA, 14 bp, Homo sapiens
caggctccctgacc

SEQ ID NO: 1870700 - DNA, 17 bp, Homo sapiens
cagggcctctggcttcc

SEQ ID NO: 1870701 - DNA, 18 bp, Homo sapiens
caggtcatggagcagccc

SEQ ID NO: 1870702 - DNA, 19 bp, Homo sapiens
caggtcatggagcagcccc

SEQ ID NO: 1870703 - DNA, 15 bp, Homo sapiens
cagtaaacactgtgt

SEQ ID NO: 1870704 - DNA, 19 bp, Homo sapiens
cagtaatatgaaagccaca

SEQ ID NO: 1870705 - DNA, 21 bp, Homo sapiens
cagtacaatgtgactttgaaa

SEQ ID NO: 1870706 - DNA, 22 bp, Homo sapiens
cagtataatctcctctgctcat

SEQ ID NO: 1870707 - DNA, 19 bp, Homo sapiens
cagtatcttagagtttaca

SEQ ID NO: 1870708 - DNA, 13 bp, Homo sapiens
cagtattcttgtc

SEQ ID NO: 1870709 - DNA, 19 bp, Homo sapiens
cagtattcttgtcaaaaaa

SEQ ID NO: 1870710 - DNA, 12 bp, Homo sapiens
cagtattttcca

SEQ ID NO: 1870711 - DNA, 18 bp, Homo sapiens
cagtattttccagcctta

SEQ ID NO: 1870712 - DNA, 18 bp, Homo sapiens
cagtattttggagaaatt

SEQ ID NO: 1870713 - DNA, 21 bp, Homo sapiens
tggtcgagtctttgtgtgtta

SEQ ID NO: 1870714 - DNA, 23 bp, Homo sapiens
tggtgtatcccccccctgtatag

SEQ ID NO: 1870715 - DNA, 21 bp, Homo sapiens
tggttccaaaccagtttattc

SEQ ID NO: 1870716 - DNA, 14 bp, Homo sapiens
tggtttagtctttt

SEQ ID NO: 1870717 - DNA, 11 bp, Homo sapiens
tggtttataga

SEQ ID NO: 1870718 - DNA, 17 bp, Homo sapiens
tggtttctcattaaact

SEQ ID NO: 1870719 - DNA, 13 bp, Homo sapiens
tggtttgtttgct

SEQ ID NO: 1870720 - DNA, 14 bp, Homo sapiens
tgtaaaagttataa

SEQ ID NO: 1870721 - DNA, 23 bp, Homo sapiens
tgtaaaagttataataactgaac

SEQ ID NO: 1870722 - DNA, 18 bp, Homo sapiens
tgtaaaataagaatgatt

SEQ ID NO: 1870723 - DNA, 12 bp, Homo sapiens
tgtaaaatagct

SEQ ID NO: 1870724 - DNA, 21 bp, Homo sapiens
tgtaaaatagcttgtatagtg

SEQ ID NO: 1870725 - DNA, 18 bp, Homo sapiens
tgtaaagtatgtaaacag

SEQ ID NO: 1870726 - DNA, 22 bp, Homo sapiens
tgtaaagtgcaatgtcctgcat

SEQ ID NO: 1870727 - DNA, 21 bp, Homo sapiens
tgtaaataaccacactgaaac

SEQ ID NO: 1870728 - DNA, 23 bp, Homo sapiens
tgtaaataaccacactgaaacct

SEQ ID NO: 1870729 - DNA, 22 bp, Homo sapiens
tgtaataaacccttaactggca

SEQ ID NO: 1870730 - DNA, 20 bp, Homo sapiens
tgtaatagaaaactgaaaat

SEQ ID NO: 1870731 - DNA, 19 bp, Homo sapiens
tgtaattaaactagtttaa

SEQ ID NO: 1870732 - DNA, 22 bp, Homo sapiens
tgtaattaaactagtttaaggg

SEQ ID NO: 1870733 - DNA, 13 bp, Homo sapiens
tgtaatttgaatt

SEQ ID NO: 1870734 - DNA, 15 bp, Homo sapiens
tgtaatttgaattgg

SEQ ID NO: 1870735 - DNA, 16 bp, Homo sapiens
tgtaccatattgctct

SEQ ID NO: 1870736 - DNA, 19 bp, Homo sapiens
tgtacctctagctgttctt

SEQ ID NO: 1870737 - DNA, 19 bp, Homo sapiens
tgtactataacatagaatt

SEQ ID NO: 1870738 - DNA, 20 bp, Homo sapiens
tgtacttaaatgagttactt

SEQ ID NO: 1870739 - DNA, 13 bp, Homo sapiens
tgtactttgcttc

SEQ ID NO: 1870740 - DNA, 15 bp, Homo sapiens
tgtactttgcttctt

SEQ ID NO: 1870741 - DNA, 20 bp, Homo sapiens
tgtacttttctggttccaaa

SEQ ID NO: 1870742 - DNA, 12 bp, Homo sapiens
tgtagccctgga

SEQ ID NO: 1870743 - DNA, 21 bp, Homo sapiens
tgtagccctggatggcctctg

SEQ ID NO: 1870744 - DNA, 23 bp, Homo sapiens
tgtagccctggatggcctctggg

SEQ ID NO: 1870745 - DNA, 17 bp, Homo sapiens
tgtaggcacttttattt

SEQ ID NO: 1870746 - DNA, 14 bp, Homo sapiens
tgtataaaaaggaa

SEQ ID NO: 1870747 - DNA, 17 bp, Homo sapiens
tgtataaaaaggaaatt

SEQ ID NO: 1870748 - DNA, 15 bp, Homo sapiens
tgtatagtgtaaaat

SEQ ID NO: 1870749 - DNA, 13 bp, Homo sapiens
tgtatatcagaaa

SEQ ID NO: 1870750 - DNA, 18 bp, Homo sapiens
tgtatatcagaaaaggga

SEQ ID NO: 1870751 - DNA, 20 bp, Homo sapiens
tgtatcattaaaatatatgt

SEQ ID NO: 1870752 - DNA, 23 bp, Homo sapiens
tgtatcattaaaatatatgttct

SEQ ID NO: 1870753 - DNA, 20 bp, Homo sapiens
tgtatcccccccctgtatag

SEQ ID NO: 1870754 - DNA, 21 bp, Homo sapiens
tgtatcccccccctgtatagt

SEQ ID NO: 1870755 - DNA, 18 bp, Homo sapiens
tgtatctttggggaaact

SEQ ID NO: 1870756 - DNA, 15 bp, Homo sapiens
tgtatgagactgtgt

SEQ ID NO: 1870757 - DNA, 18 bp, Homo sapiens
tgtattaacaaagttact

SEQ ID NO: 1870758 - DNA, 20 bp, Homo sapiens
tgtattataattgttgatat

SEQ ID NO: 1870759 - DNA, 20 bp, Homo sapiens
tgtatttcagtattttccag

SEQ ID NO: 1870760 - DNA, 14 bp, Homo sapiens
tgtatttctttgta

SEQ ID NO: 1870761 - DNA, 16 bp, Homo sapiens
tgtcaaatgaactttt

SEQ ID NO: 1870762 - DNA, 23 bp, Homo sapiens
tgtcagacatccatgtttgtaaa

SEQ ID NO: 1870763 - DNA, 23 bp, Homo sapiens
tgtcagcgcaggtttagtttact

SEQ ID NO: 1870764 - DNA, 23 bp, Homo sapiens
tgtcatcatcagacttgcggcca

SEQ ID NO: 1870765 - DNA, 22 bp, Homo sapiens
tgtcatttgacaacacatgtgg

SEQ ID NO: 1870766 - DNA, 23 bp, Homo sapiens
tgtccaagacacatgctgaggtt

SEQ ID NO: 1870767 - DNA, 18 bp, Homo sapiens
tgtccagagggactggac

SEQ ID NO: 1870768 - DNA, 21 bp, Homo sapiens
tgtccagagggactggacagc

SEQ ID NO: 1870769 - DNA, 13 bp, Homo sapiens
tgtccagttataa

SEQ ID NO: 1870770 - DNA, 11 bp, Homo sapiens
tgtcccagtcc

SEQ ID NO: 1870771 - DNA, 18 bp, Homo sapiens
tgtcccagtccaaattgt

SEQ ID NO: 1870772 - DNA, 18 bp, Homo sapiens
tgtcccagtcccagcctc

SEQ ID NO: 1870773 - DNA, 22 bp, Homo sapiens
tgtcccagtcccagcctctggg

SEQ ID NO: 1870774 - DNA, 14 bp, Homo sapiens
tgtccctccaaggc

SEQ ID NO: 1870775 - DNA, 19 bp, Homo sapiens
tgtccctccaaggctgtct

SEQ ID NO: 1870776 - DNA, 20 bp, Homo sapiens
tgtcctgtagaggttttgtt

SEQ ID NO: 1870777 - DNA, 14 bp, Homo sapiens
tgtctgcagctcct

SEQ ID NO: 1870778 - DNA, 15 bp, Homo sapiens
tgtctgcagctcctg

SEQ ID NO: 1870779 - DNA, 17 bp, Homo sapiens
tgtctgcagctcctgga

SEQ ID NO: 1870780 - DNA, 15 bp, Homo sapiens
tgtctggttttaaca

SEQ ID NO: 1870781 - DNA, 16 bp, Homo sapiens
tgtctggttttaacaa

SEQ ID NO: 1870782 - DNA, 14 bp, Homo sapiens
tgtctgtctgctct

SEQ ID NO: 1870783 - DNA, 14 bp, Homo sapiens
tgtctgtgtgctgt

SEQ ID NO: 1870784 - DNA, 22 bp, Homo sapiens
tgtctgtttatatattgaaagt

SEQ ID NO: 1870785 - DNA, 14 bp, Homo sapiens
tgtcttgaaacctt

SEQ ID NO: 1870786 - DNA, 11 bp, Homo sapiens
tgtctttcaaa

SEQ ID NO: 1870787 - DNA, 13 bp, Homo sapiens
tgtctttgcaaag

SEQ ID NO: 1870788 - DNA, 13 bp, Homo sapiens
tgtgaaaatgggt

SEQ ID NO: 1870789 - DNA, 23 bp, Homo sapiens
tgtgaatttcttcactgttgaaa

SEQ ID NO: 1870790 - DNA, 12 bp, Homo sapiens
tgtgagaagatg

SEQ ID NO: 1870791 - DNA, 21 bp, Homo sapiens
tgtgagaagatgggggctgga

SEQ ID NO: 1870792 - DNA, 15 bp, Homo sapiens
tgtgatgaactttct

SEQ ID NO: 1870793 - DNA, 17 bp, Homo sapiens
tgtgatttagaactgta

SEQ ID NO: 1870794 - DNA, 18 bp, Homo sapiens
tgtgatttagaactgtat

SEQ ID NO: 1870795 - DNA, 18 bp, Homo sapiens
tgtgcagtgttagtattc

SEQ ID NO: 1870796 - DNA, 20 bp, Homo sapiens
tgtgccatagagtttaacac

SEQ ID NO: 1870797 - DNA, 21 bp, Homo sapiens
tgtgcctcccttttctcctct

SEQ ID NO: 1870798 - DNA, 16 bp, Homo sapiens
tgtgccttttatagct

SEQ ID NO: 1870799 - DNA, 22 bp, Homo sapiens
tgtgctgtacattactgtatgt

SEQ ID NO: 1870800 - DNA, 20 bp, Homo sapiens
tgtggttctataataagttt

SEQ ID NO: 1870801 - DNA, 16 bp, Homo sapiens
tgtgtaatagaaaact

SEQ ID NO: 1870802 - DNA, 13 bp, Homo sapiens
tgtgtatcattaa

SEQ ID NO: 1870803 - DNA, 14 bp, Homo sapiens
tgtgtatcattaaa

SEQ ID NO: 1870804 - DNA, 12 bp, Homo sapiens
tgtgtatgagac

SEQ ID NO: 1870805 - DNA, 20 bp, Homo sapiens
tgtgtattgagtcttaactg

SEQ ID NO: 1870806 - DNA, 15 bp, Homo sapiens
tgtgtctgtgttgct

SEQ ID NO: 1870807 - DNA, 16 bp, Homo sapiens
tgtgtgatgaactttc

SEQ ID NO: 1870808 - DNA, 18 bp, Homo sapiens
tgtgtgcaactaactgac

SEQ ID NO: 1870809 - DNA, 17 bp, Homo sapiens
tgtgtgcaccttaccaa

SEQ ID NO: 1870810 - DNA, 24 bp, Homo sapiens
tgtgtgccatagagtttaacacaa

SEQ ID NO: 1870811 - DNA, 15 bp, Homo sapiens
tgtgttatattccaa

SEQ ID NO: 1870812 - DNA, 13 bp, Homo sapiens
tgtgttgcttcaa

SEQ ID NO: 1870813 - DNA, 13 bp, Homo sapiens
tgtgttggcttta

SEQ ID NO: 1870814 - DNA, 18 bp, Homo sapiens
tgttacaagtttgctaaa

SEQ ID NO: 1870815 - DNA, 12 bp, Homo sapiens
tgttactgcttc

SEQ ID NO: 1870816 - DNA, 13 bp, Homo sapiens
tgttactgcttct

SEQ ID NO: 1870817 - DNA, 21 bp, Homo sapiens
tgttactgcttctctttgtgc

SEQ ID NO: 1870818 - DNA, 19 bp, Homo sapiens
tgttatattccaaggaaaa

SEQ ID NO: 1870819 - DNA, 20 bp, Homo sapiens
tgttatattccaaggaaaat

SEQ ID NO: 1870820 - DNA, 22 bp, Homo sapiens
tgttatattccaaggaaaattg

SEQ ID NO: 1870821 - DNA, 18 bp, Homo sapiens
tgttattaaaaaaacaca

SEQ ID NO: 1870822 - DNA, 15 bp, Homo sapiens
tgttattaatgtttc

SEQ ID NO: 1870823 - DNA, 18 bp, Homo sapiens
tgttattaatgtttcttc

SEQ ID NO: 1870824 - DNA, 12 bp, Homo sapiens
tgttccaaattt

SEQ ID NO: 1870825 - DNA, 20 bp, Homo sapiens
tgttctgcaagaattaaaac

SEQ ID NO: 1870826 - DNA, 15 bp, Homo sapiens
tgttcttggtctccc

SEQ ID NO: 1870827 - DNA, 17 bp, Homo sapiens
tgttgatattttccctt

SEQ ID NO: 1870828 - DNA, 14 bp, Homo sapiens
tgttgcttcaaatt

SEQ ID NO: 1870829 - DNA, 11 bp, Homo sapiens
tgttgtttgcc

SEQ ID NO: 1870830 - DNA, 13 bp, Homo sapiens
tgtttaaatgcca

SEQ ID NO: 1870831 - DNA, 12 bp, Homo sapiens
acacatacacac

SEQ ID NO: 1870832 - DNA, 22 bp, Homo sapiens
acacatgctgaggttttgaata

SEQ ID NO: 1870833 - DNA, 23 bp, Homo sapiens
acacatgctgaggttttgaataa

SEQ ID NO: 1870834 - DNA, 11 bp, Homo sapiens
acaccactggg

SEQ ID NO: 1870835 - DNA, 19 bp, Homo sapiens
acactaaattagtttaaaa

SEQ ID NO: 1870836 - DNA, 20 bp, Homo sapiens
acactaaattagtttaaaat

SEQ ID NO: 1870837 - DNA, 12 bp, Homo sapiens
acactaattcct

SEQ ID NO: 1870838 - DNA, 18 bp, Homo sapiens
acactgttggcacttata

SEQ ID NO: 1870839 - DNA, 22 bp, Homo sapiens
acagaagcagttgagtcgtcat

SEQ ID NO: 1870840 - DNA, 13 bp, Homo sapiens
acagaagcttcag

SEQ ID NO: 1870841 - DNA, 13 bp, Homo sapiens
acagaagtcaggt

SEQ ID NO: 1870842 - DNA, 17 bp, Homo sapiens
acagaatgcattaaaaa

SEQ ID NO: 1870843 - DNA, 13 bp, Homo sapiens
acagagaaagaaa

SEQ ID NO: 1870844 - DNA, 14 bp, Homo sapiens
acagagaaagaaaa

SEQ ID NO: 1870845 - DNA, 17 bp, Homo sapiens
acagagaaagaaaaggc

SEQ ID NO: 1870846 - DNA, 21 bp, Homo sapiens
acagattcctgttgtgtaata

SEQ ID NO: 1870847 - DNA, 17 bp, Homo sapiens
acagccagggcagggct

SEQ ID NO: 1870848 - DNA, 12 bp, Homo sapiens
acagcctctgac

SEQ ID NO: 1870849 - DNA, 15 bp, Homo sapiens
acagctgagagactt

SEQ ID NO: 1870850 - DNA, 19 bp, Homo sapiens
acagctgagagacttttaa

SEQ ID NO: 1870851 - DNA, 17 bp, Homo sapiens
acagtaatatgaaagcc

SEQ ID NO: 1870852 - DNA, 18 bp, Homo sapiens
acagtcctaactggtata

SEQ ID NO: 1870853 - DNA, 21 bp, Homo sapiens
acagtggcactaaaatgttta

SEQ ID NO: 1870854 - DNA, 17 bp, Homo sapiens
acagtgtatttaagaaa

SEQ ID NO: 1870855 - DNA, 16 bp, Homo sapiens
acagttatagaaagca

SEQ ID NO: 1870856 - DNA, 15 bp, Homo sapiens
acagtttatttttat

SEQ ID NO: 1870857 - DNA, 12 bp, Homo sapiens
acagtttgtgtt

SEQ ID NO: 1870858 - DNA, 20 bp, Homo sapiens
acagtttgtgttttaaaaaa

SEQ ID NO: 1870859 - DNA, 21 bp, Homo sapiens
acataaaacgtatagtcaata

SEQ ID NO: 1870860 - DNA, 12 bp, Homo sapiens
acataaaacttt

SEQ ID NO: 1870861 - DNA, 13 bp, Homo sapiens
acataaaacttta

SEQ ID NO: 1870862 - DNA, 14 bp, Homo sapiens
acataaaactttaa

SEQ ID NO: 1870863 - DNA, 17 bp, Homo sapiens
acataaaactttaaaag

SEQ ID NO: 1870864 - DNA, 18 bp, Homo sapiens
acataaaactttaaaagg

SEQ ID NO: 1870865 - DNA, 13 bp, Homo sapiens
acataaacagttt

SEQ ID NO: 1870866 - DNA, 13 bp, Homo sapiens
acataatttgcaa

SEQ ID NO: 1870867 - DNA, 14 bp, Homo sapiens
acataatttgcaat

SEQ ID NO: 1870868 - DNA, 21 bp, Homo sapiens
acatacaaaaaaaatctttaa

SEQ ID NO: 1870869 - DNA, 22 bp, Homo sapiens
acatacaaaaaaaatctttaat

SEQ ID NO: 1870870 - DNA, 16 bp, Homo sapiens
acatataacacttaac

SEQ ID NO: 1870871 - DNA, 14 bp, Homo sapiens
acatatgtatcttt

SEQ ID NO: 1870872 - DNA, 20 bp, Homo sapiens
acatatgtctgtctttgcaa

SEQ ID NO: 1870873 - DNA, 23 bp, Homo sapiens
acatattattggtcaagaaaagc

SEQ ID NO: 1870874 - DNA, 20 bp, Homo sapiens
acatccatgtttgtaaaact

SEQ ID NO: 1870875 - DNA, 13 bp, Homo sapiens
acatctaaagctt

SEQ ID NO: 1870876 - DNA, 18 bp, Homo sapiens
acatgctgaggttttgaa

SEQ ID NO: 1870877 - DNA, 13 bp, Homo sapiens
acatgtggtttat

SEQ ID NO: 1870878 - DNA, 16 bp, Homo sapiens
acatgtggtttataga

SEQ ID NO: 1870879 - DNA, 14 bp, Homo sapiens
acatgttatatatt

SEQ ID NO: 1870880 - DNA, 15 bp, Homo sapiens
acattactgtatgta

SEQ ID NO: 1870881 - DNA, 16 bp, Homo sapiens
acattactgtatgtat

SEQ ID NO: 1870882 - DNA, 23 bp, Homo sapiens
acattcttggttgttaatttaga

SEQ ID NO: 1870883 - DNA, 16 bp, Homo sapiens
acattgatttgatttt

SEQ ID NO: 1870884 - DNA, 21 bp, Homo sapiens
acattgtaaacgtattttgat

SEQ ID NO: 1870885 - DNA, 21 bp, Homo sapiens
acatttagtaccctgcaggcc

SEQ ID NO: 1870886 - DNA, 14 bp, Homo sapiens
acatttctgtatac

SEQ ID NO: 1870887 - DNA, 15 bp, Homo sapiens
acatttctgtatact

SEQ ID NO: 1870888 - DNA, 18 bp, Homo sapiens
accaaatgtaactatgtt

SEQ ID NO: 1870889 - DNA, 12 bp, Homo sapiens
accaactttctg

SEQ ID NO: 1870890 - DNA, 13 bp, Homo sapiens
accaactttctgt

SEQ ID NO: 1870891 - DNA, 18 bp, Homo sapiens
accaactttctgtaaact

SEQ ID NO: 1870892 - DNA, 19 bp, Homo sapiens
accaactttctgtaaactc

SEQ ID NO: 1870893 - DNA, 18 bp, Homo sapiens
accaagaaaggaacctgt

SEQ ID NO: 1870894 - DNA, 19 bp, Homo sapiens
accaagggccctcactcag

SEQ ID NO: 1870895 - DNA, 16 bp, Homo sapiens
accaccctgcctgtgg

SEQ ID NO: 1870896 - DNA, 17 bp, Homo sapiens
accaccctgcctgtgga

SEQ ID NO: 1870897 - DNA, 20 bp, Homo sapiens
accacgatgacgcctctgga

SEQ ID NO: 1870898 - DNA, 19 bp, Homo sapiens
accactagctaagcaagcc

SEQ ID NO: 1870899 - DNA, 17 bp, Homo sapiens
accagcaatatgtaaat

SEQ ID NO: 1870900 - DNA, 18 bp, Homo sapiens
accagcaatgccctgcct

SEQ ID NO: 1870901 - DNA, 19 bp, Homo sapiens
accagcaatgccctgcctt

SEQ ID NO: 1870902 - DNA, 23 bp, Homo sapiens
accagtgcccaaagtctgtgtga

SEQ ID NO: 1870903 - DNA, 16 bp, Homo sapiens
accataggaagacata

SEQ ID NO: 1870904 - DNA, 22 bp, Homo sapiens
accataggaagacataaaactt

SEQ ID NO: 1870905 - DNA, 23 bp, Homo sapiens
accatattgctcttaaaaatctt

SEQ ID NO: 1870906 - DNA, 13 bp, Homo sapiens
accatctaatagc

SEQ ID NO: 1870907 - DNA, 16 bp, Homo sapiens
accatgacaaacctag

SEQ ID NO: 1870908 - DNA, 18 bp, Homo sapiens
accatgacaaacctagct

SEQ ID NO: 1870909 - DNA, 21 bp, Homo sapiens
accattgaaatcagcatgaca

SEQ ID NO: 1870910 - DNA, 20 bp, Homo sapiens
acccaagaaaacctgttttt

SEQ ID NO: 1870911 - DNA, 13 bp, Homo sapiens
acccagaaggacc

SEQ ID NO: 1870912 - DNA, 21 bp, Homo sapiens
tataataagttttgatataat

SEQ ID NO: 1870913 - DNA, 18 bp, Homo sapiens
tataatcatgctcatgta

SEQ ID NO: 1870914 - DNA, 23 bp, Homo sapiens
tataatcatgctcatgtatattt

SEQ ID NO: 1870915 - DNA, 18 bp, Homo sapiens
tataatctcctctgctca

SEQ ID NO: 1870916 - DNA, 21 bp, Homo sapiens
ttgaatagaggccaaattaat

SEQ ID NO: 1870917 - DNA, 22 bp, Homo sapiens
ttgaatagaggccaaattaatc

SEQ ID NO: 1870918 - DNA, 20 bp, Homo sapiens
ttgaatgacaacagaagctt

SEQ ID NO: 1870919 - DNA, 23 bp, Homo sapiens
ttgaatgttatttgttattttca

SEQ ID NO: 1870920 - DNA, 17 bp, Homo sapiens
ttgagaataagaatttg

SEQ ID NO: 1870921 - DNA, 18 bp, Homo sapiens
ttgagtatattataatag

SEQ ID NO: 1870922 - DNA, 13 bp, Homo sapiens
ttgatataatctt

SEQ ID NO: 1870923 - DNA, 15 bp, Homo sapiens
ttgatattttcacag

SEQ ID NO: 1870924 - DNA, 19 bp, Homo sapiens
ttgatctttgtttaaatgc

SEQ ID NO: 1870925 - DNA, 20 bp, Homo sapiens
ttgatttgatctttgtttaa

SEQ ID NO: 1870926 - DNA, 17 bp, Homo sapiens
ttgcaaaccctttgtat

SEQ ID NO: 1870927 - DNA, 19 bp, Homo sapiens
ttgcaaaccctttgtatta

SEQ ID NO: 1870928 - DNA, 14 bp, Homo sapiens
ttgcaccattttca

SEQ ID NO: 1870929 - DNA, 19 bp, Homo sapiens
ttgcactaaataaactact

SEQ ID NO: 1870930 - DNA, 13 bp, Homo sapiens
ttgcagtcttttg

SEQ ID NO: 1870931 - DNA, 19 bp, Homo sapiens
ttgccaagctaatctgcct

SEQ ID NO: 1870932 - DNA, 15 bp, Homo sapiens
ttgccccaaatcaca

SEQ ID NO: 1870933 - DNA, 16 bp, Homo sapiens
ttgccttaaagaaagt

SEQ ID NO: 1870934 - DNA, 13 bp, Homo sapiens
ttgccttaagttt

SEQ ID NO: 1870935 - DNA, 14 bp, Homo sapiens
ttgctaaaagaaga

SEQ ID NO: 1870936 - DNA, 15 bp, Homo sapiens
ttgctaaaagaagag

SEQ ID NO: 1870937 - DNA, 17 bp, Homo sapiens
ttgctaaaagaagagag

SEQ ID NO: 1870938 - DNA, 12 bp, Homo sapiens
ttgctgccctgg

SEQ ID NO: 1870939 - DNA, 14 bp, Homo sapiens
ttgctgttactgct

SEQ ID NO: 1870940 - DNA, 15 bp, Homo sapiens
ttgctgttactgctt

SEQ ID NO: 1870941 - DNA, 15 bp, Homo sapiens
ttgcttcaaattggt

SEQ ID NO: 1870942 - DNA, 15 bp, Homo sapiens
ttggagaaattattt

SEQ ID NO: 1870943 - DNA, 18 bp, Homo sapiens
tgaaaattattttaaaca

SEQ ID NO: 1870944 - DNA, 18 bp, Homo sapiens
tgaaacagagaaagaaaa

SEQ ID NO: 1870945 - DNA, 20 bp, Homo sapiens
tgaaacagagaaagaaaagg

SEQ ID NO: 1870946 - DNA, 22 bp, Homo sapiens
tgaaacagagaaagaaaaggca

SEQ ID NO: 1870947 - DNA, 12 bp, Homo sapiens
tgaaacatgctt

SEQ ID NO: 1870948 - DNA, 18 bp, Homo sapiens
tgaaaccaaatgtaacta

SEQ ID NO: 1870949 - DNA, 16 bp, Homo sapiens
tgaaagaattctattt

SEQ ID NO: 1870950 - DNA, 21 bp, Homo sapiens
tgaaagaattctattttgctg

SEQ ID NO: 1870951 - DNA, 17 bp, Homo sapiens
tgaaaggctatcctgct

SEQ ID NO: 1870952 - DNA, 18 bp, Homo sapiens
tgaaagtattcagaaatt

SEQ ID NO: 1870953 - DNA, 19 bp, Homo sapiens
tgaaagtattcagaaatta

SEQ ID NO: 1870954 - DNA, 21 bp, Homo sapiens
tgaaagtattcagaaattaaa

SEQ ID NO: 1870955 - DNA, 22 bp, Homo sapiens
tgaaagtattcagaaattaaaa

SEQ ID NO: 1870956 - DNA, 12 bp, Homo sapiens
tgaaagttgctt

SEQ ID NO: 1870957 - DNA, 13 bp, Homo sapiens
tgaaagttgcttt

SEQ ID NO: 1870958 - DNA, 19 bp, Homo sapiens
tgaaagttgcttttattgc

SEQ ID NO: 1870959 - DNA, 11 bp, Homo sapiens
tgaaataattt

SEQ ID NO: 1870960 - DNA, 18 bp, Homo sapiens
tgaaatcagcatgacaaa

SEQ ID NO: 1870961 - DNA, 17 bp, Homo sapiens
tgaaatcagtaaacact

SEQ ID NO: 1870962 - DNA, 22 bp, Homo sapiens
tgaaatttattagttaatatat

SEQ ID NO: 1870963 - DNA, 17 bp, Homo sapiens
tgaaattttctagactt

SEQ ID NO: 1870964 - DNA, 18 bp, Homo sapiens
tgaaattttctagacttt

SEQ ID NO: 1870965 - DNA, 21 bp, Homo sapiens
tgaaattttctagactttctg

SEQ ID NO: 1870966 - DNA, 13 bp, Homo sapiens
tgaacacatggca

SEQ ID NO: 1870967 - DNA, 19 bp, Homo sapiens
tgaacatttagtaccctgc

SEQ ID NO: 1870968 - DNA, 21 bp, Homo sapiens
tgaactttctcttcatacttt

SEQ ID NO: 1870969 - DNA, 16 bp, Homo sapiens
tgaacttttacagaat

SEQ ID NO: 1870970 - DNA, 12 bp, Homo sapiens
tgaacttttgta

SEQ ID NO: 1870971 - DNA, 13 bp, Homo sapiens
tgaacttttgtaa

SEQ ID NO: 1870972 - DNA, 23 bp, Homo sapiens
tgaacttttgtaatttgaattgg

SEQ ID NO: 1870973 - DNA, 14 bp, Homo sapiens
tgaagcaatttata

SEQ ID NO: 1870974 - DNA, 18 bp, Homo sapiens
tgaagcaatttatatctt

SEQ ID NO: 1870975 - DNA, 22 bp, Homo sapiens
tgaagtcgagcactctaattag

SEQ ID NO: 1870976 - DNA, 11 bp, Homo sapiens
tgaataaaaag

SEQ ID NO: 1870977 - DNA, 18 bp, Homo sapiens
tgaataaaaagtgaactt

SEQ ID NO: 1870978 - DNA, 19 bp, Homo sapiens
tgaataaaaagtgaacttt

SEQ ID NO: 1870979 - DNA, 12 bp, Homo sapiens
tgaataagcact

SEQ ID NO: 1870980 - DNA, 13 bp, Homo sapiens
tgaataagcactt

SEQ ID NO: 1870981 - DNA, 15 bp, Homo sapiens
tgaataagcactttt

SEQ ID NO: 1870982 - DNA, 15 bp, Homo sapiens
tgaatgacaacagaa

SEQ ID NO: 1870983 - DNA, 19 bp, Homo sapiens
tgaatgctttttgaatgtt

SEQ ID NO: 1870984 - DNA, 23 bp, Homo sapiens
tgaattaccatagagtaatgatg

SEQ ID NO: 1870985 - DNA, 14 bp, Homo sapiens
tgaattgaaatggg

SEQ ID NO: 1870986 - DNA, 14 bp, Homo sapiens
tgacaaaaataaca

SEQ ID NO: 1870987 - DNA, 22 bp, Homo sapiens
tgacaaacctagcttttaaaaa

SEQ ID NO: 1870988 - DNA, 13 bp, Homo sapiens
tgacaacagaagc

SEQ ID NO: 1870989 - DNA, 22 bp, Homo sapiens
tgacaacagaagcttcagaagt

SEQ ID NO: 1870990 - DNA, 12 bp, Homo sapiens
tgacagcctctg

SEQ ID NO: 1870991 - DNA, 13 bp, Homo sapiens
tgacagcctctga

SEQ ID NO: 1870992 - DNA, 15 bp, Homo sapiens
tgacataattgtcca

SEQ ID NO: 1870993 - DNA, 19 bp, Homo sapiens
tgacatgttatatattttt

SEQ ID NO: 1870994 - DNA, 13 bp, Homo sapiens
tgaccaccctgcc

SEQ ID NO: 1870995 - DNA, 12 bp, Homo sapiens
tgacctgcccat

SEQ ID NO: 1870996 - DNA, 12 bp, Homo sapiens
tgacgcctctgg

SEQ ID NO: 1870997 - DNA, 23 bp, Homo sapiens
tgacggccaggctccctgaccac

SEQ ID NO: 1870998 - DNA, 16 bp, Homo sapiens
tgactcaaatctccag

SEQ ID NO: 1870999 - DNA, 18 bp, Homo sapiens
tgacttacttaaccaggt

SEQ ID NO: 1871000 - DNA, 17 bp, Homo sapiens
tgagacacatacaaaaa

SEQ ID NO: 1871001 - DNA, 13 bp, Homo sapiens
tgagcaagagcca

SEQ ID NO: 1871002 - DNA, 23 bp, Homo sapiens
tgagcgcacgcgcgcacacacac

SEQ ID NO: 1871003 - DNA, 15 bp, Homo sapiens
tgagctagaaatcac

SEQ ID NO: 1871004 - DNA, 21 bp, Homo sapiens
tgaggacatgtttttgttttc

SEQ ID NO: 1871005 - DNA, 21 bp, Homo sapiens
tgaggctctgacccagtgaga

SEQ ID NO: 1871006 - DNA, 21 bp, Homo sapiens
tgagggtttctgatctgtact

SEQ ID NO: 1871007 - DNA, 16 bp, Homo sapiens
tgagtatattataata

SEQ ID NO: 1871008 - DNA, 15 bp, Homo sapiens
tgagtccatgaaaat

SEQ ID NO: 1871009 - DNA, 18 bp, Homo sapiens
tgagtcgtcatcactttt

SEQ ID NO: 1871010 - DNA, 20 bp, Homo sapiens
tgagtggaaagtcacctaca

SEQ ID NO: 1871011 - DNA, 17 bp, Homo sapiens
tgatacccaacagttta

SEQ ID NO: 1871012 - DNA, 20 bp, Homo sapiens
tgatacccaacagtttattt

SEQ ID NO: 1871013 - DNA, 17 bp, Homo sapiens
tgatacttttttgaaat

SEQ ID NO: 1871014 - DNA, 22 bp, Homo sapiens
tgatataatcttggcttcttaa

SEQ ID NO: 1871015 - DNA, 23 bp, Homo sapiens
tgatataatcttggcttcttaaa

SEQ ID NO: 1871016 - DNA, 21 bp, Homo sapiens
tgatatatctcaaattgtaat

SEQ ID NO: 1871017 - DNA, 21 bp, Homo sapiens
tgatattttccctttttaaaa

SEQ ID NO: 1871018 - DNA, 12 bp, Homo sapiens
tgatcagtgtta

SEQ ID NO: 1871019 - DNA, 14 bp, Homo sapiens
tgatcagtgttaca

SEQ ID NO: 1871020 - DNA, 14 bp, Homo sapiens
tgatctgtactttg

SEQ ID NO: 1871021 - DNA, 17 bp, Homo sapiens
tgatctgtactttgtgt

SEQ ID NO: 1871022 - DNA, 15 bp, Homo sapiens
tgatctttgtttaaa

SEQ ID NO: 1871023 - DNA, 17 bp, Homo sapiens
tgatctttgtttaaatg

SEQ ID NO: 1871024 - DNA, 15 bp, Homo sapiens
tgatgaactttctct

SEQ ID NO: 1871025 - DNA, 23 bp, Homo sapiens
tgatgccttccgacaccactggg

SEQ ID NO: 1871026 - DNA, 18 bp, Homo sapiens
tgatggaaacgcacttac

SEQ ID NO: 1871027 - DNA, 19 bp, Homo sapiens
tgatgggagagtagatggt

SEQ ID NO: 1871028 - DNA, 21 bp, Homo sapiens
tgattaaacagcaaagccata

SEQ ID NO: 1871029 - DNA, 22 bp, Homo sapiens
tgattaaacagcaaagccatat

SEQ ID NO: 1871030 - DNA, 19 bp, Homo sapiens
tgattaccagtctgattat

SEQ ID NO: 1871031 - DNA, 23 bp, Homo sapiens
tgattcttgtgattgactttttg

SEQ ID NO: 1871032 - DNA, 22 bp, Homo sapiens
tgattgattcagtatcttagag

SEQ ID NO: 1871033 - DNA, 15 bp, Homo sapiens
tgattggttcagttt

SEQ ID NO: 1871034 - DNA, 18 bp, Homo sapiens
tgattggtttaaaagtca

SEQ ID NO: 1871035 - DNA, 23 bp, Homo sapiens
tgattgtaaaatagcttgtatag

SEQ ID NO: 1871036 - DNA, 16 bp, Homo sapiens
tgatttatagtttgta

SEQ ID NO: 1871037 - DNA, 15 bp, Homo sapiens
tgatttgatctttgt

SEQ ID NO: 1871038 - DNA, 18 bp, Homo sapiens
tgatttgatctttgttta

SEQ ID NO: 1871039 - DNA, 22 bp, Homo sapiens
tgcaaaaacatatgtctgtctt

SEQ ID NO: 1871040 - DNA, 15 bp, Homo sapiens
tgcaaactgctttat

SEQ ID NO: 1871041 - DNA, 21 bp, Homo sapiens
tgcaaactgctttattttccc

SEQ ID NO: 1871042 - DNA, 15 bp, Homo sapiens
tgcaacatttctgta

SEQ ID NO: 1871043 - DNA, 16 bp, Homo sapiens
tgcaacatttctgtat

SEQ ID NO: 1871044 - DNA, 20 bp, Homo sapiens
tgcaactaactgactctgtt

SEQ ID NO: 1871045 - DNA, 15 bp, Homo sapiens
tgcaagaattaaaac

SEQ ID NO: 1871046 - DNA, 20 bp, Homo sapiens
tgcaatgtatggcttttctc

SEQ ID NO: 1871047 - DNA, 14 bp, Homo sapiens
tgcaatgtcctgca

SEQ ID NO: 1871048 - DNA, 22 bp, Homo sapiens
tgcaatttattaaaatgattgt

SEQ ID NO: 1871049 - DNA, 18 bp, Homo sapiens
tgcaccttaccaactttc

SEQ ID NO: 1871050 - DNA, 17 bp, Homo sapiens
tttccttctgttaagaa

SEQ ID NO: 1871051 - DNA, 19 bp, Homo sapiens
tttcctttatatttagtga

SEQ ID NO: 1871052 - DNA, 16 bp, Homo sapiens
tttctaacataagtaa

SEQ ID NO: 1871053 - DNA, 16 bp, Homo sapiens
tttctactttttctgt

SEQ ID NO: 1871054 - DNA, 15 bp, Homo sapiens
tttctagactttctg

SEQ ID NO: 1871055 - DNA, 16 bp, Homo sapiens
tttctattttctctga

SEQ ID NO: 1871056 - DNA, 15 bp, Homo sapiens
tttctcctgtgggaa

SEQ ID NO: 1871057 - DNA, 12 bp, Homo sapiens
tttctctttgaa

SEQ ID NO: 1871058 - DNA, 13 bp, Homo sapiens
tttctctttgaaa

SEQ ID NO: 1871059 - DNA, 21 bp, Homo sapiens
tttctgagtgagttttactct

SEQ ID NO: 1871060 - DNA, 11 bp, Homo sapiens
tttctgatctg

SEQ ID NO: 1871061 - DNA, 15 bp, Homo sapiens
tttctggcttctgct

SEQ ID NO: 1871062 - DNA, 20 bp, Homo sapiens
tttctggtatcgttcgcttg

SEQ ID NO: 1871063 - DNA, 12 bp, Homo sapiens
tttctgtatact

SEQ ID NO: 1871064 - DNA, 21 bp, Homo sapiens
tttctgtatactgtaaaagtt

SEQ ID NO: 1871065 - DNA, 22 bp, Homo sapiens
tttctgtgtgcaccttaccaac

SEQ ID NO: 1871066 - DNA, 19 bp, Homo sapiens
tttcttatttaattagaat

SEQ ID NO: 1871067 - DNA, 24 bp, Homo sapiens
tttgaaaaacttttaggttgttac

SEQ ID NO: 1871068 - DNA, 19 bp, Homo sapiens
tttgaaaaatattgctaaa

SEQ ID NO: 1871069 - DNA, 21 bp, Homo sapiens
tttgaaatcagtaaacactgt

SEQ ID NO: 1871070 - DNA, 14 bp, Homo sapiens
tttgaataaaaagt

SEQ ID NO: 1871071 - DNA, 19 bp, Homo sapiens
tttgaataaaaagtgaact

SEQ ID NO: 1871072 - DNA, 21 bp, Homo sapiens
tttgaataaaaagtgaacttt

SEQ ID NO: 1871073 - DNA, 22 bp, Homo sapiens
tttgaataaaaagtgaactttt

SEQ ID NO: 1871074 - DNA, 23 bp, Homo sapiens
tttgaataaaaagtgaacttttg

SEQ ID NO: 1871075 - DNA, 14 bp, Homo sapiens
tttgacaacacatg

SEQ ID NO: 1871076 - DNA, 15 bp, Homo sapiens
tttgatattttcaca

SEQ ID NO: 1871077 - DNA, 17 bp, Homo sapiens
tttgcaaaccctttgta

SEQ ID NO: 1871078 - DNA, 18 bp, Homo sapiens
tttgcaaaccctttgtat

SEQ ID NO: 1871079 - DNA, 13 bp, Homo sapiens
tttgcaatttcag

SEQ ID NO: 1871080 - DNA, 20 bp, Homo sapiens
tttgccaagctaatctgcct

SEQ ID NO: 1871081 - DNA, 17 bp, Homo sapiens
tttgctaaaagaagaga

SEQ ID NO: 1871082 - DNA, 11 bp, Homo sapiens
tttgctgccct

SEQ ID NO: 1871083 - DNA, 17 bp, Homo sapiens
tttgctgtgctgtacat

SEQ ID NO: 1871084 - DNA, 13 bp, Homo sapiens
tttgcttaatttc

SEQ ID NO: 1871085 - DNA, 21 bp, Homo sapiens
tttgcttaatttccttctgtt

SEQ ID NO: 1871086 - DNA, 17 bp, Homo sapiens
tttggagaaaaattaca

SEQ ID NO: 1871087 - DNA, 19 bp, Homo sapiens
tttggagaaaaattacaga

SEQ ID NO: 1871088 - DNA, 21 bp, Homo sapiens
tttggtaaatttttgaaaaat

SEQ ID NO: 1871089 - DNA, 17 bp, Homo sapiens
tttgtaatttgaattgg

SEQ ID NO: 1871090 - DNA, 14 bp, Homo sapiens
tttgtataaaaagg

SEQ ID NO: 1871091 - DNA, 13 bp, Homo sapiens
tttgtattaacaa

SEQ ID NO: 1871092 - DNA, 23 bp, Homo sapiens
tttgtattataattgttgatatt

SEQ ID NO: 1871093 - DNA, 17 bp, Homo sapiens
tttgtgatttagaactg

SEQ ID NO: 1871094 - DNA, 23 bp, Homo sapiens
tttgtgtgttcactaaactctga

SEQ ID NO: 1871095 - DNA, 22 bp, Homo sapiens
tttgtttaaatgccaaaatgta

SEQ ID NO: 1871096 - DNA, 14 bp, Homo sapiens
tttgtttggcactg

SEQ ID NO: 1871097 - DNA, 14 bp, Homo sapiens
ttttaaaaaaactg

SEQ ID NO: 1871098 - DNA, 16 bp, Homo sapiens
ttttaaaaaaactgaa

SEQ ID NO: 1871099 - DNA, 19 bp, Homo sapiens
ttttaaaaaataccattga

SEQ ID NO: 1871100 - DNA, 20 bp, Homo sapiens
ttttaaacaaaatagaagct

SEQ ID NO: 1871101 - DNA, 19 bp, Homo sapiens
ttttaaacaaaatttcaca

SEQ ID NO: 1871102 - DNA, 21 bp, Homo sapiens
ttttaaacaaaatttcacagt

SEQ ID NO: 1871103 - DNA, 12 bp, Homo sapiens
ttttaagaaaga

SEQ ID NO: 1871104 - DNA, 22 bp, Homo sapiens
ttttaagaaagagaatgaactg

SEQ ID NO: 1871105 - DNA, 22 bp, Homo sapiens
ttttaagtgacataattgtcca

SEQ ID NO: 1871106 - DNA, 17 bp, Homo sapiens
ttttaattaaaaacttt

SEQ ID NO: 1871107 - DNA, 19 bp, Homo sapiens
ttttatcatgacatgttat

SEQ ID NO: 1871108 - DNA, 19 bp, Homo sapiens
ttttattattaatgctttg

SEQ ID NO: 1871109 - DNA, 20 bp, Homo sapiens
ttttattcagctagaatttc

SEQ ID NO: 1871110 - DNA, 14 bp, Homo sapiens
ttttattgttttca

SEQ ID NO: 1871111 - DNA, 13 bp, Homo sapiens
ttttatttacatt

SEQ ID NO: 1871112 - DNA, 15 bp, Homo sapiens
ttttcatctgttgtt

SEQ ID NO: 1871113 - DNA, 14 bp, Homo sapiens
ttttccaaaatcta

SEQ ID NO: 1871114 - DNA, 18 bp, Homo sapiens
ttttcctcttttgtgaga

SEQ ID NO: 1871115 - DNA, 19 bp, Homo sapiens
ttttccttcctttttattc

SEQ ID NO: 1871116 - DNA, 15 bp, Homo sapiens
ttttctgaatcttct

SEQ ID NO: 1871117 - DNA, 16 bp, Homo sapiens
ttttctggttccaaac

SEQ ID NO: 1871118 - DNA, 18 bp, Homo sapiens
ttttctttttttggtaaa

SEQ ID NO: 1871119 - DNA, 12 bp, Homo sapiens
ttttgaaaaata

SEQ ID NO: 1871120 - DNA, 13 bp, Homo sapiens
ttttgaaaaatat

SEQ ID NO: 1871121 - DNA, 14 bp, Homo sapiens
ttttgaaaaatatt

SEQ ID NO: 1871122 - DNA, 20 bp, Homo sapiens
ttttgaaaaatattgctaaa

SEQ ID NO: 1871123 - DNA, 23 bp, Homo sapiens
ttttgaaaaatattgctaaaagt

SEQ ID NO: 1871124 - DNA, 20 bp, Homo sapiens
ttttgaaagaattctatttt

SEQ ID NO: 1871125 - DNA, 22 bp, Homo sapiens
ttttgaaatcagtaaacactgt

SEQ ID NO: 1871126 - DNA, 15 bp, Homo sapiens
ttttgaataaaaagt

SEQ ID NO: 1871127 - DNA, 16 bp, Homo sapiens
ttttgaataaaaagtg

SEQ ID NO: 1871128 - DNA, 21 bp, Homo sapiens
ttttgaataaaaagtgaactt

SEQ ID NO: 1871129 - DNA, 14 bp, Homo sapiens
ttttgaatgttatt

SEQ ID NO: 1871130 - DNA, 15 bp, Homo sapiens
ttttgatataatctt

SEQ ID NO: 1871131 - DNA, 22 bp, Homo sapiens
aaactcaaaacttaacatattt

SEQ ID NO: 1871132 - DNA, 20 bp, Homo sapiens
aaactctaaacattaatcaa

SEQ ID NO: 1871133 - DNA, 21 bp, Homo sapiens
aaactctaaacattaatcaat

SEQ ID NO: 1871134 - DNA, 20 bp, Homo sapiens
aaactctttaacttgtaata

SEQ ID NO: 1871135 - DNA, 13 bp, Homo sapiens
aaactgaaggttt

SEQ ID NO: 1871136 - DNA, 18 bp, Homo sapiens
aaactgagtccatgaaaa

SEQ ID NO: 1871137 - DNA, 19 bp, Homo sapiens
aaactgagtccatgaaaat

SEQ ID NO: 1871138 - DNA, 14 bp, Homo sapiens
aaactgctttattt

SEQ ID NO: 1871139 - DNA, 15 bp, Homo sapiens
aaactgctttatttt

SEQ ID NO: 1871140 - DNA, 17 bp, Homo sapiens
aaactgtgtatcattaa

SEQ ID NO: 1871141 - DNA, 19 bp, Homo sapiens
aaactgtgtatcattaaaa

SEQ ID NO: 1871142 - DNA, 13 bp, Homo sapiens
aaacttgtgtatt

SEQ ID NO: 1871143 - DNA, 15 bp, Homo sapiens
aaactttaaaaggca

SEQ ID NO: 1871144 - DNA, 20 bp, Homo sapiens
aaactttacccaaaaactaa

SEQ ID NO: 1871145 - DNA, 19 bp, Homo sapiens
aaacttttaggttgttacc

SEQ ID NO: 1871146 - DNA, 16 bp, Homo sapiens
aaagaagagaggggaa

SEQ ID NO: 1871147 - DNA, 22 bp, Homo sapiens
aaagaagagaggggaagaattt

SEQ ID NO: 1871148 - DNA, 23 bp, Homo sapiens
aaagaagagaggggaagaattta

SEQ ID NO: 1871149 - DNA, 15 bp, Homo sapiens
aaagacacctgcctt

SEQ ID NO: 1871150 - DNA, 14 bp, Homo sapiens
aaagacatctgcct

SEQ ID NO: 1871151 - DNA, 19 bp, Homo sapiens
aaagactggtttgtttgct

SEQ ID NO: 1871152 - DNA, 17 bp, Homo sapiens
aaagactgtcaaatgaa

SEQ ID NO: 1871153 - DNA, 19 bp, Homo sapiens
aaagactgtcaaatgaact

SEQ ID NO: 1871154 - DNA, 14 bp, Homo sapiens
aaagagaatgaact

SEQ ID NO: 1871155 - DNA, 22 bp, Homo sapiens
aaagagaatgaactgtggaatt

SEQ ID NO: 1871156 - DNA, 11 bp, Homo sapiens
aaagagactct

SEQ ID NO: 1871157 - DNA, 19 bp, Homo sapiens
aaagagctgtggctggggg

SEQ ID NO: 1871158 - DNA, 13 bp, Homo sapiens
aaagatgatggaa

SEQ ID NO: 1871159 - DNA, 18 bp, Homo sapiens
aaagatgatggaaacgca

SEQ ID NO: 1871160 - DNA, 20 bp, Homo sapiens
aaagatgatggaaacgcact

SEQ ID NO: 1871161 - DNA, 18 bp, Homo sapiens
aaagccaccttgttacaa

SEQ ID NO: 1871162 - DNA, 13 bp, Homo sapiens
aaagctcatattt

SEQ ID NO: 1871163 - DNA, 19 bp, Homo sapiens
aaagctgcctcgtttccct

SEQ ID NO: 1871164 - DNA, 19 bp, Homo sapiens
aaagcttgatttgatcttt

SEQ ID NO: 1871165 - DNA, 18 bp, Homo sapiens
aaaggactgtaagcagat

SEQ ID NO: 1871166 - DNA, 17 bp, Homo sapiens
aaaggatataaaaggat

SEQ ID NO: 1871167 - DNA, 18 bp, Homo sapiens
aaaggatgttacaagttt

SEQ ID NO: 1871168 - DNA, 15 bp, Homo sapiens
aaaggcaaaagactg

SEQ ID NO: 1871169 - DNA, 16 bp, Homo sapiens
aaaggcaaaagactgg

SEQ ID NO: 1871170 - DNA, 17 bp, Homo sapiens
aaaggcaaaagactggt

SEQ ID NO: 1871171 - DNA, 17 bp, Homo sapiens
aaagtaaacttgtgtat

SEQ ID NO: 1871172 - DNA, 16 bp, Homo sapiens
aaagtatgtccttcag

SEQ ID NO: 1871173 - DNA, 14 bp, Homo sapiens
aaagtattcagaaa

SEQ ID NO: 1871174 - DNA, 16 bp, Homo sapiens
aaagtattcagaaatt

SEQ ID NO: 1871175 - DNA, 12 bp, Homo sapiens
aaagtatttttg

SEQ ID NO: 1871176 - DNA, 15 bp, Homo sapiens
aaagtcacctacagg

SEQ ID NO: 1871177 - DNA, 18 bp, Homo sapiens
aaagtcacctacaggact

SEQ ID NO: 1871178 - DNA, 12 bp, Homo sapiens
aaagtcagattt

SEQ ID NO: 1871179 - DNA, 22 bp, Homo sapiens
aaagtctgtgtgatgaactttc

SEQ ID NO: 1871180 - DNA, 23 bp, Homo sapiens
aaagtctgtgtgatgaactttct

SEQ ID NO: 1871181 - DNA, 16 bp, Homo sapiens
aaagtgcatttaagga

SEQ ID NO: 1871182 - DNA, 17 bp, Homo sapiens
aaagttataataactga

SEQ ID NO: 1871183 - DNA, 18 bp, Homo sapiens
aaagttataataactgaa

SEQ ID NO: 1871184 - DNA, 21 bp, Homo sapiens
aaagttataataactgaactg

SEQ ID NO: 1871185 - DNA, 16 bp, Homo sapiens
aaataagttttataca

SEQ ID NO: 1871186 - DNA, 23 bp, Homo sapiens
aaataattgatcagatgctgaat

SEQ ID NO: 1871187 - DNA, 21 bp, Homo sapiens
aaataccataggaagacataa

SEQ ID NO: 1871188 - DNA, 14 bp, Homo sapiens
aaataccattgaaa

SEQ ID NO: 1871189 - DNA, 20 bp, Homo sapiens
aaatagtgcagaatctcata

SEQ ID NO: 1871190 - DNA, 18 bp, Homo sapiens
aaatatggaacttctaat

SEQ ID NO: 1871191 - DNA, 19 bp, Homo sapiens
aaatatggaacttctaata

SEQ ID NO: 1871192 - DNA, 17 bp, Homo sapiens
aaatattatttgatatc

SEQ ID NO: 1871193 - DNA, 13 bp, Homo sapiens
aaatattgctaaa

SEQ ID NO: 1871194 - DNA, 20 bp, Homo sapiens
aaatattgctaaaagtgcat

SEQ ID NO: 1871195 - DNA, 22 bp, Homo sapiens
aaatattttaagaaagagaatg

SEQ ID NO: 1871196 - DNA, 19 bp, Homo sapiens
aaatcatttggttaaatca

SEQ ID NO: 1871197 - DNA, 17 bp, Homo sapiens
aaatcctatatctgttt

SEQ ID NO: 1871198 - DNA, 15 bp, Homo sapiens
aaatctctaatatgg

SEQ ID NO: 1871199 - DNA, 18 bp, Homo sapiens
aaatctggggaagaggtt

SEQ ID NO: 1871200 - DNA, 23 bp, Homo sapiens
aaatctggggaagaggttttatt

SEQ ID NO: 1871201 - DNA, 15 bp, Homo sapiens
aaatgaacttttaca

SEQ ID NO: 1871202 - DNA, 12 bp, Homo sapiens
aaatgaagcaat

SEQ ID NO: 1871203 - DNA, 19 bp, Homo sapiens
aaatgaagcaatttatatc

SEQ ID NO: 1871204 - DNA, 14 bp, Homo sapiens
aaatgaggacatgt

SEQ ID NO: 1871205 - DNA, 16 bp, Homo sapiens
aaatgaggacatgttt

SEQ ID NO: 1871206 - DNA, 15 bp, Homo sapiens
aaatgattgtaaaat

SEQ ID NO: 1871207 - DNA, 11 bp, Homo sapiens
aaatgccaaaa

SEQ ID NO: 1871208 - DNA, 21 bp, Homo sapiens
aaatgccaaaatgtacttaaa

SEQ ID NO: 1871209 - DNA, 20 bp, Homo sapiens
aaatgcccatttttgctaat

SEQ ID NO: 1871210 - DNA, 15 bp, Homo sapiens
aaatggggcgctgga

SEQ ID NO: 1871211 - DNA, 15 bp, Homo sapiens
aaatgtacttaaatg

SEQ ID NO: 1871212 - DNA, 15 bp, Homo sapiens
aaatgtttaattcat

SEQ ID NO: 1871213 - DNA, 19 bp, Homo sapiens
aaatgtttaattcattaat

SEQ ID NO: 1871214 - DNA, 20 bp, Homo sapiens
aaattaaaatattatttgat

SEQ ID NO: 1871215 - DNA, 18 bp, Homo sapiens
aaattaacagtcctaact

SEQ ID NO: 1871216 - DNA, 14 bp, Homo sapiens
aaattagtcttttt

SEQ ID NO: 1871217 - DNA, 17 bp, Homo sapiens
aaattagtctttttctt

SEQ ID NO: 1871218 - DNA, 13 bp, Homo sapiens
aaattagtttaaa

SEQ ID NO: 1871219 - DNA, 18 bp, Homo sapiens
aaattgtctgtctgctct

SEQ ID NO: 1871220 - DNA, 19 bp, Homo sapiens
aaattgtctgtctgctctt

SEQ ID NO: 1871221 - DNA, 20 bp, Homo sapiens
aaattgtctgtctgctctta

SEQ ID NO: 1871222 - DNA, 14 bp, Homo sapiens
aaatttgatttcta

SEQ ID NO: 1871223 - DNA, 18 bp, Homo sapiens
aaattttctagactttct

SEQ ID NO: 1871224 - DNA, 18 bp, Homo sapiens
aattatttgtgtaataga

SEQ ID NO: 1871225 - DNA, 18 bp, Homo sapiens
aattattttaaacaaaat

SEQ ID NO: 1871226 - DNA, 18 bp, Homo sapiens
aattattttccaaaatct

SEQ ID NO: 1871227 - DNA, 15 bp, Homo sapiens
aattatttttaagtg

SEQ ID NO: 1871228 - DNA, 17 bp, Homo sapiens
aattcaccaaaagttca

SEQ ID NO: 1871229 - DNA, 15 bp, Homo sapiens
aattcactgttgaat

SEQ ID NO: 1871230 - DNA, 18 bp, Homo sapiens
aattcattaatctgtttg

SEQ ID NO: 1871231 - DNA, 17 bp, Homo sapiens
aattgaaagtattcaga

SEQ ID NO: 1871232 - DNA, 19 bp, Homo sapiens
aattgaaagtattcagaaa

SEQ ID NO: 1871233 - DNA, 15 bp, Homo sapiens
aattgactcaaatct

SEQ ID NO: 1871234 - DNA, 14 bp, Homo sapiens
aattgagctagaaa

SEQ ID NO: 1871235 - DNA, 15 bp, Homo sapiens
aattgatcagatgct

SEQ ID NO: 1871236 - DNA, 15 bp, Homo sapiens
aattgcaatctataa

SEQ ID NO: 1871237 - DNA, 14 bp, Homo sapiens
aattgcagtttcat

SEQ ID NO: 1871238 - DNA, 21 bp, Homo sapiens
aattgcagtttcatgtatgta

SEQ ID NO: 1871239 - DNA, 16 bp, Homo sapiens
aattggcataatttgt

SEQ ID NO: 1871240 - DNA, 15 bp, Homo sapiens
aattgttatgaaaat

SEQ ID NO: 1871241 - DNA, 16 bp, Homo sapiens
aattgttatgaaaatc

SEQ ID NO: 1871242 - DNA, 13 bp, Homo sapiens
aattgttgatatt

SEQ ID NO: 1871243 - DNA, 14 bp, Homo sapiens
aatttaaaaaataa

SEQ ID NO: 1871244 - DNA, 16 bp, Homo sapiens
aatttaaagaaacact

SEQ ID NO: 1871245 - DNA, 21 bp, Homo sapiens
aatttaaagaaacactaaatt

SEQ ID NO: 1871246 - DNA, 19 bp, Homo sapiens
aatttaatggactgtgaat

SEQ ID NO: 1871247 - DNA, 14 bp, Homo sapiens
aatttaatttatag

SEQ ID NO: 1871248 - DNA, 13 bp, Homo sapiens
aatttagagcgtt

SEQ ID NO: 1871249 - DNA, 20 bp, Homo sapiens
aatttagagcgtttggttaa

SEQ ID NO: 1871250 - DNA, 18 bp, Homo sapiens
aatttatatctttatgca

SEQ ID NO: 1871251 - DNA, 19 bp, Homo sapiens
aatttattagttaatatat

SEQ ID NO: 1871252 - DNA, 12 bp, Homo sapiens
aatttattggca

SEQ ID NO: 1871253 - DNA, 18 bp, Homo sapiens
aatttcacagttctgtaa

SEQ ID NO: 1871254 - DNA, 18 bp, Homo sapiens
aatttccaaaataatcta

SEQ ID NO: 1871255 - DNA, 17 bp, Homo sapiens
aatttcccctaatcttt

SEQ ID NO: 1871256 - DNA, 20 bp, Homo sapiens
aatttcttcactgttgaaaa

SEQ ID NO: 1871257 - DNA, 22 bp, Homo sapiens
aatttgaggtctacattcttgg

SEQ ID NO: 1871258 - DNA, 22 bp, Homo sapiens
aattttattaaaagagtagaaa

SEQ ID NO: 1871259 - DNA, 12 bp, Homo sapiens
aattttctagac

SEQ ID NO: 1871260 - DNA, 17 bp, Homo sapiens
aattttctagactttct

SEQ ID NO: 1871261 - DNA, 18 bp, Homo sapiens
aattttctagactttctg

SEQ ID NO: 1871262 - DNA, 20 bp, Homo sapiens
aattttctagactttctgtt

SEQ ID NO: 1871263 - DNA, 14 bp, Homo sapiens
aattttttaatttc

SEQ ID NO: 1871264 - DNA, 12 bp, Homo sapiens
aattttttgcag

SEQ ID NO: 1871265 - DNA, 17 bp, Homo sapiens
aattttttgcagtcttt

SEQ ID NO: 1871266 - DNA, 15 bp, Homo sapiens
aatttttttttgtaa

SEQ ID NO: 1871267 - DNA, 13 bp, Homo sapiens
acaaaaaaaagaa

SEQ ID NO: 1871268 - DNA, 14 bp, Homo sapiens
acaaaaataacact

SEQ ID NO: 1871269 - DNA, 16 bp, Homo sapiens
acaaaaataacactgt

SEQ ID NO: 1871270 - DNA, 15 bp, Homo sapiens
acaaaatagaagctg

SEQ ID NO: 1871271 - DNA, 19 bp, Homo sapiens
acaaaatttcacagttctg

SEQ ID NO: 1871272 - DNA, 15 bp, Homo sapiens
acaaacaaaaaaaag

SEQ ID NO: 1871273 - DNA, 18 bp, Homo sapiens
acaaacaaaaaaaagaac

SEQ ID NO: 1871274 - DNA, 13 bp, Homo sapiens
acaaacctagctt

SEQ ID NO: 1871275 - DNA, 17 bp, Homo sapiens
acaaagcatgggaaaaa

SEQ ID NO: 1871276 - DNA, 18 bp, Homo sapiens
acaaagcatgggaaaaag

SEQ ID NO: 1871277 - DNA, 20 bp, Homo sapiens
acaaagcatgggaaaaagag

SEQ ID NO: 1871278 - DNA, 18 bp, Homo sapiens
acaaagttactggctctt

SEQ ID NO: 1871279 - DNA, 21 bp, Homo sapiens
acaaagttactggctctttgt

SEQ ID NO: 1871280 - DNA, 13 bp, Homo sapiens
acaacaagagttt

SEQ ID NO: 1871281 - DNA, 13 bp, Homo sapiens
acaacacatgtgg

SEQ ID NO: 1871282 - DNA, 19 bp, Homo sapiens
acaacagaagcttcagaag

SEQ ID NO: 1871283 - DNA, 15 bp, Homo sapiens
acaacttgctactta

SEQ ID NO: 1871284 - DNA, 20 bp, Homo sapiens
acaacttgctacttatcatt

SEQ ID NO: 1871285 - DNA, 23 bp, Homo sapiens
acaagaaggccagcccactgggc

SEQ ID NO: 1871286 - DNA, 18 bp, Homo sapiens
acaagagtttatttccaa

SEQ ID NO: 1871287 - DNA, 22 bp, Homo sapiens
acaagagtttatttccaaataa

SEQ ID NO: 1871288 - DNA, 19 bp, Homo sapiens
acaagattgtcattagtga

SEQ ID NO: 1871289 - DNA, 16 bp, Homo sapiens
acaagtcctgtgaatt

SEQ ID NO: 1871290 - DNA, 19 bp, Homo sapiens
acaagtcctgtgaatttct

SEQ ID NO: 1871291 - DNA, 19 bp, Homo sapiens
acaagtgtatatcagaaaa

SEQ ID NO: 1871292 - DNA, 12 bp, Homo sapiens
acaagtttgcta

SEQ ID NO: 1871293 - DNA, 13 bp, Homo sapiens
acaagtttgctaa

SEQ ID NO: 1871294 - DNA, 20 bp, Homo sapiens
acaagtttgctaaaagaaga

SEQ ID NO: 1871295 - DNA, 21 bp, Homo sapiens
acaagtttgctaaaagaagag

SEQ ID NO: 1871296 - DNA, 17 bp, Homo sapiens
acaatatgattgcacta

SEQ ID NO: 1871297 - DNA, 20 bp, Homo sapiens
acaatgtgactttgaaaata

SEQ ID NO: 1871298 - DNA, 15 bp, Homo sapiens
cacccattttcacat

SEQ ID NO: 1871299 - DNA, 22 bp, Homo sapiens
caccccataccagtcacctcct

SEQ ID NO: 1871300 - DNA, 13 bp, Homo sapiens
caccctgcctgtg

SEQ ID NO: 1871301 - DNA, 14 bp, Homo sapiens
cacctacagcagca

SEQ ID NO: 1871302 - DNA, 15 bp, Homo sapiens
cacctagtccagtga

SEQ ID NO: 1871303 - DNA, 16 bp, Homo sapiens
cacctgccttatgcaa

SEQ ID NO: 1871304 - DNA, 17 bp, Homo sapiens
aagttataataactgaa

SEQ ID NO: 1871305 - DNA, 18 bp, Homo sapiens
aagttataataactgaac

SEQ ID NO: 1871306 - DNA, 17 bp, Homo sapiens
aagttcatataatttaa

SEQ ID NO: 1871307 - DNA, 20 bp, Homo sapiens
aagttcatataatttaaaga

SEQ ID NO: 1871308 - DNA, 18 bp, Homo sapiens
aagttgagtatattataa

SEQ ID NO: 1871309 - DNA, 18 bp, Homo sapiens
aagttgtgccttttatag

SEQ ID NO: 1871310 - DNA, 19 bp, Homo sapiens
aagttgtgccttttatagc

SEQ ID NO: 1871311 - DNA, 18 bp, Homo sapiens
aagtttacaagtgtatat

SEQ ID NO: 1871312 - DNA, 13 bp, Homo sapiens
aagtttgctaaaa

SEQ ID NO: 1871313 - DNA, 20 bp, Homo sapiens
aagtttgctaaaagaagaga

SEQ ID NO: 1871314 - DNA, 19 bp, Homo sapiens
aagtttggcaatagtttgc

SEQ ID NO: 1871315 - DNA, 15 bp, Homo sapiens
aagttttaactatgc

SEQ ID NO: 1871316 - DNA, 14 bp, Homo sapiens
aagttttgatataa

SEQ ID NO: 1871317 - DNA, 16 bp, Homo sapiens
aagttttttactttgg

SEQ ID NO: 1871318 - DNA, 20 bp, Homo sapiens
aataaaaagtgaacttttgt

SEQ ID NO: 1871319 - DNA, 16 bp, Homo sapiens
aataactctgattttg

SEQ ID NO: 1871320 - DNA, 11 bp, Homo sapiens
aataactgaac

SEQ ID NO: 1871321 - DNA, 16 bp, Homo sapiens
aataactgaactgttt

SEQ ID NO: 1871322 - DNA, 23 bp, Homo sapiens
aataagaagggggagtgaaacag

SEQ ID NO: 1871323 - DNA, 15 bp, Homo sapiens
aataagttttgatat

SEQ ID NO: 1871324 - DNA, 16 bp, Homo sapiens
aataagttttgatata

SEQ ID NO: 1871325 - DNA, 23 bp, Homo sapiens
aataataaaaaaatatatacaga

SEQ ID NO: 1871326 - DNA, 18 bp, Homo sapiens
aataatagattgtgaata

SEQ ID NO: 1871327 - DNA, 20 bp, Homo sapiens
aatacactaattcctttcta

SEQ ID NO: 1871328 - DNA, 13 bp, Homo sapiens
aataccattgaaa

SEQ ID NO: 1871329 - DNA, 15 bp, Homo sapiens
aataccattgaaatc

SEQ ID NO: 1871330 - DNA, 16 bp, Homo sapiens
aataccattgaaatca

SEQ ID NO: 1871331 - DNA, 19 bp, Homo sapiens
aatagaaaactgaaaatct

SEQ ID NO: 1871332 - DNA, 22 bp, Homo sapiens
aatagaggccaaattaatcttt

SEQ ID NO: 1871333 - DNA, 20 bp, Homo sapiens
aataggatgaatgggaaagt

SEQ ID NO: 1871334 - DNA, 11 bp, Homo sapiens
aatatactttt

SEQ ID NO: 1871335 - DNA, 22 bp, Homo sapiens
aatatactttttttgttataga

SEQ ID NO: 1871336 - DNA, 12 bp, Homo sapiens
aatatatgttct

SEQ ID NO: 1871337 - DNA, 13 bp, Homo sapiens
aatatatgttctg

SEQ ID NO: 1871338 - DNA, 16 bp, Homo sapiens
aatatatgttctgcaa

SEQ ID NO: 1871339 - DNA, 23 bp, Homo sapiens
aatatatgttctgcaagaattaa

SEQ ID NO: 1871340 - DNA, 14 bp, Homo sapiens
aatatgaaagccac

SEQ ID NO: 1871341 - DNA, 19 bp, Homo sapiens
aatatgattgcactaaata

SEQ ID NO: 1871342 - DNA, 17 bp, Homo sapiens
aatatggaacttctaat

SEQ ID NO: 1871343 - DNA, 18 bp, Homo sapiens
aatattaatggaaacatg

SEQ ID NO: 1871344 - DNA, 15 bp, Homo sapiens
aatattatttgatat

SEQ ID NO: 1871345 - DNA, 16 bp, Homo sapiens
aatattatttgatatc

SEQ ID NO: 1871346 - DNA, 16 bp, Homo sapiens
aatattgctaaaagtg

SEQ ID NO: 1871347 - DNA, 17 bp, Homo sapiens
aatattggttagtattt

SEQ ID NO: 1871348 - DNA, 15 bp, Homo sapiens
aatattttaagaaag

SEQ ID NO: 1871349 - DNA, 16 bp, Homo sapiens
aatattttaagaaaga

SEQ ID NO: 1871350 - DNA, 19 bp, Homo sapiens
aatattttaagaaagagaa

SEQ ID NO: 1871351 - DNA, 21 bp, Homo sapiens
aatcacaaacatatgtatctt

SEQ ID NO: 1871352 - DNA, 23 bp, Homo sapiens
aatcacaagaacaaatacacttt

SEQ ID NO: 1871353 - DNA, 21 bp, Homo sapiens
aatcagcatgacaaaaataac

SEQ ID NO: 1871354 - DNA, 20 bp, Homo sapiens
aatcatactcctatgcttta

SEQ ID NO: 1871355 - DNA, 15 bp, Homo sapiens
aatcatattaattat

SEQ ID NO: 1871356 - DNA, 15 bp, Homo sapiens
aatcatctgtgtgaa

SEQ ID NO: 1871357 - DNA, 18 bp, Homo sapiens
aatcatctgtgtgaaaat

SEQ ID NO: 1871358 - DNA, 12 bp, Homo sapiens
aatcatgctcat

SEQ ID NO: 1871359 - DNA, 11 bp, Homo sapiens
aatccatgctt

SEQ ID NO: 1871360 - DNA, 14 bp, Homo sapiens
aatcctatatctgt

SEQ ID NO: 1871361 - DNA, 15 bp, Homo sapiens
aatcctatatctgtt

SEQ ID NO: 1871362 - DNA, 18 bp, Homo sapiens
aatcctatatctgtttgt

SEQ ID NO: 1871363 - DNA, 15 bp, Homo sapiens
aatcctccctggaga

SEQ ID NO: 1871364 - DNA, 14 bp, Homo sapiens
aatctaagtatatg

SEQ ID NO: 1871365 - DNA, 20 bp, Homo sapiens
aatctaatattaaaaatatg

SEQ ID NO: 1871366 - DNA, 22 bp, Homo sapiens
aatctatattaaatgagggttt

SEQ ID NO: 1871367 - DNA, 23 bp, Homo sapiens
aatctcataggttgccaataata

SEQ ID NO: 1871368 - DNA, 16 bp, Homo sapiens
aatctgggaagggaag

SEQ ID NO: 1871369 - DNA, 18 bp, Homo sapiens
aatctggggaagaggttt

SEQ ID NO: 1871370 - DNA, 18 bp, Homo sapiens
aatcttagtatagtagaa

SEQ ID NO: 1871371 - DNA, 17 bp, Homo sapiens
aatcttggcttcttaaa

SEQ ID NO: 1871372 - DNA, 19 bp, Homo sapiens
aatcttggcttcttaaaaa

SEQ ID NO: 1871373 - DNA, 22 bp, Homo sapiens
aatcttggcttcttaaaaactg

SEQ ID NO: 1871374 - DNA, 14 bp, Homo sapiens
aatctttaatggtt

SEQ ID NO: 1871375 - DNA, 13 bp, Homo sapiens
aatcttttaaaaa

SEQ ID NO: 1871376 - DNA, 22 bp, Homo sapiens
aatcttttctgaatcttctgaa

SEQ ID NO: 1871377 - DNA, 18 bp, Homo sapiens
aatgaaccgtttacagtg

SEQ ID NO: 1871378 - DNA, 12 bp, Homo sapiens
aatgaactgtgg

SEQ ID NO: 1871379 - DNA, 15 bp, Homo sapiens
aatgaactgtggaat

SEQ ID NO: 1871380 - DNA, 16 bp, Homo sapiens
aatgaactgtggaatt

SEQ ID NO: 1871381 - DNA, 15 bp, Homo sapiens
aatgaacttttacag

SEQ ID NO: 1871382 - DNA, 21 bp, Homo sapiens
aatgaagcaatttatatcttt

SEQ ID NO: 1871383 - DNA, 15 bp, Homo sapiens
aatgacaacagaagc

SEQ ID NO: 1871384 - DNA, 24 bp, Homo sapiens
aatgacacactgcggtgtctgcag

SEQ ID NO: 1871385 - DNA, 16 bp, Homo sapiens
aatgaggacatgtttt

SEQ ID NO: 1871386 - DNA, 15 bp, Homo sapiens
aatgagttacttaga

SEQ ID NO: 1871387 - DNA, 17 bp, Homo sapiens
aatgatacccaacagtt

SEQ ID NO: 1871388 - DNA, 13 bp, Homo sapiens
aagggagaaatgc

SEQ ID NO: 1871389 - DNA, 21 bp, Homo sapiens
aaggtaatttttttttgtaaa

SEQ ID NO: 1871390 - DNA, 22 bp, Homo sapiens
aaggtaatttttttttgtaaag

SEQ ID NO: 1871391 - DNA, 14 bp, Homo sapiens
aagtaagtcttttt

SEQ ID NO: 1871392 - DNA, 23 bp, Homo sapiens
aagtaagtcttttttttttccaa

SEQ ID NO: 1871393 - DNA, 20 bp, Homo sapiens
aagtagtttgtataacttct

SEQ ID NO: 1871394 - DNA, 20 bp, Homo sapiens
aagtattcagaaattaaaat

SEQ ID NO: 1871395 - DNA, 15 bp, Homo sapiens
aagtcgaattaatag

SEQ ID NO: 1871396 - DNA, 21 bp, Homo sapiens
aagtcttttttttttccaaat

SEQ ID NO: 1871397 - DNA, 17 bp, Homo sapiens
aagtgaacttttgtaat

SEQ ID NO: 1871398 - DNA, 23 bp, Homo sapiens
aagtgaacttttgtaatttgaat

SEQ ID NO: 1871399 - DNA, 16 bp, Homo sapiens
aagtgaatttatgaga

SEQ ID NO: 1871400 - DNA, 18 bp, Homo sapiens
aagtgcaacatttctgta

SEQ ID NO: 1871401 - DNA, 19 bp, Homo sapiens
aagtgcaacatttctgtat

SEQ ID NO: 1871402 - DNA, 20 bp, Homo sapiens
aagtgcaacatttctgtata

SEQ ID NO: 1871403 - DNA, 15 bp, Homo sapiens
aagtgcatttaagga

SEQ ID NO: 1871404 - DNA, 14 bp, Homo sapiens
aagtggtgaccaaa

SEQ ID NO: 1871405 - DNA, 18 bp, Homo sapiens
aagttactggctctttgt

SEQ ID NO: 1871406 - DNA, 12 bp, Homo sapiens
aagttataataa

SEQ ID NO: 1871407 - DNA, 14 bp, Homo sapiens
aagttataataact

SEQ ID NO: 1871408 - DNA, 11 bp, Homo sapiens
aagttattgta

SEQ ID NO: 1871409 - DNA, 12 bp, Homo sapiens
aagttattgtac

SEQ ID NO: 1871410 - DNA, 20 bp, Homo sapiens
aagttattgtacagctgttt

SEQ ID NO: 1871411 - DNA, 16 bp, Homo sapiens
aagttgagtatattat

SEQ ID NO: 1871412 - DNA, 12 bp, Homo sapiens
aagtttgctaaa

SEQ ID NO: 1871413 - DNA, 16 bp, Homo sapiens
aagtttgctaaaagaa

SEQ ID NO: 1871414 - DNA, 14 bp, Homo sapiens
aataaaaaaatata

SEQ ID NO: 1871415 - DNA, 14 bp, Homo sapiens
aataaaaagtgaac

SEQ ID NO: 1871416 - DNA, 19 bp, Homo sapiens
aataaaaagtgaacttttg

SEQ ID NO: 1871417 - DNA, 19 bp, Homo sapiens
aataaaatgaggacatgtt

SEQ ID NO: 1871418 - DNA, 22 bp, Homo sapiens
aataaatacacagcatgcagac

SEQ ID NO: 1871419 - DNA, 11 bp, Homo sapiens
aataacactgt

SEQ ID NO: 1871420 - DNA, 20 bp, Homo sapiens
aataacactgttggcactta

SEQ ID NO: 1871421 - DNA, 16 bp, Homo sapiens
aataaccacactgaaa

SEQ ID NO: 1871422 - DNA, 17 bp, Homo sapiens
aataactgaactgtttg

SEQ ID NO: 1871423 - DNA, 20 bp, Homo sapiens
aataagaagggggagtgaaa

SEQ ID NO: 1871424 - DNA, 17 bp, Homo sapiens
aataagcactttttaaa

SEQ ID NO: 1871425 - DNA, 22 bp, Homo sapiens
aataaggtataaggatcttttg

SEQ ID NO: 1871426 - DNA, 19 bp, Homo sapiens
aataagttttatacataaa

SEQ ID NO: 1871427 - DNA, 14 bp, Homo sapiens
aataagttttgata

SEQ ID NO: 1871428 - DNA, 23 bp, Homo sapiens
aataagttttgatataatcttgg

SEQ ID NO: 1871429 - DNA, 14 bp, Homo sapiens
aataatctatatta

SEQ ID NO: 1871430 - DNA, 16 bp, Homo sapiens
aataattttttgcagt

SEQ ID NO: 1871431 - DNA, 13 bp, Homo sapiens
aatacactttatt

SEQ ID NO: 1871432 - DNA, 15 bp, Homo sapiens
aatacagtcaactta

SEQ ID NO: 1871433 - DNA, 22 bp, Homo sapiens
aataccataggaagacataaaa

SEQ ID NO: 1871434 - DNA, 19 bp, Homo sapiens
aataccattgaaatcagca

SEQ ID NO: 1871435 - DNA, 20 bp, Homo sapiens
aatagaaaactgaaaatcta

SEQ ID NO: 1871436 - DNA, 22 bp, Homo sapiens
aatagaggtgatgctgctaaag

SEQ ID NO: 1871437 - DNA, 14 bp, Homo sapiens
aatagcttgtatag

SEQ ID NO: 1871438 - DNA, 17 bp, Homo sapiens
aatagcttttattgtat

SEQ ID NO: 1871439 - DNA, 15 bp, Homo sapiens
aatatagattaaatc

SEQ ID NO: 1871440 - DNA, 17 bp, Homo sapiens
aatatagattaaatcat

SEQ ID NO: 1871441 - DNA, 22 bp, Homo sapiens
aatatatacagattcctgttgt

SEQ ID NO: 1871442 - DNA, 22 bp, Homo sapiens
aatatatcccagaaattagaaa

SEQ ID NO: 1871443 - DNA, 20 bp, Homo sapiens
aatatatgttctgcaagaat

SEQ ID NO: 1871444 - DNA, 19 bp, Homo sapiens
aatatatttttatatttag

SEQ ID NO: 1871445 - DNA, 20 bp, Homo sapiens
aatatatttttatatttagt

SEQ ID NO: 1871446 - DNA, 17 bp, Homo sapiens
aatatgattgcactaaa

SEQ ID NO: 1871447 - DNA, 18 bp, Homo sapiens
aatatgattgcactaaat

SEQ ID NO: 1871448 - DNA, 18 bp, Homo sapiens
aatatggaacttctaata

SEQ ID NO: 1871449 - DNA, 17 bp, Homo sapiens
aatattatttgatatct

SEQ ID NO: 1871450 - DNA, 21 bp, Homo sapiens
aatattgctaaaagtgcattt

SEQ ID NO: 1871451 - DNA, 22 bp, Homo sapiens
aatattttaagaaagagaatga

SEQ ID NO: 1871452 - DNA, 21 bp, Homo sapiens
aatcaacatggctacttgctt

SEQ ID NO: 1871453 - DNA, 17 bp, Homo sapiens
aatcagaattggcataa

SEQ ID NO: 1871454 - DNA, 14 bp, Homo sapiens
aatcagcatgacaa

SEQ ID NO: 1871455 - DNA, 14 bp, Homo sapiens
aatcatttgctttt

SEQ ID NO: 1871456 - DNA, 15 bp, Homo sapiens
aatccatgcttcact

SEQ ID NO: 1871457 - DNA, 20 bp, Homo sapiens
aatcccccagcgcttagaaa

SEQ ID NO: 1871458 - DNA, 19 bp, Homo sapiens
aatctaatattaaaaatat

SEQ ID NO: 1871459 - DNA, 16 bp, Homo sapiens
aatctatattaaatga

SEQ ID NO: 1871460 - DNA, 15 bp, Homo sapiens
aatctccagtattct

SEQ ID NO: 1871461 - DNA, 20 bp, Homo sapiens
aatctgtttgtttggcactg

SEQ ID NO: 1871462 - DNA, 15 bp, Homo sapiens
aatcttcggccaatt

SEQ ID NO: 1871463 - DNA, 20 bp, Homo sapiens
aatcttggcttcttaaaaac

SEQ ID NO: 1871464 - DNA, 22 bp, Homo sapiens
aatcttttaaaaatgatgataa

SEQ ID NO: 1871465 - DNA, 17 bp, Homo sapiens
aatgaacacatggcaga

SEQ ID NO: 1871466 - DNA, 17 bp, Homo sapiens
aatgaaccgtttacagt

SEQ ID NO: 1871467 - DNA, 20 bp, Homo sapiens
aatgaacttttacagaatgc

SEQ ID NO: 1871468 - DNA, 13 bp, Homo sapiens
aatgacaacagaa

SEQ ID NO: 1871469 - DNA, 15 bp, Homo sapiens
aatgagggtttctga

SEQ ID NO: 1871470 - DNA, 16 bp, Homo sapiens
aatgatgataatcatc

SEQ ID NO: 1871471 - DNA, 13 bp, Homo sapiens
aatgattgtaaaa

SEQ ID NO: 1871472 - DNA, 20 bp, Homo sapiens
aatgattgtaaaatagcttg

SEQ ID NO: 1871473 - DNA, 13 bp, Homo sapiens
aatgattgtttaa

SEQ ID NO: 1871474 - DNA, 14 bp, Homo sapiens
aatgattgtttaaa

SEQ ID NO: 1871475 - DNA, 14 bp, Homo sapiens
aatgcattaaaaaa

SEQ ID NO: 1871476 - DNA, 18 bp, Homo sapiens
aatgccttggtttgattt

SEQ ID NO: 1871477 - DNA, 22 bp, Homo sapiens
aatgccttggtttgatttctag

SEQ ID NO: 1871478 - DNA, 14 bp, Homo sapiens
aatgctttttgaat

SEQ ID NO: 1871479 - DNA, 17 bp, Homo sapiens
aatgctttttgaatgtt

SEQ ID NO: 1871480 - DNA, 12 bp, Homo sapiens
aatggagaaagt

SEQ ID NO: 1871481 - DNA, 23 bp, Homo sapiens
aatggatatagaaaatcttagta

SEQ ID NO: 1871482 - DNA, 18 bp, Homo sapiens
aatggcttacttacaaaa

SEQ ID NO: 1871483 - DNA, 13 bp, Homo sapiens
aatggggcgctgg

SEQ ID NO: 1871484 - DNA, 20 bp, Homo sapiens
aatggtttctcattaaactc

SEQ ID NO: 1871485 - DNA, 22 bp, Homo sapiens
aatggtttctcattaaactcta

SEQ ID NO: 1871486 - DNA, 19 bp, Homo sapiens
aatgtaaaggtcacttttc

SEQ ID NO: 1871487 - DNA, 14 bp, Homo sapiens
aatgtacttaaatg

SEQ ID NO: 1871488 - DNA, 17 bp, Homo sapiens
aatgtagggttatattt

SEQ ID NO: 1871489 - DNA, 22 bp, Homo sapiens
aatgtcctaacagagaaataga

SEQ ID NO: 1871490 - DNA, 14 bp, Homo sapiens
aatgtgactttgaa

SEQ ID NO: 1871491 - DNA, 14 bp, Homo sapiens
aatgtgtctgtgtt

SEQ ID NO: 1871492 - DNA, 17 bp, Homo sapiens
aatgtgtctgtgttgct

SEQ ID NO: 1871493 - DNA, 21 bp, Homo sapiens
aatgttatttgttattttcag

SEQ ID NO: 1871494 - DNA, 15 bp, Homo sapiens
aattaaaaactttaa

SEQ ID NO: 1871495 - DNA, 11 bp, Homo sapiens
aattaaaactg

SEQ ID NO: 1871496 - DNA, 13 bp, Homo sapiens
aattaaagcctta

SEQ ID NO: 1871497 - DNA, 13 bp, Homo sapiens
aattaatagcttt

SEQ ID NO: 1871498 - DNA, 14 bp, Homo sapiens
aattaatagctttt

SEQ ID NO: 1871499 - DNA, 22 bp, Homo sapiens
aattaccatagagtaatgatgt

SEQ ID NO: 1871500 - DNA, 21 bp, Homo sapiens
aattagaatggataagatgat

SEQ ID NO: 1871501 - DNA, 19 bp, Homo sapiens
aattagcagaatggagaaa

SEQ ID NO: 1871502 - DNA, 15 bp, Homo sapiens
aattagtctttttct

SEQ ID NO: 1871503 - DNA, 23 bp, Homo sapiens
aattatattcctcttgcatttca

SEQ ID NO: 1871504 - DNA, 13 bp, Homo sapiens
agcaagagccagg

SEQ ID NO: 1871505 - DNA, 17 bp, Homo sapiens
agcaagagccaggggtg

SEQ ID NO: 1871506 - DNA, 15 bp, Homo sapiens
agcaagatgtactat

SEQ ID NO: 1871507 - DNA, 22 bp, Homo sapiens
agcaatgccctgccttgctgcc

SEQ ID NO: 1871508 - DNA, 15 bp, Homo sapiens
agcaatttatatctt

SEQ ID NO: 1871509 - DNA, 23 bp, Homo sapiens
agcaatttatatctttatgcaaa

SEQ ID NO: 1871510 - DNA, 15 bp, Homo sapiens
agcacaagaaggcca

SEQ ID NO: 1871511 - DNA, 18 bp, Homo sapiens
agcacctagtccagtgac

SEQ ID NO: 1871512 - DNA, 22 bp, Homo sapiens
agcacgttttctggcttctgct

SEQ ID NO: 1871513 - DNA, 18 bp, Homo sapiens
agcagaatggagaaagta

SEQ ID NO: 1871514 - DNA, 20 bp, Homo sapiens
agcagcacgcatgtccctcc

SEQ ID NO: 1871515 - DNA, 15 bp, Homo sapiens
agcagcccccaaaga

SEQ ID NO: 1871516 - DNA, 19 bp, Homo sapiens
agcagcccccaaagagctg

SEQ ID NO: 1871517 - DNA, 14 bp, Homo sapiens
agcagctggcactg

SEQ ID NO: 1871518 - DNA, 21 bp, Homo sapiens
agcagctggcactgacagcct

SEQ ID NO: 1871519 - DNA, 13 bp, Homo sapiens
agcatgacaaaaa

SEQ ID NO: 1871520 - DNA, 16 bp, Homo sapiens
agcatgacaaaaataa

SEQ ID NO: 1871521 - DNA, 17 bp, Homo sapiens
agcatgacaaaaataac

SEQ ID NO: 1871522 - DNA, 23 bp, Homo sapiens
agcatgacaaaaataacactgtt

SEQ ID NO: 1871523 - DNA, 18 bp, Homo sapiens
agcatttttccatctgtg

SEQ ID NO: 1871524 - DNA, 16 bp, Homo sapiens
agcatttttgatttat

SEQ ID NO: 1871525 - DNA, 22 bp, Homo sapiens
agccaggagaagacccctgccc

SEQ ID NO: 1871526 - DNA, 14 bp, Homo sapiens
agccagggcagggc

SEQ ID NO: 1871527 - DNA, 17 bp, Homo sapiens
agccaggggtgtcccag

SEQ ID NO: 1871528 - DNA, 18 bp, Homo sapiens
agccaggggtgtcccagt

SEQ ID NO: 1871529 - DNA, 20 bp, Homo sapiens
agccatattctaaattcact

SEQ ID NO: 1871530 - DNA, 22 bp, Homo sapiens
agccattcctgttctctttgcc

SEQ ID NO: 1871531 - DNA, 19 bp, Homo sapiens
agcccactgggccctgggg

SEQ ID NO: 1871532 - DNA, 19 bp, Homo sapiens
agcccccactgacctgccc

SEQ ID NO: 1871533 - DNA, 23 bp, Homo sapiens
agcccccactgacctgcccatgt

SEQ ID NO: 1871534 - DNA, 14 bp, Homo sapiens
agccctggatggcc

SEQ ID NO: 1871535 - DNA, 17 bp, Homo sapiens
agccctggatggcctct

SEQ ID NO: 1871536 - DNA, 20 bp, Homo sapiens
agccctggatggcctctggg

SEQ ID NO: 1871537 - DNA, 13 bp, Homo sapiens
agccctttctgtg

SEQ ID NO: 1871538 - DNA, 12 bp, Homo sapiens
agcctctggggc

SEQ ID NO: 1871539 - DNA, 20 bp, Homo sapiens
agcctctggggcagagcttg

SEQ ID NO: 1871540 - DNA, 13 bp, Homo sapiens
agcgcttagaaac

SEQ ID NO: 1871541 - DNA, 16 bp, Homo sapiens
agcgggccaggcaggc

SEQ ID NO: 1871542 - DNA, 19 bp, Homo sapiens
agcgtccatttcttattta

SEQ ID NO: 1871543 - DNA, 14 bp, Homo sapiens
agctaagcaagcca

SEQ ID NO: 1871544 - DNA, 16 bp, Homo sapiens
agctactgatttttgt

SEQ ID NO: 1871545 - DNA, 14 bp, Homo sapiens
agctagaatttctg

SEQ ID NO: 1871546 - DNA, 14 bp, Homo sapiens
agctagtgccaaat

SEQ ID NO: 1871547 - DNA, 18 bp, Homo sapiens
agctagtgccaaataatt

SEQ ID NO: 1871548 - DNA, 19 bp, Homo sapiens
agctagtgccaaataattg

SEQ ID NO: 1871549 - DNA, 20 bp, Homo sapiens
agctattactgtctggtttt

SEQ ID NO: 1871550 - DNA, 21 bp, Homo sapiens
agctattactgtctggtttta

SEQ ID NO: 1871551 - DNA, 21 bp, Homo sapiens
agctcagctactgatttttgt

SEQ ID NO: 1871552 - DNA, 16 bp, Homo sapiens
agctcctgctcattgt

SEQ ID NO: 1871553 - DNA, 15 bp, Homo sapiens
agctggcactgacag

SEQ ID NO: 1871554 - DNA, 18 bp, Homo sapiens
agctggcactgacagcct

SEQ ID NO: 1871555 - DNA, 16 bp, Homo sapiens
agctgtagctggagaa

SEQ ID NO: 1871556 - DNA, 20 bp, Homo sapiens
agctgtagtagccctttctg

SEQ ID NO: 1871557 - DNA, 22 bp, Homo sapiens
agctgtgccttttttagcttca

SEQ ID NO: 1871558 - DNA, 17 bp, Homo sapiens
agctgtggctgggggga

SEQ ID NO: 1871559 - DNA, 14 bp, Homo sapiens
agcttacccttggt

SEQ ID NO: 1871560 - DNA, 13 bp, Homo sapiens
agcttcccctcac

SEQ ID NO: 1871561 - DNA, 14 bp, Homo sapiens
agcttcctgtctgt

SEQ ID NO: 1871562 - DNA, 17 bp, Homo sapiens
agcttcctgtctgttta

SEQ ID NO: 1871563 - DNA, 21 bp, Homo sapiens
agcttgtatagtgtaaaataa

SEQ ID NO: 1871564 - DNA, 21 bp, Homo sapiens
agctttacatgcaatttatta

SEQ ID NO: 1871565 - DNA, 15 bp, Homo sapiens
agctttatctttgtg

SEQ ID NO: 1871566 - DNA, 17 bp, Homo sapiens
agctttatctttgtgta

SEQ ID NO: 1871567 - DNA, 14 bp, Homo sapiens
agctttgggaaagc

SEQ ID NO: 1871568 - DNA, 17 bp, Homo sapiens
agcttttagttcagact

SEQ ID NO: 1871569 - DNA, 13 bp, Homo sapiens
aggaaaattgaaa

SEQ ID NO: 1871570 - DNA, 12 bp, Homo sapiens
aggaaattagtc

SEQ ID NO: 1871571 - DNA, 16 bp, Homo sapiens
aggaaattagtctttt

SEQ ID NO: 1871572 - DNA, 19 bp, Homo sapiens
aggaaccacatataacact

SEQ ID NO: 1871573 - DNA, 15 bp, Homo sapiens
aggaaccctggagac

SEQ ID NO: 1871574 - DNA, 20 bp, Homo sapiens
aggaaccctggagacagaag

SEQ ID NO: 1871575 - DNA, 22 bp, Homo sapiens
aggaagacataaaactttaaaa

SEQ ID NO: 1871576 - DNA, 15 bp, Homo sapiens
aggaagcagcaatta

SEQ ID NO: 1871577 - DNA, 15 bp, Homo sapiens
aggaatgtgtccaag

SEQ ID NO: 1871578 - DNA, 18 bp, Homo sapiens
aggaatgtgtccaagaca

SEQ ID NO: 1871579 - DNA, 13 bp, Homo sapiens
aggaatttaattt

SEQ ID NO: 1871580 - DNA, 15 bp, Homo sapiens
aggacatgtttttgt

SEQ ID NO: 1871581 - DNA, 16 bp, Homo sapiens
aggacatgtttttgtt

SEQ ID NO: 1871582 - DNA, 23 bp, Homo sapiens
aggacatgtttttgttttctttg

SEQ ID NO: 1871583 - DNA, 22 bp, Homo sapiens
aggaccactagctaagcaagcc

SEQ ID NO: 1871584 - DNA, 23 bp, Homo sapiens
aggaccactagctaagcaagcca

SEQ ID NO: 1871585 - DNA, 12 bp, Homo sapiens
aggacccacctg

SEQ ID NO: 1871586 - DNA, 23 bp, Homo sapiens
aggaccgttttgtattgcttcct

SEQ ID NO: 1871587 - DNA, 23 bp, Homo sapiens
aggactgggccgggcccagggcc

SEQ ID NO: 1871588 - DNA, 19 bp, Homo sapiens
aggagaagacccctgccca

SEQ ID NO: 1871589 - DNA, 15 bp, Homo sapiens
aggagcagctggcac

SEQ ID NO: 1871590 - DNA, 15 bp, Homo sapiens
aggaggtccttggag

SEQ ID NO: 1871591 - DNA, 17 bp, Homo sapiens
aggatcttttgtaaatg

SEQ ID NO: 1871592 - DNA, 15 bp, Homo sapiens
aggatgcgctgggac

SEQ ID NO: 1871593 - DNA, 15 bp, Homo sapiens
aggatgttacaagtt

SEQ ID NO: 1871594 - DNA, 19 bp, Homo sapiens
aggatgttacaagtttgct

SEQ ID NO: 1871595 - DNA, 21 bp, Homo sapiens
aggatgttacaagtttgctaa

SEQ ID NO: 1871596 - DNA, 17 bp, Homo sapiens
aggcacttttattttca

SEQ ID NO: 1871597 - DNA, 18 bp, Homo sapiens
aggcacttttattttcat

SEQ ID NO: 1871598 - DNA, 19 bp, Homo sapiens
aggcatatgcttctttaaa

SEQ ID NO: 1871599 - DNA, 14 bp, Homo sapiens
aggccagcccactg

SEQ ID NO: 1871600 - DNA, 16 bp, Homo sapiens
aggccagcccactggg

SEQ ID NO: 1871601 - DNA, 20 bp, Homo sapiens
aggccagcccactgggccct

SEQ ID NO: 1871602 - DNA, 22 bp, Homo sapiens
aggccagcccactgggccctgg

SEQ ID NO: 1871603 - DNA, 13 bp, Homo sapiens
aggccaggccagc

SEQ ID NO: 1871604 - DNA, 16 bp, Homo sapiens
aggccaggccagcttc

SEQ ID NO: 1871605 - DNA, 16 bp, Homo sapiens
aggccatttgctgccc

SEQ ID NO: 1871606 - DNA, 17 bp, Homo sapiens
aggccatttgctgccct

SEQ ID NO: 1871607 - DNA, 12 bp, Homo sapiens
aggcctccagaa

SEQ ID NO: 1871608 - DNA, 13 bp, Homo sapiens
aggctatcctgct

SEQ ID NO: 1871609 - DNA, 20 bp, Homo sapiens
aggctccctgaccaccctgc

SEQ ID NO: 1871610 - DNA, 21 bp, Homo sapiens
aggctccctgaccaccctgcc

SEQ ID NO: 1871611 - DNA, 17 bp, Homo sapiens
aggctgtcttctcccag

SEQ ID NO: 1871612 - DNA, 19 bp, Homo sapiens
aggctgtcttctcccagag

SEQ ID NO: 1871613 - DNA, 21 bp, Homo sapiens
aggctgtcttctcccagagca

SEQ ID NO: 1871614 - DNA, 21 bp, Homo sapiens
agggaaaatggatatagaaaa

SEQ ID NO: 1871615 - DNA, 14 bp, Homo sapiens
agggactggacagc

SEQ ID NO: 1871616 - DNA, 17 bp, Homo sapiens
agggactggacagccag

SEQ ID NO: 1871617 - DNA, 19 bp, Homo sapiens
agggactggacagccaggg

SEQ ID NO: 1871618 - DNA, 14 bp, Homo sapiens
agggagaaatgcca

SEQ ID NO: 1871619 - DNA, 16 bp, Homo sapiens
agggccaagacttggc

SEQ ID NO: 1871620 - DNA, 23 bp, Homo sapiens
atggggcattaatattcttttgt

SEQ ID NO: 1871621 - DNA, 16 bp, Homo sapiens
atgggttggtgcttct

SEQ ID NO: 1871622 - DNA, 17 bp, Homo sapiens
atggtgaaatttattag

SEQ ID NO: 1871623 - DNA, 18 bp, Homo sapiens
atggttgattcacacttg

SEQ ID NO: 1871624 - DNA, 18 bp, Homo sapiens
atggttgccttaaagaaa

SEQ ID NO: 1871625 - DNA, 12 bp, Homo sapiens
atgtacttaaat

SEQ ID NO: 1871626 - DNA, 12 bp, Homo sapiens
atgtatctttgg

SEQ ID NO: 1871627 - DNA, 17 bp, Homo sapiens
atgtctgtctttgcaaa

SEQ ID NO: 1871628 - DNA, 18 bp, Homo sapiens
atgtctgtctttgcaaag

SEQ ID NO: 1871629 - DNA, 20 bp, Homo sapiens
atgtctgtctttgcaaagga

SEQ ID NO: 1871630 - DNA, 16 bp, Homo sapiens
atgtgtccaagacaca

SEQ ID NO: 1871631 - DNA, 23 bp, Homo sapiens
atgtgtctgtgttgcttcaaatt

SEQ ID NO: 1871632 - DNA, 11 bp, Homo sapiens
atgtgtgccat

SEQ ID NO: 1871633 - DNA, 15 bp, Homo sapiens
atgttaaatgccttg

SEQ ID NO: 1871634 - DNA, 17 bp, Homo sapiens
atgttaaatgccttggt

SEQ ID NO: 1871635 - DNA, 15 bp, Homo sapiens
atgttacaagtttgc

SEQ ID NO: 1871636 - DNA, 16 bp, Homo sapiens
atgttacaagtttgct

SEQ ID NO: 1871637 - DNA, 20 bp, Homo sapiens
atgttacaagtttgctaaaa

SEQ ID NO: 1871638 - DNA, 23 bp, Homo sapiens
atgttacaagtttgctaaaagaa

SEQ ID NO: 1871639 - DNA, 13 bp, Homo sapiens
atgttatatattt

SEQ ID NO: 1871640 - DNA, 17 bp, Homo sapiens
atgttatatattttttg

SEQ ID NO: 1871641 - DNA, 20 bp, Homo sapiens
atgttatttgttattttcag

SEQ ID NO: 1871642 - DNA, 16 bp, Homo sapiens
atgttccaaatttaga

SEQ ID NO: 1871643 - DNA, 16 bp, Homo sapiens
atgttctgcaagaatt

SEQ ID NO: 1871644 - DNA, 21 bp, Homo sapiens
atgttctgcaagaattaaaac

SEQ ID NO: 1871645 - DNA, 17 bp, Homo sapiens
atgttgtgttgttatca

SEQ ID NO: 1871646 - DNA, 16 bp, Homo sapiens
atgtttaattcattaa

SEQ ID NO: 1871647 - DNA, 18 bp, Homo sapiens
atgtttgtacaagattgt

SEQ ID NO: 1871648 - DNA, 21 bp, Homo sapiens
atgtttttgttttctttgaat

SEQ ID NO: 1871649 - DNA, 17 bp, Homo sapiens
attaaaaactttaaaga

SEQ ID NO: 1871650 - DNA, 22 bp, Homo sapiens
attaaaactgagtccatgaaaa

SEQ ID NO: 1871651 - DNA, 18 bp, Homo sapiens
attaaaatgattgtaaaa

SEQ ID NO: 1871652 - DNA, 19 bp, Homo sapiens
attaaacagcaaagccata

SEQ ID NO: 1871653 - DNA, 18 bp, Homo sapiens
attaaagccttaagcaca

SEQ ID NO: 1871654 - DNA, 17 bp, Homo sapiens
attaacaaagcaacctt

SEQ ID NO: 1871655 - DNA, 16 bp, Homo sapiens
attaacaaagttactg

SEQ ID NO: 1871656 - DNA, 18 bp, Homo sapiens
attaacaaagttactggc

SEQ ID NO: 1871657 - DNA, 19 bp, Homo sapiens
attaacaaagttactggct

SEQ ID NO: 1871658 - DNA, 15 bp, Homo sapiens
attaactaaatgctc

SEQ ID NO: 1871659 - DNA, 19 bp, Homo sapiens
attaatagcttttattgta

SEQ ID NO: 1871660 - DNA, 23 bp, Homo sapiens
attaatagcttttattgtataaa

SEQ ID NO: 1871661 - DNA, 15 bp, Homo sapiens
attaatattcttttg

SEQ ID NO: 1871662 - DNA, 16 bp, Homo sapiens
attaatattcttttgt

SEQ ID NO: 1871663 - DNA, 13 bp, Homo sapiens
attaatcttttaa

SEQ ID NO: 1871664 - DNA, 13 bp, Homo sapiens
attaatgctttgg

SEQ ID NO: 1871665 - DNA, 20 bp, Homo sapiens
attaattgtcctgtgtctat

SEQ ID NO: 1871666 - DNA, 15 bp, Homo sapiens
attacagaggaagtt

SEQ ID NO: 1871667 - DNA, 13 bp, Homo sapiens
attaccagtctga

SEQ ID NO: 1871668 - DNA, 16 bp, Homo sapiens
attaccagtctgatta

SEQ ID NO: 1871669 - DNA, 19 bp, Homo sapiens
attaccatagagtaatgat

SEQ ID NO: 1871670 - DNA, 22 bp, Homo sapiens
attacgttcttacaagcttaaa

SEQ ID NO: 1871671 - DNA, 16 bp, Homo sapiens
attactgtatgtataa

SEQ ID NO: 1871672 - DNA, 17 bp, Homo sapiens
attactgtatgtataaa

SEQ ID NO: 1871673 - DNA, 20 bp, Homo sapiens
attactgtatgtataaatta

SEQ ID NO: 1871674 - DNA, 14 bp, Homo sapiens
attagcagaatgga

SEQ ID NO: 1871675 - DNA, 16 bp, Homo sapiens
attagcagaatggaga

SEQ ID NO: 1871676 - DNA, 22 bp, Homo sapiens
attagcagaatggagaaagtaa

SEQ ID NO: 1871677 - DNA, 13 bp, Homo sapiens
attagtttaaaat

SEQ ID NO: 1871678 - DNA, 16 bp, Homo sapiens
attataattgttgata

SEQ ID NO: 1871679 - DNA, 17 bp, Homo sapiens
attataattgttgatat

SEQ ID NO: 1871680 - DNA, 20 bp, Homo sapiens
attataccatgtgtgctaat

SEQ ID NO: 1871681 - DNA, 20 bp, Homo sapiens
attatataggttgtgcaaat

SEQ ID NO: 1871682 - DNA, 20 bp, Homo sapiens
attatattcctcttgcattt

SEQ ID NO: 1871683 - DNA, 12 bp, Homo sapiens
attatgttttca

SEQ ID NO: 1871684 - DNA, 15 bp, Homo sapiens
attattaatgctttg

SEQ ID NO: 1871685 - DNA, 16 bp, Homo sapiens
attattaattgtcctg

SEQ ID NO: 1871686 - DNA, 13 bp, Homo sapiens
attatttaataaa

SEQ ID NO: 1871687 - DNA, 15 bp, Homo sapiens
attatttgtgtaata

SEQ ID NO: 1871688 - DNA, 15 bp, Homo sapiens
attattttaaacaaa

SEQ ID NO: 1871689 - DNA, 12 bp, Homo sapiens
attattttacag

SEQ ID NO: 1871690 - DNA, 13 bp, Homo sapiens
attattttacagt

SEQ ID NO: 1871691 - DNA, 15 bp, Homo sapiens
attattttacagtct

SEQ ID NO: 1871692 - DNA, 15 bp, Homo sapiens
attattttgtatgga

SEQ ID NO: 1871693 - DNA, 16 bp, Homo sapiens
attcaccaaaagttca

SEQ ID NO: 1871694 - DNA, 16 bp, Homo sapiens
attcaccctgggcagt

SEQ ID NO: 1871695 - DNA, 14 bp, Homo sapiens
attcagaaattaaa

SEQ ID NO: 1871696 - DNA, 15 bp, Homo sapiens
attcagaaattaaaa

SEQ ID NO: 1871697 - DNA, 16 bp, Homo sapiens
attcagaaattaaaat

SEQ ID NO: 1871698 - DNA, 17 bp, Homo sapiens
attcagaaattaaaata

SEQ ID NO: 1871699 - DNA, 19 bp, Homo sapiens
attcagaaattaaaatatt

SEQ ID NO: 1871700 - DNA, 22 bp, Homo sapiens
attcagaaattaaaatattatt

SEQ ID NO: 1871701 - DNA, 19 bp, Homo sapiens
attcagatttctctttgaa

SEQ ID NO: 1871702 - DNA, 20 bp, Homo sapiens
attcagatttctctttgaaa

SEQ ID NO: 1871703 - DNA, 18 bp, Homo sapiens
attcagctagaatttctg

SEQ ID NO: 1871704 - DNA, 19 bp, Homo sapiens
attcagctagaatttctgg

SEQ ID NO: 1871705 - DNA, 15 bp, Homo sapiens
attccaacagtgagt

SEQ ID NO: 1871706 - DNA, 16 bp, Homo sapiens
attccaaggaaaattg

SEQ ID NO: 1871707 - DNA, 18 bp, Homo sapiens
attccaaggaaaattgaa

SEQ ID NO: 1871708 - DNA, 22 bp, Homo sapiens
attccaaggaaaattgaaagta

SEQ ID NO: 1871709 - DNA, 15 bp, Homo sapiens
attcccatctgtcac

SEQ ID NO: 1871710 - DNA, 14 bp, Homo sapiens
attcccttctgatc

SEQ ID NO: 1871711 - DNA, 13 bp, Homo sapiens
attcctgttctct

SEQ ID NO: 1871712 - DNA, 14 bp, Homo sapiens
attcctgttctctt

SEQ ID NO: 1871713 - DNA, 24 bp, Homo sapiens
attcctgttgtgtaataacagaac

SEQ ID NO: 1871714 - DNA, 14 bp, Homo sapiens
attctgaaatactt

SEQ ID NO: 1871715 - DNA, 21 bp, Homo sapiens
attctgaaatacttttgagta

SEQ ID NO: 1871716 - DNA, 20 bp, Homo sapiens
attctgaccacccttctcat

SEQ ID NO: 1871717 - DNA, 13 bp, Homo sapiens
attcttggttgtt

SEQ ID NO: 1871718 - DNA, 19 bp, Homo sapiens
attcttggttgttaattta

SEQ ID NO: 1871719 - DNA, 19 bp, Homo sapiens
attcttttgttattaaaaa

SEQ ID NO: 1871720 - DNA, 23 bp, Homo sapiens
attcttttgttattaaaaaaaca

SEQ ID NO: 1871721 - DNA, 17 bp, Homo sapiens
attgaaagtattcagaa

SEQ ID NO: 1871722 - DNA, 18 bp, Homo sapiens
attgaaagtattcagaaa

SEQ ID NO: 1871723 - DNA, 14 bp, Homo sapiens
attgaaagttgctt

SEQ ID NO: 1871724 - DNA, 22 bp, Homo sapiens
attgaaatggggcgctggacac

SEQ ID NO: 1871725 - DNA, 17 bp, Homo sapiens
attgagaataagaattt

SEQ ID NO: 1871726 - DNA, 16 bp, Homo sapiens
attgagctagaaatca

SEQ ID NO: 1871727 - DNA, 15 bp, Homo sapiens
attgagtcttaactg

SEQ ID NO: 1871728 - DNA, 19 bp, Homo sapiens
attgagtcttaactgtatt

SEQ ID NO: 1871729 - DNA, 22 bp, Homo sapiens
attgatcccttctcctgccctt

SEQ ID NO: 1871730 - DNA, 12 bp, Homo sapiens
attgcaaatatt

SEQ ID NO: 1871731 - DNA, 19 bp, Homo sapiens
attgcaatctataatattt

SEQ ID NO: 1871732 - DNA, 19 bp, Homo sapiens
attgcaccattttcaattt

SEQ ID NO: 1871733 - DNA, 13 bp, Homo sapiens
attgcagtttcat

SEQ ID NO: 1871734 - DNA, 16 bp, Homo sapiens
attgcagtttcatgta

SEQ ID NO: 1871735 - DNA, 17 bp, Homo sapiens
attgcagtttcatgtat

SEQ ID NO: 1871736 - DNA, 15 bp, Homo sapiens
attgcatcatttaca

SEQ ID NO: 1871737 - DNA, 17 bp, Homo sapiens
catcagacttgcggcca

SEQ ID NO: 1871738 - DNA, 18 bp, Homo sapiens
catcagacttgcggccac

SEQ ID NO: 1871739 - DNA, 19 bp, Homo sapiens
catcagacttgcggccaca

SEQ ID NO: 1871740 - DNA, 14 bp, Homo sapiens
catcagctttttgt

SEQ ID NO: 1871741 - DNA, 21 bp, Homo sapiens
catcatcagacttgcggccac

SEQ ID NO: 1871742 - DNA, 15 bp, Homo sapiens
catccatgtttgtaa

SEQ ID NO: 1871743 - DNA, 18 bp, Homo sapiens
catcgcagcttcctgtct

SEQ ID NO: 1871744 - DNA, 19 bp, Homo sapiens
catctaaagctttatcttt

SEQ ID NO: 1871745 - DNA, 16 bp, Homo sapiens
catctgcctgtaatta

SEQ ID NO: 1871746 - DNA, 20 bp, Homo sapiens
catctgttgttttgttttaa

SEQ ID NO: 1871747 - DNA, 22 bp, Homo sapiens
catcttttcctcccattttaga

SEQ ID NO: 1871748 - DNA, 14 bp, Homo sapiens
catgaaaataccat

SEQ ID NO: 1871749 - DNA, 19 bp, Homo sapiens
catgacaaaaataacactg

SEQ ID NO: 1871750 - DNA, 23 bp, Homo sapiens
catgacaaaaataacactgttgg

SEQ ID NO: 1871751 - DNA, 12 bp, Homo sapiens
catgacatgtta

SEQ ID NO: 1871752 - DNA, 15 bp, Homo sapiens
catgcaaactgcttt

SEQ ID NO: 1871753 - DNA, 22 bp, Homo sapiens
catgcaaactgctttattttcc

SEQ ID NO: 1871754 - DNA, 16 bp, Homo sapiens
catgcccactccccca

SEQ ID NO: 1871755 - DNA, 18 bp, Homo sapiens
catgcccactcccccagg

SEQ ID NO: 1871756 - DNA, 19 bp, Homo sapiens
catgcccactcccccagga

SEQ ID NO: 1871757 - DNA, 18 bp, Homo sapiens
catgctgaggttttgaat

SEQ ID NO: 1871758 - DNA, 21 bp, Homo sapiens
catgctgaggttttgaataaa

SEQ ID NO: 1871759 - DNA, 19 bp, Homo sapiens
catgcttgtgtttcttagt

SEQ ID NO: 1871760 - DNA, 18 bp, Homo sapiens
catggaaacctgaaaaaa

SEQ ID NO: 1871761 - DNA, 14 bp, Homo sapiens
catggagcagcccc

SEQ ID NO: 1871762 - DNA, 17 bp, Homo sapiens
catggagcagcccccaa

SEQ ID NO: 1871763 - DNA, 18 bp, Homo sapiens
catggctacttgctttga

SEQ ID NO: 1871764 - DNA, 17 bp, Homo sapiens
catgtccctccaaggct

SEQ ID NO: 1871765 - DNA, 21 bp, Homo sapiens
catgtccctccaaggctgtct

SEQ ID NO: 1871766 - DNA, 13 bp, Homo sapiens
catgttatatatt

SEQ ID NO: 1871767 - DNA, 14 bp, Homo sapiens
catgttatatattt

SEQ ID NO: 1871768 - DNA, 22 bp, Homo sapiens
catgttatatattttttgtagg

SEQ ID NO: 1871769 - DNA, 18 bp, Homo sapiens
catgtttgtctgtgtgct

SEQ ID NO: 1871770 - DNA, 23 bp, Homo sapiens
catgtttttgttttctttgaatg

SEQ ID NO: 1871771 - DNA, 22 bp, Homo sapiens
cattaaaaaaaaaaaaaaactc

SEQ ID NO: 1871772 - DNA, 14 bp, Homo sapiens
cattaatattcttt

SEQ ID NO: 1871773 - DNA, 16 bp, Homo sapiens
cattaatattcttttg

SEQ ID NO: 1871774 - DNA, 18 bp, Homo sapiens
cattaatcaatcatctgt

SEQ ID NO: 1871775 - DNA, 23 bp, Homo sapiens
cattaatcaatcatctgtgtgaa

SEQ ID NO: 1871776 - DNA, 18 bp, Homo sapiens
cattaccttgtctttcaa

SEQ ID NO: 1871777 - DNA, 20 bp, Homo sapiens
cattactgtatgtataaatt

SEQ ID NO: 1871778 - DNA, 14 bp, Homo sapiens
cattattttacagt

SEQ ID NO: 1871779 - DNA, 21 bp, Homo sapiens
cattcatgcaacttgattctt

SEQ ID NO: 1871780 - DNA, 16 bp, Homo sapiens
cattccaacagtgagt

SEQ ID NO: 1871781 - DNA, 13 bp, Homo sapiens
cattgatttgatt

SEQ ID NO: 1871782 - DNA, 12 bp, Homo sapiens
cattgtgtatga

SEQ ID NO: 1871783 - DNA, 12 bp, Homo sapiens
catttaaggaga

SEQ ID NO: 1871784 - DNA, 18 bp, Homo sapiens
catttagtaccctgcagg

SEQ ID NO: 1871785 - DNA, 16 bp, Homo sapiens
catttctgtatactgt

SEQ ID NO: 1871786 - DNA, 23 bp, Homo sapiens
catttctgtatactgtaaaagtt

SEQ ID NO: 1871787 - DNA, 12 bp, Homo sapiens
catttcttattt

SEQ ID NO: 1871788 - DNA, 14 bp, Homo sapiens
catttgacaacaca

SEQ ID NO: 1871789 - DNA, 15 bp, Homo sapiens
catttgctgccctgg

SEQ ID NO: 1871790 - DNA, 20 bp, Homo sapiens
cattttagaaaatcagattt

SEQ ID NO: 1871791 - DNA, 19 bp, Homo sapiens
catttttgctaattatcaa

SEQ ID NO: 1871792 - DNA, 20 bp, Homo sapiens
catttttgtataaaaaggaa

SEQ ID NO: 1871793 - DNA, 23 bp, Homo sapiens
catttttgtataaaaaggaaatt

SEQ ID NO: 1871794 - DNA, 18 bp, Homo sapiens
ccaaaagaaaccatgaca

SEQ ID NO: 1871795 - DNA, 23 bp, Homo sapiens
ccaaaataatctatattaaatga

SEQ ID NO: 1871796 - DNA, 18 bp, Homo sapiens
ccaaaatctaaaagctgt

SEQ ID NO: 1871797 - DNA, 15 bp, Homo sapiens
ccaaagagctgtggc

SEQ ID NO: 1871798 - DNA, 20 bp, Homo sapiens
ccaaattattaattgtcctg

SEQ ID NO: 1871799 - DNA, 11 bp, Homo sapiens
ccaaattattt

SEQ ID NO: 1871800 - DNA, 17 bp, Homo sapiens
ccaaattatttgtgtaa

SEQ ID NO: 1871801 - DNA, 22 bp, Homo sapiens
ccaaattgtctgtctgctctta

SEQ ID NO: 1871802 - DNA, 11 bp, Homo sapiens
ccaaatttaat

SEQ ID NO: 1871803 - DNA, 20 bp, Homo sapiens
ccaacagtgagtctgtcagc

SEQ ID NO: 1871804 - DNA, 18 bp, Homo sapiens
ccaagacttggcaacaga

SEQ ID NO: 1871805 - DNA, 20 bp, Homo sapiens
ccaagacttggcaacagaag

SEQ ID NO: 1871806 - DNA, 17 bp, Homo sapiens
ccaaggaaaattgaaag

SEQ ID NO: 1871807 - DNA, 19 bp, Homo sapiens
ccaaggaaaattgaaagta

SEQ ID NO: 1871808 - DNA, 18 bp, Homo sapiens
ccaaggaatgtgtccaag

SEQ ID NO: 1871809 - DNA, 21 bp, Homo sapiens
ccaaggaatgtgtccaagaca

SEQ ID NO: 1871810 - DNA, 23 bp, Homo sapiens
ccaaggaatgtgtccaagacaca

SEQ ID NO: 1871811 - DNA, 20 bp, Homo sapiens
ccaaggctgtcttctcccag

SEQ ID NO: 1871812 - DNA, 21 bp, Homo sapiens
ccaaggctgtcttctcccaga

SEQ ID NO: 1871813 - DNA, 16 bp, Homo sapiens
ccaatccatgcttcac

SEQ ID NO: 1871814 - DNA, 13 bp, Homo sapiens
ccacaaaaattga

SEQ ID NO: 1871815 - DNA, 14 bp, Homo sapiens
ccacagtcaaagaa

SEQ ID NO: 1871816 - DNA, 16 bp, Homo sapiens
ccacagtcaaagaagg

SEQ ID NO: 1871817 - DNA, 14 bp, Homo sapiens
ccacatataacact

SEQ ID NO: 1871818 - DNA, 17 bp, Homo sapiens
ccaccagcaatgccctg

SEQ ID NO: 1871819 - DNA, 13 bp, Homo sapiens
ccaccctgcctgt

SEQ ID NO: 1871820 - DNA, 18 bp, Homo sapiens
ccaccctgcctgtggagg

SEQ ID NO: 1871821 - DNA, 18 bp, Homo sapiens
ccacctgggccaaggact

SEQ ID NO: 1871822 - DNA, 19 bp, Homo sapiens
ccacgatgacgcctctgga

SEQ ID NO: 1871823 - DNA, 15 bp, Homo sapiens
ccacggtcttctgca

SEQ ID NO: 1871824 - DNA, 19 bp, Homo sapiens
ccactagctaagcaagcca

SEQ ID NO: 1871825 - DNA, 22 bp, Homo sapiens
ccactagctaagcaagccagga

SEQ ID NO: 1871826 - DNA, 13 bp, Homo sapiens
ccactcccccagg

SEQ ID NO: 1871827 - DNA, 15 bp, Homo sapiens
ccactcccccaggag

SEQ ID NO: 1871828 - DNA, 19 bp, Homo sapiens
ccactcccccaggagcagc

SEQ ID NO: 1871829 - DNA, 13 bp, Homo sapiens
ccactgacctgcc

SEQ ID NO: 1871830 - DNA, 16 bp, Homo sapiens
ccactgacctgcccat

SEQ ID NO: 1871831 - DNA, 20 bp, Homo sapiens
ccactggcatcgcagcttcc

SEQ ID NO: 1871832 - DNA, 16 bp, Homo sapiens
ccactgggccctgggg

SEQ ID NO: 1871833 - DNA, 17 bp, Homo sapiens
ccactgggccctggggc

SEQ ID NO: 1871834 - DNA, 18 bp, Homo sapiens
ccactgggccctggggct

SEQ ID NO: 1871835 - DNA, 21 bp, Homo sapiens
ccactgggccctggggctgcc

SEQ ID NO: 1871836 - DNA, 17 bp, Homo sapiens
ccagaaattagaaacct

SEQ ID NO: 1871837 - DNA, 14 bp, Homo sapiens
ccagaattattttt

SEQ ID NO: 1871838 - DNA, 20 bp, Homo sapiens
ccagagcacaagaaggccag

SEQ ID NO: 1871839 - DNA, 13 bp, Homo sapiens
ccagagggactgg

SEQ ID NO: 1871840 - DNA, 15 bp, Homo sapiens
ccagcaatgccctgc

SEQ ID NO: 1871841 - DNA, 17 bp, Homo sapiens
ccagcacgttttctggc

SEQ ID NO: 1871842 - DNA, 12 bp, Homo sapiens
ccagcccactgg

SEQ ID NO: 1871843 - DNA, 14 bp, Homo sapiens
ccagcccactgggc

SEQ ID NO: 1871844 - DNA, 22 bp, Homo sapiens
ccagcccactgggccctggggc

SEQ ID NO: 1871845 - DNA, 16 bp, Homo sapiens
ccagcctctggggcag

SEQ ID NO: 1871846 - DNA, 18 bp, Homo sapiens
ccaggagaagacccctgc

SEQ ID NO: 1871847 - DNA, 12 bp, Homo sapiens
ccaggagcagct

SEQ ID NO: 1871848 - DNA, 19 bp, Homo sapiens
ccaggagcagctggcactg

SEQ ID NO: 1871849 - DNA, 23 bp, Homo sapiens
ccaggcaggctgggtgggaggga

SEQ ID NO: 1871850 - DNA, 17 bp, Homo sapiens
ccaggcctccagaacct

SEQ ID NO: 1871851 - DNA, 16 bp, Homo sapiens
ccaggctccctgacca

SEQ ID NO: 1871852 - DNA, 22 bp, Homo sapiens
ccaggctccctgaccaccctgc

SEQ ID NO: 1871853 - DNA, 17 bp, Homo sapiens
ctggacacctacagcag

SEQ ID NO: 1871854 - DNA, 20 bp, Homo sapiens
ctggacacctacagcagcac

SEQ ID NO: 1871855 - DNA, 15 bp, Homo sapiens
ctggacagccagggc

SEQ ID NO: 1871856 - DNA, 20 bp, Homo sapiens
ctggacagccagggcagggc

SEQ ID NO: 1871857 - DNA, 21 bp, Homo sapiens
ctggacagccagggcagggct

SEQ ID NO: 1871858 - DNA, 20 bp, Homo sapiens
ctggacctcggtgatgcctt

SEQ ID NO: 1871859 - DNA, 21 bp, Homo sapiens
ctggacctcggtgatgccttc

SEQ ID NO: 1871860 - DNA, 14 bp, Homo sapiens
ctggagactattta

SEQ ID NO: 1871861 - DNA, 16 bp, Homo sapiens
ctggagactatttaag

SEQ ID NO: 1871862 - DNA, 14 bp, Homo sapiens
ctggagggggcaga

SEQ ID NO: 1871863 - DNA, 17 bp, Homo sapiens
ctggagggggcagagtg

SEQ ID NO: 1871864 - DNA, 18 bp, Homo sapiens
ctggagggggcagagtgg

SEQ ID NO: 1871865 - DNA, 15 bp, Homo sapiens
ctggcactgacagcc

SEQ ID NO: 1871866 - DNA, 13 bp, Homo sapiens
ctggcactgtggc

SEQ ID NO: 1871867 - DNA, 14 bp, Homo sapiens
ctggcactgtggca

SEQ ID NO: 1871868 - DNA, 19 bp, Homo sapiens
ctggcactgtggcactgcc

SEQ ID NO: 1871869 - DNA, 21 bp, Homo sapiens
ctggcactgtggcactgccac

SEQ ID NO: 1871870 - DNA, 22 bp, Homo sapiens
ctggcactgtggcactgccacc

SEQ ID NO: 1871871 - DNA, 18 bp, Homo sapiens
ctggcaggtcatggagca

SEQ ID NO: 1871872 - DNA, 20 bp, Homo sapiens
ctggcaggtcatggagcagc

SEQ ID NO: 1871873 - DNA, 20 bp, Homo sapiens
ctggcatcgcagcttcctgt

SEQ ID NO: 1871874 - DNA, 14 bp, Homo sapiens
ctggcttccctgcc

SEQ ID NO: 1871875 - DNA, 15 bp, Homo sapiens
ctggcttccctgccc

SEQ ID NO: 1871876 - DNA, 20 bp, Homo sapiens
ctgggaaccaagggccctca

SEQ ID NO: 1871877 - DNA, 14 bp, Homo sapiens
ctgggcagtgagtg

SEQ ID NO: 1871878 - DNA, 21 bp, Homo sapiens
ctgggcagtgagtgccatgct

SEQ ID NO: 1871879 - DNA, 16 bp, Homo sapiens
ctgggccctggggctg

SEQ ID NO: 1871880 - DNA, 20 bp, Homo sapiens
ctgggccctggggctgccct

SEQ ID NO: 1871881 - DNA, 17 bp, Homo sapiens
ctgggccgggcccaggg

SEQ ID NO: 1871882 - DNA, 19 bp, Homo sapiens
ctgggcttggtaagtgaat

SEQ ID NO: 1871883 - DNA, 13 bp, Homo sapiens
ctggggcaggacc

SEQ ID NO: 1871884 - DNA, 13 bp, Homo sapiens
ctggggctgccct

SEQ ID NO: 1871885 - DNA, 19 bp, Homo sapiens
ctggggctgccctcggcaa

SEQ ID NO: 1871886 - DNA, 16 bp, Homo sapiens
ctggtaaactatttgt

SEQ ID NO: 1871887 - DNA, 19 bp, Homo sapiens
ctggtaaactatttgtctt

SEQ ID NO: 1871888 - DNA, 12 bp, Homo sapiens
ctggttccaaac

SEQ ID NO: 1871889 - DNA, 20 bp, Homo sapiens
ctggttccaaaccagtttat

SEQ ID NO: 1871890 - DNA, 22 bp, Homo sapiens
ctggttccaaaccagtttattc

SEQ ID NO: 1871891 - DNA, 23 bp, Homo sapiens
ctggtttgtttgcttaatttcct

SEQ ID NO: 1871892 - DNA, 19 bp, Homo sapiens
ctgtaaactcaaaacttaa

SEQ ID NO: 1871893 - DNA, 22 bp, Homo sapiens
ctgtaaactcaaaacttaacat

SEQ ID NO: 1871894 - DNA, 17 bp, Homo sapiens
ctgtaacctgaagtcaa

SEQ ID NO: 1871895 - DNA, 22 bp, Homo sapiens
ctgtaagcagattacaataaat

SEQ ID NO: 1871896 - DNA, 16 bp, Homo sapiens
ctgtacattactgtat

SEQ ID NO: 1871897 - DNA, 13 bp, Homo sapiens
ctgtactttgtgt

SEQ ID NO: 1871898 - DNA, 18 bp, Homo sapiens
ctgtagtagccctttctg

SEQ ID NO: 1871899 - DNA, 21 bp, Homo sapiens
ctgtagtagccctttctgtgt

SEQ ID NO: 1871900 - DNA, 20 bp, Homo sapiens
ctgtatactgtaaaagttat

SEQ ID NO: 1871901 - DNA, 18 bp, Homo sapiens
ctgtcaaatgaactttta

SEQ ID NO: 1871902 - DNA, 22 bp, Homo sapiens
ctgtcaaatgaacttttacaga

SEQ ID NO: 1871903 - DNA, 23 bp, Homo sapiens
ctgtcaaatgaacttttacagaa

SEQ ID NO: 1871904 - DNA, 17 bp, Homo sapiens
ctgtcagcgcaggttta

SEQ ID NO: 1871905 - DNA, 18 bp, Homo sapiens
ctgtctggttttaacaat

SEQ ID NO: 1871906 - DNA, 14 bp, Homo sapiens
ctgtctgtacctaa

SEQ ID NO: 1871907 - DNA, 14 bp, Homo sapiens
ctgtcttctcccag

SEQ ID NO: 1871908 - DNA, 17 bp, Homo sapiens
ctgtgactagatacaga

SEQ ID NO: 1871909 - DNA, 15 bp, Homo sapiens
ctgtgagcaagagcc

SEQ ID NO: 1871910 - DNA, 19 bp, Homo sapiens
ctgtgagcaagagccaggg

SEQ ID NO: 1871911 - DNA, 20 bp, Homo sapiens
ctgtgagcaagagccagggg

SEQ ID NO: 1871912 - DNA, 19 bp, Homo sapiens
ctgtgaggcgggtggctgg

SEQ ID NO: 1871913 - DNA, 18 bp, Homo sapiens
ctgtgctatgctggacat

SEQ ID NO: 1871914 - DNA, 13 bp, Homo sapiens
ctgtggcactgcc

SEQ ID NO: 1871915 - DNA, 16 bp, Homo sapiens
ctgtggcactgccacc

SEQ ID NO: 1871916 - DNA, 19 bp, Homo sapiens
ctgtggcactgccaccagc

SEQ ID NO: 1871917 - DNA, 23 bp, Homo sapiens
ctgtggccatatatgctgtattt

SEQ ID NO: 1871918 - DNA, 14 bp, Homo sapiens
ctgtggctgggggg

SEQ ID NO: 1871919 - DNA, 15 bp, Homo sapiens
ctgtgtgatgaactt

SEQ ID NO: 1871920 - DNA, 16 bp, Homo sapiens
ctgtgtgatgaacttt

SEQ ID NO: 1871921 - DNA, 19 bp, Homo sapiens
ctgtgtgatgaactttctc

SEQ ID NO: 1871922 - DNA, 13 bp, Homo sapiens
ctgttaagaaagg

SEQ ID NO: 1871923 - DNA, 15 bp, Homo sapiens
ctgttaagaaaggat

SEQ ID NO: 1871924 - DNA, 23 bp, Homo sapiens
ctgttactgcttctctttgtgca

SEQ ID NO: 1871925 - DNA, 23 bp, Homo sapiens
ctgttcctcgggatgaaaagcca

SEQ ID NO: 1871926 - DNA, 22 bp, Homo sapiens
ctgttgaaaattattttaaaca

SEQ ID NO: 1871927 - DNA, 23 bp, Homo sapiens
ctgttgtaaataaccacactgaa

SEQ ID NO: 1871928 - DNA, 20 bp, Homo sapiens
ctgtttactcccttctgtag

SEQ ID NO: 1871929 - DNA, 20 bp, Homo sapiens
ctgtttggtcgagtctttgt

SEQ ID NO: 1871930 - DNA, 14 bp, Homo sapiens
ctgtttgtatattt

SEQ ID NO: 1871931 - DNA, 13 bp, Homo sapiens
ctgtttttaacat

SEQ ID NO: 1871932 - DNA, 14 bp, Homo sapiens
cttaaaaactgtgt

SEQ ID NO: 1871933 - DNA, 15 bp, Homo sapiens
cttaaaaactgtgta

SEQ ID NO: 1871934 - DNA, 21 bp, Homo sapiens
cttaaagaaagtcgaattaat

SEQ ID NO: 1871935 - DNA, 22 bp, Homo sapiens
cttaaagaaagtcgaattaata

SEQ ID NO: 1871936 - DNA, 15 bp, Homo sapiens
cttaaagcttgattt

SEQ ID NO: 1871937 - DNA, 21 bp, Homo sapiens
cttaaagcttgatttgatctt

SEQ ID NO: 1871938 - DNA, 17 bp, Homo sapiens
cttaaatgagttactta

SEQ ID NO: 1871939 - DNA, 13 bp, Homo sapiens
cttaactgtattt

SEQ ID NO: 1871940 - DNA, 14 bp, Homo sapiens
cttaactgtatttc

SEQ ID NO: 1871941 - DNA, 21 bp, Homo sapiens
cttaactgtatttcagtattt

SEQ ID NO: 1871942 - DNA, 21 bp, Homo sapiens
cttaaggtactctggactttc

SEQ ID NO: 1871943 - DNA, 24 bp, Homo sapiens
cttaatggtaggtcaagtaataaa

SEQ ID NO: 1871944 - DNA, 21 bp, Homo sapiens
cttaatttccttctgttaaga

SEQ ID NO: 1871945 - DNA, 18 bp, Homo sapiens
cttacaaaagcagctttt

SEQ ID NO: 1871946 - DNA, 17 bp, Homo sapiens
cttacaagcttaaagct

SEQ ID NO: 1871947 - DNA, 17 bp, Homo sapiens
cttaccaactttctgta

SEQ ID NO: 1871948 - DNA, 19 bp, Homo sapiens
cttacccttggtttgcaca

SEQ ID NO: 1871949 - DNA, 15 bp, Homo sapiens
cttacggtgcacagt

SEQ ID NO: 1871950 - DNA, 23 bp, Homo sapiens
cttacggtgcacagtaatatgaa

SEQ ID NO: 1871951 - DNA, 13 bp, Homo sapiens
cttactggcactg

SEQ ID NO: 1871952 - DNA, 13 bp, Homo sapiens
cttacttacaaaa

SEQ ID NO: 1871953 - DNA, 13 bp, Homo sapiens
cttagaaacatgt

SEQ ID NO: 1871954 - DNA, 15 bp, Homo sapiens
cttagaaacatgttc

SEQ ID NO: 1871955 - DNA, 13 bp, Homo sapiens
cttagaatgccat

SEQ ID NO: 1871956 - DNA, 22 bp, Homo sapiens
cttagagtttacagtttgtgtt

SEQ ID NO: 1871957 - DNA, 18 bp, Homo sapiens
cttagtggggttttatat

SEQ ID NO: 1871958 - DNA, 16 bp, Homo sapiens
cttagttcttgaattg

SEQ ID NO: 1871959 - DNA, 22 bp, Homo sapiens
cttagttgatattcaaggcttt

SEQ ID NO: 1871960 - DNA, 21 bp, Homo sapiens
cttataggtaacgtgattgat

SEQ ID NO: 1871961 - DNA, 21 bp, Homo sapiens
cttatcatttttgtataaaaa

SEQ ID NO: 1871962 - DNA, 13 bp, Homo sapiens
cttatgtgttaca

SEQ ID NO: 1871963 - DNA, 14 bp, Homo sapiens
cttatgtgttacat

SEQ ID NO: 1871964 - DNA, 17 bp, Homo sapiens
cttatgtgttacattat

SEQ ID NO: 1871965 - DNA, 13 bp, Homo sapiens
cttatttttgtac

SEQ ID NO: 1871966 - DNA, 17 bp, Homo sapiens
cttatttttgtaccata

SEQ ID NO: 1871967 - DNA, 15 bp, Homo sapiens
cttcactgttgaaaa

SEQ ID NO: 1871968 - DNA, 16 bp, Homo sapiens
cttcactgttgaaaat

SEQ ID NO: 1871969 - DNA, 17 bp, Homo sapiens
gcacttagctatcagaa

SEQ ID NO: 1871970 - DNA, 18 bp, Homo sapiens
gcacttttattttcattg

SEQ ID NO: 1871971 - DNA, 15 bp, Homo sapiens
gcagaaccagctcta

SEQ ID NO: 1871972 - DNA, 16 bp, Homo sapiens
gcagaatggagaaagt

SEQ ID NO: 1871973 - DNA, 20 bp, Homo sapiens
gcagagcttgtagccctgga

SEQ ID NO: 1871974 - DNA, 23 bp, Homo sapiens
gcagagcttgtagccctggatgg

SEQ ID NO: 1871975 - DNA, 17 bp, Homo sapiens
gcagagtggcctgtgag

SEQ ID NO: 1871976 - DNA, 20 bp, Homo sapiens
gcagcacgcatgtccctcca

SEQ ID NO: 1871977 - DNA, 16 bp, Homo sapiens
gcagcccacccagcag

SEQ ID NO: 1871978 - DNA, 18 bp, Homo sapiens
gcagcccccaaagagctg

SEQ ID NO: 1871979 - DNA, 23 bp, Homo sapiens
gcagcccccaaagagctgtggct

SEQ ID NO: 1871980 - DNA, 19 bp, Homo sapiens
gcagcccccactgacctgc

SEQ ID NO: 1871981 - DNA, 21 bp, Homo sapiens
gcagcccccactgacctgccc

SEQ ID NO: 1871982 - DNA, 16 bp, Homo sapiens
gcagccgtgcaggact

SEQ ID NO: 1871983 - DNA, 17 bp, Homo sapiens
gcagccgtgcaggactc

SEQ ID NO: 1871984 - DNA, 21 bp, Homo sapiens
gcagccttaaacagtgtccag

SEQ ID NO: 1871985 - DNA, 16 bp, Homo sapiens
gcagctggcactgaca

SEQ ID NO: 1871986 - DNA, 18 bp, Homo sapiens
gcagctggcactgacagc

SEQ ID NO: 1871987 - DNA, 18 bp, Homo sapiens
gcaggactctagctcatg

SEQ ID NO: 1871988 - DNA, 13 bp, Homo sapiens
gcagtctgaagga

SEQ ID NO: 1871989 - DNA, 22 bp, Homo sapiens
gcagttgaatgacaacagaagc

SEQ ID NO: 1871990 - DNA, 22 bp, Homo sapiens
gcagtttcatgtatgtatataa

SEQ ID NO: 1871991 - DNA, 21 bp, Homo sapiens
gcataatgaaccgtttacagt

SEQ ID NO: 1871992 - DNA, 22 bp, Homo sapiens
gcatagaggtaccagcaatatg

SEQ ID NO: 1871993 - DNA, 16 bp, Homo sapiens
gcatgggaaaaagaga

SEQ ID NO: 1871994 - DNA, 19 bp, Homo sapiens
gcatgtccctccaaggctg

SEQ ID NO: 1871995 - DNA, 23 bp, Homo sapiens
gcattaaaaaaaaaaaaaaactc

SEQ ID NO: 1871996 - DNA, 15 bp, Homo sapiens
gcattaactaaatgc

SEQ ID NO: 1871997 - DNA, 17 bp, Homo sapiens
gcattaactaaatgctc

SEQ ID NO: 1871998 - DNA, 18 bp, Homo sapiens
gcattaactaaatgctca

SEQ ID NO: 1871999 - DNA, 19 bp, Homo sapiens
gcattaatattcttttgtt

SEQ ID NO: 1872000 - DNA, 14 bp, Homo sapiens
gcatttaaggagat

SEQ ID NO: 1872001 - DNA, 20 bp, Homo sapiens
gcatttttgatttatgcatg

SEQ ID NO: 1872002 - DNA, 20 bp, Homo sapiens
gccaaaatgtacttaaatga

SEQ ID NO: 1872003 - DNA, 21 bp, Homo sapiens
gccaaaatgtacttaaatgag

SEQ ID NO: 1872004 - DNA, 23 bp, Homo sapiens
gccaaattatttgtgtaatagaa

SEQ ID NO: 1872005 - DNA, 22 bp, Homo sapiens
gccaagacttggcaacagaagc

SEQ ID NO: 1872006 - DNA, 18 bp, Homo sapiens
gccaagctaatctgcctg

SEQ ID NO: 1872007 - DNA, 13 bp, Homo sapiens
gccaagtggccac

SEQ ID NO: 1872008 - DNA, 14 bp, Homo sapiens
gccaccagcaatgc

SEQ ID NO: 1872009 - DNA, 14 bp, Homo sapiens
gccaccttgttaca

SEQ ID NO: 1872010 - DNA, 22 bp, Homo sapiens
gccaccttgttacaaatttttt

SEQ ID NO: 1872011 - DNA, 16 bp, Homo sapiens
gccagcccactgggcc

SEQ ID NO: 1872012 - DNA, 16 bp, Homo sapiens
gccaggagaagacccc

SEQ ID NO: 1872013 - DNA, 23 bp, Homo sapiens
gccaggagaagacccctgcccaa

SEQ ID NO: 1872014 - DNA, 15 bp, Homo sapiens
gccaggctccctgac

SEQ ID NO: 1872015 - DNA, 14 bp, Homo sapiens
gccagggcagggct

SEQ ID NO: 1872016 - DNA, 19 bp, Homo sapiens
gccaggggtgtcccagtcc

SEQ ID NO: 1872017 - DNA, 21 bp, Homo sapiens
gccaggggtgtcccagtccca

SEQ ID NO: 1872018 - DNA, 16 bp, Homo sapiens
gccatatatgctgtat

SEQ ID NO: 1872019 - DNA, 18 bp, Homo sapiens
gccatatatgctgtattt

SEQ ID NO: 1872020 - DNA, 12 bp, Homo sapiens
gccatgcttttt

SEQ ID NO: 1872021 - DNA, 16 bp, Homo sapiens
gccattcctgttctct

SEQ ID NO: 1872022 - DNA, 19 bp, Homo sapiens
gccatttgctgccctgggg

SEQ ID NO: 1872023 - DNA, 17 bp, Homo sapiens
gcccaaagtctgtgtga

SEQ ID NO: 1872024 - DNA, 18 bp, Homo sapiens
gcccaagtggctcttggg

SEQ ID NO: 1872025 - DNA, 23 bp, Homo sapiens
gcccaagtggctcttgggacaac

SEQ ID NO: 1872026 - DNA, 14 bp, Homo sapiens
gcccaatcctccct

SEQ ID NO: 1872027 - DNA, 16 bp, Homo sapiens
gcccaatcctccctgg

SEQ ID NO: 1872028 - DNA, 17 bp, Homo sapiens
gcccaatcctccctgga

SEQ ID NO: 1872029 - DNA, 20 bp, Homo sapiens
gcccaatcctccctggagaa

SEQ ID NO: 1872030 - DNA, 16 bp, Homo sapiens
gcccactcccccagga

SEQ ID NO: 1872031 - DNA, 13 bp, Homo sapiens
gcccactgggccc

SEQ ID NO: 1872032 - DNA, 18 bp, Homo sapiens
gcccactgggccctgggg

SEQ ID NO: 1872033 - DNA, 19 bp, Homo sapiens
gcccactgggccctggggc

SEQ ID NO: 1872034 - DNA, 20 bp, Homo sapiens
gcccactgggccctggggct

SEQ ID NO: 1872035 - DNA, 23 bp, Homo sapiens
gcccactgggccctggggctgcc

SEQ ID NO: 1872036 - DNA, 12 bp, Homo sapiens
gcccagggcctc

SEQ ID NO: 1872037 - DNA, 19 bp, Homo sapiens
gcccagggcctctggcttc

SEQ ID NO: 1872038 - DNA, 20 bp, Homo sapiens
gcccatgtccagagggactg

SEQ ID NO: 1872039 - DNA, 14 bp, Homo sapiens
gcccatttttgcta

SEQ ID NO: 1872040 - DNA, 13 bp, Homo sapiens
gccccaaatcaca

SEQ ID NO: 1872041 - DNA, 15 bp, Homo sapiens
gcccccaaagagctg

SEQ ID NO: 1872042 - DNA, 18 bp, Homo sapiens
gcccccaaagagctgtgg

SEQ ID NO: 1872043 - DNA, 19 bp, Homo sapiens
gcccccaaagagctgtggc

SEQ ID NO: 1872044 - DNA, 22 bp, Homo sapiens
gcccccaaagagctgtggctgg

SEQ ID NO: 1872045 - DNA, 21 bp, Homo sapiens
gccccgtccccctagagactc

SEQ ID NO: 1872046 - DNA, 20 bp, Homo sapiens
gcccctccccaaaagaaacc

SEQ ID NO: 1872047 - DNA, 17 bp, Homo sapiens
gccctatttttgcaatg

SEQ ID NO: 1872048 - DNA, 17 bp, Homo sapiens
gccctgccttgctgcct

SEQ ID NO: 1872049 - DNA, 19 bp, Homo sapiens
gccctgccttgctgccttc

SEQ ID NO: 1872050 - DNA, 22 bp, Homo sapiens
gccctgccttgctgccttcacc

SEQ ID NO: 1872051 - DNA, 19 bp, Homo sapiens
gccctggatggcctctggg

SEQ ID NO: 1872052 - DNA, 21 bp, Homo sapiens
gccctggatggcctctggggc

SEQ ID NO: 1872053 - DNA, 22 bp, Homo sapiens
gccctggatggcctctggggca

SEQ ID NO: 1872054 - DNA, 16 bp, Homo sapiens
gccctggggctgccct

SEQ ID NO: 1872055 - DNA, 21 bp, Homo sapiens
gccctggggctgccctcggca

SEQ ID NO: 1872056 - DNA, 12 bp, Homo sapiens
gccctttctgtg

SEQ ID NO: 1872057 - DNA, 18 bp, Homo sapiens
gccgagacaggagcagcc

SEQ ID NO: 1872058 - DNA, 12 bp, Homo sapiens
gccgcagccccc

SEQ ID NO: 1872059 - DNA, 16 bp, Homo sapiens
gccgcagcccccactg

SEQ ID NO: 1872060 - DNA, 20 bp, Homo sapiens
gccgcagcccccactgacct

SEQ ID NO: 1872061 - DNA, 23 bp, Homo sapiens
gccgcagcccccactgacctgcc

SEQ ID NO: 1872062 - DNA, 19 bp, Homo sapiens
gccgctctccccctgcagc

SEQ ID NO: 1872063 - DNA, 12 bp, Homo sapiens
gccgggcccagg

SEQ ID NO: 1872064 - DNA, 16 bp, Homo sapiens
gcctcccttttctcct

SEQ ID NO: 1872065 - DNA, 18 bp, Homo sapiens
gcctcccttttctcctct

SEQ ID NO: 1872066 - DNA, 15 bp, Homo sapiens
gcctctggacctcgg

SEQ ID NO: 1872067 - DNA, 15 bp, Homo sapiens
gcctctggcttccct

SEQ ID NO: 1872068 - DNA, 17 bp, Homo sapiens
gcctctggcttccctgc

SEQ ID NO: 1872069 - DNA, 18 bp, Homo sapiens
gcctctggcttccctgcc

SEQ ID NO: 1872070 - DNA, 20 bp, Homo sapiens
gcctctggcttccctgccca

SEQ ID NO: 1872071 - DNA, 16 bp, Homo sapiens
gcctctggggcaggac

SEQ ID NO: 1872072 - DNA, 18 bp, Homo sapiens
gcctgtggaggtgacctg

SEQ ID NO: 1872073 - DNA, 19 bp, Homo sapiens
gccttaaacagtgtccagg

SEQ ID NO: 1872074 - DNA, 16 bp, Homo sapiens
gccttaagcacaatta

SEQ ID NO: 1872075 - DNA, 21 bp, Homo sapiens
gccttaagcacaattaattaa

SEQ ID NO: 1872076 - DNA, 19 bp, Homo sapiens
gccttatgtgttacattat

SEQ ID NO: 1872077 - DNA, 17 bp, Homo sapiens
gccttcaccctgaacat

SEQ ID NO: 1872078 - DNA, 19 bp, Homo sapiens
gccttccgacaccactggg

SEQ ID NO: 1872079 - DNA, 15 bp, Homo sapiens
gcgaggaaaaacaaa

SEQ ID NO: 1872080 - DNA, 13 bp, Homo sapiens
gcgggccaggcag

SEQ ID NO: 1872081 - DNA, 15 bp, Homo sapiens
gcggtgtctgcagct

SEQ ID NO: 1872082 - DNA, 12 bp, Homo sapiens
gctaaaagaaga

SEQ ID NO: 1872083 - DNA, 15 bp, Homo sapiens
gctaaaagaagagag

SEQ ID NO: 1872084 - DNA, 15 bp, Homo sapiens
gctaaaagtgcattt

SEQ ID NO: 1872085 - DNA, 18 bp, Homo sapiens
taacttcttaaaagttgt

SEQ ID NO: 1872086 - DNA, 15 bp, Homo sapiens
taacttgtaataaac

SEQ ID NO: 1872087 - DNA, 16 bp, Homo sapiens
taagaaagagaatgaa

SEQ ID NO: 1872088 - DNA, 19 bp, Homo sapiens
taagaaagagaatgaactg

SEQ ID NO: 1872089 - DNA, 21 bp, Homo sapiens
taagaaagagaatgaactgtg

SEQ ID NO: 1872090 - DNA, 21 bp, Homo sapiens
taagaaaggatataaaaggat

SEQ ID NO: 1872091 - DNA, 18 bp, Homo sapiens
taagaaagggaaagctgt

SEQ ID NO: 1872092 - DNA, 18 bp, Homo sapiens
taagaagggggagtgaaa

SEQ ID NO: 1872093 - DNA, 20 bp, Homo sapiens
taagaagggggagtgaaaca

SEQ ID NO: 1872094 - DNA, 20 bp, Homo sapiens
taagatgatgttaaatgcct

SEQ ID NO: 1872095 - DNA, 18 bp, Homo sapiens
taagatgggcagctagtt

SEQ ID NO: 1872096 - DNA, 16 bp, Homo sapiens
taagcaagccaggaga

SEQ ID NO: 1872097 - DNA, 17 bp, Homo sapiens
taagcaagccaggagaa

SEQ ID NO: 1872098 - DNA, 16 bp, Homo sapiens
taagcactttttaaaa

SEQ ID NO: 1872099 - DNA, 23 bp, Homo sapiens
taagcagattacaataaatcctt

SEQ ID NO: 1872100 - DNA, 17 bp, Homo sapiens
taagggtggaaaaatgc

SEQ ID NO: 1872101 - DNA, 15 bp, Homo sapiens
taagtctacattaaa

SEQ ID NO: 1872102 - DNA, 19 bp, Homo sapiens
taagtcttttttttttcca

SEQ ID NO: 1872103 - DNA, 21 bp, Homo sapiens
taagtcttttttttttccaaa

SEQ ID NO: 1872104 - DNA, 22 bp, Homo sapiens
taagtcttttttttttccaaat

SEQ ID NO: 1872105 - DNA, 10 bp, Homo sapiens
taagtgacat

SEQ ID NO: 1872106 - DNA, 17 bp, Homo sapiens
taagtgagtttttaatg

SEQ ID NO: 1872107 - DNA, 21 bp, Homo sapiens
taagtgcaacatttctgtata

SEQ ID NO: 1872108 - DNA, 16 bp, Homo sapiens
taagttttatacataa

SEQ ID NO: 1872109 - DNA, 12 bp, Homo sapiens
taataactgaac

SEQ ID NO: 1872110 - DNA, 16 bp, Homo sapiens
taataagttttgatat

SEQ ID NO: 1872111 - DNA, 22 bp, Homo sapiens
taataagttttgatataatctt

SEQ ID NO: 1872112 - DNA, 22 bp, Homo sapiens
taatacactaattcctttctat

SEQ ID NO: 1872113 - DNA, 17 bp, Homo sapiens
taatatatcccagaaat

SEQ ID NO: 1872114 - DNA, 22 bp, Homo sapiens
taatatatttttatatttagtt

SEQ ID NO: 1872115 - DNA, 13 bp, Homo sapiens
taatatgaaagcc

SEQ ID NO: 1872116 - DNA, 15 bp, Homo sapiens
taatatgaaagccac

SEQ ID NO: 1872117 - DNA, 18 bp, Homo sapiens
taatatggcaaaaatggc

SEQ ID NO: 1872118 - DNA, 14 bp, Homo sapiens
taatattaaaaata

SEQ ID NO: 1872119 - DNA, 19 bp, Homo sapiens
taatcatcaggtttactca

SEQ ID NO: 1872120 - DNA, 17 bp, Homo sapiens
taatcatgctcatgtat

SEQ ID NO: 1872121 - DNA, 18 bp, Homo sapiens
taatcatgctcatgtata

SEQ ID NO: 1872122 - DNA, 15 bp, Homo sapiens
taatctatattaaat

SEQ ID NO: 1872123 - DNA, 16 bp, Homo sapiens
taatctatattaaatg

SEQ ID NO: 1872124 - DNA, 17 bp, Homo sapiens
taatctatattaaatga

SEQ ID NO: 1872125 - DNA, 17 bp, Homo sapiens
taatctcctctgctcat

SEQ ID NO: 1872126 - DNA, 21 bp, Homo sapiens
taatctcctctgctcattaaa

SEQ ID NO: 1872127 - DNA, 12 bp, Homo sapiens
taatctgcctgg

SEQ ID NO: 1872128 - DNA, 16 bp, Homo sapiens
taatctgcctggtttt

SEQ ID NO: 1872129 - DNA, 21 bp, Homo sapiens
taatcttggcttcttaaaaac

SEQ ID NO: 1872130 - DNA, 22 bp, Homo sapiens
taatcttggcttcttaaaaact

SEQ ID NO: 1872131 - DNA, 15 bp, Homo sapiens
taatcttttaaaaat

SEQ ID NO: 1872132 - DNA, 18 bp, Homo sapiens
taatcttttaaaaatgat

SEQ ID NO: 1872133 - DNA, 20 bp, Homo sapiens
taatcttttaaaaatgatga

SEQ ID NO: 1872134 - DNA, 18 bp, Homo sapiens
taatgaaccgtttacagt

SEQ ID NO: 1872135 - DNA, 20 bp, Homo sapiens
taatgaaccgtttacagtgt

SEQ ID NO: 1872136 - DNA, 22 bp, Homo sapiens
taatgagctcctgctcattgtg

SEQ ID NO: 1872137 - DNA, 14 bp, Homo sapiens
taatggaaacatgc

SEQ ID NO: 1872138 - DNA, 15 bp, Homo sapiens
taatggactgtgaat

SEQ ID NO: 1872139 - DNA, 22 bp, Homo sapiens
taatgtagggttatatttggga

SEQ ID NO: 1872140 - DNA, 13 bp, Homo sapiens
taatgtgtctgtg

SEQ ID NO: 1872141 - DNA, 12 bp, Homo sapiens
taattaaaaact

SEQ ID NO: 1872142 - DNA, 13 bp, Homo sapiens
taattaaaaactt

SEQ ID NO: 1872143 - DNA, 20 bp, Homo sapiens
taattaaaaactttaaagat

SEQ ID NO: 1872144 - DNA, 18 bp, Homo sapiens
taattaaactagtttaag

SEQ ID NO: 1872145 - DNA, 23 bp, Homo sapiens
taattaaagccttaagcacaatt

SEQ ID NO: 1872146 - DNA, 20 bp, Homo sapiens
taattattttccaaaatcta

SEQ ID NO: 1872147 - DNA, 22 bp, Homo sapiens
taattcctctcactaaacttta

SEQ ID NO: 1872148 - DNA, 13 bp, Homo sapiens
taattgttgatat

SEQ ID NO: 1872149 - DNA, 15 bp, Homo sapiens
taatttaaaaaataa

SEQ ID NO: 1872150 - DNA, 12 bp, Homo sapiens
taatttaaagaa

SEQ ID NO: 1872151 - DNA, 17 bp, Homo sapiens
taatttaaagaaacact

SEQ ID NO: 1872152 - DNA, 16 bp, Homo sapiens
taatttaccattattt

SEQ ID NO: 1872153 - DNA, 22 bp, Homo sapiens
taatttaccattattttacagt

SEQ ID NO: 1872154 - DNA, 17 bp, Homo sapiens
taatttccttctgttaa

SEQ ID NO: 1872155 - DNA, 13 bp, Homo sapiens
taatttgaattgg

SEQ ID NO: 1872156 - DNA, 22 bp, Homo sapiens
taatttgtgcatcagaaaatgc

SEQ ID NO: 1872157 - DNA, 22 bp, Homo sapiens
taattttttgcagtcttttgct

SEQ ID NO: 1872158 - DNA, 15 bp, Homo sapiens
tacaaaaaaaatctt

SEQ ID NO: 1872159 - DNA, 16 bp, Homo sapiens
tacaaaaaaaatcttt

SEQ ID NO: 1872160 - DNA, 20 bp, Homo sapiens
tacaaaagcagcttttagtt

SEQ ID NO: 1872161 - DNA, 16 bp, Homo sapiens
tacaaattttttaatt

SEQ ID NO: 1872162 - DNA, 22 bp, Homo sapiens
tacaacaagagtttatttccaa

SEQ ID NO: 1872163 - DNA, 19 bp, Homo sapiens
tacaacagaagttatattt

SEQ ID NO: 1872164 - DNA, 17 bp, Homo sapiens
tacaagcagttaatcac

SEQ ID NO: 1872165 - DNA, 17 bp, Homo sapiens
tacaagcttaaagcttg

SEQ ID NO: 1872166 - DNA, 17 bp, Homo sapiens
tacaagtggtgaccaaa

SEQ ID NO: 1872167 - DNA, 13 bp, Homo sapiens
tacaagtgtatat

SEQ ID NO: 1872168 - DNA, 15 bp, Homo sapiens
tacaagtgtatatca

SEQ ID NO: 1872169 - DNA, 16 bp, Homo sapiens
tacaatgtgactttga

SEQ ID NO: 1872170 - DNA, 17 bp, Homo sapiens
tacaatgtgactttgaa

SEQ ID NO: 1872171 - DNA, 20 bp, Homo sapiens
tacaatgtgactttgaaaat

SEQ ID NO: 1872172 - DNA, 9 bp, Homo sapiens
tacacacac

SEQ ID NO: 1872173 - DNA, 12 bp, Homo sapiens
tacactccaggt

SEQ ID NO: 1872174 - DNA, 16 bp, Homo sapiens
tacagctgtttaagat

SEQ ID NO: 1872175 - DNA, 16 bp, Homo sapiens
tacagtgtatttaaga

SEQ ID NO: 1872176 - DNA, 19 bp, Homo sapiens
tacagtttgtgttttaaaa

SEQ ID NO: 1872177 - DNA, 15 bp, Homo sapiens
tacataaacagtttt

SEQ ID NO: 1872178 - DNA, 14 bp, Homo sapiens
tacataatttgcaa

SEQ ID NO: 1872179 - DNA, 16 bp, Homo sapiens
tacatgcaatttatta

SEQ ID NO: 1872180 - DNA, 19 bp, Homo sapiens
tacatgcaatttattaaaa

SEQ ID NO: 1872181 - DNA, 22 bp, Homo sapiens
tacatgcaatttattaaaatga

SEQ ID NO: 1872182 - DNA, 14 bp, Homo sapiens
tacatgtggtttat

SEQ ID NO: 1872183 - DNA, 13 bp, Homo sapiens
tacattaaacaat

SEQ ID NO: 1872184 - DNA, 15 bp, Homo sapiens
tacattattccaatg

SEQ ID NO: 1872185 - DNA, 14 bp, Homo sapiens
taccaactttctgt

SEQ ID NO: 1872186 - DNA, 17 bp, Homo sapiens
taccaactttctgtaaa

SEQ ID NO: 1872187 - DNA, 21 bp, Homo sapiens
taccaagaaaggaacctgtca

SEQ ID NO: 1872188 - DNA, 18 bp, Homo sapiens
taccatagagtaatgatg

SEQ ID NO: 1872189 - DNA, 20 bp, Homo sapiens
taccataggaagacataaaa

SEQ ID NO: 1872190 - DNA, 18 bp, Homo sapiens
taccatattgctcttaaa

SEQ ID NO: 1872191 - DNA, 18 bp, Homo sapiens
taccattattttacagtc

SEQ ID NO: 1872192 - DNA, 17 bp, Homo sapiens
tacccaacagtttattt

SEQ ID NO: 1872193 - DNA, 16 bp, Homo sapiens
taccctatatctataa

SEQ ID NO: 1872194 - DNA, 12 bp, Homo sapiens
tacccttggttt

SEQ ID NO: 1872195 - DNA, 22 bp, Homo sapiens
tacccttggtttgcacataaaa

SEQ ID NO: 1872196 - DNA, 21 bp, Homo sapiens
tacctctagctgttctttttt

SEQ ID NO: 1872197 - DNA, 15 bp, Homo sapiens
tacctgccttttaag

SEQ ID NO: 1872198 - DNA, 16 bp, Homo sapiens
tacctgccttttaagt

SEQ ID NO: 1872199 - DNA, 20 bp, Homo sapiens
tacctgccttttaagtttga

SEQ ID NO: 1872200 - DNA, 16 bp, Homo sapiens
taccttgtctttcaaa

SEQ ID NO: 1872201 - DNA, 18 bp, Homo sapiens
tgacaaaaataacactgt

SEQ ID NO: 1872202 - DNA, 13 bp, Homo sapiens
tgacagcctgggg

SEQ ID NO: 1872203 - DNA, 15 bp, Homo sapiens
tgacagcctgggggg

SEQ ID NO: 1872204 - DNA, 16 bp, Homo sapiens
tgacagcctggggggg

SEQ ID NO: 1872205 - DNA, 18 bp, Homo sapiens
tgaccaccctgcctgtgg

SEQ ID NO: 1872206 - DNA, 21 bp, Homo sapiens
tgacctgctgggtaaactgtg

SEQ ID NO: 1872207 - DNA, 21 bp, Homo sapiens
tgacctgttaggtctcatgcc

SEQ ID NO: 1872208 - DNA, 18 bp, Homo sapiens
tgactggccaaaaatatc

SEQ ID NO: 1872209 - DNA, 21 bp, Homo sapiens
tgactttcaggaattgcccat

SEQ ID NO: 1872210 - DNA, 20 bp, Homo sapiens
tgagaaatcagaattggcat

SEQ ID NO: 1872211 - DNA, 18 bp, Homo sapiens
tgagaagatgggggctgg

SEQ ID NO: 1872212 - DNA, 21 bp, Homo sapiens
tgagaagatgggggctggagg

SEQ ID NO: 1872213 - DNA, 22 bp, Homo sapiens
tgagaagatgggggctggaggg

SEQ ID NO: 1872214 - DNA, 13 bp, Homo sapiens
tgagacatattta

SEQ ID NO: 1872215 - DNA, 14 bp, Homo sapiens
tgagactgggaact

SEQ ID NO: 1872216 - DNA, 15 bp, Homo sapiens
tgagcaagagccagg

SEQ ID NO: 1872217 - DNA, 19 bp, Homo sapiens
tgagcacgttggcgaggaa

SEQ ID NO: 1872218 - DNA, 18 bp, Homo sapiens
tgagcgcacgcgcgcaca

SEQ ID NO: 1872219 - DNA, 14 bp, Homo sapiens
tgaggcgggtggct

SEQ ID NO: 1872220 - DNA, 17 bp, Homo sapiens
tgaggcgggtggctggt

SEQ ID NO: 1872221 - DNA, 18 bp, Homo sapiens
tgagggtgtcggctgtga

SEQ ID NO: 1872222 - DNA, 19 bp, Homo sapiens
tgagggtgtcggctgtgag

SEQ ID NO: 1872223 - DNA, 20 bp, Homo sapiens
tgagggtgtcggctgtgagg

SEQ ID NO: 1872224 - DNA, 14 bp, Homo sapiens
tgagggtttctgat

SEQ ID NO: 1872225 - DNA, 15 bp, Homo sapiens
tgagtatattataat

SEQ ID NO: 1872226 - DNA, 14 bp, Homo sapiens
tgagtccatgaaaa

SEQ ID NO: 1872227 - DNA, 14 bp, Homo sapiens
tgagtcttaactgt

SEQ ID NO: 1872228 - DNA, 18 bp, Homo sapiens
tgagtcttaactgtattt

SEQ ID NO: 1872229 - DNA, 20 bp, Homo sapiens
tgagtcttaactgtatttca

SEQ ID NO: 1872230 - DNA, 21 bp, Homo sapiens
tgagtcttaactgtatttcag

SEQ ID NO: 1872231 - DNA, 15 bp, Homo sapiens
tgagtgagttttact

SEQ ID NO: 1872232 - DNA, 15 bp, Homo sapiens
tgagtgccatgcttt

SEQ ID NO: 1872233 - DNA, 16 bp, Homo sapiens
tgagtgccatgctttt

SEQ ID NO: 1872234 - DNA, 17 bp, Homo sapiens
tgagttacttagaatgc

SEQ ID NO: 1872235 - DNA, 20 bp, Homo sapiens
tgatacttttttgaaatcag

SEQ ID NO: 1872236 - DNA, 16 bp, Homo sapiens
tgatatatctcaaatt

SEQ ID NO: 1872237 - DNA, 16 bp, Homo sapiens
tgatattcaaggcttt

SEQ ID NO: 1872238 - DNA, 18 bp, Homo sapiens
tgatattcaaggctttaa

SEQ ID NO: 1872239 - DNA, 17 bp, Homo sapiens
tgatcacatctaaagct

SEQ ID NO: 1872240 - DNA, 19 bp, Homo sapiens
tgatcacatctaaagcttt

SEQ ID NO: 1872241 - DNA, 17 bp, Homo sapiens
tgatcagatgctgaatt

SEQ ID NO: 1872242 - DNA, 13 bp, Homo sapiens
tgatctgtacttt

SEQ ID NO: 1872243 - DNA, 17 bp, Homo sapiens
tgatcttggaaagaggt

SEQ ID NO: 1872244 - DNA, 14 bp, Homo sapiens
tgatctttgtttaa

SEQ ID NO: 1872245 - DNA, 18 bp, Homo sapiens
tgatctttgtttaaatgc

SEQ ID NO: 1872246 - DNA, 19 bp, Homo sapiens
tgatctttgtttaaatgcc

SEQ ID NO: 1872247 - DNA, 19 bp, Homo sapiens
tgatgcaatgtatggcttt

SEQ ID NO: 1872248 - DNA, 22 bp, Homo sapiens
tgatggaaacgcacttacaagt

SEQ ID NO: 1872249 - DNA, 16 bp, Homo sapiens
tgatgttgtgttgtta

SEQ ID NO: 1872250 - DNA, 17 bp, Homo sapiens
tgatgttgtgttgttat

SEQ ID NO: 1872251 - DNA, 15 bp, Homo sapiens
tgattaaacagcaaa

SEQ ID NO: 1872252 - DNA, 16 bp, Homo sapiens
tgattaaacagcaaag

SEQ ID NO: 1872253 - DNA, 20 bp, Homo sapiens
tgattaaacagcaaagccat

SEQ ID NO: 1872254 - DNA, 16 bp, Homo sapiens
tgattaccagtctgat

SEQ ID NO: 1872255 - DNA, 19 bp, Homo sapiens
tgattataccatgtgtgct

SEQ ID NO: 1872256 - DNA, 22 bp, Homo sapiens
tgattcagtatcttagagttta

SEQ ID NO: 1872257 - DNA, 13 bp, Homo sapiens
tgattcttgtgat

SEQ ID NO: 1872258 - DNA, 14 bp, Homo sapiens
tgattgattcagta

SEQ ID NO: 1872259 - DNA, 16 bp, Homo sapiens
tgattgattcagtatc

SEQ ID NO: 1872260 - DNA, 14 bp, Homo sapiens
tgattgtaaaatag

SEQ ID NO: 1872261 - DNA, 21 bp, Homo sapiens
tgatttagaactgtatgtcag

SEQ ID NO: 1872262 - DNA, 13 bp, Homo sapiens
tgatttatgcatg

SEQ ID NO: 1872263 - DNA, 15 bp, Homo sapiens
tgatttctagtatct

SEQ ID NO: 1872264 - DNA, 14 bp, Homo sapiens
tgatttctattcaa

SEQ ID NO: 1872265 - DNA, 18 bp, Homo sapiens
tgatttggggattcagat

SEQ ID NO: 1872266 - DNA, 19 bp, Homo sapiens
tgattttgatattttcaca

SEQ ID NO: 1872267 - DNA, 15 bp, Homo sapiens
tgcaaaccctttgta

SEQ ID NO: 1872268 - DNA, 17 bp, Homo sapiens
tgcaaaccctttgtatt

SEQ ID NO: 1872269 - DNA, 20 bp, Homo sapiens
tgcaaaggactgtaagcaga

SEQ ID NO: 1872270 - DNA, 19 bp, Homo sapiens
tgcaaatattggttagtat

SEQ ID NO: 1872271 - DNA, 23 bp, Homo sapiens
tgcaactaactgactctgttatt

SEQ ID NO: 1872272 - DNA, 24 bp, Homo sapiens
tgcaactaactgactctgttattg

SEQ ID NO: 1872273 - DNA, 16 bp, Homo sapiens
tgcaagaattaaaact

SEQ ID NO: 1872274 - DNA, 19 bp, Homo sapiens
tgcaagaattaaaactgag

SEQ ID NO: 1872275 - DNA, 20 bp, Homo sapiens
tgcaagaattaaaactgagt

SEQ ID NO: 1872276 - DNA, 21 bp, Homo sapiens
tgcaagaattaaaactgagtc

SEQ ID NO: 1872277 - DNA, 21 bp, Homo sapiens
tgcaagattttttttttaagt

SEQ ID NO: 1872278 - DNA, 23 bp, Homo sapiens
tgcaagattttttttttaagtga

SEQ ID NO: 1872279 - DNA, 23 bp, Homo sapiens
tgcaagcatttttccatctgtgt

SEQ ID NO: 1872280 - DNA, 18 bp, Homo sapiens
tgcaatctataatatttg

SEQ ID NO: 1872281 - DNA, 18 bp, Homo sapiens
tgcaatggctatatggca

SEQ ID NO: 1872282 - DNA, 14 bp, Homo sapiens
tgcaatttattaaa

SEQ ID NO: 1872283 - DNA, 15 bp, Homo sapiens
tgcaatttattaaaa

SEQ ID NO: 1872284 - DNA, 23 bp, Homo sapiens
tgcaatttcaggaatttaattta

SEQ ID NO: 1872285 - DNA, 22 bp, Homo sapiens
tgcacagtaatatgaaagccac

SEQ ID NO: 1872286 - DNA, 14 bp, Homo sapiens
tgcaccattttcaa

SEQ ID NO: 1872287 - DNA, 12 bp, Homo sapiens
tgcactcctgga

SEQ ID NO: 1872288 - DNA, 20 bp, Homo sapiens
tgcactctctctctgttaaa

SEQ ID NO: 1872289 - DNA, 17 bp, Homo sapiens
tgcagccgtgcaggact

SEQ ID NO: 1872290 - DNA, 18 bp, Homo sapiens
tgcagccgtgcaggactc

SEQ ID NO: 1872291 - DNA, 16 bp, Homo sapiens
tgcagctttacatgca

SEQ ID NO: 1872292 - DNA, 23 bp, Homo sapiens
tgcaggactctagctcatgagtg

SEQ ID NO: 1872293 - DNA, 13 bp, Homo sapiens
tgcaggccaggcc

SEQ ID NO: 1872294 - DNA, 16 bp, Homo sapiens
tgcaggccaggccagc

SEQ ID NO: 1872295 - DNA, 20 bp, Homo sapiens
tgcaggccaggccagcttcc

SEQ ID NO: 1872296 - DNA, 22 bp, Homo sapiens
tgcaggccaggccagcttcccc

SEQ ID NO: 1872297 - DNA, 23 bp, Homo sapiens
tgcaggccaggccagcttcccct

SEQ ID NO: 1872298 - DNA, 13 bp, Homo sapiens
tgcagtcttttgc

SEQ ID NO: 1872299 - DNA, 19 bp, Homo sapiens
tgcatagaggtaccagcaa

SEQ ID NO: 1872300 - DNA, 18 bp, Homo sapiens
tgcatcagctttttgtat

SEQ ID NO: 1872301 - DNA, 15 bp, Homo sapiens
tgcatgcataatgaa

SEQ ID NO: 1872302 - DNA, 17 bp, Homo sapiens
tgcatgcataatgaacc

SEQ ID NO: 1872303 - DNA, 15 bp, Homo sapiens
tgcatggaaacctga

SEQ ID NO: 1872304 - DNA, 19 bp, Homo sapiens
tgcatggaaacctgaaaaa

SEQ ID NO: 1872305 - DNA, 13 bp, Homo sapiens
tgcatttaaggag

SEQ ID NO: 1872306 - DNA, 22 bp, Homo sapiens
tgccaccagcaatgccctgcct

SEQ ID NO: 1872307 - DNA, 13 bp, Homo sapiens
tgccatagagttt

SEQ ID NO: 1872308 - DNA, 13 bp, Homo sapiens
tgccatgcttttt

SEQ ID NO: 1872309 - DNA, 14 bp, Homo sapiens
tgcccaagtggctc

SEQ ID NO: 1872310 - DNA, 17 bp, Homo sapiens
tgcccaatcctccctgg

SEQ ID NO: 1872311 - DNA, 18 bp, Homo sapiens
tgcccaatcctccctgga

SEQ ID NO: 1872312 - DNA, 21 bp, Homo sapiens
tgcccaatcctccctggagaa

SEQ ID NO: 1872313 - DNA, 16 bp, Homo sapiens
tgcccactcccccagg

SEQ ID NO: 1872314 - DNA, 17 bp, Homo sapiens
tgcccactcccccagga

SEQ ID NO: 1872315 - DNA, 22 bp, Homo sapiens
tgccccgtccccctagagactc

SEQ ID NO: 1872316 - DNA, 18 bp, Homo sapiens
tgccctgccttgctgcct

SEQ ID NO: 1872317 - DNA, 17 bp, Homo sapiens
ttcagtattttggagaa

SEQ ID NO: 1872318 - DNA, 18 bp, Homo sapiens
ttcagtattttggagaaa

SEQ ID NO: 1872319 - DNA, 12 bp, Homo sapiens
ttcagtctgaat

SEQ ID NO: 1872320 - DNA, 12 bp, Homo sapiens
ttcagtggagaa

SEQ ID NO: 1872321 - DNA, 20 bp, Homo sapiens
ttcataccagtcagtattcc

SEQ ID NO: 1872322 - DNA, 14 bp, Homo sapiens
ttcatataatttaa

SEQ ID NO: 1872323 - DNA, 14 bp, Homo sapiens
ttcatatctaattt

SEQ ID NO: 1872324 - DNA, 18 bp, Homo sapiens
ttcatatctaatttacca

SEQ ID NO: 1872325 - DNA, 18 bp, Homo sapiens
ttcatctgttgttttgtt

SEQ ID NO: 1872326 - DNA, 17 bp, Homo sapiens
ttcatgtatgtatataa

SEQ ID NO: 1872327 - DNA, 15 bp, Homo sapiens
ttcattaatctgttt

SEQ ID NO: 1872328 - DNA, 17 bp, Homo sapiens
ttcattaatctgtttgt

SEQ ID NO: 1872329 - DNA, 16 bp, Homo sapiens
ttcattgtgtatgaga

SEQ ID NO: 1872330 - DNA, 20 bp, Homo sapiens
ttccaaaataatctatatta

SEQ ID NO: 1872331 - DNA, 20 bp, Homo sapiens
ttccaaaatctaaaagctgt

SEQ ID NO: 1872332 - DNA, 16 bp, Homo sapiens
ttccaaaccagtttat

SEQ ID NO: 1872333 - DNA, 16 bp, Homo sapiens
ttccaaattattaatt

SEQ ID NO: 1872334 - DNA, 19 bp, Homo sapiens
ttccaaattattaattgtc

SEQ ID NO: 1872335 - DNA, 20 bp, Homo sapiens
ttccagagttgttgtttgcc

SEQ ID NO: 1872336 - DNA, 16 bp, Homo sapiens
ttccagccttatgtgt

SEQ ID NO: 1872337 - DNA, 22 bp, Homo sapiens
ttccagccttatgtgttacatt

SEQ ID NO: 1872338 - DNA, 15 bp, Homo sapiens
ttccatgcactctct

SEQ ID NO: 1872339 - DNA, 22 bp, Homo sapiens
ttcccaggtaatttaaattggt

SEQ ID NO: 1872340 - DNA, 20 bp, Homo sapiens
ttcccctaatcttttctgaa

SEQ ID NO: 1872341 - DNA, 22 bp, Homo sapiens
ttccctgcccaatcctccctgg

SEQ ID NO: 1872342 - DNA, 21 bp, Homo sapiens
ttccctttttaaaaaatacca

SEQ ID NO: 1872343 - DNA, 15 bp, Homo sapiens
ttccgacaccactgg

SEQ ID NO: 1872344 - DNA, 19 bp, Homo sapiens
ttcctcccattttagaaaa

SEQ ID NO: 1872345 - DNA, 21 bp, Homo sapiens
ttcctcgggatgaaaagccat

SEQ ID NO: 1872346 - DNA, 17 bp, Homo sapiens
ttcctctcactaaactt

SEQ ID NO: 1872347 - DNA, 15 bp, Homo sapiens
ttcctcttgaaccag

SEQ ID NO: 1872348 - DNA, 22 bp, Homo sapiens
ttcctgattaccagtctgatta

SEQ ID NO: 1872349 - DNA, 23 bp, Homo sapiens
ttcctgattaccagtctgattat

SEQ ID NO: 1872350 - DNA, 17 bp, Homo sapiens
ttccttctgttaagaaa

SEQ ID NO: 1872351 - DNA, 20 bp, Homo sapiens
ttccttctgttaagaaagga

SEQ ID NO: 1872352 - DNA, 23 bp, Homo sapiens
ttccttctgttaagaaaggatat

SEQ ID NO: 1872353 - DNA, 21 bp, Homo sapiens
ttcggccaatttatgcagagt

SEQ ID NO: 1872354 - DNA, 15 bp, Homo sapiens
ttctagactttctgt

SEQ ID NO: 1872355 - DNA, 21 bp, Homo sapiens
ttctataataagttttgatat

SEQ ID NO: 1872356 - DNA, 21 bp, Homo sapiens
ttctattttgctggagactat

SEQ ID NO: 1872357 - DNA, 19 bp, Homo sapiens
ttctcctgccctttcccag

SEQ ID NO: 1872358 - DNA, 23 bp, Homo sapiens
ttctcttgccccaaatcacaaac

SEQ ID NO: 1872359 - DNA, 19 bp, Homo sapiens
ttctcttggacattgtaaa

SEQ ID NO: 1872360 - DNA, 16 bp, Homo sapiens
ttctgatctgtacttt

SEQ ID NO: 1872361 - DNA, 16 bp, Homo sapiens
ttctgcaagaattaaa

SEQ ID NO: 1872362 - DNA, 17 bp, Homo sapiens
ttctgcaagaattaaaa

SEQ ID NO: 1872363 - DNA, 19 bp, Homo sapiens
ttctgcaagaattaaaact

SEQ ID NO: 1872364 - DNA, 18 bp, Homo sapiens
ttctggttccaaaccagt

SEQ ID NO: 1872365 - DNA, 19 bp, Homo sapiens
ttctgtaaactcaaaactt

SEQ ID NO: 1872366 - DNA, 20 bp, Homo sapiens
ttctgtaaactcaaaactta

SEQ ID NO: 1872367 - DNA, 20 bp, Homo sapiens
ttctgtagtttttaattaaa

SEQ ID NO: 1872368 - DNA, 13 bp, Homo sapiens
ttctgtatactgt

SEQ ID NO: 1872369 - DNA, 15 bp, Homo sapiens
ttctgttaagaaagg

SEQ ID NO: 1872370 - DNA, 13 bp, Homo sapiens
ttcttaaaaactg

SEQ ID NO: 1872371 - DNA, 15 bp, Homo sapiens
ttcttaaaaactgtg

SEQ ID NO: 1872372 - DNA, 16 bp, Homo sapiens
ttcttacataattttt

SEQ ID NO: 1872373 - DNA, 12 bp, Homo sapiens
ttcttgaattgt

SEQ ID NO: 1872374 - DNA, 21 bp, Homo sapiens
ttcttgaattgttatgaaaat

SEQ ID NO: 1872375 - DNA, 20 bp, Homo sapiens
ttctttgtagaataaatggt

SEQ ID NO: 1872376 - DNA, 14 bp, Homo sapiens
ttcttttgttatta

SEQ ID NO: 1872377 - DNA, 22 bp, Homo sapiens
ttcttttttgtacttttctggt

SEQ ID NO: 1872378 - DNA, 12 bp, Homo sapiens
ttgaaaaacttt

SEQ ID NO: 1872379 - DNA, 13 bp, Homo sapiens
ttgaaaaactttt

SEQ ID NO: 1872380 - DNA, 15 bp, Homo sapiens
ttgaaaattatttta

SEQ ID NO: 1872381 - DNA, 19 bp, Homo sapiens
ttgaaaattattttaaaca

SEQ ID NO: 1872382 - DNA, 22 bp, Homo sapiens
ttgaaaattattttaaacaaaa

SEQ ID NO: 1872383 - DNA, 17 bp, Homo sapiens
ttgaaagaattctattt

SEQ ID NO: 1872384 - DNA, 18 bp, Homo sapiens
ttgaaagaattctatttt

SEQ ID NO: 1872385 - DNA, 21 bp, Homo sapiens
ttgaaagtattcagaaattaa

SEQ ID NO: 1872386 - DNA, 12 bp, Homo sapiens
ttgaataaaaag

SEQ ID NO: 1872387 - DNA, 15 bp, Homo sapiens
ttgaataaaaagtga

SEQ ID NO: 1872388 - DNA, 19 bp, Homo sapiens
ttgaataaaaagtgaactt

SEQ ID NO: 1872389 - DNA, 20 bp, Homo sapiens
ttgaataaaaagtgaacttt

SEQ ID NO: 1872390 - DNA, 23 bp, Homo sapiens
ttgaataaaaagtgaacttttgt

SEQ ID NO: 1872391 - DNA, 23 bp, Homo sapiens
ttgaatagggctaggaatataga

SEQ ID NO: 1872392 - DNA, 20 bp, Homo sapiens
ttgaatgctttttgaatgtt

SEQ ID NO: 1872393 - DNA, 18 bp, Homo sapiens
ttgaattgttatgaaaat

SEQ ID NO: 1872394 - DNA, 19 bp, Homo sapiens
ttgagaataagaatttgag

SEQ ID NO: 1872395 - DNA, 20 bp, Homo sapiens
ttgagtcttaactgtatttc

SEQ ID NO: 1872396 - DNA, 18 bp, Homo sapiens
ttgatattttcccttttt

SEQ ID NO: 1872397 - DNA, 22 bp, Homo sapiens
ttgatcagatgctgaattgaga

SEQ ID NO: 1872398 - DNA, 12 bp, Homo sapiens
ttgatctttgtt

SEQ ID NO: 1872399 - DNA, 18 bp, Homo sapiens
ttgatctttgtttaaatg

SEQ ID NO: 1872400 - DNA, 20 bp, Homo sapiens
ttgatctttgtttaaatgcc

SEQ ID NO: 1872401 - DNA, 21 bp, Homo sapiens
ttgattaaacagcaaagccat

SEQ ID NO: 1872402 - DNA, 19 bp, Homo sapiens
ttgatttatgcatggaaac

SEQ ID NO: 1872403 - DNA, 20 bp, Homo sapiens
ttgatttctagtatctattg

SEQ ID NO: 1872404 - DNA, 13 bp, Homo sapiens
ttgcaaacccttt

SEQ ID NO: 1872405 - DNA, 13 bp, Homo sapiens
ttgcaaaggactg

SEQ ID NO: 1872406 - DNA, 13 bp, Homo sapiens
ttgcaatctataa

SEQ ID NO: 1872407 - DNA, 16 bp, Homo sapiens
ttgcaatctataatat

SEQ ID NO: 1872408 - DNA, 19 bp, Homo sapiens
ttgcaatggctatatggca

SEQ ID NO: 1872409 - DNA, 19 bp, Homo sapiens
ttgcactaaagtatgtaaa

SEQ ID NO: 1872410 - DNA, 21 bp, Homo sapiens
ttgcagtttcatgtatgtata

SEQ ID NO: 1872411 - DNA, 21 bp, Homo sapiens
ttgccaagctaatctgcctgg

SEQ ID NO: 1872412 - DNA, 16 bp, Homo sapiens
ttgctagcaaacaaat

SEQ ID NO: 1872413 - DNA, 14 bp, Homo sapiens
ttgctcttaaaaat

SEQ ID NO: 1872414 - DNA, 14 bp, Homo sapiens
ttgctgccctgggg

SEQ ID NO: 1872415 - DNA, 18 bp, Homo sapiens
ttgctgtgctgtacatta

SEQ ID NO: 1872416 - DNA, 20 bp, Homo sapiens
ttgctgtgctgtacattact

SEQ ID NO: 1872417 - DNA, 14 bp, Homo sapiens
ttggagaaattatt

SEQ ID NO: 1872418 - DNA, 17 bp, Homo sapiens
ttggagcattaactaaa

SEQ ID NO: 1872419 - DNA, 24 bp, Homo sapiens
ttggagcattaactaaatgctcat

SEQ ID NO: 1872420 - DNA, 14 bp, Homo sapiens
ttggatttgctgtg

SEQ ID NO: 1872421 - DNA, 18 bp, Homo sapiens
ttggatttgctgtgacta

SEQ ID NO: 1872422 - DNA, 15 bp, Homo sapiens
ttggcaacagaagca

SEQ ID NO: 1872423 - DNA, 20 bp, Homo sapiens
ttggcagccaaggaatgtgt

SEQ ID NO: 1872424 - DNA, 23 bp, Homo sapiens
ttggcagccaaggaatgtgtcca

SEQ ID NO: 1872425 - DNA, 16 bp, Homo sapiens
ttggcataatttgtct

SEQ ID NO: 1872426 - DNA, 20 bp, Homo sapiens
ttggctggatgaaattttct

SEQ ID NO: 1872427 - DNA, 17 bp, Homo sapiens
ttggcttcttaaaaact

SEQ ID NO: 1872428 - DNA, 15 bp, Homo sapiens
ttggtaaatttttga

SEQ ID NO: 1872429 - DNA, 14 bp, Homo sapiens
ttggtcgagtcttt

SEQ ID NO: 1872430 - DNA, 17 bp, Homo sapiens
ttgtaaacgtattttga

SEQ ID NO: 1872431 - DNA, 13 bp, Homo sapiens
ttgtaaataacca

SEQ ID NO: 1872432 - DNA, 21 bp, Homo sapiens
ttgtaaataaccacactgaaa

SEQ ID NO: 1872433 - DNA, 20 bp, Homo sapiens
aggaggcagaggttgcaatg

SEQ ID NO: 1872434 - DNA, 16 bp, Homo sapiens
aggatcttttgtaaat

SEQ ID NO: 1872435 - DNA, 17 bp, Homo sapiens
aggatgaatgggaaagt

SEQ ID NO: 1872436 - DNA, 12 bp, Homo sapiens
aggcaaaagact

SEQ ID NO: 1872437 - DNA, 18 bp, Homo sapiens
aggcatatgcttctttaa

SEQ ID NO: 1872438 - DNA, 15 bp, Homo sapiens
aggccagcccactgg

SEQ ID NO: 1872439 - DNA, 19 bp, Homo sapiens
aggccagcccactgggccc

SEQ ID NO: 1872440 - DNA, 17 bp, Homo sapiens
aggccaggccagcttcc

SEQ ID NO: 1872441 - DNA, 18 bp, Homo sapiens
aggccaggccagcttccc

SEQ ID NO: 1872442 - DNA, 22 bp, Homo sapiens
aggccatttgctgccctggggc

SEQ ID NO: 1872443 - DNA, 13 bp, Homo sapiens
aggccctgtctgt

SEQ ID NO: 1872444 - DNA, 19 bp, Homo sapiens
aggctatcctgctgaaagt

SEQ ID NO: 1872445 - DNA, 14 bp, Homo sapiens
aggctccctgacca

SEQ ID NO: 1872446 - DNA, 15 bp, Homo sapiens
aggctccctgaccac

SEQ ID NO: 1872447 - DNA, 19 bp, Homo sapiens
aggctctgacccagtgaga

SEQ ID NO: 1872448 - DNA, 22 bp, Homo sapiens
agggactggacagccagggcag

SEQ ID NO: 1872449 - DNA, 21 bp, Homo sapiens
agggcctctggcttccctgcc

SEQ ID NO: 1872450 - DNA, 22 bp, Homo sapiens
agggcctctggcttccctgccc

SEQ ID NO: 1872451 - DNA, 23 bp, Homo sapiens
agggcctctggcttccctgccca

SEQ ID NO: 1872452 - DNA, 15 bp, Homo sapiens
agggctaggaatata

SEQ ID NO: 1872453 - DNA, 12 bp, Homo sapiens
agggggcagagt

SEQ ID NO: 1872454 - DNA, 14 bp, Homo sapiens
agggggcagagtgg

SEQ ID NO: 1872455 - DNA, 23 bp, Homo sapiens
agggggcagagtggcctgtgagc

SEQ ID NO: 1872456 - DNA, 16 bp, Homo sapiens
aggggtcaaagaaatg

SEQ ID NO: 1872457 - DNA, 19 bp, Homo sapiens
aggggtgtcccagtcccag

SEQ ID NO: 1872458 - DNA, 23 bp, Homo sapiens
aggtaacgtgattgattcagtat

SEQ ID NO: 1872459 - DNA, 14 bp, Homo sapiens
aggtaggttttaaa

SEQ ID NO: 1872460 - DNA, 21 bp, Homo sapiens
aggtataaggatcttttgtaa

SEQ ID NO: 1872461 - DNA, 22 bp, Homo sapiens
aggtataaggatcttttgtaaa

SEQ ID NO: 1872462 - DNA, 15 bp, Homo sapiens
aggtcatggagcagc

SEQ ID NO: 1872463 - DNA, 21 bp, Homo sapiens
aggtcatggagcagcccccaa

SEQ ID NO: 1872464 - DNA, 21 bp, Homo sapiens
aggtctcatgcccactccccc

SEQ ID NO: 1872465 - DNA, 13 bp, Homo sapiens
aggtgatgctgct

SEQ ID NO: 1872466 - DNA, 15 bp, Homo sapiens
aggtggtgcttacat

SEQ ID NO: 1872467 - DNA, 22 bp, Homo sapiens
aggtgtcatttgacaacacatg

SEQ ID NO: 1872468 - DNA, 14 bp, Homo sapiens
aggttctgcactcc

SEQ ID NO: 1872469 - DNA, 18 bp, Homo sapiens
aggttctgcactcctgga

SEQ ID NO: 1872470 - DNA, 20 bp, Homo sapiens
aggtttggagccgggaaagc

SEQ ID NO: 1872471 - DNA, 21 bp, Homo sapiens
aggtttggagccgggaaagct

SEQ ID NO: 1872472 - DNA, 14 bp, Homo sapiens
aggttttgaataaa

SEQ ID NO: 1872473 - DNA, 16 bp, Homo sapiens
aggttttgaataaaaa

SEQ ID NO: 1872474 - DNA, 24 bp, Homo sapiens
aggttttgaataaaaagtgaactt

SEQ ID NO: 1872475 - DNA, 18 bp, Homo sapiens
agtaactggtgatatatc

SEQ ID NO: 1872476 - DNA, 20 bp, Homo sapiens
agtaagtcttttttttttcc

SEQ ID NO: 1872477 - DNA, 17 bp, Homo sapiens
agtaatatgaaagccac

SEQ ID NO: 1872478 - DNA, 22 bp, Homo sapiens
agtacaatgtgactttgaaaat

SEQ ID NO: 1872479 - DNA, 17 bp, Homo sapiens
agtaccctgcaggccag

SEQ ID NO: 1872480 - DNA, 18 bp, Homo sapiens
agtaccctgcaggccagg

SEQ ID NO: 1872481 - DNA, 15 bp, Homo sapiens
actttgctgttactg

SEQ ID NO: 1872482 - DNA, 16 bp, Homo sapiens
actttgctgttactgc

SEQ ID NO: 1872483 - DNA, 20 bp, Homo sapiens
actttgctgttactgcttct

SEQ ID NO: 1872484 - DNA, 11 bp, Homo sapiens
actttgtgttt

SEQ ID NO: 1872485 - DNA, 20 bp, Homo sapiens
acttttacagaatgcattaa

SEQ ID NO: 1872486 - DNA, 16 bp, Homo sapiens
acttttctggttccaa

SEQ ID NO: 1872487 - DNA, 16 bp, Homo sapiens
acttttctttcttttc

SEQ ID NO: 1872488 - DNA, 12 bp, Homo sapiens
acttttgtaatt

SEQ ID NO: 1872489 - DNA, 15 bp, Homo sapiens
acttttgtaatttga

SEQ ID NO: 1872490 - DNA, 17 bp, Homo sapiens
actttttgttttgttct

SEQ ID NO: 1872491 - DNA, 18 bp, Homo sapiens
acttttttgaaatcagta

SEQ ID NO: 1872492 - DNA, 15 bp, Homo sapiens
actttttttgttata

SEQ ID NO: 1872493 - DNA, 22 bp, Homo sapiens
agaaaacctgtttttaacatgt

SEQ ID NO: 1872494 - DNA, 15 bp, Homo sapiens
agaaaactgaaaatc

SEQ ID NO: 1872495 - DNA, 14 bp, Homo sapiens
agaaaaggcaaaag

SEQ ID NO: 1872496 - DNA, 18 bp, Homo sapiens
agaaaaggcaaaagactg

SEQ ID NO: 1872497 - DNA, 23 bp, Homo sapiens
agaaaagggaagttgtgcctttt

SEQ ID NO: 1872498 - DNA, 20 bp, Homo sapiens
agaaacatgttcctgttcct

SEQ ID NO: 1872499 - DNA, 15 bp, Homo sapiens
agaaaccatgacaaa

SEQ ID NO: 1872500 - DNA, 16 bp, Homo sapiens
agaaaccatgacaaac

SEQ ID NO: 1872501 - DNA, 16 bp, Homo sapiens
agaaagagaatgaact

SEQ ID NO: 1872502 - DNA, 14 bp, Homo sapiens
agaaaggatataaa

SEQ ID NO: 1872503 - DNA, 17 bp, Homo sapiens
agaaaggatataaaagg

SEQ ID NO: 1872504 - DNA, 16 bp, Homo sapiens
agaaagggaaagctgt

SEQ ID NO: 1872505 - DNA, 16 bp, Homo sapiens
agaaagtaagtctttt

SEQ ID NO: 1872506 - DNA, 17 bp, Homo sapiens
agaaagtaagtcttttt

SEQ ID NO: 1872507 - DNA, 20 bp, Homo sapiens
agaaagtcgaattaatagct

SEQ ID NO: 1872508 - DNA, 21 bp, Homo sapiens
agaaagtcgaattaatagctt

SEQ ID NO: 1872509 - DNA, 13 bp, Homo sapiens
agaaatcagaatt

SEQ ID NO: 1872510 - DNA, 14 bp, Homo sapiens
agaaattatttaat

SEQ ID NO: 1872511 - DNA, 16 bp, Homo sapiens
agaaattatttaataa

SEQ ID NO: 1872512 - DNA, 15 bp, Homo sapiens
agaaatttgatttct

SEQ ID NO: 1872513 - DNA, 20 bp, Homo sapiens
agaaatttgatttctattca

SEQ ID NO: 1872514 - DNA, 13 bp, Homo sapiens
agaaccttactgg

SEQ ID NO: 1872515 - DNA, 18 bp, Homo sapiens
agaactttgccttaagtt

SEQ ID NO: 1872516 - DNA, 21 bp, Homo sapiens
agaactttgccttaagtttcc

SEQ ID NO: 1872517 - DNA, 16 bp, Homo sapiens
agaagaactttgcctt

SEQ ID NO: 1872518 - DNA, 18 bp, Homo sapiens
agaagagaggggaagaat

SEQ ID NO: 1872519 - DNA, 20 bp, Homo sapiens
agaagagaggggaagaattt

SEQ ID NO: 1872520 - DNA, 23 bp, Homo sapiens
agaagagaggggaagaatttaat

SEQ ID NO: 1872521 - DNA, 21 bp, Homo sapiens
agaagatgggggctggagggg

SEQ ID NO: 1872522 - DNA, 13 bp, Homo sapiens
agaagctgtagta

SEQ ID NO: 1872523 - DNA, 17 bp, Homo sapiens
aaatattttaagaaaga

SEQ ID NO: 1872524 - DNA, 14 bp, Homo sapiens
aaatcacaaacata

SEQ ID NO: 1872525 - DNA, 16 bp, Homo sapiens
aaatcagcatgacaaa

SEQ ID NO: 1872526 - DNA, 17 bp, Homo sapiens
aaatcagcatgacaaaa

SEQ ID NO: 1872527 - DNA, 15 bp, Homo sapiens
aaatcagtaaacact

SEQ ID NO: 1872528 - DNA, 22 bp, Homo sapiens
aaatcatactcctatgctttag

SEQ ID NO: 1872529 - DNA, 12 bp, Homo sapiens
aaatctctaata

SEQ ID NO: 1872530 - DNA, 14 bp, Homo sapiens
aaatgaacacatgg

SEQ ID NO: 1872531 - DNA, 18 bp, Homo sapiens
aaatgaacttttacagaa

SEQ ID NO: 1872532 - DNA, 22 bp, Homo sapiens
aaatgaagcaatttatatcttt

SEQ ID NO: 1872533 - DNA, 16 bp, Homo sapiens
aaatgagggtttctga

SEQ ID NO: 1872534 - DNA, 18 bp, Homo sapiens
aaatgagttacttagaat

SEQ ID NO: 1872535 - DNA, 16 bp, Homo sapiens
aaatgatgataatcat

SEQ ID NO: 1872536 - DNA, 17 bp, Homo sapiens
aaatgcccatttttgct

SEQ ID NO: 1872537 - DNA, 14 bp, Homo sapiens
aaatggatatagaa

SEQ ID NO: 1872538 - DNA, 18 bp, Homo sapiens
aaatggcttacttacaaa

SEQ ID NO: 1872539 - DNA, 23 bp, Homo sapiens
aaatgggaattctgacttactta

SEQ ID NO: 1872540 - DNA, 20 bp, Homo sapiens
aaatgggttggtgcttctaa

SEQ ID NO: 1872541 - DNA, 17 bp, Homo sapiens
aaattaacagtcctaac

SEQ ID NO: 1872542 - DNA, 19 bp, Homo sapiens
aaattaatcttttaaaaat

SEQ ID NO: 1872543 - DNA, 23 bp, Homo sapiens
aaattagaaaccttaatatgtgg

SEQ ID NO: 1872544 - DNA, 12 bp, Homo sapiens
aaattatattcc

SEQ ID NO: 1872545 - DNA, 20 bp, Homo sapiens
aaattattaattgtcctgtg

SEQ ID NO: 1872546 - DNA, 13 bp, Homo sapiens
aaattatttgtgt

SEQ ID NO: 1872547 - DNA, 16 bp, Homo sapiens
aaattattttaaacaa

SEQ ID NO: 1872548 - DNA, 17 bp, Homo sapiens
aaattattttaaacaaa

SEQ ID NO: 1872549 - DNA, 16 bp, Homo sapiens
aaattcactgttgaat

SEQ ID NO: 1872550 - DNA, 17 bp, Homo sapiens
aaattcactgttgaatg

SEQ ID NO: 1872551 - DNA, 21 bp, Homo sapiens
aaattcactgttgaatgcctg

SEQ ID NO: 1872552 - DNA, 21 bp, Homo sapiens
aaattccgattagacctttat

SEQ ID NO: 1872553 - DNA, 13 bp, Homo sapiens
aaattgaaagtat

SEQ ID NO: 1872554 - DNA, 14 bp, Homo sapiens
aaattgaaagtatt

SEQ ID NO: 1872555 - DNA, 19 bp, Homo sapiens
aaattgaaagtattcagaa

SEQ ID NO: 1872556 - DNA, 15 bp, Homo sapiens
aaattggtctgaaag

SEQ ID NO: 1872557 - DNA, 14 bp, Homo sapiens
aaattgtctgtctg

SEQ ID NO: 1872558 - DNA, 23 bp, Homo sapiens
aaattgtctgtctgctcttattt

SEQ ID NO: 1872559 - DNA, 18 bp, Homo sapiens
aaatttcacagttctgta

SEQ ID NO: 1872560 - DNA, 19 bp, Homo sapiens
aaatttcacagttctgtaa

SEQ ID NO: 1872561 - DNA, 19 bp, Homo sapiens
aaattttctagactttctg

SEQ ID NO: 1872562 - DNA, 10 bp, Homo sapiens
aaatttttga

SEQ ID NO: 1872563 - DNA, 21 bp, Homo sapiens
aaatttttgaaaaatattgct

SEQ ID NO: 1872564 - DNA, 19 bp, Homo sapiens
aacaacttgctacttatca

SEQ ID NO: 1872565 - DNA, 21 bp, Homo sapiens
aacaacttgctacttatcatt

SEQ ID NO: 1872566 - DNA, 20 bp, Homo sapiens
aacaatttcctttatattta

SEQ ID NO: 1872567 - DNA, 21 bp, Homo sapiens
aacaatttcctttatatttag

SEQ ID NO: 1872568 - DNA, 10 bp, Homo sapiens
aacacaaaaa

SEQ ID NO: 1872569 - DNA, 19 bp, Homo sapiens
aacacagctgagagacttt

SEQ ID NO: 1872570 - DNA, 20 bp, Homo sapiens
aacactaaattagtttaaaa

SEQ ID NO: 1872571 - DNA, 13 bp, Homo sapiens
aacactgttggca

SEQ ID NO: 1872572 - DNA, 21 bp, Homo sapiens
aacacttttctccagggttca

SEQ ID NO: 1872573 - DNA, 12 bp, Homo sapiens
aacagagaaaga

SEQ ID NO: 1872574 - DNA, 13 bp, Homo sapiens
aacagagaaagaa

SEQ ID NO: 1872575 - DNA, 17 bp, Homo sapiens
aacagtttctcaagttt

SEQ ID NO: 1872576 - DNA, 13 bp, Homo sapiens
aacatatgtctgt

SEQ ID NO: 1872577 - DNA, 17 bp, Homo sapiens
aacattaccttgtcttt

SEQ ID NO: 1872578 - DNA, 17 bp, Homo sapiens
aacatttctgtatactg

SEQ ID NO: 1872579 - DNA, 19 bp, Homo sapiens
aacatttctgtatactgta

SEQ ID NO: 1872580 - DNA, 23 bp, Homo sapiens
aacatttctgtatactgtaaaag

SEQ ID NO: 1872581 - DNA, 20 bp, Homo sapiens
aaccaccccataccagtcac

SEQ ID NO: 1872582 - DNA, 21 bp, Homo sapiens
aaccaccccataccagtcacc

SEQ ID NO: 1872583 - DNA, 16 bp, Homo sapiens
aaccagtttattctgt

SEQ ID NO: 1872584 - DNA, 15 bp, Homo sapiens
aacccccaaatttaa

SEQ ID NO: 1872585 - DNA, 13 bp, Homo sapiens
aaccgtttacagt

SEQ ID NO: 1872586 - DNA, 20 bp, Homo sapiens
aacctagcttttaaaaaata

SEQ ID NO: 1872587 - DNA, 19 bp, Homo sapiens
aacctttctactttttctg

SEQ ID NO: 1872588 - DNA, 12 bp, Homo sapiens
aacgcacttaca

SEQ ID NO: 1872589 - DNA, 19 bp, Homo sapiens
aactacgcttgctcatttt

SEQ ID NO: 1872590 - DNA, 16 bp, Homo sapiens
aactagttaaaagcct

SEQ ID NO: 1872591 - DNA, 20 bp, Homo sapiens
aactcattgcatcatttaca

SEQ ID NO: 1872592 - DNA, 15 bp, Homo sapiens
aactctgaataagca

SEQ ID NO: 1872593 - DNA, 15 bp, Homo sapiens
aactctgattttgat

SEQ ID NO: 1872594 - DNA, 16 bp, Homo sapiens
aactgactctgttatt

SEQ ID NO: 1872595 - DNA, 17 bp, Homo sapiens
aactgctttattttccc

SEQ ID NO: 1872596 - DNA, 17 bp, Homo sapiens
aactgtatttcagtatt

SEQ ID NO: 1872597 - DNA, 12 bp, Homo sapiens
aactgtggaatt

SEQ ID NO: 1872598 - DNA, 23 bp, Homo sapiens
aactgtggaatttattggcagcc

SEQ ID NO: 1872599 - DNA, 17 bp, Homo sapiens
aactgtgtatcattaaa

SEQ ID NO: 1872600 - DNA, 19 bp, Homo sapiens
aactgtgtatcattaaaat

SEQ ID NO: 1872601 - DNA, 20 bp, Homo sapiens
aactgtgtatcattaaaata

SEQ ID NO: 1872602 - DNA, 21 bp, Homo sapiens
aactgtgtatcattaaaatat

SEQ ID NO: 1872603 - DNA, 23 bp, Homo sapiens
aactgtttggtcgagtctttgtg

SEQ ID NO: 1872604 - DNA, 16 bp, Homo sapiens
aacttaacatatttac

SEQ ID NO: 1872605 - DNA, 20 bp, Homo sapiens
aacttgctacttatcatttt

SEQ ID NO: 1872606 - DNA, 17 bp, Homo sapiens
aactttaaaaggcaact

SEQ ID NO: 1872607 - DNA, 19 bp, Homo sapiens
aactttgcttgattaaaca

SEQ ID NO: 1872608 - DNA, 12 bp, Homo sapiens
aacttttacaga

SEQ ID NO: 1872609 - DNA, 21 bp, Homo sapiens
aagaaaacctgtttttaacat

SEQ ID NO: 1872610 - DNA, 17 bp, Homo sapiens
aagaaaaggcaaaagac

SEQ ID NO: 1872611 - DNA, 13 bp, Homo sapiens
aagaaacactaaa

SEQ ID NO: 1872612 - DNA, 9 bp, Homo sapiens
aagaaagag

SEQ ID NO: 1872613 - DNA, 14 bp, Homo sapiens
aagaaagagaatga

SEQ ID NO: 1872614 - DNA, 18 bp, Homo sapiens
aagaaagagaatgaactg

SEQ ID NO: 1872615 - DNA, 21 bp, Homo sapiens
aatttcttcactgttgaaaat

SEQ ID NO: 1872616 - DNA, 16 bp, Homo sapiens
aatttgaattgggtcc

SEQ ID NO: 1872617 - DNA, 15 bp, Homo sapiens
aatttgatttctatt

SEQ ID NO: 1872618 - DNA, 13 bp, Homo sapiens
aatttttgaaaaa

SEQ ID NO: 1872619 - DNA, 16 bp, Homo sapiens
aatttttgaaaaatat

SEQ ID NO: 1872620 - DNA, 23 bp, Homo sapiens
aatttttgaaaaatattgctaaa

SEQ ID NO: 1872621 - DNA, 12 bp, Homo sapiens
acaaaaaaaaga

SEQ ID NO: 1872622 - DNA, 14 bp, Homo sapiens
acaaaaaaaagaac

SEQ ID NO: 1872623 - DNA, 16 bp, Homo sapiens
acaaaagcagctttta

SEQ ID NO: 1872624 - DNA, 15 bp, Homo sapiens
acaaaatttcacagt

SEQ ID NO: 1872625 - DNA, 18 bp, Homo sapiens
acaaaatttcacagttct

SEQ ID NO: 1872626 - DNA, 22 bp, Homo sapiens
acaaaatttcacagttctgtaa

SEQ ID NO: 1872627 - DNA, 10 bp, Homo sapiens
acaaacaaaa

SEQ ID NO: 1872628 - DNA, 19 bp, Homo sapiens
acaaagttactggctcttt

SEQ ID NO: 1872629 - DNA, 14 bp, Homo sapiens
acaaagttcagtgt

SEQ ID NO: 1872630 - DNA, 16 bp, Homo sapiens
acaaatacactttatt

SEQ ID NO: 1872631 - DNA, 20 bp, Homo sapiens
acaaatggcttacttacaaa

SEQ ID NO: 1872632 - DNA, 23 bp, Homo sapiens
acaaattttttaatttccaaaat

SEQ ID NO: 1872633 - DNA, 13 bp, Homo sapiens
acaacagaagctt

SEQ ID NO: 1872634 - DNA, 18 bp, Homo sapiens
acaagaaatttgatttct

SEQ ID NO: 1872635 - DNA, 17 bp, Homo sapiens
acaagacaacattgtaa

SEQ ID NO: 1872636 - DNA, 15 bp, Homo sapiens
acaagtcctgtgaat

SEQ ID NO: 1872637 - DNA, 20 bp, Homo sapiens
acaagtggtgaccaaaattt

SEQ ID NO: 1872638 - DNA, 23 bp, Homo sapiens
acaagtggtgaccaaaattttta

SEQ ID NO: 1872639 - DNA, 18 bp, Homo sapiens
acaagtgtatatcagaaa

SEQ ID NO: 1872640 - DNA, 17 bp, Homo sapiens
acaagtttgctaaaaga

SEQ ID NO: 1872641 - DNA, 18 bp, Homo sapiens
acaagtttgctaaaagaa

SEQ ID NO: 1872642 - DNA, 19 bp, Homo sapiens
acaagtttgctaaaagaag

SEQ ID NO: 1872643 - DNA, 18 bp, Homo sapiens
acaatcatttgctttttg

SEQ ID NO: 1872644 - DNA, 15 bp, Homo sapiens
acaattagcagaatg

SEQ ID NO: 1872645 - DNA, 15 bp, Homo sapiens
acacaagtcctgtga

SEQ ID NO: 1872646 - DNA, 16 bp, Homo sapiens
acacaagtcctgtgaa

SEQ ID NO: 1872647 - DNA, 13 bp, Homo sapiens
acacacacacata

SEQ ID NO: 1872648 - DNA, 22 bp, Homo sapiens
acacagctgagagacttttaat

SEQ ID NO: 1872649 - DNA, 23 bp, Homo sapiens
acacagttaaataaatagaaaga

SEQ ID NO: 1872650 - DNA, 15 bp, Homo sapiens
caagtttaaagtcat

SEQ ID NO: 1872651 - DNA, 16 bp, Homo sapiens
caagtttaaagtcatg

SEQ ID NO: 1872652 - DNA, 13 bp, Homo sapiens
caagtttgctaaa

SEQ ID NO: 1872653 - DNA, 16 bp, Homo sapiens
caataactctgatttt

SEQ ID NO: 1872654 - DNA, 19 bp, Homo sapiens
caataactctgattttgat

SEQ ID NO: 1872655 - DNA, 21 bp, Homo sapiens
caataactctgattttgatat

SEQ ID NO: 1872656 - DNA, 16 bp, Homo sapiens
caatagtttgcataga

SEQ ID NO: 1872657 - DNA, 17 bp, Homo sapiens
caatcatctgtgtgaaa

SEQ ID NO: 1872658 - DNA, 19 bp, Homo sapiens
caatcatctgtgtgaaaat

SEQ ID NO: 1872659 - DNA, 15 bp, Homo sapiens
caatcctccctggag

SEQ ID NO: 1872660 - DNA, 19 bp, Homo sapiens
caatgatcacatctaaagc

SEQ ID NO: 1872661 - DNA, 13 bp, Homo sapiens
caatgccctgcct

SEQ ID NO: 1872662 - DNA, 16 bp, Homo sapiens
caatgtgactttgaaa

SEQ ID NO: 1872663 - DNA, 12 bp, Homo sapiens
caattaattaaa

SEQ ID NO: 1872664 - DNA, 15 bp, Homo sapiens
caattacatgtttgg

SEQ ID NO: 1872665 - DNA, 15 bp, Homo sapiens
caattagcagaatgg

SEQ ID NO: 1872666 - DNA, 22 bp, Homo sapiens
caatttatatctttatgcaaaa

SEQ ID NO: 1872667 - DNA, 13 bp, Homo sapiens
caatttatgcaga

SEQ ID NO: 1872668 - DNA, 14 bp, Homo sapiens
caatttattaaaat

SEQ ID NO: 1872669 - DNA, 16 bp, Homo sapiens
caatttcctttatatt

SEQ ID NO: 1872670 - DNA, 19 bp, Homo sapiens
caatttcctttatatttag

SEQ ID NO: 1872671 - DNA, 20 bp, Homo sapiens
caatttcctttatatttagt

SEQ ID NO: 1872672 - DNA, 18 bp, Homo sapiens
cacaaaaaaataataaaa

SEQ ID NO: 1872673 - DNA, 19 bp, Homo sapiens
cacaactagttaaaagcct

SEQ ID NO: 1872674 - DNA, 20 bp, Homo sapiens
cacaagaaatttgatttcta

SEQ ID NO: 1872675 - DNA, 15 bp, Homo sapiens
cacaagaaggccagc

SEQ ID NO: 1872676 - DNA, 19 bp, Homo sapiens
cacaagaaggccagcccac

SEQ ID NO: 1872677 - DNA, 23 bp, Homo sapiens
cacaagaaggccagcccactggg

SEQ ID NO: 1872678 - DNA, 22 bp, Homo sapiens
cacagttggctggatgaaattt

SEQ ID NO: 1872679 - DNA, 19 bp, Homo sapiens
cacatacaaaaaaaatctt

SEQ ID NO: 1872680 - DNA, 16 bp, Homo sapiens
cacatattattggtca

SEQ ID NO: 1872681 - DNA, 21 bp, Homo sapiens
cacatccttgactttttagat

SEQ ID NO: 1872682 - DNA, 20 bp, Homo sapiens
cacatgctgaggttttgaat

SEQ ID NO: 1872683 - DNA, 20 bp, Homo sapiens
caccacgatgacgcctctgg

SEQ ID NO: 1872684 - DNA, 21 bp, Homo sapiens
caccacgatgacgcctctgga

SEQ ID NO: 1872685 - DNA, 12 bp, Homo sapiens
caccactgggaa

SEQ ID NO: 1872686 - DNA, 14 bp, Homo sapiens
cacccagaaggacc

SEQ ID NO: 1872687 - DNA, 18 bp, Homo sapiens
caccccataccagtcacc

SEQ ID NO: 1872688 - DNA, 12 bp, Homo sapiens
cacccccccagg

SEQ ID NO: 1872689 - DNA, 17 bp, Homo sapiens
cacccccccaggcctcc

SEQ ID NO: 1872690 - DNA, 20 bp, Homo sapiens
cacccccccaggcctccaga

SEQ ID NO: 1872691 - DNA, 23 bp, Homo sapiens
caccctgaacatttagtaccctg

SEQ ID NO: 1872692 - DNA, 12 bp, Homo sapiens
caccctgcctgt

SEQ ID NO: 1872693 - DNA, 14 bp, Homo sapiens
caccctgcctgtgg

SEQ ID NO: 1872694 - DNA, 15 bp, Homo sapiens
caccctgcctgtgga

SEQ ID NO: 1872695 - DNA, 17 bp, Homo sapiens
caccctgcctgtggagg

SEQ ID NO: 1872696 - DNA, 22 bp, Homo sapiens
caccctgggcagtgagtgccat

SEQ ID NO: 1872697 - DNA, 15 bp, Homo sapiens
cagtcacctcctgct

SEQ ID NO: 1872698 - DNA, 18 bp, Homo sapiens
cagtcacctcctgctcct

SEQ ID NO: 1872699 - DNA, 22 bp, Homo sapiens
cagtccaaattgtctgtctgct

SEQ ID NO: 1872700 - DNA, 12 bp, Homo sapiens
cagtcccagcct

SEQ ID NO: 1872701 - DNA, 16 bp, Homo sapiens
cagtcccagcctctgg

SEQ ID NO: 1872702 - DNA, 18 bp, Homo sapiens
cagtcccagcctctgggg

SEQ ID NO: 1872703 - DNA, 21 bp, Homo sapiens
cagtcccagcctctggggcag

SEQ ID NO: 1872704 - DNA, 17 bp, Homo sapiens
cagtctctgttgtaaat

SEQ ID NO: 1872705 - DNA, 21 bp, Homo sapiens
cagtctgaatggcatggagac

SEQ ID NO: 1872706 - DNA, 20 bp, Homo sapiens
cagtctttcaactcattgca

SEQ ID NO: 1872707 - DNA, 19 bp, Homo sapiens
cagtgacctgctgggtaaa

SEQ ID NO: 1872708 - DNA, 17 bp, Homo sapiens
cagtgatgggagagtag

SEQ ID NO: 1872709 - DNA, 17 bp, Homo sapiens
cagtgatttacatgctg

SEQ ID NO: 1872710 - DNA, 13 bp, Homo sapiens
cagtggagaatta

SEQ ID NO: 1872711 - DNA, 13 bp, Homo sapiens
cagtggcactaaa

SEQ ID NO: 1872712 - DNA, 19 bp, Homo sapiens
cagtgtcgggaattttccc

SEQ ID NO: 1872713 - DNA, 18 bp, Homo sapiens
cagtttcatgtatgtata

SEQ ID NO: 1872714 - DNA, 15 bp, Homo sapiens
cataaaactttaaaa

SEQ ID NO: 1872715 - DNA, 20 bp, Homo sapiens
cataaaactttaaaaggcaa

SEQ ID NO: 1872716 - DNA, 21 bp, Homo sapiens
cataagtaagacttgattggt

SEQ ID NO: 1872717 - DNA, 16 bp, Homo sapiens
cataccagtcacctcc

SEQ ID NO: 1872718 - DNA, 17 bp, Homo sapiens
cataggaagacataaaa

SEQ ID NO: 1872719 - DNA, 18 bp, Homo sapiens
catataagcaagacagtg

SEQ ID NO: 1872720 - DNA, 14 bp, Homo sapiens
catatatgctgtat

SEQ ID NO: 1872721 - DNA, 16 bp, Homo sapiens
catatatgctgtattt

SEQ ID NO: 1872722 - DNA, 15 bp, Homo sapiens
catatctagtcaata

SEQ ID NO: 1872723 - DNA, 15 bp, Homo sapiens
catatgcttctttaa

SEQ ID NO: 1872724 - DNA, 15 bp, Homo sapiens
catatgtctgtcttt

SEQ ID NO: 1872725 - DNA, 16 bp, Homo sapiens
catatgtctgtctttg

SEQ ID NO: 1872726 - DNA, 18 bp, Homo sapiens
catattgctcttaaaaat

SEQ ID NO: 1872727 - DNA, 14 bp, Homo sapiens
catattggtattca

SEQ ID NO: 1872728 - DNA, 13 bp, Homo sapiens
catattttgtata

SEQ ID NO: 1872729 - DNA, 15 bp, Homo sapiens
catcacttttcagtg

SEQ ID NO: 1872730 - DNA, 22 bp, Homo sapiens
catcagacttgcggccacagca

SEQ ID NO: 1872731 - DNA, 11 bp, Homo sapiens
catccttaaag

SEQ ID NO: 1872732 - DNA, 23 bp, Homo sapiens
catctaatagcgggttactttca

SEQ ID NO: 1872733 - DNA, 15 bp, Homo sapiens
catctgcctgtaatt

SEQ ID NO: 1872734 - DNA, 23 bp, Homo sapiens
catcttttcctcccattttagaa

SEQ ID NO: 1872735 - DNA, 19 bp, Homo sapiens
catgaaaataccataggaa

SEQ ID NO: 1872736 - DNA, 20 bp, Homo sapiens
catgacaaaaataacactgt

SEQ ID NO: 1872737 - DNA, 16 bp, Homo sapiens
catgacatgttatata

SEQ ID NO: 1872738 - DNA, 17 bp, Homo sapiens
catgacatgttatatat

SEQ ID NO: 1872739 - DNA, 19 bp, Homo sapiens
catgacatgttatatattt

SEQ ID NO: 1872740 - DNA, 14 bp, Homo sapiens
catgcattcataca

SEQ ID NO: 1872741 - DNA, 23 bp, Homo sapiens
catgcccactcccccaggagcag

SEQ ID NO: 1872742 - DNA, 20 bp, Homo sapiens
catgctcatgtatatttagt

SEQ ID NO: 1872743 - DNA, 12 bp, Homo sapiens
catgcttcactc

SEQ ID NO: 1872744 - DNA, 15 bp, Homo sapiens
catgctttttggtga

SEQ ID NO: 1872745 - DNA, 12 bp, Homo sapiens
catggagcagcc

SEQ ID NO: 1872746 - DNA, 13 bp, Homo sapiens
catggagcagccc

SEQ ID NO: 1872747 - DNA, 18 bp, Homo sapiens
catgggaaaaagagactc

SEQ ID NO: 1872748 - DNA, 19 bp, Homo sapiens
catgggaaaaagagactct

SEQ ID NO: 1872749 - DNA, 23 bp, Homo sapiens
catgggcaactcgtgacagcctc

SEQ ID NO: 1872750 - DNA, 21 bp, Homo sapiens
catggtagatttttttcatag

SEQ ID NO: 1872751 - DNA, 20 bp, Homo sapiens
catgttatatattttttgta

SEQ ID NO: 1872752 - DNA, 14 bp, Homo sapiens
catgttcctgttcc

SEQ ID NO: 1872753 - DNA, 21 bp, Homo sapiens
catgtttgtctgtgtgctgta

SEQ ID NO: 1872754 - DNA, 23 bp, Homo sapiens
catgtttgtctgtgtgctgtaac

SEQ ID NO: 1872755 - DNA, 17 bp, Homo sapiens
catgtttttgttttctt

SEQ ID NO: 1872756 - DNA, 21 bp, Homo sapiens
cattaaaatatatgttctgca

SEQ ID NO: 1872757 - DNA, 18 bp, Homo sapiens
cattaaactctaaagatt

SEQ ID NO: 1872758 - DNA, 15 bp, Homo sapiens
cattaactaaatgct

SEQ ID NO: 1872759 - DNA, 15 bp, Homo sapiens
cattaatctgtttgt

SEQ ID NO: 1872760 - DNA, 14 bp, Homo sapiens
cattattttgtatg

SEQ ID NO: 1872761 - DNA, 14 bp, Homo sapiens
cattcctgttctct

SEQ ID NO: 1872762 - DNA, 23 bp, Homo sapiens
cattcctgttctctttgccttga

SEQ ID NO: 1872763 - DNA, 18 bp, Homo sapiens
cattcttggttgttaatt

SEQ ID NO: 1872764 - DNA, 19 bp, Homo sapiens
cattcttggttgttaattt

SEQ ID NO: 1872765 - DNA, 14 bp, Homo sapiens
cattgaaatcagca

SEQ ID NO: 1872766 - DNA, 19 bp, Homo sapiens
cattgaaatcagcatgaca

SEQ ID NO: 1872767 - DNA, 23 bp, Homo sapiens
cattgtgtatgagactgtgtttc

SEQ ID NO: 1872768 - DNA, 13 bp, Homo sapiens
catttaaggagat

SEQ ID NO: 1872769 - DNA, 16 bp, Homo sapiens
catttagtaccctgca

SEQ ID NO: 1872770 - DNA, 15 bp, Homo sapiens
catttctaacataag

SEQ ID NO: 1872771 - DNA, 12 bp, Homo sapiens
catttgctgccc

SEQ ID NO: 1872772 - DNA, 15 bp, Homo sapiens
catttggcttgctgt

SEQ ID NO: 1872773 - DNA, 17 bp, Homo sapiens
catttttgatttatgca

SEQ ID NO: 1872774 - DNA, 15 bp, Homo sapiens
catttttgctaatta

SEQ ID NO: 1872775 - DNA, 12 bp, Homo sapiens
catttttgtata

SEQ ID NO: 1872776 - DNA, 18 bp, Homo sapiens
ccaaaccagtttattctg

SEQ ID NO: 1872777 - DNA, 20 bp, Homo sapiens
ccaaaccagtttattctgtg

SEQ ID NO: 1872778 - DNA, 16 bp, Homo sapiens
ccaaagagctgtggct

SEQ ID NO: 1872779 - DNA, 14 bp, Homo sapiens
ccaaattaatcttt

SEQ ID NO: 1872780 - DNA, 17 bp, Homo sapiens
ccaaattaatcttttaa

SEQ ID NO: 1872781 - DNA, 21 bp, Homo sapiens
ccaaattaatcttttaaaaat

SEQ ID NO: 1872782 - DNA, 13 bp, Homo sapiens
ccaaattattaat

SEQ ID NO: 1872783 - DNA, 22 bp, Homo sapiens
ccaaattattaattgtcctgtg

SEQ ID NO: 1872784 - DNA, 14 bp, Homo sapiens
ccaaattatttgtg

SEQ ID NO: 1872785 - DNA, 15 bp, Homo sapiens
ccaaatttaattaaa

SEQ ID NO: 1872786 - DNA, 13 bp, Homo sapiens
ccaactttctgta

SEQ ID NO: 1872787 - DNA, 17 bp, Homo sapiens
ccaagctaatctgcctg

SEQ ID NO: 1872788 - DNA, 16 bp, Homo sapiens
ccaaggaaaattgaaa

SEQ ID NO: 1872789 - DNA, 22 bp, Homo sapiens
ccaaggaatgtgtccaagacac

SEQ ID NO: 1872790 - DNA, 17 bp, Homo sapiens
ccaatcccccagcgctt

SEQ ID NO: 1872791 - DNA, 15 bp, Homo sapiens
ccaatcctccctgga

SEQ ID NO: 1872792 - DNA, 22 bp, Homo sapiens
ccacagcactagagtcaccccc

SEQ ID NO: 1872793 - DNA, 18 bp, Homo sapiens
ccaccccataccagtcac

SEQ ID NO: 1872794 - DNA, 20 bp, Homo sapiens
ccactagctaagcaagccag

SEQ ID NO: 1872795 - DNA, 20 bp, Homo sapiens
ccactcccccaggagcagct

SEQ ID NO: 1872796 - DNA, 21 bp, Homo sapiens
ccactcccccaggagcagctg

SEQ ID NO: 1872797 - DNA, 22 bp, Homo sapiens
ccactcccccaggagcagctgg

SEQ ID NO: 1872798 - DNA, 18 bp, Homo sapiens
ccactgacctgcccatgt

SEQ ID NO: 1872799 - DNA, 22 bp, Homo sapiens
ccactggcatcgcagcttcctg

SEQ ID NO: 1872800 - DNA, 23 bp, Homo sapiens
ccactgggaaccaagggccctca

SEQ ID NO: 1872801 - DNA, 23 bp, Homo sapiens
ccactgggccctggggctgccct

SEQ ID NO: 1872802 - DNA, 22 bp, Homo sapiens
ccagagcacaagaaggccagcc

SEQ ID NO: 1872803 - DNA, 15 bp, Homo sapiens
ccagagggactggac

SEQ ID NO: 1872804 - DNA, 17 bp, Homo sapiens
ccagcaatatgtaaata

SEQ ID NO: 1872805 - DNA, 19 bp, Homo sapiens
ccagcaatgccctgccttg

SEQ ID NO: 1872806 - DNA, 22 bp, Homo sapiens
ccagcaatgccctgccttgctg

SEQ ID NO: 1872807 - DNA, 19 bp, Homo sapiens
ccagcccactgggccctgg

SEQ ID NO: 1872808 - DNA, 21 bp, Homo sapiens
ccagcccactgggccctgggg

SEQ ID NO: 1872809 - DNA, 15 bp, Homo sapiens
ccagctctacgagag

SEQ ID NO: 1872810 - DNA, 13 bp, Homo sapiens
ccagcttcccctc

SEQ ID NO: 1872811 - DNA, 21 bp, Homo sapiens
ccaggagaagacccctgccca

SEQ ID NO: 1872812 - DNA, 22 bp, Homo sapiens
ccaggagattggatttgctgtg

SEQ ID NO: 1872813 - DNA, 17 bp, Homo sapiens
ctacttatcatttttgt

SEQ ID NO: 1872814 - DNA, 22 bp, Homo sapiens
ctagaagtaactggtgatatat

SEQ ID NO: 1872815 - DNA, 18 bp, Homo sapiens
ctagacattattttgtat

SEQ ID NO: 1872816 - DNA, 18 bp, Homo sapiens
ctagcatttatttctctg

SEQ ID NO: 1872817 - DNA, 15 bp, Homo sapiens
ctagctaagcaagcc

SEQ ID NO: 1872818 - DNA, 16 bp, Homo sapiens
ctagtatctattgtgt

SEQ ID NO: 1872819 - DNA, 21 bp, Homo sapiens
ctagtatctattgtgttggct

SEQ ID NO: 1872820 - DNA, 20 bp, Homo sapiens
ctagtcaataactctgattt

SEQ ID NO: 1872821 - DNA, 19 bp, Homo sapiens
ctataataagttttgatat

SEQ ID NO: 1872822 - DNA, 22 bp, Homo sapiens
ctataataagttttgatataat

SEQ ID NO: 1872823 - DNA, 17 bp, Homo sapiens
ctatatctataaacact

SEQ ID NO: 1872824 - DNA, 16 bp, Homo sapiens
ctatatctgtttgtat

SEQ ID NO: 1872825 - DNA, 21 bp, Homo sapiens
ctatatctgtttgtatatttg

SEQ ID NO: 1872826 - DNA, 16 bp, Homo sapiens
ctatatgatttatagt

SEQ ID NO: 1872827 - DNA, 17 bp, Homo sapiens
ctatatgatttatagtt

SEQ ID NO: 1872828 - DNA, 19 bp, Homo sapiens
ctatctagcatttatttct

SEQ ID NO: 1872829 - DNA, 18 bp, Homo sapiens
ctatctatacctgccttt

SEQ ID NO: 1872830 - DNA, 19 bp, Homo sapiens
ctatggagactttgctgtt

SEQ ID NO: 1872831 - DNA, 21 bp, Homo sapiens
ctattgtgttggctttacaaa

SEQ ID NO: 1872832 - DNA, 22 bp, Homo sapiens
ctattgtgttggctttacaaat

SEQ ID NO: 1872833 - DNA, 16 bp, Homo sapiens
ctattttctctgatac

SEQ ID NO: 1872834 - DNA, 22 bp, Homo sapiens
ctattttctctgatactttttt

SEQ ID NO: 1872835 - DNA, 14 bp, Homo sapiens
ctcactcaggaacc

SEQ ID NO: 1872836 - DNA, 19 bp, Homo sapiens
ctcactcaggaaccctgga

SEQ ID NO: 1872837 - DNA, 20 bp, Homo sapiens
ctcagagagcatcttttcct

SEQ ID NO: 1872838 - DNA, 18 bp, Homo sapiens
ctcatacacagttaaata

SEQ ID NO: 1872839 - DNA, 18 bp, Homo sapiens
ctcatgcaaactgcttta

SEQ ID NO: 1872840 - DNA, 19 bp, Homo sapiens
ctcatgcaaactgctttat

SEQ ID NO: 1872841 - DNA, 14 bp, Homo sapiens
ctcatgcccactcc

SEQ ID NO: 1872842 - DNA, 16 bp, Homo sapiens
ctcatgcccactcccc

SEQ ID NO: 1872843 - DNA, 18 bp, Homo sapiens
ctcatgcccactccccca

SEQ ID NO: 1872844 - DNA, 18 bp, Homo sapiens
ctcattttaatgattgtt

SEQ ID NO: 1872845 - DNA, 14 bp, Homo sapiens
ctccaaggctgtct

SEQ ID NO: 1872846 - DNA, 21 bp, Homo sapiens
ctccagaaccttactggcact

SEQ ID NO: 1872847 - DNA, 22 bp, Homo sapiens
ctccagaaccttactggcactg

SEQ ID NO: 1872848 - DNA, 23 bp, Homo sapiens
ctccagaaccttactggcactgt

SEQ ID NO: 1872849 - DNA, 23 bp, Homo sapiens
ctccagcacgttttctggcttct

SEQ ID NO: 1872850 - DNA, 12 bp, Homo sapiens
ctccagggttca

SEQ ID NO: 1872851 - DNA, 19 bp, Homo sapiens
ctccccaatccatgcttca

SEQ ID NO: 1872852 - DNA, 14 bp, Homo sapiens
ctccccctgcagcc

SEQ ID NO: 1872853 - DNA, 16 bp, Homo sapiens
ctccctgaccaccctg

SEQ ID NO: 1872854 - DNA, 12 bp, Homo sapiens
ctccctggagaa

SEQ ID NO: 1872855 - DNA, 14 bp, Homo sapiens
ctccctggagaagg

SEQ ID NO: 1872856 - DNA, 13 bp, Homo sapiens
ctcctatgcttta

SEQ ID NO: 1872857 - DNA, 24 bp, Homo sapiens
ctcctctccccaatccatgcttca

SEQ ID NO: 1872858 - DNA, 22 bp, Homo sapiens
ctcctgtgtcggtcagaacaac

SEQ ID NO: 1872859 - DNA, 18 bp, Homo sapiens
ctcgggatgaaaagccat

SEQ ID NO: 1872860 - DNA, 17 bp, Homo sapiens
ctcggtgatgccttccg

SEQ ID NO: 1872861 - DNA, 12 bp, Homo sapiens
ctcgtgacagcc

SEQ ID NO: 1872862 - DNA, 14 bp, Homo sapiens
ctcgtgacagcctc

SEQ ID NO: 1872863 - DNA, 15 bp, Homo sapiens
ctcgtgacagcctct

SEQ ID NO: 1872864 - DNA, 20 bp, Homo sapiens
ctcgtgacagcctctgactc

SEQ ID NO: 1872865 - DNA, 23 bp, Homo sapiens
ctctagaagcagaaccagctcta

SEQ ID NO: 1872866 - DNA, 15 bp, Homo sapiens
ctctcactaaacttt

SEQ ID NO: 1872867 - DNA, 15 bp, Homo sapiens
ctctccccctgcagc

SEQ ID NO: 1872868 - DNA, 16 bp, Homo sapiens
ctctccccctgcagcc

SEQ ID NO: 1872869 - DNA, 12 bp, Homo sapiens
ctctctctctgt

SEQ ID NO: 1872870 - DNA, 18 bp, Homo sapiens
ctctgatacttttttgaa

SEQ ID NO: 1872871 - DNA, 20 bp, Homo sapiens
ctctgatacttttttgaaat

SEQ ID NO: 1872872 - DNA, 22 bp, Homo sapiens
ctctgatacttttttgaaatca

SEQ ID NO: 1872873 - DNA, 15 bp, Homo sapiens
ctctggacctcggtg

SEQ ID NO: 1872874 - DNA, 19 bp, Homo sapiens
ctctggacctcggtgatgc

SEQ ID NO: 1872875 - DNA, 21 bp, Homo sapiens
ctctggacctcggtgatgcct

SEQ ID NO: 1872876 - DNA, 15 bp, Homo sapiens
ctctggcaaactttt

SEQ ID NO: 1872877 - DNA, 12 bp, Homo sapiens
ctctggcttccc

SEQ ID NO: 1872878 - DNA, 23 bp, Homo sapiens
ctctggcttccctgcccaatcct

SEQ ID NO: 1872879 - DNA, 12 bp, Homo sapiens
ctcttaaaaatc

SEQ ID NO: 1872880 - DNA, 16 bp, Homo sapiens
ctcttaaaaatcttgg

SEQ ID NO: 1872881 - DNA, 14 bp, Homo sapiens
ctcttcggttgtct

SEQ ID NO: 1872882 - DNA, 18 bp, Homo sapiens
ctcttgccccaaatcaca

SEQ ID NO: 1872883 - DNA, 19 bp, Homo sapiens
ctctttgccttgatgttgt

SEQ ID NO: 1872884 - DNA, 15 bp, Homo sapiens
ctgaaaaaaagttta

SEQ ID NO: 1872885 - DNA, 20 bp, Homo sapiens
ctgaaaaaaagtttacaagt

SEQ ID NO: 1872886 - DNA, 16 bp, Homo sapiens
ctgaaaatctaatatt

SEQ ID NO: 1872887 - DNA, 16 bp, Homo sapiens
ctgaaagtcctgcttt

SEQ ID NO: 1872888 - DNA, 18 bp, Homo sapiens
ctgaaagtcctgctttcc

SEQ ID NO: 1872889 - DNA, 14 bp, Homo sapiens
ctgaacaaagagag

SEQ ID NO: 1872890 - DNA, 21 bp, Homo sapiens
ctgaacatttagtaccctgca

SEQ ID NO: 1872891 - DNA, 23 bp, Homo sapiens
ctgaacatttagtaccctgcagg

SEQ ID NO: 1872892 - DNA, 21 bp, Homo sapiens
ctgaagtcaaaccttaagata

SEQ ID NO: 1872893 - DNA, 16 bp, Homo sapiens
ctgaatggcatggaga

SEQ ID NO: 1872894 - DNA, 16 bp, Homo sapiens
ctgaattgagaataag

SEQ ID NO: 1872895 - DNA, 21 bp, Homo sapiens
ctgaattgagaataagaattt

SEQ ID NO: 1872896 - DNA, 17 bp, Homo sapiens
ctgacagcctggggggg

SEQ ID NO: 1872897 - DNA, 13 bp, Homo sapiens
ctgacccagtgag

SEQ ID NO: 1872898 - DNA, 16 bp, Homo sapiens
ctgacctgcccatgtc

SEQ ID NO: 1872899 - DNA, 23 bp, Homo sapiens
ctgacctgcccatgtccagaggg

SEQ ID NO: 1872900 - DNA, 22 bp, Homo sapiens
ctgaggctctgacccagtgaga

SEQ ID NO: 1872901 - DNA, 23 bp, Homo sapiens
ctgaggctctgacccagtgagat

SEQ ID NO: 1872902 - DNA, 13 bp, Homo sapiens
ctgaggttttgaa

SEQ ID NO: 1872903 - DNA, 15 bp, Homo sapiens
ctgaggttttgaata

SEQ ID NO: 1872904 - DNA, 16 bp, Homo sapiens
ctgaggttttgaataa

SEQ ID NO: 1872905 - DNA, 21 bp, Homo sapiens
ctgagtccatgaaaataccat

SEQ ID NO: 1872906 - DNA, 15 bp, Homo sapiens
ctgatacttttttga

SEQ ID NO: 1872907 - DNA, 16 bp, Homo sapiens
ctgatacttttttgaa

SEQ ID NO: 1872908 - DNA, 13 bp, Homo sapiens
ctgatctgtactt

SEQ ID NO: 1872909 - DNA, 14 bp, Homo sapiens
ctgatctgtacttt

SEQ ID NO: 1872910 - DNA, 21 bp, Homo sapiens
ctgatctgtactttgtgttta

SEQ ID NO: 1872911 - DNA, 18 bp, Homo sapiens
ctgattaccagtctgatt

SEQ ID NO: 1872912 - DNA, 17 bp, Homo sapiens
ctgcaagaattaaaact

SEQ ID NO: 1872913 - DNA, 21 bp, Homo sapiens
ctgcaagaattaaaactgagt

SEQ ID NO: 1872914 - DNA, 22 bp, Homo sapiens
ctgcaagaattaaaactgagtc

SEQ ID NO: 1872915 - DNA, 20 bp, Homo sapiens
ctgcaagcatttttccatct

SEQ ID NO: 1872916 - DNA, 18 bp, Homo sapiens
ctgcagccgtgcaggact

SEQ ID NO: 1872917 - DNA, 20 bp, Homo sapiens
ctgcagccgtgcaggactct

SEQ ID NO: 1872918 - DNA, 14 bp, Homo sapiens
ctgcagctttacat

SEQ ID NO: 1872919 - DNA, 21 bp, Homo sapiens
ctgcagctttacatgcaattt

SEQ ID NO: 1872920 - DNA, 16 bp, Homo sapiens
ctgcaggccaggccag

SEQ ID NO: 1872921 - DNA, 17 bp, Homo sapiens
ctgcaggccaggccagc

SEQ ID NO: 1872922 - DNA, 15 bp, Homo sapiens
ctgcatcagcttttt

SEQ ID NO: 1872923 - DNA, 14 bp, Homo sapiens
ctgccaccagcaat

SEQ ID NO: 1872924 - DNA, 22 bp, Homo sapiens
ctgccaccagcaatgccctgcc

SEQ ID NO: 1872925 - DNA, 18 bp, Homo sapiens
ctgcccaatcctccctgg

SEQ ID NO: 1872926 - DNA, 20 bp, Homo sapiens
ctgcccaatcctccctggag

SEQ ID NO: 1872927 - DNA, 22 bp, Homo sapiens
ctgcccaatcctccctggagaa

SEQ ID NO: 1872928 - DNA, 23 bp, Homo sapiens
ctgcccaatcctccctggagaag

SEQ ID NO: 1872929 - DNA, 21 bp, Homo sapiens
gaaagaaaaggcaaaagactg

SEQ ID NO: 1872930 - DNA, 21 bp, Homo sapiens
gaaagaattctattttgctgg

SEQ ID NO: 1872931 - DNA, 17 bp, Homo sapiens
gaaagagaatgaactgt

SEQ ID NO: 1872932 - DNA, 14 bp, Homo sapiens
gaaagtattcagaa

SEQ ID NO: 1872933 - DNA, 18 bp, Homo sapiens
gaaagtattcagaaatta

SEQ ID NO: 1872934 - DNA, 21 bp, Homo sapiens
gaaagtattcagaaattaaaa

SEQ ID NO: 1872935 - DNA, 14 bp, Homo sapiens
gaaagtatttttga

SEQ ID NO: 1872936 - DNA, 17 bp, Homo sapiens
gaaagtcacctacagga

SEQ ID NO: 1872937 - DNA, 20 bp, Homo sapiens
gaaagtcacctacaggactg

SEQ ID NO: 1872938 - DNA, 22 bp, Homo sapiens
gaaagtcacctacaggactggg

SEQ ID NO: 1872939 - DNA, 22 bp, Homo sapiens
gaaatagaggtgatgctgctaa

SEQ ID NO: 1872940 - DNA, 12 bp, Homo sapiens
gaaatcagcatg

SEQ ID NO: 1872941 - DNA, 17 bp, Homo sapiens
gaaatcagcatgacaaa

SEQ ID NO: 1872942 - DNA, 16 bp, Homo sapiens
gaaatcagtaaacact

SEQ ID NO: 1872943 - DNA, 15 bp, Homo sapiens
gaaattagtcttttt

SEQ ID NO: 1872944 - DNA, 19 bp, Homo sapiens
gaaatttattagttaatat

SEQ ID NO: 1872945 - DNA, 20 bp, Homo sapiens
gaaattttctagactttctg

SEQ ID NO: 1872946 - DNA, 21 bp, Homo sapiens
gaaattttctagactttctgt

SEQ ID NO: 1872947 - DNA, 23 bp, Homo sapiens
gaacatttagtaccctgcaggcc

SEQ ID NO: 1872948 - DNA, 21 bp, Homo sapiens
gaaccaagggccctcactcag

SEQ ID NO: 1872949 - DNA, 12 bp, Homo sapiens
gaaccctggaga

SEQ ID NO: 1872950 - DNA, 15 bp, Homo sapiens
gaactgtggaattta

SEQ ID NO: 1872951 - DNA, 20 bp, Homo sapiens
gaacttttgtaatttgaatt

SEQ ID NO: 1872952 - DNA, 13 bp, Homo sapiens
gaagaagttttaa

SEQ ID NO: 1872953 - DNA, 22 bp, Homo sapiens
gaagaatttaatggactgtgaa

SEQ ID NO: 1872954 - DNA, 13 bp, Homo sapiens
gaagacccctgcc

SEQ ID NO: 1872955 - DNA, 14 bp, Homo sapiens
gaagacccctgccc

SEQ ID NO: 1872956 - DNA, 16 bp, Homo sapiens
gaagacccctgcccaa

SEQ ID NO: 1872957 - DNA, 19 bp, Homo sapiens
gaagagaggggaagaattt

SEQ ID NO: 1872958 - DNA, 22 bp, Homo sapiens
gaagagaggggaagaatttaat

SEQ ID NO: 1872959 - DNA, 13 bp, Homo sapiens
gaagatgggggct

SEQ ID NO: 1872960 - DNA, 16 bp, Homo sapiens
gaagatgggggctgga

SEQ ID NO: 1872961 - DNA, 17 bp, Homo sapiens
gaagcaatttatatctt

SEQ ID NO: 1872962 - DNA, 18 bp, Homo sapiens
gaagcagaaccagctcta

SEQ ID NO: 1872963 - DNA, 15 bp, Homo sapiens
gaagcttcagaagtt

SEQ ID NO: 1872964 - DNA, 14 bp, Homo sapiens
gaaggccagcccac

SEQ ID NO: 1872965 - DNA, 18 bp, Homo sapiens
gaaggccagcccactggg

SEQ ID NO: 1872966 - DNA, 22 bp, Homo sapiens
gaagggaacccccaaatttaat

SEQ ID NO: 1872967 - DNA, 19 bp, Homo sapiens
gaagtcaaaccttaagata

SEQ ID NO: 1872968 - DNA, 18 bp, Homo sapiens
gaagtcgagcactctaat

SEQ ID NO: 1872969 - DNA, 22 bp, Homo sapiens
gaagtgcagcgggccaggcagg

SEQ ID NO: 1872970 - DNA, 15 bp, Homo sapiens
gaataaatggtttct

SEQ ID NO: 1872971 - DNA, 17 bp, Homo sapiens
gaatgaactgtggaatt

SEQ ID NO: 1872972 - DNA, 21 bp, Homo sapiens
gaatgaactgtggaatttatt

SEQ ID NO: 1872973 - DNA, 16 bp, Homo sapiens
gaatgacaacagaagc

SEQ ID NO: 1872974 - DNA, 14 bp, Homo sapiens
gaatgatttttaga

SEQ ID NO: 1872975 - DNA, 16 bp, Homo sapiens
gaatgatttttagatg

SEQ ID NO: 1872976 - DNA, 14 bp, Homo sapiens
gaatgcattaaaaa

SEQ ID NO: 1872977 - DNA, 14 bp, Homo sapiens
gaatgccataaaat

SEQ ID NO: 1872978 - DNA, 22 bp, Homo sapiens
gaatgcctgtcccagtccaaat

SEQ ID NO: 1872979 - DNA, 14 bp, Homo sapiens
gaattctattttgc

SEQ ID NO: 1872980 - DNA, 12 bp, Homo sapiens
gaattctgactt

SEQ ID NO: 1872981 - DNA, 20 bp, Homo sapiens
gaattgcccattgtttttct

SEQ ID NO: 1872982 - DNA, 21 bp, Homo sapiens
gaattgcccattgtttttctg

SEQ ID NO: 1872983 - DNA, 16 bp, Homo sapiens
gaattgttatgaaaat

SEQ ID NO: 1872984 - DNA, 23 bp, Homo sapiens
gaatttaatggactgtgaatttc

SEQ ID NO: 1872985 - DNA, 13 bp, Homo sapiens
gaatttattggca

SEQ ID NO: 1872986 - DNA, 19 bp, Homo sapiens
gaatttcttcactgttgaa

SEQ ID NO: 1872987 - DNA, 18 bp, Homo sapiens
gacaaacctagcttttaa

SEQ ID NO: 1872988 - DNA, 19 bp, Homo sapiens
gacaaacctagcttttaaa

SEQ ID NO: 1872989 - DNA, 22 bp, Homo sapiens
gacaaacctagcttttaaaaaa

SEQ ID NO: 1872990 - DNA, 15 bp, Homo sapiens
gacaacgtgctgctt

SEQ ID NO: 1872991 - DNA, 23 bp, Homo sapiens
gacacatgctgaggttttgaata

SEQ ID NO: 1872992 - DNA, 15 bp, Homo sapiens
gacacctacagcagc

SEQ ID NO: 1872993 - DNA, 17 bp, Homo sapiens
gacacctacagcagcac

SEQ ID NO: 1872994 - DNA, 13 bp, Homo sapiens
gacagccagggca

SEQ ID NO: 1872995 - DNA, 18 bp, Homo sapiens
gacagccagggcagggct

SEQ ID NO: 1872996 - DNA, 15 bp, Homo sapiens
gacagtggcactaaa

SEQ ID NO: 1872997 - DNA, 12 bp, Homo sapiens
gacataaaactt

SEQ ID NO: 1872998 - DNA, 16 bp, Homo sapiens
gacataaaactttaaa

SEQ ID NO: 1872999 - DNA, 21 bp, Homo sapiens
gacataaaactttaaaaggca

SEQ ID NO: 1873000 - DNA, 16 bp, Homo sapiens
gacatctgcctgtaat

SEQ ID NO: 1873001 - DNA, 15 bp, Homo sapiens
gacatgttatatatt

SEQ ID NO: 1873002 - DNA, 13 bp, Homo sapiens
gacattgtaaacg

SEQ ID NO: 1873003 - DNA, 20 bp, Homo sapiens
gaccactagctaagcaagcc

SEQ ID NO: 1873004 - DNA, 19 bp, Homo sapiens
gacccacctgggccaagga

SEQ ID NO: 1873005 - DNA, 22 bp, Homo sapiens
gacccacctgggccaaggactc

SEQ ID NO: 1873006 - DNA, 22 bp, Homo sapiens
gacccagtgagattacagagga

SEQ ID NO: 1873007 - DNA, 11 bp, Homo sapiens
gacccctgccc

SEQ ID NO: 1873008 - DNA, 14 bp, Homo sapiens
gacccctgcccaag

SEQ ID NO: 1873009 - DNA, 16 bp, Homo sapiens
gaccggccgcagcccc

SEQ ID NO: 1873010 - DNA, 18 bp, Homo sapiens
gaccggccgcagccccca

SEQ ID NO: 1873011 - DNA, 22 bp, Homo sapiens
gaccggccgcagcccccactga

SEQ ID NO: 1873012 - DNA, 23 bp, Homo sapiens
gaccggccgcagcccccactgac

SEQ ID NO: 1873013 - DNA, 18 bp, Homo sapiens
gaccgttttgtattgctt

SEQ ID NO: 1873014 - DNA, 22 bp, Homo sapiens
gacctgttaggtctcatgccca

SEQ ID NO: 1873015 - DNA, 20 bp, Homo sapiens
gactaacgaacgttttaaag

SEQ ID NO: 1873016 - DNA, 18 bp, Homo sapiens
gactaatttaaaaaataa

SEQ ID NO: 1873017 - DNA, 12 bp, Homo sapiens
gactggacagcc

SEQ ID NO: 1873018 - DNA, 20 bp, Homo sapiens
gactgggccgggcccagggc

SEQ ID NO: 1873019 - DNA, 22 bp, Homo sapiens
gactgtcaaatgaacttttaca

SEQ ID NO: 1873020 - DNA, 14 bp, Homo sapiens
gacttagtttttat

SEQ ID NO: 1873021 - DNA, 17 bp, Homo sapiens
gacttgcggccacagca

SEQ ID NO: 1873022 - DNA, 12 bp, Homo sapiens
gactttgctgtt

SEQ ID NO: 1873023 - DNA, 15 bp, Homo sapiens
gagaaagaaaaggca

SEQ ID NO: 1873024 - DNA, 18 bp, Homo sapiens
gagaaagaaaaggcaaaa

SEQ ID NO: 1873025 - DNA, 11 bp, Homo sapiens
gagaaattatt

SEQ ID NO: 1873026 - DNA, 14 bp, Homo sapiens
gagaagacccctgc

SEQ ID NO: 1873027 - DNA, 16 bp, Homo sapiens
gagaagacccctgccc

SEQ ID NO: 1873028 - DNA, 15 bp, Homo sapiens
gagaagggacatggg

SEQ ID NO: 1873029 - DNA, 13 bp, Homo sapiens
gagaatgaactgt

SEQ ID NO: 1873030 - DNA, 22 bp, Homo sapiens
gagacttttaatcagacaaagt

SEQ ID NO: 1873031 - DNA, 17 bp, Homo sapiens
gagattggatttgctgt

SEQ ID NO: 1873032 - DNA, 21 bp, Homo sapiens
gagcactctaattagagaact

SEQ ID NO: 1873033 - DNA, 15 bp, Homo sapiens
gagcagcccacccag

SEQ ID NO: 1873034 - DNA, 18 bp, Homo sapiens
gagcagcccacccagcag

SEQ ID NO: 1873035 - DNA, 19 bp, Homo sapiens
gagcagcccacccagcaga

SEQ ID NO: 1873036 - DNA, 21 bp, Homo sapiens
gagcagcccacccagcagaaa

SEQ ID NO: 1873037 - DNA, 13 bp, Homo sapiens
gagcagcccccaa

SEQ ID NO: 1873038 - DNA, 17 bp, Homo sapiens
gagcagctggcactgac

SEQ ID NO: 1873039 - DNA, 21 bp, Homo sapiens
gagcattaactaaatgctcat

SEQ ID NO: 1873040 - DNA, 14 bp, Homo sapiens
gagctacaaagcat

SEQ ID NO: 1873041 - DNA, 22 bp, Homo sapiens
gagctacaaagcatgggaaaaa

SEQ ID NO: 1873042 - DNA, 23 bp, Homo sapiens
gagctcctgctcattgtggccag

SEQ ID NO: 1873043 - DNA, 14 bp, Homo sapiens
gagctgtggctggg

SEQ ID NO: 1873044 - DNA, 15 bp, Homo sapiens
gagcttgtagccctg

SEQ ID NO: 1873045 - DNA, 18 bp, Homo sapiens
ggctccctgaccaccctg

SEQ ID NO: 1873046 - DNA, 22 bp, Homo sapiens
ggctccctgaccaccctgcctg

SEQ ID NO: 1873047 - DNA, 18 bp, Homo sapiens
ggctggagggggcagagt

SEQ ID NO: 1873048 - DNA, 17 bp, Homo sapiens
ggctgtcttctcccaga

SEQ ID NO: 1873049 - DNA, 22 bp, Homo sapiens
ggctgtcttctcccagagcaca

SEQ ID NO: 1873050 - DNA, 18 bp, Homo sapiens
ggcttcttaaaaactgtg

SEQ ID NO: 1873051 - DNA, 11 bp, Homo sapiens
ggcttgctgtt

SEQ ID NO: 1873052 - DNA, 18 bp, Homo sapiens
ggctttacaaataatttt

SEQ ID NO: 1873053 - DNA, 14 bp, Homo sapiens
gggaaaaagagact

SEQ ID NO: 1873054 - DNA, 15 bp, Homo sapiens
gggaaaaagagactc

SEQ ID NO: 1873055 - DNA, 18 bp, Homo sapiens
gggaaacctgtgaaagct

SEQ ID NO: 1873056 - DNA, 20 bp, Homo sapiens
gggaaagtatttttgaaaga

SEQ ID NO: 1873057 - DNA, 22 bp, Homo sapiens
gggaacccccaaatttaattaa

SEQ ID NO: 1873058 - DNA, 21 bp, Homo sapiens
gggactggacagccagggcag

SEQ ID NO: 1873059 - DNA, 22 bp, Homo sapiens
gggaggagggccgagacaggag

SEQ ID NO: 1873060 - DNA, 21 bp, Homo sapiens
gggaggccatttgctgccctg

SEQ ID NO: 1873061 - DNA, 15 bp, Homo sapiens
gggatgaaaagccat

SEQ ID NO: 1873062 - DNA, 15 bp, Homo sapiens
gggatgacggccagg

SEQ ID NO: 1873063 - DNA, 22 bp, Homo sapiens
gggcaactcgtgacagcctctg

SEQ ID NO: 1873064 - DNA, 19 bp, Homo sapiens
gggcagagcttgtagccct

SEQ ID NO: 1873065 - DNA, 22 bp, Homo sapiens
gggcagagcttgtagccctgga

SEQ ID NO: 1873066 - DNA, 21 bp, Homo sapiens
gggcagagtggcctgtgagca

SEQ ID NO: 1873067 - DNA, 15 bp, Homo sapiens
gggcccagggcctct

SEQ ID NO: 1873068 - DNA, 14 bp, Homo sapiens
gggccctcactcag

SEQ ID NO: 1873069 - DNA, 17 bp, Homo sapiens
gggccctcactcaggaa

SEQ ID NO: 1873070 - DNA, 12 bp, Homo sapiens
gggccctggggc

SEQ ID NO: 1873071 - DNA, 19 bp, Homo sapiens
gggccctggggctgccctc

SEQ ID NO: 1873072 - DNA, 20 bp, Homo sapiens
gggccgctctccccctgcag

SEQ ID NO: 1873073 - DNA, 14 bp, Homo sapiens
gggccgggcccagg

SEQ ID NO: 1873074 - DNA, 20 bp, Homo sapiens
gggccgggcccagggcctct

SEQ ID NO: 1873075 - DNA, 14 bp, Homo sapiens
gggcctctggcttc

SEQ ID NO: 1873076 - DNA, 23 bp, Homo sapiens
gggcctctggcttccctgcccaa

SEQ ID NO: 1873077 - DNA, 11 bp, Homo sapiens
gggctgccctc

SEQ ID NO: 1873078 - DNA, 22 bp, Homo sapiens
gggctgccctcggcaaccgtgg

SEQ ID NO: 1873079 - DNA, 21 bp, Homo sapiens
ggggaggccatttgctgccct

SEQ ID NO: 1873080 - DNA, 22 bp, Homo sapiens
ggggaggccatttgctgccctg

SEQ ID NO: 1873081 - DNA, 17 bp, Homo sapiens
ggggcactagaagatga

SEQ ID NO: 1873082 - DNA, 17 bp, Homo sapiens
ggggcagagtggcctgt

SEQ ID NO: 1873083 - DNA, 22 bp, Homo sapiens
ggggccgctctccccctgcagc

SEQ ID NO: 1873084 - DNA, 12 bp, Homo sapiens
ggtaaatttttg

SEQ ID NO: 1873085 - DNA, 16 bp, Homo sapiens
ggtaaatttttgaaaa

SEQ ID NO: 1873086 - DNA, 21 bp, Homo sapiens
ggtaaatttttgaaaaatatt

SEQ ID NO: 1873087 - DNA, 22 bp, Homo sapiens
ggtatcgttcgcttgttttaaa

SEQ ID NO: 1873088 - DNA, 17 bp, Homo sapiens
ggtcatggagcagcccc

SEQ ID NO: 1873089 - DNA, 23 bp, Homo sapiens
ggtgaaatttattagttaatata

SEQ ID NO: 1873090 - DNA, 22 bp, Homo sapiens
ggtgcacagtaatatgaaagcc

SEQ ID NO: 1873091 - DNA, 23 bp, Homo sapiens
ggtgtcatttgacaacacatgtg

SEQ ID NO: 1873092 - DNA, 11 bp, Homo sapiens
ggttccaaacc

SEQ ID NO: 1873093 - DNA, 18 bp, Homo sapiens
ggttccaaaccagtttat

SEQ ID NO: 1873094 - DNA, 14 bp, Homo sapiens
ggttctataataag

SEQ ID NO: 1873095 - DNA, 20 bp, Homo sapiens
ggtttctgatctgtactttg

SEQ ID NO: 1873096 - DNA, 16 bp, Homo sapiens
ggtttggtacagttca

SEQ ID NO: 1873097 - DNA, 14 bp, Homo sapiens
ggtttgtttgctta

SEQ ID NO: 1873098 - DNA, 13 bp, Homo sapiens
gtaaaagttataa

SEQ ID NO: 1873099 - DNA, 11 bp, Homo sapiens
gtaaacactgt

SEQ ID NO: 1873100 - DNA, 16 bp, Homo sapiens
gtaaagtatgtaaaca

SEQ ID NO: 1873101 - DNA, 21 bp, Homo sapiens
gtaaatgaacacatggcagaa

SEQ ID NO: 1873102 - DNA, 16 bp, Homo sapiens
gtaaatgagacacata

SEQ ID NO: 1873103 - DNA, 12 bp, Homo sapiens
gtaaatttttga

SEQ ID NO: 1873104 - DNA, 17 bp, Homo sapiens
gtaacgtgattgattca

SEQ ID NO: 1873105 - DNA, 14 bp, Homo sapiens
gtaactatgtttta

SEQ ID NO: 1873106 - DNA, 19 bp, Homo sapiens
gtaagaaagccaccttgtt

SEQ ID NO: 1873107 - DNA, 12 bp, Homo sapiens
gtaagtcttttt

SEQ ID NO: 1873108 - DNA, 20 bp, Homo sapiens
gtaagtcttttttttttcca

SEQ ID NO: 1873109 - DNA, 13 bp, Homo sapiens
gtaataaatacac

SEQ ID NO: 1873110 - DNA, 23 bp, Homo sapiens
gtaattaataatagattgtgaat

SEQ ID NO: 1873111 - DNA, 21 bp, Homo sapiens
gtaattcctctcactaaactt

SEQ ID NO: 1873112 - DNA, 13 bp, Homo sapiens
gtaatttgaattg

SEQ ID NO: 1873113 - DNA, 18 bp, Homo sapiens
gtacagctgtttaagatg

SEQ ID NO: 1873114 - DNA, 19 bp, Homo sapiens
gtacagttcataattcacc

SEQ ID NO: 1873115 - DNA, 16 bp, Homo sapiens
gtacattactgtatgt

SEQ ID NO: 1873116 - DNA, 17 bp, Homo sapiens
gtaccctgcaggccagg

SEQ ID NO: 1873117 - DNA, 18 bp, Homo sapiens
gtactatctttgtctaaa

SEQ ID NO: 1873118 - DNA, 12 bp, Homo sapiens
gtacttaaatga

SEQ ID NO: 1873119 - DNA, 19 bp, Homo sapiens
gtacttaaatgagttactt

SEQ ID NO: 1873120 - DNA, 11 bp, Homo sapiens
gtacttttctg

SEQ ID NO: 1873121 - DNA, 17 bp, Homo sapiens
gtacttttctggttcca

SEQ ID NO: 1873122 - DNA, 21 bp, Homo sapiens
gtagaaagacatctgcctgta

SEQ ID NO: 1873123 - DNA, 21 bp, Homo sapiens
gtagccctggatggcctctgg

SEQ ID NO: 1873124 - DNA, 14 bp, Homo sapiens
gtagccctttctgt

SEQ ID NO: 1873125 - DNA, 17 bp, Homo sapiens
gtagctttcccaaataa

SEQ ID NO: 1873126 - DNA, 17 bp, Homo sapiens
gtaggttttaaaaataa

SEQ ID NO: 1873127 - DNA, 20 bp, Homo sapiens
gtaggttttaaaaataagtt

SEQ ID NO: 1873128 - DNA, 23 bp, Homo sapiens
gtaggttttaaaaataagtttta

SEQ ID NO: 1873129 - DNA, 18 bp, Homo sapiens
gtagtttttaattaaaaa

SEQ ID NO: 1873130 - DNA, 12 bp, Homo sapiens
gtataaaaagga

SEQ ID NO: 1873131 - DNA, 21 bp, Homo sapiens
gtataaaaaggaaattagtct

SEQ ID NO: 1873132 - DNA, 19 bp, Homo sapiens
gtataatctcctctgctca

SEQ ID NO: 1873133 - DNA, 12 bp, Homo sapiens
gtatactgtaaa

SEQ ID NO: 1873134 - DNA, 17 bp, Homo sapiens
gtatactgtaaaagtta

SEQ ID NO: 1873135 - DNA, 18 bp, Homo sapiens
gtatactgtaaaagttat

SEQ ID NO: 1873136 - DNA, 19 bp, Homo sapiens
gtatatgtgagaaatcaga

SEQ ID NO: 1873137 - DNA, 20 bp, Homo sapiens
gtatcccccccctgtatagt

SEQ ID NO: 1873138 - DNA, 14 bp, Homo sapiens
gtatctattgtgtt

SEQ ID NO: 1873139 - DNA, 18 bp, Homo sapiens
gtatctattgtgttggct

SEQ ID NO: 1873140 - DNA, 23 bp, Homo sapiens
gtatcttagagtttacagtttgt

SEQ ID NO: 1873141 - DNA, 19 bp, Homo sapiens
gtatgattttgatgcacaa

SEQ ID NO: 1873142 - DNA, 14 bp, Homo sapiens
gtatgtaaacagga

SEQ ID NO: 1873143 - DNA, 21 bp, Homo sapiens
gtatgtataaattatgaagga

SEQ ID NO: 1873144 - DNA, 23 bp, Homo sapiens
atttctattcaaggtggccaaat

SEQ ID NO: 1873145 - DNA, 13 bp, Homo sapiens
atttctgtatact

SEQ ID NO: 1873146 - DNA, 16 bp, Homo sapiens
atttctgtatactgta

SEQ ID NO: 1873147 - DNA, 18 bp, Homo sapiens
atttctgtatactgtaaa

SEQ ID NO: 1873148 - DNA, 21 bp, Homo sapiens
atttctgtatactgtaaaagt

SEQ ID NO: 1873149 - DNA, 22 bp, Homo sapiens
atttctgtatactgtaaaagtt

SEQ ID NO: 1873150 - DNA, 13 bp, Homo sapiens
atttcttcactgt

SEQ ID NO: 1873151 - DNA, 22 bp, Homo sapiens
atttctttgtagaataaatggt

SEQ ID NO: 1873152 - DNA, 16 bp, Homo sapiens
atttgaattgggtccc

SEQ ID NO: 1873153 - DNA, 13 bp, Homo sapiens
atttgatctttgt

SEQ ID NO: 1873154 - DNA, 20 bp, Homo sapiens
atttgatctttgtttaaatg

SEQ ID NO: 1873155 - DNA, 19 bp, Homo sapiens
atttgcaaaccctttgtat

SEQ ID NO: 1873156 - DNA, 22 bp, Homo sapiens
atttgcaaaccctttgtattat

SEQ ID NO: 1873157 - DNA, 15 bp, Homo sapiens
atttgctgccctggg

SEQ ID NO: 1873158 - DNA, 13 bp, Homo sapiens
atttggcttgctg

SEQ ID NO: 1873159 - DNA, 15 bp, Homo sapiens
atttggcttgctgtt

SEQ ID NO: 1873160 - DNA, 22 bp, Homo sapiens
atttggggattcagatttctct

SEQ ID NO: 1873161 - DNA, 17 bp, Homo sapiens
atttgttattttcagta

SEQ ID NO: 1873162 - DNA, 12 bp, Homo sapiens
attttaagaaag

SEQ ID NO: 1873163 - DNA, 12 bp, Homo sapiens
attttacagtct

SEQ ID NO: 1873164 - DNA, 20 bp, Homo sapiens
attttacagtctctgttgta

SEQ ID NO: 1873165 - DNA, 11 bp, Homo sapiens
attttagaaaa

SEQ ID NO: 1873166 - DNA, 19 bp, Homo sapiens
attttagaaaatcagattt

SEQ ID NO: 1873167 - DNA, 13 bp, Homo sapiens
attttcacagatg

SEQ ID NO: 1873168 - DNA, 16 bp, Homo sapiens
attttcattgtgattt

SEQ ID NO: 1873169 - DNA, 14 bp, Homo sapiens
attttcatttctaa

SEQ ID NO: 1873170 - DNA, 17 bp, Homo sapiens
attttccagccttatgt

SEQ ID NO: 1873171 - DNA, 20 bp, Homo sapiens
attttccagccttatgtgtt

SEQ ID NO: 1873172 - DNA, 23 bp, Homo sapiens
attttccccgtgacattcactgg

SEQ ID NO: 1873173 - DNA, 14 bp, Homo sapiens
attttcccttttta

SEQ ID NO: 1873174 - DNA, 18 bp, Homo sapiens
attttctagactttctgt

SEQ ID NO: 1873175 - DNA, 13 bp, Homo sapiens
attttctcctgtg

SEQ ID NO: 1873176 - DNA, 14 bp, Homo sapiens
attttctcctgtgg

SEQ ID NO: 1873177 - DNA, 17 bp, Homo sapiens
attttctctgatacttt

SEQ ID NO: 1873178 - DNA, 19 bp, Homo sapiens
attttctctgatacttttt

SEQ ID NO: 1873179 - DNA, 18 bp, Homo sapiens
attttgagtggcaaaata

SEQ ID NO: 1873180 - DNA, 17 bp, Homo sapiens
attttgatattttcaca

SEQ ID NO: 1873181 - DNA, 12 bp, Homo sapiens
atttttaaaagg

SEQ ID NO: 1873182 - DNA, 20 bp, Homo sapiens
atttttaaaaggtaggtttt

SEQ ID NO: 1873183 - DNA, 15 bp, Homo sapiens
atttttatcaggatt

SEQ ID NO: 1873184 - DNA, 16 bp, Homo sapiens
atttttgaaaaatatt

SEQ ID NO: 1873185 - DNA, 17 bp, Homo sapiens
atttttgaaaaatattg

SEQ ID NO: 1873186 - DNA, 18 bp, Homo sapiens
atttttgaaaaatattgc

SEQ ID NO: 1873187 - DNA, 16 bp, Homo sapiens
atttttgtaccatatt

SEQ ID NO: 1873188 - DNA, 16 bp, Homo sapiens
atttttgtataaaaag

SEQ ID NO: 1873189 - DNA, 17 bp, Homo sapiens
atttttgtataaaaagg

SEQ ID NO: 1873190 - DNA, 18 bp, Homo sapiens
atttttgtataaaaagga

SEQ ID NO: 1873191 - DNA, 22 bp, Homo sapiens
atttttgtataaaaaggaaatt

SEQ ID NO: 1873192 - DNA, 14 bp, Homo sapiens
attttttgcagtct

SEQ ID NO: 1873193 - DNA, 14 bp, Homo sapiens
atttttttaaacaa

SEQ ID NO: 1873194 - DNA, 16 bp, Homo sapiens
atttttttttgtaaag

SEQ ID NO: 1873195 - DNA, 16 bp, Homo sapiens
taagtactatctttgt

SEQ ID NO: 1873196 - DNA, 16 bp, Homo sapiens
taagtctacattaaac

SEQ ID NO: 1873197 - DNA, 18 bp, Homo sapiens
taagtggttttaataaaa

SEQ ID NO: 1873198 - DNA, 13 bp, Homo sapiens
taagttttataca

SEQ ID NO: 1873199 - DNA, 14 bp, Homo sapiens
taataactgaactg

SEQ ID NO: 1873200 - DNA, 16 bp, Homo sapiens
taataactgaactgtt

SEQ ID NO: 1873201 - DNA, 19 bp, Homo sapiens
taataagttttgatataat

SEQ ID NO: 1873202 - DNA, 20 bp, Homo sapiens
taataagttttgatataatc

SEQ ID NO: 1873203 - DNA, 20 bp, Homo sapiens
taatacactaattcctttct

SEQ ID NO: 1873204 - DNA, 21 bp, Homo sapiens
atgcaaactgctttattttcc

SEQ ID NO: 1873205 - DNA, 19 bp, Homo sapiens
atgcaacttgattcttgtg

SEQ ID NO: 1873206 - DNA, 19 bp, Homo sapiens
atgcaatttattaaaatga

SEQ ID NO: 1873207 - DNA, 16 bp, Homo sapiens
atgcaggcaacattac

SEQ ID NO: 1873208 - DNA, 19 bp, Homo sapiens
atgcatgtaatcaacatgg

SEQ ID NO: 1873209 - DNA, 14 bp, Homo sapiens
atgcattaaaaaaa

SEQ ID NO: 1873210 - DNA, 17 bp, Homo sapiens
atgcccactcccccagg

SEQ ID NO: 1873211 - DNA, 11 bp, Homo sapiens
atgccctgcct

SEQ ID NO: 1873212 - DNA, 14 bp, Homo sapiens
atgccctgccttgc

SEQ ID NO: 1873213 - DNA, 15 bp, Homo sapiens
atgccctgccttgct

SEQ ID NO: 1873214 - DNA, 16 bp, Homo sapiens
atgccctgccttgctg

SEQ ID NO: 1873215 - DNA, 16 bp, Homo sapiens
atgccttccgacacca

SEQ ID NO: 1873216 - DNA, 12 bp, Homo sapiens
atgctcatgtat

SEQ ID NO: 1873217 - DNA, 15 bp, Homo sapiens
atgctgaggttttga

SEQ ID NO: 1873218 - DNA, 17 bp, Homo sapiens
atgctgaggttttgaat

SEQ ID NO: 1873219 - DNA, 18 bp, Homo sapiens
atgctgaggttttgaata

SEQ ID NO: 1873220 - DNA, 21 bp, Homo sapiens
atgctgaggttttgaataaaa

SEQ ID NO: 1873221 - DNA, 22 bp, Homo sapiens
atgctggacattaacaagatca

SEQ ID NO: 1873222 - DNA, 17 bp, Homo sapiens
atgctgtactaaaatat

SEQ ID NO: 1873223 - DNA, 12 bp, Homo sapiens
atgctgtatttc

SEQ ID NO: 1873224 - DNA, 17 bp, Homo sapiens
atgctgtatttctttgt

SEQ ID NO: 1873225 - DNA, 14 bp, Homo sapiens
atgctttagcttat

SEQ ID NO: 1873226 - DNA, 15 bp, Homo sapiens
atgctttagcttatt

SEQ ID NO: 1873227 - DNA, 16 bp, Homo sapiens
atgctttttgaatgtt

SEQ ID NO: 1873228 - DNA, 23 bp, Homo sapiens
atggaaacctgaaaaaaagttta

SEQ ID NO: 1873229 - DNA, 16 bp, Homo sapiens
atggaaacgcacttac

SEQ ID NO: 1873230 - DNA, 19 bp, Homo sapiens
atggaacttctaatatatt

SEQ ID NO: 1873231 - DNA, 20 bp, Homo sapiens
atggaagaagttttaactat

SEQ ID NO: 1873232 - DNA, 17 bp, Homo sapiens
atggactgtgaatttca

SEQ ID NO: 1873233 - DNA, 22 bp, Homo sapiens
atggagaaagtaagtctttttt

SEQ ID NO: 1873234 - DNA, 17 bp, Homo sapiens
atggagactttgctgtt

SEQ ID NO: 1873235 - DNA, 14 bp, Homo sapiens
atggagcagccccc

SEQ ID NO: 1873236 - DNA, 15 bp, Homo sapiens
atggagcagccccca

SEQ ID NO: 1873237 - DNA, 23 bp, Homo sapiens
atggagcagcccccaaagagctg

SEQ ID NO: 1873238 - DNA, 20 bp, Homo sapiens
atggcacttagctatcagaa

SEQ ID NO: 1873239 - DNA, 22 bp, Homo sapiens
atggcacttagctatcagaaga

SEQ ID NO: 1873240 - DNA, 14 bp, Homo sapiens
atggcctctggggc

SEQ ID NO: 1873241 - DNA, 22 bp, Homo sapiens
atggcctctggggcaggaccac

SEQ ID NO: 1873242 - DNA, 17 bp, Homo sapiens
atggctacttgctttga

SEQ ID NO: 1873243 - DNA, 20 bp, Homo sapiens
atggcttacttacaaaagca

SEQ ID NO: 1873244 - DNA, 12 bp, Homo sapiens
atggcttttctc

SEQ ID NO: 1873245 - DNA, 16 bp, Homo sapiens
atgggaaaaagagact

SEQ ID NO: 1873246 - DNA, 23 bp, Homo sapiens
atgggagagtagatggtgaaatt

SEQ ID NO: 1873247 - DNA, 23 bp, Homo sapiens
atgggcaactcgtgacagcctct

SEQ ID NO: 1873248 - DNA, 24 bp, Homo sapiens
atgggcaactcgtgacagcctctg

SEQ ID NO: 1873249 - DNA, 15 bp, Homo sapiens
atggggcgctggaca

SEQ ID NO: 1873250 - DNA, 14 bp, Homo sapiens
atggtatccagaat

SEQ ID NO: 1873251 - DNA, 14 bp, Homo sapiens
atggtctcagaaac

SEQ ID NO: 1873252 - DNA, 15 bp, Homo sapiens
atggttgccttaaag

SEQ ID NO: 1873253 - DNA, 14 bp, Homo sapiens
atgtaaacaggaga

SEQ ID NO: 1873254 - DNA, 12 bp, Homo sapiens
atgtaaatagtg

SEQ ID NO: 1873255 - DNA, 21 bp, Homo sapiens
atgtatataatcatgctcatg

SEQ ID NO: 1873256 - DNA, 19 bp, Homo sapiens
atgtatctttggggaaact

SEQ ID NO: 1873257 - DNA, 20 bp, Homo sapiens
atgtatggcttttctcttgc

SEQ ID NO: 1873258 - DNA, 23 bp, Homo sapiens
atgtcagacatccatgtttgtaa

SEQ ID NO: 1873259 - DNA, 15 bp, Homo sapiens
atgtctgtctttgca

SEQ ID NO: 1873260 - DNA, 13 bp, Homo sapiens
atgtgactttgaa

SEQ ID NO: 1873261 - DNA, 21 bp, Homo sapiens
atgtgactttgaaaatatata

SEQ ID NO: 1873262 - DNA, 19 bp, Homo sapiens
atgtgagaaatcagaattg

SEQ ID NO: 1873263 - DNA, 14 bp, Homo sapiens
atgtgctgctttga

SEQ ID NO: 1873264 - DNA, 16 bp, Homo sapiens
atgtgctgctttgata

SEQ ID NO: 1873265 - DNA, 13 bp, Homo sapiens
atgtggtttatag

SEQ ID NO: 1873266 - DNA, 19 bp, Homo sapiens
atgtggtttatagagggcc

SEQ ID NO: 1873267 - DNA, 15 bp, Homo sapiens
atgtgttacattatt

SEQ ID NO: 1873268 - DNA, 21 bp, Homo sapiens
atgttacaagtttgctaaaag

SEQ ID NO: 1873269 - DNA, 22 bp, Homo sapiens
atgttatttgttattttcagta

SEQ ID NO: 1873270 - DNA, 17 bp, Homo sapiens
atgttcctgttcctcgg

SEQ ID NO: 1873271 - DNA, 22 bp, Homo sapiens
atgttctgcaagaattaaaact

SEQ ID NO: 1873272 - DNA, 15 bp, Homo sapiens
atgtttcttctccaa

SEQ ID NO: 1873273 - DNA, 17 bp, Homo sapiens
atgtttggtaccaagaa

SEQ ID NO: 1873274 - DNA, 14 bp, Homo sapiens
atgtttgtaaaact

SEQ ID NO: 1873275 - DNA, 21 bp, Homo sapiens
atgtttgtctgtgtgctgtaa

SEQ ID NO: 1873276 - DNA, 21 bp, Homo sapiens
attaaaaaaaaaaaaaaactc

SEQ ID NO: 1873277 - DNA, 17 bp, Homo sapiens
attaaaaaaacacaaaa

SEQ ID NO: 1873278 - DNA, 13 bp, Homo sapiens
attaaaaacttta

SEQ ID NO: 1873279 - DNA, 21 bp, Homo sapiens
attaaaactgagtccatgaaa

SEQ ID NO: 1873280 - DNA, 11 bp, Homo sapiens
attaaaatata

SEQ ID NO: 1873281 - DNA, 15 bp, Homo sapiens
attaaaatatatgtt

SEQ ID NO: 1873282 - DNA, 18 bp, Homo sapiens
attaatattcttttgtta

SEQ ID NO: 1873283 - DNA, 23 bp, Homo sapiens
attaatcaatcatctgtgtgaaa

SEQ ID NO: 1873284 - DNA, 17 bp, Homo sapiens
attaatcttttaaaaat

SEQ ID NO: 1873285 - DNA, 18 bp, Homo sapiens
attaattagatcaacact

SEQ ID NO: 1873286 - DNA, 16 bp, Homo sapiens
attaattgtcctgtgt

SEQ ID NO: 1873287 - DNA, 23 bp, Homo sapiens
attaattgtcctgtgtctatgta

SEQ ID NO: 1873288 - DNA, 23 bp, Homo sapiens
attaatttttgtactttgcttct

SEQ ID NO: 1873289 - DNA, 15 bp, Homo sapiens
attacaataaatcct

SEQ ID NO: 1873290 - DNA, 18 bp, Homo sapiens
attaccttgtctttcaaa

SEQ ID NO: 1873291 - DNA, 14 bp, Homo sapiens
attagatcaacact

SEQ ID NO: 1873292 - DNA, 23 bp, Homo sapiens
attagggaaaatggatatagaaa

SEQ ID NO: 1873293 - DNA, 14 bp, Homo sapiens
attagttaatatat

SEQ ID NO: 1873294 - DNA, 23 bp, Homo sapiens
attagtttaaaatgaagcaattt

SEQ ID NO: 1873295 - DNA, 13 bp, Homo sapiens
attataattgttg

SEQ ID NO: 1873296 - DNA, 13 bp, Homo sapiens
attatataggttg

SEQ ID NO: 1873297 - DNA, 23 bp, Homo sapiens
attatataggttgtgcaaattaa

SEQ ID NO: 1873298 - DNA, 14 bp, Homo sapiens
attatgaaggacct

SEQ ID NO: 1873299 - DNA, 16 bp, Homo sapiens
attattaatgctttgg

SEQ ID NO: 1873300 - DNA, 13 bp, Homo sapiens
attattaattgtc

SEQ ID NO: 1873301 - DNA, 15 bp, Homo sapiens
attatttgatatctg

SEQ ID NO: 1873302 - DNA, 18 bp, Homo sapiens
attatttgtgtaatagaa

SEQ ID NO: 1873303 - DNA, 19 bp, Homo sapiens
attattttacagtctctgt

SEQ ID NO: 1873304 - DNA, 20 bp, Homo sapiens
attcaaggctttaaaagtca

SEQ ID NO: 1873305 - DNA, 15 bp, Homo sapiens
attcaaggtggccaa

SEQ ID NO: 1873306 - DNA, 15 bp, Homo sapiens
attcaagttattgta

SEQ ID NO: 1873307 - DNA, 16 bp, Homo sapiens
attcaagttattgtac

SEQ ID NO: 1873308 - DNA, 12 bp, Homo sapiens
attcactgttga

SEQ ID NO: 1873309 - DNA, 13 bp, Homo sapiens
attcagaaattaa

SEQ ID NO: 1873310 - DNA, 17 bp, Homo sapiens
attcagctagaatttct

SEQ ID NO: 1873311 - DNA, 18 bp, Homo sapiens
attcatgcaacttgattc

SEQ ID NO: 1873312 - DNA, 24 bp, Homo sapiens
attcattaatctgtttgtttggca

SEQ ID NO: 1873313 - DNA, 22 bp, Homo sapiens
attcccttctgatcttggaaag

SEQ ID NO: 1873314 - DNA, 16 bp, Homo sapiens
attctgaaatactttt

SEQ ID NO: 1873315 - DNA, 17 bp, Homo sapiens
attctgtggttctataa

SEQ ID NO: 1873316 - DNA, 19 bp, Homo sapiens
attctgtggttctataata

SEQ ID NO: 1873317 - DNA, 14 bp, Homo sapiens
attcttgtcaaaaa

SEQ ID NO: 1873318 - DNA, 19 bp, Homo sapiens
attcttgtgattgactttt

SEQ ID NO: 1873319 - DNA, 12 bp, Homo sapiens
attgaaagtatt

SEQ ID NO: 1873320 - DNA, 11 bp, Homo sapiens
aaaaaaaactc

SEQ ID NO: 1873321 - DNA, 11 bp, Homo sapiens
aaaaaaaagaa

SEQ ID NO: 1873322 - DNA, 12 bp, Homo sapiens
aaaaaaactctt

SEQ ID NO: 1873323 - DNA, 12 bp, Homo sapiens
aaaaaaagactg

SEQ ID NO: 1873324 - DNA, 13 bp, Homo sapiens
aaaaaactgaagg

SEQ ID NO: 1873325 - DNA, 10 bp, Homo sapiens
aaaaaagaac

SEQ ID NO: 1873326 - DNA, 11 bp, Homo sapiens
aaaaaagactg

SEQ ID NO: 1873327 - DNA, 12 bp, Homo sapiens
aaaaaagactgt

SEQ ID NO: 1873328 - DNA, 18 bp, Homo sapiens
aaaaactagacattattt

SEQ ID NO: 1873329 - DNA, 14 bp, Homo sapiens
aaaaactcctgtgt

SEQ ID NO: 1873330 - DNA, 16 bp, Homo sapiens
aaaaactcctgtgtcg

SEQ ID NO: 1873331 - DNA, 10 bp, Homo sapiens
aaaaactgaa

SEQ ID NO: 1873332 - DNA, 13 bp, Homo sapiens
aaaaactgaaggt

SEQ ID NO: 1873333 - DNA, 15 bp, Homo sapiens
aaaaactgtgtatca

SEQ ID NO: 1873334 - DNA, 17 bp, Homo sapiens
aaaaactgtgtatcatt

SEQ ID NO: 1873335 - DNA, 21 bp, Homo sapiens
aaaaagactgtcaaatgaact

SEQ ID NO: 1873336 - DNA, 19 bp, Homo sapiens
aaaaagctataaattatat

SEQ ID NO: 1873337 - DNA, 15 bp, Homo sapiens
aaaaaggaaattagt

SEQ ID NO: 1873338 - DNA, 16 bp, Homo sapiens
aaaaatatatacagat

SEQ ID NO: 1873339 - DNA, 20 bp, Homo sapiens
aaaaatatggaacttctaat

SEQ ID NO: 1873340 - DNA, 15 bp, Homo sapiens
aaaaatattgctaaa

SEQ ID NO: 1873341 - DNA, 18 bp, Homo sapiens
aaaaatattttaagaaag

SEQ ID NO: 1873342 - DNA, 13 bp, Homo sapiens
aaaaattacagat

SEQ ID NO: 1873343 - DNA, 19 bp, Homo sapiens
aaaacaatcatttgctttt

SEQ ID NO: 1873344 - DNA, 24 bp, Homo sapiens
aaaacatatgtctgtctttgcaaa

SEQ ID NO: 1873345 - DNA, 12 bp, Homo sapiens
aaaactgaaggt

SEQ ID NO: 1873346 - DNA, 19 bp, Homo sapiens
aaaactgagtccatgaaaa

SEQ ID NO: 1873347 - DNA, 20 bp, Homo sapiens
aaaactgagtccatgaaaat

SEQ ID NO: 1873348 - DNA, 13 bp, Homo sapiens
aaaacttcagaga

SEQ ID NO: 1873349 - DNA, 20 bp, Homo sapiens
aaaagaagagaggggaagaa

SEQ ID NO: 1873350 - DNA, 11 bp, Homo sapiens
aaaagagactc

SEQ ID NO: 1873351 - DNA, 12 bp, Homo sapiens
aaaagcagcttt

SEQ ID NO: 1873352 - DNA, 15 bp, Homo sapiens
aaaagccatatctag

SEQ ID NO: 1873353 - DNA, 16 bp, Homo sapiens
aaaagccatatctagt

SEQ ID NO: 1873354 - DNA, 20 bp, Homo sapiens
aaaagctgtagctggagaag

SEQ ID NO: 1873355 - DNA, 19 bp, Homo sapiens
aaaaggaaattagtctttt

SEQ ID NO: 1873356 - DNA, 16 bp, Homo sapiens
aaaaggatgttacaag

SEQ ID NO: 1873357 - DNA, 19 bp, Homo sapiens
aaaagggaagttgtgcctt

SEQ ID NO: 1873358 - DNA, 14 bp, Homo sapiens
aaaagtgaactttt

SEQ ID NO: 1873359 - DNA, 17 bp, Homo sapiens
aaaagtgaacttttgta

SEQ ID NO: 1873360 - DNA, 15 bp, Homo sapiens
aaaagtgcatttaag

SEQ ID NO: 1873361 - DNA, 16 bp, Homo sapiens
aaaagttataataact

SEQ ID NO: 1873362 - DNA, 17 bp, Homo sapiens
aaaagttataataactg

SEQ ID NO: 1873363 - DNA, 22 bp, Homo sapiens
aaaagttataataactgaactg

SEQ ID NO: 1873364 - DNA, 16 bp, Homo sapiens
aaaagtttacaagtgt

SEQ ID NO: 1873365 - DNA, 16 bp, Homo sapiens
aaaataacactgttgg

SEQ ID NO: 1873366 - DNA, 21 bp, Homo sapiens
aaaataccataggaagacata

SEQ ID NO: 1873367 - DNA, 15 bp, Homo sapiens
aaaataccattgaaa

SEQ ID NO: 1873368 - DNA, 16 bp, Homo sapiens
aaaataccattgaaat

SEQ ID NO: 1873369 - DNA, 12 bp, Homo sapiens
aaaatagcttgt

SEQ ID NO: 1873370 - DNA, 16 bp, Homo sapiens
aaaatatatgttctgc

SEQ ID NO: 1873371 - DNA, 17 bp, Homo sapiens
aaaatattatttgatat

SEQ ID NO: 1873372 - DNA, 13 bp, Homo sapiens
aaaatattgctaa

SEQ ID NO: 1873373 - DNA, 16 bp, Homo sapiens
aaaatattttaagaaa

SEQ ID NO: 1873374 - DNA, 19 bp, Homo sapiens
aaaatattttaagaaagag

SEQ ID NO: 1873375 - DNA, 18 bp, Homo sapiens
aaaatcctatatctgttt

SEQ ID NO: 1873376 - DNA, 23 bp, Homo sapiens
aaaatctaatattaaaaatatgg

SEQ ID NO: 1873377 - DNA, 13 bp, Homo sapiens
aaaatcttggttt

SEQ ID NO: 1873378 - DNA, 15 bp, Homo sapiens
aaaatgaagcaattt

SEQ ID NO: 1873379 - DNA, 23 bp, Homo sapiens
aaaatgcagccttaaacagtgtc

SEQ ID NO: 1873380 - DNA, 16 bp, Homo sapiens
aaaatgcatgtaatca

SEQ ID NO: 1873381 - DNA, 21 bp, Homo sapiens
aaaatgcggcactatttctga

SEQ ID NO: 1873382 - DNA, 18 bp, Homo sapiens
aaggaatgtgtccaagac

SEQ ID NO: 1873383 - DNA, 21 bp, Homo sapiens
aaggagattgggagacaatta

SEQ ID NO: 1873384 - DNA, 22 bp, Homo sapiens
aaggatataaaaggatgttaca

SEQ ID NO: 1873385 - DNA, 15 bp, Homo sapiens
aaggatcttttgtaa

SEQ ID NO: 1873386 - DNA, 17 bp, Homo sapiens
aaggatcttttgtaaat

SEQ ID NO: 1873387 - DNA, 20 bp, Homo sapiens
aaggccacaaaagttccctc

SEQ ID NO: 1873388 - DNA, 21 bp, Homo sapiens
aaggctttaaaagtcattatt

SEQ ID NO: 1873389 - DNA, 20 bp, Homo sapiens
aagggaacccccaaatttaa

SEQ ID NO: 1873390 - DNA, 20 bp, Homo sapiens
aagggccctcactcaggaac

SEQ ID NO: 1873391 - DNA, 18 bp, Homo sapiens
aaggtaataaatacacag

SEQ ID NO: 1873392 - DNA, 20 bp, Homo sapiens
aaggtataaggatcttttgt

SEQ ID NO: 1873393 - DNA, 19 bp, Homo sapiens
aaggtgagaggaaatgttg

SEQ ID NO: 1873394 - DNA, 17 bp, Homo sapiens
aaggtgtcatttgacaa

SEQ ID NO: 1873395 - DNA, 18 bp, Homo sapiens
aaggttttttttttaagt

SEQ ID NO: 1873396 - DNA, 18 bp, Homo sapiens
aagtaactggtgatatat

SEQ ID NO: 1873397 - DNA, 18 bp, Homo sapiens
aagtactatctttgtcta

SEQ ID NO: 1873398 - DNA, 19 bp, Homo sapiens
aagtatatgtgagaaatca

SEQ ID NO: 1873399 - DNA, 13 bp, Homo sapiens
aagtatgtaaaca

SEQ ID NO: 1873400 - DNA, 12 bp, Homo sapiens
aagtatgtaaag

SEQ ID NO: 1873401 - DNA, 22 bp, Homo sapiens
aagtatgtaaagtatgtaaaca

SEQ ID NO: 1873402 - DNA, 20 bp, Homo sapiens
aagtatttttgaaagaattc

SEQ ID NO: 1873403 - DNA, 16 bp, Homo sapiens
aagtcacctacaggac

SEQ ID NO: 1873404 - DNA, 17 bp, Homo sapiens
aagtcacctacaggact

SEQ ID NO: 1873405 - DNA, 18 bp, Homo sapiens
aagtcacctacaggactg

SEQ ID NO: 1873406 - DNA, 20 bp, Homo sapiens
aagtcttttttttttccaaa

SEQ ID NO: 1873407 - DNA, 12 bp, Homo sapiens
aagtgaactttt

SEQ ID NO: 1873408 - DNA, 17 bp, Homo sapiens
aagtgcaacatttctgt

SEQ ID NO: 1873409 - DNA, 18 bp, Homo sapiens
aagtgcatttaaggagat

SEQ ID NO: 1873410 - DNA, 16 bp, Homo sapiens
aagtggccactggcat

SEQ ID NO: 1873411 - DNA, 23 bp, Homo sapiens
aagtggtgaccaaaatttttagg

SEQ ID NO: 1873412 - DNA, 23 bp, Homo sapiens
ccctgcaggccaggccagcttcc

SEQ ID NO: 1873413 - DNA, 10 bp, Homo sapiens
ccctgcccaa

SEQ ID NO: 1873414 - DNA, 21 bp, Homo sapiens
ccctgcccaagtggctcttgg

SEQ ID NO: 1873415 - DNA, 20 bp, Homo sapiens
ccctgcccaatcctccctgg

SEQ ID NO: 1873416 - DNA, 22 bp, Homo sapiens
ccctgcccctccccaaaagaaa

SEQ ID NO: 1873417 - DNA, 17 bp, Homo sapiens
ccctgcctgtggaggtg

SEQ ID NO: 1873418 - DNA, 11 bp, Homo sapiens
ccctgccttgc

SEQ ID NO: 1873419 - DNA, 15 bp, Homo sapiens
ccctgccttgctgcc

SEQ ID NO: 1873420 - DNA, 21 bp, Homo sapiens
ccctggagaagggacatggga

SEQ ID NO: 1873421 - DNA, 15 bp, Homo sapiens
ccctggatggcctct

SEQ ID NO: 1873422 - DNA, 17 bp, Homo sapiens
ccctggatggcctctgg

SEQ ID NO: 1873423 - DNA, 20 bp, Homo sapiens
ccctggatggcctctggggc

SEQ ID NO: 1873424 - DNA, 16 bp, Homo sapiens
ccctgggcagtgagtg

SEQ ID NO: 1873425 - DNA, 14 bp, Homo sapiens
ccctggggctgccc

SEQ ID NO: 1873426 - DNA, 20 bp, Homo sapiens
ccctggggctgccctcggca

SEQ ID NO: 1873427 - DNA, 23 bp, Homo sapiens
cccttctcattccaacagtgagt

SEQ ID NO: 1873428 - DNA, 15 bp, Homo sapiens
ccctttgtattataa

SEQ ID NO: 1873429 - DNA, 16 bp, Homo sapiens
ccgacaccactgggaa

SEQ ID NO: 1873430 - DNA, 13 bp, Homo sapiens
ccgcagcccccac

SEQ ID NO: 1873431 - DNA, 19 bp, Homo sapiens
ccgcagcccccactgacct

SEQ ID NO: 1873432 - DNA, 21 bp, Homo sapiens
ccgcagcccccactgacctgc

SEQ ID NO: 1873433 - DNA, 17 bp, Homo sapiens
ccgctctccccctgcag

SEQ ID NO: 1873434 - DNA, 18 bp, Homo sapiens
ccgctctccccctgcagc

SEQ ID NO: 1873435 - DNA, 23 bp, Homo sapiens
ctgccaccagcaatgccctgcct

SEQ ID NO: 1873436 - DNA, 14 bp, Homo sapiens
ctgcccaagtggct

SEQ ID NO: 1873437 - DNA, 19 bp, Homo sapiens
ctgcccaagtggctcttgg

SEQ ID NO: 1873438 - DNA, 21 bp, Homo sapiens
ctgcccaagtggctcttggga

SEQ ID NO: 1873439 - DNA, 19 bp, Homo sapiens
ctgcccaatcctccctgga

SEQ ID NO: 1873440 - DNA, 22 bp, Homo sapiens
ctgcccatgtccagagggactg

SEQ ID NO: 1873441 - DNA, 13 bp, Homo sapiens
ctgccctggggca

SEQ ID NO: 1873442 - DNA, 20 bp, Homo sapiens
ctgccctggggcatcatggg

SEQ ID NO: 1873443 - DNA, 21 bp, Homo sapiens
ctgccctggggcatcatgggc

SEQ ID NO: 1873444 - DNA, 16 bp, Homo sapiens
ctgcctcccattctga

SEQ ID NO: 1873445 - DNA, 17 bp, Homo sapiens
ctgccttgctgccttca

SEQ ID NO: 1873446 - DNA, 17 bp, Homo sapiens
ctgcggtgtctgcagct

SEQ ID NO: 1873447 - DNA, 18 bp, Homo sapiens
ctgcggtgtctgcagctc

SEQ ID NO: 1873448 - DNA, 18 bp, Homo sapiens
ctgctcttatttttgtac

SEQ ID NO: 1873449 - DNA, 17 bp, Homo sapiens
ctgctgaaagtcctgct

SEQ ID NO: 1873450 - DNA, 20 bp, Homo sapiens
ctgctgaaagtcctgctttc

SEQ ID NO: 1873451 - DNA, 12 bp, Homo sapiens
ctgcttcagtgg

SEQ ID NO: 1873452 - DNA, 18 bp, Homo sapiens
ctggacacctacagcagc

SEQ ID NO: 1873453 - DNA, 19 bp, Homo sapiens
ctggacacctacagcagca

SEQ ID NO: 1873454 - DNA, 13 bp, Homo sapiens
ctggacagccagg

SEQ ID NO: 1873455 - DNA, 16 bp, Homo sapiens
ctggacagccagggca

SEQ ID NO: 1873456 - DNA, 20 bp, Homo sapiens
ctggactttctcttggacat

SEQ ID NO: 1873457 - DNA, 16 bp, Homo sapiens
ctggagggggcagagt

SEQ ID NO: 1873458 - DNA, 20 bp, Homo sapiens
ctggagggggcagagtggcc

SEQ ID NO: 1873459 - DNA, 21 bp, Homo sapiens
ctggagggggcagagtggcct

SEQ ID NO: 1873460 - DNA, 13 bp, Homo sapiens
ctggatgaaattt

SEQ ID NO: 1873461 - DNA, 16 bp, Homo sapiens
ctggatggcctctggg

SEQ ID NO: 1873462 - DNA, 17 bp, Homo sapiens
ctggatggcctctgggg

SEQ ID NO: 1873463 - DNA, 20 bp, Homo sapiens
ctggcaaacttttctttctt

SEQ ID NO: 1873464 - DNA, 17 bp, Homo sapiens
ctggcactgacagcctg

SEQ ID NO: 1873465 - DNA, 21 bp, Homo sapiens
ctggcaggtcatggagcagcc

SEQ ID NO: 1873466 - DNA, 16 bp, Homo sapiens
ctggcatcgcagcttc

SEQ ID NO: 1873467 - DNA, 13 bp, Homo sapiens
ctggcttccctgc

SEQ ID NO: 1873468 - DNA, 16 bp, Homo sapiens
ctggcttccctgccca

SEQ ID NO: 1873469 - DNA, 17 bp, Homo sapiens
ctggcttccctgcccaa

SEQ ID NO: 1873470 - DNA, 16 bp, Homo sapiens
ctggcttctgcttcat

SEQ ID NO: 1873471 - DNA, 15 bp, Homo sapiens
ctgggaaccaagggc

SEQ ID NO: 1873472 - DNA, 23 bp, Homo sapiens
ctgggaaccaagggccctcactc

SEQ ID NO: 1873473 - DNA, 15 bp, Homo sapiens
ctgggccaaggactc

SEQ ID NO: 1873474 - DNA, 21 bp, Homo sapiens
ctgggccctggggctgccctc

SEQ ID NO: 1873475 - DNA, 15 bp, Homo sapiens
ctgggccgggcccag

SEQ ID NO: 1873476 - DNA, 18 bp, Homo sapiens
ctgggccgggcccagggc

SEQ ID NO: 1873477 - DNA, 19 bp, Homo sapiens
ctgggccgggcccagggcc

SEQ ID NO: 1873478 - DNA, 22 bp, Homo sapiens
ctgggccgggcccagggcctct

SEQ ID NO: 1873479 - DNA, 14 bp, Homo sapiens
ctggggcagagctt

SEQ ID NO: 1873480 - DNA, 14 bp, Homo sapiens
ctggggcaggacca

SEQ ID NO: 1873481 - DNA, 14 bp, Homo sapiens
ctggtcctgtgtgc

SEQ ID NO: 1873482 - DNA, 16 bp, Homo sapiens
ctggttttatttatat

SEQ ID NO: 1873483 - DNA, 15 bp, Homo sapiens
ctgtaaaagttataa

SEQ ID NO: 1873484 - DNA, 18 bp, Homo sapiens
ctgtaaaagttataataa

SEQ ID NO: 1873485 - DNA, 22 bp, Homo sapiens
ctgtaaaagttataataactga

SEQ ID NO: 1873486 - DNA, 21 bp, Homo sapiens
ctgtaaatgaacacatggcag

SEQ ID NO: 1873487 - DNA, 22 bp, Homo sapiens
ctgtaaatgaacacatggcaga

SEQ ID NO: 1873488 - DNA, 19 bp, Homo sapiens
ctgtaagcagattacaata

SEQ ID NO: 1873489 - DNA, 21 bp, Homo sapiens
ctgtaagcagattacaataaa

SEQ ID NO: 1873490 - DNA, 16 bp, Homo sapiens
ctgtactttgtgttta

SEQ ID NO: 1873491 - DNA, 18 bp, Homo sapiens
ctgtagtttttaattaaa

SEQ ID NO: 1873492 - DNA, 15 bp, Homo sapiens
ctgtatactgtaaaa

SEQ ID NO: 1873493 - DNA, 17 bp, Homo sapiens
ctgtatactgtaaaagt

SEQ ID NO: 1873494 - DNA, 16 bp, Homo sapiens
ctgtatagttaggata

SEQ ID NO: 1873495 - DNA, 15 bp, Homo sapiens
ctgtatgtataaatt

SEQ ID NO: 1873496 - DNA, 17 bp, Homo sapiens
ctgtatgtataaattat

SEQ ID NO: 1873497 - DNA, 19 bp, Homo sapiens
ctgtatttcagtattttcc

SEQ ID NO: 1873498 - DNA, 15 bp, Homo sapiens
ctgtatttctttgta

SEQ ID NO: 1873499 - DNA, 16 bp, Homo sapiens
ctgtcaaatgaacttt

SEQ ID NO: 1873500 - DNA, 20 bp, Homo sapiens
ctgtcagggcagtacaatgt

SEQ ID NO: 1873501 - DNA, 13 bp, Homo sapiens
ctgtctgctctta

SEQ ID NO: 1873502 - DNA, 14 bp, Homo sapiens
ctgtctgctcttat

SEQ ID NO: 1873503 - DNA, 14 bp, Homo sapiens
ctgtctgtttatat

SEQ ID NO: 1873504 - DNA, 12 bp, Homo sapiens
ctgtgaatttca

SEQ ID NO: 1873505 - DNA, 14 bp, Homo sapiens
ctgtgaatttcaaa

SEQ ID NO: 1873506 - DNA, 16 bp, Homo sapiens
ctgtgaatttcaaaaa

SEQ ID NO: 1873507 - DNA, 14 bp, Homo sapiens
ctgtgagcaagagc

SEQ ID NO: 1873508 - DNA, 17 bp, Homo sapiens
ctgtgagcaagagccag

SEQ ID NO: 1873509 - DNA, 18 bp, Homo sapiens
ctgtgagcaagagccagg

SEQ ID NO: 1873510 - DNA, 14 bp, Homo sapiens
ctgtggcactgcca

SEQ ID NO: 1873511 - DNA, 17 bp, Homo sapiens
ctgtggttctataataa

SEQ ID NO: 1873512 - DNA, 18 bp, Homo sapiens
ctgtggttctataataag

SEQ ID NO: 1873513 - DNA, 19 bp, Homo sapiens
ctgtggttctataataagt

SEQ ID NO: 1873514 - DNA, 13 bp, Homo sapiens
ctgtgtgaaaatg

SEQ ID NO: 1873515 - DNA, 18 bp, Homo sapiens
ctgtgtgatgaactttct

SEQ ID NO: 1873516 - DNA, 13 bp, Homo sapiens
ctgtgtgctgtaa

SEQ ID NO: 1873517 - DNA, 23 bp, Homo sapiens
ctgttaagaaaggatataaaagg

SEQ ID NO: 1873518 - DNA, 17 bp, Homo sapiens
ctgttactgcttctctt

SEQ ID NO: 1873519 - DNA, 22 bp, Homo sapiens
ctgttaggtctcatgcccactc

SEQ ID NO: 1873520 - DNA, 15 bp, Homo sapiens
ctgttcttttttgta

SEQ ID NO: 1873521 - DNA, 14 bp, Homo sapiens
ctgttgaaaattat

SEQ ID NO: 1873522 - DNA, 18 bp, Homo sapiens
ctgtttactcccttctgt

SEQ ID NO: 1873523 - DNA, 18 bp, Homo sapiens
ctgtttggtcgagtcttt

SEQ ID NO: 1873524 - DNA, 18 bp, Homo sapiens
ctgtttgtatatttgcaa

SEQ ID NO: 1873525 - DNA, 16 bp, Homo sapiens
ctgtttttaacatgtg

SEQ ID NO: 1873526 - DNA, 11 bp, Homo sapiens
ctgtttttccg

SEQ ID NO: 1873527 - DNA, 11 bp, Homo sapiens
cttaaaaactg

SEQ ID NO: 1873528 - DNA, 12 bp, Homo sapiens
cttaaaaactgt

SEQ ID NO: 1873529 - DNA, 17 bp, Homo sapiens
cttaaaaatcttggttt

SEQ ID NO: 1873530 - DNA, 12 bp, Homo sapiens
cttaaagaaagt

SEQ ID NO: 1873531 - DNA, 17 bp, Homo sapiens
cttaaagcttgatttga

SEQ ID NO: 1873532 - DNA, 20 bp, Homo sapiens
cttaaaggcaccatctaata

SEQ ID NO: 1873533 - DNA, 22 bp, Homo sapiens
cttaaatcatttggttaaatca

SEQ ID NO: 1873534 - DNA, 13 bp, Homo sapiens
cttaacatattta

SEQ ID NO: 1873535 - DNA, 17 bp, Homo sapiens
cttaacatatttactaa

SEQ ID NO: 1873536 - DNA, 15 bp, Homo sapiens
cttaactgtatttca

SEQ ID NO: 1873537 - DNA, 17 bp, Homo sapiens
cttaactgtatttcagt

SEQ ID NO: 1873538 - DNA, 23 bp, Homo sapiens
cttaagataatggataatcttcg

SEQ ID NO: 1873539 - DNA, 18 bp, Homo sapiens
cttaatttccttctgtta

SEQ ID NO: 1873540 - DNA, 13 bp, Homo sapiens
cttacataatttg

SEQ ID NO: 1873541 - DNA, 19 bp, Homo sapiens
cttacataatttgcaattt

SEQ ID NO: 1873542 - DNA, 22 bp, Homo sapiens
cttacataattttttattcaag

SEQ ID NO: 1873543 - DNA, 19 bp, Homo sapiens
cttaccaactttctgtaaa

SEQ ID NO: 1873544 - DNA, 15 bp, Homo sapiens
cttagagtttacagt

SEQ ID NO: 1873545 - DNA, 19 bp, Homo sapiens
cttagagtttacagtttgt

SEQ ID NO: 1873546 - DNA, 13 bp, Homo sapiens
cttagttcttgaa

SEQ ID NO: 1873547 - DNA, 14 bp, Homo sapiens
cttagttcttgaat

SEQ ID NO: 1873548 - DNA, 19 bp, Homo sapiens
cttagttcttgaattgtta

SEQ ID NO: 1873549 - DNA, 15 bp, Homo sapiens
cttatcatttttgta

SEQ ID NO: 1873550 - DNA, 19 bp, Homo sapiens
cttatcatttttgtataaa

SEQ ID NO: 1873551 - DNA, 21 bp, Homo sapiens
cttatgtgttacattattcca

SEQ ID NO: 1873552 - DNA, 11 bp, Homo sapiens
cttcatatcta

SEQ ID NO: 1873553 - DNA, 12 bp, Homo sapiens
cttccctgccca

SEQ ID NO: 1873554 - DNA, 19 bp, Homo sapiens
ctagcatttatttctctgg

SEQ ID NO: 1873555 - DNA, 17 bp, Homo sapiens
ctagctaagcaagccag

SEQ ID NO: 1873556 - DNA, 19 bp, Homo sapiens
ctagctaagcaagccagga

SEQ ID NO: 1873557 - DNA, 15 bp, Homo sapiens
ctagctgttcttttt

SEQ ID NO: 1873558 - DNA, 14 bp, Homo sapiens
ctagcttttaaaaa

SEQ ID NO: 1873559 - DNA, 14 bp, Homo sapiens
ctaggaatatagat

SEQ ID NO: 1873560 - DNA, 17 bp, Homo sapiens
ctaggaatatagattaa

SEQ ID NO: 1873561 - DNA, 14 bp, Homo sapiens
ctagtatctattgt

SEQ ID NO: 1873562 - DNA, 17 bp, Homo sapiens
ctagtcaataactctga

SEQ ID NO: 1873563 - DNA, 19 bp, Homo sapiens
ctagtcaataactctgatt

SEQ ID NO: 1873564 - DNA, 14 bp, Homo sapiens
ctagtccagtgacc

SEQ ID NO: 1873565 - DNA, 19 bp, Homo sapiens
ctagtgccaaataattgat

SEQ ID NO: 1873566 - DNA, 13 bp, Homo sapiens
ctataaattatat

SEQ ID NO: 1873567 - DNA, 13 bp, Homo sapiens
ctataataagttt

SEQ ID NO: 1873568 - DNA, 16 bp, Homo sapiens
ctataataagttttga

SEQ ID NO: 1873569 - DNA, 18 bp, Homo sapiens
ctatatctgtttgtatat

SEQ ID NO: 1873570 - DNA, 19 bp, Homo sapiens
ctatatctgtttgtatatt

SEQ ID NO: 1873571 - DNA, 18 bp, Homo sapiens
ctatatgatttatagttt

SEQ ID NO: 1873572 - DNA, 13 bp, Homo sapiens
ctatcagaagacc

SEQ ID NO: 1873573 - DNA, 14 bp, Homo sapiens
ctatcctgctgaaa

SEQ ID NO: 1873574 - DNA, 17 bp, Homo sapiens
ctatctagcatttattt

SEQ ID NO: 1873575 - DNA, 19 bp, Homo sapiens
ctatctatacctgcctttt

SEQ ID NO: 1873576 - DNA, 18 bp, Homo sapiens
ctatggagactttgctgt

SEQ ID NO: 1873577 - DNA, 23 bp, Homo sapiens
ctattcaaggtggccaaattatt

SEQ ID NO: 1873578 - DNA, 21 bp, Homo sapiens
ctatttaagtactatctttgt

SEQ ID NO: 1873579 - DNA, 13 bp, Homo sapiens
ctattttctctga

SEQ ID NO: 1873580 - DNA, 13 bp, Homo sapiens
ctcaagtttaaag

SEQ ID NO: 1873581 - DNA, 15 bp, Homo sapiens
ctcactcaggaaccc

SEQ ID NO: 1873582 - DNA, 22 bp, Homo sapiens
ctcactcaggaaccctggagac

SEQ ID NO: 1873583 - DNA, 24 bp, Homo sapiens
ctcactcaggaaccctggagacag

SEQ ID NO: 1873584 - DNA, 23 bp, Homo sapiens
ctcagaggacccacctgggccaa

SEQ ID NO: 1873585 - DNA, 14 bp, Homo sapiens
ctcagtgaaatcat

SEQ ID NO: 1873586 - DNA, 16 bp, Homo sapiens
ctcatagattgcaaat

SEQ ID NO: 1873587 - DNA, 13 bp, Homo sapiens
ctcatattttgta

SEQ ID NO: 1873588 - DNA, 21 bp, Homo sapiens
ctcatattttgtatatatctg

SEQ ID NO: 1873589 - DNA, 13 bp, Homo sapiens
ctcatgagtggaa

SEQ ID NO: 1873590 - DNA, 17 bp, Homo sapiens
ctcatgcaaactgcttt

SEQ ID NO: 1873591 - DNA, 21 bp, Homo sapiens
ctcatgcccactcccccagga

SEQ ID NO: 1873592 - DNA, 22 bp, Homo sapiens
ctcatgcccactcccccaggag

SEQ ID NO: 1873593 - DNA, 18 bp, Homo sapiens
ctcattccaacagtgagt

SEQ ID NO: 1873594 - DNA, 23 bp, Homo sapiens
ctccaaggctgtcttctcccaga

SEQ ID NO: 1873595 - DNA, 23 bp, Homo sapiens
ctccaattctgaaatacttttga

SEQ ID NO: 1873596 - DNA, 14 bp, Homo sapiens
ctccaggtgtggac

SEQ ID NO: 1873597 - DNA, 23 bp, Homo sapiens
ctccaggtgtggaccggccgcag

SEQ ID NO: 1873598 - DNA, 24 bp, Homo sapiens
ctccaggtgtggaccggccgcagc

SEQ ID NO: 1873599 - DNA, 14 bp, Homo sapiens
ctccagtattcttg

SEQ ID NO: 1873600 - DNA, 20 bp, Homo sapiens
ctccagtattcttgtcaaaa

SEQ ID NO: 1873601 - DNA, 16 bp, Homo sapiens
ctccatcggggaatga

SEQ ID NO: 1873602 - DNA, 22 bp, Homo sapiens
ctccccaaaagaaaccatgaca

SEQ ID NO: 1873603 - DNA, 17 bp, Homo sapiens
ctcccccaggagcagct

SEQ ID NO: 1873604 - DNA, 23 bp, Homo sapiens
ctcccccaggagcagctggcact

SEQ ID NO: 1873605 - DNA, 12 bp, Homo sapiens
ctccccctgcag

SEQ ID NO: 1873606 - DNA, 18 bp, Homo sapiens
ctccctgaccaccctgcc

SEQ ID NO: 1873607 - DNA, 13 bp, Homo sapiens
ctcccttctgtag

SEQ ID NO: 1873608 - DNA, 18 bp, Homo sapiens
ctcctatgctttagctta

SEQ ID NO: 1873609 - DNA, 23 bp, Homo sapiens
ctcctgggcatgtttgtctgtgt

SEQ ID NO: 1873610 - DNA, 17 bp, Homo sapiens
ctcctgtgcctcccttt

SEQ ID NO: 1873611 - DNA, 9 bp, Homo sapiens
ctcctgtgt

SEQ ID NO: 1873612 - DNA, 10 bp, Homo sapiens
ctcctgtgtc

SEQ ID NO: 1873613 - DNA, 11 bp, Homo sapiens
ctcctgtgtcg

SEQ ID NO: 1873614 - DNA, 23 bp, Homo sapiens
ctcggcaaccgtggggaggccat

SEQ ID NO: 1873615 - DNA, 21 bp, Homo sapiens
ctcgtccacggtcttctgcat

SEQ ID NO: 1873616 - DNA, 19 bp, Homo sapiens
ctctaattagagaactgga

SEQ ID NO: 1873617 - DNA, 18 bp, Homo sapiens
ctctacgagagtgagact

SEQ ID NO: 1873618 - DNA, 23 bp, Homo sapiens
ctctagaaagtatagatggccaa

SEQ ID NO: 1873619 - DNA, 18 bp, Homo sapiens
ctctccccaatccatgct

SEQ ID NO: 1873620 - DNA, 19 bp, Homo sapiens
ctctccccaatccatgctt

SEQ ID NO: 1873621 - DNA, 14 bp, Homo sapiens
ctctccccctgcag

SEQ ID NO: 1873622 - DNA, 17 bp, Homo sapiens
ctctccccctgcagccg

SEQ ID NO: 1873623 - DNA, 18 bp, Homo sapiens
ctctccccctgcagccgt

SEQ ID NO: 1873624 - DNA, 21 bp, Homo sapiens
ctctgaataagcactttttaa

SEQ ID NO: 1873625 - DNA, 16 bp, Homo sapiens
ctctgacccagtgaga

SEQ ID NO: 1873626 - DNA, 14 bp, Homo sapiens
ctctgactcaccac

SEQ ID NO: 1873627 - DNA, 22 bp, Homo sapiens
ctctgactcaccacgatgacgc

SEQ ID NO: 1873628 - DNA, 16 bp, Homo sapiens
ctctgatacttttttg

SEQ ID NO: 1873629 - DNA, 17 bp, Homo sapiens
ctctgatacttttttga

SEQ ID NO: 1873630 - DNA, 18 bp, Homo sapiens
ctctgattttgatatttt

SEQ ID NO: 1873631 - DNA, 14 bp, Homo sapiens
ctctggggcagagc

SEQ ID NO: 1873632 - DNA, 14 bp, Homo sapiens
ctctggggcaggac

SEQ ID NO: 1873633 - DNA, 16 bp, Homo sapiens
ctctggggcaggacca

SEQ ID NO: 1873634 - DNA, 19 bp, Homo sapiens
ctctgttaaagatcagcta

SEQ ID NO: 1873635 - DNA, 13 bp, Homo sapiens
ctctgttgtaaat

SEQ ID NO: 1873636 - DNA, 14 bp, Homo sapiens
ctcttaaaaatctt

SEQ ID NO: 1873637 - DNA, 19 bp, Homo sapiens
ctcttatttttgtaccata

SEQ ID NO: 1873638 - DNA, 17 bp, Homo sapiens
ctcttgccccaaatcac

SEQ ID NO: 1873639 - DNA, 19 bp, Homo sapiens
ctcttgccccaaatcacaa

SEQ ID NO: 1873640 - DNA, 19 bp, Homo sapiens
ctctttaacttgtaataaa

SEQ ID NO: 1873641 - DNA, 14 bp, Homo sapiens
ctctttgtgcagtg

SEQ ID NO: 1873642 - DNA, 15 bp, Homo sapiens
ctctttgtgtgtctc

SEQ ID NO: 1873643 - DNA, 15 bp, Homo sapiens
ctgaaaatctaatat

SEQ ID NO: 1873644 - DNA, 11 bp, Homo sapiens
ctgaactgttt

SEQ ID NO: 1873645 - DNA, 19 bp, Homo sapiens
ctgaaggttttttttttaa

SEQ ID NO: 1873646 - DNA, 21 bp, Homo sapiens
ctgaaggttttttttttaagt

SEQ ID NO: 1873647 - DNA, 16 bp, Homo sapiens
ctgaagtcaaacctta

SEQ ID NO: 1873648 - DNA, 18 bp, Homo sapiens
ctgaatggcatggagacc

SEQ ID NO: 1873649 - DNA, 13 bp, Homo sapiens
ctgacagcctggg

SEQ ID NO: 1873650 - DNA, 16 bp, Homo sapiens
ctgaccaccctgcctg

SEQ ID NO: 1873651 - DNA, 19 bp, Homo sapiens
ctgaccaccctgcctgtgg

SEQ ID NO: 1873652 - DNA, 21 bp, Homo sapiens
ctgaccaccctgcctgtggag

SEQ ID NO: 1873653 - DNA, 14 bp, Homo sapiens
ctgacccagtgaga

SEQ ID NO: 1873654 - DNA, 15 bp, Homo sapiens
ctgacctgcccatgt

SEQ ID NO: 1873655 - DNA, 14 bp, Homo sapiens
ctgactctgttatt

SEQ ID NO: 1873656 - DNA, 16 bp, Homo sapiens
ctgagagacttttaat

SEQ ID NO: 1873657 - DNA, 23 bp, Homo sapiens
ctgaggttttgaataaaaagtga

SEQ ID NO: 1873658 - DNA, 18 bp, Homo sapiens
ctgagtccatgaaaatac

SEQ ID NO: 1873659 - DNA, 19 bp, Homo sapiens
ctgagtccatgaaaatacc

SEQ ID NO: 1873660 - DNA, 16 bp, Homo sapiens
ctgatctgtactttgt

SEQ ID NO: 1873661 - DNA, 21 bp, Homo sapiens
ctgatgcaatgtatggctttt

SEQ ID NO: 1873662 - DNA, 16 bp, Homo sapiens
ctgatggtacaggaaa

SEQ ID NO: 1873663 - DNA, 15 bp, Homo sapiens
ctgcaagaattaaaa

SEQ ID NO: 1873664 - DNA, 13 bp, Homo sapiens
ctgcactcctgga

SEQ ID NO: 1873665 - DNA, 19 bp, Homo sapiens
ctgcagccgtgcaggactc

SEQ ID NO: 1873666 - DNA, 22 bp, Homo sapiens
ctgcagctcctggaaggtgtca

SEQ ID NO: 1873667 - DNA, 12 bp, Homo sapiens
ctgcagctttac

SEQ ID NO: 1873668 - DNA, 21 bp, Homo sapiens
ctgcagctttgggaaagctgc

SEQ ID NO: 1873669 - DNA, 11 bp, Homo sapiens
ctgcaggccag

SEQ ID NO: 1873670 - DNA, 19 bp, Homo sapiens
ctgcaggccaggccagctt

SEQ ID NO: 1873671 - DNA, 22 bp, Homo sapiens
ctgcaggccaggccagcttccc

SEQ ID NO: 1873672 - DNA, 18 bp, Homo sapiens
ctgcatcagctttttgta

SEQ ID NO: 1873673 - DNA, 20 bp, Homo sapiens
cacctgggccaaggactcca

SEQ ID NO: 1873674 - DNA, 19 bp, Homo sapiens
caccttaccaactttctgt

SEQ ID NO: 1873675 - DNA, 21 bp, Homo sapiens
cacgatgacgcctctggacct

SEQ ID NO: 1873676 - DNA, 14 bp, Homo sapiens
cacggtcttctgca

SEQ ID NO: 1873677 - DNA, 13 bp, Homo sapiens
cactaaataaact

SEQ ID NO: 1873678 - DNA, 18 bp, Homo sapiens
cactaaataaactacttt

SEQ ID NO: 1873679 - DNA, 21 bp, Homo sapiens
cactaaattagtttaaaatga

SEQ ID NO: 1873680 - DNA, 20 bp, Homo sapiens
cactacatgtggtttataga

SEQ ID NO: 1873681 - DNA, 18 bp, Homo sapiens
cactagaagatgagggtg

SEQ ID NO: 1873682 - DNA, 23 bp, Homo sapiens
cactagagtcacccccccaggcc

SEQ ID NO: 1873683 - DNA, 18 bp, Homo sapiens
cactagctaagcaagcca

SEQ ID NO: 1873684 - DNA, 19 bp, Homo sapiens
cactagctaagcaagccag

SEQ ID NO: 1873685 - DNA, 22 bp, Homo sapiens
cactcagagggaggagtttttc

SEQ ID NO: 1873686 - DNA, 18 bp, Homo sapiens
cactcaggaaccctggag

SEQ ID NO: 1873687 - DNA, 19 bp, Homo sapiens
cactcaggaaccctggaga

SEQ ID NO: 1873688 - DNA, 20 bp, Homo sapiens
cactcaggaaccctggagac

SEQ ID NO: 1873689 - DNA, 23 bp, Homo sapiens
cactcaggaaccctggagacaga

SEQ ID NO: 1873690 - DNA, 20 bp, Homo sapiens
cactcatgcaaactgcttta

SEQ ID NO: 1873691 - DNA, 21 bp, Homo sapiens
cactcatgcaaactgctttat

SEQ ID NO: 1873692 - DNA, 22 bp, Homo sapiens
cactcatgcaaactgctttatt

SEQ ID NO: 1873693 - DNA, 15 bp, Homo sapiens
cactccaggtgtgga

SEQ ID NO: 1873694 - DNA, 12 bp, Homo sapiens
cactgacctgcc

SEQ ID NO: 1873695 - DNA, 13 bp, Homo sapiens
cactgacctgccc

SEQ ID NO: 1873696 - DNA, 23 bp, Homo sapiens
cactgacctgcccatgtccagag

SEQ ID NO: 1873697 - DNA, 14 bp, Homo sapiens
cactgccaccagca

SEQ ID NO: 1873698 - DNA, 21 bp, Homo sapiens
cactggcatcgcagcttcctg

SEQ ID NO: 1873699 - DNA, 23 bp, Homo sapiens
cactgggaaccaagggccctcac

SEQ ID NO: 1873700 - DNA, 14 bp, Homo sapiens
cactgggccctggg

SEQ ID NO: 1873701 - DNA, 18 bp, Homo sapiens
cactgggccctggggctg

SEQ ID NO: 1873702 - DNA, 21 bp, Homo sapiens
cactgggccctggggctgccc

SEQ ID NO: 1873703 - DNA, 23 bp, Homo sapiens
cactgggccctggggctgccctc

SEQ ID NO: 1873704 - DNA, 15 bp, Homo sapiens
cactgtggcactgcc

SEQ ID NO: 1873705 - DNA, 16 bp, Homo sapiens
cactgtggcactgcca

SEQ ID NO: 1873706 - DNA, 19 bp, Homo sapiens
cactgtggcactgccacca

SEQ ID NO: 1873707 - DNA, 14 bp, Homo sapiens
cactgtgtattgtt

SEQ ID NO: 1873708 - DNA, 16 bp, Homo sapiens
cactgttgaaaattat

SEQ ID NO: 1873709 - DNA, 18 bp, Homo sapiens
cactgttgaaaattattt

SEQ ID NO: 1873710 - DNA, 17 bp, Homo sapiens
cactgttgaatgcctgt

SEQ ID NO: 1873711 - DNA, 18 bp, Homo sapiens
cactgttggcacttatag

SEQ ID NO: 1873712 - DNA, 15 bp, Homo sapiens
cacttacaagtggtg

SEQ ID NO: 1873713 - DNA, 21 bp, Homo sapiens
cacttctaagttgagtatatt

SEQ ID NO: 1873714 - DNA, 23 bp, Homo sapiens
cacttctaagttgagtatattat

SEQ ID NO: 1873715 - DNA, 20 bp, Homo sapiens
cacttgttcaacagtttctc

SEQ ID NO: 1873716 - DNA, 19 bp, Homo sapiens
cactttgaaggtaataaat

SEQ ID NO: 1873717 - DNA, 12 bp, Homo sapiens
cagaaattaaaa

SEQ ID NO: 1873718 - DNA, 13 bp, Homo sapiens
cagaaattaaaat

SEQ ID NO: 1873719 - DNA, 14 bp, Homo sapiens
cagaaattaaaata

SEQ ID NO: 1873720 - DNA, 20 bp, Homo sapiens
cagaacaacttgctacttat

SEQ ID NO: 1873721 - DNA, 16 bp, Homo sapiens
cagaaccagtctttca

SEQ ID NO: 1873722 - DNA, 17 bp, Homo sapiens
cagaaccttactggcac

SEQ ID NO: 1873723 - DNA, 23 bp, Homo sapiens
cagaaccttactggcactgtggc

SEQ ID NO: 1873724 - DNA, 18 bp, Homo sapiens
cagaatctgtatgattct

SEQ ID NO: 1873725 - DNA, 14 bp, Homo sapiens
cagaatgcattaaa

SEQ ID NO: 1873726 - DNA, 17 bp, Homo sapiens
cagaatgcattaaaaaa

SEQ ID NO: 1873727 - DNA, 14 bp, Homo sapiens
cagaattggcataa

SEQ ID NO: 1873728 - DNA, 23 bp, Homo sapiens
cagaattggcataatttgtctta

SEQ ID NO: 1873729 - DNA, 23 bp, Homo sapiens
cagacatccatgtttgtaaaact

SEQ ID NO: 1873730 - DNA, 21 bp, Homo sapiens
cagacttagtttttataaaat

SEQ ID NO: 1873731 - DNA, 19 bp, Homo sapiens
cagacttgcggccacagca

SEQ ID NO: 1873732 - DNA, 9 bp, Homo sapiens
cagagaaag

SEQ ID NO: 1873733 - DNA, 13 bp, Homo sapiens
cagagaaagaaaa

SEQ ID NO: 1873734 - DNA, 14 bp, Homo sapiens
cagagagcatcttt

SEQ ID NO: 1873735 - DNA, 19 bp, Homo sapiens
cagagcacaagaaggccag

SEQ ID NO: 1873736 - DNA, 21 bp, Homo sapiens
cagagcacaagaaggccagcc

SEQ ID NO: 1873737 - DNA, 18 bp, Homo sapiens
cagagcttgtagccctgg

SEQ ID NO: 1873738 - DNA, 22 bp, Homo sapiens
cagagtcagccattcctgttct

SEQ ID NO: 1873739 - DNA, 13 bp, Homo sapiens
cagagtggcctgt

SEQ ID NO: 1873740 - DNA, 15 bp, Homo sapiens
cagagtggcctgtga

SEQ ID NO: 1873741 - DNA, 16 bp, Homo sapiens
cagagtggcctgtgag

SEQ ID NO: 1873742 - DNA, 17 bp, Homo sapiens
cagagtggcctgtgagc

SEQ ID NO: 1873743 - DNA, 21 bp, Homo sapiens
cagagttgttgtttgccaagc

SEQ ID NO: 1873744 - DNA, 14 bp, Homo sapiens
cagatcatggcagg

SEQ ID NO: 1873745 - DNA, 23 bp, Homo sapiens
cagatctttaaatacagtcaact

SEQ ID NO: 1873746 - DNA, 12 bp, Homo sapiens
cagatgctgaat

SEQ ID NO: 1873747 - DNA, 18 bp, Homo sapiens
cagatggaagaagtttta

SEQ ID NO: 1873748 - DNA, 21 bp, Homo sapiens
cagatggaagaagttttaact

SEQ ID NO: 1873749 - DNA, 16 bp, Homo sapiens
cagatttctctttgaa

SEQ ID NO: 1873750 - DNA, 12 bp, Homo sapiens
cagcaaagccat

SEQ ID NO: 1873751 - DNA, 14 bp, Homo sapiens
cagcaaagccatat

SEQ ID NO: 1873752 - DNA, 14 bp, Homo sapiens
cagcaatgccctgc

SEQ ID NO: 1873753 - DNA, 15 bp, Homo sapiens
cagcaatgccctgcc

SEQ ID NO: 1873754 - DNA, 16 bp, Homo sapiens
cagcaatgccctgcct

SEQ ID NO: 1873755 - DNA, 17 bp, Homo sapiens
cagcacgcatgtccctc

SEQ ID NO: 1873756 - DNA, 13 bp, Homo sapiens
cagccaaggaatg

SEQ ID NO: 1873757 - DNA, 20 bp, Homo sapiens
cagccaaggaatgtgtccaa

SEQ ID NO: 1873758 - DNA, 17 bp, Homo sapiens
cagccattcctgttctc

SEQ ID NO: 1873759 - DNA, 19 bp, Homo sapiens
cagccattcctgttctctt

SEQ ID NO: 1873760 - DNA, 20 bp, Homo sapiens
cagccattcctgttctcttt

SEQ ID NO: 1873761 - DNA, 19 bp, Homo sapiens
cagcccactgggccctggg

SEQ ID NO: 1873762 - DNA, 21 bp, Homo sapiens
cagcccccaaagagctgtggc

SEQ ID NO: 1873763 - DNA, 20 bp, Homo sapiens
cagcccccactgacctgccc

SEQ ID NO: 1873764 - DNA, 23 bp, Homo sapiens
cagcccccactgacctgcccatg

SEQ ID NO: 1873765 - DNA, 16 bp, Homo sapiens
cagccgtgcaggactc

SEQ ID NO: 1873766 - DNA, 14 bp, Homo sapiens
cagcctctgactca

SEQ ID NO: 1873767 - DNA, 16 bp, Homo sapiens
cagcctctgactcacc

SEQ ID NO: 1873768 - DNA, 17 bp, Homo sapiens
cagcctctgactcacca

SEQ ID NO: 1873769 - DNA, 11 bp, Homo sapiens
cagcctctggg

SEQ ID NO: 1873770 - DNA, 12 bp, Homo sapiens
cagcctctgggg

SEQ ID NO: 1873771 - DNA, 20 bp, Homo sapiens
cagcctgggggggccgctct

SEQ ID NO: 1873772 - DNA, 20 bp, Homo sapiens
cagccttaaacagtgtccag

SEQ ID NO: 1873773 - DNA, 21 bp, Homo sapiens
cagccttaaacagtgtccagg

SEQ ID NO: 1873774 - DNA, 20 bp, Homo sapiens
cagccttatgtgttacatta

SEQ ID NO: 1873775 - DNA, 13 bp, Homo sapiens
cagcgggccaggc

SEQ ID NO: 1873776 - DNA, 19 bp, Homo sapiens
cagctactgatttttgtga

SEQ ID NO: 1873777 - DNA, 15 bp, Homo sapiens
cagctagtgccaaat

SEQ ID NO: 1873778 - DNA, 20 bp, Homo sapiens
cagctagtgccaaataattg

SEQ ID NO: 1873779 - DNA, 11 bp, Homo sapiens
caggagcagct

SEQ ID NO: 1873780 - DNA, 12 bp, Homo sapiens
caggagcagctg

SEQ ID NO: 1873781 - DNA, 17 bp, Homo sapiens
caggagcagctggcact

SEQ ID NO: 1873782 - DNA, 20 bp, Homo sapiens
caggagcagctggcactgac

SEQ ID NO: 1873783 - DNA, 13 bp, Homo sapiens
caggccaggccag

SEQ ID NO: 1873784 - DNA, 13 bp, Homo sapiens
caggcctccagaa

SEQ ID NO: 1873785 - DNA, 13 bp, Homo sapiens
cagggcctctggc

SEQ ID NO: 1873786 - DNA, 14 bp, Homo sapiens
cagggcctctggct

SEQ ID NO: 1873787 - DNA, 20 bp, Homo sapiens
cagggcctctggcttccctg

SEQ ID NO: 1873788 - DNA, 21 bp, Homo sapiens
cagggcctctggcttccctgc

SEQ ID NO: 1873789 - DNA, 21 bp, Homo sapiens
cagggctttggggggcactag

SEQ ID NO: 1873790 - DNA, 23 bp, Homo sapiens
cagggctttggggggcactagaa

SEQ ID NO: 1873791 - DNA, 14 bp, Homo sapiens
caggggtgtcccag

SEQ ID NO: 1873792 - DNA, 16 bp, Homo sapiens
caggtcatggagcagc

SEQ ID NO: 1873793 - DNA, 17 bp, Homo sapiens
caggtcatggagcagcc

SEQ ID NO: 1873794 - DNA, 20 bp, Homo sapiens
caggtcatggagcagccccc

SEQ ID NO: 1873795 - DNA, 21 bp, Homo sapiens
caggtttactcagtgaaatca

SEQ ID NO: 1873796 - DNA, 12 bp, Homo sapiens
cagtaaacactg

SEQ ID NO: 1873797 - DNA, 18 bp, Homo sapiens
cagtaatatgaaagccac

SEQ ID NO: 1873798 - DNA, 18 bp, Homo sapiens
cagtatcttagagtttac

SEQ ID NO: 1873799 - DNA, 21 bp, Homo sapiens
cagtatcttagagtttacagt

SEQ ID NO: 1873800 - DNA, 16 bp, Homo sapiens
cagtattcttgtcaaa

SEQ ID NO: 1873801 - DNA, 17 bp, Homo sapiens
cagtattttggagaaat

SEQ ID NO: 1873802 - DNA, 19 bp, Homo sapiens
cagtattttggagaaatta

SEQ ID NO: 1873803 - DNA, 20 bp, Homo sapiens
cagtattttggagaaattat

SEQ ID NO: 1873804 - DNA, 19 bp, Homo sapiens
cagtcacctcctgctcctt

SEQ ID NO: 1873805 - DNA, 14 bp, Homo sapiens
cagtcccagcctct

SEQ ID NO: 1873806 - DNA, 22 bp, Homo sapiens
cagtcccagcctctggggcaga

SEQ ID NO: 1873807 - DNA, 19 bp, Homo sapiens
cagtcttaatattcagaga

SEQ ID NO: 1873808 - DNA, 15 bp, Homo sapiens
cagtcttttgctgtg

SEQ ID NO: 1873809 - DNA, 19 bp, Homo sapiens
cagtgaaatcatattaatt

SEQ ID NO: 1873810 - DNA, 18 bp, Homo sapiens
cagtgagtgccatgcttt

SEQ ID NO: 1873811 - DNA, 13 bp, Homo sapiens
cagtgtatttaag

SEQ ID NO: 1873812 - DNA, 20 bp, Homo sapiens
cagttaaataaatagaaaga

SEQ ID NO: 1873813 - DNA, 17 bp, Homo sapiens
cagttataagcgtattt

SEQ ID NO: 1873814 - DNA, 15 bp, Homo sapiens
cagtttagagttcta

SEQ ID NO: 1873815 - DNA, 15 bp, Homo sapiens
cagtttattctgtgg

SEQ ID NO: 1873816 - DNA, 15 bp, Homo sapiens
cagtttcatgtatgt

SEQ ID NO: 1873817 - DNA, 19 bp, Homo sapiens
cagtttctcaagtttaaag

SEQ ID NO: 1873818 - DNA, 21 bp, Homo sapiens
cagtttgtgttttaaaaaaac

SEQ ID NO: 1873819 - DNA, 13 bp, Homo sapiens
cataaaactttaa

SEQ ID NO: 1873820 - DNA, 16 bp, Homo sapiens
cataaaactttaaaag

SEQ ID NO: 1873821 - DNA, 18 bp, Homo sapiens
cataaaactttaaaaggc

SEQ ID NO: 1873822 - DNA, 21 bp, Homo sapiens
cataaatcaattcattgtgta

SEQ ID NO: 1873823 - DNA, 20 bp, Homo sapiens
cataatgaaccgtttacagt

SEQ ID NO: 1873824 - DNA, 21 bp, Homo sapiens
cataatgaaccgtttacagtg

SEQ ID NO: 1873825 - DNA, 20 bp, Homo sapiens
cataattcaccaaaagttca

SEQ ID NO: 1873826 - DNA, 21 bp, Homo sapiens
cataatttgtcttagttgata

SEQ ID NO: 1873827 - DNA, 12 bp, Homo sapiens
catacaaaaaaa

SEQ ID NO: 1873828 - DNA, 19 bp, Homo sapiens
cataccagtcacctcctgc

SEQ ID NO: 1873829 - DNA, 17 bp, Homo sapiens
catactcctatgcttta

SEQ ID NO: 1873830 - DNA, 21 bp, Homo sapiens
cataggaagacataaaacttt

SEQ ID NO: 1873831 - DNA, 18 bp, Homo sapiens
catatatgctgtatttct

SEQ ID NO: 1873832 - DNA, 15 bp, Homo sapiens
catatctaatttacc

SEQ ID NO: 1873833 - DNA, 14 bp, Homo sapiens
catatgtatctttg

SEQ ID NO: 1873834 - DNA, 16 bp, Homo sapiens
catattctaaattcac

SEQ ID NO: 1873835 - DNA, 17 bp, Homo sapiens
catattctaaattcact

SEQ ID NO: 1873836 - DNA, 13 bp, Homo sapiens
catattgctctta

SEQ ID NO: 1873837 - DNA, 15 bp, Homo sapiens
catcagctttttgta

SEQ ID NO: 1873838 - DNA, 18 bp, Homo sapiens
catcagctttttgtatta

SEQ ID NO: 1873839 - DNA, 18 bp, Homo sapiens
catccatgtttgtaaaac

SEQ ID NO: 1873840 - DNA, 19 bp, Homo sapiens
catccatgtttgtaaaact

SEQ ID NO: 1873841 - DNA, 13 bp, Homo sapiens
catcgcagcttcc

SEQ ID NO: 1873842 - DNA, 15 bp, Homo sapiens
catctaaagctttat

SEQ ID NO: 1873843 - DNA, 18 bp, Homo sapiens
catctaaagctttatctt

SEQ ID NO: 1873844 - DNA, 15 bp, Homo sapiens
catctgtgtgaaaat

SEQ ID NO: 1873845 - DNA, 12 bp, Homo sapiens
catctgttgttt

SEQ ID NO: 1873846 - DNA, 14 bp, Homo sapiens
catgacaaaaataa

SEQ ID NO: 1873847 - DNA, 16 bp, Homo sapiens
catgacaaacctagct

SEQ ID NO: 1873848 - DNA, 16 bp, Homo sapiens
catgcaaactgcttta

SEQ ID NO: 1873849 - DNA, 23 bp, Homo sapiens
catgcaaactgctttattttccc

SEQ ID NO: 1873850 - DNA, 19 bp, Homo sapiens
catgctgaggttttgaata

SEQ ID NO: 1873851 - DNA, 20 bp, Homo sapiens
catgctgaggttttgaataa

SEQ ID NO: 1873852 - DNA, 14 bp, Homo sapiens
catgggaaaaagag

SEQ ID NO: 1873853 - DNA, 19 bp, Homo sapiens
catgtccagagggactgga

SEQ ID NO: 1873854 - DNA, 21 bp, Homo sapiens
catgtccagagggactggaca

SEQ ID NO: 1873855 - DNA, 22 bp, Homo sapiens
catgtccagagggactggacag

SEQ ID NO: 1873856 - DNA, 14 bp, Homo sapiens
catgtccctccaag

SEQ ID NO: 1873857 - DNA, 20 bp, Homo sapiens
catgtttgtctgtgtgctgt

SEQ ID NO: 1873858 - DNA, 15 bp, Homo sapiens
cattaaaatatatgt

SEQ ID NO: 1873859 - DNA, 19 bp, Homo sapiens
cattaaaatatatgttctg

SEQ ID NO: 1873860 - DNA, 17 bp, Homo sapiens
cattaactaaatgctca

SEQ ID NO: 1873861 - DNA, 16 bp, Homo sapiens
cattaccttgtctttc

SEQ ID NO: 1873862 - DNA, 15 bp, Homo sapiens
cattatcttcatgtt

SEQ ID NO: 1873863 - DNA, 18 bp, Homo sapiens
cattcctgttctctttgc

SEQ ID NO: 1873864 - DNA, 16 bp, Homo sapiens
cattcttggttgttaa

SEQ ID NO: 1873865 - DNA, 21 bp, Homo sapiens
cattgaaatcagcatgacaaa

SEQ ID NO: 1873866 - DNA, 12 bp, Homo sapiens
cattgtgattta

SEQ ID NO: 1873867 - DNA, 21 bp, Homo sapiens
cattgtggccagtttagagtt

SEQ ID NO: 1873868 - DNA, 16 bp, Homo sapiens
catttaaggagattgg

SEQ ID NO: 1873869 - DNA, 21 bp, Homo sapiens
catttagtaccctgcaggcca

SEQ ID NO: 1873870 - DNA, 21 bp, Homo sapiens
catttctaacataagtaagac

SEQ ID NO: 1873871 - DNA, 13 bp, Homo sapiens
catttctgtatac

SEQ ID NO: 1873872 - DNA, 18 bp, Homo sapiens
catttgacaacacatgtg

SEQ ID NO: 1873873 - DNA, 11 bp, Homo sapiens
catttgctgcc

SEQ ID NO: 1873874 - DNA, 17 bp, Homo sapiens
catttgctgccctgggg

SEQ ID NO: 1873875 - DNA, 19 bp, Homo sapiens
catttgctgccctggggca

SEQ ID NO: 1873876 - DNA, 20 bp, Homo sapiens
catttgctgccctggggcat

SEQ ID NO: 1873877 - DNA, 13 bp, Homo sapiens
catttgctttttg

SEQ ID NO: 1873878 - DNA, 16 bp, Homo sapiens
catttggcttgctgtt

SEQ ID NO: 1873879 - DNA, 13 bp, Homo sapiens
catttttgtataa

SEQ ID NO: 1873880 - DNA, 17 bp, Homo sapiens
catttttgtataaaaag

SEQ ID NO: 1873881 - DNA, 22 bp, Homo sapiens
catttttgtataaaaaggaaat

SEQ ID NO: 1873882 - DNA, 14 bp, Homo sapiens
ccaaaccagtttat

SEQ ID NO: 1873883 - DNA, 21 bp, Homo sapiens
ccaaaccagtttattctgtgg

SEQ ID NO: 1873884 - DNA, 19 bp, Homo sapiens
ccaaagagctgtggctggg

SEQ ID NO: 1873885 - DNA, 19 bp, Homo sapiens
ccaaattaatcttttaaaa

SEQ ID NO: 1873886 - DNA, 18 bp, Homo sapiens
ccaaattattaattgtcc

SEQ ID NO: 1873887 - DNA, 23 bp, Homo sapiens
ccaaattattaattgtcctgtgt

SEQ ID NO: 1873888 - DNA, 18 bp, Homo sapiens
ccaaattatttgtgtaat

SEQ ID NO: 1873889 - DNA, 17 bp, Homo sapiens
ccaaattgtctgtctgc

SEQ ID NO: 1873890 - DNA, 20 bp, Homo sapiens
ccaaattgtctgtctgctct

SEQ ID NO: 1873891 - DNA, 11 bp, Homo sapiens
ccaaatttaga

SEQ ID NO: 1873892 - DNA, 16 bp, Homo sapiens
ccaacagtttattttt

SEQ ID NO: 1873893 - DNA, 14 bp, Homo sapiens
ccaactttctgtaa

SEQ ID NO: 1873894 - DNA, 17 bp, Homo sapiens
ccaactttctgtaaact

SEQ ID NO: 1873895 - DNA, 14 bp, Homo sapiens
ccaagacacatgct

SEQ ID NO: 1873896 - DNA, 13 bp, Homo sapiens
ccaaggctgtctt

SEQ ID NO: 1873897 - DNA, 15 bp, Homo sapiens
ccaagggccctcact

SEQ ID NO: 1873898 - DNA, 13 bp, Homo sapiens
atttttgtataaa

SEQ ID NO: 1873899 - DNA, 21 bp, Homo sapiens
atttttgtataaaaaggaaat

SEQ ID NO: 1873900 - DNA, 21 bp, Homo sapiens
agctttcccaaataaactcta

SEQ ID NO: 1873901 - DNA, 14 bp, Homo sapiens
aggaaccctggaga

SEQ ID NO: 1873902 - DNA, 16 bp, Homo sapiens
aggaagacataaaact

SEQ ID NO: 1873903 - DNA, 17 bp, Homo sapiens
aggaagacataaaactt

SEQ ID NO: 1873904 - DNA, 18 bp, Homo sapiens
aggaagacataaaacttt

SEQ ID NO: 1873905 - DNA, 16 bp, Homo sapiens
aggaatgtgtccaaga

SEQ ID NO: 1873906 - DNA, 19 bp, Homo sapiens
aggaccactagctaagcaa

SEQ ID NO: 1873907 - DNA, 12 bp, Homo sapiens
aggactgggccg

SEQ ID NO: 1873908 - DNA, 22 bp, Homo sapiens
aggactgggccgggcccagggc

SEQ ID NO: 1873909 - DNA, 16 bp, Homo sapiens
aggagaagacccctgc

SEQ ID NO: 1873910 - DNA, 17 bp, Homo sapiens
aggagaagacccctgcc

SEQ ID NO: 1873911 - DNA, 18 bp, Homo sapiens
aggagaagacccctgccc

SEQ ID NO: 1873912 - DNA, 17 bp, Homo sapiens
aggagcagctggcactg

SEQ ID NO: 1873913 - DNA, 23 bp, Homo sapiens
aggagcagctggcactgacagcc

SEQ ID NO: 1873914 - DNA, 17 bp, Homo sapiens
aggaggtccttggagtg

SEQ ID NO: 1873915 - DNA, 15 bp, Homo sapiens
aggatataaaaggat

SEQ ID NO: 1873916 - DNA, 17 bp, Homo sapiens
aggatataaaaggatgt

SEQ ID NO: 1873917 - DNA, 15 bp, Homo sapiens
aggatcttttgtaaa

SEQ ID NO: 1873918 - DNA, 22 bp, Homo sapiens
aggatgttacaagtttgctaaa

SEQ ID NO: 1873919 - DNA, 13 bp, Homo sapiens
aggcaaaagactg

SEQ ID NO: 1873920 - DNA, 18 bp, Homo sapiens
aggcaactcaaagatgat

SEQ ID NO: 1873921 - DNA, 20 bp, Homo sapiens
aggcacttttattttcattg

SEQ ID NO: 1873922 - DNA, 17 bp, Homo sapiens
aggcatatgcttcttta

SEQ ID NO: 1873923 - DNA, 12 bp, Homo sapiens
aggccagcccac

SEQ ID NO: 1873924 - DNA, 17 bp, Homo sapiens
aggccagcccactgggc

SEQ ID NO: 1873925 - DNA, 21 bp, Homo sapiens
aggccagcccactgggccctg

SEQ ID NO: 1873926 - DNA, 23 bp, Homo sapiens
aggccagcccactgggccctggg

SEQ ID NO: 1873927 - DNA, 15 bp, Homo sapiens
aggccatttgctgcc

SEQ ID NO: 1873928 - DNA, 14 bp, Homo sapiens
aggccctgtctgta

SEQ ID NO: 1873929 - DNA, 20 bp, Homo sapiens
aggcctccagaaccttactg

SEQ ID NO: 1873930 - DNA, 19 bp, Homo sapiens
aggcggacaaagttcagtg

SEQ ID NO: 1873931 - DNA, 15 bp, Homo sapiens
aggcgggtggctggt

SEQ ID NO: 1873932 - DNA, 22 bp, Homo sapiens
aggctccctgaccaccctgcct

SEQ ID NO: 1873933 - DNA, 20 bp, Homo sapiens
aggctgtcttctcccagagc

SEQ ID NO: 1873934 - DNA, 22 bp, Homo sapiens
aggctgtcttctcccagagcac

SEQ ID NO: 1873935 - DNA, 13 bp, Homo sapiens
aggctttaaaagt

SEQ ID NO: 1873936 - DNA, 19 bp, Homo sapiens
agggaacccccaaatttaa

SEQ ID NO: 1873937 - DNA, 15 bp, Homo sapiens
agggactggacagcc

SEQ ID NO: 1873938 - DNA, 22 bp, Homo sapiens
attttttgcagtcttttgctgt

SEQ ID NO: 1873939 - DNA, 21 bp, Homo sapiens
atttttttaaacaaaatttca

SEQ ID NO: 1873940 - DNA, 22 bp, Homo sapiens
attttttttttttggtaattat

SEQ ID NO: 1873941 - DNA, 13 bp, Homo sapiens
caaaaaaaagaac

SEQ ID NO: 1873942 - DNA, 15 bp, Homo sapiens
caaaaaaaatcttta

SEQ ID NO: 1873943 - DNA, 13 bp, Homo sapiens
caaaacttaacat

SEQ ID NO: 1873944 - DNA, 19 bp, Homo sapiens
caaaagaaaccatgacaaa

SEQ ID NO: 1873945 - DNA, 16 bp, Homo sapiens
caaaagactggtttgt

SEQ ID NO: 1873946 - DNA, 17 bp, Homo sapiens
caaaagactggtttgtt

SEQ ID NO: 1873947 - DNA, 20 bp, Homo sapiens
caaaataatctatattaaat

SEQ ID NO: 1873948 - DNA, 21 bp, Homo sapiens
caaaataatctatattaaatg

SEQ ID NO: 1873949 - DNA, 17 bp, Homo sapiens
caaaatgtacttaaatg

SEQ ID NO: 1873950 - DNA, 14 bp, Homo sapiens
caaaatttcacagt

SEQ ID NO: 1873951 - DNA, 16 bp, Homo sapiens
caaacaaaaaaaagaa

SEQ ID NO: 1873952 - DNA, 19 bp, Homo sapiens
caaacatatgtatctttgg

SEQ ID NO: 1873953 - DNA, 23 bp, Homo sapiens
caaaccagtttattctgtggttc

SEQ ID NO: 1873954 - DNA, 21 bp, Homo sapiens
caaaccttaagataatggata

SEQ ID NO: 1873955 - DNA, 14 bp, Homo sapiens
caaacttttctttc

SEQ ID NO: 1873956 - DNA, 15 bp, Homo sapiens
caaagcaacctttcc

SEQ ID NO: 1873957 - DNA, 19 bp, Homo sapiens
caaagcatgggaaaaagag

SEQ ID NO: 1873958 - DNA, 13 bp, Homo sapiens
caaagttcagtgt

SEQ ID NO: 1873959 - DNA, 22 bp, Homo sapiens
caaataattttttgcagtcttt

SEQ ID NO: 1873960 - DNA, 15 bp, Homo sapiens
caaatcacaaacata

SEQ ID NO: 1873961 - DNA, 22 bp, Homo sapiens
caaatgaacttttacagaatgc

SEQ ID NO: 1873962 - DNA, 19 bp, Homo sapiens
caaatggcttacttacaaa

SEQ ID NO: 1873963 - DNA, 19 bp, Homo sapiens
caaatgtaactatgtttta

SEQ ID NO: 1873964 - DNA, 13 bp, Homo sapiens
caaattaatcttt

SEQ ID NO: 1873965 - DNA, 18 bp, Homo sapiens
caaattaatcttttaaaa

SEQ ID NO: 1873966 - DNA, 19 bp, Homo sapiens
caaattaatcttttaaaaa

SEQ ID NO: 1873967 - DNA, 15 bp, Homo sapiens
caaattattaattgt

SEQ ID NO: 1873968 - DNA, 23 bp, Homo sapiens
caaattattaattgtcctgtgtc

SEQ ID NO: 1873969 - DNA, 15 bp, Homo sapiens
caaattatttgtgta

SEQ ID NO: 1873970 - DNA, 16 bp, Homo sapiens
caaattgtaattaata

SEQ ID NO: 1873971 - DNA, 20 bp, Homo sapiens
caaattgtaattaataatag

SEQ ID NO: 1873972 - DNA, 21 bp, Homo sapiens
caaattgtaattaataataga

SEQ ID NO: 1873973 - DNA, 14 bp, Homo sapiens
caaatttaattaaa

SEQ ID NO: 1873974 - DNA, 21 bp, Homo sapiens
caaattttattaaaagagtag

SEQ ID NO: 1873975 - DNA, 13 bp, Homo sapiens
caaattttttaat

SEQ ID NO: 1873976 - DNA, 15 bp, Homo sapiens
caacaagagtttatt

SEQ ID NO: 1873977 - DNA, 16 bp, Homo sapiens
caacagaagcttcaga

SEQ ID NO: 1873978 - DNA, 17 bp, Homo sapiens
caacagaagcttcagaa

SEQ ID NO: 1873979 - DNA, 21 bp, Homo sapiens
caacagtttctcaagtttaaa

SEQ ID NO: 1873980 - DNA, 21 bp, Homo sapiens
caacatggctacttgctttga

SEQ ID NO: 1873981 - DNA, 18 bp, Homo sapiens
caacattaccttgtcttt

SEQ ID NO: 1873982 - DNA, 19 bp, Homo sapiens
caacattaccttgtctttc

SEQ ID NO: 1873983 - DNA, 13 bp, Homo sapiens
caacatttctgta

SEQ ID NO: 1873984 - DNA, 15 bp, Homo sapiens
caactcaaagatgat

SEQ ID NO: 1873985 - DNA, 16 bp, Homo sapiens
caactcaaagatgatg

SEQ ID NO: 1873986 - DNA, 14 bp, Homo sapiens
caactcattgcatc

SEQ ID NO: 1873987 - DNA, 14 bp, Homo sapiens
caactcgtgacagc

SEQ ID NO: 1873988 - DNA, 18 bp, Homo sapiens
caactcgtgacagcctct

SEQ ID NO: 1873989 - DNA, 19 bp, Homo sapiens
caagaaaacctgtttttaa

SEQ ID NO: 1873990 - DNA, 14 bp, Homo sapiens
caagaaggccagcc

SEQ ID NO: 1873991 - DNA, 13 bp, Homo sapiens
caagaattaaaac

SEQ ID NO: 1873992 - DNA, 16 bp, Homo sapiens
caagacagtggcacta

SEQ ID NO: 1873993 - DNA, 22 bp, Homo sapiens
caagacagtggcactaaaatgt

SEQ ID NO: 1873994 - DNA, 15 bp, Homo sapiens
caagacttggcaaca

SEQ ID NO: 1873995 - DNA, 20 bp, Homo sapiens
caagacttggcaacagaagc

SEQ ID NO: 1873996 - DNA, 11 bp, Homo sapiens
caagagccagg

SEQ ID NO: 1873997 - DNA, 20 bp, Homo sapiens
caagccaggagaagacccct

SEQ ID NO: 1873998 - DNA, 23 bp, Homo sapiens
caagccaggagaagacccctgcc

SEQ ID NO: 1873999 - DNA, 18 bp, Homo sapiens
caaggaaaattgaaagta

SEQ ID NO: 1874000 - DNA, 14 bp, Homo sapiens
caaggaatgtgtcc

SEQ ID NO: 1874001 - DNA, 19 bp, Homo sapiens
caaggctgtcttctcccag

SEQ ID NO: 1874002 - DNA, 22 bp, Homo sapiens
caaggctgtcttctcccagagc

SEQ ID NO: 1874003 - DNA, 14 bp, Homo sapiens
caagggccctcact

SEQ ID NO: 1874004 - DNA, 21 bp, Homo sapiens
caaggtaatttttttttgtaa

SEQ ID NO: 1874005 - DNA, 20 bp, Homo sapiens
caagtatgaagtataaatct

SEQ ID NO: 1874006 - DNA, 18 bp, Homo sapiens
caagtcctgtgaatttct

SEQ ID NO: 1874007 - DNA, 18 bp, Homo sapiens
caagtggctcttgggaca

SEQ ID NO: 1874008 - DNA, 15 bp, Homo sapiens
caagtggtgaccaaa

SEQ ID NO: 1874009 - DNA, 12 bp, Homo sapiens
caagttattgta

SEQ ID NO: 1874010 - DNA, 11 bp, Homo sapiens
caagtttgcta

SEQ ID NO: 1874011 - DNA, 14 bp, Homo sapiens
caagtttgctaaaa

SEQ ID NO: 1874012 - DNA, 17 bp, Homo sapiens
caagtttgctaaaagaa

SEQ ID NO: 1874013 - DNA, 17 bp, Homo sapiens
caatatggggcattaat

SEQ ID NO: 1874014 - DNA, 21 bp, Homo sapiens
caatatgtaaatagtgcagaa

SEQ ID NO: 1874015 - DNA, 20 bp, Homo sapiens
caatcatctgtgtgaaaatg

SEQ ID NO: 1874016 - DNA, 16 bp, Homo sapiens
caatcctccctggaga

SEQ ID NO: 1874017 - DNA, 20 bp, Homo sapiens
caatgatacccaacagttta

SEQ ID NO: 1874018 - DNA, 22 bp, Homo sapiens
caatgatacccaacagtttatt

SEQ ID NO: 1874019 - DNA, 21 bp, Homo sapiens
caatgatcacatctaaagctt

SEQ ID NO: 1874020 - DNA, 16 bp, Homo sapiens
caatgccctgccttgc

SEQ ID NO: 1874021 - DNA, 15 bp, Homo sapiens
caattaattaaaagt

SEQ ID NO: 1874022 - DNA, 23 bp, Homo sapiens
caattagcagaatggagaaagta

SEQ ID NO: 1874023 - DNA, 13 bp, Homo sapiens
caattcattgtgt

SEQ ID NO: 1874024 - DNA, 22 bp, Homo sapiens
caatttattaaaatgattgtaa

SEQ ID NO: 1874025 - DNA, 19 bp, Homo sapiens
caatttcaggaatttaatt

SEQ ID NO: 1874026 - DNA, 23 bp, Homo sapiens
caatttcaggaatttaatttata

SEQ ID NO: 1874027 - DNA, 21 bp, Homo sapiens
caatttcctttatatttagtg

SEQ ID NO: 1874028 - DNA, 20 bp, Homo sapiens
caatttggagcattaactaa

SEQ ID NO: 1874029 - DNA, 19 bp, Homo sapiens
cacaaacatatgtatcttt

SEQ ID NO: 1874030 - DNA, 12 bp, Homo sapiens
cacaagaaattt

SEQ ID NO: 1874031 - DNA, 14 bp, Homo sapiens
cacaagaaatttga

SEQ ID NO: 1874032 - DNA, 13 bp, Homo sapiens
cacaagaaggcca

SEQ ID NO: 1874033 - DNA, 14 bp, Homo sapiens
cacaagaaggccag

SEQ ID NO: 1874034 - DNA, 19 bp, Homo sapiens
cacactgcggtgtctgcag

SEQ ID NO: 1874035 - DNA, 18 bp, Homo sapiens
cacagctgagagactttt

SEQ ID NO: 1874036 - DNA, 19 bp, Homo sapiens
cacagctgagagactttta

SEQ ID NO: 1874037 - DNA, 21 bp, Homo sapiens
cacaggaacgcacagatcatg

SEQ ID NO: 1874038 - DNA, 20 bp, Homo sapiens
cacagtaatatgaaagccac

SEQ ID NO: 1874039 - DNA, 19 bp, Homo sapiens
cacatccttgactttttag

SEQ ID NO: 1874040 - DNA, 14 bp, Homo sapiens
cacatctaaagctt

SEQ ID NO: 1874041 - DNA, 19 bp, Homo sapiens
cacatgctgaggttttgaa

SEQ ID NO: 1874042 - DNA, 21 bp, Homo sapiens
cacatgctgaggttttgaata

SEQ ID NO: 1874043 - DNA, 24 bp, Homo sapiens
caccaattggttaatctttcctga

SEQ ID NO: 1874044 - DNA, 19 bp, Homo sapiens
caccacgatgacgcctctg

SEQ ID NO: 1874045 - DNA, 15 bp, Homo sapiens
caccactgggaacca

SEQ ID NO: 1874046 - DNA, 16 bp, Homo sapiens
caccagcaatgccctg

SEQ ID NO: 1874047 - DNA, 18 bp, Homo sapiens
caccagcaatgccctgcc

SEQ ID NO: 1874048 - DNA, 20 bp, Homo sapiens
cacccaccatagggcatgat

SEQ ID NO: 1874049 - DNA, 17 bp, Homo sapiens
cacccagcagaaataca

SEQ ID NO: 1874050 - DNA, 19 bp, Homo sapiens
tgtgctgtaacctgaagtc

SEQ ID NO: 1874051 - DNA, 21 bp, Homo sapiens
tgtggaccggccgcagccccc

SEQ ID NO: 1874052 - DNA, 19 bp, Homo sapiens
tgtggcactgccaccagca

SEQ ID NO: 1874053 - DNA, 16 bp, Homo sapiens
tgtggctggggggatg

SEQ ID NO: 1874054 - DNA, 20 bp, Homo sapiens
tgtgtattgttgtaaaatgt

SEQ ID NO: 1874055 - DNA, 17 bp, Homo sapiens
tgtgtgatgaactttct

SEQ ID NO: 1874056 - DNA, 13 bp, Homo sapiens
tgtgtgcagtgaa

SEQ ID NO: 1874057 - DNA, 14 bp, Homo sapiens
tgtgttacattatt

SEQ ID NO: 1874058 - DNA, 13 bp, Homo sapiens
tgtgttatattcc

SEQ ID NO: 1874059 - DNA, 19 bp, Homo sapiens
tgtgttatattccaaggaa

SEQ ID NO: 1874060 - DNA, 20 bp, Homo sapiens
tgtgttcactaaactctgaa

SEQ ID NO: 1874061 - DNA, 19 bp, Homo sapiens
tcaaaaaaaaaaaaaaaga

SEQ ID NO: 1874062 - DNA, 22 bp, Homo sapiens
tcaaaaaaaaaaaaaaagactg

SEQ ID NO: 1874063 - DNA, 23 bp, Homo sapiens
tcaaaaaaaaaaaaaaagactgt

SEQ ID NO: 1874064 - DNA, 18 bp, Homo sapiens
tcaaaagacacctgcctt

SEQ ID NO: 1874065 - DNA, 20 bp, Homo sapiens
tcaaggtggccaaattattt

SEQ ID NO: 1874066 - DNA, 13 bp, Homo sapiens
tcaagttattgta

SEQ ID NO: 1874067 - DNA, 13 bp, Homo sapiens
tcaagtttaaagt

SEQ ID NO: 1874068 - DNA, 15 bp, Homo sapiens
tcaagtttaaagtca

SEQ ID NO: 1874069 - DNA, 15 bp, Homo sapiens
tcaataactctgatt

SEQ ID NO: 1874070 - DNA, 23 bp, Homo sapiens
tcaatatggggcattaatattct

SEQ ID NO: 1874071 - DNA, 20 bp, Homo sapiens
tcaatcatctgtgtgaaaat

SEQ ID NO: 1874072 - DNA, 14 bp, Homo sapiens
tcaattacatgttt

SEQ ID NO: 1874073 - DNA, 13 bp, Homo sapiens
tcacataaaatgc

SEQ ID NO: 1874074 - DNA, 14 bp, Homo sapiens
tcacatctaaagct

SEQ ID NO: 1874075 - DNA, 16 bp, Homo sapiens
tcacatctaaagcttt

SEQ ID NO: 1874076 - DNA, 12 bp, Homo sapiens
tcacccaccata

SEQ ID NO: 1874077 - DNA, 17 bp, Homo sapiens
tgaaaaatattgctaaa

SEQ ID NO: 1874078 - DNA, 19 bp, Homo sapiens
tgaaaaatattgctaaaag

SEQ ID NO: 1874079 - DNA, 20 bp, Homo sapiens
tgaaaaatattgctaaaagt

SEQ ID NO: 1874080 - DNA, 11 bp, Homo sapiens
tgaaaagccat

SEQ ID NO: 1874081 - DNA, 17 bp, Homo sapiens
tgaaaataccataggaa

SEQ ID NO: 1874082 - DNA, 21 bp, Homo sapiens
tgaaaataccataggaagaca

SEQ ID NO: 1874083 - DNA, 19 bp, Homo sapiens
tgaaaatcctatatctgtt

SEQ ID NO: 1874084 - DNA, 20 bp, Homo sapiens
tgaaaatcctatatctgttt

SEQ ID NO: 1874085 - DNA, 21 bp, Homo sapiens
tgaaaatgggttggtgcttct

SEQ ID NO: 1874086 - DNA, 11 bp, Homo sapiens
tgaaacagaga

SEQ ID NO: 1874087 - DNA, 12 bp, Homo sapiens
tgaaacagagaa

SEQ ID NO: 1874088 - DNA, 17 bp, Homo sapiens
tgaaacagagaaagaaa

SEQ ID NO: 1874089 - DNA, 23 bp, Homo sapiens
tgaaacagagaaagaaaaggcaa

SEQ ID NO: 1874090 - DNA, 14 bp, Homo sapiens
tgaaagaattctat

SEQ ID NO: 1874091 - DNA, 16 bp, Homo sapiens
tgaaagtattcagaaa

SEQ ID NO: 1874092 - DNA, 17 bp, Homo sapiens
tgaaagtcctgctttcc

SEQ ID NO: 1874093 - DNA, 14 bp, Homo sapiens
tgaaagttgctttt

SEQ ID NO: 1874094 - DNA, 19 bp, Homo sapiens
tgaaatcagcatgacaaaa

SEQ ID NO: 1874095 - DNA, 22 bp, Homo sapiens
tgaaatcagtaaacactgtgta

SEQ ID NO: 1874096 - DNA, 17 bp, Homo sapiens
tgaaatggggcgctgga

SEQ ID NO: 1874097 - DNA, 20 bp, Homo sapiens
tgaaattttctagactttct

SEQ ID NO: 1874098 - DNA, 18 bp, Homo sapiens
tgaaccagaaccagtctt

SEQ ID NO: 1874099 - DNA, 15 bp, Homo sapiens
tgaaccgtttacagt

SEQ ID NO: 1874100 - DNA, 21 bp, Homo sapiens
tgaactacgcttgctcatttt

SEQ ID NO: 1874101 - DNA, 12 bp, Homo sapiens
tgaactgtggaa

SEQ ID NO: 1874102 - DNA, 19 bp, Homo sapiens
tgaacttttacagaatgca

SEQ ID NO: 1874103 - DNA, 23 bp, Homo sapiens
tgaacttttacagaatgcattaa

SEQ ID NO: 1874104 - DNA, 16 bp, Homo sapiens
tgaacttttgtaattt

SEQ ID NO: 1874105 - DNA, 18 bp, Homo sapiens
tgaacttttgtaatttga

SEQ ID NO: 1874106 - DNA, 19 bp, Homo sapiens
tgaacttttgtaatttgaa

SEQ ID NO: 1874107 - DNA, 20 bp, Homo sapiens
tgaacttttgtaatttgaat

SEQ ID NO: 1874108 - DNA, 22 bp, Homo sapiens
tgaacttttgtaatttgaattg

SEQ ID NO: 1874109 - DNA, 17 bp, Homo sapiens
tgaaggtaataaataca

SEQ ID NO: 1874110 - DNA, 23 bp, Homo sapiens
tgaaggttttttttttaagtgca

SEQ ID NO: 1874111 - DNA, 14 bp, Homo sapiens
tgaagtagtttgta

SEQ ID NO: 1874112 - DNA, 14 bp, Homo sapiens
tgaataaaaagtga

SEQ ID NO: 1874113 - DNA, 17 bp, Homo sapiens
tgaataaaaagtgaact

SEQ ID NO: 1874114 - DNA, 23 bp, Homo sapiens
tgaatagaggccaaattaatctt

SEQ ID NO: 1874115 - DNA, 17 bp, Homo sapiens
tgaatgacaacagaagc

SEQ ID NO: 1874116 - DNA, 12 bp, Homo sapiens
tgaatgcttttt

SEQ ID NO: 1874117 - DNA, 18 bp, Homo sapiens
tgaatgctttttgaatgt

SEQ ID NO: 1874118 - DNA, 13 bp, Homo sapiens
tgaatgggaaagt

SEQ ID NO: 1874119 - DNA, 16 bp, Homo sapiens
tgaatgggaaagtatt

SEQ ID NO: 1874120 - DNA, 20 bp, Homo sapiens
tgaatgggaaagtatttttg

SEQ ID NO: 1874121 - DNA, 15 bp, Homo sapiens
tgaattgagctagaa

SEQ ID NO: 1874122 - DNA, 15 bp, Homo sapiens
tgaattgttatgaaa

SEQ ID NO: 1874123 - DNA, 16 bp, Homo sapiens
tgaattgttatgaaaa

SEQ ID NO: 1874124 - DNA, 15 bp, Homo sapiens
tgaatttatgagatt

SEQ ID NO: 1874125 - DNA, 21 bp, Homo sapiens
tgaatttcttcactgttgaaa

SEQ ID NO: 1874126 - DNA, 16 bp, Homo sapiens
tgacaaacctagcttt

SEQ ID NO: 1874127 - DNA, 20 bp, Homo sapiens
tgacaaacctagcttttaaa

SEQ ID NO: 1874128 - DNA, 12 bp, Homo sapiens
tgacaacacatg

SEQ ID NO: 1874129 - DNA, 20 bp, Homo sapiens
tgacataattgtccagttat

SEQ ID NO: 1874130 - DNA, 13 bp, Homo sapiens
tgacattcactgg

SEQ ID NO: 1874131 - DNA, 12 bp, Homo sapiens
tgaccaccctgc

SEQ ID NO: 1874132 - DNA, 15 bp, Homo sapiens
tgaccaccctgcctg

SEQ ID NO: 1874133 - DNA, 19 bp, Homo sapiens
tgaccaccctgcctgtgga

SEQ ID NO: 1874134 - DNA, 20 bp, Homo sapiens
tgaccaccctgcctgtggag

SEQ ID NO: 1874135 - DNA, 11 bp, Homo sapiens
tgacctgccca

SEQ ID NO: 1874136 - DNA, 14 bp, Homo sapiens
tgacctgcccatgt

SEQ ID NO: 1874137 - DNA, 15 bp, Homo sapiens
tgacctgcccatgtc

SEQ ID NO: 1874138 - DNA, 16 bp, Homo sapiens
tgacctgcccatgtcc

SEQ ID NO: 1874139 - DNA, 23 bp, Homo sapiens
tgacctgcccatgtccagaggga

SEQ ID NO: 1874140 - DNA, 13 bp, Homo sapiens
tgacgcctctgga

SEQ ID NO: 1874141 - DNA, 19 bp, Homo sapiens
tgacggccaggctccctga

SEQ ID NO: 1874142 - DNA, 20 bp, Homo sapiens
tgacggccaggctccctgac

SEQ ID NO: 1874143 - DNA, 15 bp, Homo sapiens
tgagaagatgggggc

SEQ ID NO: 1874144 - DNA, 19 bp, Homo sapiens
tgagaagatgggggctgga

SEQ ID NO: 1874145 - DNA, 17 bp, Homo sapiens
tgagactgggaacttga

SEQ ID NO: 1874146 - DNA, 16 bp, Homo sapiens
tgagaggaaatgttga

SEQ ID NO: 1874147 - DNA, 15 bp, Homo sapiens
tgagattacagagga

SEQ ID NO: 1874148 - DNA, 16 bp, Homo sapiens
tgagatttactgctct

SEQ ID NO: 1874149 - DNA, 21 bp, Homo sapiens
tgagatttactgctctagaaa

SEQ ID NO: 1874150 - DNA, 16 bp, Homo sapiens
tgagcaagagccaggg

SEQ ID NO: 1874151 - DNA, 22 bp, Homo sapiens
tgagcacgttggcgaggaaaaa

SEQ ID NO: 1874152 - DNA, 22 bp, Homo sapiens
tgagcgcacgcgcgcacacaca

SEQ ID NO: 1874153 - DNA, 18 bp, Homo sapiens
tgagctcctgctcattgt

SEQ ID NO: 1874154 - DNA, 19 bp, Homo sapiens
tgaggttttgaataaaaag

SEQ ID NO: 1874155 - DNA, 14 bp, Homo sapiens
tgagtatattataa

SEQ ID NO: 1874156 - DNA, 13 bp, Homo sapiens
tgagtcttaactg

SEQ ID NO: 1874157 - DNA, 17 bp, Homo sapiens
tgagtcttaactgtatt

SEQ ID NO: 1874158 - DNA, 12 bp, Homo sapiens
tgagtgccatgc

SEQ ID NO: 1874159 - DNA, 17 bp, Homo sapiens
tgagtgccatgcttttt

SEQ ID NO: 1874160 - DNA, 23 bp, Homo sapiens
tgagtggaaagtcacctacagga

SEQ ID NO: 1874161 - DNA, 18 bp, Homo sapiens
tgagttacttagaatgcc

SEQ ID NO: 1874162 - DNA, 19 bp, Homo sapiens
tgagttacttagaatgcca

SEQ ID NO: 1874163 - DNA, 22 bp, Homo sapiens
tgagttacttagaatgccataa

SEQ ID NO: 1874164 - DNA, 15 bp, Homo sapiens
tgatacccaacagtt

SEQ ID NO: 1874165 - DNA, 16 bp, Homo sapiens
tgatacccaacagttt

SEQ ID NO: 1874166 - DNA, 16 bp, Homo sapiens
tgatacttttttgaaa

SEQ ID NO: 1874167 - DNA, 16 bp, Homo sapiens
tgatattttccctttt

SEQ ID NO: 1874168 - DNA, 18 bp, Homo sapiens
tgatcacatctaaagctt

SEQ ID NO: 1874169 - DNA, 20 bp, Homo sapiens
tgatcacatctaaagcttta

SEQ ID NO: 1874170 - DNA, 21 bp, Homo sapiens
tgatcacatctaaagctttat

SEQ ID NO: 1874171 - DNA, 15 bp, Homo sapiens
tgatctgtactttgt

SEQ ID NO: 1874172 - DNA, 16 bp, Homo sapiens
tgatctgtactttgtg

SEQ ID NO: 1874173 - DNA, 20 bp, Homo sapiens
tgatctgtactttgtgttta

SEQ ID NO: 1874174 - DNA, 23 bp, Homo sapiens
tgatctttgtttaaatgccaaaa

SEQ ID NO: 1874175 - DNA, 13 bp, Homo sapiens
tgatgaactttct

SEQ ID NO: 1874176 - DNA, 23 bp, Homo sapiens
tgatgaactttctcttcatactt

SEQ ID NO: 1874177 - DNA, 22 bp, Homo sapiens
tgatggcacttagctatcagaa

SEQ ID NO: 1874178 - DNA, 22 bp, Homo sapiens
tgatggctcagagagcatcttt

SEQ ID NO: 1874179 - DNA, 15 bp, Homo sapiens
tgattataccatgtg

SEQ ID NO: 1874180 - DNA, 22 bp, Homo sapiens
tgattataccatgtgtgctaat

SEQ ID NO: 1874181 - DNA, 14 bp, Homo sapiens
tgattcagtatctt

SEQ ID NO: 1874182 - DNA, 14 bp, Homo sapiens
tgattgcactaaat

SEQ ID NO: 1874183 - DNA, 19 bp, Homo sapiens
tgattgcactaaataaact

SEQ ID NO: 1874184 - DNA, 12 bp, Homo sapiens
tgattgtaaaat

SEQ ID NO: 1874185 - DNA, 16 bp, Homo sapiens
tgatttacatgctgat

SEQ ID NO: 1874186 - DNA, 22 bp, Homo sapiens
tgatttatagtttgtacatgca

SEQ ID NO: 1874187 - DNA, 19 bp, Homo sapiens
tgatttctagtatctattg

SEQ ID NO: 1874188 - DNA, 13 bp, Homo sapiens
tgatttctattca

SEQ ID NO: 1874189 - DNA, 20 bp, Homo sapiens
tgatttctattcaaggtggc

SEQ ID NO: 1874190 - DNA, 22 bp, Homo sapiens
tgatttggggattcagatttct

SEQ ID NO: 1874191 - DNA, 19 bp, Homo sapiens
tgcaaaaacatatgtctgt

SEQ ID NO: 1874192 - DNA, 20 bp, Homo sapiens
tgcaaaagactaatttaaaa

SEQ ID NO: 1874193 - DNA, 23 bp, Homo sapiens
tggcaggtcatggagcagccccc

SEQ ID NO: 1874194 - DNA, 19 bp, Homo sapiens
tggcatcgcagcttcctgt

SEQ ID NO: 1874195 - DNA, 20 bp, Homo sapiens
gaacttttacagaatgcatt

SEQ ID NO: 1874196 - DNA, 23 bp, Homo sapiens
gaacttttacagaatgcattaaa

SEQ ID NO: 1874197 - DNA, 13 bp, Homo sapiens
gaacttttgtaat

SEQ ID NO: 1874198 - DNA, 18 bp, Homo sapiens
gaagagaggggaagaatt

SEQ ID NO: 1874199 - DNA, 18 bp, Homo sapiens
gaagatgggggctggagg

SEQ ID NO: 1874200 - DNA, 15 bp, Homo sapiens
gaaggacccaagaaa

SEQ ID NO: 1874201 - DNA, 15 bp, Homo sapiens
gaaggtgtcatttga

SEQ ID NO: 1874202 - DNA, 20 bp, Homo sapiens
gaaggttttttttttaagtg

SEQ ID NO: 1874203 - DNA, 19 bp, Homo sapiens
gaagtagtttgtataactt

SEQ ID NO: 1874204 - DNA, 21 bp, Homo sapiens
gaagtgcagcgggccaggcag

SEQ ID NO: 1874205 - DNA, 20 bp, Homo sapiens
gaagttgtgccttttatagc

SEQ ID NO: 1874206 - DNA, 16 bp, Homo sapiens
gaagttttaactatgc

SEQ ID NO: 1874207 - DNA, 16 bp, Homo sapiens
gaagttttttactttg

SEQ ID NO: 1874208 - DNA, 13 bp, Homo sapiens
gaataaaaagtga

SEQ ID NO: 1874209 - DNA, 12 bp, Homo sapiens
gaatgaactgtg

SEQ ID NO: 1874210 - DNA, 15 bp, Homo sapiens
gaatgcattaaaaaa

SEQ ID NO: 1874211 - DNA, 16 bp, Homo sapiens
gaatgcattaaaaaaa

SEQ ID NO: 1874212 - DNA, 13 bp, Homo sapiens
gaatggagaaagt

SEQ ID NO: 1874213 - DNA, 19 bp, Homo sapiens
gaattaccatagagtaatg

SEQ ID NO: 1874214 - DNA, 13 bp, Homo sapiens
gaattctattttg

SEQ ID NO: 1874215 - DNA, 21 bp, Homo sapiens
gaattgaaatggggcgctgga

SEQ ID NO: 1874216 - DNA, 15 bp, Homo sapiens
gaattggcataattt

SEQ ID NO: 1874217 - DNA, 20 bp, Homo sapiens
gaatttaatggactgtgaat

SEQ ID NO: 1874218 - DNA, 22 bp, Homo sapiens
gaatttaatggactgtgaattt

SEQ ID NO: 1874219 - DNA, 21 bp, Homo sapiens
gaatttaatttataggcagat

SEQ ID NO: 1874220 - DNA, 20 bp, Homo sapiens
gaatttcttcactgttgaaa

SEQ ID NO: 1874221 - DNA, 13 bp, Homo sapiens
gacaaaaataaca

SEQ ID NO: 1874222 - DNA, 15 bp, Homo sapiens
gacaaaaataacact

SEQ ID NO: 1874223 - DNA, 14 bp, Homo sapiens
gacaacgtgctgct

SEQ ID NO: 1874224 - DNA, 13 bp, Homo sapiens
gacaattagcaga

SEQ ID NO: 1874225 - DNA, 14 bp, Homo sapiens
gacaattagcagaa

SEQ ID NO: 1874226 - DNA, 21 bp, Homo sapiens
gacacactgcggtgtctgcag

SEQ ID NO: 1874227 - DNA, 23 bp, Homo sapiens
gacacactgcggtgtctgcagct

SEQ ID NO: 1874228 - DNA, 18 bp, Homo sapiens
gacacatgctgaggtttt

SEQ ID NO: 1874229 - DNA, 13 bp, Homo sapiens
gacaccactggga

SEQ ID NO: 1874230 - DNA, 15 bp, Homo sapiens
gacacccattttcac

SEQ ID NO: 1874231 - DNA, 14 bp, Homo sapiens
gacacctacagcag

SEQ ID NO: 1874232 - DNA, 12 bp, Homo sapiens
gacagccagggc

SEQ ID NO: 1874233 - DNA, 13 bp, Homo sapiens
gacagcctggggg

SEQ ID NO: 1874234 - DNA, 18 bp, Homo sapiens
gacataaaactttaaaag

SEQ ID NO: 1874235 - DNA, 23 bp, Homo sapiens
gacatccatgtttgtaaaactac

SEQ ID NO: 1874236 - DNA, 20 bp, Homo sapiens
gacatctgcctgtaattaaa

SEQ ID NO: 1874237 - DNA, 18 bp, Homo sapiens
gacatgttatatattttt

SEQ ID NO: 1874238 - DNA, 18 bp, Homo sapiens
gaccaccctgcctgtgga

SEQ ID NO: 1874239 - DNA, 17 bp, Homo sapiens
gaccactagctaagcaa

SEQ ID NO: 1874240 - DNA, 21 bp, Homo sapiens
gaccactagctaagcaagcca

SEQ ID NO: 1874241 - DNA, 22 bp, Homo sapiens
gaccactagctaagcaagccag

SEQ ID NO: 1874242 - DNA, 23 bp, Homo sapiens
gaccactagctaagcaagccagg

SEQ ID NO: 1874243 - DNA, 16 bp, Homo sapiens
gacccctgcccaagtg

SEQ ID NO: 1874244 - DNA, 13 bp, Homo sapiens
gaccggccgcagc

SEQ ID NO: 1874245 - DNA, 21 bp, Homo sapiens
gacctgcccatgtccagaggg

SEQ ID NO: 1874246 - DNA, 23 bp, Homo sapiens
gacctgttaggtctcatgcccac

SEQ ID NO: 1874247 - DNA, 11 bp, Homo sapiens
gacgcctctgg

SEQ ID NO: 1874248 - DNA, 19 bp, Homo sapiens
gacggccaggctccctgac

SEQ ID NO: 1874249 - DNA, 21 bp, Homo sapiens
gacggccaggctccctgacca

SEQ ID NO: 1874250 - DNA, 19 bp, Homo sapiens
gactcagaggacccacctg

SEQ ID NO: 1874251 - DNA, 13 bp, Homo sapiens
gactggacagcca

SEQ ID NO: 1874252 - DNA, 14 bp, Homo sapiens
gactggacagccag

SEQ ID NO: 1874253 - DNA, 15 bp, Homo sapiens
gactggacagccagg

SEQ ID NO: 1874254 - DNA, 16 bp, Homo sapiens
gactggacagccaggg

SEQ ID NO: 1874255 - DNA, 17 bp, Homo sapiens
gactggacagccagggc

SEQ ID NO: 1874256 - DNA, 11 bp, Homo sapiens
taaaaggatgt

SEQ ID NO: 1874257 - DNA, 19 bp, Homo sapiens
taaaaggatgttacaagtt

SEQ ID NO: 1874258 - DNA, 15 bp, Homo sapiens
taaaaggcaactcaa

SEQ ID NO: 1874259 - DNA, 17 bp, Homo sapiens
taaaagtcattattcct

SEQ ID NO: 1874260 - DNA, 18 bp, Homo sapiens
taaaagtcattattcctg

SEQ ID NO: 1874261 - DNA, 13 bp, Homo sapiens
taaaagtgcattt

SEQ ID NO: 1874262 - DNA, 20 bp, Homo sapiens
taaaagttataataactgaa

SEQ ID NO: 1874263 - DNA, 14 bp, Homo sapiens
taaaagttgtgatt

SEQ ID NO: 1874264 - DNA, 17 bp, Homo sapiens
taaaatgaagcaattta

SEQ ID NO: 1874265 - DNA, 21 bp, Homo sapiens
taaaatgtttaattcattaat

SEQ ID NO: 1874266 - DNA, 22 bp, Homo sapiens
taaaattgcagtttcatgtatg

SEQ ID NO: 1874267 - DNA, 18 bp, Homo sapiens
taaacaaaatagaagctg

SEQ ID NO: 1874268 - DNA, 11 bp, Homo sapiens
taaacactgtt

SEQ ID NO: 1874269 - DNA, 17 bp, Homo sapiens
taaacagcaaagccata

SEQ ID NO: 1874270 - DNA, 23 bp, Homo sapiens
taaacgtattttgatcagtgtta

SEQ ID NO: 1874271 - DNA, 19 bp, Homo sapiens
taaactcaaaacttaacat

SEQ ID NO: 1874272 - DNA, 15 bp, Homo sapiens
taaactctaaacatt

SEQ ID NO: 1874273 - DNA, 22 bp, Homo sapiens
taaactctaaacattaatcaat

SEQ ID NO: 1874274 - DNA, 22 bp, Homo sapiens
taaactctgaataagcactttt

SEQ ID NO: 1874275 - DNA, 14 bp, Homo sapiens
taaacttgtgtatt

SEQ ID NO: 1874276 - DNA, 15 bp, Homo sapiens
taaagaaacactaaa

SEQ ID NO: 1874277 - DNA, 23 bp, Homo sapiens
taaagaaacactaaattagttta

SEQ ID NO: 1874278 - DNA, 15 bp, Homo sapiens
taaagattagggaaa

SEQ ID NO: 1874279 - DNA, 14 bp, Homo sapiens
taaagccttaagca

SEQ ID NO: 1874280 - DNA, 19 bp, Homo sapiens
taaagcttacccttggttt

SEQ ID NO: 1874281 - DNA, 21 bp, Homo sapiens
taaagctttatctttgtgtaa

SEQ ID NO: 1874282 - DNA, 16 bp, Homo sapiens
taaagtatgtaaacag

SEQ ID NO: 1874283 - DNA, 21 bp, Homo sapiens
taaagtatgtaaagtatgtaa

SEQ ID NO: 1874284 - DNA, 22 bp, Homo sapiens
taaagtatgtaaagtatgtaaa

SEQ ID NO: 1874285 - DNA, 13 bp, Homo sapiens
taaataaatagaa

SEQ ID NO: 1874286 - DNA, 22 bp, Homo sapiens
taaatcatactcctatgcttta

SEQ ID NO: 1874287 - DNA, 15 bp, Homo sapiens
taaatctggggaaga

SEQ ID NO: 1874288 - DNA, 16 bp, Homo sapiens
taaatgagacacatac

SEQ ID NO: 1874289 - DNA, 22 bp, Homo sapiens
taaatgagacacatacaaaaaa

SEQ ID NO: 1874290 - DNA, 23 bp, Homo sapiens
taaatgagggtttctgatctgta

SEQ ID NO: 1874291 - DNA, 23 bp, Homo sapiens
taaatgccttggtttgatttcta

SEQ ID NO: 1874292 - DNA, 16 bp, Homo sapiens
taaattcactgttgaa

SEQ ID NO: 1874293 - DNA, 12 bp, Homo sapiens
taaatttttgaa

SEQ ID NO: 1874294 - DNA, 13 bp, Homo sapiens
taaatttttgaaa

SEQ ID NO: 1874295 - DNA, 16 bp, Homo sapiens
taaatttttgaaaaat

SEQ ID NO: 1874296 - DNA, 21 bp, Homo sapiens
taacaaagcaacctttccctt

SEQ ID NO: 1874297 - DNA, 23 bp, Homo sapiens
taacaatatgattgcactaaata

SEQ ID NO: 1874298 - DNA, 13 bp, Homo sapiens
taacagagaaata

SEQ ID NO: 1874299 - DNA, 17 bp, Homo sapiens
taacatagaattgcaat

SEQ ID NO: 1874300 - DNA, 22 bp, Homo sapiens
taacatgtgatggttgattcac

SEQ ID NO: 1874301 - DNA, 20 bp, Homo sapiens
taacctatatgatttatagt

SEQ ID NO: 1874302 - DNA, 17 bp, Homo sapiens
taacgccctatttttgc

SEQ ID NO: 1874303 - DNA, 19 bp, Homo sapiens
taacgtgattgattcagta

SEQ ID NO: 1874304 - DNA, 12 bp, Homo sapiens
taactctgattt

SEQ ID NO: 1874305 - DNA, 14 bp, Homo sapiens
taactgaactgttt

SEQ ID NO: 1874306 - DNA, 17 bp, Homo sapiens
taactgactctgttatt

SEQ ID NO: 1874307 - DNA, 13 bp, Homo sapiens
taactggtataga

SEQ ID NO: 1874308 - DNA, 18 bp, Homo sapiens
taactgtatttcagtatt

SEQ ID NO: 1874309 - DNA, 20 bp, Homo sapiens
taagaaagagaatgaactgt

SEQ ID NO: 1874310 - DNA, 22 bp, Homo sapiens
taagaaagccaccttgttacaa

SEQ ID NO: 1874311 - DNA, 21 bp, Homo sapiens
taagaagggggagtgaaacag

SEQ ID NO: 1874312 - DNA, 23 bp, Homo sapiens
taagaagggggagtgaaacagag

SEQ ID NO: 1874313 - DNA, 20 bp, Homo sapiens
taagaatttgaggtctacat

SEQ ID NO: 1874314 - DNA, 15 bp, Homo sapiens
taagcagattacaat

SEQ ID NO: 1874315 - DNA, 17 bp, Homo sapiens
taagcagattacaataa

SEQ ID NO: 1874316 - DNA, 16 bp, Homo sapiens
taaggatcttttgtaa

SEQ ID NO: 1874317 - DNA, 15 bp, Homo sapiens
taagtactatctttg

SEQ ID NO: 1874318 - DNA, 18 bp, Homo sapiens
taagtactatctttgtct

SEQ ID NO: 1874319 - DNA, 20 bp, Homo sapiens
taagtactatctttgtctaa

SEQ ID NO: 1874320 - DNA, 13 bp, Homo sapiens
taagtgcaacatt

SEQ ID NO: 1874321 - DNA, 23 bp, Homo sapiens
taagtgcaacatttctgtatact

SEQ ID NO: 1874322 - DNA, 12 bp, Homo sapiens
taagttgagtat

SEQ ID NO: 1874323 - DNA, 21 bp, Homo sapiens
taagttttatacataaacagt

SEQ ID NO: 1874324 - DNA, 18 bp, Homo sapiens
taagttttgatataatct

SEQ ID NO: 1874325 - DNA, 21 bp, Homo sapiens
taataaaaaaatatatacaga

SEQ ID NO: 1874326 - DNA, 19 bp, Homo sapiens
taataagaatggttgcctt

SEQ ID NO: 1874327 - DNA, 21 bp, Homo sapiens
taataagttttgatataatct

SEQ ID NO: 1874328 - DNA, 15 bp, Homo sapiens
taatagaaaactgaa

SEQ ID NO: 1874329 - DNA, 16 bp, Homo sapiens
taatagaaaactgaaa

SEQ ID NO: 1874330 - DNA, 18 bp, Homo sapiens
taatagaaaactgaaaat

SEQ ID NO: 1874331 - DNA, 19 bp, Homo sapiens
taatagaaaactgaaaatc

SEQ ID NO: 1874332 - DNA, 18 bp, Homo sapiens
taatagattgtgaataat

SEQ ID NO: 1874333 - DNA, 22 bp, Homo sapiens
taatagcgggttactttcacat

SEQ ID NO: 1874334 - DNA, 21 bp, Homo sapiens
taatagcttttattgtataaa

SEQ ID NO: 1874335 - DNA, 16 bp, Homo sapiens
taataggatgaatggg

SEQ ID NO: 1874336 - DNA, 21 bp, Homo sapiens
taatattcttttgttattaaa

SEQ ID NO: 1874337 - DNA, 15 bp, Homo sapiens
taatcatgctcatgt

SEQ ID NO: 1874338 - DNA, 20 bp, Homo sapiens
taatctaagtatatgtgaga

SEQ ID NO: 1874339 - DNA, 12 bp, Homo sapiens
taatctatatta

SEQ ID NO: 1874340 - DNA, 13 bp, Homo sapiens
taatctccacagt

SEQ ID NO: 1874341 - DNA, 22 bp, Homo sapiens
taatctcctctgctcattaaac

SEQ ID NO: 1874342 - DNA, 17 bp, Homo sapiens
taatctgggaagggaag

SEQ ID NO: 1874343 - DNA, 15 bp, Homo sapiens
taatctgtaaatgaa

SEQ ID NO: 1874344 - DNA, 18 bp, Homo sapiens
taatcttggcttcttaaa

SEQ ID NO: 1874345 - DNA, 15 bp, Homo sapiens
taatcttttctgaat

SEQ ID NO: 1874346 - DNA, 12 bp, Homo sapiens
taatgattgttt

SEQ ID NO: 1874347 - DNA, 14 bp, Homo sapiens
taatggactgtgaa

SEQ ID NO: 1874348 - DNA, 15 bp, Homo sapiens
taattaaaaacttta

SEQ ID NO: 1874349 - DNA, 12 bp, Homo sapiens
taattagagaac

SEQ ID NO: 1874350 - DNA, 20 bp, Homo sapiens
taattagagaactggaggaa

SEQ ID NO: 1874351 - DNA, 21 bp, Homo sapiens
taattattttccaaaatctaa

SEQ ID NO: 1874352 - DNA, 19 bp, Homo sapiens
taattcattaatctgtttg

SEQ ID NO: 1874353 - DNA, 16 bp, Homo sapiens
taattgtacaagcagt

SEQ ID NO: 1874354 - DNA, 21 bp, Homo sapiens
taattgtcctgtgtctatgta

SEQ ID NO: 1874355 - DNA, 19 bp, Homo sapiens
taatttaaagaaacactaa

SEQ ID NO: 1874356 - DNA, 21 bp, Homo sapiens
taatttaaagaaacactaaat

SEQ ID NO: 1874357 - DNA, 14 bp, Homo sapiens
taatttagagcgtt

SEQ ID NO: 1874358 - DNA, 19 bp, Homo sapiens
taatttataggcagatctt

SEQ ID NO: 1874359 - DNA, 20 bp, Homo sapiens
taatttataggcagatcttt

SEQ ID NO: 1874360 - DNA, 16 bp, Homo sapiens
taatttccttctgtta

SEQ ID NO: 1874361 - DNA, 21 bp, Homo sapiens
taatttccttctgttaagaaa

SEQ ID NO: 1874362 - DNA, 17 bp, Homo sapiens
taatttgtcttagttga

SEQ ID NO: 1874363 - DNA, 17 bp, Homo sapiens
taattttttattcaagt

SEQ ID NO: 1874364 - DNA, 17 bp, Homo sapiens
taattttttgcagtctt

SEQ ID NO: 1874365 - DNA, 18 bp, Homo sapiens
tacaaagcatgggaaaaa

SEQ ID NO: 1874366 - DNA, 16 bp, Homo sapiens
tacaaataattttttg

SEQ ID NO: 1874367 - DNA, 18 bp, Homo sapiens
tacaagacaacattgtaa

SEQ ID NO: 1874368 - DNA, 14 bp, Homo sapiens
tacaagcagttaat

SEQ ID NO: 1874369 - DNA, 16 bp, Homo sapiens
tacaagcttaaagctt

SEQ ID NO: 1874370 - DNA, 20 bp, Homo sapiens
tacaagcttaaagcttgatt

SEQ ID NO: 1874371 - DNA, 21 bp, Homo sapiens
tacaagtgtatatcagaaaag

SEQ ID NO: 1874372 - DNA, 15 bp, Homo sapiens
tacaagtttgctaaa

SEQ ID NO: 1874373 - DNA, 16 bp, Homo sapiens
tacaagtttgctaaaa

SEQ ID NO: 1874374 - DNA, 23 bp, Homo sapiens
cttccctgcccaatcctccctgg

SEQ ID NO: 1874375 - DNA, 19 bp, Homo sapiens
cttcctgattaccagtctg

SEQ ID NO: 1874376 - DNA, 15 bp, Homo sapiens
cttcctgtctgttta

SEQ ID NO: 1874377 - DNA, 15 bp, Homo sapiens
cttctaatatatttt

SEQ ID NO: 1874378 - DNA, 20 bp, Homo sapiens
cttctaatatatttttatat

SEQ ID NO: 1874379 - DNA, 23 bp, Homo sapiens
cttctcccagagcacaagaaggc

SEQ ID NO: 1874380 - DNA, 20 bp, Homo sapiens
cttctgtagtttttaattaa

SEQ ID NO: 1874381 - DNA, 18 bp, Homo sapiens
cttctgttaagaaaggat

SEQ ID NO: 1874382 - DNA, 15 bp, Homo sapiens
cttgaaacctttcta

SEQ ID NO: 1874383 - DNA, 21 bp, Homo sapiens
cttgaaacctttctacttttt

SEQ ID NO: 1874384 - DNA, 16 bp, Homo sapiens
cttgaattgttatgaa

SEQ ID NO: 1874385 - DNA, 18 bp, Homo sapiens
cttgaattgttatgaaaa

SEQ ID NO: 1874386 - DNA, 20 bp, Homo sapiens
cttgaattgttatgaaaatc

SEQ ID NO: 1874387 - DNA, 17 bp, Homo sapiens
cttgatttgatctttgt

SEQ ID NO: 1874388 - DNA, 16 bp, Homo sapiens
cttgctacttatcatt

SEQ ID NO: 1874389 - DNA, 20 bp, Homo sapiens
cttgctgtttactcccttct

SEQ ID NO: 1874390 - DNA, 14 bp, Homo sapiens
cttggaaagaggtt

SEQ ID NO: 1874391 - DNA, 20 bp, Homo sapiens
cttggcaacagaagcagttg

SEQ ID NO: 1874392 - DNA, 15 bp, Homo sapiens
cttggcttcttaaaa

SEQ ID NO: 1874393 - DNA, 19 bp, Homo sapiens
cttgggacaacgtgctgct

SEQ ID NO: 1874394 - DNA, 13 bp, Homo sapiens
cttgtagccctgg

SEQ ID NO: 1874395 - DNA, 14 bp, Homo sapiens
cttgtagccctgga

SEQ ID NO: 1874396 - DNA, 20 bp, Homo sapiens
cttgtagccctggatggcct

SEQ ID NO: 1874397 - DNA, 19 bp, Homo sapiens
ctttaaaaaagctataaat

SEQ ID NO: 1874398 - DNA, 13 bp, Homo sapiens
ctttaaaaggcaa

SEQ ID NO: 1874399 - DNA, 14 bp, Homo sapiens
ctttaaaaggcaac

SEQ ID NO: 1874400 - DNA, 15 bp, Homo sapiens
ctttaaaaggcaact

SEQ ID NO: 1874401 - DNA, 14 bp, Homo sapiens
ctttaaagataagt

SEQ ID NO: 1874402 - DNA, 21 bp, Homo sapiens
ctttacaaataattttttgca

SEQ ID NO: 1874403 - DNA, 14 bp, Homo sapiens
ctttacatgcaatt

SEQ ID NO: 1874404 - DNA, 18 bp, Homo sapiens
ctttagcttatttttaca

SEQ ID NO: 1874405 - DNA, 12 bp, Homo sapiens
ctttatattttg

SEQ ID NO: 1874406 - DNA, 17 bp, Homo sapiens
ctttatattttgttgtt

SEQ ID NO: 1874407 - DNA, 13 bp, Homo sapiens
ctttatgcaaaaa

SEQ ID NO: 1874408 - DNA, 19 bp, Homo sapiens
ctttatgcaaaaacatatg

SEQ ID NO: 1874409 - DNA, 20 bp, Homo sapiens
ctttatgcaaaaacatatgt

SEQ ID NO: 1874410 - DNA, 14 bp, Homo sapiens
ctttcaactcattg

SEQ ID NO: 1874411 - DNA, 19 bp, Homo sapiens
ctttcctatctagcattta

SEQ ID NO: 1874412 - DNA, 16 bp, Homo sapiens
ctttctcttggacatt

SEQ ID NO: 1874413 - DNA, 23 bp, Homo sapiens
ctttctgagtgagttttactctt

SEQ ID NO: 1874414 - DNA, 18 bp, Homo sapiens
ctttgaaggtaataaata

SEQ ID NO: 1874415 - DNA, 22 bp, Homo sapiens
ctttgaaggtaataaatacaca

SEQ ID NO: 1874416 - DNA, 21 bp, Homo sapiens
ctttgaatagaggccaaatta

SEQ ID NO: 1874417 - DNA, 21 bp, Homo sapiens
ctttgccttgatgttgtgttg

SEQ ID NO: 1874418 - DNA, 21 bp, Homo sapiens
ctttggttctgggttgtttcc

SEQ ID NO: 1874419 - DNA, 14 bp, Homo sapiens
ctttgtagaataaa

SEQ ID NO: 1874420 - DNA, 13 bp, Homo sapiens
ctttgtgtaatct

SEQ ID NO: 1874421 - DNA, 17 bp, Homo sapiens
ctttgtgtgttatattc

SEQ ID NO: 1874422 - DNA, 16 bp, Homo sapiens
cttttaaaaaatattt

SEQ ID NO: 1874423 - DNA, 18 bp, Homo sapiens
cttttatagctattactg

SEQ ID NO: 1874424 - DNA, 21 bp, Homo sapiens
cttttattgtataaactatca

SEQ ID NO: 1874425 - DNA, 17 bp, Homo sapiens
cttttcctcccatttta

SEQ ID NO: 1874426 - DNA, 18 bp, Homo sapiens
cttttcttttttaaagta

SEQ ID NO: 1874427 - DNA, 21 bp, Homo sapiens
cttttgagtatggctatctat

SEQ ID NO: 1874428 - DNA, 14 bp, Homo sapiens
cttttgctgtgctg

SEQ ID NO: 1874429 - DNA, 21 bp, Homo sapiens
cttttggttcctcacatatta

SEQ ID NO: 1874430 - DNA, 19 bp, Homo sapiens
cttttgtaatttgaattgg

SEQ ID NO: 1874431 - DNA, 12 bp, Homo sapiens
cttttgtgagaa

SEQ ID NO: 1874432 - DNA, 15 bp, Homo sapiens
ctttttaaaaaatac

SEQ ID NO: 1874433 - DNA, 20 bp, Homo sapiens
ctttttaaaaaataccattg

SEQ ID NO: 1874434 - DNA, 17 bp, Homo sapiens
ctttttctttttttggt

SEQ ID NO: 1874435 - DNA, 11 bp, Homo sapiens
ctttttttcct

SEQ ID NO: 1874436 - DNA, 17 bp, Homo sapiens
cttttttttttccaaat

SEQ ID NO: 1874437 - DNA, 21 bp, Homo sapiens
gaaaaacttttaggttgttac

SEQ ID NO: 1874438 - DNA, 14 bp, Homo sapiens
gaaaaatattgcta

SEQ ID NO: 1874439 - DNA, 16 bp, Homo sapiens
gaaaaatattgctaaa

SEQ ID NO: 1874440 - DNA, 20 bp, Homo sapiens
tataatcttggcttcttaaa

SEQ ID NO: 1874441 - DNA, 16 bp, Homo sapiens
tataatgctttctgag

SEQ ID NO: 1874442 - DNA, 14 bp, Homo sapiens
tataatgtgtctgt

SEQ ID NO: 1874443 - DNA, 16 bp, Homo sapiens
tataattgttgatatt

SEQ ID NO: 1874444 - DNA, 18 bp, Homo sapiens
tataattgttgatatttt

SEQ ID NO: 1874445 - DNA, 19 bp, Homo sapiens
tataattgttgatattttc

SEQ ID NO: 1874446 - DNA, 13 bp, Homo sapiens
tataatttaaaga

SEQ ID NO: 1874447 - DNA, 23 bp, Homo sapiens
tatacagattcctgttgtgtaat

SEQ ID NO: 1874448 - DNA, 18 bp, Homo sapiens
tatacataaacagttttg

SEQ ID NO: 1874449 - DNA, 18 bp, Homo sapiens
tataccatgtgtgctaat

SEQ ID NO: 1874450 - DNA, 18 bp, Homo sapiens
tatacctgccttttaagt

SEQ ID NO: 1874451 - DNA, 18 bp, Homo sapiens
tatagaaagcaagatgta

SEQ ID NO: 1874452 - DNA, 14 bp, Homo sapiens
tatagatggccaaa

SEQ ID NO: 1874453 - DNA, 22 bp, Homo sapiens
tatagctattactgtctggttt

SEQ ID NO: 1874454 - DNA, 18 bp, Homo sapiens
tataggcagatctttaaa

SEQ ID NO: 1874455 - DNA, 15 bp, Homo sapiens
tataggtaacgtgat

SEQ ID NO: 1874456 - DNA, 22 bp, Homo sapiens
tataggttgtgcaaattaacag

SEQ ID NO: 1874457 - DNA, 13 bp, Homo sapiens
tatagtagaaaga

SEQ ID NO: 1874458 - DNA, 24 bp, Homo sapiens
tatagtagaaagacatctgcctgt

SEQ ID NO: 1874459 - DNA, 22 bp, Homo sapiens
ggtaacgtgattgattcagtat

SEQ ID NO: 1874460 - DNA, 19 bp, Homo sapiens
ggtataaggatcttttgta

SEQ ID NO: 1874461 - DNA, 17 bp, Homo sapiens
ggtataatgtgtctgtg

SEQ ID NO: 1874462 - DNA, 15 bp, Homo sapiens
ggtcatggagcagcc

SEQ ID NO: 1874463 - DNA, 16 bp, Homo sapiens
ggtcatggagcagccc

SEQ ID NO: 1874464 - DNA, 18 bp, Homo sapiens
ggtcatggagcagccccc

SEQ ID NO: 1874465 - DNA, 13 bp, Homo sapiens
ggtgatgccttcc

SEQ ID NO: 1874466 - DNA, 15 bp, Homo sapiens
ggtgtcatcatcaga

SEQ ID NO: 1874467 - DNA, 15 bp, Homo sapiens
ggtgtcccagtccca

SEQ ID NO: 1874468 - DNA, 20 bp, Homo sapiens
ggtgtcccagtcccagcctc

SEQ ID NO: 1874469 - DNA, 23 bp, Homo sapiens
ggtgtcccagtcccagcctctgg

SEQ ID NO: 1874470 - DNA, 22 bp, Homo sapiens
ggtttctgatctgtactttgtg

SEQ ID NO: 1874471 - DNA, 16 bp, Homo sapiens
ggtttgggatggagat

SEQ ID NO: 1874472 - DNA, 18 bp, Homo sapiens
ggtttgtttgcttaattt

SEQ ID NO: 1874473 - DNA, 17 bp, Homo sapiens
ggttttgaataaaaagt

SEQ ID NO: 1874474 - DNA, 20 bp, Homo sapiens
gtaaaagttataataactga

SEQ ID NO: 1874475 - DNA, 19 bp, Homo sapiens
gtaaatttttgaaaaatat

SEQ ID NO: 1874476 - DNA, 20 bp, Homo sapiens
gtaaatttttgaaaaatatt

SEQ ID NO: 1874477 - DNA, 17 bp, Homo sapiens
gtaacagtgcaagattt

SEQ ID NO: 1874478 - DNA, 21 bp, Homo sapiens
gtaagcagattacaataaatc

SEQ ID NO: 1874479 - DNA, 22 bp, Homo sapiens
gtaagtcttttttttttccaaa

SEQ ID NO: 1874480 - DNA, 15 bp, Homo sapiens
gtaagtgaatttatg

SEQ ID NO: 1874481 - DNA, 14 bp, Homo sapiens
gtaataaaaagaga

SEQ ID NO: 1874482 - DNA, 21 bp, Homo sapiens
gtaataaaaagagatgaaata

SEQ ID NO: 1874483 - DNA, 15 bp, Homo sapiens
gtaataaatacacag

SEQ ID NO: 1874484 - DNA, 23 bp, Homo sapiens
gtaataaatacacagcatgcaga

SEQ ID NO: 1874485 - DNA, 19 bp, Homo sapiens
gtaatagaaaactgaaaat

SEQ ID NO: 1874486 - DNA, 22 bp, Homo sapiens
gtaatctccacagtcaaagaag

SEQ ID NO: 1874487 - DNA, 16 bp, Homo sapiens
gtaatttttttttgta

SEQ ID NO: 1874488 - DNA, 17 bp, Homo sapiens
gtaatttttttttgtaa

SEQ ID NO: 1874489 - DNA, 17 bp, Homo sapiens
gtaccatattgctctta

SEQ ID NO: 1874490 - DNA, 18 bp, Homo sapiens
gtaccatattgctcttaa

SEQ ID NO: 1874491 - DNA, 11 bp, Homo sapiens
gtaccctgcag

SEQ ID NO: 1874492 - DNA, 16 bp, Homo sapiens
gtaccctgcaggccag

SEQ ID NO: 1874493 - DNA, 18 bp, Homo sapiens
gtacctctagctgttctt

SEQ ID NO: 1874494 - DNA, 16 bp, Homo sapiens
gtactatctttgtcta

SEQ ID NO: 1874495 - DNA, 22 bp, Homo sapiens
gtactttgtgtttagctacctt

SEQ ID NO: 1874496 - DNA, 19 bp, Homo sapiens
gtacttttctggttccaaa

SEQ ID NO: 1874497 - DNA, 13 bp, Homo sapiens
gtactttttgttt

SEQ ID NO: 1874498 - DNA, 18 bp, Homo sapiens
gtagaaagacatctgcct

SEQ ID NO: 1874499 - DNA, 19 bp, Homo sapiens
gtagaaagacatctgcctg

SEQ ID NO: 1874500 - DNA, 20 bp, Homo sapiens
gtagccctggatggcctctg

SEQ ID NO: 1874501 - DNA, 22 bp, Homo sapiens
gtagccctggatggcctctggg

SEQ ID NO: 1874502 - DNA, 23 bp, Homo sapiens
gtagccctggatggcctctgggg

SEQ ID NO: 1874503 - DNA, 16 bp, Homo sapiens
gtaggcacttttattt

SEQ ID NO: 1874504 - DNA, 21 bp, Homo sapiens
gtaggttttaaaaataagttt

SEQ ID NO: 1874505 - DNA, 17 bp, Homo sapiens
gtagtagccctttctgt

SEQ ID NO: 1874506 - DNA, 13 bp, Homo sapiens
gtataaaaaggaa

SEQ ID NO: 1874507 - DNA, 17 bp, Homo sapiens
gtataaaaaggaaatta

SEQ ID NO: 1874508 - DNA, 20 bp, Homo sapiens
gtataaggatcttttgtaaa

SEQ ID NO: 1874509 - DNA, 14 bp, Homo sapiens
gtataatgctttct

SEQ ID NO: 1874510 - DNA, 16 bp, Homo sapiens
gtataatgctttctga

SEQ ID NO: 1874511 - DNA, 14 bp, Homo sapiens
gtataatgtgtctg

SEQ ID NO: 1874512 - DNA, 15 bp, Homo sapiens
gtataatgtgtctgt

SEQ ID NO: 1874513 - DNA, 16 bp, Homo sapiens
gtataatgtgtctgtg

SEQ ID NO: 1874514 - DNA, 20 bp, Homo sapiens
gtatactgtaaaagttataa

SEQ ID NO: 1874515 - DNA, 14 bp, Homo sapiens
gtatagtagaaaga

SEQ ID NO: 1874516 - DNA, 15 bp, Homo sapiens
gtatagtgtaaaata

SEQ ID NO: 1874517 - DNA, 17 bp, Homo sapiens
gtatataatcatgctca

SEQ ID NO: 1874518 - DNA, 14 bp, Homo sapiens
gtatatcagaaaag

SEQ ID NO: 1874519 - DNA, 12 bp, Homo sapiens
gtatattataat

SEQ ID NO: 1874520 - DNA, 13 bp, Homo sapiens
gtatcattaaaat

SEQ ID NO: 1874521 - DNA, 16 bp, Homo sapiens
gtatcattaaaatata

SEQ ID NO: 1874522 - DNA, 17 bp, Homo sapiens
gtatcattaaaatatat

SEQ ID NO: 1874523 - DNA, 15 bp, Homo sapiens
gtatccagaatggaa

SEQ ID NO: 1874524 - DNA, 18 bp, Homo sapiens
gtatcgttcgcttgtttt

SEQ ID NO: 1874525 - DNA, 21 bp, Homo sapiens
gtatcttagagtttacagttt

SEQ ID NO: 1874526 - DNA, 14 bp, Homo sapiens
gtattataattgtt

SEQ ID NO: 1874527 - DNA, 19 bp, Homo sapiens
gtattcagaaattaaaata

SEQ ID NO: 1874528 - DNA, 14 bp, Homo sapiens
gtattcttgtcaaa

SEQ ID NO: 1874529 - DNA, 20 bp, Homo sapiens
gtatttaactacatctgcct

SEQ ID NO: 1874530 - DNA, 22 bp, Homo sapiens
gtatttaactacatctgcctcg

SEQ ID NO: 1874531 - DNA, 20 bp, Homo sapiens
gtatttaagaaagggaaagc

SEQ ID NO: 1874532 - DNA, 12 bp, Homo sapiens
gtcaaagaaatg

SEQ ID NO: 1874533 - DNA, 16 bp, Homo sapiens
gtcaataactctgatt

SEQ ID NO: 1874534 - DNA, 15 bp, Homo sapiens
gtcacccccccaggc

SEQ ID NO: 1874535 - DNA, 17 bp, Homo sapiens
gtcacccccccaggcct

SEQ ID NO: 1874536 - DNA, 21 bp, Homo sapiens
gtcagcgcaggtttagtttac

SEQ ID NO: 1874537 - DNA, 15 bp, Homo sapiens
gtcatcacttttcag

SEQ ID NO: 1874538 - DNA, 16 bp, Homo sapiens
gtcatcatcagacttg

SEQ ID NO: 1874539 - DNA, 16 bp, Homo sapiens
gtcatggagcagcccc

SEQ ID NO: 1874540 - DNA, 20 bp, Homo sapiens
gtcatggagcagcccccaaa

SEQ ID NO: 1874541 - DNA, 21 bp, Homo sapiens
gtcatggtagatttttttcat

SEQ ID NO: 1874542 - DNA, 16 bp, Homo sapiens
gtccaagacacatgct

SEQ ID NO: 1874543 - DNA, 18 bp, Homo sapiens
gtccagagggactggaca

SEQ ID NO: 1874544 - DNA, 22 bp, Homo sapiens
gtccagagggactggacagcca

SEQ ID NO: 1874545 - DNA, 20 bp, Homo sapiens
gtccagttataagcgtattt

SEQ ID NO: 1874546 - DNA, 20 bp, Homo sapiens
gtccatttcttatttaatta

SEQ ID NO: 1874547 - DNA, 14 bp, Homo sapiens
gtcccagcctctgg

SEQ ID NO: 1874548 - DNA, 16 bp, Homo sapiens
gtcccagcctctgggg

SEQ ID NO: 1874549 - DNA, 19 bp, Homo sapiens
gtcccagcctctggggcag

SEQ ID NO: 1874550 - DNA, 17 bp, Homo sapiens
gtcccagtcccagcctc

SEQ ID NO: 1874551 - DNA, 15 bp, Homo sapiens
gtcctgctttcctat

SEQ ID NO: 1874552 - DNA, 15 bp, Homo sapiens
gtcctgtgaatttct

SEQ ID NO: 1874553 - DNA, 11 bp, Homo sapiens
gtcctgtgtct

SEQ ID NO: 1874554 - DNA, 17 bp, Homo sapiens
gtcgaattaatagcttt

SEQ ID NO: 1874555 - DNA, 13 bp, Homo sapiens
gtcgagcactcta

SEQ ID NO: 1874556 - DNA, 13 bp, Homo sapiens
gtcggctgtgagg

SEQ ID NO: 1874557 - DNA, 14 bp, Homo sapiens
gtctacattaaaca

SEQ ID NO: 1874558 - DNA, 15 bp, Homo sapiens
gtctacattaaacaa

SEQ ID NO: 1874559 - DNA, 23 bp, Homo sapiens
gtctcatgcccactcccccagga

SEQ ID NO: 1874560 - DNA, 15 bp, Homo sapiens
gtctctgttgtaaat

SEQ ID NO: 1874561 - DNA, 15 bp, Homo sapiens
gtctgcagctcctgg

SEQ ID NO: 1874562 - DNA, 19 bp, Homo sapiens
gtctgcatcagctttttgt

SEQ ID NO: 1874563 - DNA, 14 bp, Homo sapiens
gtcttctcccagag

SEQ ID NO: 1874564 - DNA, 14 bp, Homo sapiens
gtctttgtgtgtta

SEQ ID NO: 1874565 - DNA, 20 bp, Homo sapiens
gtctttgtgtgttatattcc

SEQ ID NO: 1874566 - DNA, 19 bp, Homo sapiens
gtcttttttttttccaaat

SEQ ID NO: 1874567 - DNA, 13 bp, Homo sapiens
gtgaaagctgcac

SEQ ID NO: 1874568 - DNA, 15 bp, Homo sapiens
gtgaacttttgtaat

SEQ ID NO: 1874569 - DNA, 16 bp, Homo sapiens
gtgaacttttgtaatt

SEQ ID NO: 1874570 - DNA, 19 bp, Homo sapiens
gtgaacttttgtaatttga

SEQ ID NO: 1874571 - DNA, 23 bp, Homo sapiens
gtgaacttttgtaatttgaattg

SEQ ID NO: 1874572 - DNA, 22 bp, Homo sapiens
gtgactgcaagcatttttccat

SEQ ID NO: 1874573 - DNA, 12 bp, Homo sapiens
gtgactttgaaa

SEQ ID NO: 1874574 - DNA, 19 bp, Homo sapiens
gtgagaagatgggggctgg

SEQ ID NO: 1874575 - DNA, 16 bp, Homo sapiens
gtgagaggaaatgttg

SEQ ID NO: 1874576 - DNA, 20 bp, Homo sapiens
gtgagtgccatgctttttgg

SEQ ID NO: 1874577 - DNA, 23 bp, Homo sapiens
gtgatgccttccgacaccactgg

SEQ ID NO: 1874578 - DNA, 21 bp, Homo sapiens
gtgatttagaactgtatgtca

SEQ ID NO: 1874579 - DNA, 20 bp, Homo sapiens
gtgcaccttaccaactttct

SEQ ID NO: 1874580 - DNA, 19 bp, Homo sapiens
gtgcagcgggccaggcagg

SEQ ID NO: 1874581 - DNA, 15 bp, Homo sapiens
gtgcatcagaaaatg

SEQ ID NO: 1874582 - DNA, 15 bp, Homo sapiens
gtgcatttaaggaga

SEQ ID NO: 1874583 - DNA, 18 bp, Homo sapiens
gtgccttttatagctatt

SEQ ID NO: 1874584 - DNA, 18 bp, Homo sapiens
gtggaccggccgcagccc

SEQ ID NO: 1874585 - DNA, 21 bp, Homo sapiens
gtggaccggccgcagccccca

SEQ ID NO: 1874586 - DNA, 14 bp, Homo sapiens
gtggctcttgggac

SEQ ID NO: 1874587 - DNA, 19 bp, Homo sapiens
gtgtaatctaagtatatgt

SEQ ID NO: 1874588 - DNA, 13 bp, Homo sapiens
gtgtatatcagaa

SEQ ID NO: 1874589 - DNA, 15 bp, Homo sapiens
gtgtatcattaaaat

SEQ ID NO: 1874590 - DNA, 21 bp, Homo sapiens
gtgtatcccccccctgtatag

SEQ ID NO: 1874591 - DNA, 22 bp, Homo sapiens
gtgtatcccccccctgtatagt

SEQ ID NO: 1874592 - DNA, 20 bp, Homo sapiens
gtgtatgattttgatgcaca

SEQ ID NO: 1874593 - DNA, 12 bp, Homo sapiens
gtgtatttaaga

SEQ ID NO: 1874594 - DNA, 17 bp, Homo sapiens
gtgtcccagtcccagcc

SEQ ID NO: 1874595 - DNA, 15 bp, Homo sapiens
gtgtctgcagctcct

SEQ ID NO: 1874596 - DNA, 11 bp, Homo sapiens
gtgtctgtgtt

SEQ ID NO: 1874597 - DNA, 13 bp, Homo sapiens
gtgtgaaaatggg

SEQ ID NO: 1874598 - DNA, 23 bp, Homo sapiens
gtgtgcaactaactgactctgtt

SEQ ID NO: 1874599 - DNA, 22 bp, Homo sapiens
gtgtgcaccttaccaactttct

SEQ ID NO: 1874600 - DNA, 19 bp, Homo sapiens
gtgtgttatattccaagga

SEQ ID NO: 1874601 - DNA, 18 bp, Homo sapiens
gtgttatattccaaggaa

SEQ ID NO: 1874602 - DNA, 13 bp, Homo sapiens
gttaaatcatttg

SEQ ID NO: 1874603 - DNA, 22 bp, Homo sapiens
gttaaatgccttggtttgattt

SEQ ID NO: 1874604 - DNA, 14 bp, Homo sapiens
gttaagaaaggata

SEQ ID NO: 1874605 - DNA, 21 bp, Homo sapiens
gttaatatatcccagaaatta

SEQ ID NO: 1874606 - DNA, 17 bp, Homo sapiens
gttacaagtttgctaaa

SEQ ID NO: 1874607 - DNA, 21 bp, Homo sapiens
gttacaagtttgctaaaagaa

SEQ ID NO: 1874608 - DNA, 20 bp, Homo sapiens
gttactgcttctctttgtgc

SEQ ID NO: 1874609 - DNA, 17 bp, Homo sapiens
gttagcgtccatttctt

SEQ ID NO: 1874610 - DNA, 14 bp, Homo sapiens
gttataataactga

SEQ ID NO: 1874611 - DNA, 17 bp, Homo sapiens
gttataataactgaact

SEQ ID NO: 1874612 - DNA, 18 bp, Homo sapiens
gttataataactgaactg

SEQ ID NO: 1874613 - DNA, 17 bp, Homo sapiens
gttatagattgtcttaa

SEQ ID NO: 1874614 - DNA, 21 bp, Homo sapiens
gttatattccaaggaaaattg

SEQ ID NO: 1874615 - DNA, 12 bp, Homo sapiens
gttatgaaaatc

SEQ ID NO: 1874616 - DNA, 13 bp, Homo sapiens
gttatgaaaatcc

SEQ ID NO: 1874617 - DNA, 19 bp, Homo sapiens
gttatttgttattttcagt

SEQ ID NO: 1874618 - DNA, 12 bp, Homo sapiens
gttattttcagt

SEQ ID NO: 1874619 - DNA, 15 bp, Homo sapiens
gttattttcagtatt

SEQ ID NO: 1874620 - DNA, 21 bp, Homo sapiens
gttcaacagtttctcaagttt

SEQ ID NO: 1874621 - DNA, 15 bp, Homo sapiens
gttcactaaactctg

SEQ ID NO: 1874622 - DNA, 15 bp, Homo sapiens
gttcagacttagttt

SEQ ID NO: 1874623 - DNA, 13 bp, Homo sapiens
gttcatataattt

SEQ ID NO: 1874624 - DNA, 14 bp, Homo sapiens
gttcatataattta

SEQ ID NO: 1874625 - DNA, 22 bp, Homo sapiens
gttccaaaccagtttattctgt

SEQ ID NO: 1874626 - DNA, 22 bp, Homo sapiens
gttcctcgggatgaaaagccat

SEQ ID NO: 1874627 - DNA, 22 bp, Homo sapiens
gttctctttgccttgatgttgt

SEQ ID NO: 1874628 - DNA, 18 bp, Homo sapiens
gttctgcaagaattaaaa

SEQ ID NO: 1874629 - DNA, 19 bp, Homo sapiens
gttctgcaagaattaaaac

SEQ ID NO: 1874630 - DNA, 16 bp, Homo sapiens
gttcttgaattgttat

SEQ ID NO: 1874631 - DNA, 15 bp, Homo sapiens
gttgaatgacaacag

SEQ ID NO: 1874632 - DNA, 21 bp, Homo sapiens
gttgatggtagggtataatgt

SEQ ID NO: 1874633 - DNA, 18 bp, Homo sapiens
gttgccttaaagaaagtc

SEQ ID NO: 1874634 - DNA, 22 bp, Homo sapiens
gttgctagcaaacaaatggctt

SEQ ID NO: 1874635 - DNA, 14 bp, Homo sapiens
gttggcacttatag

SEQ ID NO: 1874636 - DNA, 19 bp, Homo sapiens
gtttaaaatgaagcaattt

SEQ ID NO: 1874637 - DNA, 16 bp, Homo sapiens
gtttacaagtgtatat

SEQ ID NO: 1874638 - DNA, 19 bp, Homo sapiens
gtttacagtgtatttaaga

SEQ ID NO: 1874639 - DNA, 17 bp, Homo sapiens
gtttactcccttctgta

SEQ ID NO: 1874640 - DNA, 20 bp, Homo sapiens
gtttactcccttctgtagtt

SEQ ID NO: 1874641 - DNA, 13 bp, Homo sapiens
gtttattctgtgg

SEQ ID NO: 1874642 - DNA, 12 bp, Homo sapiens
gtttatttccaa

SEQ ID NO: 1874643 - DNA, 21 bp, Homo sapiens
gtttatttccaaataaaatga

SEQ ID NO: 1874644 - DNA, 21 bp, Homo sapiens
gtttcagatatatatcatatt

SEQ ID NO: 1874645 - DNA, 19 bp, Homo sapiens
gtttcatgtatgtatataa

SEQ ID NO: 1874646 - DNA, 13 bp, Homo sapiens
gtttctattttct

SEQ ID NO: 1874647 - DNA, 13 bp, Homo sapiens
gtttctcaagttt

SEQ ID NO: 1874648 - DNA, 14 bp, Homo sapiens
gtttctcaagttta

SEQ ID NO: 1874649 - DNA, 21 bp, Homo sapiens
gtttctcaagtttaaagtcat

SEQ ID NO: 1874650 - DNA, 20 bp, Homo sapiens
gtttctgatctgtactttgt

SEQ ID NO: 1874651 - DNA, 22 bp, Homo sapiens
gtttctgatctgtactttgtgt

SEQ ID NO: 1874652 - DNA, 14 bp, Homo sapiens
gtttgctaaaagaa

SEQ ID NO: 1874653 - DNA, 20 bp, Homo sapiens
gtttgctaaaagaagagagg

SEQ ID NO: 1874654 - DNA, 16 bp, Homo sapiens
gtttgcttaatttcct

SEQ ID NO: 1874655 - DNA, 17 bp, Homo sapiens
gtttgcttaatttcctt

SEQ ID NO: 1874656 - DNA, 15 bp, Homo sapiens
gtttggcaatagttt

SEQ ID NO: 1874657 - DNA, 14 bp, Homo sapiens
gtttgtaatctgta

SEQ ID NO: 1874658 - DNA, 14 bp, Homo sapiens
gtttgtatatttgc

SEQ ID NO: 1874659 - DNA, 15 bp, Homo sapiens
gtttgtatatttgca

SEQ ID NO: 1874660 - DNA, 14 bp, Homo sapiens
gtttgttccagaat

SEQ ID NO: 1874661 - DNA, 14 bp, Homo sapiens
gtttgtttgcttaa

SEQ ID NO: 1874662 - DNA, 17 bp, Homo sapiens
gttttaaaaaaactgaa

SEQ ID NO: 1874663 - DNA, 22 bp, Homo sapiens
gttttaacaatttcctttatat

SEQ ID NO: 1874664 - DNA, 16 bp, Homo sapiens
gttttaccctatatct

SEQ ID NO: 1874665 - DNA, 17 bp, Homo sapiens
gttttagatttttaaaa

SEQ ID NO: 1874666 - DNA, 18 bp, Homo sapiens
gttttagatttttaaaag

SEQ ID NO: 1874667 - DNA, 15 bp, Homo sapiens
gttttatttacattt

SEQ ID NO: 1874668 - DNA, 21 bp, Homo sapiens
gttttattttttattgttttc

SEQ ID NO: 1874669 - DNA, 17 bp, Homo sapiens
gttttctggcttctgct

SEQ ID NO: 1874670 - DNA, 16 bp, Homo sapiens
gttttgaataaaaagt

SEQ ID NO: 1874671 - DNA, 17 bp, Homo sapiens
gttttgaataaaaagtg

SEQ ID NO: 1874672 - DNA, 23 bp, Homo sapiens
gttttgaataaaaagtgaacttt

SEQ ID NO: 1874673 - DNA, 15 bp, Homo sapiens
gttttgtattgcttc

SEQ ID NO: 1874674 - DNA, 15 bp, Homo sapiens
gtttttaacatgtga

SEQ ID NO: 1874675 - DNA, 15 bp, Homo sapiens
gttttttttttaagt

SEQ ID NO: 1874676 - DNA, 19 bp, Homo sapiens
gttttttttttaagtgcaa

SEQ ID NO: 1874677 - DNA, 17 bp, Homo sapiens
gtttttttttttccaga

SEQ ID NO: 1874678 - DNA, 13 bp, Homo sapiens
taaaaaaactgaa

SEQ ID NO: 1874679 - DNA, 19 bp, Homo sapiens
taaaaaaactgaaggtttt

SEQ ID NO: 1874680 - DNA, 17 bp, Homo sapiens
taaaaaatattttaaga

SEQ ID NO: 1874681 - DNA, 12 bp, Homo sapiens
taaaaactgtgt

SEQ ID NO: 1874682 - DNA, 18 bp, Homo sapiens
taaaaactgtgtatcatt

SEQ ID NO: 1874683 - DNA, 20 bp, Homo sapiens
taaaaactgtgtatcattaa

SEQ ID NO: 1874684 - DNA, 21 bp, Homo sapiens
taaaaactgtgtatcattaaa

SEQ ID NO: 1874685 - DNA, 22 bp, Homo sapiens
taaaaactgtgtatcattaaaa

SEQ ID NO: 1874686 - DNA, 23 bp, Homo sapiens
taaaaactgtgtatcattaaaat

SEQ ID NO: 1874687 - DNA, 12 bp, Homo sapiens
taaaaaggaaat

SEQ ID NO: 1874688 - DNA, 15 bp, Homo sapiens
taaaaaggaaattag

SEQ ID NO: 1874689 - DNA, 23 bp, Homo sapiens
taaaaagtgaacttttgtaattt

SEQ ID NO: 1874690 - DNA, 19 bp, Homo sapiens
taaaaataagttttataca

SEQ ID NO: 1874691 - DNA, 23 bp, Homo sapiens
taaaaatatggaacttctaatat

SEQ ID NO: 1874692 - DNA, 18 bp, Homo sapiens
taaaactgagtccatgaa

SEQ ID NO: 1874693 - DNA, 20 bp, Homo sapiens
taaaactgagtccatgaaaa

SEQ ID NO: 1874694 - DNA, 21 bp, Homo sapiens
taaaactgagtccatgaaaat

SEQ ID NO: 1874695 - DNA, 12 bp, Homo sapiens
taaaactttaaa

SEQ ID NO: 1874696 - DNA, 20 bp, Homo sapiens
ttaattcattaatctgtttg

SEQ ID NO: 1874697 - DNA, 17 bp, Homo sapiens
ttaattgtcctgtgtct

SEQ ID NO: 1874698 - DNA, 17 bp, Homo sapiens
ttaatttccttctgtta

SEQ ID NO: 1874699 - DNA, 23 bp, Homo sapiens
ttaatttttgtactttgcttctt

SEQ ID NO: 1874700 - DNA, 16 bp, Homo sapiens
ttacaagcttaaagct

SEQ ID NO: 1874701 - DNA, 17 bp, Homo sapiens
ttacaagcttaaagctt

SEQ ID NO: 1874702 - DNA, 21 bp, Homo sapiens
ttacaagcttaaagcttgatt

SEQ ID NO: 1874703 - DNA, 22 bp, Homo sapiens
ttacaagtttgctaaaagaaga

SEQ ID NO: 1874704 - DNA, 17 bp, Homo sapiens
ttacagaatgcattaaa

SEQ ID NO: 1874705 - DNA, 20 bp, Homo sapiens
ttacagaatgcattaaaaaa

SEQ ID NO: 1874706 - DNA, 16 bp, Homo sapiens
ttacagaggaagttat

SEQ ID NO: 1874707 - DNA, 20 bp, Homo sapiens
ttacagtctctgttgtaaat

SEQ ID NO: 1874708 - DNA, 17 bp, Homo sapiens
ttacagtgtatttaaga

SEQ ID NO: 1874709 - DNA, 16 bp, Homo sapiens
ttacagttatagaaag

SEQ ID NO: 1874710 - DNA, 14 bp, Homo sapiens
ttacagtttgtgtt

SEQ ID NO: 1874711 - DNA, 13 bp, Homo sapiens
ttacatccttaaa

SEQ ID NO: 1874712 - DNA, 12 bp, Homo sapiens
ttacattattcc

SEQ ID NO: 1874713 - DNA, 15 bp, Homo sapiens
ttaccaactttctgt

SEQ ID NO: 1874714 - DNA, 16 bp, Homo sapiens
ttaccaactttctgta

SEQ ID NO: 1874715 - DNA, 22 bp, Homo sapiens
ttaccaagtatgaagtataaat

SEQ ID NO: 1874716 - DNA, 14 bp, Homo sapiens
ttaccagtctgatt

SEQ ID NO: 1874717 - DNA, 24 bp, Homo sapiens
ttacccaaaaactaaatctctaat

SEQ ID NO: 1874718 - DNA, 17 bp, Homo sapiens
ttactaagccacaagaa

SEQ ID NO: 1874719 - DNA, 17 bp, Homo sapiens
ttactcccttctgtagt

SEQ ID NO: 1874720 - DNA, 18 bp, Homo sapiens
ttactgcttctctttgtg

SEQ ID NO: 1874721 - DNA, 12 bp, Homo sapiens
ttactggcactg

SEQ ID NO: 1874722 - DNA, 20 bp, Homo sapiens
ttacttacaaaagcagcttt

SEQ ID NO: 1874723 - DNA, 17 bp, Homo sapiens
ttagaatgccataaaat

SEQ ID NO: 1874724 - DNA, 22 bp, Homo sapiens
ttagactgtggccatatatgct

SEQ ID NO: 1874725 - DNA, 17 bp, Homo sapiens
ttagagtttacagtttg

SEQ ID NO: 1874726 - DNA, 17 bp, Homo sapiens
ttagcagaatggagaaa

SEQ ID NO: 1874727 - DNA, 20 bp, Homo sapiens
ttagctacctttttatattt

SEQ ID NO: 1874728 - DNA, 14 bp, Homo sapiens
ttaggttgttacca

SEQ ID NO: 1874729 - DNA, 15 bp, Homo sapiens
ttagtaccctgcagg

SEQ ID NO: 1874730 - DNA, 21 bp, Homo sapiens
ttagtaccctgcaggccaggc

SEQ ID NO: 1874731 - DNA, 16 bp, Homo sapiens
ttagtgagacatattt

SEQ ID NO: 1874732 - DNA, 13 bp, Homo sapiens
ttagttaatatat

SEQ ID NO: 1874733 - DNA, 13 bp, Homo sapiens
ttagttatagttt

SEQ ID NO: 1874734 - DNA, 18 bp, Homo sapiens
ttagttatagtttcagat

SEQ ID NO: 1874735 - DNA, 14 bp, Homo sapiens
attaatctgtttgt

SEQ ID NO: 1874736 - DNA, 14 bp, Homo sapiens
attaatcttttaaa

SEQ ID NO: 1874737 - DNA, 19 bp, Homo sapiens
attaattagatcaacactt

SEQ ID NO: 1874738 - DNA, 17 bp, Homo sapiens
attaattattttccaaa

SEQ ID NO: 1874739 - DNA, 19 bp, Homo sapiens
attaattattttccaaaat

SEQ ID NO: 1874740 - DNA, 18 bp, Homo sapiens
attacaataaatccttta

SEQ ID NO: 1874741 - DNA, 17 bp, Homo sapiens
attacagaggaagttat

SEQ ID NO: 1874742 - DNA, 15 bp, Homo sapiens
attacagatcatata

SEQ ID NO: 1874743 - DNA, 16 bp, Homo sapiens
attacagatcatataa

SEQ ID NO: 1874744 - DNA, 22 bp, Homo sapiens
attaccatagagtaatgatgta

SEQ ID NO: 1874745 - DNA, 17 bp, Homo sapiens
attaccttgtctttcaa

SEQ ID NO: 1874746 - DNA, 21 bp, Homo sapiens
attaccttgtctttcaaaaga

SEQ ID NO: 1874747 - DNA, 14 bp, Homo sapiens
attactgtatgtat

SEQ ID NO: 1874748 - DNA, 23 bp, Homo sapiens
attactgtatgtataaattatga

SEQ ID NO: 1874749 - DNA, 16 bp, Homo sapiens
attagagaactggagg

SEQ ID NO: 1874750 - DNA, 19 bp, Homo sapiens
attagtctttttctttttt

SEQ ID NO: 1874751 - DNA, 12 bp, Homo sapiens
attataattgtt

SEQ ID NO: 1874752 - DNA, 18 bp, Homo sapiens
attataccatgtgtgcta

SEQ ID NO: 1874753 - DNA, 19 bp, Homo sapiens
attataccatgtgtgctaa

SEQ ID NO: 1874754 - DNA, 14 bp, Homo sapiens
attatcttcatgtt

SEQ ID NO: 1874755 - DNA, 14 bp, Homo sapiens
attatttgatatct

SEQ ID NO: 1874756 - DNA, 23 bp, Homo sapiens
attatttgtgtaatagaaaactg

SEQ ID NO: 1874757 - DNA, 14 bp, Homo sapiens
attattttaaacaa

SEQ ID NO: 1874758 - DNA, 21 bp, Homo sapiens
attattttaaacaaaatagaa

SEQ ID NO: 1874759 - DNA, 14 bp, Homo sapiens
attattttacagtc

SEQ ID NO: 1874760 - DNA, 14 bp, Homo sapiens
attcaagttattgt

SEQ ID NO: 1874761 - DNA, 19 bp, Homo sapiens
attcacacttgttcaacag

SEQ ID NO: 1874762 - DNA, 14 bp, Homo sapiens
attcactgttgaat

SEQ ID NO: 1874763 - DNA, 17 bp, Homo sapiens
attcatgcaacttgatt

SEQ ID NO: 1874764 - DNA, 14 bp, Homo sapiens
attcattaatctgt

SEQ ID NO: 1874765 - DNA, 18 bp, Homo sapiens
attcattaatctgtttgt

SEQ ID NO: 1874766 - DNA, 14 bp, Homo sapiens
attccaacagtgag

SEQ ID NO: 1874767 - DNA, 23 bp, Homo sapiens
attccaatgatacccaacagttt

SEQ ID NO: 1874768 - DNA, 22 bp, Homo sapiens
attccatgcactctctctctgt

SEQ ID NO: 1874769 - DNA, 14 bp, Homo sapiens
attctaaattcact

SEQ ID NO: 1874770 - DNA, 17 bp, Homo sapiens
attctatggagctattt

SEQ ID NO: 1874771 - DNA, 14 bp, Homo sapiens
attctattttgctg

SEQ ID NO: 1874772 - DNA, 16 bp, Homo sapiens
attctgtggttctata

SEQ ID NO: 1874773 - DNA, 16 bp, Homo sapiens
attcttttgttattaa

SEQ ID NO: 1874774 - DNA, 16 bp, Homo sapiens
attgaaagtattcaga

SEQ ID NO: 1874775 - DNA, 23 bp, Homo sapiens
attgaaagtattcagaaattaaa

SEQ ID NO: 1874776 - DNA, 15 bp, Homo sapiens
attgaaagttgcttt

SEQ ID NO: 1874777 - DNA, 16 bp, Homo sapiens
attgaaagttgctttt

SEQ ID NO: 1874778 - DNA, 14 bp, Homo sapiens
attgaaatcagcat

SEQ ID NO: 1874779 - DNA, 21 bp, Homo sapiens
attgaaatcagcatgacaaaa

SEQ ID NO: 1874780 - DNA, 13 bp, Homo sapiens
attgcactaaata

SEQ ID NO: 1874781 - DNA, 23 bp, Homo sapiens
attgcagtttcatgtatgtatat

SEQ ID NO: 1874782 - DNA, 16 bp, Homo sapiens
caaagccatattctaa

SEQ ID NO: 1874783 - DNA, 19 bp, Homo sapiens
caaagccatattctaaatt

SEQ ID NO: 1874784 - DNA, 16 bp, Homo sapiens
caaaggactgtaagca

SEQ ID NO: 1874785 - DNA, 20 bp, Homo sapiens
caaaggactgtaagcagatt

SEQ ID NO: 1874786 - DNA, 18 bp, Homo sapiens
caaagttactggctcttt

SEQ ID NO: 1874787 - DNA, 18 bp, Homo sapiens
caaataaactctaaacat

SEQ ID NO: 1874788 - DNA, 11 bp, Homo sapiens
caaataatttt

SEQ ID NO: 1874789 - DNA, 13 bp, Homo sapiens
caaatgaactttt

SEQ ID NO: 1874790 - DNA, 21 bp, Homo sapiens
caaatgaacttttacagaatg

SEQ ID NO: 1874791 - DNA, 23 bp, Homo sapiens
caaatgaacttttacagaatgca

SEQ ID NO: 1874792 - DNA, 12 bp, Homo sapiens
caaattaatctt

SEQ ID NO: 1874793 - DNA, 22 bp, Homo sapiens
caaattattaattgtcctgtgt

SEQ ID NO: 1874794 - DNA, 16 bp, Homo sapiens
caaattatttgtgtaa

SEQ ID NO: 1874795 - DNA, 17 bp, Homo sapiens
caaattatttgtgtaat

SEQ ID NO: 1874796 - DNA, 23 bp, Homo sapiens
caaattccgattagacctttatc

SEQ ID NO: 1874797 - DNA, 15 bp, Homo sapiens
caaattgtaattaat

SEQ ID NO: 1874798 - DNA, 18 bp, Homo sapiens
caaattgtaattaataat

SEQ ID NO: 1874799 - DNA, 13 bp, Homo sapiens
caaattgtctgtc

SEQ ID NO: 1874800 - DNA, 20 bp, Homo sapiens
caaattgtctgtctgctctt

SEQ ID NO: 1874801 - DNA, 12 bp, Homo sapiens
caacacatgtgg

SEQ ID NO: 1874802 - DNA, 12 bp, Homo sapiens
caacagtgagtc

SEQ ID NO: 1874803 - DNA, 12 bp, Homo sapiens
caacatttctgt

SEQ ID NO: 1874804 - DNA, 20 bp, Homo sapiens
caacatttctgtatactgta

SEQ ID NO: 1874805 - DNA, 22 bp, Homo sapiens
caacatttctgtatactgtaaa

SEQ ID NO: 1874806 - DNA, 16 bp, Homo sapiens
caactcgtgacagcct

SEQ ID NO: 1874807 - DNA, 19 bp, Homo sapiens
caactcgtgacagcctctg

SEQ ID NO: 1874808 - DNA, 15 bp, Homo sapiens
caacttgattcttgt

SEQ ID NO: 1874809 - DNA, 21 bp, Homo sapiens
caagaaaacctgtttttaaca

SEQ ID NO: 1874810 - DNA, 21 bp, Homo sapiens
caagaaggccagcccactggg

SEQ ID NO: 1874811 - DNA, 22 bp, Homo sapiens
caagaaggccagcccactgggc

SEQ ID NO: 1874812 - DNA, 14 bp, Homo sapiens
caagaattaaaact

SEQ ID NO: 1874813 - DNA, 15 bp, Homo sapiens
caagaattaaaactg

SEQ ID NO: 1874814 - DNA, 18 bp, Homo sapiens
caagaattaaaactgagt

SEQ ID NO: 1874815 - DNA, 22 bp, Homo sapiens
caagaattaaaactgagtccat

SEQ ID NO: 1874816 - DNA, 16 bp, Homo sapiens
caagacaacattgtaa

SEQ ID NO: 1874817 - DNA, 19 bp, Homo sapiens
caagacacatgctgaggtt

SEQ ID NO: 1874818 - DNA, 18 bp, Homo sapiens
caagacagtggcactaaa

SEQ ID NO: 1874819 - DNA, 19 bp, Homo sapiens
caagacagtggcactaaaa

SEQ ID NO: 1874820 - DNA, 13 bp, Homo sapiens
caagagccagggg

SEQ ID NO: 1874821 - DNA, 23 bp, Homo sapiens
caagagccaggggtgtcccagtc

SEQ ID NO: 1874822 - DNA, 20 bp, Homo sapiens
caagatcattatcttcatgt

SEQ ID NO: 1874823 - DNA, 23 bp, Homo sapiens
caagattttttttttaagtgaca

SEQ ID NO: 1874824 - DNA, 18 bp, Homo sapiens
caagcatttttccatctg

SEQ ID NO: 1874825 - DNA, 22 bp, Homo sapiens
caagccaggagaagacccctgc

SEQ ID NO: 1874826 - DNA, 21 bp, Homo sapiens
caagctaatctgcctggtttt

SEQ ID NO: 1874827 - DNA, 15 bp, Homo sapiens
caaggaaaattgaaa

SEQ ID NO: 1874828 - DNA, 23 bp, Homo sapiens
caaggctgtcttctcccagagca

SEQ ID NO: 1874829 - DNA, 19 bp, Homo sapiens
caagggccctcactcagga

SEQ ID NO: 1874830 - DNA, 23 bp, Homo sapiens
caaggtaatttttttttgtaaag

SEQ ID NO: 1874831 - DNA, 15 bp, Homo sapiens
caagtcctgtgaatt

SEQ ID NO: 1874832 - DNA, 19 bp, Homo sapiens
caagtggctcttgggacaa

SEQ ID NO: 1874833 - DNA, 16 bp, Homo sapiens
caagtgtatatcagaa

SEQ ID NO: 1874834 - DNA, 18 bp, Homo sapiens
caatatgattgcactaaa

SEQ ID NO: 1874835 - DNA, 19 bp, Homo sapiens
caatatgattgcactaaat

SEQ ID NO: 1874836 - DNA, 19 bp, Homo sapiens
caatcaccttgcatttcaa

SEQ ID NO: 1874837 - DNA, 15 bp, Homo sapiens
caatcatctgtgtga

SEQ ID NO: 1874838 - DNA, 14 bp, Homo sapiens
caatcctccctgga

SEQ ID NO: 1874839 - DNA, 17 bp, Homo sapiens
caatcctccctggagaa

SEQ ID NO: 1874840 - DNA, 18 bp, Homo sapiens
caatcctccctggagaag

SEQ ID NO: 1874841 - DNA, 19 bp, Homo sapiens
caatcctccctggagaagg

SEQ ID NO: 1874842 - DNA, 11 bp, Homo sapiens
caatgccctgc

SEQ ID NO: 1874843 - DNA, 12 bp, Homo sapiens
caatgccctgcc

SEQ ID NO: 1874844 - DNA, 20 bp, Homo sapiens
caatgccctgccttgctgcc

SEQ ID NO: 1874845 - DNA, 22 bp, Homo sapiens
caatggctatatggcaagaaag

SEQ ID NO: 1874846 - DNA, 18 bp, Homo sapiens
caattctgaaatactttt

SEQ ID NO: 1874847 - DNA, 14 bp, Homo sapiens
caatttatatcttt

SEQ ID NO: 1874848 - DNA, 15 bp, Homo sapiens
caatttatatcttta

SEQ ID NO: 1874849 - DNA, 21 bp, Homo sapiens
caatttatatctttatgcaaa

SEQ ID NO: 1874850 - DNA, 22 bp, Homo sapiens
caatttggagcattaactaaat

SEQ ID NO: 1874851 - DNA, 16 bp, Homo sapiens
cacaagaaggccagcc

SEQ ID NO: 1874852 - DNA, 17 bp, Homo sapiens
cacaagaaggccagccc

SEQ ID NO: 1874853 - DNA, 18 bp, Homo sapiens
cacaagaaggccagccca

SEQ ID NO: 1874854 - DNA, 16 bp, Homo sapiens
cacaagtcctgtgaat

SEQ ID NO: 1874855 - DNA, 20 bp, Homo sapiens
cacaagtcctgtgaatttct

SEQ ID NO: 1874856 - DNA, 19 bp, Homo sapiens
cacactgaaacctcttcgg

SEQ ID NO: 1874857 - DNA, 13 bp, Homo sapiens
caggactgggccg

SEQ ID NO: 1874858 - DNA, 23 bp, Homo sapiens
caggactgggccgggcccagggc

SEQ ID NO: 1874859 - DNA, 21 bp, Homo sapiens
caggagaagacccctgcccaa

SEQ ID NO: 1874860 - DNA, 14 bp, Homo sapiens
caggagacaggaag

SEQ ID NO: 1874861 - DNA, 15 bp, Homo sapiens
caggagattggattt

SEQ ID NO: 1874862 - DNA, 16 bp, Homo sapiens
caggagcagcccaccc

SEQ ID NO: 1874863 - DNA, 17 bp, Homo sapiens
caggagcagcccaccca

SEQ ID NO: 1874864 - DNA, 16 bp, Homo sapiens
caggagcagctggcac

SEQ ID NO: 1874865 - DNA, 23 bp, Homo sapiens
caggagcagctggcactgacagc

SEQ ID NO: 1874866 - DNA, 18 bp, Homo sapiens
caggcagcgatggtctca

SEQ ID NO: 1874867 - DNA, 21 bp, Homo sapiens
caggcagcgatggtctcagaa

SEQ ID NO: 1874868 - DNA, 12 bp, Homo sapiens
caggccaggcca

SEQ ID NO: 1874869 - DNA, 19 bp, Homo sapiens
caggccaggccagcttccc

SEQ ID NO: 1874870 - DNA, 16 bp, Homo sapiens
caggctccctgaccac

SEQ ID NO: 1874871 - DNA, 19 bp, Homo sapiens
caggctccctgaccaccct

SEQ ID NO: 1874872 - DNA, 20 bp, Homo sapiens
caggctccctgaccaccctg

SEQ ID NO: 1874873 - DNA, 21 bp, Homo sapiens
caggctccctgaccaccctgc

SEQ ID NO: 1874874 - DNA, 23 bp, Homo sapiens
caggctccctgaccaccctgcct

SEQ ID NO: 1874875 - DNA, 11 bp, Homo sapiens
cagggcctctg

SEQ ID NO: 1874876 - DNA, 22 bp, Homo sapiens
cagggcctctggcttccctgcc

SEQ ID NO: 1874877 - DNA, 23 bp, Homo sapiens
cagggcctctggcttccctgccc

SEQ ID NO: 1874878 - DNA, 18 bp, Homo sapiens
caggggtgtcccagtccc

SEQ ID NO: 1874879 - DNA, 21 bp, Homo sapiens
caggggtgtcccagtcccagc

SEQ ID NO: 1874880 - DNA, 16 bp, Homo sapiens
caggtaatttaaattg

SEQ ID NO: 1874881 - DNA, 15 bp, Homo sapiens
caggtcatggagcag

SEQ ID NO: 1874882 - DNA, 22 bp, Homo sapiens
caggtctgattcccagaaatac

SEQ ID NO: 1874883 - DNA, 14 bp, Homo sapiens
cagtaaacactgtg

SEQ ID NO: 1874884 - DNA, 21 bp, Homo sapiens
cagtaaacactgtgtattgtt

SEQ ID NO: 1874885 - DNA, 11 bp, Homo sapiens
cagtattttcc

SEQ ID NO: 1874886 - DNA, 14 bp, Homo sapiens
cagtcaattacatg

SEQ ID NO: 1874887 - DNA, 17 bp, Homo sapiens
cagtcccagcctctggg

SEQ ID NO: 1874888 - DNA, 21 bp, Homo sapiens
cagtctgattataccatgtgt

SEQ ID NO: 1874889 - DNA, 16 bp, Homo sapiens
cagtgaaatcatatta

SEQ ID NO: 1874890 - DNA, 19 bp, Homo sapiens
cagtgagattacagaggaa

SEQ ID NO: 1874891 - DNA, 13 bp, Homo sapiens
cagtgagtgccat

SEQ ID NO: 1874892 - DNA, 12 bp, Homo sapiens
cactgccaccag

SEQ ID NO: 1874893 - DNA, 16 bp, Homo sapiens
cactgcggtgtctgca

SEQ ID NO: 1874894 - DNA, 17 bp, Homo sapiens
cactggcatcgcagctt

SEQ ID NO: 1874895 - DNA, 21 bp, Homo sapiens
cactgggaaccaagggccctc

SEQ ID NO: 1874896 - DNA, 13 bp, Homo sapiens
cactgggccctgg

SEQ ID NO: 1874897 - DNA, 15 bp, Homo sapiens
cactgggccctgggg

SEQ ID NO: 1874898 - DNA, 16 bp, Homo sapiens
cactgggccctggggc

SEQ ID NO: 1874899 - DNA, 17 bp, Homo sapiens
cactgtggcactgccac

SEQ ID NO: 1874900 - DNA, 17 bp, Homo sapiens
cactgttgaaaattatt

SEQ ID NO: 1874901 - DNA, 22 bp, Homo sapiens
cactgttggcacttataggtaa

SEQ ID NO: 1874902 - DNA, 12 bp, Homo sapiens
cacttacaagtg

SEQ ID NO: 1874903 - DNA, 20 bp, Homo sapiens
cacttctaagttgagtatat

SEQ ID NO: 1874904 - DNA, 22 bp, Homo sapiens
cacttgttcaacagtttctcaa

SEQ ID NO: 1874905 - DNA, 22 bp, Homo sapiens
cactttgaaggtaataaataca

SEQ ID NO: 1874906 - DNA, 14 bp, Homo sapiens
cacttttattttca

SEQ ID NO: 1874907 - DNA, 17 bp, Homo sapiens
cagaaaagggaagttgt

SEQ ID NO: 1874908 - DNA, 15 bp, Homo sapiens
cagaaattaaaatat

SEQ ID NO: 1874909 - DNA, 21 bp, Homo sapiens
cagaagaccacaaaaattgac

SEQ ID NO: 1874910 - DNA, 18 bp, Homo sapiens
cagaagttatatttttaa

SEQ ID NO: 1874911 - DNA, 16 bp, Homo sapiens
cagaagtttggcaata

SEQ ID NO: 1874912 - DNA, 16 bp, Homo sapiens
cagaatgcattaaaaa

SEQ ID NO: 1874913 - DNA, 15 bp, Homo sapiens
cagaatggagaaagt

SEQ ID NO: 1874914 - DNA, 21 bp, Homo sapiens
cagacaaagtaattcctctca

SEQ ID NO: 1874915 - DNA, 23 bp, Homo sapiens
cagacttagtttttataaaatgg

SEQ ID NO: 1874916 - DNA, 15 bp, Homo sapiens
cagacttgcggccac

SEQ ID NO: 1874917 - DNA, 17 bp, Homo sapiens
cagacttgcggccacag

SEQ ID NO: 1874918 - DNA, 22 bp, Homo sapiens
cagacttgcggccacagcacta

SEQ ID NO: 1874919 - DNA, 14 bp, Homo sapiens
cagagaaagaaaag

SEQ ID NO: 1874920 - DNA, 17 bp, Homo sapiens
cagagaaagaaaaggca

SEQ ID NO: 1874921 - DNA, 19 bp, Homo sapiens
cagagaaagaaaaggcaaa

SEQ ID NO: 1874922 - DNA, 20 bp, Homo sapiens
cagagcacaagaaggccagc

SEQ ID NO: 1874923 - DNA, 17 bp, Homo sapiens
cagagcttgtagccctg

SEQ ID NO: 1874924 - DNA, 21 bp, Homo sapiens
cagagcttgtagccctggatg

SEQ ID NO: 1874925 - DNA, 14 bp, Homo sapiens
cagagggactggac

SEQ ID NO: 1874926 - DNA, 21 bp, Homo sapiens
cagagggaggagtttttctta

SEQ ID NO: 1874927 - DNA, 12 bp, Homo sapiens
cagagtggcctg

SEQ ID NO: 1874928 - DNA, 21 bp, Homo sapiens
cagatgctgaattgagaataa

SEQ ID NO: 1874929 - DNA, 22 bp, Homo sapiens
cagatgctgaattgagaataag

SEQ ID NO: 1874930 - DNA, 14 bp, Homo sapiens
cagattacaataaa

SEQ ID NO: 1874931 - DNA, 19 bp, Homo sapiens
cagattacaataaatcctt

SEQ ID NO: 1874932 - DNA, 13 bp, Homo sapiens
cagatttgtataa

SEQ ID NO: 1874933 - DNA, 16 bp, Homo sapiens
cagattttctcctgtg

SEQ ID NO: 1874934 - DNA, 16 bp, Homo sapiens
cagcaaagccatattc

SEQ ID NO: 1874935 - DNA, 17 bp, Homo sapiens
cagcaaagccatattct

SEQ ID NO: 1874936 - DNA, 13 bp, Homo sapiens
cagcaatgccctg

SEQ ID NO: 1874937 - DNA, 23 bp, Homo sapiens
cagcaatgccctgccttgctgcc

SEQ ID NO: 1874938 - DNA, 16 bp, Homo sapiens
cagcacgcatgtccct

SEQ ID NO: 1874939 - DNA, 23 bp, Homo sapiens
cagcacgcatgtccctccaaggc

SEQ ID NO: 1874940 - DNA, 15 bp, Homo sapiens
cagcacgttttctgg

SEQ ID NO: 1874941 - DNA, 16 bp, Homo sapiens
cagcactagagtcacc

SEQ ID NO: 1874942 - DNA, 18 bp, Homo sapiens
cagcagcacgcatgtccc

SEQ ID NO: 1874943 - DNA, 14 bp, Homo sapiens
cagcagctgcctct

SEQ ID NO: 1874944 - DNA, 23 bp, Homo sapiens
cagcagttgaatgacaacagaag

SEQ ID NO: 1874945 - DNA, 21 bp, Homo sapiens
cagcatgacaaaaataacact

SEQ ID NO: 1874946 - DNA, 22 bp, Homo sapiens
cagcatgacaaaaataacactg

SEQ ID NO: 1874947 - DNA, 19 bp, Homo sapiens
cagccaaggaatgtgtcca

SEQ ID NO: 1874948 - DNA, 12 bp, Homo sapiens
cagcccactggg

SEQ ID NO: 1874949 - DNA, 17 bp, Homo sapiens
cagcccactgggccctg

SEQ ID NO: 1874950 - DNA, 20 bp, Homo sapiens
cagcccactgggccctgggg

SEQ ID NO: 1874951 - DNA, 22 bp, Homo sapiens
cagcccccaaagagctgtggct

SEQ ID NO: 1874952 - DNA, 13 bp, Homo sapiens
cagcccccactga

SEQ ID NO: 1874953 - DNA, 20 bp, Homo sapiens
cagccgtgcaggactctagc

SEQ ID NO: 1874954 - DNA, 19 bp, Homo sapiens
cagcctctgactcaccacg

SEQ ID NO: 1874955 - DNA, 15 bp, Homo sapiens
cagcctctggggcag

SEQ ID NO: 1874956 - DNA, 21 bp, Homo sapiens
cagcctctggggcagagcttg

SEQ ID NO: 1874957 - DNA, 15 bp, Homo sapiens
cagccttatgtgtta

SEQ ID NO: 1874958 - DNA, 18 bp, Homo sapiens
cagccttatgtgttacat

SEQ ID NO: 1874959 - DNA, 15 bp, Homo sapiens
cagctagaatttctg

SEQ ID NO: 1874960 - DNA, 13 bp, Homo sapiens
cagctggcactga

SEQ ID NO: 1874961 - DNA, 15 bp, Homo sapiens
cagctggcactgaca

SEQ ID NO: 1874962 - DNA, 16 bp, Homo sapiens
cagctggcactgacag

SEQ ID NO: 1874963 - DNA, 18 bp, Homo sapiens
cagctgtaacacagctga

SEQ ID NO: 1874964 - DNA, 20 bp, Homo sapiens
cagcttcctgtctgtttata

SEQ ID NO: 1874965 - DNA, 15 bp, Homo sapiens
cagctttacatgcaa

SEQ ID NO: 1874966 - DNA, 14 bp, Homo sapiens
cagctttttgtatt

SEQ ID NO: 1874967 - DNA, 12 bp, Homo sapiens
caggaaccctgg

SEQ ID NO: 1874968 - DNA, 13 bp, Homo sapiens
caggaatttaatt

SEQ ID NO: 1874969 - DNA, 17 bp, Homo sapiens
caggaatttaatttata

SEQ ID NO: 1874970 - DNA, 23 bp, Homo sapiens
caggaccactagctaagcaagcc

SEQ ID NO: 1874971 - DNA, 13 bp, Homo sapiens
caggaccttttga

SEQ ID NO: 1874972 - DNA, 18 bp, Homo sapiens
actacatgtggtttatag

SEQ ID NO: 1874973 - DNA, 21 bp, Homo sapiens
actagagtcacccccccaggc

SEQ ID NO: 1874974 - DNA, 23 bp, Homo sapiens
actagagtcacccccccaggcct

SEQ ID NO: 1874975 - DNA, 18 bp, Homo sapiens
actagctaagcaagccag

SEQ ID NO: 1874976 - DNA, 20 bp, Homo sapiens
actagctaagcaagccagga

SEQ ID NO: 1874977 - DNA, 19 bp, Homo sapiens
actataacatagaattgca

SEQ ID NO: 1874978 - DNA, 23 bp, Homo sapiens
actcaccacgatgacgcctctgg

SEQ ID NO: 1874979 - DNA, 16 bp, Homo sapiens
actcaggaaccctgga

SEQ ID NO: 1874980 - DNA, 19 bp, Homo sapiens
actcagtgaaatcatatta

SEQ ID NO: 1874981 - DNA, 20 bp, Homo sapiens
actcatgcaaactgctttat

SEQ ID NO: 1874982 - DNA, 22 bp, Homo sapiens
actcatgcaaactgctttattt

SEQ ID NO: 1874983 - DNA, 17 bp, Homo sapiens
actccagcacgttttct

SEQ ID NO: 1874984 - DNA, 18 bp, Homo sapiens
actcccccaggagcagct

SEQ ID NO: 1874985 - DNA, 10 bp, Homo sapiens
actcctgtgt

SEQ ID NO: 1874986 - DNA, 21 bp, Homo sapiens
actctaattagagaactggag

SEQ ID NO: 1874987 - DNA, 23 bp, Homo sapiens
actctgaataagcactttttaaa

SEQ ID NO: 1874988 - DNA, 14 bp, Homo sapiens
actctggactttct

SEQ ID NO: 1874989 - DNA, 21 bp, Homo sapiens
actctgttattgatcccttct

SEQ ID NO: 1874990 - DNA, 15 bp, Homo sapiens
actcttaaatcattt

SEQ ID NO: 1874991 - DNA, 15 bp, Homo sapiens
actctttaacttgta

SEQ ID NO: 1874992 - DNA, 19 bp, Homo sapiens
actctttaacttgtaataa

SEQ ID NO: 1874993 - DNA, 17 bp, Homo sapiens
actgaaacctcttcggt

SEQ ID NO: 1874994 - DNA, 13 bp, Homo sapiens
actgacagcctgg

SEQ ID NO: 1874995 - DNA, 16 bp, Homo sapiens
actgacagcctggggg

SEQ ID NO: 1874996 - DNA, 12 bp, Homo sapiens
actgacctgccc

SEQ ID NO: 1874997 - DNA, 13 bp, Homo sapiens
actgacctgccca

SEQ ID NO: 1874998 - DNA, 17 bp, Homo sapiens
actgagtccatgaaaat

SEQ ID NO: 1874999 - DNA, 20 bp, Homo sapiens
actgagtccatgaaaatacc

SEQ ID NO: 1875000 - DNA, 14 bp, Homo sapiens
actgatttttgtga

SEQ ID NO: 1875001 - DNA, 23 bp, Homo sapiens
actgccaccagcaatgccctgcc

SEQ ID NO: 1875002 - DNA, 17 bp, Homo sapiens
actgcgaggttgtttta

SEQ ID NO: 1875003 - DNA, 21 bp, Homo sapiens
actgcgaggttgttttaaagt

SEQ ID NO: 1875004 - DNA, 22 bp, Homo sapiens
actgcggtgtctgcagctcctg

SEQ ID NO: 1875005 - DNA, 17 bp, Homo sapiens
actgcttctctttgtgc

SEQ ID NO: 1875006 - DNA, 17 bp, Homo sapiens
actggacagccagggca

SEQ ID NO: 1875007 - DNA, 22 bp, Homo sapiens
actggacagccagggcagggct

SEQ ID NO: 1875008 - DNA, 15 bp, Homo sapiens
actggattattcagg

SEQ ID NO: 1875009 - DNA, 18 bp, Homo sapiens
actggcactgtggcactg

SEQ ID NO: 1875010 - DNA, 11 bp, Homo sapiens
actgggccctg

SEQ ID NO: 1875011 - DNA, 20 bp, Homo sapiens
actgggccctggggctgccc

SEQ ID NO: 1875012 - DNA, 21 bp, Homo sapiens
actgggccctggggctgccct

SEQ ID NO: 1875013 - DNA, 23 bp, Homo sapiens
actgggccctggggctgccctcg

SEQ ID NO: 1875014 - DNA, 17 bp, Homo sapiens
actgggccgggcccagg

SEQ ID NO: 1875015 - DNA, 12 bp, Homo sapiens
actggtttgttt

SEQ ID NO: 1875016 - DNA, 16 bp, Homo sapiens
actggtttgtttgctt

SEQ ID NO: 1875017 - DNA, 13 bp, Homo sapiens
actgtaaaagtta

SEQ ID NO: 1875018 - DNA, 15 bp, Homo sapiens
actgtaaaagttata

SEQ ID NO: 1875019 - DNA, 21 bp, Homo sapiens
actgtaaaagttataataact

SEQ ID NO: 1875020 - DNA, 19 bp, Homo sapiens
actgtaagcagattacaat

SEQ ID NO: 1875021 - DNA, 22 bp, Homo sapiens
ggagtgaaacagagaaagaaaa

SEQ ID NO: 1875022 - DNA, 17 bp, Homo sapiens
ggagtttttcttacata

SEQ ID NO: 1875023 - DNA, 14 bp, Homo sapiens
ggataacctatatg

SEQ ID NO: 1875024 - DNA, 13 bp, Homo sapiens
ggatagcattttt

SEQ ID NO: 1875025 - DNA, 15 bp, Homo sapiens
ggatcttttgtaaat

SEQ ID NO: 1875026 - DNA, 15 bp, Homo sapiens
ggatgaaaagccata

SEQ ID NO: 1875027 - DNA, 16 bp, Homo sapiens
ggatgaaaagccatat

SEQ ID NO: 1875028 - DNA, 22 bp, Homo sapiens
ggatgacggccaggctccctga

SEQ ID NO: 1875029 - DNA, 13 bp, Homo sapiens
ggatggcctctgg

SEQ ID NO: 1875030 - DNA, 14 bp, Homo sapiens
ggatggcctctggg

SEQ ID NO: 1875031 - DNA, 18 bp, Homo sapiens
ggcaaccgtggggaggcc

SEQ ID NO: 1875032 - DNA, 14 bp, Homo sapiens
ggcactagaagatg

SEQ ID NO: 1875033 - DNA, 15 bp, Homo sapiens
ggcactgacagcctg

SEQ ID NO: 1875034 - DNA, 17 bp, Homo sapiens
ggcactgacagcctggg

SEQ ID NO: 1875035 - DNA, 19 bp, Homo sapiens
ggcactgacagcctggggg

SEQ ID NO: 1875036 - DNA, 19 bp, Homo sapiens
ggcactgccaccagcaatg

SEQ ID NO: 1875037 - DNA, 12 bp, Homo sapiens
ggcactgtggca

SEQ ID NO: 1875038 - DNA, 15 bp, Homo sapiens
ggcactgtggcactg

SEQ ID NO: 1875039 - DNA, 20 bp, Homo sapiens
ggcactgtggcactgccacc

SEQ ID NO: 1875040 - DNA, 19 bp, Homo sapiens
ggcagagcttgtagccctg

SEQ ID NO: 1875041 - DNA, 22 bp, Homo sapiens
ggcagagcttgtagccctggat

SEQ ID NO: 1875042 - DNA, 19 bp, Homo sapiens
ggcagagtggcctgtgagc

SEQ ID NO: 1875043 - DNA, 21 bp, Homo sapiens
ggcagagtggcctgtgagcaa

SEQ ID NO: 1875044 - DNA, 13 bp, Homo sapiens
ggcagccaaggaa

SEQ ID NO: 1875045 - DNA, 22 bp, Homo sapiens
ggcaggaccactagctaagcaa

SEQ ID NO: 1875046 - DNA, 19 bp, Homo sapiens
ggcaggtcatggagcagcc

SEQ ID NO: 1875047 - DNA, 20 bp, Homo sapiens
ggcaggtcatggagcagccc

SEQ ID NO: 1875048 - DNA, 21 bp, Homo sapiens
ggccaaattatttgtgtaata

SEQ ID NO: 1875049 - DNA, 13 bp, Homo sapiens
ggccaaggactcc

SEQ ID NO: 1875050 - DNA, 21 bp, Homo sapiens
ggccagcccactgggccctgg

SEQ ID NO: 1875051 - DNA, 22 bp, Homo sapiens
ggccagcccactgggccctggg

SEQ ID NO: 1875052 - DNA, 19 bp, Homo sapiens
ggccagcttcccctcactt

SEQ ID NO: 1875053 - DNA, 16 bp, Homo sapiens
ggccaggccagcttcc

SEQ ID NO: 1875054 - DNA, 23 bp, Homo sapiens
ggccaggctccctgaccaccctg

SEQ ID NO: 1875055 - DNA, 17 bp, Homo sapiens
ggccatttgctgccctg

SEQ ID NO: 1875056 - DNA, 18 bp, Homo sapiens
ggccatttgctgccctgg

SEQ ID NO: 1875057 - DNA, 20 bp, Homo sapiens
ggccatttgctgccctgggg

SEQ ID NO: 1875058 - DNA, 15 bp, Homo sapiens
ggcccagggcctctg

SEQ ID NO: 1875059 - DNA, 16 bp, Homo sapiens
ggcccagggcctctgg

SEQ ID NO: 1875060 - DNA, 17 bp, Homo sapiens
ggcccagggcctctggc

SEQ ID NO: 1875061 - DNA, 21 bp, Homo sapiens
ggccctcactcaggaaccctg

SEQ ID NO: 1875062 - DNA, 18 bp, Homo sapiens
ggccctggggctgccctc

SEQ ID NO: 1875063 - DNA, 13 bp, Homo sapiens
ggccgcagccccc

SEQ ID NO: 1875064 - DNA, 16 bp, Homo sapiens
ggccgctctccccctg

SEQ ID NO: 1875065 - DNA, 23 bp, Homo sapiens
ggccgctctccccctgcagccgt

SEQ ID NO: 1875066 - DNA, 13 bp, Homo sapiens
ggccgggcccagg

SEQ ID NO: 1875067 - DNA, 14 bp, Homo sapiens
ggcctccagaacct

SEQ ID NO: 1875068 - DNA, 12 bp, Homo sapiens
ggcctctggggc

SEQ ID NO: 1875069 - DNA, 18 bp, Homo sapiens
ggcctctggggcaggacc

SEQ ID NO: 1875070 - DNA, 23 bp, Homo sapiens
ggcgctggacacctacagcagca

SEQ ID NO: 1875071 - DNA, 20 bp, Homo sapiens
ggctatctatacctgccttt

SEQ ID NO: 1875072 - DNA, 17 bp, Homo sapiens
ggctggagggggcagag

SEQ ID NO: 1875073 - DNA, 23 bp, Homo sapiens
ggctggggggatgacggccaggc

SEQ ID NO: 1875074 - DNA, 20 bp, Homo sapiens
ggctgtgaggcgggtggctg

SEQ ID NO: 1875075 - DNA, 15 bp, Homo sapiens
ggcttccctgcccaa

SEQ ID NO: 1875076 - DNA, 23 bp, Homo sapiens
ggcttccctgcccaatcctccct

SEQ ID NO: 1875077 - DNA, 14 bp, Homo sapiens
ggcttcttaaaaac

SEQ ID NO: 1875078 - DNA, 17 bp, Homo sapiens
ggcttcttaaaaactgt

SEQ ID NO: 1875079 - DNA, 16 bp, Homo sapiens
gggactggacagccag

SEQ ID NO: 1875080 - DNA, 14 bp, Homo sapiens
gggagaaatgccag

SEQ ID NO: 1875081 - DNA, 20 bp, Homo sapiens
gggaggccatttgctgccct

SEQ ID NO: 1875082 - DNA, 20 bp, Homo sapiens
gggagtgaaacagagaaaga

SEQ ID NO: 1875083 - DNA, 19 bp, Homo sapiens
gggcaactcgtgacagcct

SEQ ID NO: 1875084 - DNA, 20 bp, Homo sapiens
gggcagagcttgtagccctg

SEQ ID NO: 1875085 - DNA, 20 bp, Homo sapiens
gggcagagtggcctgtgagc

SEQ ID NO: 1875086 - DNA, 16 bp, Homo sapiens
gggcagtgagtgccat

SEQ ID NO: 1875087 - DNA, 20 bp, Homo sapiens
gggcagtgagtgccatgctt

SEQ ID NO: 1875088 - DNA, 12 bp, Homo sapiens
gggcatcatggg

SEQ ID NO: 1875089 - DNA, 14 bp, Homo sapiens
gggcatcatgggca

SEQ ID NO: 1875090 - DNA, 23 bp, Homo sapiens
gggcatgtttgtctgtgtgctgt

SEQ ID NO: 1875091 - DNA, 17 bp, Homo sapiens
gggccaagacttggcaa

SEQ ID NO: 1875092 - DNA, 13 bp, Homo sapiens
gggccaaggactc

SEQ ID NO: 1875093 - DNA, 17 bp, Homo sapiens
gggcccagggcctctgg

SEQ ID NO: 1875094 - DNA, 23 bp, Homo sapiens
gggccctcactcaggaaccctgg

SEQ ID NO: 1875095 - DNA, 21 bp, Homo sapiens
gggccgctctccccctgcagc

SEQ ID NO: 1875096 - DNA, 16 bp, Homo sapiens
gggccgggcccagggc

SEQ ID NO: 1875097 - DNA, 20 bp, Homo sapiens
gggcctctggcttccctgcc

SEQ ID NO: 1875098 - DNA, 21 bp, Homo sapiens
gggcctctggcttccctgccc

SEQ ID NO: 1875099 - DNA, 22 bp, Homo sapiens
gggcctctggcttccctgccca

SEQ ID NO: 1875100 - DNA, 16 bp, Homo sapiens
gggcgcttcccacctg

SEQ ID NO: 1875101 - DNA, 17 bp, Homo sapiens
gggcgcttcccacctgc

SEQ ID NO: 1875102 - DNA, 14 bp, Homo sapiens
ggggagtgaaacag

SEQ ID NO: 1875103 - DNA, 22 bp, Homo sapiens
ggggcagagtggcctgtgagca

SEQ ID NO: 1875104 - DNA, 13 bp, Homo sapiens
ggggcgctggaca

SEQ ID NO: 1875105 - DNA, 20 bp, Homo sapiens
ggggctggagggggcagagt

SEQ ID NO: 1875106 - DNA, 21 bp, Homo sapiens
ggggctggagggggcagagtg

SEQ ID NO: 1875107 - DNA, 20 bp, Homo sapiens
gggggccgctctccccctgc

SEQ ID NO: 1875108 - DNA, 18 bp, Homo sapiens
gggtataatgtgtctgtg

SEQ ID NO: 1875109 - DNA, 15 bp, Homo sapiens
ggtaaatttttgaaa

SEQ ID NO: 1875110 - DNA, 20 bp, Homo sapiens
ggtaaatttttgaaaaatat

SEQ ID NO: 1875111 - DNA, 23 bp, Homo sapiens
ggtaacgtgattgattcagtatc

SEQ ID NO: 1875112 - DNA, 23 bp, Homo sapiens
ggtaagaaagccaccttgttaca

SEQ ID NO: 1875113 - DNA, 17 bp, Homo sapiens
ggtaattattttgagtg

SEQ ID NO: 1875114 - DNA, 20 bp, Homo sapiens
ggtaatttaaattggtcatg

SEQ ID NO: 1875115 - DNA, 20 bp, Homo sapiens
ggtaatttttttttgtaaag

SEQ ID NO: 1875116 - DNA, 19 bp, Homo sapiens
ggtacagttcataattcac

SEQ ID NO: 1875117 - DNA, 13 bp, Homo sapiens
ggtcatggagcag

SEQ ID NO: 1875118 - DNA, 16 bp, Homo sapiens
ggtctcatgcccactc

SEQ ID NO: 1875119 - DNA, 13 bp, Homo sapiens
ggtcttctgcatc

SEQ ID NO: 1875120 - DNA, 18 bp, Homo sapiens
ggtgtcccagtcccagcc

SEQ ID NO: 1875121 - DNA, 16 bp, Homo sapiens
ggtgtggaccggccgc

SEQ ID NO: 1875122 - DNA, 18 bp, Homo sapiens
ggtgtggaccggccgcag

SEQ ID NO: 1875123 - DNA, 19 bp, Homo sapiens
ggtgtggaccggccgcagc

SEQ ID NO: 1875124 - DNA, 15 bp, Homo sapiens
ggttaaatcatttgg

SEQ ID NO: 1875125 - DNA, 17 bp, Homo sapiens
ggttaatctttcctgat

SEQ ID NO: 1875126 - DNA, 10 bp, Homo sapiens
ggttccaaac

SEQ ID NO: 1875127 - DNA, 16 bp, Homo sapiens
ggttccaaaccagttt

SEQ ID NO: 1875128 - DNA, 17 bp, Homo sapiens
ggttctataataagttt

SEQ ID NO: 1875129 - DNA, 17 bp, Homo sapiens
ggttctgcactcctgga

SEQ ID NO: 1875130 - DNA, 21 bp, Homo sapiens
ggtttggtacagttcataatt

SEQ ID NO: 1875131 - DNA, 13 bp, Homo sapiens
ggtttgtttgctt

SEQ ID NO: 1875132 - DNA, 21 bp, Homo sapiens
ggtttgtttgcttaatttcct

SEQ ID NO: 1875133 - DNA, 20 bp, Homo sapiens
ggttttagatttttaaaagg

SEQ ID NO: 1875134 - DNA, 12 bp, Homo sapiens
gtaaaagttata

SEQ ID NO: 1875135 - DNA, 20 bp, Homo sapiens
gtggcctgtgagcaagagcc

SEQ ID NO: 1875136 - DNA, 23 bp, Homo sapiens
gtggcctgtgagcaagagccagg

SEQ ID NO: 1875137 - DNA, 15 bp, Homo sapiens
gtggctcttgggaca

SEQ ID NO: 1875138 - DNA, 12 bp, Homo sapiens
gtgtatcattaa

SEQ ID NO: 1875139 - DNA, 22 bp, Homo sapiens
gtgtatcattaaaatatatgtt

SEQ ID NO: 1875140 - DNA, 22 bp, Homo sapiens
gtgtattgagtcttaactgtat

SEQ ID NO: 1875141 - DNA, 17 bp, Homo sapiens
gtgtcatcatcagactt

SEQ ID NO: 1875142 - DNA, 12 bp, Homo sapiens
gtgtctgcagct

SEQ ID NO: 1875143 - DNA, 14 bp, Homo sapiens
tataaaaaggaaat

SEQ ID NO: 1875144 - DNA, 18 bp, Homo sapiens
tataaaaggatgttacaa

SEQ ID NO: 1875145 - DNA, 19 bp, Homo sapiens
tataaaaggatgttacaag

SEQ ID NO: 1875146 - DNA, 20 bp, Homo sapiens
tataaaaggatgttacaagt

SEQ ID NO: 1875147 - DNA, 22 bp, Homo sapiens
tataaaaggatgttacaagttt

SEQ ID NO: 1875148 - DNA, 12 bp, Homo sapiens
tataaacactgt

SEQ ID NO: 1875149 - DNA, 17 bp, Homo sapiens
tataaattatgaaggac

SEQ ID NO: 1875150 - DNA, 15 bp, Homo sapiens
tataacttcttaaaa

SEQ ID NO: 1875151 - DNA, 19 bp, Homo sapiens
tataaggatcttttgtaaa

SEQ ID NO: 1875152 - DNA, 15 bp, Homo sapiens
tataaggtaatgtag

SEQ ID NO: 1875153 - DNA, 14 bp, Homo sapiens
tataataactgaac

SEQ ID NO: 1875154 - DNA, 21 bp, Homo sapiens
tataataactgaactgtttgg

SEQ ID NO: 1875155 - DNA, 18 bp, Homo sapiens
tataatcttggcttctta

SEQ ID NO: 1875156 - DNA, 19 bp, Homo sapiens
tataatcttggcttcttaa

SEQ ID NO: 1875157 - DNA, 21 bp, Homo sapiens
tataatcttggcttcttaaaa

SEQ ID NO: 1875158 - DNA, 16 bp, Homo sapiens
tataatgtgtctgtgt

SEQ ID NO: 1875159 - DNA, 18 bp, Homo sapiens
tatacagattcctgttgt

SEQ ID NO: 1875160 - DNA, 17 bp, Homo sapiens
tatacataaacagtttt

SEQ ID NO: 1875161 - DNA, 20 bp, Homo sapiens
tatacataaacagttttgga

SEQ ID NO: 1875162 - DNA, 21 bp, Homo sapiens
tataccatgtgtgctaatata

SEQ ID NO: 1875163 - DNA, 14 bp, Homo sapiens
tatactgtaaaagt

SEQ ID NO: 1875164 - DNA, 20 bp, Homo sapiens
tatactttttttgttataga

SEQ ID NO: 1875165 - DNA, 15 bp, Homo sapiens
tatagattaaatcat

SEQ ID NO: 1875166 - DNA, 16 bp, Homo sapiens
tatagattgtcttaat

SEQ ID NO: 1875167 - DNA, 14 bp, Homo sapiens
tatagctattactg

SEQ ID NO: 1875168 - DNA, 11 bp, Homo sapiens
tataggcagat

SEQ ID NO: 1875169 - DNA, 15 bp, Homo sapiens
tataggcagatcttt

SEQ ID NO: 1875170 - DNA, 14 bp, Homo sapiens
tataggtaacgtga

SEQ ID NO: 1875171 - DNA, 21 bp, Homo sapiens
tatagtgtaaaataagaatga

SEQ ID NO: 1875172 - DNA, 19 bp, Homo sapiens
tatagttaatctataacta

SEQ ID NO: 1875173 - DNA, 18 bp, Homo sapiens
tatagttaggatagcatt

SEQ ID NO: 1875174 - DNA, 22 bp, Homo sapiens
tatagtttcagatatatatcat

SEQ ID NO: 1875175 - DNA, 18 bp, Homo sapiens
tatagtttgtacatgcat

SEQ ID NO: 1875176 - DNA, 16 bp, Homo sapiens
tatataatcatgctca

SEQ ID NO: 1875177 - DNA, 15 bp, Homo sapiens
tatataccgtggggg

SEQ ID NO: 1875178 - DNA, 17 bp, Homo sapiens
tatataggttgtgcaaa

SEQ ID NO: 1875179 - DNA, 19 bp, Homo sapiens
tatatatctgcttcagtgg

SEQ ID NO: 1875180 - DNA, 13 bp, Homo sapiens
tatatcagaaaag

SEQ ID NO: 1875181 - DNA, 14 bp, Homo sapiens
tatatcccagaaat

SEQ ID NO: 1875182 - DNA, 19 bp, Homo sapiens
tatatctcaaattgtaatt

SEQ ID NO: 1875183 - DNA, 15 bp, Homo sapiens
tatatctgtttgtat

SEQ ID NO: 1875184 - DNA, 18 bp, Homo sapiens
tatatctgtttgtatatt

SEQ ID NO: 1875185 - DNA, 15 bp, Homo sapiens
tatatctttatgcaa

SEQ ID NO: 1875186 - DNA, 16 bp, Homo sapiens
tatatctttatgcaaa

SEQ ID NO: 1875187 - DNA, 20 bp, Homo sapiens
tatatctttatgcaaaaaca

SEQ ID NO: 1875188 - DNA, 15 bp, Homo sapiens
tatatgatttatagt

SEQ ID NO: 1875189 - DNA, 12 bp, Homo sapiens
tatattaaatga

SEQ ID NO: 1875190 - DNA, 16 bp, Homo sapiens
tatattccaaggaaaa

SEQ ID NO: 1875191 - DNA, 19 bp, Homo sapiens
tatattcctcttgcatttc

SEQ ID NO: 1875192 - DNA, 12 bp, Homo sapiens
tatatttgcaaa

SEQ ID NO: 1875193 - DNA, 18 bp, Homo sapiens
tatatttgggagtgactg

SEQ ID NO: 1875194 - DNA, 12 bp, Homo sapiens
tatcattaaaat

SEQ ID NO: 1875195 - DNA, 18 bp, Homo sapiens
tatcattaaaatatatgt

SEQ ID NO: 1875196 - DNA, 22 bp, Homo sapiens
tatcattaaaatatatgttctg

SEQ ID NO: 1875197 - DNA, 13 bp, Homo sapiens
tatcatttttgta

SEQ ID NO: 1875198 - DNA, 21 bp, Homo sapiens
tatcatttttgtataaaaagg

SEQ ID NO: 1875199 - DNA, 22 bp, Homo sapiens
tatcatttttgtataaaaagga

SEQ ID NO: 1875200 - DNA, 15 bp, Homo sapiens
tatccagaatggaat

SEQ ID NO: 1875201 - DNA, 18 bp, Homo sapiens
tatccagctagtgccaaa

SEQ ID NO: 1875202 - DNA, 19 bp, Homo sapiens
tatccagctagtgccaaat

SEQ ID NO: 1875203 - DNA, 19 bp, Homo sapiens
tatcctacaacaagagttt

SEQ ID NO: 1875204 - DNA, 21 bp, Homo sapiens
tatcctgctgaaagtcctgct

SEQ ID NO: 1875205 - DNA, 22 bp, Homo sapiens
tatcctgctgaaagtcctgctt

SEQ ID NO: 1875206 - DNA, 13 bp, Homo sapiens
tatctgtttgtat

SEQ ID NO: 1875207 - DNA, 17 bp, Homo sapiens
tatctgtttgtatattt

SEQ ID NO: 1875208 - DNA, 21 bp, Homo sapiens
tatcttgttattaatgtttct

SEQ ID NO: 1875209 - DNA, 14 bp, Homo sapiens
tatctttatgcaaa

SEQ ID NO: 1875210 - DNA, 15 bp, Homo sapiens
tatctttatgcaaaa

SEQ ID NO: 1875211 - DNA, 18 bp, Homo sapiens
tatctttatgcaaaaaca

SEQ ID NO: 1875212 - DNA, 16 bp, Homo sapiens
tatctttgtctaaaca

SEQ ID NO: 1875213 - DNA, 15 bp, Homo sapiens
tatgagactgtgttt

SEQ ID NO: 1875214 - DNA, 13 bp, Homo sapiens
tatgagatttact

SEQ ID NO: 1875215 - DNA, 18 bp, Homo sapiens
tatgattggttcagtttt

SEQ ID NO: 1875216 - DNA, 15 bp, Homo sapiens
tatgatttatagttt

SEQ ID NO: 1875217 - DNA, 21 bp, Homo sapiens
tatgcaaaaacatatgtctgt

SEQ ID NO: 1875218 - DNA, 20 bp, Homo sapiens
tatgcatggaaacctgaaaa

SEQ ID NO: 1875219 - DNA, 21 bp, Homo sapiens
tatgccgtgtagtttctggta

SEQ ID NO: 1875220 - DNA, 23 bp, Homo sapiens
tatgctgtatttctttgtagaat

SEQ ID NO: 1875221 - DNA, 17 bp, Homo sapiens
tatggaacttctaatat

SEQ ID NO: 1875222 - DNA, 17 bp, Homo sapiens
tatggagactttgctgt

SEQ ID NO: 1875223 - DNA, 15 bp, Homo sapiens
tatgtaaacaggaga

SEQ ID NO: 1875224 - DNA, 17 bp, Homo sapiens
tatgtaaagtatgtaaa

SEQ ID NO: 1875225 - DNA, 19 bp, Homo sapiens
tatgtaaagtatgtaaaca

SEQ ID NO: 1875226 - DNA, 20 bp, Homo sapiens
tatgtaaagtatgtaaacag

SEQ ID NO: 1875227 - DNA, 19 bp, Homo sapiens
tatgtacctctagctgttc

SEQ ID NO: 1875228 - DNA, 23 bp, Homo sapiens
tatgtataaattatgaaggacct

SEQ ID NO: 1875229 - DNA, 18 bp, Homo sapiens
tatgtatataatcatgct

SEQ ID NO: 1875230 - DNA, 19 bp, Homo sapiens
tatgtgagaaatcagaatt

SEQ ID NO: 1875231 - DNA, 23 bp, Homo sapiens
tatgttctgcaagaattaaaact

SEQ ID NO: 1875232 - DNA, 19 bp, Homo sapiens
tatgtttgtacaagattgt

SEQ ID NO: 1875233 - DNA, 21 bp, Homo sapiens
tattaaaaaaacacaaaaaaa

SEQ ID NO: 1875234 - DNA, 20 bp, Homo sapiens
tattaaaaatatggaacttc

SEQ ID NO: 1875235 - DNA, 18 bp, Homo sapiens
tattaaaatgattgtaaa

SEQ ID NO: 1875236 - DNA, 20 bp, Homo sapiens
tattaaaatgattgtaaaat

SEQ ID NO: 1875237 - DNA, 22 bp, Homo sapiens
tattaaaatgattgtaaaatag

SEQ ID NO: 1875238 - DNA, 18 bp, Homo sapiens
tattactgtctggtttta

SEQ ID NO: 1875239 - DNA, 18 bp, Homo sapiens
tattataattgttgatat

SEQ ID NO: 1875240 - DNA, 16 bp, Homo sapiens
tattattaatgctttg

SEQ ID NO: 1875241 - DNA, 12 bp, Homo sapiens
tattatttgata

SEQ ID NO: 1875242 - DNA, 13 bp, Homo sapiens
tattatttgatat

SEQ ID NO: 1875243 - DNA, 16 bp, Homo sapiens
tattatttgatatctg

SEQ ID NO: 1875244 - DNA, 12 bp, Homo sapiens
tattcagaaatt

SEQ ID NO: 1875245 - DNA, 13 bp, Homo sapiens
tattcagaaatta

SEQ ID NO: 1875246 - DNA, 20 bp, Homo sapiens
tattcagaaattaaaatatt

SEQ ID NO: 1875247 - DNA, 21 bp, Homo sapiens
tattcagaaattaaaatatta

SEQ ID NO: 1875248 - DNA, 20 bp, Homo sapiens
tattcagctagaatttctgg

SEQ ID NO: 1875249 - DNA, 19 bp, Homo sapiens
tattccaaggaaaattgaa

SEQ ID NO: 1875250 - DNA, 21 bp, Homo sapiens
tattgagtcttaactgtattt

SEQ ID NO: 1875251 - DNA, 23 bp, Homo sapiens
tattgagtcttaactgtatttca

SEQ ID NO: 1875252 - DNA, 18 bp, Homo sapiens
tattgatcccttctcctg

SEQ ID NO: 1875253 - DNA, 23 bp, Homo sapiens
tattgatcccttctcctgccctt

SEQ ID NO: 1875254 - DNA, 11 bp, Homo sapiens
tattgctaaaa

SEQ ID NO: 1875255 - DNA, 13 bp, Homo sapiens
tattgctaaaagt

SEQ ID NO: 1875256 - DNA, 16 bp, Homo sapiens
tattgctaaaagtgca

SEQ ID NO: 1875257 - DNA, 11 bp, Homo sapiens
tattgctctta

SEQ ID NO: 1875258 - DNA, 15 bp, Homo sapiens
tattgctcttaaaaa

SEQ ID NO: 1875259 - DNA, 22 bp, Homo sapiens
tattgctcttaaaaatcttggt

SEQ ID NO: 1875260 - DNA, 17 bp, Homo sapiens
tattggcagccaaggaa

SEQ ID NO: 1875261 - DNA, 14 bp, Homo sapiens
taaagaaacactaa

SEQ ID NO: 1875262 - DNA, 16 bp, Homo sapiens
taaagaaacactaaat

SEQ ID NO: 1875263 - DNA, 17 bp, Homo sapiens
taaagaaacactaaatt

SEQ ID NO: 1875264 - DNA, 17 bp, Homo sapiens
taaagaaagtcgaatta

SEQ ID NO: 1875265 - DNA, 17 bp, Homo sapiens
taaagataagtctacat

SEQ ID NO: 1875266 - DNA, 20 bp, Homo sapiens
taaagattagggaaaatgga

SEQ ID NO: 1875267 - DNA, 23 bp, Homo sapiens
taaagattagggaaaatggatat

SEQ ID NO: 1875268 - DNA, 15 bp, Homo sapiens
taaagccttaagcac

SEQ ID NO: 1875269 - DNA, 22 bp, Homo sapiens
taaagcttgatttgatctttgt

SEQ ID NO: 1875270 - DNA, 12 bp, Homo sapiens
taaagctttatc

SEQ ID NO: 1875271 - DNA, 17 bp, Homo sapiens
taaagctttatctttgt

SEQ ID NO: 1875272 - DNA, 19 bp, Homo sapiens
taaaggcaccatctaatag

SEQ ID NO: 1875273 - DNA, 20 bp, Homo sapiens
tcattaaaatatatgttctg

SEQ ID NO: 1875274 - DNA, 17 bp, Homo sapiens
tcattaaactgattcca

SEQ ID NO: 1875275 - DNA, 16 bp, Homo sapiens
tcattatcttcatgtt

SEQ ID NO: 1875276 - DNA, 13 bp, Homo sapiens
tcatttgcttttt

SEQ ID NO: 1875277 - DNA, 17 bp, Homo sapiens
tcatttggcttgctgtt

SEQ ID NO: 1875278 - DNA, 19 bp, Homo sapiens
tcatttggcttgctgttta

SEQ ID NO: 1875279 - DNA, 13 bp, Homo sapiens
tcatttggttaaa

SEQ ID NO: 1875280 - DNA, 16 bp, Homo sapiens
tcatttggttaaatca

SEQ ID NO: 1875281 - DNA, 12 bp, Homo sapiens
tcatttttgtat

SEQ ID NO: 1875282 - DNA, 13 bp, Homo sapiens
tcatttttgtata

SEQ ID NO: 1875283 - DNA, 14 bp, Homo sapiens
tcatttttgtataa

SEQ ID NO: 1875284 - DNA, 23 bp, Homo sapiens
tcatttttgtataaaaaggaaat

SEQ ID NO: 1875285 - DNA, 22 bp, Homo sapiens
tccaaaataatctatattaaat

SEQ ID NO: 1875286 - DNA, 17 bp, Homo sapiens
tccaaattattaattgt

SEQ ID NO: 1875287 - DNA, 14 bp, Homo sapiens
tccaaggaaaattg

SEQ ID NO: 1875288 - DNA, 22 bp, Homo sapiens
tccaaggctgtcttctcccaga

SEQ ID NO: 1875289 - DNA, 20 bp, Homo sapiens
tccaattctgaaatactttt

SEQ ID NO: 1875290 - DNA, 15 bp, Homo sapiens
tccagagggactgga

SEQ ID NO: 1875291 - DNA, 23 bp, Homo sapiens
tccagagggactggacagccagg

SEQ ID NO: 1875292 - DNA, 17 bp, Homo sapiens
tccagcacgttttctgg

SEQ ID NO: 1875293 - DNA, 20 bp, Homo sapiens
tccagccttatgtgttacat

SEQ ID NO: 1875294 - DNA, 13 bp, Homo sapiens
tccagtattcttg

SEQ ID NO: 1875295 - DNA, 15 bp, Homo sapiens
tccatgaaaatacca

SEQ ID NO: 1875296 - DNA, 16 bp, Homo sapiens
tccatgaaaataccat

SEQ ID NO: 1875297 - DNA, 17 bp, Homo sapiens
tggcttcttaaaaactg

SEQ ID NO: 1875298 - DNA, 12 bp, Homo sapiens
tgggaaaaagag

SEQ ID NO: 1875299 - DNA, 13 bp, Homo sapiens
tgggaaaaagaga

SEQ ID NO: 1875300 - DNA, 17 bp, Homo sapiens
tgggaaaaagagactct

SEQ ID NO: 1875301 - DNA, 14 bp, Homo sapiens
tgggccaaggactc

SEQ ID NO: 1875302 - DNA, 12 bp, Homo sapiens
tgggccctgggg

SEQ ID NO: 1875303 - DNA, 18 bp, Homo sapiens
tgggccgggcccagggcc

SEQ ID NO: 1875304 - DNA, 15 bp, Homo sapiens
tggggaaactaacaa

SEQ ID NO: 1875305 - DNA, 20 bp, Homo sapiens
tggggaagaggttttattta

SEQ ID NO: 1875306 - DNA, 23 bp, Homo sapiens
tggggaagaggttttatttacat

SEQ ID NO: 1875307 - DNA, 13 bp, Homo sapiens
tggggaggccatt

SEQ ID NO: 1875308 - DNA, 23 bp, Homo sapiens
tggggaggccatttgctgccctg

SEQ ID NO: 1875309 - DNA, 11 bp, Homo sapiens
tggggcagagc

SEQ ID NO: 1875310 - DNA, 17 bp, Homo sapiens
tggggctgccctcggca

SEQ ID NO: 1875311 - DNA, 22 bp, Homo sapiens
tgggtaagaaagccaccttgtt

SEQ ID NO: 1875312 - DNA, 16 bp, Homo sapiens
tgggttggtgcttcta

SEQ ID NO: 1875313 - DNA, 19 bp, Homo sapiens
tggtaaatttttgaaaaat

SEQ ID NO: 1875314 - DNA, 23 bp, Homo sapiens
tggtaaatttttgaaaaatattg

SEQ ID NO: 1875315 - DNA, 22 bp, Homo sapiens
tggtagggtataatgtgtctgt

SEQ ID NO: 1875316 - DNA, 17 bp, Homo sapiens
tggtctgcatcagcttt

SEQ ID NO: 1875317 - DNA, 17 bp, Homo sapiens
tggttaatctttcctga

SEQ ID NO: 1875318 - DNA, 15 bp, Homo sapiens
tggttcctcacatat

SEQ ID NO: 1875319 - DNA, 21 bp, Homo sapiens
tggtttatagagggccaagac

SEQ ID NO: 1875320 - DNA, 18 bp, Homo sapiens
tggtttgatttctagtat

SEQ ID NO: 1875321 - DNA, 16 bp, Homo sapiens
tggtttgcacataaaa

SEQ ID NO: 1875322 - DNA, 19 bp, Homo sapiens
tggtttgcacataaaacgt

SEQ ID NO: 1875323 - DNA, 20 bp, Homo sapiens
tgtaaaagttataataactg

SEQ ID NO: 1875324 - DNA, 14 bp, Homo sapiens
tgtaaaatagcttg

SEQ ID NO: 1875325 - DNA, 17 bp, Homo sapiens
tgtaaaatagcttgtat

SEQ ID NO: 1875326 - DNA, 20 bp, Homo sapiens
tgtaaaatagcttgtatagt

SEQ ID NO: 1875327 - DNA, 16 bp, Homo sapiens
tgtaaactcaaaactt

SEQ ID NO: 1875328 - DNA, 21 bp, Homo sapiens
tgtaaactcaaaacttaacat

SEQ ID NO: 1875329 - DNA, 17 bp, Homo sapiens
tgtaaatgagacacata

SEQ ID NO: 1875330 - DNA, 21 bp, Homo sapiens
tgtaacacagctgagagactt

SEQ ID NO: 1875331 - DNA, 17 bp, Homo sapiens
tgtaactatgttttatc

SEQ ID NO: 1875332 - DNA, 12 bp, Homo sapiens
tgtaataacaga

SEQ ID NO: 1875333 - DNA, 14 bp, Homo sapiens
tgtaatcaacatgg

SEQ ID NO: 1875334 - DNA, 20 bp, Homo sapiens
tgtaatctaagtatatgtga

SEQ ID NO: 1875335 - DNA, 21 bp, Homo sapiens
tgtaatctaagtatatgtgag

SEQ ID NO: 1875336 - DNA, 20 bp, Homo sapiens
tgtaatgtaggcacttttat

SEQ ID NO: 1875337 - DNA, 21 bp, Homo sapiens
tgtaatgtaggcacttttatt

SEQ ID NO: 1875338 - DNA, 14 bp, Homo sapiens
tgtacatgcattca

SEQ ID NO: 1875339 - DNA, 19 bp, Homo sapiens
tgtacttaaatgagttact

SEQ ID NO: 1875340 - DNA, 21 bp, Homo sapiens
tgtagaataaatggtttctca

SEQ ID NO: 1875341 - DNA, 11 bp, Homo sapiens
tgtagccctgg

SEQ ID NO: 1875342 - DNA, 21 bp, Homo sapiens
tgtaggcacttttattttcat

SEQ ID NO: 1875343 - DNA, 17 bp, Homo sapiens
tgtagtttttaattaaa

SEQ ID NO: 1875344 - DNA, 22 bp, Homo sapiens
tgtagtttttaattaaaaactt

SEQ ID NO: 1875345 - DNA, 16 bp, Homo sapiens
tgtataaaaaggaaat

SEQ ID NO: 1875346 - DNA, 19 bp, Homo sapiens
tgtataaaaaggaaattag

SEQ ID NO: 1875347 - DNA, 13 bp, Homo sapiens
tgtatactgtaaa

SEQ ID NO: 1875348 - DNA, 16 bp, Homo sapiens
tgtatactgtaaaagt

SEQ ID NO: 1875349 - DNA, 13 bp, Homo sapiens
tgtatcattaaaa

SEQ ID NO: 1875350 - DNA, 17 bp, Homo sapiens
tgtatcattaaaatata

SEQ ID NO: 1875351 - DNA, 22 bp, Homo sapiens
tgtatcccccccctgtatagtt

SEQ ID NO: 1875352 - DNA, 19 bp, Homo sapiens
tgtatgagactgtgtttct

SEQ ID NO: 1875353 - DNA, 20 bp, Homo sapiens
tgtatgattttgatgcacaa

SEQ ID NO: 1875354 - DNA, 15 bp, Homo sapiens
tgtatggcttttctc

SEQ ID NO: 1875355 - DNA, 14 bp, Homo sapiens
tgtattaacaaagt

SEQ ID NO: 1875356 - DNA, 24 bp, Homo sapiens
tgtattaacaaagttactggctct

SEQ ID NO: 1875357 - DNA, 13 bp, Homo sapiens
tgtattataattg

SEQ ID NO: 1875358 - DNA, 14 bp, Homo sapiens
tgtattataattgt

SEQ ID NO: 1875359 - DNA, 22 bp, Homo sapiens
tgtattgagtcttaactgtatt

SEQ ID NO: 1875360 - DNA, 18 bp, Homo sapiens
tgtattgttgtaaaatgt

SEQ ID NO: 1875361 - DNA, 21 bp, Homo sapiens
tgtatttaagaaagggaaagc

SEQ ID NO: 1875362 - DNA, 22 bp, Homo sapiens
tgtatttaagaaagggaaagct

SEQ ID NO: 1875363 - DNA, 14 bp, Homo sapiens
tgtatttcagtatt

SEQ ID NO: 1875364 - DNA, 15 bp, Homo sapiens
tgtatttcagtattt

SEQ ID NO: 1875365 - DNA, 19 bp, Homo sapiens
tgtatttcagtattttcca

SEQ ID NO: 1875366 - DNA, 17 bp, Homo sapiens
tgtcaaatgaactttta

SEQ ID NO: 1875367 - DNA, 22 bp, Homo sapiens
tgtcattagtgagacatattta

SEQ ID NO: 1875368 - DNA, 24 bp, Homo sapiens
tgtcattagtgagacatatttaca

SEQ ID NO: 1875369 - DNA, 22 bp, Homo sapiens
tgtccaagacacatgctgaggt

SEQ ID NO: 1875370 - DNA, 23 bp, Homo sapiens
tgtccagagggactggacagcca

SEQ ID NO: 1875371 - DNA, 24 bp, Homo sapiens
tgtccagagggactggacagccag

SEQ ID NO: 1875372 - DNA, 16 bp, Homo sapiens
tgtcccagtcccagcc

SEQ ID NO: 1875373 - DNA, 23 bp, Homo sapiens
tgtcccagtcccagcctctgggg

SEQ ID NO: 1875374 - DNA, 15 bp, Homo sapiens
tgtccctccaaggct

SEQ ID NO: 1875375 - DNA, 16 bp, Homo sapiens
tgtcctgcatgcataa

SEQ ID NO: 1875376 - DNA, 12 bp, Homo sapiens
tgtcctgtgtct

SEQ ID NO: 1875377 - DNA, 14 bp, Homo sapiens
tgtcggctgtgagg

SEQ ID NO: 1875378 - DNA, 17 bp, Homo sapiens
tgtctccaggtaacttt

SEQ ID NO: 1875379 - DNA, 22 bp, Homo sapiens
tgtctccaggtaactttgcttg

SEQ ID NO: 1875380 - DNA, 11 bp, Homo sapiens
tgtctgcagct

SEQ ID NO: 1875381 - DNA, 12 bp, Homo sapiens
tgtctgtctgct

SEQ ID NO: 1875382 - DNA, 15 bp, Homo sapiens
tgtctgtgtgctgta

SEQ ID NO: 1875383 - DNA, 16 bp, Homo sapiens
tgtctgtgtgctgtaa

SEQ ID NO: 1875384 - DNA, 13 bp, Homo sapiens
tgtcttagttgat

SEQ ID NO: 1875385 - DNA, 12 bp, Homo sapiens
tgtcttctccca

SEQ ID NO: 1875386 - DNA, 15 bp, Homo sapiens
tgtcttctcccagag

SEQ ID NO: 1875387 - DNA, 17 bp, Homo sapiens
tgtcttctcccagagca

SEQ ID NO: 1875388 - DNA, 12 bp, Homo sapiens
tgtctttcaaaa

SEQ ID NO: 1875389 - DNA, 14 bp, Homo sapiens
tgtgaaaatgggtt

SEQ ID NO: 1875390 - DNA, 12 bp, Homo sapiens
tgtgaatttcaa

SEQ ID NO: 1875391 - DNA, 16 bp, Homo sapiens
tgtgaatttcaaaaaa

SEQ ID NO: 1875392 - DNA, 14 bp, Homo sapiens
tgtgactttgaaaa

SEQ ID NO: 1875393 - DNA, 22 bp, Homo sapiens
tgtgagaagatgggggctggag

SEQ ID NO: 1875394 - DNA, 15 bp, Homo sapiens
tgtgagcaagagcca

SEQ ID NO: 1875395 - DNA, 18 bp, Homo sapiens
tgtgagcaagagccaggg

SEQ ID NO: 1875396 - DNA, 23 bp, Homo sapiens
tgtgatttagaactgtatgtcag

SEQ ID NO: 1875397 - DNA, 15 bp, Homo sapiens
tgtgcaaattaacag

SEQ ID NO: 1875398 - DNA, 22 bp, Homo sapiens
tgtgcaccttaccaactttctg

SEQ ID NO: 1875399 - DNA, 22 bp, Homo sapiens
tgtgccatagagtttaacacaa

SEQ ID NO: 1875400 - DNA, 15 bp, Homo sapiens
tgtgccttttatagc

SEQ ID NO: 1875401 - DNA, 20 bp, Homo sapiens
tgtgccttttttagcttcat

SEQ ID NO: 1875402 - DNA, 17 bp, Homo sapiens
tgtggaccggccgcagc

SEQ ID NO: 1875403 - DNA, 13 bp, Homo sapiens
tgtggcactgcca

SEQ ID NO: 1875404 - DNA, 20 bp, Homo sapiens
tgtggccatatatgctgtat

SEQ ID NO: 1875405 - DNA, 23 bp, Homo sapiens
tgtggccatatatgctgtatttc

SEQ ID NO: 1875406 - DNA, 22 bp, Homo sapiens
tgtggttctataataagttttg

SEQ ID NO: 1875407 - DNA, 22 bp, Homo sapiens
tgtgtatgagactgtgtttcta

SEQ ID NO: 1875408 - DNA, 13 bp, Homo sapiens
tgtgtattgttgt

SEQ ID NO: 1875409 - DNA, 23 bp, Homo sapiens
tgtgtgcaccttaccaactttct

SEQ ID NO: 1875410 - DNA, 21 bp, Homo sapiens
tgtgtgccatagagtttaaca

SEQ ID NO: 1875411 - DNA, 13 bp, Homo sapiens
tgtgtgtctccag

SEQ ID NO: 1875412 - DNA, 15 bp, Homo sapiens
tgtgttacattattc

SEQ ID NO: 1875413 - DNA, 19 bp, Homo sapiens
tgtgttcactaaactctga

SEQ ID NO: 1875414 - DNA, 20 bp, Homo sapiens
tgtgttttaaaaaaactgaa

SEQ ID NO: 1875415 - DNA, 10 bp, Homo sapiens
tgttacaagt

SEQ ID NO: 1875416 - DNA, 17 bp, Homo sapiens
tgttacaagtttgctaa

SEQ ID NO: 1875417 - DNA, 19 bp, Homo sapiens
tgttacaagtttgctaaaa

SEQ ID NO: 1875418 - DNA, 12 bp, Homo sapiens
tgttacattatt

SEQ ID NO: 1875419 - DNA, 15 bp, Homo sapiens
tgttacattattcca

SEQ ID NO: 1875420 - DNA, 15 bp, Homo sapiens
tgttactgcttctct

SEQ ID NO: 1875421 - DNA, 17 bp, Homo sapiens
tgttaggtctcatgccc

SEQ ID NO: 1875422 - DNA, 16 bp, Homo sapiens
tgttatattccaagga

SEQ ID NO: 1875423 - DNA, 18 bp, Homo sapiens
tgttatattccaaggaaa

SEQ ID NO: 1875424 - DNA, 21 bp, Homo sapiens
tgttatgaaaatcctatatct

SEQ ID NO: 1875425 - DNA, 23 bp, Homo sapiens
tgttatgaaaatcctatatctgt

SEQ ID NO: 1875426 - DNA, 22 bp, Homo sapiens
tgttattgatcccttctcctgc

SEQ ID NO: 1875427 - DNA, 18 bp, Homo sapiens
tgttattttcagtatttt

SEQ ID NO: 1875428 - DNA, 16 bp, Homo sapiens
tgttcaacagtttctc

SEQ ID NO: 1875429 - DNA, 14 bp, Homo sapiens
tgttccaaatttag

SEQ ID NO: 1875430 - DNA, 19 bp, Homo sapiens
tgttcctcgggatgaaaag

SEQ ID NO: 1875431 - DNA, 23 bp, Homo sapiens
tgttctgcaagaattaaaactga

SEQ ID NO: 1875432 - DNA, 14 bp, Homo sapiens
tgttggctttacaa

SEQ ID NO: 1875433 - DNA, 17 bp, Homo sapiens
tgttggctttacaaata

SEQ ID NO: 1875434 - DNA, 23 bp, Homo sapiens
tgtttaaaggtttctattttctc

SEQ ID NO: 1875435 - DNA, 15 bp, Homo sapiens
tgtttaaatgccaaa

SEQ ID NO: 1875436 - DNA, 23 bp, Homo sapiens
tgtttaattcattaatctgtttg

SEQ ID NO: 1875437 - DNA, 21 bp, Homo sapiens
tgtttactcccttctgtagtt

SEQ ID NO: 1875438 - DNA, 14 bp, Homo sapiens
tgtttcttctccaa

SEQ ID NO: 1875439 - DNA, 24 bp, Homo sapiens
tgtttgcttaatttccttctgtta

SEQ ID NO: 1875440 - DNA, 20 bp, Homo sapiens
tgtttgtacaagattgtcat

SEQ ID NO: 1875441 - DNA, 21 bp, Homo sapiens
tgttttaaaaaaactgaaggt

SEQ ID NO: 1875442 - DNA, 12 bp, Homo sapiens
ttaaaaaaactg

SEQ ID NO: 1875443 - DNA, 15 bp, Homo sapiens
ttaaaaaaactgaag

SEQ ID NO: 1875444 - DNA, 19 bp, Homo sapiens
ttaaaaaaactgaaggttt

SEQ ID NO: 1875445 - DNA, 17 bp, Homo sapiens
ttaaaaaatattttaag

SEQ ID NO: 1875446 - DNA, 18 bp, Homo sapiens
ttaaaaaatattttaaga

SEQ ID NO: 1875447 - DNA, 20 bp, Homo sapiens
ttaaaaaatattttaagaaa

SEQ ID NO: 1875448 - DNA, 11 bp, Homo sapiens
ttaaaaactgt

SEQ ID NO: 1875449 - DNA, 14 bp, Homo sapiens
ttaaaaactgtgta

SEQ ID NO: 1875450 - DNA, 22 bp, Homo sapiens
ttaaaactgagtccatgaaaat

SEQ ID NO: 1875451 - DNA, 13 bp, Homo sapiens
ttaaaaggcaact

SEQ ID NO: 1875452 - DNA, 16 bp, Homo sapiens
ttaaaaggcaactcaa

SEQ ID NO: 1875453 - DNA, 11 bp, Homo sapiens
ttaaaatatat

SEQ ID NO: 1875454 - DNA, 13 bp, Homo sapiens
ttaaaatatatgt

SEQ ID NO: 1875455 - DNA, 16 bp, Homo sapiens
ttaaaatatatgttct

SEQ ID NO: 1875456 - DNA, 22 bp, Homo sapiens
ttaaaatatatgttctgcaaga

SEQ ID NO: 1875457 - DNA, 23 bp, Homo sapiens
ttaaaatatatgttctgcaagaa

SEQ ID NO: 1875458 - DNA, 17 bp, Homo sapiens
ttaaaatgaagcaattt

SEQ ID NO: 1875459 - DNA, 21 bp, Homo sapiens
ttaaacaaaatttcacagttc

SEQ ID NO: 1875460 - DNA, 15 bp, Homo sapiens
ttaaagaaacactaa

SEQ ID NO: 1875461 - DNA, 19 bp, Homo sapiens
ttaaagaaacactaaatta

SEQ ID NO: 1875462 - DNA, 22 bp, Homo sapiens
ttaaagaaacactaaattagtt

SEQ ID NO: 1875463 - DNA, 18 bp, Homo sapiens
ttaaagataagtctacat

SEQ ID NO: 1875464 - DNA, 20 bp, Homo sapiens
ttaaagcttgatttgatctt

SEQ ID NO: 1875465 - DNA, 17 bp, Homo sapiens
ttaaataaatagaaaga

SEQ ID NO: 1875466 - DNA, 22 bp, Homo sapiens
ttaaatcatactcctatgcttt

SEQ ID NO: 1875467 - DNA, 15 bp, Homo sapiens
ttaaatgagttactt

SEQ ID NO: 1875468 - DNA, 13 bp, Homo sapiens
ttaaatgccaaaa

SEQ ID NO: 1875469 - DNA, 16 bp, Homo sapiens
ttaaatgccttggttt

SEQ ID NO: 1875470 - DNA, 21 bp, Homo sapiens
ttaaatgccttggtttgattt

SEQ ID NO: 1875471 - DNA, 13 bp, Homo sapiens
ttaactaaatgct

SEQ ID NO: 1875472 - DNA, 16 bp, Homo sapiens
ttaactaaatgctcat

SEQ ID NO: 1875473 - DNA, 9 bp, Homo sapiens
ttaagaaag

SEQ ID NO: 1875474 - DNA, 21 bp, Homo sapiens
ttaagaaagagaatgaactgt

SEQ ID NO: 1875475 - DNA, 19 bp, Homo sapiens
ttaagaaaggatataaaag

SEQ ID NO: 1875476 - DNA, 16 bp, Homo sapiens
ttaagtactatctttg

SEQ ID NO: 1875477 - DNA, 17 bp, Homo sapiens
ttaagtactatctttgt

SEQ ID NO: 1875478 - DNA, 24 bp, Homo sapiens
ttaagtgcaacatttctgtatact

SEQ ID NO: 1875479 - DNA, 18 bp, Homo sapiens
ttaatagcttttattgta

SEQ ID NO: 1875480 - DNA, 22 bp, Homo sapiens
ttaatagcttttattgtataaa

SEQ ID NO: 1875481 - DNA, 19 bp, Homo sapiens
ttaataggatgaatgggaa

SEQ ID NO: 1875482 - DNA, 19 bp, Homo sapiens
ttaatatatcccagaaatt

SEQ ID NO: 1875483 - DNA, 20 bp, Homo sapiens
ttaatctgtttgtttggcac

SEQ ID NO: 1875484 - DNA, 14 bp, Homo sapiens
ttaatctttcctga

SEQ ID NO: 1875485 - DNA, 16 bp, Homo sapiens
ttaatggactgtgaat

SEQ ID NO: 1875486 - DNA, 22 bp, Homo sapiens
ttaattaaagccttaagcacaa

SEQ ID NO: 1875487 - DNA, 17 bp, Homo sapiens
ttaattcattaatctgt

SEQ ID NO: 1875488 - DNA, 15 bp, Homo sapiens
ttaattgtcctgtgt

SEQ ID NO: 1875489 - DNA, 21 bp, Homo sapiens
ttaatttagagcgtttggtta

SEQ ID NO: 1875490 - DNA, 16 bp, Homo sapiens
ttaatttccttctgtt

SEQ ID NO: 1875491 - DNA, 21 bp, Homo sapiens
ttaatttccttctgttaagaa

SEQ ID NO: 1875492 - DNA, 14 bp, Homo sapiens
ttacaaataatttt

SEQ ID NO: 1875493 - DNA, 15 bp, Homo sapiens
ttacaaataattttt

SEQ ID NO: 1875494 - DNA, 17 bp, Homo sapiens
ttacaagtggtgaccaa

SEQ ID NO: 1875495 - DNA, 23 bp, Homo sapiens
ttacaagtggtgaccaaaatttt

SEQ ID NO: 1875496 - DNA, 16 bp, Homo sapiens
ttacaagtgtatatca

SEQ ID NO: 1875497 - DNA, 14 bp, Homo sapiens
ttacaagtttgcta

SEQ ID NO: 1875498 - DNA, 20 bp, Homo sapiens
ttacagatcatataagcaag

SEQ ID NO: 1875499 - DNA, 14 bp, Homo sapiens
ttacagtgtattta

SEQ ID NO: 1875500 - DNA, 16 bp, Homo sapiens
ttacagtgtatttaag

SEQ ID NO: 1875501 - DNA, 19 bp, Homo sapiens
ttacattattccaatgata

SEQ ID NO: 1875502 - DNA, 14 bp, Homo sapiens
ttaccaactttctg

SEQ ID NO: 1875503 - DNA, 19 bp, Homo sapiens
ttaccattattttacagtc

SEQ ID NO: 1875504 - DNA, 17 bp, Homo sapiens
ttaccctatatctataa

SEQ ID NO: 1875505 - DNA, 14 bp, Homo sapiens
ttaccttgtctttc

SEQ ID NO: 1875506 - DNA, 13 bp, Homo sapiens
ttacgtataatgc

SEQ ID NO: 1875507 - DNA, 16 bp, Homo sapiens
ttacgtataatgcttt

SEQ ID NO: 1875508 - DNA, 14 bp, Homo sapiens
ttactcagtgaaat

SEQ ID NO: 1875509 - DNA, 22 bp, Homo sapiens
ttactcagtgaaatcatattaa

SEQ ID NO: 1875510 - DNA, 16 bp, Homo sapiens
ttactcccttctgtag

SEQ ID NO: 1875511 - DNA, 23 bp, Homo sapiens
ttactgtctggttttaacaattt

SEQ ID NO: 1875512 - DNA, 11 bp, Homo sapiens
ttagaaacatg

SEQ ID NO: 1875513 - DNA, 14 bp, Homo sapiens
ttagaaaccttaat

SEQ ID NO: 1875514 - DNA, 15 bp, Homo sapiens
ttagacctttatcca

SEQ ID NO: 1875515 - DNA, 14 bp, Homo sapiens
ttagagtttacagt

SEQ ID NO: 1875516 - DNA, 18 bp, Homo sapiens
ttagatgtgctgctttga

SEQ ID NO: 1875517 - DNA, 23 bp, Homo sapiens
ttagcgtccatttcttatttaat

SEQ ID NO: 1875518 - DNA, 16 bp, Homo sapiens
ttagcttcatatctaa

SEQ ID NO: 1875519 - DNA, 22 bp, Homo sapiens
ttagggaaaatggatatagaaa

SEQ ID NO: 1875520 - DNA, 15 bp, Homo sapiens
ttagttatagtttca

SEQ ID NO: 1875521 - DNA, 14 bp, Homo sapiens
ttagttcttgaatt

SEQ ID NO: 1875522 - DNA, 18 bp, Homo sapiens
ttagtttaaaatgaagca

SEQ ID NO: 1875523 - DNA, 20 bp, Homo sapiens
ttataagcgtatttagactg

SEQ ID NO: 1875524 - DNA, 13 bp, Homo sapiens
ttataataactga

SEQ ID NO: 1875525 - DNA, 20 bp, Homo sapiens
ttataataactgaactgttt

SEQ ID NO: 1875526 - DNA, 14 bp, Homo sapiens
ttatagattgtctt

SEQ ID NO: 1875527 - DNA, 19 bp, Homo sapiens
ttataggcagatctttaaa

SEQ ID NO: 1875528 - DNA, 23 bp, Homo sapiens
ttataggtaacgtgattgattca

SEQ ID NO: 1875529 - DNA, 13 bp, Homo sapiens
ttatagttaatct

SEQ ID NO: 1875530 - DNA, 15 bp, Homo sapiens
ttatagtttgtacat

SEQ ID NO: 1875531 - DNA, 18 bp, Homo sapiens
ttatatataaggtaatgt

SEQ ID NO: 1875532 - DNA, 15 bp, Homo sapiens
ttatatattgaaagt

SEQ ID NO: 1875533 - DNA, 16 bp, Homo sapiens
ttatattccaaggaaa

SEQ ID NO: 1875534 - DNA, 19 bp, Homo sapiens
ttatatttagttatagttt

SEQ ID NO: 1875535 - DNA, 15 bp, Homo sapiens
ttatatttttaaagg

SEQ ID NO: 1875536 - DNA, 19 bp, Homo sapiens
ttatcatgacatgttatat

SEQ ID NO: 1875537 - DNA, 15 bp, Homo sapiens
ttatcatttaagatt

SEQ ID NO: 1875538 - DNA, 18 bp, Homo sapiens
ttatcatttttgtataaa

SEQ ID NO: 1875539 - DNA, 20 bp, Homo sapiens
ttatcatttttgtataaaaa

SEQ ID NO: 1875540 - DNA, 14 bp, Homo sapiens
ttatgagatttact

SEQ ID NO: 1875541 - DNA, 15 bp, Homo sapiens
ttatgcaaaaacata

SEQ ID NO: 1875542 - DNA, 13 bp, Homo sapiens
ttatgtgttacat

SEQ ID NO: 1875543 - DNA, 16 bp, Homo sapiens
ttattaaaaaaacaca

SEQ ID NO: 1875544 - DNA, 17 bp, Homo sapiens
ttattaaaaaaacacaa

SEQ ID NO: 1875545 - DNA, 20 bp, Homo sapiens
ttattaaaaaaacacaaaaa

SEQ ID NO: 1875546 - DNA, 14 bp, Homo sapiens
ttattaaaatgatt

SEQ ID NO: 1875547 - DNA, 21 bp, Homo sapiens
ttattaaaatgattgtaaaat

SEQ ID NO: 1875548 - DNA, 13 bp, Homo sapiens
ttattaatgcttt

SEQ ID NO: 1875549 - DNA, 16 bp, Homo sapiens
ttattcagctagaatt

SEQ ID NO: 1875550 - DNA, 17 bp, Homo sapiens
ttattcagctagaattt

SEQ ID NO: 1875551 - DNA, 11 bp, Homo sapiens
ttattctgtgg

SEQ ID NO: 1875552 - DNA, 16 bp, Homo sapiens
ttattctgtggttcta

SEQ ID NO: 1875553 - DNA, 23 bp, Homo sapiens
ttattgcaccattttcaatttgg

SEQ ID NO: 1875554 - DNA, 18 bp, Homo sapiens
ttattggcagccaaggaa

SEQ ID NO: 1875555 - DNA, 22 bp, Homo sapiens
ttattggcagccaaggaatgtg

SEQ ID NO: 1875556 - DNA, 14 bp, Homo sapiens
ttattgtataaact

SEQ ID NO: 1875557 - DNA, 21 bp, Homo sapiens
ttattgtataaactatcagtt

SEQ ID NO: 1875558 - DNA, 12 bp, Homo sapiens
ttatttgatatc

SEQ ID NO: 1875559 - DNA, 13 bp, Homo sapiens
ttatttgtgtaat

SEQ ID NO: 1875560 - DNA, 21 bp, Homo sapiens
ttatttgtgtaatagaaaact

SEQ ID NO: 1875561 - DNA, 16 bp, Homo sapiens
ttattttaaacaaaat

SEQ ID NO: 1875562 - DNA, 17 bp, Homo sapiens
ttattttaaacaaaata

SEQ ID NO: 1875563 - DNA, 12 bp, Homo sapiens
ttattttcagta

SEQ ID NO: 1875564 - DNA, 14 bp, Homo sapiens
ttattttcagtatt

SEQ ID NO: 1875565 - DNA, 16 bp, Homo sapiens
ttatttttgtaccata

SEQ ID NO: 1875566 - DNA, 21 bp, Homo sapiens
ttcaaaatggtaactttacaa

SEQ ID NO: 1875567 - DNA, 17 bp, Homo sapiens
ttcaaattggtctgaaa

SEQ ID NO: 1875568 - DNA, 14 bp, Homo sapiens
ttcaagttattgta

SEQ ID NO: 1875569 - DNA, 16 bp, Homo sapiens
ttcacagttctgtaat

SEQ ID NO: 1875570 - DNA, 17 bp, Homo sapiens
ttcaccatgcaggcaac

SEQ ID NO: 1875571 - DNA, 21 bp, Homo sapiens
ttcactggggcatgagatttt

SEQ ID NO: 1875572 - DNA, 14 bp, Homo sapiens
ttcagaaattaaaa

SEQ ID NO: 1875573 - DNA, 15 bp, Homo sapiens
ttcagaaattaaaat

SEQ ID NO: 1875574 - DNA, 15 bp, Homo sapiens
ttcagatatatatca

SEQ ID NO: 1875575 - DNA, 15 bp, Homo sapiens
ttcagatttctcttt

SEQ ID NO: 1875576 - DNA, 19 bp, Homo sapiens
ttcagatttctctttgaaa

SEQ ID NO: 1875577 - DNA, 15 bp, Homo sapiens
ttcagtatcttagag

SEQ ID NO: 1875578 - DNA, 17 bp, Homo sapiens
ttcagtatcttagagtt

SEQ ID NO: 1875579 - DNA, 16 bp, Homo sapiens
ttcagtattttccagc

SEQ ID NO: 1875580 - DNA, 13 bp, Homo sapiens
ttcataattcacc

SEQ ID NO: 1875581 - DNA, 18 bp, Homo sapiens
ttcataccagtcagtatt

SEQ ID NO: 1875582 - DNA, 17 bp, Homo sapiens
ttcatataatttaaaga

SEQ ID NO: 1875583 - DNA, 18 bp, Homo sapiens
ttcatataatttaaagaa

SEQ ID NO: 1875584 - DNA, 15 bp, Homo sapiens
ttcatatctaattta

SEQ ID NO: 1875585 - DNA, 19 bp, Homo sapiens
ttccaaaataatctatatt

SEQ ID NO: 1875586 - DNA, 21 bp, Homo sapiens
ttccaaaccagtttattctgt

SEQ ID NO: 1875587 - DNA, 14 bp, Homo sapiens
ttccaacagtgagt

SEQ ID NO: 1875588 - DNA, 19 bp, Homo sapiens
ttccagagttgttgtttgc

SEQ ID NO: 1875589 - DNA, 23 bp, Homo sapiens
ttccagataaccagctgtaacac

SEQ ID NO: 1875590 - DNA, 18 bp, Homo sapiens
ttccagccttatgtgtta

SEQ ID NO: 1875591 - DNA, 21 bp, Homo sapiens
ttccagccttatgtgttacat

SEQ ID NO: 1875592 - DNA, 18 bp, Homo sapiens
ttcccaggtaatttaaat

SEQ ID NO: 1875593 - DNA, 19 bp, Homo sapiens
ttcccaggtaatttaaatt

SEQ ID NO: 1875594 - DNA, 15 bp, Homo sapiens
ttccctttttaaaaa

SEQ ID NO: 1875595 - DNA, 17 bp, Homo sapiens
ttccgacaccactggga

SEQ ID NO: 1875596 - DNA, 19 bp, Homo sapiens
ttccgacaccactgggaac

SEQ ID NO: 1875597 - DNA, 22 bp, Homo sapiens
ttcctgatggtacaggaaagct

SEQ ID NO: 1875598 - DNA, 21 bp, Homo sapiens
ttcctgattaccagtctgatt

SEQ ID NO: 1875599 - DNA, 16 bp, Homo sapiens
ttcctgtctgtttata

SEQ ID NO: 1875600 - DNA, 17 bp, Homo sapiens
ttcctgttgtgtaataa

SEQ ID NO: 1875601 - DNA, 16 bp, Homo sapiens
ttcgcttgttttaaaa

SEQ ID NO: 1875602 - DNA, 19 bp, Homo sapiens
ttcgtagctttcccaaata

SEQ ID NO: 1875603 - DNA, 12 bp, Homo sapiens
ttctaaattcac

SEQ ID NO: 1875604 - DNA, 20 bp, Homo sapiens
ttctaagttgagtatattat

SEQ ID NO: 1875605 - DNA, 18 bp, Homo sapiens
ttctagtatctattgtgt

SEQ ID NO: 1875606 - DNA, 12 bp, Homo sapiens
ttctataataag

SEQ ID NO: 1875607 - DNA, 18 bp, Homo sapiens
ttctataataagttttga

SEQ ID NO: 1875608 - DNA, 22 bp, Homo sapiens
ttctattttctctgatactttt

SEQ ID NO: 1875609 - DNA, 13 bp, Homo sapiens
ttctcattaaact

SEQ ID NO: 1875610 - DNA, 21 bp, Homo sapiens
ttctccaattctgaaatactt

SEQ ID NO: 1875611 - DNA, 16 bp, Homo sapiens
ttctctttgccttgat

SEQ ID NO: 1875612 - DNA, 14 bp, Homo sapiens
ttctgaaatacttt

SEQ ID NO: 1875613 - DNA, 16 bp, Homo sapiens
ttctgaatcttctgaa

SEQ ID NO: 1875614 - DNA, 20 bp, Homo sapiens
ttctgacttacttaaccagg

SEQ ID NO: 1875615 - DNA, 12 bp, Homo sapiens
ttctgcaagaat

SEQ ID NO: 1875616 - DNA, 21 bp, Homo sapiens
ttctgcaagaattaaaactga

SEQ ID NO: 1875617 - DNA, 22 bp, Homo sapiens
ttctgcaagaattaaaactgag

SEQ ID NO: 1875618 - DNA, 23 bp, Homo sapiens
ttctgcaagaattaaaactgagt

SEQ ID NO: 1875619 - DNA, 14 bp, Homo sapiens
ttctgcactcctgg

SEQ ID NO: 1875620 - DNA, 13 bp, Homo sapiens
ttctggttccaaa

SEQ ID NO: 1875621 - DNA, 10 bp, Homo sapiens
ttctgtggtt

SEQ ID NO: 1875622 - DNA, 21 bp, Homo sapiens
ttctgtggttctataataagt

SEQ ID NO: 1875623 - DNA, 14 bp, Homo sapiens
ttcttaaaaactgt

SEQ ID NO: 1875624 - DNA, 16 bp, Homo sapiens
ttcttaaaaactgtgt

SEQ ID NO: 1875625 - DNA, 20 bp, Homo sapiens
ttcttaaaaactgtgtatca

SEQ ID NO: 1875626 - DNA, 15 bp, Homo sapiens
ttcttgaattgttat

SEQ ID NO: 1875627 - DNA, 16 bp, Homo sapiens
ttcttgaattgttatg

SEQ ID NO: 1875628 - DNA, 16 bp, Homo sapiens
ttcttttgttattaaa

SEQ ID NO: 1875629 - DNA, 14 bp, Homo sapiens
ttcttttttaaagt

SEQ ID NO: 1875630 - DNA, 19 bp, Homo sapiens
ttcttttttaaagtaaact

SEQ ID NO: 1875631 - DNA, 21 bp, Homo sapiens
ttgaaaaatattgctaaaagt

SEQ ID NO: 1875632 - DNA, 21 bp, Homo sapiens
ttgaaatcagtaaacactgtg

SEQ ID NO: 1875633 - DNA, 18 bp, Homo sapiens
ttgaatgacaacagaagc

SEQ ID NO: 1875634 - DNA, 21 bp, Homo sapiens
ttgaatgacaacagaagcttc

SEQ ID NO: 1875635 - DNA, 15 bp, Homo sapiens
ttgaatgctttttga

SEQ ID NO: 1875636 - DNA, 17 bp, Homo sapiens
ttgaattgttatgaaaa

SEQ ID NO: 1875637 - DNA, 14 bp, Homo sapiens
ttgacaacacatgt

SEQ ID NO: 1875638 - DNA, 16 bp, Homo sapiens
ttgacaacacatgtgg

SEQ ID NO: 1875639 - DNA, 16 bp, Homo sapiens
ttgactttttagatgt

SEQ ID NO: 1875640 - DNA, 23 bp, Homo sapiens
ttgagtcttaactgtatttcagt

SEQ ID NO: 1875641 - DNA, 15 bp, Homo sapiens
ttgatctttgtttaa

SEQ ID NO: 1875642 - DNA, 16 bp, Homo sapiens
ttgatctttgtttaaa

SEQ ID NO: 1875643 - DNA, 22 bp, Homo sapiens
ttgatctttgtttaaatgccaa

SEQ ID NO: 1875644 - DNA, 22 bp, Homo sapiens
ttgattaaacagcaaagccata

SEQ ID NO: 1875645 - DNA, 23 bp, Homo sapiens
ttgattaaacagcaaagccatat

SEQ ID NO: 1875646 - DNA, 14 bp, Homo sapiens
ttgatttctagtat

SEQ ID NO: 1875647 - DNA, 13 bp, Homo sapiens
ttgatttgatttt

SEQ ID NO: 1875648 - DNA, 17 bp, Homo sapiens
ttgcaaaagactaattt

SEQ ID NO: 1875649 - DNA, 16 bp, Homo sapiens
ttgcaaaccctttgta

SEQ ID NO: 1875650 - DNA, 22 bp, Homo sapiens
ttgcagtcttttgctgtgctgt

SEQ ID NO: 1875651 - DNA, 17 bp, Homo sapiens
ttgccttgatgttgtgt

SEQ ID NO: 1875652 - DNA, 13 bp, Homo sapiens
ttgctaaaagaag

SEQ ID NO: 1875653 - DNA, 16 bp, Homo sapiens
ttgctaaaagaagaga

SEQ ID NO: 1875654 - DNA, 15 bp, Homo sapiens
ttgctaaaagtgcat

SEQ ID NO: 1875655 - DNA, 22 bp, Homo sapiens
ttgctaccaaaaactagacatt

SEQ ID NO: 1875656 - DNA, 11 bp, Homo sapiens
ttgctgccctg

SEQ ID NO: 1875657 - DNA, 13 bp, Homo sapiens
ttgctgccctggg

SEQ ID NO: 1875658 - DNA, 16 bp, Homo sapiens
ttgctgtgactagata

SEQ ID NO: 1875659 - DNA, 22 bp, Homo sapiens
ttgcttaatttccttctgttaa

SEQ ID NO: 1875660 - DNA, 23 bp, Homo sapiens
ttgcttaatttccttctgttaag

SEQ ID NO: 1875661 - DNA, 16 bp, Homo sapiens
ttggaaagaggttctg

SEQ ID NO: 1875662 - DNA, 19 bp, Homo sapiens
ttggaaagaggttctgcac

SEQ ID NO: 1875663 - DNA, 23 bp, Homo sapiens
ttggagcattaactaaatgctca

SEQ ID NO: 1875664 - DNA, 16 bp, Homo sapiens
ttggcaatagtttgca

SEQ ID NO: 1875665 - DNA, 22 bp, Homo sapiens
ttggcacttataggtaacgtga

SEQ ID NO: 1875666 - DNA, 16 bp, Homo sapiens
ttggcagccaaggaat

SEQ ID NO: 1875667 - DNA, 13 bp, Homo sapiens
ttggcttgctgtt

SEQ ID NO: 1875668 - DNA, 18 bp, Homo sapiens
ttggggcatttgtgggac

SEQ ID NO: 1875669 - DNA, 11 bp, Homo sapiens
ttggtaaattt

SEQ ID NO: 1875670 - DNA, 17 bp, Homo sapiens
ttggtaaatttttgaaa

SEQ ID NO: 1875671 - DNA, 19 bp, Homo sapiens
ttggtcatggtagattttt

SEQ ID NO: 1875672 - DNA, 14 bp, Homo sapiens
ttggttcagttttt

SEQ ID NO: 1875673 - DNA, 15 bp, Homo sapiens
ttggttcagtttttt

SEQ ID NO: 1875674 - DNA, 16 bp, Homo sapiens
ttggtttgcacataaa

SEQ ID NO: 1875675 - DNA, 13 bp, Homo sapiens
ttggtttggtaca

SEQ ID NO: 1875676 - DNA, 14 bp, Homo sapiens
ttgtaaaactacac

SEQ ID NO: 1875677 - DNA, 17 bp, Homo sapiens
ttgtaaatgagacacat

SEQ ID NO: 1875678 - DNA, 16 bp, Homo sapiens
ttgtacagctgtttaa

SEQ ID NO: 1875679 - DNA, 21 bp, Homo sapiens
ttgtacttttctggttccaaa

SEQ ID NO: 1875680 - DNA, 22 bp, Homo sapiens
ttgtagaataaatggtttctca

SEQ ID NO: 1875681 - DNA, 14 bp, Homo sapiens
ttgtagccctggat

SEQ ID NO: 1875682 - DNA, 23 bp, Homo sapiens
ttgtagccctggatggcctctgg

SEQ ID NO: 1875683 - DNA, 17 bp, Homo sapiens
ttgtaggggtcaaagaa

SEQ ID NO: 1875684 - DNA, 15 bp, Homo sapiens
ttgtataaaaaggaa

SEQ ID NO: 1875685 - DNA, 19 bp, Homo sapiens
ttgtataaaaaggaaatta

SEQ ID NO: 1875686 - DNA, 11 bp, Homo sapiens
ttgtatatatc

SEQ ID NO: 1875687 - DNA, 16 bp, Homo sapiens
ttgtattataattgtt

SEQ ID NO: 1875688 - DNA, 15 bp, Homo sapiens
ttgtattgcttcctg

SEQ ID NO: 1875689 - DNA, 11 bp, Homo sapiens
ttgtcctgtgt

SEQ ID NO: 1875690 - DNA, 12 bp, Homo sapiens
ttgtctttcaaa

SEQ ID NO: 1875691 - DNA, 13 bp, Homo sapiens
ttgtctttcagga

SEQ ID NO: 1875692 - DNA, 18 bp, Homo sapiens
ttgtgcagtgttagtatt

SEQ ID NO: 1875693 - DNA, 13 bp, Homo sapiens
ttgtgtaataaca

SEQ ID NO: 1875694 - DNA, 11 bp, Homo sapiens
ttgtgtattga

SEQ ID NO: 1875695 - DNA, 18 bp, Homo sapiens
ttgtgtttagctaccttt

SEQ ID NO: 1875696 - DNA, 20 bp, Homo sapiens
ttgtgttttaaaaaaactga

SEQ ID NO: 1875697 - DNA, 17 bp, Homo sapiens
ttgttatagattgtctt

SEQ ID NO: 1875698 - DNA, 18 bp, Homo sapiens
ttgttatcatttaagatt

SEQ ID NO: 1875699 - DNA, 14 bp, Homo sapiens
ttgttcaacagttt

SEQ ID NO: 1875700 - DNA, 16 bp, Homo sapiens
ttgttcaacagtttct

SEQ ID NO: 1875701 - DNA, 11 bp, Homo sapiens
ttgttgatatt

SEQ ID NO: 1875702 - DNA, 13 bp, Homo sapiens
ttgttttgtttta

SEQ ID NO: 1875703 - DNA, 15 bp, Homo sapiens
tttaaaaaaactgaa

SEQ ID NO: 1875704 - DNA, 16 bp, Homo sapiens
tttaaaaaaactgaag

SEQ ID NO: 1875705 - DNA, 19 bp, Homo sapiens
tttaaaaaactttctactc

SEQ ID NO: 1875706 - DNA, 24 bp, Homo sapiens
tttaaaaaataccattgaaatcag

SEQ ID NO: 1875707 - DNA, 13 bp, Homo sapiens
tttaaaaaatatt

SEQ ID NO: 1875708 - DNA, 15 bp, Homo sapiens
tttaaaaaatatttt

SEQ ID NO: 1875709 - DNA, 21 bp, Homo sapiens
tttaaaaaatattttaagaaa

SEQ ID NO: 1875710 - DNA, 17 bp, Homo sapiens
tttaaaaatgatgataa

SEQ ID NO: 1875711 - DNA, 23 bp, Homo sapiens
tttaaaaggcaactcaaagatga

SEQ ID NO: 1875712 - DNA, 20 bp, Homo sapiens
tttaaaagggttcaaggact

SEQ ID NO: 1875713 - DNA, 21 bp, Homo sapiens
tttaaaagggttcaaggacta

SEQ ID NO: 1875714 - DNA, 19 bp, Homo sapiens
tttaaaagtcacataaaat

SEQ ID NO: 1875715 - DNA, 15 bp, Homo sapiens
tttaaagaaacacta

SEQ ID NO: 1875716 - DNA, 20 bp, Homo sapiens
tttaaatacgcactacatgt

SEQ ID NO: 1875717 - DNA, 13 bp, Homo sapiens
tttaaatgccaaa

SEQ ID NO: 1875718 - DNA, 12 bp, Homo sapiens
tttaacatgtga

SEQ ID NO: 1875719 - DNA, 15 bp, Homo sapiens
tttaacttgtaataa

SEQ ID NO: 1875720 - DNA, 15 bp, Homo sapiens
tttaagaaagagaat

SEQ ID NO: 1875721 - DNA, 17 bp, Homo sapiens
tttaagaaagagaatga

SEQ ID NO: 1875722 - DNA, 23 bp, Homo sapiens
tttaagaaagagaatgaactgtg

SEQ ID NO: 1875723 - DNA, 22 bp, Homo sapiens
tttaagtactatctttgtctaa

SEQ ID NO: 1875724 - DNA, 23 bp, Homo sapiens
tttaagtgacataattgtccagt

SEQ ID NO: 1875725 - DNA, 17 bp, Homo sapiens
tttaagtgcaacatttc

SEQ ID NO: 1875726 - DNA, 17 bp, Homo sapiens
tttaatggactgtgaat

SEQ ID NO: 1875727 - DNA, 21 bp, Homo sapiens
tttaatttccaaaataatcta

SEQ ID NO: 1875728 - DNA, 15 bp, Homo sapiens
tttacagaatgcatt

SEQ ID NO: 1875729 - DNA, 17 bp, Homo sapiens
tttacagaatgcattaa

SEQ ID NO: 1875730 - DNA, 16 bp, Homo sapiens
tttacagtgtatttaa

SEQ ID NO: 1875731 - DNA, 13 bp, Homo sapiens
tttacagtttgtg

SEQ ID NO: 1875732 - DNA, 14 bp, Homo sapiens
tttacagtttgtgt

SEQ ID NO: 1875733 - DNA, 15 bp, Homo sapiens
tttaccctatatcta

SEQ ID NO: 1875734 - DNA, 16 bp, Homo sapiens
tttaccctatatctat

SEQ ID NO: 1875735 - DNA, 18 bp, Homo sapiens
tttaccctatatctataa

SEQ ID NO: 1875736 - DNA, 22 bp, Homo sapiens
tttactaagccacaagaaattt

SEQ ID NO: 1875737 - DNA, 18 bp, Homo sapiens
tttactcagtgaaatcat

SEQ ID NO: 1875738 - DNA, 16 bp, Homo sapiens
tttagatttttaaaag

SEQ ID NO: 1875739 - DNA, 17 bp, Homo sapiens
tttagatttttaaaagg

SEQ ID NO: 1875740 - DNA, 15 bp, Homo sapiens
tttagtaccctgcag

SEQ ID NO: 1875741 - DNA, 23 bp, Homo sapiens
tttagtctttttttccttccttt

SEQ ID NO: 1875742 - DNA, 16 bp, Homo sapiens
tttagttacgtataat

SEQ ID NO: 1875743 - DNA, 14 bp, Homo sapiens
tttataaaatggga

SEQ ID NO: 1875744 - DNA, 16 bp, Homo sapiens
tttatacataaacagt

SEQ ID NO: 1875745 - DNA, 13 bp, Homo sapiens
tttataggcagat

SEQ ID NO: 1875746 - DNA, 16 bp, Homo sapiens
tttatatccattttta

SEQ ID NO: 1875747 - DNA, 12 bp, Homo sapiens
tttatatcttta

SEQ ID NO: 1875748 - DNA, 12 bp, Homo sapiens
tttatatttaaa

SEQ ID NO: 1875749 - DNA, 21 bp, Homo sapiens
tttatatttaaaaaattaaaa

SEQ ID NO: 1875750 - DNA, 14 bp, Homo sapiens
tttatatttagtga

SEQ ID NO: 1875751 - DNA, 13 bp, Homo sapiens
tttatctttgtgt

SEQ ID NO: 1875752 - DNA, 16 bp, Homo sapiens
tttatgagatttactg

SEQ ID NO: 1875753 - DNA, 22 bp, Homo sapiens
tttattaaaatgattgtaaaat

SEQ ID NO: 1875754 - DNA, 20 bp, Homo sapiens
tttattcagctagaatttct

SEQ ID NO: 1875755 - DNA, 23 bp, Homo sapiens
tttattcagctagaatttctggt

SEQ ID NO: 1875756 - DNA, 15 bp, Homo sapiens
tttattctgtggttc

SEQ ID NO: 1875757 - DNA, 14 bp, Homo sapiens
tttatttatatctt

SEQ ID NO: 1875758 - DNA, 13 bp, Homo sapiens
tttatttctctgg

SEQ ID NO: 1875759 - DNA, 21 bp, Homo sapiens
tttatttctctggcaaacttt

SEQ ID NO: 1875760 - DNA, 13 bp, Homo sapiens
tttcacagttctg

SEQ ID NO: 1875761 - DNA, 15 bp, Homo sapiens
tttcagatatatatc

SEQ ID NO: 1875762 - DNA, 15 bp, Homo sapiens
tttcagtattttcca

SEQ ID NO: 1875763 - DNA, 23 bp, Homo sapiens
tttcatagatttgaaaaactttt

SEQ ID NO: 1875764 - DNA, 17 bp, Homo sapiens
tttccaaattattaatt

SEQ ID NO: 1875765 - DNA, 18 bp, Homo sapiens
tttccaaattattaattg

SEQ ID NO: 1875766 - DNA, 20 bp, Homo sapiens
tttcccttttcctctagaag

SEQ ID NO: 1875767 - DNA, 16 bp, Homo sapiens
tttccctttttaaaaa

SEQ ID NO: 1875768 - DNA, 19 bp, Homo sapiens
tttccctttttaaaaaata

SEQ ID NO: 1875769 - DNA, 12 bp, Homo sapiens
tttcctcttgaa

SEQ ID NO: 1875770 - DNA, 19 bp, Homo sapiens
tttccttctgttaagaaag

SEQ ID NO: 1875771 - DNA, 21 bp, Homo sapiens
tttccttctgttaagaaagga

SEQ ID NO: 1875772 - DNA, 23 bp, Homo sapiens
tttccttctgttaagaaaggata

SEQ ID NO: 1875773 - DNA, 11 bp, Homo sapiens
tttctactttt

SEQ ID NO: 1875774 - DNA, 19 bp, Homo sapiens
tttctagtatctattgtgt

SEQ ID NO: 1875775 - DNA, 14 bp, Homo sapiens
tttctattttctct

SEQ ID NO: 1875776 - DNA, 13 bp, Homo sapiens
tttctcattaaac

SEQ ID NO: 1875777 - DNA, 13 bp, Homo sapiens
tttctcctctccc

SEQ ID NO: 1875778 - DNA, 16 bp, Homo sapiens
tttctcttcatacttt

SEQ ID NO: 1875779 - DNA, 15 bp, Homo sapiens
tttctctttgaaaca

SEQ ID NO: 1875780 - DNA, 14 bp, Homo sapiens
tttctgaacaaaga

SEQ ID NO: 1875781 - DNA, 23 bp, Homo sapiens
tttctgagtgagttttactctta

SEQ ID NO: 1875782 - DNA, 19 bp, Homo sapiens
tttctgatctgtactttgt

SEQ ID NO: 1875783 - DNA, 13 bp, Homo sapiens
tttctggttccaa

SEQ ID NO: 1875784 - DNA, 14 bp, Homo sapiens
tttctggttccaaa

SEQ ID NO: 1875785 - DNA, 15 bp, Homo sapiens
tttctggttccaaac

SEQ ID NO: 1875786 - DNA, 14 bp, Homo sapiens
tttctgtatactgt

SEQ ID NO: 1875787 - DNA, 15 bp, Homo sapiens
tttctgttggtgtat

SEQ ID NO: 1875788 - DNA, 19 bp, Homo sapiens
tttcttacataatttgcaa

SEQ ID NO: 1875789 - DNA, 17 bp, Homo sapiens
tttcttacataattttt

SEQ ID NO: 1875790 - DNA, 15 bp, Homo sapiens
tttcttatttaatta

SEQ ID NO: 1875791 - DNA, 18 bp, Homo sapiens
tttcttttttaaagtaaa

SEQ ID NO: 1875792 - DNA, 19 bp, Homo sapiens
tttctttttttggtaaatt

SEQ ID NO: 1875793 - DNA, 12 bp, Homo sapiens
tttgaaaaatat

SEQ ID NO: 1875794 - DNA, 16 bp, Homo sapiens
tttgaaaaatattgct

SEQ ID NO: 1875795 - DNA, 18 bp, Homo sapiens
tttgaaaaatattgctaa

SEQ ID NO: 1875796 - DNA, 22 bp, Homo sapiens
tttgaaaaatattgctaaaagt

SEQ ID NO: 1875797 - DNA, 13 bp, Homo sapiens
tttgaaagaattc

SEQ ID NO: 1875798 - DNA, 18 bp, Homo sapiens
tttgaaagaattctattt

SEQ ID NO: 1875799 - DNA, 15 bp, Homo sapiens
tttgaaatcagtaaa

SEQ ID NO: 1875800 - DNA, 23 bp, Homo sapiens
tttgaagtagtttgtataacttc

SEQ ID NO: 1875801 - DNA, 20 bp, Homo sapiens
tttgaatgttatttgttatt

SEQ ID NO: 1875802 - DNA, 17 bp, Homo sapiens
tttgagtatggctatct

SEQ ID NO: 1875803 - DNA, 13 bp, Homo sapiens
tttgatcagtgtt

SEQ ID NO: 1875804 - DNA, 13 bp, Homo sapiens
tcttaaatcattt

SEQ ID NO: 1875805 - DNA, 16 bp, Homo sapiens
tcttaatattcagaga

SEQ ID NO: 1875806 - DNA, 17 bp, Homo sapiens
tcttacataatttgcaa

SEQ ID NO: 1875807 - DNA, 16 bp, Homo sapiens
tcttagagtttacagt

SEQ ID NO: 1875808 - DNA, 19 bp, Homo sapiens
tcttagtatagtagaaaga

SEQ ID NO: 1875809 - DNA, 12 bp, Homo sapiens
tcttatttaatt

SEQ ID NO: 1875810 - DNA, 22 bp, Homo sapiens
tcttcggccaatttatgcagag

SEQ ID NO: 1875811 - DNA, 19 bp, Homo sapiens
tcttgccccaaatcacaaa

SEQ ID NO: 1875812 - DNA, 20 bp, Homo sapiens
tcttggaaagaggttctgca

SEQ ID NO: 1875813 - DNA, 17 bp, Homo sapiens
tcttggtttggtacagt

SEQ ID NO: 1875814 - DNA, 20 bp, Homo sapiens
tcttgttattaatgtttctt

SEQ ID NO: 1875815 - DNA, 17 bp, Homo sapiens
tctttatgcaaaaacat

SEQ ID NO: 1875816 - DNA, 17 bp, Homo sapiens
tctttcaactcattgca

SEQ ID NO: 1875817 - DNA, 19 bp, Homo sapiens
tctttgaaacatgcttgtg

SEQ ID NO: 1875818 - DNA, 19 bp, Homo sapiens
tctttgtagaataaatggt

SEQ ID NO: 1875819 - DNA, 16 bp, Homo sapiens
tctttgtctaaacaag

SEQ ID NO: 1875820 - DNA, 20 bp, Homo sapiens
tctttgtgtgttatattcca

SEQ ID NO: 1875821 - DNA, 17 bp, Homo sapiens
tctttgtttaaatgcca

SEQ ID NO: 1875822 - DNA, 15 bp, Homo sapiens
tcttttaaaaatgat

SEQ ID NO: 1875823 - DNA, 22 bp, Homo sapiens
tcttttctgaatcttctgaaac

SEQ ID NO: 1875824 - DNA, 14 bp, Homo sapiens
tcttttgtaaatga

SEQ ID NO: 1875825 - DNA, 16 bp, Homo sapiens
tgaaaaatattgctaa

SEQ ID NO: 1875826 - DNA, 23 bp, Homo sapiens
tgaaaaatattgctaaaagtgca

SEQ ID NO: 1875827 - DNA, 22 bp, Homo sapiens
tgaaaatcctatatctgtttgt

SEQ ID NO: 1875828 - DNA, 23 bp, Homo sapiens
tgaaaatcctatatctgtttgta

SEQ ID NO: 1875829 - DNA, 15 bp, Homo sapiens
tgaaaatctaatatt

SEQ ID NO: 1875830 - DNA, 19 bp, Homo sapiens
aaatttttgaaaaatattg

SEQ ID NO: 1875831 - DNA, 18 bp, Homo sapiens
aacaaagttactggctct

SEQ ID NO: 1875832 - DNA, 20 bp, Homo sapiens
aacaacttgctacttatcat

SEQ ID NO: 1875833 - DNA, 23 bp, Homo sapiens
aacaaggtaatttttttttgtaa

SEQ ID NO: 1875834 - DNA, 19 bp, Homo sapiens
aacaatatgattgcactaa

SEQ ID NO: 1875835 - DNA, 20 bp, Homo sapiens
aacaatatgattgcactaaa

SEQ ID NO: 1875836 - DNA, 21 bp, Homo sapiens
aacactgtgtattgttgtaaa

SEQ ID NO: 1875837 - DNA, 18 bp, Homo sapiens
aacactgttggcacttat

SEQ ID NO: 1875838 - DNA, 14 bp, Homo sapiens
aacagagaaataga

SEQ ID NO: 1875839 - DNA, 17 bp, Homo sapiens
aacaggagacaggaagg

SEQ ID NO: 1875840 - DNA, 20 bp, Homo sapiens
aacagtttatttttattatt

SEQ ID NO: 1875841 - DNA, 22 bp, Homo sapiens
aacatagaattgcaatctataa

SEQ ID NO: 1875842 - DNA, 20 bp, Homo sapiens
aacattaccttgtctttcaa

SEQ ID NO: 1875843 - DNA, 21 bp, Homo sapiens
aacattaccttgtctttcaaa

SEQ ID NO: 1875844 - DNA, 15 bp, Homo sapiens
aacatttctgtatac

SEQ ID NO: 1875845 - DNA, 16 bp, Homo sapiens
aacatttctgtatact

SEQ ID NO: 1875846 - DNA, 21 bp, Homo sapiens
aacatttctgtatactgtaaa

SEQ ID NO: 1875847 - DNA, 24 bp, Homo sapiens
aacatttctgtatactgtaaaagt

SEQ ID NO: 1875848 - DNA, 13 bp, Homo sapiens
aaccatgacaaac

SEQ ID NO: 1875849 - DNA, 21 bp, Homo sapiens
aaccatgacaaacctagcttt

SEQ ID NO: 1875850 - DNA, 16 bp, Homo sapiens
aacccccaaatttaat

SEQ ID NO: 1875851 - DNA, 12 bp, Homo sapiens
aaccctttgtat

SEQ ID NO: 1875852 - DNA, 23 bp, Homo sapiens
aaccctttgtattataattgttg

SEQ ID NO: 1875853 - DNA, 14 bp, Homo sapiens
aaccgtttacagtg

SEQ ID NO: 1875854 - DNA, 21 bp, Homo sapiens
aacctagcttttaaaaaatat

SEQ ID NO: 1875855 - DNA, 23 bp, Homo sapiens
aacctagcttttaaaaaatattt

SEQ ID NO: 1875856 - DNA, 17 bp, Homo sapiens
aacctgtttttaacatg

SEQ ID NO: 1875857 - DNA, 20 bp, Homo sapiens
aacctgtttttaacatgtga

SEQ ID NO: 1875858 - DNA, 20 bp, Homo sapiens
aaccttaagataatggataa

SEQ ID NO: 1875859 - DNA, 16 bp, Homo sapiens
aaccttactggcactg

SEQ ID NO: 1875860 - DNA, 20 bp, Homo sapiens
aacctttctactttttctgt

SEQ ID NO: 1875861 - DNA, 14 bp, Homo sapiens
aacgtatagtcaat

SEQ ID NO: 1875862 - DNA, 18 bp, Homo sapiens
aacgtgattgattcagta

SEQ ID NO: 1875863 - DNA, 22 bp, Homo sapiens
aacgtgattgattcagtatctt

SEQ ID NO: 1875864 - DNA, 23 bp, Homo sapiens
aacgtgctgcttacactccaggt

SEQ ID NO: 1875865 - DNA, 22 bp, Homo sapiens
aactaaatgctcatacacagtt

SEQ ID NO: 1875866 - DNA, 14 bp, Homo sapiens
aactaacaatatga

SEQ ID NO: 1875867 - DNA, 20 bp, Homo sapiens
aactaactgactctgttatt

SEQ ID NO: 1875868 - DNA, 15 bp, Homo sapiens
aactacatctgcctc

SEQ ID NO: 1875869 - DNA, 17 bp, Homo sapiens
aactagttaaaagcctt

SEQ ID NO: 1875870 - DNA, 19 bp, Homo sapiens
aactcaaagatgatggaaa

SEQ ID NO: 1875871 - DNA, 11 bp, Homo sapiens
aactcctgtgt

SEQ ID NO: 1875872 - DNA, 22 bp, Homo sapiens
aactcctgtgtcggtcagaaca

SEQ ID NO: 1875873 - DNA, 12 bp, Homo sapiens
aactctgaataa

SEQ ID NO: 1875874 - DNA, 18 bp, Homo sapiens
aactctgaataagcactt

SEQ ID NO: 1875875 - DNA, 14 bp, Homo sapiens
aactctgattttga

SEQ ID NO: 1875876 - DNA, 13 bp, Homo sapiens
aactctttaactt

SEQ ID NO: 1875877 - DNA, 11 bp, Homo sapiens
aactgaactgt

SEQ ID NO: 1875878 - DNA, 22 bp, Homo sapiens
aactgaaggttttttttttaag

SEQ ID NO: 1875879 - DNA, 12 bp, Homo sapiens
aactgtatttca

SEQ ID NO: 1875880 - DNA, 16 bp, Homo sapiens
aactgtatttcagtat

SEQ ID NO: 1875881 - DNA, 15 bp, Homo sapiens
aactgtgtatcatta

SEQ ID NO: 1875882 - DNA, 22 bp, Homo sapiens
aactgtgtatcattaaaatata

SEQ ID NO: 1875883 - DNA, 14 bp, Homo sapiens
aacttaacatattt

SEQ ID NO: 1875884 - DNA, 23 bp, Homo sapiens
aacttgctacttatcatttttgt

SEQ ID NO: 1875885 - DNA, 15 bp, Homo sapiens
aactttgcttgatta

SEQ ID NO: 1875886 - DNA, 17 bp, Homo sapiens
aacttttacagaatgca

SEQ ID NO: 1875887 - DNA, 21 bp, Homo sapiens
aacttttgtaatttgaattgg

SEQ ID NO: 1875888 - DNA, 16 bp, Homo sapiens
aagaaaaggcaaaaga

SEQ ID NO: 1875889 - DNA, 18 bp, Homo sapiens
aagaaaaggcaaaagact

SEQ ID NO: 1875890 - DNA, 20 bp, Homo sapiens
aagaaaaggcaaaagactgg

SEQ ID NO: 1875891 - DNA, 14 bp, Homo sapiens
aagaaacactaaat

SEQ ID NO: 1875892 - DNA, 21 bp, Homo sapiens
aagaaagagaatgaactgtgg

SEQ ID NO: 1875893 - DNA, 17 bp, Homo sapiens
aagaaagctggtaaact

SEQ ID NO: 1875894 - DNA, 20 bp, Homo sapiens
aagaaaggatataaaaggat

SEQ ID NO: 1875895 - DNA, 20 bp, Homo sapiens
aagaactttgccttaagttt

SEQ ID NO: 1875896 - DNA, 21 bp, Homo sapiens
aagaaggccagcccactgggc

SEQ ID NO: 1875897 - DNA, 23 bp, Homo sapiens
aagaaggccagcccactgggccc

SEQ ID NO: 1875898 - DNA, 22 bp, Homo sapiens
aagaagggggagtgaaacagag

SEQ ID NO: 1875899 - DNA, 23 bp, Homo sapiens
aagaagggggagtgaaacagaga

SEQ ID NO: 1875900 - DNA, 17 bp, Homo sapiens
aagaagttttttacttt

SEQ ID NO: 1875901 - DNA, 13 bp, Homo sapiens
aagaattaaaact

SEQ ID NO: 1875902 - DNA, 15 bp, Homo sapiens
aagaattaaaactga

SEQ ID NO: 1875903 - DNA, 17 bp, Homo sapiens
aagaatttaatggactg

SEQ ID NO: 1875904 - DNA, 18 bp, Homo sapiens
aagaatttaatggactgt

SEQ ID NO: 1875905 - DNA, 20 bp, Homo sapiens
aagaatttgaggtctacatt

SEQ ID NO: 1875906 - DNA, 17 bp, Homo sapiens
aagacaacattgtaaga

SEQ ID NO: 1875907 - DNA, 20 bp, Homo sapiens
aagacacatgctgaggtttt

SEQ ID NO: 1875908 - DNA, 20 bp, Homo sapiens
aagacacctgccttatgcaa

SEQ ID NO: 1875909 - DNA, 14 bp, Homo sapiens
aagacataaaactt

SEQ ID NO: 1875910 - DNA, 15 bp, Homo sapiens
aagacataaaacttt

SEQ ID NO: 1875911 - DNA, 17 bp, Homo sapiens
aagacataaaactttaa

SEQ ID NO: 1875912 - DNA, 14 bp, Homo sapiens
aagacatctgcctg

SEQ ID NO: 1875913 - DNA, 19 bp, Homo sapiens
aagactaatttaaaaaata

SEQ ID NO: 1875914 - DNA, 19 bp, Homo sapiens
aagacttggcaacagaagc

SEQ ID NO: 1875915 - DNA, 13 bp, Homo sapiens
aagagaatgaact

SEQ ID NO: 1875916 - DNA, 16 bp, Homo sapiens
aagagaatgaactgtg

SEQ ID NO: 1875917 - DNA, 19 bp, Homo sapiens
aagagaatgaactgtggaa

SEQ ID NO: 1875918 - DNA, 16 bp, Homo sapiens
aagagctgtggctggg

SEQ ID NO: 1875919 - DNA, 23 bp, Homo sapiens
aagaggccctgtctgtacctaac

SEQ ID NO: 1875920 - DNA, 13 bp, Homo sapiens
aagaggttctgca

SEQ ID NO: 1875921 - DNA, 13 bp, Homo sapiens
aagagtagaaaag

SEQ ID NO: 1875922 - DNA, 23 bp, Homo sapiens
aagatcagctattcccttctgat

SEQ ID NO: 1875923 - DNA, 21 bp, Homo sapiens
aagatcattatcttcatgttt

SEQ ID NO: 1875924 - DNA, 14 bp, Homo sapiens
aagatgatggaaac

SEQ ID NO: 1875925 - DNA, 15 bp, Homo sapiens
aagatgggggctgga

SEQ ID NO: 1875926 - DNA, 16 bp, Homo sapiens
aagcaagccaggagaa

SEQ ID NO: 1875927 - DNA, 17 bp, Homo sapiens
aagcagattacaataaa

SEQ ID NO: 1875928 - DNA, 16 bp, Homo sapiens
aagcatgggaaaaaga

SEQ ID NO: 1875929 - DNA, 21 bp, Homo sapiens
aagcatgggaaaaagagactc

SEQ ID NO: 1875930 - DNA, 20 bp, Homo sapiens
aagcatttttccatctgtgt

SEQ ID NO: 1875931 - DNA, 19 bp, Homo sapiens
aagccaggagaagacccct

SEQ ID NO: 1875932 - DNA, 22 bp, Homo sapiens
aagccatatctagtcaataact

SEQ ID NO: 1875933 - DNA, 14 bp, Homo sapiens
aagctaatctgcct

SEQ ID NO: 1875934 - DNA, 14 bp, Homo sapiens
aagctataaattat

SEQ ID NO: 1875935 - DNA, 18 bp, Homo sapiens
aaggaaagccaaatttta

SEQ ID NO: 1875936 - DNA, 15 bp, Homo sapiens
aaggaatgtgtccaa

SEQ ID NO: 1875937 - DNA, 21 bp, Homo sapiens
aaggaatgtgtccaagacaca

SEQ ID NO: 1875938 - DNA, 21 bp, Homo sapiens
aaggactaacgaacgttttaa

SEQ ID NO: 1875939 - DNA, 14 bp, Homo sapiens
aaggactgtaagca

SEQ ID NO: 1875940 - DNA, 15 bp, Homo sapiens
aaggagattgggaga

SEQ ID NO: 1875941 - DNA, 16 bp, Homo sapiens
aaggatcttttgtaaa

SEQ ID NO: 1875942 - DNA, 18 bp, Homo sapiens
aaggatcttttgtaaatg

SEQ ID NO: 1875943 - DNA, 17 bp, Homo sapiens
aaggccagcccactggg

SEQ ID NO: 1875944 - DNA, 18 bp, Homo sapiens
aaggctgtcttctcccag

SEQ ID NO: 1875945 - DNA, 17 bp, Homo sapiens
aagggaagttgtgcctt

SEQ ID NO: 1875946 - DNA, 22 bp, Homo sapiens
aattattaattgtcctgtgtct

SEQ ID NO: 1875947 - DNA, 14 bp, Homo sapiens
aattatttgtgtaa

SEQ ID NO: 1875948 - DNA, 19 bp, Homo sapiens
aattatttgtgtaatagaa

SEQ ID NO: 1875949 - DNA, 23 bp, Homo sapiens
aattattttgagtggcaaaataa

SEQ ID NO: 1875950 - DNA, 21 bp, Homo sapiens
aattcactgttgaatgcctgt

SEQ ID NO: 1875951 - DNA, 17 bp, Homo sapiens
aattctattttgctgga

SEQ ID NO: 1875952 - DNA, 11 bp, Homo sapiens
aattctgaaat

SEQ ID NO: 1875953 - DNA, 13 bp, Homo sapiens
aattgaaagtatt

SEQ ID NO: 1875954 - DNA, 14 bp, Homo sapiens
aattgaaagtattc

SEQ ID NO: 1875955 - DNA, 20 bp, Homo sapiens
aattgaaagtattcagaaat

SEQ ID NO: 1875956 - DNA, 18 bp, Homo sapiens
aattgagaataagaattt

SEQ ID NO: 1875957 - DNA, 18 bp, Homo sapiens
aattgcagtttcatgtat

SEQ ID NO: 1875958 - DNA, 20 bp, Homo sapiens
aattggtcatggtagatttt

SEQ ID NO: 1875959 - DNA, 17 bp, Homo sapiens
aattgtaattaataata

SEQ ID NO: 1875960 - DNA, 14 bp, Homo sapiens
aattgttatgaaaa

SEQ ID NO: 1875961 - DNA, 15 bp, Homo sapiens
aattgttgatatttt

SEQ ID NO: 1875962 - DNA, 17 bp, Homo sapiens
aattgttgatattttcc

SEQ ID NO: 1875963 - DNA, 11 bp, Homo sapiens
aatttaaattg

SEQ ID NO: 1875964 - DNA, 20 bp, Homo sapiens
aatttaatggactgtgaatt

SEQ ID NO: 1875965 - DNA, 22 bp, Homo sapiens
aatttaatggactgtgaatttc

SEQ ID NO: 1875966 - DNA, 13 bp, Homo sapiens
aatttaattaaag

SEQ ID NO: 1875967 - DNA, 12 bp, Homo sapiens
aatttaatttat

SEQ ID NO: 1875968 - DNA, 21 bp, Homo sapiens
aatttaccattattttacagt

SEQ ID NO: 1875969 - DNA, 22 bp, Homo sapiens
aatttaccattattttacagtc

SEQ ID NO: 1875970 - DNA, 16 bp, Homo sapiens
aatttagaaagcttaa

SEQ ID NO: 1875971 - DNA, 17 bp, Homo sapiens
aatttattagttaatat

SEQ ID NO: 1875972 - DNA, 21 bp, Homo sapiens
aatttattggcagccaaggaa

SEQ ID NO: 1875973 - DNA, 14 bp, Homo sapiens
aatttcacagttct

SEQ ID NO: 1875974 - DNA, 19 bp, Homo sapiens
aatttccttctgttaagaa

SEQ ID NO: 1875975 - DNA, 21 bp, Homo sapiens
aatttccttctgttaagaaag

SEQ ID NO: 1875976 - DNA, 15 bp, Homo sapiens
aatttggagcattaa

SEQ ID NO: 1875977 - DNA, 20 bp, Homo sapiens
aatttgtgcatcagaaaatg

SEQ ID NO: 1875978 - DNA, 15 bp, Homo sapiens
aatttttgaaaaata

SEQ ID NO: 1875979 - DNA, 17 bp, Homo sapiens
aatttttgaaaaatatt

SEQ ID NO: 1875980 - DNA, 18 bp, Homo sapiens
aatttttgaaaaatattg

SEQ ID NO: 1875981 - DNA, 20 bp, Homo sapiens
aatttttgaaaaatattgct

SEQ ID NO: 1875982 - DNA, 17 bp, Homo sapiens
acaaaaaaataataaaa

SEQ ID NO: 1875983 - DNA, 15 bp, Homo sapiens
acaaaagcagctttt

SEQ ID NO: 1875984 - DNA, 12 bp, Homo sapiens
acaaaatagaag

SEQ ID NO: 1875985 - DNA, 19 bp, Homo sapiens
acaaacctagcttttaaaa

SEQ ID NO: 1875986 - DNA, 22 bp, Homo sapiens
acaaagcatgggaaaaagagac

SEQ ID NO: 1875987 - DNA, 23 bp, Homo sapiens
acaaataattttttgcagtcttt

SEQ ID NO: 1875988 - DNA, 18 bp, Homo sapiens
acaaatggcttacttaca

SEQ ID NO: 1875989 - DNA, 17 bp, Homo sapiens
acaaattttttaatttc

SEQ ID NO: 1875990 - DNA, 19 bp, Homo sapiens
acaacagaagttatatttt

SEQ ID NO: 1875991 - DNA, 21 bp, Homo sapiens
acaacttgctacttatcattt

SEQ ID NO: 1875992 - DNA, 13 bp, Homo sapiens
acaagaaggccag

SEQ ID NO: 1875993 - DNA, 17 bp, Homo sapiens
acaagcttaaagcttga

SEQ ID NO: 1875994 - DNA, 19 bp, Homo sapiens
acaagcttaaagcttgatt

SEQ ID NO: 1875995 - DNA, 16 bp, Homo sapiens
acaagtggtgaccaaa

SEQ ID NO: 1875996 - DNA, 16 bp, Homo sapiens
acaagtttgctaaaag

SEQ ID NO: 1875997 - DNA, 22 bp, Homo sapiens
acaagtttgctaaaagaagaga

SEQ ID NO: 1875998 - DNA, 17 bp, Homo sapiens
acaatgtgactttgaaa

SEQ ID NO: 1875999 - DNA, 16 bp, Homo sapiens
acaattagcagaatgg

SEQ ID NO: 1876000 - DNA, 17 bp, Homo sapiens
acaattagcagaatgga

SEQ ID NO: 1876001 - DNA, 18 bp, Homo sapiens
acaattagcagaatggag

SEQ ID NO: 1876002 - DNA, 17 bp, Homo sapiens
acaatttcctttatatt

SEQ ID NO: 1876003 - DNA, 19 bp, Homo sapiens
acacaaaaaaataataaaa

SEQ ID NO: 1876004 - DNA, 14 bp, Homo sapiens
acacatacaaaaaa

SEQ ID NO: 1876005 - DNA, 17 bp, Homo sapiens
acacatccctaatgtgt

SEQ ID NO: 1876006 - DNA, 13 bp, Homo sapiens
acacatggcagaa

SEQ ID NO: 1876007 - DNA, 15 bp, Homo sapiens
acactaaattagttt

SEQ ID NO: 1876008 - DNA, 23 bp, Homo sapiens
acactaattcctttctatcctac

SEQ ID NO: 1876009 - DNA, 14 bp, Homo sapiens
acactgttggcact

SEQ ID NO: 1876010 - DNA, 17 bp, Homo sapiens
acactgttggcacttat

SEQ ID NO: 1876011 - DNA, 19 bp, Homo sapiens
acactgtttgttccagaat

SEQ ID NO: 1876012 - DNA, 23 bp, Homo sapiens
acagaactcgtggcgtggggcag

SEQ ID NO: 1876013 - DNA, 14 bp, Homo sapiens
acagaagcttcaga

SEQ ID NO: 1876014 - DNA, 19 bp, Homo sapiens
acagaagcttcagaagttt

SEQ ID NO: 1876015 - DNA, 14 bp, Homo sapiens
acagaatgcattaa

SEQ ID NO: 1876016 - DNA, 15 bp, Homo sapiens
acagagaaagaaaag

SEQ ID NO: 1876017 - DNA, 19 bp, Homo sapiens
acagagaaagaaaaggcaa

SEQ ID NO: 1876018 - DNA, 19 bp, Homo sapiens
acagatggaagaagtttta

SEQ ID NO: 1876019 - DNA, 13 bp, Homo sapiens
acagattcctgtt

SEQ ID NO: 1876020 - DNA, 12 bp, Homo sapiens
acagcctggggg

SEQ ID NO: 1876021 - DNA, 13 bp, Homo sapiens
acagcctgggggg

SEQ ID NO: 1876022 - DNA, 20 bp, Homo sapiens
acaggaaggtggtgcttaca

SEQ ID NO: 1876023 - DNA, 19 bp, Homo sapiens
acagtaatatgaaagccac

SEQ ID NO: 1876024 - DNA, 19 bp, Homo sapiens
acagtcctaactggtatag

SEQ ID NO: 1876025 - DNA, 18 bp, Homo sapiens
acagtctctgttgtaaat

SEQ ID NO: 1876026 - DNA, 15 bp, Homo sapiens
acagtggcactaaaa

SEQ ID NO: 1876027 - DNA, 16 bp, Homo sapiens
acagtggcactaaaat

SEQ ID NO: 1876028 - DNA, 15 bp, Homo sapiens
acagtgtatttaaga

SEQ ID NO: 1876029 - DNA, 15 bp, Homo sapiens
acagttcataattca

SEQ ID NO: 1876030 - DNA, 15 bp, Homo sapiens
acagttctgtaatgt

SEQ ID NO: 1876031 - DNA, 19 bp, Homo sapiens
acataagtaagacttgatt

SEQ ID NO: 1876032 - DNA, 22 bp, Homo sapiens
acataatttgcaatttcaggaa

SEQ ID NO: 1876033 - DNA, 12 bp, Homo sapiens
acataatttttt

SEQ ID NO: 1876034 - DNA, 15 bp, Homo sapiens
acatctaaagcttta

SEQ ID NO: 1876035 - DNA, 17 bp, Homo sapiens
acatctaaagctttatc

SEQ ID NO: 1876036 - DNA, 17 bp, Homo sapiens
acatctgcctgtaatta

SEQ ID NO: 1876037 - DNA, 21 bp, Homo sapiens
acatctgcctgtaattaaact

SEQ ID NO: 1876038 - DNA, 15 bp, Homo sapiens
acatgttatatattt

SEQ ID NO: 1876039 - DNA, 16 bp, Homo sapiens
acattaccttgtcttt

SEQ ID NO: 1876040 - DNA, 21 bp, Homo sapiens
acattaccttgtctttcaaaa

SEQ ID NO: 1876041 - DNA, 17 bp, Homo sapiens
acattattttgtatgga

SEQ ID NO: 1876042 - DNA, 19 bp, Homo sapiens
acattcttggttgttaatt

SEQ ID NO: 1876043 - DNA, 16 bp, Homo sapiens
acatttagtaccctgc

SEQ ID NO: 1876044 - DNA, 20 bp, Homo sapiens
acatttagtaccctgcaggc

SEQ ID NO: 1876045 - DNA, 13 bp, Homo sapiens
acatttctgtata

SEQ ID NO: 1876046 - DNA, 21 bp, Homo sapiens
acatttctgtatactgtaaaa

SEQ ID NO: 1876047 - DNA, 20 bp, Homo sapiens
accaaaatttttaggtgaag

SEQ ID NO: 1876048 - DNA, 20 bp, Homo sapiens
accacatataacacttaact

SEQ ID NO: 1876049 - DNA, 22 bp, Homo sapiens
accacatataacacttaacttc

SEQ ID NO: 1876050 - DNA, 13 bp, Homo sapiens
accaccctgcctg

SEQ ID NO: 1876051 - DNA, 15 bp, Homo sapiens
accaccctgcctgtg

SEQ ID NO: 1876052 - DNA, 19 bp, Homo sapiens
accaccctgcctgtggagg

SEQ ID NO: 1876053 - DNA, 19 bp, Homo sapiens
accacgatgacgcctctgg

SEQ ID NO: 1876054 - DNA, 20 bp, Homo sapiens
accactagctaagcaagcca

SEQ ID NO: 1876055 - DNA, 23 bp, Homo sapiens
accactgggaaccaagggccctc

SEQ ID NO: 1876056 - DNA, 19 bp, Homo sapiens
accagaaccagtctttcaa

SEQ ID NO: 1876057 - DNA, 17 bp, Homo sapiens
accagctgtaacacagc

SEQ ID NO: 1876058 - DNA, 20 bp, Homo sapiens
accagtctttcaactcattg

SEQ ID NO: 1876059 - DNA, 14 bp, Homo sapiens
accagtttattctg

SEQ ID NO: 1876060 - DNA, 15 bp, Homo sapiens
accagtttattctgt

SEQ ID NO: 1876061 - DNA, 15 bp, Homo sapiens
accatattgctctta

SEQ ID NO: 1876062 - DNA, 23 bp, Homo sapiens
agggccctcactcaggaaccctg

SEQ ID NO: 1876063 - DNA, 21 bp, Homo sapiens
agggctactgcagctttacat

SEQ ID NO: 1876064 - DNA, 14 bp, Homo sapiens
aggggaagaattta

SEQ ID NO: 1876065 - DNA, 18 bp, Homo sapiens
agggggcagagtggcctg

SEQ ID NO: 1876066 - DNA, 18 bp, Homo sapiens
aggggtgtcccagtccca

SEQ ID NO: 1876067 - DNA, 14 bp, Homo sapiens
agggtataatgtgt

SEQ ID NO: 1876068 - DNA, 18 bp, Homo sapiens
agggtgtcggctgtgagg

SEQ ID NO: 1876069 - DNA, 15 bp, Homo sapiens
aggtaacgtgattga

SEQ ID NO: 1876070 - DNA, 21 bp, Homo sapiens
aggtaatgtagggttatattt

SEQ ID NO: 1876071 - DNA, 18 bp, Homo sapiens
aggtaatttttttttgta

SEQ ID NO: 1876072 - DNA, 20 bp, Homo sapiens
aggtaatttttttttgtaaa

SEQ ID NO: 1876073 - DNA, 22 bp, Homo sapiens
aggtaccagcaatatgtaaata

SEQ ID NO: 1876074 - DNA, 13 bp, Homo sapiens
aggtaggttttaa

SEQ ID NO: 1876075 - DNA, 20 bp, Homo sapiens
aggtaggttttaaaaataag

SEQ ID NO: 1876076 - DNA, 15 bp, Homo sapiens
aggtcaagtaataaa

SEQ ID NO: 1876077 - DNA, 13 bp, Homo sapiens
aggtcatggagca

SEQ ID NO: 1876078 - DNA, 14 bp, Homo sapiens
aggtcatggagcag

SEQ ID NO: 1876079 - DNA, 20 bp, Homo sapiens
aggtcatggagcagccccca

SEQ ID NO: 1876080 - DNA, 12 bp, Homo sapiens
aggtctcatgcc

SEQ ID NO: 1876081 - DNA, 15 bp, Homo sapiens
aggtctcatgcccac

SEQ ID NO: 1876082 - DNA, 14 bp, Homo sapiens
aggtttctattttc

SEQ ID NO: 1876083 - DNA, 17 bp, Homo sapiens
aggttttgaataaaaag

SEQ ID NO: 1876084 - DNA, 20 bp, Homo sapiens
aggttttgaataaaaagtga

SEQ ID NO: 1876085 - DNA, 12 bp, Homo sapiens
aggttttgttgt

SEQ ID NO: 1876086 - DNA, 16 bp, Homo sapiens
aggttttttttttaag

SEQ ID NO: 1876087 - DNA, 13 bp, Homo sapiens
agtaaacactgtg

SEQ ID NO: 1876088 - DNA, 22 bp, Homo sapiens
agtaagtcttttttttttccaa

SEQ ID NO: 1876089 - DNA, 22 bp, Homo sapiens
agtaataaaaagagatgaaata

SEQ ID NO: 1876090 - DNA, 22 bp, Homo sapiens
agtaatgatgtaacagtgcaag

SEQ ID NO: 1876091 - DNA, 19 bp, Homo sapiens
agtacaatgtgactttgaa

SEQ ID NO: 1876092 - DNA, 20 bp, Homo sapiens
agtagaaagacatctgcctg

SEQ ID NO: 1876093 - DNA, 15 bp, Homo sapiens
agtagatggtgaaat

SEQ ID NO: 1876094 - DNA, 21 bp, Homo sapiens
agtagatggtgaaatttatta

SEQ ID NO: 1876095 - DNA, 21 bp, Homo sapiens
agtagccctttctgtgtgcac

SEQ ID NO: 1876096 - DNA, 17 bp, Homo sapiens
agtagtttgtataactt

SEQ ID NO: 1876097 - DNA, 13 bp, Homo sapiens
agtataaatctgg

SEQ ID NO: 1876098 - DNA, 20 bp, Homo sapiens
agtataatctcctctgctca

SEQ ID NO: 1876099 - DNA, 12 bp, Homo sapiens
agtatctattgt

SEQ ID NO: 1876100 - DNA, 15 bp, Homo sapiens
agtatcttagagttt

SEQ ID NO: 1876101 - DNA, 16 bp, Homo sapiens
agtatgtaaagtatgt

SEQ ID NO: 1876102 - DNA, 19 bp, Homo sapiens
agtattcagaaattaaaat

SEQ ID NO: 1876103 - DNA, 22 bp, Homo sapiens
agtattcagaaattaaaatatt

SEQ ID NO: 1876104 - DNA, 18 bp, Homo sapiens
agtattttccagccttat

SEQ ID NO: 1876105 - DNA, 14 bp, Homo sapiens
agtcaacttacggt

SEQ ID NO: 1876106 - DNA, 17 bp, Homo sapiens
agtcaataactctgatt

SEQ ID NO: 1876107 - DNA, 21 bp, Homo sapiens
agtcaataactctgattttga

SEQ ID NO: 1876108 - DNA, 21 bp, Homo sapiens
agtcacccccccaggcctcca

SEQ ID NO: 1876109 - DNA, 16 bp, Homo sapiens
agtcacctacaggact

SEQ ID NO: 1876110 - DNA, 15 bp, Homo sapiens
agtcacctcctgctc

SEQ ID NO: 1876111 - DNA, 18 bp, Homo sapiens
agtcacctcctgctcctt

SEQ ID NO: 1876112 - DNA, 20 bp, Homo sapiens
agtcagccattcctgttctc

SEQ ID NO: 1876113 - DNA, 23 bp, Homo sapiens
agtccaaattgtctgtctgctct

SEQ ID NO: 1876114 - DNA, 12 bp, Homo sapiens
agtcccagcctc

SEQ ID NO: 1876115 - DNA, 18 bp, Homo sapiens
agtcccagcctctggggc

SEQ ID NO: 1876116 - DNA, 16 bp, Homo sapiens
agtcctgctttcctat

SEQ ID NO: 1876117 - DNA, 23 bp, Homo sapiens
agtcctgtgaatttcttcactgt

SEQ ID NO: 1876118 - DNA, 13 bp, Homo sapiens
agtcgagcactct

SEQ ID NO: 1876119 - DNA, 16 bp, Homo sapiens
agtcgagcactctaat

SEQ ID NO: 1876120 - DNA, 22 bp, Homo sapiens
agtcgtcatcacttttcagtga

SEQ ID NO: 1876121 - DNA, 15 bp, Homo sapiens
agtctgattatacca

SEQ ID NO: 1876122 - DNA, 21 bp, Homo sapiens
agtctgattataccatgtgtg

SEQ ID NO: 1876123 - DNA, 19 bp, Homo sapiens
agtctgtgtgatgaacttt

SEQ ID NO: 1876124 - DNA, 22 bp, Homo sapiens
agtctttgtgtgttatattcca

SEQ ID NO: 1876125 - DNA, 21 bp, Homo sapiens
agtctttttctttttttggta

SEQ ID NO: 1876126 - DNA, 22 bp, Homo sapiens
agtctttttctttttttggtaa

SEQ ID NO: 1876127 - DNA, 17 bp, Homo sapiens
agtcttttttttttcca

SEQ ID NO: 1876128 - DNA, 18 bp, Homo sapiens
agtgaaacagagaaagaa

SEQ ID NO: 1876129 - DNA, 22 bp, Homo sapiens
agtgaaacagagaaagaaaagg

SEQ ID NO: 1876130 - DNA, 16 bp, Homo sapiens
agtgaacttttgtaat

SEQ ID NO: 1876131 - DNA, 16 bp, Homo sapiens
agtgacataattgtcc

SEQ ID NO: 1876132 - DNA, 14 bp, Homo sapiens
agtgagtctgtcag

SEQ ID NO: 1876133 - DNA, 18 bp, Homo sapiens
agtgagtgccatgctttt

SEQ ID NO: 1876134 - DNA, 20 bp, Homo sapiens
agtgagttttactcttaaat

SEQ ID NO: 1876135 - DNA, 19 bp, Homo sapiens
agtgcaacatttctgtata

SEQ ID NO: 1876136 - DNA, 23 bp, Homo sapiens
agtgcaacatttctgtatactgt

SEQ ID NO: 1876137 - DNA, 18 bp, Homo sapiens
agtgcagcgggccaggca

SEQ ID NO: 1876138 - DNA, 12 bp, Homo sapiens
agtgccatgctt

SEQ ID NO: 1876139 - DNA, 13 bp, Homo sapiens
agtgccatgcttt

SEQ ID NO: 1876140 - DNA, 22 bp, Homo sapiens
agtgctgcagctttgggaaagc

SEQ ID NO: 1876141 - DNA, 12 bp, Homo sapiens
agtggcctgtga

SEQ ID NO: 1876142 - DNA, 14 bp, Homo sapiens
agtggcctgtgagc

SEQ ID NO: 1876143 - DNA, 16 bp, Homo sapiens
agtggcctgtgagcaa

SEQ ID NO: 1876144 - DNA, 21 bp, Homo sapiens
agtggcctgtgagcaagagcc

SEQ ID NO: 1876145 - DNA, 14 bp, Homo sapiens
agtggctcttggga

SEQ ID NO: 1876146 - DNA, 11 bp, Homo sapiens
agtgtaaaata

SEQ ID NO: 1876147 - DNA, 14 bp, Homo sapiens
agtgtatatcagaa

SEQ ID NO: 1876148 - DNA, 21 bp, Homo sapiens
agttaatatatcccagaaatt

SEQ ID NO: 1876149 - DNA, 17 bp, Homo sapiens
agttactggctctttgt

SEQ ID NO: 1876150 - DNA, 18 bp, Homo sapiens
agttaggatagcattttt

SEQ ID NO: 1876151 - DNA, 21 bp, Homo sapiens
agttataataactgaactgtt

SEQ ID NO: 1876152 - DNA, 22 bp, Homo sapiens
agttataataactgaactgttt

SEQ ID NO: 1876153 - DNA, 21 bp, Homo sapiens
agttattgtacagctgtttaa

SEQ ID NO: 1876154 - DNA, 22 bp, Homo sapiens
agttattgtacagctgtttaag

SEQ ID NO: 1876155 - DNA, 23 bp, Homo sapiens
agttcagacttagtttttataaa

SEQ ID NO: 1876156 - DNA, 15 bp, Homo sapiens
agttcataattcacc

SEQ ID NO: 1876157 - DNA, 15 bp, Homo sapiens
agttctgtaatgtag

SEQ ID NO: 1876158 - DNA, 15 bp, Homo sapiens
agttcttgaattgtt

SEQ ID NO: 1876159 - DNA, 17 bp, Homo sapiens
agttcttgaattgttat

SEQ ID NO: 1876160 - DNA, 22 bp, Homo sapiens
agttcttgaattgttatgaaaa

SEQ ID NO: 1876161 - DNA, 19 bp, Homo sapiens
agttgaatgacaacagaag

SEQ ID NO: 1876162 - DNA, 23 bp, Homo sapiens
agttgagtatattataatagatt

SEQ ID NO: 1876163 - DNA, 15 bp, Homo sapiens
agttgcattttcata

SEQ ID NO: 1876164 - DNA, 18 bp, Homo sapiens
agttggctggatgaaatt

SEQ ID NO: 1876165 - DNA, 21 bp, Homo sapiens
agttgtgccttttatagctat

SEQ ID NO: 1876166 - DNA, 22 bp, Homo sapiens
agttgtgccttttatagctatt

SEQ ID NO: 1876167 - DNA, 22 bp, Homo sapiens
agttgttgtttgccaagctaat

SEQ ID NO: 1876168 - DNA, 19 bp, Homo sapiens
agtttaaaatgaagcaatt

SEQ ID NO: 1876169 - DNA, 22 bp, Homo sapiens
agtttaaaatgaagcaatttat

SEQ ID NO: 1876170 - DNA, 12 bp, Homo sapiens
agtttaacacaa

SEQ ID NO: 1876171 - DNA, 22 bp, Homo sapiens
agtttaacacaagtcctgtgaa

SEQ ID NO: 1876172 - DNA, 21 bp, Homo sapiens
agtttaagggtggaaaaatgc

SEQ ID NO: 1876173 - DNA, 15 bp, Homo sapiens
agtttattctgtggt

SEQ ID NO: 1876174 - DNA, 21 bp, Homo sapiens
agtttattctgtggttctata

SEQ ID NO: 1876175 - DNA, 18 bp, Homo sapiens
agtttcatgtatgtatat

SEQ ID NO: 1876176 - DNA, 19 bp, Homo sapiens
agtttctcaagtttaaagt

SEQ ID NO: 1876177 - DNA, 13 bp, Homo sapiens
attgctaaaagtg

SEQ ID NO: 1876178 - DNA, 20 bp, Homo sapiens
attggcagccaaggaatgtg

SEQ ID NO: 1876179 - DNA, 23 bp, Homo sapiens
attggcagccaaggaatgtgtcc

SEQ ID NO: 1876180 - DNA, 21 bp, Homo sapiens
attgtaaaatagcttgtatag

SEQ ID NO: 1876181 - DNA, 18 bp, Homo sapiens
attgtaattaataataga

SEQ ID NO: 1876182 - DNA, 14 bp, Homo sapiens
attgtacagctgtt

SEQ ID NO: 1876183 - DNA, 13 bp, Homo sapiens
attgtataaacta

SEQ ID NO: 1876184 - DNA, 23 bp, Homo sapiens
attgtgttggctttacaaataat

SEQ ID NO: 1876185 - DNA, 18 bp, Homo sapiens
attgttttatcatgacat

SEQ ID NO: 1876186 - DNA, 13 bp, Homo sapiens
atttaaaaaatta

SEQ ID NO: 1876187 - DNA, 20 bp, Homo sapiens
atttaaaaaattaaaaatga

SEQ ID NO: 1876188 - DNA, 19 bp, Homo sapiens
atttaaagaaacactaaat

SEQ ID NO: 1876189 - DNA, 14 bp, Homo sapiens
atttaaattggtca

SEQ ID NO: 1876190 - DNA, 22 bp, Homo sapiens
atttaatttataggcagatctt

SEQ ID NO: 1876191 - DNA, 19 bp, Homo sapiens
atttacaagacaacattgt

SEQ ID NO: 1876192 - DNA, 15 bp, Homo sapiens
atttactaagccaca

SEQ ID NO: 1876193 - DNA, 22 bp, Homo sapiens
atttactaagccacaagaaatt

SEQ ID NO: 1876194 - DNA, 23 bp, Homo sapiens
atttagagcgtttggttaaagta

SEQ ID NO: 1876195 - DNA, 17 bp, Homo sapiens
atttagtaccctgcagg

SEQ ID NO: 1876196 - DNA, 17 bp, Homo sapiens
atttataggcagatctt

SEQ ID NO: 1876197 - DNA, 20 bp, Homo sapiens
atttataggcagatctttaa

SEQ ID NO: 1876198 - DNA, 23 bp, Homo sapiens
atttataggcagatctttaaata

SEQ ID NO: 1876199 - DNA, 13 bp, Homo sapiens
atttatatcttgt

SEQ ID NO: 1876200 - DNA, 15 bp, Homo sapiens
atttatatcttgtta

SEQ ID NO: 1876201 - DNA, 23 bp, Homo sapiens
atttatatcttgttattaatgtt

SEQ ID NO: 1876202 - DNA, 19 bp, Homo sapiens
atttatatctttatgcaaa

SEQ ID NO: 1876203 - DNA, 18 bp, Homo sapiens
atttatgagatttactgc

SEQ ID NO: 1876204 - DNA, 16 bp, Homo sapiens
atttcacagttctgta

SEQ ID NO: 1876205 - DNA, 18 bp, Homo sapiens
atttccaaataaaatgag

SEQ ID NO: 1876206 - DNA, 16 bp, Homo sapiens
atttcccctaatcttt

SEQ ID NO: 1876207 - DNA, 16 bp, Homo sapiens
atttcctcttgaacca

SEQ ID NO: 1876208 - DNA, 16 bp, Homo sapiens
atttccttctgttaag

SEQ ID NO: 1876209 - DNA, 23 bp, Homo sapiens
atttccttctgttaagaaaggat

SEQ ID NO: 1876210 - DNA, 19 bp, Homo sapiens
atttctctggcaaactttt

SEQ ID NO: 1876211 - DNA, 11 bp, Homo sapiens
atttctgaaca

SEQ ID NO: 1876212 - DNA, 15 bp, Homo sapiens
atttctgtatactgt

SEQ ID NO: 1876213 - DNA, 23 bp, Homo sapiens
atttctgtatactgtaaaagtta

SEQ ID NO: 1876214 - DNA, 15 bp, Homo sapiens
atttctttgtagaat

SEQ ID NO: 1876215 - DNA, 11 bp, Homo sapiens
atttgaattgg

SEQ ID NO: 1876216 - DNA, 17 bp, Homo sapiens
atttgatctttgtttaa

SEQ ID NO: 1876217 - DNA, 21 bp, Homo sapiens
atttgatctttgtttaaatgc

SEQ ID NO: 1876218 - DNA, 13 bp, Homo sapiens
atttgatttctat

SEQ ID NO: 1876219 - DNA, 11 bp, Homo sapiens
atttgctgccc

SEQ ID NO: 1876220 - DNA, 16 bp, Homo sapiens
atttgctgccctgggg

SEQ ID NO: 1876221 - DNA, 14 bp, Homo sapiens
atttgctgtgacta

SEQ ID NO: 1876222 - DNA, 14 bp, Homo sapiens
atttggttaaatca

SEQ ID NO: 1876223 - DNA, 13 bp, Homo sapiens
atttgtgtaatag

SEQ ID NO: 1876224 - DNA, 18 bp, Homo sapiens
atttgtgtgttcactaaa

SEQ ID NO: 1876225 - DNA, 22 bp, Homo sapiens
atttgtgtgttcactaaactct

SEQ ID NO: 1876226 - DNA, 17 bp, Homo sapiens
attttaaacaaaataga

SEQ ID NO: 1876227 - DNA, 21 bp, Homo sapiens
attttaagaaagagaatgaac

SEQ ID NO: 1876228 - DNA, 23 bp, Homo sapiens
attttacagtctctgttgtaaat

SEQ ID NO: 1876229 - DNA, 13 bp, Homo sapiens
attttcattgtga

SEQ ID NO: 1876230 - DNA, 14 bp, Homo sapiens
attttcattgtgat

SEQ ID NO: 1876231 - DNA, 21 bp, Homo sapiens
attttccagccttatgtgtta

SEQ ID NO: 1876232 - DNA, 22 bp, Homo sapiens
attttccagccttatgtgttac

SEQ ID NO: 1876233 - DNA, 15 bp, Homo sapiens
attttctcctgtggg

SEQ ID NO: 1876234 - DNA, 18 bp, Homo sapiens
attttctctgatactttt

SEQ ID NO: 1876235 - DNA, 23 bp, Homo sapiens
attttgatattttcacagatgga

SEQ ID NO: 1876236 - DNA, 22 bp, Homo sapiens
attttggaagaagttttttact

SEQ ID NO: 1876237 - DNA, 21 bp, Homo sapiens
attttggagaaattatttaat

SEQ ID NO: 1876238 - DNA, 15 bp, Homo sapiens
atttttatatttagt

SEQ ID NO: 1876239 - DNA, 16 bp, Homo sapiens
atttttccatctgtgt

SEQ ID NO: 1876240 - DNA, 14 bp, Homo sapiens
atttttgaaaaata

SEQ ID NO: 1876241 - DNA, 19 bp, Homo sapiens
atttttgaaaaatattgct

SEQ ID NO: 1876242 - DNA, 21 bp, Homo sapiens
atttttgaaaaatattgctaa

SEQ ID NO: 1876243 - DNA, 23 bp, Homo sapiens
atttttgaaaaatattgctaaaa

SEQ ID NO: 1876244 - DNA, 12 bp, Homo sapiens
attttttattgt

SEQ ID NO: 1876245 - DNA, 13 bp, Homo sapiens
attttttattgtt

SEQ ID NO: 1876246 - DNA, 15 bp, Homo sapiens
attttttgcagtctt

SEQ ID NO: 1876247 - DNA, 17 bp, Homo sapiens
attttttgcagtctttt

SEQ ID NO: 1876248 - DNA, 20 bp, Homo sapiens
caaaaaaaaaaaaaaagact

SEQ ID NO: 1876249 - DNA, 22 bp, Homo sapiens
caaaaaaaaaaaaaaagactgt

SEQ ID NO: 1876250 - DNA, 12 bp, Homo sapiens
caaaaaaaagaa

SEQ ID NO: 1876251 - DNA, 15 bp, Homo sapiens
caaaaataacactgt

SEQ ID NO: 1876252 - DNA, 21 bp, Homo sapiens
caaaacaaacaaaaaaaagaa

SEQ ID NO: 1876253 - DNA, 20 bp, Homo sapiens
caaaagactggtttgtttgc

SEQ ID NO: 1876254 - DNA, 21 bp, Homo sapiens
caaaagactggtttgtttgct

SEQ ID NO: 1876255 - DNA, 22 bp, Homo sapiens
caaaagactggtttgtttgctt

SEQ ID NO: 1876256 - DNA, 23 bp, Homo sapiens
caaaagactggtttgtttgctta

SEQ ID NO: 1876257 - DNA, 14 bp, Homo sapiens
caaaataaagaata

SEQ ID NO: 1876258 - DNA, 20 bp, Homo sapiens
caaaataaagaatagcaatt

SEQ ID NO: 1876259 - DNA, 19 bp, Homo sapiens
caaaataatctatattaaa

SEQ ID NO: 1876260 - DNA, 16 bp, Homo sapiens
caaaatgtacttaaat

SEQ ID NO: 1876261 - DNA, 16 bp, Homo sapiens
caaaatttcacagttc

SEQ ID NO: 1876262 - DNA, 17 bp, Homo sapiens
caaacatatgtatcttt

SEQ ID NO: 1876263 - DNA, 22 bp, Homo sapiens
caaaccagtttattctgtggtt

SEQ ID NO: 1876264 - DNA, 21 bp, Homo sapiens
caaacctagcttttaaaaaat

SEQ ID NO: 1876265 - DNA, 14 bp, Homo sapiens
caaagagctgtggc

SEQ ID NO: 1876266 - DNA, 15 bp, Homo sapiens
caaagatgatggaaa

SEQ ID NO: 1876267 - DNA, 18 bp, Homo sapiens
caaagcatgggaaaaaga

SEQ ID NO: 1876268 - DNA, 22 bp, Homo sapiens
caaagcatgggaaaaagagact

SEQ ID NO: 1876269 - DNA, 23 bp, Homo sapiens
caaagcatgggaaaaagagactc

SEQ ID NO: 1876270 - DNA, 19 bp, Homo sapiens
caaaggaccgttttgtatt

SEQ ID NO: 1876271 - DNA, 13 bp, Homo sapiens
caaagtctgtgtg

SEQ ID NO: 1876272 - DNA, 14 bp, Homo sapiens
caaagtctgtgtga

SEQ ID NO: 1876273 - DNA, 16 bp, Homo sapiens
caaagttactggctct

SEQ ID NO: 1876274 - DNA, 19 bp, Homo sapiens
caaatcacaaacatatgta

SEQ ID NO: 1876275 - DNA, 14 bp, Homo sapiens
caaatgaactttta

SEQ ID NO: 1876276 - DNA, 18 bp, Homo sapiens
caaatgaacttttacaga

SEQ ID NO: 1876277 - DNA, 17 bp, Homo sapiens
caaatggcttacttaca

SEQ ID NO: 1876278 - DNA, 22 bp, Homo sapiens
caaattgtctgtctgctcttat

SEQ ID NO: 1876279 - DNA, 17 bp, Homo sapiens
caaattttattaaaaga

SEQ ID NO: 1876280 - DNA, 14 bp, Homo sapiens
caacaagagtttat

SEQ ID NO: 1876281 - DNA, 12 bp, Homo sapiens
caacagaagcag

SEQ ID NO: 1876282 - DNA, 11 bp, Homo sapiens
caacagtgagt

SEQ ID NO: 1876283 - DNA, 14 bp, Homo sapiens
caacatttctgtat

SEQ ID NO: 1876284 - DNA, 18 bp, Homo sapiens
caacatttctgtatactg

SEQ ID NO: 1876285 - DNA, 21 bp, Homo sapiens
caacatttctgtatactgtaa

SEQ ID NO: 1876286 - DNA, 22 bp, Homo sapiens
caactcgtgacagcctctgact

SEQ ID NO: 1876287 - DNA, 11 bp, Homo sapiens
caactttctgt

SEQ ID NO: 1876288 - DNA, 16 bp, Homo sapiens
caactttctgtaaact

SEQ ID NO: 1876289 - DNA, 16 bp, Homo sapiens
caagaaatttgatttc

SEQ ID NO: 1876290 - DNA, 15 bp, Homo sapiens
caagaaggccagccc

SEQ ID NO: 1876291 - DNA, 12 bp, Homo sapiens
caagaattaaaa

SEQ ID NO: 1876292 - DNA, 16 bp, Homo sapiens
caagaattaaaactga

SEQ ID NO: 1876293 - DNA, 16 bp, Homo sapiens
cctgaccaccctgcct

SEQ ID NO: 1876294 - DNA, 18 bp, Homo sapiens
cctgaccaccctgcctgt

SEQ ID NO: 1876295 - DNA, 20 bp, Homo sapiens
cctgaccaccctgcctgtgg

SEQ ID NO: 1876296 - DNA, 21 bp, Homo sapiens
cctgatggtacaggaaagctc

SEQ ID NO: 1876297 - DNA, 12 bp, Homo sapiens
cctgcaggccag

SEQ ID NO: 1876298 - DNA, 16 bp, Homo sapiens
cctgcaggccaggcca

SEQ ID NO: 1876299 - DNA, 17 bp, Homo sapiens
cctgcaggccaggccag

SEQ ID NO: 1876300 - DNA, 18 bp, Homo sapiens
cctgcaggccaggccagc

SEQ ID NO: 1876301 - DNA, 19 bp, Homo sapiens
cctgcaggccaggccagct

SEQ ID NO: 1876302 - DNA, 18 bp, Homo sapiens
cctgcccaagtggctctt

SEQ ID NO: 1876303 - DNA, 21 bp, Homo sapiens
cctgcccaagtggctcttggg

SEQ ID NO: 1876304 - DNA, 14 bp, Homo sapiens
cctgcccatgtcca

SEQ ID NO: 1876305 - DNA, 15 bp, Homo sapiens
cctgcccatgtccag

SEQ ID NO: 1876306 - DNA, 17 bp, Homo sapiens
cctgcccatgtccagag

SEQ ID NO: 1876307 - DNA, 18 bp, Homo sapiens
cctgcccatgtccagagg

SEQ ID NO: 1876308 - DNA, 17 bp, Homo sapiens
cctgccttgctgccttc

SEQ ID NO: 1876309 - DNA, 17 bp, Homo sapiens
cctgccttttaagtttg

SEQ ID NO: 1876310 - DNA, 13 bp, Homo sapiens
cctgctcattgtg

SEQ ID NO: 1876311 - DNA, 18 bp, Homo sapiens
cctgctcattgtggccag

SEQ ID NO: 1876312 - DNA, 15 bp, Homo sapiens
cctgctgggtaaact

SEQ ID NO: 1876313 - DNA, 15 bp, Homo sapiens
cctggagaagggaca

SEQ ID NO: 1876314 - DNA, 13 bp, Homo sapiens
cctggatggcctc

SEQ ID NO: 1876315 - DNA, 23 bp, Homo sapiens
cctggatggcctctggggcagga

SEQ ID NO: 1876316 - DNA, 22 bp, Homo sapiens
cctgggcatgtttgtctgtgtg

SEQ ID NO: 1876317 - DNA, 18 bp, Homo sapiens
cctgggccaaggactcca

SEQ ID NO: 1876318 - DNA, 15 bp, Homo sapiens
cctggggctgccctc

SEQ ID NO: 1876319 - DNA, 12 bp, Homo sapiens
cctgtatagtta

SEQ ID NO: 1876320 - DNA, 15 bp, Homo sapiens
cctgtctgtttatat

SEQ ID NO: 1876321 - DNA, 14 bp, Homo sapiens
cctgtgaaagctgc

SEQ ID NO: 1876322 - DNA, 16 bp, Homo sapiens
cctgtgagcaagagcc

SEQ ID NO: 1876323 - DNA, 21 bp, Homo sapiens
cctgtgagcaagagccagggg

SEQ ID NO: 1876324 - DNA, 18 bp, Homo sapiens
cctgttaggtctcatgcc

SEQ ID NO: 1876325 - DNA, 22 bp, Homo sapiens
cctgttaggtctcatgcccact

SEQ ID NO: 1876326 - DNA, 17 bp, Homo sapiens
cctgtttttaacatgtg

SEQ ID NO: 1876327 - DNA, 12 bp, Homo sapiens
ccttaagtttcc

SEQ ID NO: 1876328 - DNA, 19 bp, Homo sapiens
ccttaccaactttctgtaa

SEQ ID NO: 1876329 - DNA, 18 bp, Homo sapiens
ccttactggcactgtggc

SEQ ID NO: 1876330 - DNA, 19 bp, Homo sapiens
ccttatgtgttacattatt

SEQ ID NO: 1876331 - DNA, 14 bp, Homo sapiens
ccttcaccctgaac

SEQ ID NO: 1876332 - DNA, 14 bp, Homo sapiens
ccttcagcttgctt

SEQ ID NO: 1876333 - DNA, 16 bp, Homo sapiens
ccttccgacaccactg

SEQ ID NO: 1876334 - DNA, 18 bp, Homo sapiens
ccttccgacaccactggg

SEQ ID NO: 1876335 - DNA, 13 bp, Homo sapiens
ccttctgttaaga

SEQ ID NO: 1876336 - DNA, 18 bp, Homo sapiens
ccttggagtgctgcagct

SEQ ID NO: 1876337 - DNA, 23 bp, Homo sapiens
ccttggtttgatttctagtatct

SEQ ID NO: 1876338 - DNA, 17 bp, Homo sapiens
cctttgtattataattg

SEQ ID NO: 1876339 - DNA, 21 bp, Homo sapiens
cctttgtattataattgttga

SEQ ID NO: 1876340 - DNA, 23 bp, Homo sapiens
cctttgtattataattgttgata

SEQ ID NO: 1876341 - DNA, 16 bp, Homo sapiens
cgaattaatagctttt

SEQ ID NO: 1876342 - DNA, 16 bp, Homo sapiens
cgacaccactgggaac

SEQ ID NO: 1876343 - DNA, 14 bp, Homo sapiens
cgagacaggagcag

SEQ ID NO: 1876344 - DNA, 18 bp, Homo sapiens
cgagacaggagcagccca

SEQ ID NO: 1876345 - DNA, 22 bp, Homo sapiens
cgagtctttgtgtgttatattc

SEQ ID NO: 1876346 - DNA, 17 bp, Homo sapiens
cgatgacgcctctggac

SEQ ID NO: 1876347 - DNA, 19 bp, Homo sapiens
cgatgacgcctctggacct

SEQ ID NO: 1876348 - DNA, 22 bp, Homo sapiens
cgcactacatgtggtttataga

SEQ ID NO: 1876349 - DNA, 14 bp, Homo sapiens
cgcacttacaagtg

SEQ ID NO: 1876350 - DNA, 12 bp, Homo sapiens
cgcagcccccac

SEQ ID NO: 1876351 - DNA, 15 bp, Homo sapiens
cgcagcccccactga

SEQ ID NO: 1876352 - DNA, 17 bp, Homo sapiens
cgcagcccccactgacc

SEQ ID NO: 1876353 - DNA, 22 bp, Homo sapiens
cgcagcccccactgacctgccc

SEQ ID NO: 1876354 - DNA, 14 bp, Homo sapiens
cgcatgtccctcca

SEQ ID NO: 1876355 - DNA, 22 bp, Homo sapiens
cgctcgtccacggtcttctgca

SEQ ID NO: 1876356 - DNA, 15 bp, Homo sapiens
cgctctccccctgca

SEQ ID NO: 1876357 - DNA, 20 bp, Homo sapiens
cgctggacacctacagcagc

SEQ ID NO: 1876358 - DNA, 17 bp, Homo sapiens
cgcttagaaacatgttc

SEQ ID NO: 1876359 - DNA, 13 bp, Homo sapiens
cggacaaagttca

SEQ ID NO: 1876360 - DNA, 17 bp, Homo sapiens
cggccacagcactagag

SEQ ID NO: 1876361 - DNA, 20 bp, Homo sapiens
cggccgcagcccccactgac

SEQ ID NO: 1876362 - DNA, 19 bp, Homo sapiens
cggctgtgaggcgggtggc

SEQ ID NO: 1876363 - DNA, 18 bp, Homo sapiens
cgggcccagggcctctgg

SEQ ID NO: 1876364 - DNA, 15 bp, Homo sapiens
cggtcagaacaactt

SEQ ID NO: 1876365 - DNA, 16 bp, Homo sapiens
cgtataatgctttctg

SEQ ID NO: 1876366 - DNA, 22 bp, Homo sapiens
cgtatttagactgtggccatat

SEQ ID NO: 1876367 - DNA, 17 bp, Homo sapiens
cgtattttgatcagtgt

SEQ ID NO: 1876368 - DNA, 12 bp, Homo sapiens
cgtgcaggactc

SEQ ID NO: 1876369 - DNA, 16 bp, Homo sapiens
cgtgcaggactctagc

SEQ ID NO: 1876370 - DNA, 22 bp, Homo sapiens
cgtggggaggccatttgctgcc

SEQ ID NO: 1876371 - DNA, 23 bp, Homo sapiens
cgtggggaggccatttgctgccc

SEQ ID NO: 1876372 - DNA, 11 bp, Homo sapiens
cgtttacagtg

SEQ ID NO: 1876373 - DNA, 12 bp, Homo sapiens
ctaaaagaagag

SEQ ID NO: 1876374 - DNA, 16 bp, Homo sapiens
ctaaaagtgcatttaa

SEQ ID NO: 1876375 - DNA, 23 bp, Homo sapiens
ctaaaagtgcatttaaggagatt

SEQ ID NO: 1876376 - DNA, 22 bp, Homo sapiens
ctaaaatatctgggtggcttaa

SEQ ID NO: 1876377 - DNA, 19 bp, Homo sapiens
ctaaaatgtttaattcatt

SEQ ID NO: 1876378 - DNA, 20 bp, Homo sapiens
ctaaaatgtttaattcatta

SEQ ID NO: 1876379 - DNA, 18 bp, Homo sapiens
ctaaagggagaaatgcca

SEQ ID NO: 1876380 - DNA, 18 bp, Homo sapiens
ctaaattagtttaaaatg

SEQ ID NO: 1876381 - DNA, 17 bp, Homo sapiens
ctaaattcactgttgaa

SEQ ID NO: 1876382 - DNA, 12 bp, Homo sapiens
ctaacaatatga

SEQ ID NO: 1876383 - DNA, 14 bp, Homo sapiens
ctaagcaagccagg

SEQ ID NO: 1876384 - DNA, 15 bp, Homo sapiens
ctaagcaagccagga

SEQ ID NO: 1876385 - DNA, 16 bp, Homo sapiens
ctaagcaagccaggag

SEQ ID NO: 1876386 - DNA, 18 bp, Homo sapiens
ctaatattaaaaatatgg

SEQ ID NO: 1876387 - DNA, 18 bp, Homo sapiens
ctaattagagaactggag

SEQ ID NO: 1876388 - DNA, 21 bp, Homo sapiens
ctacaaagcatgggaaaaaga

SEQ ID NO: 1876389 - DNA, 23 bp, Homo sapiens
ctacagcagcacgcatgtccctc

SEQ ID NO: 1876390 - DNA, 12 bp, Homo sapiens
ctacaggactgg

SEQ ID NO: 1876391 - DNA, 14 bp, Homo sapiens
ctacaggactgggc

SEQ ID NO: 1876392 - DNA, 16 bp, Homo sapiens
ctacaggactgggccg

SEQ ID NO: 1876393 - DNA, 14 bp, Homo sapiens
ctacatattgaata

SEQ ID NO: 1876394 - DNA, 19 bp, Homo sapiens
ctacattcttggttgttaa

SEQ ID NO: 1876395 - DNA, 19 bp, Homo sapiens
ctacctttttatatttaaa

SEQ ID NO: 1876396 - DNA, 20 bp, Homo sapiens
ctacctttttatatttaaaa

SEQ ID NO: 1876397 - DNA, 16 bp, Homo sapiens
ctactgatttttgtga

SEQ ID NO: 1876398 - DNA, 13 bp, Homo sapiens
ctacttatcattt

SEQ ID NO: 1876399 - DNA, 24 bp, Homo sapiens
ctacttatcatttttgtataaaaa

SEQ ID NO: 1876400 - DNA, 20 bp, Homo sapiens
ctagaagcagaaccagctct

SEQ ID NO: 1876401 - DNA, 12 bp, Homo sapiens
ctagactttctg

SEQ ID NO: 1876402 - DNA, 14 bp, Homo sapiens
ctagactttctgtt

SEQ ID NO: 1876403 - DNA, 21 bp, Homo sapiens
ctagagtcacccccccaggcc

SEQ ID NO: 1876404 - DNA, 23 bp, Homo sapiens
ctagagtcacccccccaggcctc

SEQ ID NO: 1876405 - DNA, 20 bp, Homo sapiens
ctagcatttatttctctggc

SEQ ID NO: 1876406 - DNA, 16 bp, Homo sapiens
ctagctaagcaagcca

SEQ ID NO: 1876407 - DNA, 18 bp, Homo sapiens
ctagctaagcaagccagg

SEQ ID NO: 1876408 - DNA, 18 bp, Homo sapiens
ctagcttttaaaaaatat

SEQ ID NO: 1876409 - DNA, 19 bp, Homo sapiens
gacttggcaacagaagcag

SEQ ID NO: 1876410 - DNA, 11 bp, Homo sapiens
gactttctgtt

SEQ ID NO: 1876411 - DNA, 13 bp, Homo sapiens
gactttctgttgg

SEQ ID NO: 1876412 - DNA, 16 bp, Homo sapiens
gagaaagaaaaggcaa

SEQ ID NO: 1876413 - DNA, 19 bp, Homo sapiens
gagaaagaaaaggcaaaag

SEQ ID NO: 1876414 - DNA, 18 bp, Homo sapiens
gagaagacccctgcccaa

SEQ ID NO: 1876415 - DNA, 10 bp, Homo sapiens
gagaagatgg

SEQ ID NO: 1876416 - DNA, 18 bp, Homo sapiens
gagaagatgggggctgga

SEQ ID NO: 1876417 - DNA, 14 bp, Homo sapiens
gagactatttaagt

SEQ ID NO: 1876418 - DNA, 21 bp, Homo sapiens
gagactcagaggacccacctg

SEQ ID NO: 1876419 - DNA, 16 bp, Homo sapiens
gagaggggaagaattt

SEQ ID NO: 1876420 - DNA, 17 bp, Homo sapiens
gagaggggaagaattta

SEQ ID NO: 1876421 - DNA, 18 bp, Homo sapiens
gagattggatttgctgtg

SEQ ID NO: 1876422 - DNA, 18 bp, Homo sapiens
gagattgggagacaatta

SEQ ID NO: 1876423 - DNA, 15 bp, Homo sapiens
gagatttactgctct

SEQ ID NO: 1876424 - DNA, 20 bp, Homo sapiens
gagcaaaatgcatgtaatca

SEQ ID NO: 1876425 - DNA, 14 bp, Homo sapiens
gagcaagagccagg

SEQ ID NO: 1876426 - DNA, 17 bp, Homo sapiens
gagcaagagccaggggt

SEQ ID NO: 1876427 - DNA, 20 bp, Homo sapiens
gagcacaagaaggccagccc

SEQ ID NO: 1876428 - DNA, 22 bp, Homo sapiens
gagcacaagaaggccagcccac

SEQ ID NO: 1876429 - DNA, 20 bp, Homo sapiens
gagcacgttggcgaggaaaa

SEQ ID NO: 1876430 - DNA, 23 bp, Homo sapiens
gagcacgttggcgaggaaaaaca

SEQ ID NO: 1876431 - DNA, 16 bp, Homo sapiens
gagcagcccacccagc

SEQ ID NO: 1876432 - DNA, 18 bp, Homo sapiens
gagcagctggcactgaca

SEQ ID NO: 1876433 - DNA, 22 bp, Homo sapiens
gagccaggggtgtcccagtccc

SEQ ID NO: 1876434 - DNA, 17 bp, Homo sapiens
gagcgtttggttaaagt

SEQ ID NO: 1876435 - DNA, 19 bp, Homo sapiens
gagcttgtagccctggatg

SEQ ID NO: 1876436 - DNA, 22 bp, Homo sapiens
gaggaaccacatataacactta

SEQ ID NO: 1876437 - DNA, 22 bp, Homo sapiens
gaggacccacctgggccaagga

SEQ ID NO: 1876438 - DNA, 17 bp, Homo sapiens
gaggccatttgctgccc

SEQ ID NO: 1876439 - DNA, 22 bp, Homo sapiens
gagggccgagacaggagcagcc

SEQ ID NO: 1876440 - DNA, 14 bp, Homo sapiens
gagtaatgatgtaa

SEQ ID NO: 1876441 - DNA, 18 bp, Homo sapiens
gagtagatggtgaaattt

SEQ ID NO: 1876442 - DNA, 20 bp, Homo sapiens
gagtcacccccccaggcctc

SEQ ID NO: 1876443 - DNA, 13 bp, Homo sapiens
gagtccatgaaaa

SEQ ID NO: 1876444 - DNA, 14 bp, Homo sapiens
gagtccatgaaaat

SEQ ID NO: 1876445 - DNA, 15 bp, Homo sapiens
gagtccatgaaaata

SEQ ID NO: 1876446 - DNA, 13 bp, Homo sapiens
gagtgctgcagct

SEQ ID NO: 1876447 - DNA, 14 bp, Homo sapiens
gagtggcctgtgag

SEQ ID NO: 1876448 - DNA, 11 bp, Homo sapiens
gagtttacagt

SEQ ID NO: 1876449 - DNA, 17 bp, Homo sapiens
gagtttacagtttgtgt

SEQ ID NO: 1876450 - DNA, 23 bp, Homo sapiens
gagtttacagtttgtgttttaaa

SEQ ID NO: 1876451 - DNA, 21 bp, Homo sapiens
gagtttttcttacataatttg

SEQ ID NO: 1876452 - DNA, 18 bp, Homo sapiens
gataatggataatcttcg

SEQ ID NO: 1876453 - DNA, 22 bp, Homo sapiens
gatagcatttttgatttatgca

SEQ ID NO: 1876454 - DNA, 23 bp, Homo sapiens
gatataatcttggcttcttaaaa

SEQ ID NO: 1876455 - DNA, 16 bp, Homo sapiens
gatattttcccttttt

SEQ ID NO: 1876456 - DNA, 13 bp, Homo sapiens
gatcacatctaaa

SEQ ID NO: 1876457 - DNA, 15 bp, Homo sapiens
gatcagatgctgaat

SEQ ID NO: 1876458 - DNA, 16 bp, Homo sapiens
gatcagatgctgaatt

SEQ ID NO: 1876459 - DNA, 20 bp, Homo sapiens
gatcagctattcccttctga

SEQ ID NO: 1876460 - DNA, 22 bp, Homo sapiens
gatcccagcacctattgaatta

SEQ ID NO: 1876461 - DNA, 15 bp, Homo sapiens
gatctgtactttgtg

SEQ ID NO: 1876462 - DNA, 16 bp, Homo sapiens
gatctttaaatacagt

SEQ ID NO: 1876463 - DNA, 17 bp, Homo sapiens
gatctttgtttaaatgc

SEQ ID NO: 1876464 - DNA, 19 bp, Homo sapiens
gatctttgtttaaatgcca

SEQ ID NO: 1876465 - DNA, 14 bp, Homo sapiens
gatgaaaagccata

SEQ ID NO: 1876466 - DNA, 13 bp, Homo sapiens
gatgacggccagg

SEQ ID NO: 1876467 - DNA, 14 bp, Homo sapiens
gatgacggccaggc

SEQ ID NO: 1876468 - DNA, 21 bp, Homo sapiens
gatgacggccaggctccctga

SEQ ID NO: 1876469 - DNA, 16 bp, Homo sapiens
gatggaaacgcactta

SEQ ID NO: 1876470 - DNA, 19 bp, Homo sapiens
gatggaaacgcacttacaa

SEQ ID NO: 1876471 - DNA, 23 bp, Homo sapiens
gatggagactggtcctgtgtgca

SEQ ID NO: 1876472 - DNA, 13 bp, Homo sapiens
gatggcctctggg

SEQ ID NO: 1876473 - DNA, 21 bp, Homo sapiens
gatggcctctggggcaggacc

SEQ ID NO: 1876474 - DNA, 20 bp, Homo sapiens
gatgttacaagtttgctaaa

SEQ ID NO: 1876475 - DNA, 19 bp, Homo sapiens
gattaaacagcaaagccat

SEQ ID NO: 1876476 - DNA, 21 bp, Homo sapiens
gattaaacagcaaagccatat

SEQ ID NO: 1876477 - DNA, 13 bp, Homo sapiens
gattacaataaat

SEQ ID NO: 1876478 - DNA, 20 bp, Homo sapiens
gattagggaaaatggatata

SEQ ID NO: 1876479 - DNA, 20 bp, Homo sapiens
gattcagatttctctttgaa

SEQ ID NO: 1876480 - DNA, 22 bp, Homo sapiens
gattgcaaatattggttagtat

SEQ ID NO: 1876481 - DNA, 12 bp, Homo sapiens
gattgtaaaata

SEQ ID NO: 1876482 - DNA, 23 bp, Homo sapiens
gattgtaaaatagcttgtatagt

SEQ ID NO: 1876483 - DNA, 11 bp, Homo sapiens
gattgtttaaa

SEQ ID NO: 1876484 - DNA, 15 bp, Homo sapiens
gatttagaactgtat

SEQ ID NO: 1876485 - DNA, 17 bp, Homo sapiens
gatttatagtttgtaca

SEQ ID NO: 1876486 - DNA, 14 bp, Homo sapiens
gatttcctcttgaa

SEQ ID NO: 1876487 - DNA, 16 bp, Homo sapiens
gatttctagtatctat

SEQ ID NO: 1876488 - DNA, 13 bp, Homo sapiens
gatttgaaaaact

SEQ ID NO: 1876489 - DNA, 14 bp, Homo sapiens
gatttgatctttgt

SEQ ID NO: 1876490 - DNA, 15 bp, Homo sapiens
gatttgatctttgtt

SEQ ID NO: 1876491 - DNA, 22 bp, Homo sapiens
gatttgatctttgtttaaatgc

SEQ ID NO: 1876492 - DNA, 16 bp, Homo sapiens
gcaaaagactaattta

SEQ ID NO: 1876493 - DNA, 21 bp, Homo sapiens
gcaaactgctttattttccct

SEQ ID NO: 1876494 - DNA, 11 bp, Homo sapiens
gcaaagccata

SEQ ID NO: 1876495 - DNA, 15 bp, Homo sapiens
gcaaagccatattct

SEQ ID NO: 1876496 - DNA, 20 bp, Homo sapiens
gcaaagccatattctaaatt

SEQ ID NO: 1876497 - DNA, 19 bp, Homo sapiens
gcaacattaccttgtcttt

SEQ ID NO: 1876498 - DNA, 16 bp, Homo sapiens
gcaaccgtggggaggc

SEQ ID NO: 1876499 - DNA, 16 bp, Homo sapiens
gcaactcgtgacagcc

SEQ ID NO: 1876500 - DNA, 17 bp, Homo sapiens
gcaactcgtgacagcct

SEQ ID NO: 1876501 - DNA, 22 bp, Homo sapiens
gcaactcgtgacagcctctgac

SEQ ID NO: 1876502 - DNA, 23 bp, Homo sapiens
gcaactcgtgacagcctctgact

SEQ ID NO: 1876503 - DNA, 12 bp, Homo sapiens
gcaagaattaaa

SEQ ID NO: 1876504 - DNA, 14 bp, Homo sapiens
gcaagaattaaaac

SEQ ID NO: 1876505 - DNA, 16 bp, Homo sapiens
gcaagaattaaaactg

SEQ ID NO: 1876506 - DNA, 17 bp, Homo sapiens
gcaagacagtggcacta

SEQ ID NO: 1876507 - DNA, 20 bp, Homo sapiens
gcaagacagtggcactaaaa

SEQ ID NO: 1876508 - DNA, 16 bp, Homo sapiens
gcaagagccaggggtg

SEQ ID NO: 1876509 - DNA, 14 bp, Homo sapiens
gcaatctataatat

SEQ ID NO: 1876510 - DNA, 13 bp, Homo sapiens
gcaatgccctgcc

SEQ ID NO: 1876511 - DNA, 23 bp, Homo sapiens
gcaatgccctgccttgctgcctt

SEQ ID NO: 1876512 - DNA, 13 bp, Homo sapiens
gcacaagaaggcc

SEQ ID NO: 1876513 - DNA, 15 bp, Homo sapiens
gcacaagaaggccag

SEQ ID NO: 1876514 - DNA, 15 bp, Homo sapiens
gcacagtaatatgaa

SEQ ID NO: 1876515 - DNA, 21 bp, Homo sapiens
gcacagtaatatgaaagccac

SEQ ID NO: 1876516 - DNA, 22 bp, Homo sapiens
gcaccattttcaatttggagca

SEQ ID NO: 1876517 - DNA, 17 bp, Homo sapiens
gcacgcatgtccctcca

SEQ ID NO: 1876518 - DNA, 22 bp, Homo sapiens
gcactaaagtatgtaaagtatg

SEQ ID NO: 1876519 - DNA, 13 bp, Homo sapiens
gcactagagtcac

SEQ ID NO: 1876520 - DNA, 13 bp, Homo sapiens
gcactgacagcct

SEQ ID NO: 1876521 - DNA, 14 bp, Homo sapiens
gcactgacagcctg

SEQ ID NO: 1876522 - DNA, 17 bp, Homo sapiens
gcactgacagcctgggg

SEQ ID NO: 1876523 - DNA, 21 bp, Homo sapiens
gcactgccaccagcaatgccc

SEQ ID NO: 1876524 - DNA, 22 bp, Homo sapiens
gcactgccaccagcaatgccct

SEQ ID NO: 1876525 - DNA, 19 bp, Homo sapiens
gcactgtggcactgccacc

SEQ ID NO: 1876526 - DNA, 19 bp, Homo sapiens
gtatcattaaaatatatgt

SEQ ID NO: 1876527 - DNA, 14 bp, Homo sapiens
gtatcttagagttt

SEQ ID NO: 1876528 - DNA, 15 bp, Homo sapiens
gtatcttagagttta

SEQ ID NO: 1876529 - DNA, 19 bp, Homo sapiens
gtatcttagagtttacagt

SEQ ID NO: 1876530 - DNA, 13 bp, Homo sapiens
gtatgtataaatt

SEQ ID NO: 1876531 - DNA, 15 bp, Homo sapiens
gtatgtatataatca

SEQ ID NO: 1876532 - DNA, 16 bp, Homo sapiens
gtatgtccttcagctg

SEQ ID NO: 1876533 - DNA, 14 bp, Homo sapiens
gtattcagaaatta

SEQ ID NO: 1876534 - DNA, 21 bp, Homo sapiens
gtatttaactacatctgcctc

SEQ ID NO: 1876535 - DNA, 19 bp, Homo sapiens
gtatttagactgtggccat

SEQ ID NO: 1876536 - DNA, 19 bp, Homo sapiens
gtatttctttgtagaataa

SEQ ID NO: 1876537 - DNA, 21 bp, Homo sapiens
gtatttctttgtagaataaat

SEQ ID NO: 1876538 - DNA, 12 bp, Homo sapiens
gtattttccagc

SEQ ID NO: 1876539 - DNA, 21 bp, Homo sapiens
gtattttccagccttatgtgt

SEQ ID NO: 1876540 - DNA, 14 bp, Homo sapiens
gtattttggagaaa

SEQ ID NO: 1876541 - DNA, 17 bp, Homo sapiens
gtattttggagaaatta

SEQ ID NO: 1876542 - DNA, 13 bp, Homo sapiens
gtatttttgaaag

SEQ ID NO: 1876543 - DNA, 20 bp, Homo sapiens
gtatttttgaaagaattcta

SEQ ID NO: 1876544 - DNA, 14 bp, Homo sapiens
gtcaaatgaacttt

SEQ ID NO: 1876545 - DNA, 18 bp, Homo sapiens
gtcaaatgaacttttaca

SEQ ID NO: 1876546 - DNA, 20 bp, Homo sapiens
gtcaaatgaacttttacaga

SEQ ID NO: 1876547 - DNA, 12 bp, Homo sapiens
gtcaagaaaagc

SEQ ID NO: 1876548 - DNA, 15 bp, Homo sapiens
gtcaagtaataaaaa

SEQ ID NO: 1876549 - DNA, 13 bp, Homo sapiens
gtcaataactctg

SEQ ID NO: 1876550 - DNA, 17 bp, Homo sapiens
gtcaataactctgattt

SEQ ID NO: 1876551 - DNA, 14 bp, Homo sapiens
gtcacccccccagg

SEQ ID NO: 1876552 - DNA, 13 bp, Homo sapiens
gtcacctacagga

SEQ ID NO: 1876553 - DNA, 17 bp, Homo sapiens
gtcacctacaggactgg

SEQ ID NO: 1876554 - DNA, 20 bp, Homo sapiens
gtcagacatccatgtttgta

SEQ ID NO: 1876555 - DNA, 17 bp, Homo sapiens
gtcatcacttttcagtg

SEQ ID NO: 1876556 - DNA, 21 bp, Homo sapiens
gtccagagggactggacagcc

SEQ ID NO: 1876557 - DNA, 18 bp, Homo sapiens
gtcccagcctctggggca

SEQ ID NO: 1876558 - DNA, 16 bp, Homo sapiens
gtcccgcttagttctt

SEQ ID NO: 1876559 - DNA, 22 bp, Homo sapiens
gtcccgcttagttcttgaattg

SEQ ID NO: 1876560 - DNA, 15 bp, Homo sapiens
gtccctccaaggctg

SEQ ID NO: 1876561 - DNA, 21 bp, Homo sapiens
gtccctccaaggctgtcttct

SEQ ID NO: 1876562 - DNA, 20 bp, Homo sapiens
gtcgagcactctaattagag

SEQ ID NO: 1876563 - DNA, 17 bp, Homo sapiens
gtcggctgtgaggcggg

SEQ ID NO: 1876564 - DNA, 15 bp, Homo sapiens
gtctcatgcccactc

SEQ ID NO: 1876565 - DNA, 23 bp, Homo sapiens
gtctcccgcttggggcatttgtg

SEQ ID NO: 1876566 - DNA, 22 bp, Homo sapiens
gtctgaaaggctatcctgctga

SEQ ID NO: 1876567 - DNA, 21 bp, Homo sapiens
gtctgcatcagctttttgtat

SEQ ID NO: 1876568 - DNA, 16 bp, Homo sapiens
gtctggttttaacaat

SEQ ID NO: 1876569 - DNA, 18 bp, Homo sapiens
gtctggttttaacaattt

SEQ ID NO: 1876570 - DNA, 16 bp, Homo sapiens
gtctgtctgctcttat

SEQ ID NO: 1876571 - DNA, 14 bp, Homo sapiens
gtctgtgtgctgta

SEQ ID NO: 1876572 - DNA, 19 bp, Homo sapiens
gtcttaactgtatttcagt

SEQ ID NO: 1876573 - DNA, 15 bp, Homo sapiens
gtcttctcccagagc

SEQ ID NO: 1876574 - DNA, 17 bp, Homo sapiens
gtcttctcccagagcac

SEQ ID NO: 1876575 - DNA, 21 bp, Homo sapiens
gtctttcaggaccttttgaag

SEQ ID NO: 1876576 - DNA, 22 bp, Homo sapiens
gtctttttctttttttggtaaa

SEQ ID NO: 1876577 - DNA, 18 bp, Homo sapiens
gtcttttttttttccaaa

SEQ ID NO: 1876578 - DNA, 13 bp, Homo sapiens
gtgaaacagagaa

SEQ ID NO: 1876579 - DNA, 16 bp, Homo sapiens
gtgaaacagagaaaga

SEQ ID NO: 1876580 - DNA, 17 bp, Homo sapiens
gtgaaacagagaaagaa

SEQ ID NO: 1876581 - DNA, 19 bp, Homo sapiens
gtgaaacagagaaagaaaa

SEQ ID NO: 1876582 - DNA, 17 bp, Homo sapiens
gtgaaacgtaattgtac

SEQ ID NO: 1876583 - DNA, 19 bp, Homo sapiens
gtgaaacgtaattgtacaa

SEQ ID NO: 1876584 - DNA, 14 bp, Homo sapiens
gtgaataatgattt

SEQ ID NO: 1876585 - DNA, 19 bp, Homo sapiens
gtgaatttcttcactgttg

SEQ ID NO: 1876586 - DNA, 18 bp, Homo sapiens
gtgacataattgtccagt

SEQ ID NO: 1876587 - DNA, 13 bp, Homo sapiens
gtgacattcactg

SEQ ID NO: 1876588 - DNA, 15 bp, Homo sapiens
gtgagcaagagccag

SEQ ID NO: 1876589 - DNA, 21 bp, Homo sapiens
gtgagcaagagccaggggtgt

SEQ ID NO: 1876590 - DNA, 15 bp, Homo sapiens
gtgagtgccatgctt

SEQ ID NO: 1876591 - DNA, 21 bp, Homo sapiens
gtgagttttactcttaaatca

SEQ ID NO: 1876592 - DNA, 14 bp, Homo sapiens
gtgccttttatagc

SEQ ID NO: 1876593 - DNA, 19 bp, Homo sapiens
gtgctgcttacactccagg

SEQ ID NO: 1876594 - DNA, 12 bp, Homo sapiens
gtgctgctttga

SEQ ID NO: 1876595 - DNA, 13 bp, Homo sapiens
gtgctgctttgat

SEQ ID NO: 1876596 - DNA, 17 bp, Homo sapiens
gtggaccggccgcagcc

SEQ ID NO: 1876597 - DNA, 19 bp, Homo sapiens
gtggaccggccgcagcccc

SEQ ID NO: 1876598 - DNA, 12 bp, Homo sapiens
gtggcactaaaa

SEQ ID NO: 1876599 - DNA, 18 bp, Homo sapiens
gtggcactgccaccagca

SEQ ID NO: 1876600 - DNA, 17 bp, Homo sapiens
gtggccatatatgctgt

SEQ ID NO: 1876601 - DNA, 21 bp, Homo sapiens
gtggccatatatgctgtattt

SEQ ID NO: 1876602 - DNA, 22 bp, Homo sapiens
gtggcctgtgagcaagagccag

SEQ ID NO: 1876603 - DNA, 23 bp, Homo sapiens
gtggctggggggatgacggccag

SEQ ID NO: 1876604 - DNA, 13 bp, Homo sapiens
gtggggaggccat

SEQ ID NO: 1876605 - DNA, 22 bp, Homo sapiens
gtggggaggccatttgctgccc

SEQ ID NO: 1876606 - DNA, 23 bp, Homo sapiens
gtggggaggccatttgctgccct

SEQ ID NO: 1876607 - DNA, 19 bp, Homo sapiens
gtggggcagcagctgcctc

SEQ ID NO: 1876608 - DNA, 14 bp, Homo sapiens
gtgtatcattaaaa

SEQ ID NO: 1876609 - DNA, 16 bp, Homo sapiens
gtgtcccagtcccagc

SEQ ID NO: 1876610 - DNA, 15 bp, Homo sapiens
gtgtcggctgtgagg

SEQ ID NO: 1876611 - DNA, 19 bp, Homo sapiens
gtgtctccaggtaactttg

SEQ ID NO: 1876612 - DNA, 22 bp, Homo sapiens
gtgtgatgaactttctcttcat

SEQ ID NO: 1876613 - DNA, 21 bp, Homo sapiens
gtgtgccatagagtttaacac

SEQ ID NO: 1876614 - DNA, 16 bp, Homo sapiens
gtgtgttatattccaa

SEQ ID NO: 1876615 - DNA, 18 bp, Homo sapiens
gtgtgttatattccaagg

SEQ ID NO: 1876616 - DNA, 13 bp, Homo sapiens
gtgttatattcca

SEQ ID NO: 1876617 - DNA, 16 bp, Homo sapiens
gtgttggctttacaaa

SEQ ID NO: 1876618 - DNA, 19 bp, Homo sapiens
gtgttttaaaaaaactgaa

SEQ ID NO: 1876619 - DNA, 14 bp, Homo sapiens
gttaaatcatttgg

SEQ ID NO: 1876620 - DNA, 15 bp, Homo sapiens
gttacaagtttgcta

SEQ ID NO: 1876621 - DNA, 16 bp, Homo sapiens
gttacaagtttgctaa

SEQ ID NO: 1876622 - DNA, 20 bp, Homo sapiens
gttacaagtttgctaaaaga

SEQ ID NO: 1876623 - DNA, 19 bp, Homo sapiens
gttaccaagtatgaagtat

SEQ ID NO: 1876624 - DNA, 17 bp, Homo sapiens
gttatattccaaggaaa

SEQ ID NO: 1876625 - DNA, 23 bp, Homo sapiens
gttatattccaaggaaaattgaa

SEQ ID NO: 1876626 - DNA, 17 bp, Homo sapiens
gttattaaaaaaacaca

SEQ ID NO: 1876627 - DNA, 17 bp, Homo sapiens
gttattgtacagctgtt

SEQ ID NO: 1876628 - DNA, 14 bp, Homo sapiens
gttattttcagtat

SEQ ID NO: 1876629 - DNA, 12 bp, Homo sapiens
gttcaaggacta

SEQ ID NO: 1876630 - DNA, 18 bp, Homo sapiens
gttcactaaactctgaat

SEQ ID NO: 1876631 - DNA, 21 bp, Homo sapiens
gttcagtgtcgggaattttcc

SEQ ID NO: 1876632 - DNA, 20 bp, Homo sapiens
gttcagtttttttttttcca

SEQ ID NO: 1876633 - DNA, 21 bp, Homo sapiens
gttcagtttttttttttccag

SEQ ID NO: 1876634 - DNA, 23 bp, Homo sapiens
gttcctcgggatgaaaagccata

SEQ ID NO: 1876635 - DNA, 13 bp, Homo sapiens
gttcgtagctttc

SEQ ID NO: 1876636 - DNA, 18 bp, Homo sapiens
gttctataataagttttg

SEQ ID NO: 1876637 - DNA, 21 bp, Homo sapiens
gttctatggagactttgctgt

SEQ ID NO: 1876638 - DNA, 17 bp, Homo sapiens
gttctgcaagaattaaa

SEQ ID NO: 1876639 - DNA, 20 bp, Homo sapiens
gttctgcaagaattaaaact

SEQ ID NO: 1876640 - DNA, 22 bp, Homo sapiens
gttctgcaagaattaaaactga

SEQ ID NO: 1876641 - DNA, 13 bp, Homo sapiens
gttcttgaattgt

SEQ ID NO: 1876642 - DNA, 13 bp, Homo sapiens
tatatgtgagaaa

SEQ ID NO: 1876643 - DNA, 14 bp, Homo sapiens
tatatgtgagaaat

SEQ ID NO: 1876644 - DNA, 20 bp, Homo sapiens
tatatgttctgcaagaatta

SEQ ID NO: 1876645 - DNA, 13 bp, Homo sapiens
tatattaaatgag

SEQ ID NO: 1876646 - DNA, 16 bp, Homo sapiens
tatatttagttacgta

SEQ ID NO: 1876647 - DNA, 22 bp, Homo sapiens
tatatttagttacgtataatgc

SEQ ID NO: 1876648 - DNA, 16 bp, Homo sapiens
tatatttagttatagt

SEQ ID NO: 1876649 - DNA, 23 bp, Homo sapiens
tatcaggatttcctcttgaacca

SEQ ID NO: 1876650 - DNA, 15 bp, Homo sapiens
tatcatattggtatt

SEQ ID NO: 1876651 - DNA, 13 bp, Homo sapiens
tatcatgacatgt

SEQ ID NO: 1876652 - DNA, 14 bp, Homo sapiens
tatcatgacatgtt

SEQ ID NO: 1876653 - DNA, 13 bp, Homo sapiens
tatcattaaaata

SEQ ID NO: 1876654 - DNA, 16 bp, Homo sapiens
tatcatttttgtataa

SEQ ID NO: 1876655 - DNA, 21 bp, Homo sapiens
tatcccccccctgtatagtta

SEQ ID NO: 1876656 - DNA, 21 bp, Homo sapiens
tatctagcatttatttctctg

SEQ ID NO: 1876657 - DNA, 15 bp, Homo sapiens
tatctatacctgcct

SEQ ID NO: 1876658 - DNA, 23 bp, Homo sapiens
tatctatacctgccttttaagtt

SEQ ID NO: 1876659 - DNA, 12 bp, Homo sapiens
tatctattgtgt

SEQ ID NO: 1876660 - DNA, 14 bp, Homo sapiens
tatctcaaattgta

SEQ ID NO: 1876661 - DNA, 15 bp, Homo sapiens
tatctgtttgtatat

SEQ ID NO: 1876662 - DNA, 20 bp, Homo sapiens
tatctgtttgtatatttgca

SEQ ID NO: 1876663 - DNA, 15 bp, Homo sapiens
tatcttgttattaat

SEQ ID NO: 1876664 - DNA, 14 bp, Homo sapiens
tatctttgtctaaa

SEQ ID NO: 1876665 - DNA, 17 bp, Homo sapiens
tatctttgtctaaacaa

SEQ ID NO: 1876666 - DNA, 15 bp, Homo sapiens
tatcttttcaaccag

SEQ ID NO: 1876667 - DNA, 16 bp, Homo sapiens
tatgaagtataaatct

SEQ ID NO: 1876668 - DNA, 18 bp, Homo sapiens
tatgagactgtgtttcta

SEQ ID NO: 1876669 - DNA, 17 bp, Homo sapiens
tatgattggttcagttt

SEQ ID NO: 1876670 - DNA, 18 bp, Homo sapiens
tatgatttatagtttgta

SEQ ID NO: 1876671 - DNA, 15 bp, Homo sapiens
tatgcaaaaacatat

SEQ ID NO: 1876672 - DNA, 22 bp, Homo sapiens
tatgcaaaaacatatgtctgtc

SEQ ID NO: 1876673 - DNA, 16 bp, Homo sapiens
tatgcaaggggaaacc

SEQ ID NO: 1876674 - DNA, 19 bp, Homo sapiens
tatgcaaggggaaacctgt

SEQ ID NO: 1876675 - DNA, 19 bp, Homo sapiens
tatgctgtatttctttgta

SEQ ID NO: 1876676 - DNA, 15 bp, Homo sapiens
tatggaacttctaat

SEQ ID NO: 1876677 - DNA, 21 bp, Homo sapiens
tatgtatctttggggaaacta

SEQ ID NO: 1876678 - DNA, 18 bp, Homo sapiens
tatgtctgtctttgcaaa

SEQ ID NO: 1876679 - DNA, 22 bp, Homo sapiens
tattaaaaatatggaacttcta

SEQ ID NO: 1876680 - DNA, 19 bp, Homo sapiens
tattaaaatgattgtaaaa

SEQ ID NO: 1876681 - DNA, 16 bp, Homo sapiens
tattaacaaagttact

SEQ ID NO: 1876682 - DNA, 16 bp, Homo sapiens
tattaatgtttcttct

SEQ ID NO: 1876683 - DNA, 23 bp, Homo sapiens
tattactgtctggttttaacaat

SEQ ID NO: 1876684 - DNA, 13 bp, Homo sapiens
tattataattgtt

SEQ ID NO: 1876685 - DNA, 14 bp, Homo sapiens
tattattaatgctt

SEQ ID NO: 1876686 - DNA, 15 bp, Homo sapiens
tattattaatgcttt

SEQ ID NO: 1876687 - DNA, 18 bp, Homo sapiens
tattatttttttaaacaa

SEQ ID NO: 1876688 - DNA, 21 bp, Homo sapiens
tattcaaggctttaaaagtca

SEQ ID NO: 1876689 - DNA, 18 bp, Homo sapiens
tattcagaaattaaaata

SEQ ID NO: 1876690 - DNA, 13 bp, Homo sapiens
tattccaaggaaa

SEQ ID NO: 1876691 - DNA, 20 bp, Homo sapiens
tattcctcttgcatttcact

SEQ ID NO: 1876692 - DNA, 19 bp, Homo sapiens
tattctaaattcactgttg

SEQ ID NO: 1876693 - DNA, 17 bp, Homo sapiens
tattctgtggttctata

SEQ ID NO: 1876694 - DNA, 12 bp, Homo sapiens
tattcttttgtt

SEQ ID NO: 1876695 - DNA, 15 bp, Homo sapiens
tattgctaaaagtgc

SEQ ID NO: 1876696 - DNA, 22 bp, Homo sapiens
tattgctaaaagtgcatttaag

SEQ ID NO: 1876697 - DNA, 16 bp, Homo sapiens
tattgctcttaaaaat

SEQ ID NO: 1876698 - DNA, 18 bp, Homo sapiens
tattggtcaagaaaagca

SEQ ID NO: 1876699 - DNA, 14 bp, Homo sapiens
tatttaaaaaatta

SEQ ID NO: 1876700 - DNA, 21 bp, Homo sapiens
tatttaaaaaattaaaaatga

SEQ ID NO: 1876701 - DNA, 13 bp, Homo sapiens
tatttaactacat

SEQ ID NO: 1876702 - DNA, 18 bp, Homo sapiens
tatttaactacatctgcc

SEQ ID NO: 1876703 - DNA, 22 bp, Homo sapiens
tatttaagaaagggaaagctgt

SEQ ID NO: 1876704 - DNA, 19 bp, Homo sapiens
tatttaagtactatctttg

SEQ ID NO: 1876705 - DNA, 16 bp, Homo sapiens
tatttacaacctagaa

SEQ ID NO: 1876706 - DNA, 13 bp, Homo sapiens
tatttagttacgt

SEQ ID NO: 1876707 - DNA, 22 bp, Homo sapiens
tatttagttacgtataatgctt

SEQ ID NO: 1876708 - DNA, 15 bp, Homo sapiens
tatttagttatagtt

SEQ ID NO: 1876709 - DNA, 18 bp, Homo sapiens
tatttcagtattttccag

SEQ ID NO: 1876710 - DNA, 20 bp, Homo sapiens
tatttctctggcaaactttt

SEQ ID NO: 1876711 - DNA, 13 bp, Homo sapiens
tatttctttgtag

SEQ ID NO: 1876712 - DNA, 17 bp, Homo sapiens
tatttctttgtagaata

SEQ ID NO: 1876713 - DNA, 19 bp, Homo sapiens
tattttaaacaaaatagaa

SEQ ID NO: 1876714 - DNA, 19 bp, Homo sapiens
tattttaagaaagagaatg

SEQ ID NO: 1876715 - DNA, 20 bp, Homo sapiens
tattttaagaaagagaatga

SEQ ID NO: 1876716 - DNA, 19 bp, Homo sapiens
tattttcacagatggaaga

SEQ ID NO: 1876717 - DNA, 23 bp, Homo sapiens
tattttcacagatggaagaagtt

SEQ ID NO: 1876718 - DNA, 14 bp, Homo sapiens
tattttcattgtga

SEQ ID NO: 1876719 - DNA, 20 bp, Homo sapiens
tattttccctacttgcagcg

SEQ ID NO: 1876720 - DNA, 20 bp, Homo sapiens
tattttccctttttaaaaaa

SEQ ID NO: 1876721 - DNA, 21 bp, Homo sapiens
tattttctctgatactttttt

SEQ ID NO: 1876722 - DNA, 23 bp, Homo sapiens
tattttgctggagactatttaag

SEQ ID NO: 1876723 - DNA, 18 bp, Homo sapiens
tatttttttaaacaaaat

SEQ ID NO: 1876724 - DNA, 21 bp, Homo sapiens
tcaaaaaaaaaaaaaaagact

SEQ ID NO: 1876725 - DNA, 18 bp, Homo sapiens
tcaaaataaaaattaaat

SEQ ID NO: 1876726 - DNA, 20 bp, Homo sapiens
tcaaaccttaagataatgga

SEQ ID NO: 1876727 - DNA, 19 bp, Homo sapiens
tcaaagaaatgctgatgga

SEQ ID NO: 1876728 - DNA, 17 bp, Homo sapiens
tcaaagatgatggaaac

SEQ ID NO: 1876729 - DNA, 16 bp, Homo sapiens
tcaaatctccagtatt

SEQ ID NO: 1876730 - DNA, 16 bp, Homo sapiens
tcaaattgtaattaat

SEQ ID NO: 1876731 - DNA, 21 bp, Homo sapiens
tcaacatggctacttgctttg

SEQ ID NO: 1876732 - DNA, 22 bp, Homo sapiens
tcaagaaaagcatgaaaactga

SEQ ID NO: 1876733 - DNA, 16 bp, Homo sapiens
tcaaggctttaaaagt

SEQ ID NO: 1876734 - DNA, 13 bp, Homo sapiens
tcaataactctga

SEQ ID NO: 1876735 - DNA, 23 bp, Homo sapiens
tcaatttggagcattaactaaat

SEQ ID NO: 1876736 - DNA, 20 bp, Homo sapiens
tcacaaattccgattagacc

SEQ ID NO: 1876737 - DNA, 12 bp, Homo sapiens
tcacagttctgt

SEQ ID NO: 1876738 - DNA, 15 bp, Homo sapiens
tcacatctaaagctt

SEQ ID NO: 1876739 - DNA, 19 bp, Homo sapiens
tcacatctaaagctttatc

SEQ ID NO: 1876740 - DNA, 21 bp, Homo sapiens
tcaccacgatgacgcctctgg

SEQ ID NO: 1876741 - DNA, 14 bp, Homo sapiens
tcacccccccaggc

SEQ ID NO: 1876742 - DNA, 15 bp, Homo sapiens
tcacccccccaggcc

SEQ ID NO: 1876743 - DNA, 17 bp, Homo sapiens
tcacccccccaggcctc

SEQ ID NO: 1876744 - DNA, 20 bp, Homo sapiens
tcacccccccaggcctccag

SEQ ID NO: 1876745 - DNA, 14 bp, Homo sapiens
tcaccctgggcagt

SEQ ID NO: 1876746 - DNA, 15 bp, Homo sapiens
tcacctacaggactg

SEQ ID NO: 1876747 - DNA, 18 bp, Homo sapiens
tcacctacaggactgggc

SEQ ID NO: 1876748 - DNA, 13 bp, Homo sapiens
tcactaaactctg

SEQ ID NO: 1876749 - DNA, 13 bp, Homo sapiens
tcactaaacttta

SEQ ID NO: 1876750 - DNA, 17 bp, Homo sapiens
tcactcaggaaccctgg

SEQ ID NO: 1876751 - DNA, 18 bp, Homo sapiens
tcactcaggaaccctgga

SEQ ID NO: 1876752 - DNA, 22 bp, Homo sapiens
tcactcatgcaaactgctttat

SEQ ID NO: 1876753 - DNA, 15 bp, Homo sapiens
tcactggtatacaca

SEQ ID NO: 1876754 - DNA, 19 bp, Homo sapiens
tcactgttgaaaattattt

SEQ ID NO: 1876755 - DNA, 13 bp, Homo sapiens
tcacttttcagtg

SEQ ID NO: 1876756 - DNA, 12 bp, Homo sapiens
tcagaacaactt

SEQ ID NO: 1876757 - DNA, 20 bp, Homo sapiens
tcagaacaacttgctactta

SEQ ID NO: 1876758 - DNA, 19 bp, Homo sapiens
tgccctggggcatcatggg

SEQ ID NO: 1876759 - DNA, 17 bp, Homo sapiens
tgcctcctgtgcctccc

SEQ ID NO: 1876760 - DNA, 15 bp, Homo sapiens
tgcctgtaattaaac

SEQ ID NO: 1876761 - DNA, 13 bp, Homo sapiens
tgccttcaccctg

SEQ ID NO: 1876762 - DNA, 16 bp, Homo sapiens
tgccttgctgccttca

SEQ ID NO: 1876763 - DNA, 21 bp, Homo sapiens
tgccttgctgccttcaccctg

SEQ ID NO: 1876764 - DNA, 13 bp, Homo sapiens
tgccttttaagtt

SEQ ID NO: 1876765 - DNA, 22 bp, Homo sapiens
tgccttttatagctattactgt

SEQ ID NO: 1876766 - DNA, 18 bp, Homo sapiens
tgccttttttagcttcat

SEQ ID NO: 1876767 - DNA, 19 bp, Homo sapiens
tgcgaggttgttttaaagt

SEQ ID NO: 1876768 - DNA, 11 bp, Homo sapiens
tgctaaaagaa

SEQ ID NO: 1876769 - DNA, 12 bp, Homo sapiens
tgctaaaagaag

SEQ ID NO: 1876770 - DNA, 12 bp, Homo sapiens
tgctaaaagtgc

SEQ ID NO: 1876771 - DNA, 22 bp, Homo sapiens
tgctaatatactttttttgtta

SEQ ID NO: 1876772 - DNA, 21 bp, Homo sapiens
tgctacttatcatttttgtat

SEQ ID NO: 1876773 - DNA, 19 bp, Homo sapiens
tgctcatacacagttaaat

SEQ ID NO: 1876774 - DNA, 22 bp, Homo sapiens
tgctcatacacagttaaataaa

SEQ ID NO: 1876775 - DNA, 16 bp, Homo sapiens
tgctcattaaactgat

SEQ ID NO: 1876776 - DNA, 23 bp, Homo sapiens
tgctcattaaactgattccagga

SEQ ID NO: 1876777 - DNA, 13 bp, Homo sapiens
tgctctagaaagt

SEQ ID NO: 1876778 - DNA, 21 bp, Homo sapiens
tgctcttatttttgtaccata

SEQ ID NO: 1876779 - DNA, 21 bp, Homo sapiens
tgctgaaagtcctgctttcct

SEQ ID NO: 1876780 - DNA, 23 bp, Homo sapiens
tgctgaggttttgaataaaaagt

SEQ ID NO: 1876781 - DNA, 12 bp, Homo sapiens
tgctgccctggg

SEQ ID NO: 1876782 - DNA, 13 bp, Homo sapiens
tgctgccctgggg

SEQ ID NO: 1876783 - DNA, 16 bp, Homo sapiens
tgctgccctggggcat

SEQ ID NO: 1876784 - DNA, 16 bp, Homo sapiens
tgctgccttcaccctg

SEQ ID NO: 1876785 - DNA, 14 bp, Homo sapiens
tgctgctttgatat

SEQ ID NO: 1876786 - DNA, 17 bp, Homo sapiens
tgctgtatttctttgta

SEQ ID NO: 1876787 - DNA, 16 bp, Homo sapiens
tgcttagatgttccaa

SEQ ID NO: 1876788 - DNA, 23 bp, Homo sapiens
tgcttcctgattaccagtctgat

SEQ ID NO: 1876789 - DNA, 15 bp, Homo sapiens
tgcttctctttgtgc

SEQ ID NO: 1876790 - DNA, 17 bp, Homo sapiens
tgcttctctttgtgcag

SEQ ID NO: 1876791 - DNA, 18 bp, Homo sapiens
tgcttctctttgtgcagt

SEQ ID NO: 1876792 - DNA, 14 bp, Homo sapiens
tgcttgattaaaca

SEQ ID NO: 1876793 - DNA, 15 bp, Homo sapiens
tgctttattttccct

SEQ ID NO: 1876794 - DNA, 13 bp, Homo sapiens
tgctttttggtga

SEQ ID NO: 1876795 - DNA, 15 bp, Homo sapiens
tggaaaaatgcccat

SEQ ID NO: 1876796 - DNA, 14 bp, Homo sapiens
tggaaacgcactta

SEQ ID NO: 1876797 - DNA, 14 bp, Homo sapiens
tggaacttctaata

SEQ ID NO: 1876798 - DNA, 18 bp, Homo sapiens
tggacacctacagcagca

SEQ ID NO: 1876799 - DNA, 14 bp, Homo sapiens
tggacagccagggc

SEQ ID NO: 1876800 - DNA, 17 bp, Homo sapiens
tggagaaaaattacaga

SEQ ID NO: 1876801 - DNA, 21 bp, Homo sapiens
tggagaaaaattacagatcat

SEQ ID NO: 1876802 - DNA, 17 bp, Homo sapiens
tggagaaattatttaat

SEQ ID NO: 1876803 - DNA, 19 bp, Homo sapiens
tggagaaattatttaataa

SEQ ID NO: 1876804 - DNA, 16 bp, Homo sapiens
tggagactatttaagt

SEQ ID NO: 1876805 - DNA, 17 bp, Homo sapiens
tggaggaaccacatata

SEQ ID NO: 1876806 - DNA, 22 bp, Homo sapiens
tggaggaaccacatataacact

SEQ ID NO: 1876807 - DNA, 14 bp, Homo sapiens
tggaggtgacctgt

SEQ ID NO: 1876808 - DNA, 18 bp, Homo sapiens
tggaggtgacctgttagg

SEQ ID NO: 1876809 - DNA, 14 bp, Homo sapiens
tggagtgctgcagc

SEQ ID NO: 1876810 - DNA, 15 bp, Homo sapiens
tggagtgctgcagct

SEQ ID NO: 1876811 - DNA, 23 bp, Homo sapiens
tggataatcttcggccaatttat

SEQ ID NO: 1876812 - DNA, 13 bp, Homo sapiens
tggatatagaaaa

SEQ ID NO: 1876813 - DNA, 14 bp, Homo sapiens
tggatgaaattttc

SEQ ID NO: 1876814 - DNA, 12 bp, Homo sapiens
tggatggcctct

SEQ ID NO: 1876815 - DNA, 16 bp, Homo sapiens
tggatggcctctgggg

SEQ ID NO: 1876816 - DNA, 15 bp, Homo sapiens
tggcaaacttttctt

SEQ ID NO: 1876817 - DNA, 15 bp, Homo sapiens
tggcaacagaagcag

SEQ ID NO: 1876818 - DNA, 19 bp, Homo sapiens
tggcaagaaagctggtaaa

SEQ ID NO: 1876819 - DNA, 13 bp, Homo sapiens
tggcactaaaatg

SEQ ID NO: 1876820 - DNA, 15 bp, Homo sapiens
tggcactgacagcct

SEQ ID NO: 1876821 - DNA, 17 bp, Homo sapiens
tggcactgacagcctgg

SEQ ID NO: 1876822 - DNA, 23 bp, Homo sapiens
tggcactgccaccagcaatgccc

SEQ ID NO: 1876823 - DNA, 16 bp, Homo sapiens
tggcactgtggcactg

SEQ ID NO: 1876824 - DNA, 19 bp, Homo sapiens
tggcactgtggcactgcca

SEQ ID NO: 1876825 - DNA, 22 bp, Homo sapiens
tggcactgtggcactgccacca

SEQ ID NO: 1876826 - DNA, 21 bp, Homo sapiens
tggcacttagctatcagaaga

SEQ ID NO: 1876827 - DNA, 15 bp, Homo sapiens
tggcagccaaggaat

SEQ ID NO: 1876828 - DNA, 16 bp, Homo sapiens
tggcagccaaggaatg

SEQ ID NO: 1876829 - DNA, 16 bp, Homo sapiens
tggcatcgcagcttcc

SEQ ID NO: 1876830 - DNA, 20 bp, Homo sapiens
tggccaaattatttgtgtaa

SEQ ID NO: 1876831 - DNA, 20 bp, Homo sapiens
tggcctctggggcaggacca

SEQ ID NO: 1876832 - DNA, 10 bp, Homo sapiens
tggcctgtga

SEQ ID NO: 1876833 - DNA, 12 bp, Homo sapiens
tggctctttgtg

SEQ ID NO: 1876834 - DNA, 13 bp, Homo sapiens
tggcttccctgcc

SEQ ID NO: 1876835 - DNA, 15 bp, Homo sapiens
tggcttcttaaaaac

SEQ ID NO: 1876836 - DNA, 16 bp, Homo sapiens
tggcttcttaaaaact

SEQ ID NO: 1876837 - DNA, 13 bp, Homo sapiens
tggcttgctgttt

SEQ ID NO: 1876838 - DNA, 14 bp, Homo sapiens
tggcttgctgttta

SEQ ID NO: 1876839 - DNA, 21 bp, Homo sapiens
tgggcaactcgtgacagcctc

SEQ ID NO: 1876840 - DNA, 15 bp, Homo sapiens
tgggccgggcccagg

SEQ ID NO: 1876841 - DNA, 17 bp, Homo sapiens
tgggcgcttcccacctg

SEQ ID NO: 1876842 - DNA, 17 bp, Homo sapiens
tggggaagaggttttat

SEQ ID NO: 1876843 - DNA, 16 bp, Homo sapiens
tggggattcagatttc

SEQ ID NO: 1876844 - DNA, 23 bp, Homo sapiens
tggggcagagcttgtagccctgg

SEQ ID NO: 1876845 - DNA, 12 bp, Homo sapiens
tggggcaggacc

SEQ ID NO: 1876846 - DNA, 15 bp, Homo sapiens
tggggcgctggacac

SEQ ID NO: 1876847 - DNA, 22 bp, Homo sapiens
tggggcgctggacacctacagc

SEQ ID NO: 1876848 - DNA, 12 bp, Homo sapiens
tggggctgccct

SEQ ID NO: 1876849 - DNA, 10 bp, Homo sapiens
tggtaattat

SEQ ID NO: 1876850 - DNA, 20 bp, Homo sapiens
tggtcctgtgtgcagtgaag

SEQ ID NO: 1876851 - DNA, 12 bp, Homo sapiens
tggtctcagaaa

SEQ ID NO: 1876852 - DNA, 18 bp, Homo sapiens
tggtgaaatttattagtt

SEQ ID NO: 1876853 - DNA, 19 bp, Homo sapiens
tggtgaaatttattagtta

SEQ ID NO: 1876854 - DNA, 17 bp, Homo sapiens
tggttagtatttaacta

SEQ ID NO: 1876855 - DNA, 23 bp, Homo sapiens
tggttcagtttttttttttccag

SEQ ID NO: 1876856 - DNA, 20 bp, Homo sapiens
tggttccaaaccagtttatt

SEQ ID NO: 1876857 - DNA, 17 bp, Homo sapiens
tggttgccttaaagaaa

SEQ ID NO: 1876858 - DNA, 12 bp, Homo sapiens
tggttttaacaa

SEQ ID NO: 1876859 - DNA, 16 bp, Homo sapiens
tgtaaaagttataata

SEQ ID NO: 1876860 - DNA, 21 bp, Homo sapiens
tgtaaaagttataataactga

SEQ ID NO: 1876861 - DNA, 22 bp, Homo sapiens
tgtaaaagttataataactgaa

SEQ ID NO: 1876862 - DNA, 18 bp, Homo sapiens
tgtaaaggtcacttttca

SEQ ID NO: 1876863 - DNA, 20 bp, Homo sapiens
tgtaacacagctgagagact

SEQ ID NO: 1876864 - DNA, 23 bp, Homo sapiens
tgtaacacagctgagagactttt

SEQ ID NO: 1876865 - DNA, 23 bp, Homo sapiens
tgtaagagagatgagcacttcta

SEQ ID NO: 1876866 - DNA, 14 bp, Homo sapiens
tgtaataaaccctt

SEQ ID NO: 1876867 - DNA, 18 bp, Homo sapiens
tgtaatctaagtatatgt

SEQ ID NO: 1876868 - DNA, 24 bp, Homo sapiens
tgtaatctaagtatatgtgagaaa

SEQ ID NO: 1876869 - DNA, 22 bp, Homo sapiens
tgtacattactgtatgtataaa

SEQ ID NO: 1876870 - DNA, 20 bp, Homo sapiens
tgtactataacatagaattg

SEQ ID NO: 1876871 - DNA, 14 bp, Homo sapiens
tgtacttaaatgag

SEQ ID NO: 1876872 - DNA, 19 bp, Homo sapiens
tgtacttttctggttccaa

SEQ ID NO: 1876873 - DNA, 21 bp, Homo sapiens
tgtacttttctggttccaaac

SEQ ID NO: 1876874 - DNA, 22 bp, Homo sapiens
tgtagccctggatggcctctgg

SEQ ID NO: 1876875 - DNA, 23 bp, Homo sapiens
ttgtaataaacccttaactggca

SEQ ID NO: 1876876 - DNA, 17 bp, Homo sapiens
ttgtaatttgaattggg

SEQ ID NO: 1876877 - DNA, 12 bp, Homo sapiens
ttgtaccatatt

SEQ ID NO: 1876878 - DNA, 13 bp, Homo sapiens
ttgtaccatattg

SEQ ID NO: 1876879 - DNA, 18 bp, Homo sapiens
ttgtaccatattgctctt

SEQ ID NO: 1876880 - DNA, 22 bp, Homo sapiens
ttgtacttttctggttccaaac

SEQ ID NO: 1876881 - DNA, 13 bp, Homo sapiens
ttgtataaaaagg

SEQ ID NO: 1876882 - DNA, 23 bp, Homo sapiens
ttgtataaaaaggaaattagtct

SEQ ID NO: 1876883 - DNA, 15 bp, Homo sapiens
ttgtatagtgtaaaa

SEQ ID NO: 1876884 - DNA, 13 bp, Homo sapiens
ttgtatatatctg

SEQ ID NO: 1876885 - DNA, 12 bp, Homo sapiens
ttgtattgcttc

SEQ ID NO: 1876886 - DNA, 14 bp, Homo sapiens
ttgtcctgtgtcta

SEQ ID NO: 1876887 - DNA, 13 bp, Homo sapiens
ttgtctgtctgct

SEQ ID NO: 1876888 - DNA, 15 bp, Homo sapiens
ttgtctgtgtgctgt

SEQ ID NO: 1876889 - DNA, 17 bp, Homo sapiens
ttgtctgtgtgctgtaa

SEQ ID NO: 1876890 - DNA, 17 bp, Homo sapiens
ttgtctttcaaaagaca

SEQ ID NO: 1876891 - DNA, 19 bp, Homo sapiens
ttgtgagaagatgggggct

SEQ ID NO: 1876892 - DNA, 15 bp, Homo sapiens
ttgtgtgttatattc

SEQ ID NO: 1876893 - DNA, 22 bp, Homo sapiens
ttgtgtgttcactaaactctga

SEQ ID NO: 1876894 - DNA, 18 bp, Homo sapiens
ttgtgttggctttacaaa

SEQ ID NO: 1876895 - DNA, 16 bp, Homo sapiens
ttgttatgaaaatcct

SEQ ID NO: 1876896 - DNA, 22 bp, Homo sapiens
ttgttatgaaaatcctatatct

SEQ ID NO: 1876897 - DNA, 17 bp, Homo sapiens
ttgttattaaaaaaaca

SEQ ID NO: 1876898 - DNA, 19 bp, Homo sapiens
ttgttcaacagtttctcaa

SEQ ID NO: 1876899 - DNA, 19 bp, Homo sapiens
ttgttttatcatgacatgt

SEQ ID NO: 1876900 - DNA, 13 bp, Homo sapiens
ttgtttttctgat

SEQ ID NO: 1876901 - DNA, 21 bp, Homo sapiens
tttaaaaaaactgaaggtttt

SEQ ID NO: 1876902 - DNA, 11 bp, Homo sapiens
tttaaaaaact

SEQ ID NO: 1876903 - DNA, 14 bp, Homo sapiens
tttaaaaaactttc

SEQ ID NO: 1876904 - DNA, 20 bp, Homo sapiens
tttaaaaaataactaccaag

SEQ ID NO: 1876905 - DNA, 14 bp, Homo sapiens
tttaaaaaatattt

SEQ ID NO: 1876906 - DNA, 18 bp, Homo sapiens
tttaaaaaatattttaag

SEQ ID NO: 1876907 - DNA, 12 bp, Homo sapiens
tttaaaaaatta

SEQ ID NO: 1876908 - DNA, 11 bp, Homo sapiens
tttaaaaggca

SEQ ID NO: 1876909 - DNA, 15 bp, Homo sapiens
tttaaaagtcacata

SEQ ID NO: 1876910 - DNA, 18 bp, Homo sapiens
tttaaaagtcattattcc

SEQ ID NO: 1876911 - DNA, 21 bp, Homo sapiens
tttaaaggtttctattttctc

SEQ ID NO: 1876912 - DNA, 16 bp, Homo sapiens
tttaaagtaaacttgt

SEQ ID NO: 1876913 - DNA, 18 bp, Homo sapiens
tttaaatgccaaaatgta

SEQ ID NO: 1876914 - DNA, 19 bp, Homo sapiens
tttaacacaagtcctgtga

SEQ ID NO: 1876915 - DNA, 21 bp, Homo sapiens
tttaagaaagagaatgaactg

SEQ ID NO: 1876916 - DNA, 17 bp, Homo sapiens
tttaagtactatctttg

SEQ ID NO: 1876917 - DNA, 23 bp, Homo sapiens
tttaagtactatctttgtctaaa

SEQ ID NO: 1876918 - DNA, 20 bp, Homo sapiens
tttaagtgcaacatttctgt

SEQ ID NO: 1876919 - DNA, 21 bp, Homo sapiens
tttaagtgcaacatttctgta

SEQ ID NO: 1876920 - DNA, 16 bp, Homo sapiens
tttaatgattgtttaa

SEQ ID NO: 1876921 - DNA, 19 bp, Homo sapiens
tttaattaaaaactttaaa

SEQ ID NO: 1876922 - DNA, 18 bp, Homo sapiens
tttaattagaatggataa

SEQ ID NO: 1876923 - DNA, 19 bp, Homo sapiens
tttacagaatgcattaaaa

SEQ ID NO: 1876924 - DNA, 20 bp, Homo sapiens
tttacagaatgcattaaaaa

SEQ ID NO: 1876925 - DNA, 18 bp, Homo sapiens
tttacagtctctgttgta

SEQ ID NO: 1876926 - DNA, 20 bp, Homo sapiens
tttacagtctctgttgtaaa

SEQ ID NO: 1876927 - DNA, 15 bp, Homo sapiens
tttacagtgtattta

SEQ ID NO: 1876928 - DNA, 17 bp, Homo sapiens
tttacagtgtatttaag

SEQ ID NO: 1876929 - DNA, 19 bp, Homo sapiens
tttacagtgtatttaagaa

SEQ ID NO: 1876930 - DNA, 15 bp, Homo sapiens
tttacagttatagaa

SEQ ID NO: 1876931 - DNA, 20 bp, Homo sapiens
tttacatgcaatttattaaa

SEQ ID NO: 1876932 - DNA, 19 bp, Homo sapiens
tttactcagtgaaatcata

SEQ ID NO: 1876933 - DNA, 21 bp, Homo sapiens
tttactgctctagaaagtata

SEQ ID NO: 1876934 - DNA, 19 bp, Homo sapiens
tttagatgtgctgctttga

SEQ ID NO: 1876935 - DNA, 20 bp, Homo sapiens
tttaggcatatgcttcttta

SEQ ID NO: 1876936 - DNA, 12 bp, Homo sapiens
tttagtaccctg

SEQ ID NO: 1876937 - DNA, 15 bp, Homo sapiens
tttataaaatgggaa

SEQ ID NO: 1876938 - DNA, 15 bp, Homo sapiens
tttatacataaacag

SEQ ID NO: 1876939 - DNA, 20 bp, Homo sapiens
tttatagctattactgtctg

SEQ ID NO: 1876940 - DNA, 17 bp, Homo sapiens
tttatagttaatctata

SEQ ID NO: 1876941 - DNA, 19 bp, Homo sapiens
tttatatctttatgcaaaa

SEQ ID NO: 1876942 - DNA, 14 bp, Homo sapiens
tttatatttagtta

SEQ ID NO: 1876943 - DNA, 15 bp, Homo sapiens
tttatcatgacatgt

SEQ ID NO: 1876944 - DNA, 17 bp, Homo sapiens
tttatgagatttactgc

SEQ ID NO: 1876945 - DNA, 15 bp, Homo sapiens
tttatgcaaaaacat

SEQ ID NO: 1876946 - DNA, 18 bp, Homo sapiens
tttattaaaagagtagaa

SEQ ID NO: 1876947 - DNA, 18 bp, Homo sapiens
tttattcagctagaattt

SEQ ID NO: 1876948 - DNA, 12 bp, Homo sapiens
tttattctgtgg

SEQ ID NO: 1876949 - DNA, 23 bp, Homo sapiens
tttattggcagccaaggaatgtg

SEQ ID NO: 1876950 - DNA, 21 bp, Homo sapiens
tttcaaaaaaaaaaaaaaaga

SEQ ID NO: 1876951 - DNA, 22 bp, Homo sapiens
tttcaaaaaaaaaaaaaaagac

SEQ ID NO: 1876952 - DNA, 13 bp, Homo sapiens
tttcaactcattg

SEQ ID NO: 1876953 - DNA, 21 bp, Homo sapiens
tttcaatttggagcattaact

SEQ ID NO: 1876954 - DNA, 22 bp, Homo sapiens
tttcacagatggaagaagtttt

SEQ ID NO: 1876955 - DNA, 16 bp, Homo sapiens
tttcagatatatatca

SEQ ID NO: 1876956 - DNA, 21 bp, Homo sapiens
tttcagtattttggagaaatt

SEQ ID NO: 1876957 - DNA, 15 bp, Homo sapiens
tttcatccattaaaa

SEQ ID NO: 1876958 - DNA, 22 bp, Homo sapiens
tttccaaaataatctatattaa

SEQ ID NO: 1876959 - DNA, 15 bp, Homo sapiens
tttccaaataaaatg

SEQ ID NO: 1876960 - DNA, 21 bp, Homo sapiens
tttcctatctagcatttattt

SEQ ID NO: 1876961 - DNA, 23 bp, Homo sapiens
tttcctatctagcatttatttct

SEQ ID NO: 1876962 - DNA, 18 bp, Homo sapiens
tttccttctgttaagaaa

SEQ ID NO: 1876963 - DNA, 17 bp, Homo sapiens
tttctactcattttaat

SEQ ID NO: 1876964 - DNA, 16 bp, Homo sapiens
tttctagactttctgt

SEQ ID NO: 1876965 - DNA, 13 bp, Homo sapiens
tttctcaagttta

SEQ ID NO: 1876966 - DNA, 15 bp, Homo sapiens
tttctcaagtttaaa

SEQ ID NO: 1876967 - DNA, 14 bp, Homo sapiens
tttctctttgaaac

SEQ ID NO: 1876968 - DNA, 20 bp, Homo sapiens
tttctctttgaaacatgctt

SEQ ID NO: 1876969 - DNA, 17 bp, Homo sapiens
tttctgtatactgtaaa

SEQ ID NO: 1876970 - DNA, 20 bp, Homo sapiens
tttctgtgtgcaccttacca

SEQ ID NO: 1876971 - DNA, 21 bp, Homo sapiens
tttcttcactgttgaaaatta

SEQ ID NO: 1876972 - DNA, 16 bp, Homo sapiens
tttctttgaatgcttt

SEQ ID NO: 1876973 - DNA, 22 bp, Homo sapiens
tttctttgaatgctttttgaat

SEQ ID NO: 1876974 - DNA, 21 bp, Homo sapiens
tttcttttttaaagtaaactt

SEQ ID NO: 1876975 - DNA, 14 bp, Homo sapiens
tttctttttttggt

SEQ ID NO: 1876976 - DNA, 14 bp, Homo sapiens
tttgaaaaatattg

SEQ ID NO: 1876977 - DNA, 23 bp, Homo sapiens
tttgaaaaatattgctaaaagtg

SEQ ID NO: 1876978 - DNA, 21 bp, Homo sapiens
tttgaaacatgcttgtgtttc

SEQ ID NO: 1876979 - DNA, 14 bp, Homo sapiens
tttgaaatcagtaa

SEQ ID NO: 1876980 - DNA, 20 bp, Homo sapiens
tttgaaatcagtaaacactg

SEQ ID NO: 1876981 - DNA, 19 bp, Homo sapiens
tttgaatagaggccaaatt

SEQ ID NO: 1876982 - DNA, 20 bp, Homo sapiens
tttgacaacacatgtgggag

SEQ ID NO: 1876983 - DNA, 20 bp, Homo sapiens
tttgaggctcaccagaatta

SEQ ID NO: 1876984 - DNA, 15 bp, Homo sapiens
tttgatataatcttg

SEQ ID NO: 1876985 - DNA, 13 bp, Homo sapiens
tttgatctttgtt

SEQ ID NO: 1876986 - DNA, 20 bp, Homo sapiens
tttgatctttgtttaaatgc

SEQ ID NO: 1876987 - DNA, 12 bp, Homo sapiens
tttgatttatgc

SEQ ID NO: 1876988 - DNA, 20 bp, Homo sapiens
tttgcaaaccctttgtatta

SEQ ID NO: 1876989 - DNA, 13 bp, Homo sapiens
tttgcacataaaa

SEQ ID NO: 1876990 - DNA, 13 bp, Homo sapiens
tttgctaaaagaa

SEQ ID NO: 1876991 - DNA, 16 bp, Homo sapiens
agaggagagcatctgc

SEQ ID NO: 1876992 - DNA, 20 bp, Homo sapiens
agaggagagcatctgctctg

SEQ ID NO: 1876993 - DNA, 15 bp, Homo sapiens
agaggagccacctgg

SEQ ID NO: 1876994 - DNA, 18 bp, Homo sapiens
agaggagccacctgggct

SEQ ID NO: 1876995 - DNA, 19 bp, Homo sapiens
agaggagccacctgggctg

SEQ ID NO: 1876996 - DNA, 16 bp, Homo sapiens
agaggcaacagtgttc

SEQ ID NO: 1876997 - DNA, 13 bp, Homo sapiens
agagggactgaat

SEQ ID NO: 1876998 - DNA, 12 bp, Homo sapiens
agagtctggagc

SEQ ID NO: 1876999 - DNA, 14 bp, Homo sapiens
agagtctggagctg

SEQ ID NO: 1877000 - DNA, 19 bp, Homo sapiens
agagtctggagctgagcta

SEQ ID NO: 1877001 - DNA, 20 bp, Homo sapiens
agagtgagactcgtctcaaa

SEQ ID NO: 1877002 - DNA, 22 bp, Homo sapiens
agatatataagaaaaaattctt

SEQ ID NO: 1877003 - DNA, 19 bp, Homo sapiens
agatattgggaaggaaata

SEQ ID NO: 1877004 - DNA, 16 bp, Homo sapiens
agatcacataccagag

SEQ ID NO: 1877005 - DNA, 19 bp, Homo sapiens
agatcacataccagagtct

SEQ ID NO: 1877006 - DNA, 21 bp, Homo sapiens
agatcaccagtgtgtggcttt

SEQ ID NO: 1877007 - DNA, 16 bp, Homo sapiens
agattttcctgaaaac

SEQ ID NO: 1877008 - DNA, 17 bp, Homo sapiens
agatttttcatgatttt

SEQ ID NO: 1877009 - DNA, 22 bp, Homo sapiens
agcaaacctcagtcatattctt

SEQ ID NO: 1877010 - DNA, 16 bp, Homo sapiens
agcaaggaggctggct

SEQ ID NO: 1877011 - DNA, 24 bp, Homo sapiens
agcacagcaaggaggctggctggg

SEQ ID NO: 1877012 - DNA, 12 bp, Homo sapiens
agcacagccctc

SEQ ID NO: 1877013 - DNA, 16 bp, Homo sapiens
agcacagccctcccgc

SEQ ID NO: 1877014 - DNA, 16 bp, Homo sapiens
agcaccaatcatgaat

SEQ ID NO: 1877015 - DNA, 17 bp, Homo sapiens
agcacccgggctcaggg

SEQ ID NO: 1877016 - DNA, 22 bp, Homo sapiens
agcagacccatacctttccagg

SEQ ID NO: 1877017 - DNA, 17 bp, Homo sapiens
agcagcttctgccactt

SEQ ID NO: 1877018 - DNA, 16 bp, Homo sapiens
agcaggcagaggagag

SEQ ID NO: 1877019 - DNA, 18 bp, Homo sapiens
agcaggctgcagcaggca

SEQ ID NO: 1877020 - DNA, 15 bp, Homo sapiens
agcaggtgctgctac

SEQ ID NO: 1877021 - DNA, 17 bp, Homo sapiens
agcaggtgctgctaccc

SEQ ID NO: 1877022 - DNA, 14 bp, Homo sapiens
agcaggtggcttgt

SEQ ID NO: 1877023 - DNA, 23 bp, Homo sapiens
agcagtaaatacttgcagttgtg

SEQ ID NO: 1877024 - DNA, 14 bp, Homo sapiens
agcagtccagagct

SEQ ID NO: 1877025 - DNA, 17 bp, Homo sapiens
agcagtcctgttcaaat

SEQ ID NO: 1877026 - DNA, 23 bp, Homo sapiens
agcataaatgttgacatgggaca

SEQ ID NO: 1877027 - DNA, 13 bp, Homo sapiens
agcatctgctctg

SEQ ID NO: 1877028 - DNA, 23 bp, Homo sapiens
agcatgtgggggaaggccttgct

SEQ ID NO: 1877029 - DNA, 13 bp, Homo sapiens
agcattctgcctg

SEQ ID NO: 1877030 - DNA, 15 bp, Homo sapiens
agcattctgcctgcc

SEQ ID NO: 1877031 - DNA, 16 bp, Homo sapiens
agcattctgcctgcct

SEQ ID NO: 1877032 - DNA, 22 bp, Homo sapiens
agcatttagatgtataggttga

SEQ ID NO: 1877033 - DNA, 12 bp, Homo sapiens
agccacctgggc

SEQ ID NO: 1877034 - DNA, 22 bp, Homo sapiens
agccacctgggctgggagaagg

SEQ ID NO: 1877035 - DNA, 23 bp, Homo sapiens
agccacgaggtggtagctctgag

SEQ ID NO: 1877036 - DNA, 18 bp, Homo sapiens
agccatttaactggagct

SEQ ID NO: 1877037 - DNA, 17 bp, Homo sapiens
agcccaaattcatataa

SEQ ID NO: 1877038 - DNA, 20 bp, Homo sapiens
agcccaaattcatataaaag

SEQ ID NO: 1877039 - DNA, 21 bp, Homo sapiens
agcccaaattcatataaaagt

SEQ ID NO: 1877040 - DNA, 21 bp, Homo sapiens
agcccaacacacactcgggtt

SEQ ID NO: 1877041 - DNA, 19 bp, Homo sapiens
agcccacgtcctgtcagtg

SEQ ID NO: 1877042 - DNA, 22 bp, Homo sapiens
agcccacgtcctgtcagtgccg

SEQ ID NO: 1877043 - DNA, 13 bp, Homo sapiens
agccccacagccc

SEQ ID NO: 1877044 - DNA, 16 bp, Homo sapiens
agccccacagcccacg

SEQ ID NO: 1877045 - DNA, 17 bp, Homo sapiens
agccccacagcccacgt

SEQ ID NO: 1877046 - DNA, 12 bp, Homo sapiens
agcccccacctg

SEQ ID NO: 1877047 - DNA, 20 bp, Homo sapiens
agccctccttcttgccctga

SEQ ID NO: 1877048 - DNA, 21 bp, Homo sapiens
agccctccttcttgccctgag

SEQ ID NO: 1877049 - DNA, 18 bp, Homo sapiens
agcccttctttccacaga

SEQ ID NO: 1877050 - DNA, 21 bp, Homo sapiens
agccctttacttgacctccta

SEQ ID NO: 1877051 - DNA, 16 bp, Homo sapiens
agcctcctttctggct

SEQ ID NO: 1877052 - DNA, 14 bp, Homo sapiens
agcctctgtgtcac

SEQ ID NO: 1877053 - DNA, 18 bp, Homo sapiens
agcctctgtgtcactggc

SEQ ID NO: 1877054 - DNA, 17 bp, Homo sapiens
agcctggagcccctgtg

SEQ ID NO: 1877055 - DNA, 20 bp, Homo sapiens
agcctggagcccctgtgtgg

SEQ ID NO: 1877056 - DNA, 17 bp, Homo sapiens
agccttcatttgcaatt

SEQ ID NO: 1877057 - DNA, 20 bp, Homo sapiens
agccttggggctgatgcagt

SEQ ID NO: 1877058 - DNA, 22 bp, Homo sapiens
agcgctggccgggaccccgagc

SEQ ID NO: 1877059 - DNA, 12 bp, Homo sapiens
agctcaaggtca

SEQ ID NO: 1877060 - DNA, 20 bp, Homo sapiens
agctccactggcctgcccgt

SEQ ID NO: 1877061 - DNA, 13 bp, Homo sapiens
agctctgagccct

SEQ ID NO: 1877062 - DNA, 17 bp, Homo sapiens
agctctgagccctcctt

SEQ ID NO: 1877063 - DNA, 14 bp, Homo sapiens
agctcttctccatc

SEQ ID NO: 1877064 - DNA, 12 bp, Homo sapiens
agctgaagaact

SEQ ID NO: 1877065 - DNA, 16 bp, Homo sapiens
agctgacagtcctctc

SEQ ID NO: 1877066 - DNA, 15 bp, Homo sapiens
agctgagctacctgg

SEQ ID NO: 1877067 - DNA, 17 bp, Homo sapiens
agctgcagagagcacct

SEQ ID NO: 1877068 - DNA, 22 bp, Homo sapiens
agctgcagagagcacctggtgg

SEQ ID NO: 1877069 - DNA, 21 bp, Homo sapiens
agctgcctggaagagcagccc

SEQ ID NO: 1877070 - DNA, 15 bp, Homo sapiens
agctgctatatattt

SEQ ID NO: 1877071 - DNA, 13 bp, Homo sapiens
agctggaaaagta

SEQ ID NO: 1877072 - DNA, 15 bp, Homo sapiens
agctggacctcacca

SEQ ID NO: 1877073 - DNA, 19 bp, Homo sapiens
agctggctgtactgccaag

SEQ ID NO: 1877074 - DNA, 21 bp, Homo sapiens
agctggctgtactgccaaggt

SEQ ID NO: 1877075 - DNA, 16 bp, Homo sapiens
agctgggctgttggct

SEQ ID NO: 1877076 - DNA, 15 bp, Homo sapiens
agctgtaaaaagaga

SEQ ID NO: 1877077 - DNA, 17 bp, Homo sapiens
agctgtgaacatggact

SEQ ID NO: 1877078 - DNA, 14 bp, Homo sapiens
agcttcagggctgg

SEQ ID NO: 1877079 - DNA, 17 bp, Homo sapiens
agcttcagttgttcttt

SEQ ID NO: 1877080 - DNA, 17 bp, Homo sapiens
agcttctattaaatgta

SEQ ID NO: 1877081 - DNA, 13 bp, Homo sapiens
agcttctgctggg

SEQ ID NO: 1877082 - DNA, 18 bp, Homo sapiens
agcttctgctgggctggg

SEQ ID NO: 1877083 - DNA, 14 bp, Homo sapiens
agctttattgtgat

SEQ ID NO: 1877084 - DNA, 18 bp, Homo sapiens
agctttccggggaggagc

SEQ ID NO: 1877085 - DNA, 19 bp, Homo sapiens
agctttctcctctgctatg

SEQ ID NO: 1877086 - DNA, 19 bp, Homo sapiens
aggaaagagaacttccaga

SEQ ID NO: 1877087 - DNA, 18 bp, Homo sapiens
aggaaatatttattttaa

SEQ ID NO: 1877088 - DNA, 20 bp, Homo sapiens
aggaagagaggacccatcct

SEQ ID NO: 1877089 - DNA, 18 bp, Homo sapiens
aggaccaacccatgccct

SEQ ID NO: 1877090 - DNA, 19 bp, Homo sapiens
aggaccaacccatgccctg

SEQ ID NO: 1877091 - DNA, 21 bp, Homo sapiens
aggaccaacccatgccctgcc

SEQ ID NO: 1877092 - DNA, 20 bp, Homo sapiens
aggaccaagcttaaggagag

SEQ ID NO: 1877093 - DNA, 15 bp, Homo sapiens
aggaccctgtttctg

SEQ ID NO: 1877094 - DNA, 20 bp, Homo sapiens
aggaccctgtttctgtagaa

SEQ ID NO: 1877095 - DNA, 15 bp, Homo sapiens
aggacggggccggcc

SEQ ID NO: 1877096 - DNA, 19 bp, Homo sapiens
aggacggggccggccaggt

SEQ ID NO: 1877097 - DNA, 22 bp, Homo sapiens
aggacggggccggccaggtggg

SEQ ID NO: 1877098 - DNA, 17 bp, Homo sapiens
aggactttagggatctg

SEQ ID NO: 1877099 - DNA, 21 bp, Homo sapiens
aggactttatagatcagccag

SEQ ID NO: 1877100 - DNA, 16 bp, Homo sapiens
aggagagactggccag

SEQ ID NO: 1877101 - DNA, 24 bp, Homo sapiens
aggagagaggttgaggatgcactg

SEQ ID NO: 1877102 - DNA, 19 bp, Homo sapiens
aggagagtacccccctgag

SEQ ID NO: 1877103 - DNA, 20 bp, Homo sapiens
aggagagtacccccctgaga

SEQ ID NO: 1877104 - DNA, 17 bp, Homo sapiens
aggagccacctgggctg

SEQ ID NO: 1877105 - DNA, 13 bp, Homo sapiens
aggagccttggag

SEQ ID NO: 1877106 - DNA, 18 bp, Homo sapiens
aggaggaggtgccaacag

SEQ ID NO: 1877107 - DNA, 16 bp, Homo sapiens
aggaggccaggccacc

SEQ ID NO: 1877108 - DNA, 14 bp, Homo sapiens
aggagtgacatgaa

SEQ ID NO: 1877109 - DNA, 15 bp, Homo sapiens
aggatatggcaggga

SEQ ID NO: 1877110 - DNA, 19 bp, Homo sapiens
aggatatggcagggaagct

SEQ ID NO: 1877111 - DNA, 16 bp, Homo sapiens
aggatgcactggcctg

SEQ ID NO: 1877112 - DNA, 16 bp, Homo sapiens
aggattgtacgtggga

SEQ ID NO: 1877113 - DNA, 18 bp, Homo sapiens
aggattgtacgtgggaga

SEQ ID NO: 1877114 - DNA, 21 bp, Homo sapiens
aggattgtacgtgggagaggc

SEQ ID NO: 1877115 - DNA, 20 bp, Homo sapiens
aggcaacagtgttctgagcc

SEQ ID NO: 1877116 - DNA, 15 bp, Homo sapiens
aggcaagagctcaag

SEQ ID NO: 1877117 - DNA, 16 bp, Homo sapiens
aggcacatgtcagcaa

SEQ ID NO: 1877118 - DNA, 16 bp, Homo sapiens
aggcagtgggtcccac

SEQ ID NO: 1877119 - DNA, 18 bp, Homo sapiens
aggcagtgggtcccactt

SEQ ID NO: 1877120 - DNA, 18 bp, Homo sapiens
aggccaggccaccctgcc

SEQ ID NO: 1877121 - DNA, 15 bp, Homo sapiens
aggccatcttccagg

SEQ ID NO: 1877122 - DNA, 18 bp, Homo sapiens
aggccatcttccaggtgg

SEQ ID NO: 1877123 - DNA, 21 bp, Homo sapiens
aggcccagagaggaaggtggc

SEQ ID NO: 1877124 - DNA, 17 bp, Homo sapiens
aggccctgcactgtcct

SEQ ID NO: 1877125 - DNA, 21 bp, Homo sapiens
aggccctgcactgtcctgctc

SEQ ID NO: 1877126 - DNA, 22 bp, Homo sapiens
aggccctgcactgtcctgctcc

SEQ ID NO: 1877127 - DNA, 23 bp, Homo sapiens
aggccctgcactgtcctgctcca

SEQ ID NO: 1877128 - DNA, 18 bp, Homo sapiens
aggcctcccacagtgact

SEQ ID NO: 1877129 - DNA, 16 bp, Homo sapiens
aggcctggcacagtgt

SEQ ID NO: 1877130 - DNA, 23 bp, Homo sapiens
aggcctggcacagtgtctgggct

SEQ ID NO: 1877131 - DNA, 12 bp, Homo sapiens
aggcctgggagg

SEQ ID NO: 1877132 - DNA, 13 bp, Homo sapiens
aggcctgggaggg

SEQ ID NO: 1877133 - DNA, 15 bp, Homo sapiens
aggcctgggagggca

SEQ ID NO: 1877134 - DNA, 15 bp, Homo sapiens
aggcgcccctggggt

SEQ ID NO: 1877135 - DNA, 16 bp, Homo sapiens
aggcgggggagcctgg

SEQ ID NO: 1877136 - DNA, 17 bp, Homo sapiens
aggcgggggatcctgga

SEQ ID NO: 1877137 - DNA, 19 bp, Homo sapiens
aggcgggggatcctggagc

SEQ ID NO: 1877138 - DNA, 16 bp, Homo sapiens
aggctagatgtatgta

SEQ ID NO: 1877139 - DNA, 21 bp, Homo sapiens
aggctgagactgcagaggagc

SEQ ID NO: 1877140 - DNA, 21 bp, Homo sapiens
aggctgcagcaggcagaggag

SEQ ID NO: 1877141 - DNA, 14 bp, Homo sapiens
aggctggccagccc

SEQ ID NO: 1877142 - DNA, 19 bp, Homo sapiens
aggctggccagccccacag

SEQ ID NO: 1877143 - DNA, 12 bp, Homo sapiens
aggctggctggg

SEQ ID NO: 1877144 - DNA, 22 bp, Homo sapiens
aggctggggcggggctggaggt

SEQ ID NO: 1877145 - DNA, 16 bp, Homo sapiens
aggctttcaaatgtac

SEQ ID NO: 1877146 - DNA, 14 bp, Homo sapiens
agggaccacagcaa

SEQ ID NO: 1877147 - DNA, 20 bp, Homo sapiens
agggaccaggtgtctagagg

SEQ ID NO: 1877148 - DNA, 11 bp, Homo sapiens
agggaggggag

SEQ ID NO: 1877149 - DNA, 16 bp, Homo sapiens
agggatctggggaagg

SEQ ID NO: 1877150 - DNA, 12 bp, Homo sapiens
agggatttgagg

SEQ ID NO: 1877151 - DNA, 19 bp, Homo sapiens
agggcccacccatgtcacc

SEQ ID NO: 1877152 - DNA, 16 bp, Homo sapiens
agggcgaggcggggga

SEQ ID NO: 1877153 - DNA, 20 bp, Homo sapiens
agggcgaggcgggggagcct

SEQ ID NO: 1877154 - DNA, 22 bp, Homo sapiens
agggctgagtttgcacagtggt

SEQ ID NO: 1877155 - DNA, 21 bp, Homo sapiens
agggctgggcaggtcctgggg

SEQ ID NO: 1877156 - DNA, 22 bp, Homo sapiens
aggggcaggaatcaaggagcct

SEQ ID NO: 1877157 - DNA, 13 bp, Homo sapiens
aggggcaggcaca

SEQ ID NO: 1877158 - DNA, 15 bp, Homo sapiens
aggggcaggccctgc

SEQ ID NO: 1877159 - DNA, 20 bp, Homo sapiens
aggggcccgcttgcctcggc

SEQ ID NO: 1877160 - DNA, 20 bp, Homo sapiens
aggggcccgttgtctccctg

SEQ ID NO: 1877161 - DNA, 16 bp, Homo sapiens
aggggctgcccgctcc

SEQ ID NO: 1877162 - DNA, 19 bp, Homo sapiens
aggggctgcccgctcccag

SEQ ID NO: 1877163 - DNA, 20 bp, Homo sapiens
aggggctgcccgctcccagt

SEQ ID NO: 1877164 - DNA, 13 bp, Homo sapiens
aggggctggggcc

SEQ ID NO: 1877165 - DNA, 23 bp, Homo sapiens
aggggctggggccaaataaagtc

SEQ ID NO: 1877166 - DNA, 19 bp, Homo sapiens
aggggtaatatattgctgc

SEQ ID NO: 1877167 - DNA, 16 bp, Homo sapiens
aggggtctccctgagc

SEQ ID NO: 1877168 - DNA, 21 bp, Homo sapiens
aggggtctccctgagcctgcc

SEQ ID NO: 1877169 - DNA, 22 bp, Homo sapiens
agggtaataaacttagaataaa

SEQ ID NO: 1877170 - DNA, 12 bp, Homo sapiens
agggtgcctgct

SEQ ID NO: 1877171 - DNA, 14 bp, Homo sapiens
agggtgcctgctct

SEQ ID NO: 1877172 - DNA, 17 bp, Homo sapiens
agggttatgattaagta

SEQ ID NO: 1877173 - DNA, 20 bp, Homo sapiens
agggttatttagtaaagttt

SEQ ID NO: 1877174 - DNA, 19 bp, Homo sapiens
aggtaagcaggaggaggtg

SEQ ID NO: 1877175 - DNA, 15 bp, Homo sapiens
aggtctcctccaccg

SEQ ID NO: 1877176 - DNA, 17 bp, Homo sapiens
aggtctcgctgatgctg

SEQ ID NO: 1877177 - DNA, 20 bp, Homo sapiens
aggtctcgctgatgctgggc

SEQ ID NO: 1877178 - DNA, 21 bp, Homo sapiens
aggtctcgctgatgctgggct

SEQ ID NO: 1877179 - DNA, 22 bp, Homo sapiens
aggtctcgctgatgctgggctg

SEQ ID NO: 1877180 - DNA, 20 bp, Homo sapiens
aggtgaccccatctctgctg

SEQ ID NO: 1877181 - DNA, 17 bp, Homo sapiens
aggtgcagtcccagtcc

SEQ ID NO: 1877182 - DNA, 19 bp, Homo sapiens
aggtgctagggtgcctgct

SEQ ID NO: 1877183 - DNA, 17 bp, Homo sapiens
aggtggcgccccctggt

SEQ ID NO: 1877184 - DNA, 20 bp, Homo sapiens
aggtggcgccccctggtggg

SEQ ID NO: 1877185 - DNA, 15 bp, Homo sapiens
aggtggcttcatgtg

SEQ ID NO: 1877186 - DNA, 18 bp, Homo sapiens
aggtgggcgggcagcaca

SEQ ID NO: 1877187 - DNA, 22 bp, Homo sapiens
aggtgggcgggcagcacagcaa

SEQ ID NO: 1877188 - DNA, 14 bp, Homo sapiens
aggtggggctgtca

SEQ ID NO: 1877189 - DNA, 23 bp, Homo sapiens
aggtgggggagcctggagcccct

SEQ ID NO: 1877190 - DNA, 17 bp, Homo sapiens
aggtggtagctctgagc

SEQ ID NO: 1877191 - DNA, 19 bp, Homo sapiens
aggtggtagctctgagccc

SEQ ID NO: 1877192 - DNA, 23 bp, Homo sapiens
aggtggtagctctgagccctcct

SEQ ID NO: 1877193 - DNA, 21 bp, Homo sapiens
aggttgaggatgcactggcct

SEQ ID NO: 1877194 - DNA, 18 bp, Homo sapiens
aggttggagtccagccta

SEQ ID NO: 1877195 - DNA, 22 bp, Homo sapiens
aggttggagtccagcctaatca

SEQ ID NO: 1877196 - DNA, 12 bp, Homo sapiens
aggttgtctgtg

SEQ ID NO: 1877197 - DNA, 19 bp, Homo sapiens
aggtttatattgggaagct

SEQ ID NO: 1877198 - DNA, 13 bp, Homo sapiens
agtaaagtttgtt

SEQ ID NO: 1877199 - DNA, 14 bp, Homo sapiens
agtaaagtttgttg

SEQ ID NO: 1877200 - DNA, 15 bp, Homo sapiens
agtaaataaattgtt

SEQ ID NO: 1877201 - DNA, 17 bp, Homo sapiens
agtaaatacttgcagtt

SEQ ID NO: 1877202 - DNA, 18 bp, Homo sapiens
agtaatgataactggaaa

SEQ ID NO: 1877203 - DNA, 20 bp, Homo sapiens
agtaatgataactggaaact

SEQ ID NO: 1877204 - DNA, 12 bp, Homo sapiens
agtaattggaaa

SEQ ID NO: 1877205 - DNA, 17 bp, Homo sapiens
agtacagaaaaatactt

SEQ ID NO: 1877206 - DNA, 23 bp, Homo sapiens
agtactaactcctaggaaaatac

SEQ ID NO: 1877207 - DNA, 18 bp, Homo sapiens
agtactgaggtggtggac

SEQ ID NO: 1877208 - DNA, 19 bp, Homo sapiens
agtagataggccatgggca

SEQ ID NO: 1877209 - DNA, 13 bp, Homo sapiens
agtatatttctga

SEQ ID NO: 1877210 - DNA, 15 bp, Homo sapiens
agtatctggctgggt

SEQ ID NO: 1877211 - DNA, 14 bp, Homo sapiens
agtatcttttaaaa

SEQ ID NO: 1877212 - DNA, 21 bp, Homo sapiens
agtatgttagtgcaaattgtc

SEQ ID NO: 1877213 - DNA, 15 bp, Homo sapiens
agtatttctatgaaa

SEQ ID NO: 1877214 - DNA, 13 bp, Homo sapiens
agtcaaattgtgt

SEQ ID NO: 1877215 - DNA, 15 bp, Homo sapiens
agtcaaattgtgtga

SEQ ID NO: 1877216 - DNA, 23 bp, Homo sapiens
agtcaaattgtgtgaaaggtact

SEQ ID NO: 1877217 - DNA, 14 bp, Homo sapiens
agtcacctcatgga

SEQ ID NO: 1877218 - DNA, 18 bp, Homo sapiens
agtcaggtgcagtcccag

SEQ ID NO: 1877219 - DNA, 15 bp, Homo sapiens
agtcatttgtggtta

SEQ ID NO: 1877220 - DNA, 17 bp, Homo sapiens
agtcccagtccttgaga

SEQ ID NO: 1877221 - DNA, 16 bp, Homo sapiens
agtcctcacatgcccg

SEQ ID NO: 1877222 - DNA, 14 bp, Homo sapiens
agtcctctccacct

SEQ ID NO: 1877223 - DNA, 14 bp, Homo sapiens
agtcgcgctgcctg

SEQ ID NO: 1877224 - DNA, 13 bp, Homo sapiens
agtctaaagttta

SEQ ID NO: 1877225 - DNA, 17 bp, Homo sapiens
agtctaaagtttacagt

SEQ ID NO: 1877226 - DNA, 15 bp, Homo sapiens
agtctattgtttgtt

SEQ ID NO: 1877227 - DNA, 14 bp, Homo sapiens
agtgacatgaagca

SEQ ID NO: 1877228 - DNA, 15 bp, Homo sapiens
agtgacatgaagcat

SEQ ID NO: 1877229 - DNA, 15 bp, Homo sapiens
agtgactcgggctcc

SEQ ID NO: 1877230 - DNA, 17 bp, Homo sapiens
agtgactcgggctcctg

SEQ ID NO: 1877231 - DNA, 22 bp, Homo sapiens
agtgactcgggctcctgtgccc

SEQ ID NO: 1877232 - DNA, 21 bp, Homo sapiens
agtgcaaattgtcacaggaca

SEQ ID NO: 1877233 - DNA, 15 bp, Homo sapiens
agtgcagtcatttgt

SEQ ID NO: 1877234 - DNA, 17 bp, Homo sapiens
agtgccgccgcctcgcc

SEQ ID NO: 1877235 - DNA, 20 bp, Homo sapiens
agtgccgccgcctcgcccac

SEQ ID NO: 1877236 - DNA, 23 bp, Homo sapiens
agtgccgccgcctcgcccaccgc

SEQ ID NO: 1877237 - DNA, 12 bp, Homo sapiens
agtgctggctcc

SEQ ID NO: 1877238 - DNA, 15 bp, Homo sapiens
agtgctttttccttt

SEQ ID NO: 1877239 - DNA, 20 bp, Homo sapiens
agtggaggaggtggcttcat

SEQ ID NO: 1877240 - DNA, 23 bp, Homo sapiens
agtggccaagatcacagtggcca

SEQ ID NO: 1877241 - DNA, 13 bp, Homo sapiens
agtggctgtccag

SEQ ID NO: 1877242 - DNA, 14 bp, Homo sapiens
agtgggtcccactt

SEQ ID NO: 1877243 - DNA, 22 bp, Homo sapiens
agtgggtcccacttcccctcct

SEQ ID NO: 1877244 - DNA, 16 bp, Homo sapiens
agtgtaataatgttat

SEQ ID NO: 1877245 - DNA, 17 bp, Homo sapiens
agtgtcaactccaggac

SEQ ID NO: 1877246 - DNA, 19 bp, Homo sapiens
agtgtgccccccatcctgg

SEQ ID NO: 1877247 - DNA, 20 bp, Homo sapiens
agtgtgccccccatcctggc

SEQ ID NO: 1877248 - DNA, 22 bp, Homo sapiens
agtgtgccccccatcctggccc

SEQ ID NO: 1877249 - DNA, 15 bp, Homo sapiens
agtgtggtccctcca

SEQ ID NO: 1877250 - DNA, 18 bp, Homo sapiens
agtgtgtgtgttctgtag

SEQ ID NO: 1877251 - DNA, 12 bp, Homo sapiens
agtgttctgagc

SEQ ID NO: 1877252 - DNA, 16 bp, Homo sapiens
agtgttggagaagaac

SEQ ID NO: 1877253 - DNA, 23 bp, Homo sapiens
agtgttggagaagaactgaaatc

SEQ ID NO: 1877254 - DNA, 20 bp, Homo sapiens
agttaacacctttaaagtgt

SEQ ID NO: 1877255 - DNA, 19 bp, Homo sapiens
agttattgttttatgttct

SEQ ID NO: 1877256 - DNA, 23 bp, Homo sapiens
agttattgttttatgttctagtg

SEQ ID NO: 1877257 - DNA, 11 bp, Homo sapiens
agttgcagttt

SEQ ID NO: 1877258 - DNA, 19 bp, Homo sapiens
agttgcgtttaagttgtat

SEQ ID NO: 1877259 - DNA, 15 bp, Homo sapiens
agtttatgtctaaag

SEQ ID NO: 1877260 - DNA, 14 bp, Homo sapiens
cccatctgcccagg

SEQ ID NO: 1877261 - DNA, 20 bp, Homo sapiens
cccatgccctgccaagcctg

SEQ ID NO: 1877262 - DNA, 20 bp, Homo sapiens
cccatgggcactgctgggtg

SEQ ID NO: 1877263 - DNA, 14 bp, Homo sapiens
cccatgggctagga

SEQ ID NO: 1877264 - DNA, 21 bp, Homo sapiens
cccatgtcaccggtcagtgcc

SEQ ID NO: 1877265 - DNA, 23 bp, Homo sapiens
ccccaacccccagcacccgggct

SEQ ID NO: 1877266 - DNA, 13 bp, Homo sapiens
ccccagcacccgg

SEQ ID NO: 1877267 - DNA, 12 bp, Homo sapiens
ccccagcctggc

SEQ ID NO: 1877268 - DNA, 13 bp, Homo sapiens
ccccagcctggcc

SEQ ID NO: 1877269 - DNA, 18 bp, Homo sapiens
ccccagcctggcccagct

SEQ ID NO: 1877270 - DNA, 15 bp, Homo sapiens
ccccagctgggctgt

SEQ ID NO: 1877271 - DNA, 13 bp, Homo sapiens
ccccatcctggcc

SEQ ID NO: 1877272 - DNA, 14 bp, Homo sapiens
ccccatcctggccc

SEQ ID NO: 1877273 - DNA, 18 bp, Homo sapiens
ccccatctgcccaggacg

SEQ ID NO: 1877274 - DNA, 15 bp, Homo sapiens
cccccgggaggggcc

SEQ ID NO: 1877275 - DNA, 16 bp, Homo sapiens
cccccggggctgggtt

SEQ ID NO: 1877276 - DNA, 14 bp, Homo sapiens
ccccctcctgctgc

SEQ ID NO: 1877277 - DNA, 15 bp, Homo sapiens
ccccctcctgctgca

SEQ ID NO: 1877278 - DNA, 23 bp, Homo sapiens
ccccgggaggggcccgcttgcct

SEQ ID NO: 1877279 - DNA, 13 bp, Homo sapiens
ccccggggcctgt

SEQ ID NO: 1877280 - DNA, 15 bp, Homo sapiens
ccccggggctgggtt

SEQ ID NO: 1877281 - DNA, 19 bp, Homo sapiens
cccctagtatctggctggg

SEQ ID NO: 1877282 - DNA, 13 bp, Homo sapiens
cccctcccctcca

SEQ ID NO: 1877283 - DNA, 18 bp, Homo sapiens
cccctgtgtgggagggcg

SEQ ID NO: 1877284 - DNA, 17 bp, Homo sapiens
ccccttttcagcttctg

SEQ ID NO: 1877285 - DNA, 18 bp, Homo sapiens
cccgcccaggctggccag

SEQ ID NO: 1877286 - DNA, 22 bp, Homo sapiens
cccgcccaggctggccagcccc

SEQ ID NO: 1877287 - DNA, 12 bp, Homo sapiens
cccgctcccagt

SEQ ID NO: 1877288 - DNA, 23 bp, Homo sapiens
cccgctcccagtgtcttcctgtg

SEQ ID NO: 1877289 - DNA, 20 bp, Homo sapiens
cccgcttgcctcggctcctg

SEQ ID NO: 1877290 - DNA, 15 bp, Homo sapiens
cccggcgccctctgt

SEQ ID NO: 1877291 - DNA, 16 bp, Homo sapiens
cccggcgccctctgtc

SEQ ID NO: 1877292 - DNA, 20 bp, Homo sapiens
cccggcgccctctgtcctga

SEQ ID NO: 1877293 - DNA, 17 bp, Homo sapiens
cccgggaggggcccgct

SEQ ID NO: 1877294 - DNA, 21 bp, Homo sapiens
cccgggctcagggaccacagc

SEQ ID NO: 1877295 - DNA, 13 bp, Homo sapiens
cccggggcctgtt

SEQ ID NO: 1877296 - DNA, 14 bp, Homo sapiens
cccgtggccccagc

SEQ ID NO: 1877297 - DNA, 18 bp, Homo sapiens
cccgtggccccagcctgg

SEQ ID NO: 1877298 - DNA, 22 bp, Homo sapiens
cccgtggccccagcctggccca

SEQ ID NO: 1877299 - DNA, 20 bp, Homo sapiens
cccgttgtctccctggccct

SEQ ID NO: 1877300 - DNA, 16 bp, Homo sapiens
ccctacacctctgggc

SEQ ID NO: 1877301 - DNA, 17 bp, Homo sapiens
ccctcaaaattgataat

SEQ ID NO: 1877302 - DNA, 14 bp, Homo sapiens
ccctcaccaggggc

SEQ ID NO: 1877303 - DNA, 12 bp, Homo sapiens
ccctccatccct

SEQ ID NO: 1877304 - DNA, 13 bp, Homo sapiens
ccctcccagctga

SEQ ID NO: 1877305 - DNA, 22 bp, Homo sapiens
ccctcccgtctactcattcccc

SEQ ID NO: 1877306 - DNA, 18 bp, Homo sapiens
ccctcctacccctcccag

SEQ ID NO: 1877307 - DNA, 12 bp, Homo sapiens
ccctcctgctgc

SEQ ID NO: 1877308 - DNA, 18 bp, Homo sapiens
ccctccttcttgccctga

SEQ ID NO: 1877309 - DNA, 16 bp, Homo sapiens
ccctcgtgccagtcgc

SEQ ID NO: 1877310 - DNA, 13 bp, Homo sapiens
ccctctgtcctga

SEQ ID NO: 1877311 - DNA, 14 bp, Homo sapiens
ccctctgtcctgac

SEQ ID NO: 1877312 - DNA, 12 bp, Homo sapiens
ccctcttgcccc

SEQ ID NO: 1877313 - DNA, 13 bp, Homo sapiens
ccctcttgcccca

SEQ ID NO: 1877314 - DNA, 23 bp, Homo sapiens
ccctcttgccccaacccccagca

SEQ ID NO: 1877315 - DNA, 19 bp, Homo sapiens
ccctgaacaaagcacctca

SEQ ID NO: 1877316 - DNA, 16 bp, Homo sapiens
ccctgagagcatgtgg

SEQ ID NO: 1877317 - DNA, 17 bp, Homo sapiens
ccctgagagcatgtggg

SEQ ID NO: 1877318 - DNA, 21 bp, Homo sapiens
ccctgagagcatgtgggggaa

SEQ ID NO: 1877319 - DNA, 19 bp, Homo sapiens
ccctgcaagagtggtccta

SEQ ID NO: 1877320 - DNA, 18 bp, Homo sapiens
ccctgcaggaggcctggg

SEQ ID NO: 1877321 - DNA, 17 bp, Homo sapiens
ccctgccaagcctggag

SEQ ID NO: 1877322 - DNA, 18 bp, Homo sapiens
ccctgccaagcctggagc

SEQ ID NO: 1877323 - DNA, 21 bp, Homo sapiens
ccctgccaagcctggagcccc

SEQ ID NO: 1877324 - DNA, 15 bp, Homo sapiens
ccctgcctctaccca

SEQ ID NO: 1877325 - DNA, 19 bp, Homo sapiens
ccctgcctctacccaacca

SEQ ID NO: 1877326 - DNA, 12 bp, Homo sapiens
ccctgctgtccc

SEQ ID NO: 1877327 - DNA, 13 bp, Homo sapiens
ccctgctgtcccc

SEQ ID NO: 1877328 - DNA, 16 bp, Homo sapiens
ccctgctgtcccctct

SEQ ID NO: 1877329 - DNA, 10 bp, Homo sapiens
ccctggctcc

SEQ ID NO: 1877330 - DNA, 11 bp, Homo sapiens
ccctggctccc

SEQ ID NO: 1877331 - DNA, 14 bp, Homo sapiens
ccctggctcccaag

SEQ ID NO: 1877332 - DNA, 11 bp, Homo sapiens
ccctgggccag

SEQ ID NO: 1877333 - DNA, 19 bp, Homo sapiens
ccctgggccagcccaggat

SEQ ID NO: 1877334 - DNA, 14 bp, Homo sapiens
ccctgggctctgtg

SEQ ID NO: 1877335 - DNA, 20 bp, Homo sapiens
ccctgggctctgtgggctgc

SEQ ID NO: 1877336 - DNA, 14 bp, Homo sapiens
cccttccccgaggg

SEQ ID NO: 1877337 - DNA, 17 bp, Homo sapiens
cccttctttccacagaa

SEQ ID NO: 1877338 - DNA, 23 bp, Homo sapiens
cccttctttgtagaactgcccat

SEQ ID NO: 1877339 - DNA, 15 bp, Homo sapiens
cccttgatgaagaag

SEQ ID NO: 1877340 - DNA, 19 bp, Homo sapiens
ccgaaggaaaagggctttc

SEQ ID NO: 1877341 - DNA, 18 bp, Homo sapiens
ccgagggatgatgccaca

SEQ ID NO: 1877342 - DNA, 19 bp, Homo sapiens
ccgagggatgatgccacac

SEQ ID NO: 1877343 - DNA, 12 bp, Homo sapiens
ccgcatgccccc

SEQ ID NO: 1877344 - DNA, 21 bp, Homo sapiens
ccgcatgccccctcgtgccag

SEQ ID NO: 1877345 - DNA, 22 bp, Homo sapiens
ccgcatgccccctcgtgccagt

SEQ ID NO: 1877346 - DNA, 17 bp, Homo sapiens
ccgcccaggctggccag

SEQ ID NO: 1877347 - DNA, 20 bp, Homo sapiens
ccgcccaggctggccagccc

SEQ ID NO: 1877348 - DNA, 14 bp, Homo sapiens
ccgccgcctcgccc

SEQ ID NO: 1877349 - DNA, 15 bp, Homo sapiens
ccgccgcctcgccca

SEQ ID NO: 1877350 - DNA, 18 bp, Homo sapiens
ccgcctcgcccaccgcat

SEQ ID NO: 1877351 - DNA, 19 bp, Homo sapiens
caggtgctagggtgcctgc

SEQ ID NO: 1877352 - DNA, 23 bp, Homo sapiens
caggtgctgctaccctccctgct

SEQ ID NO: 1877353 - DNA, 22 bp, Homo sapiens
caggtgggcgggcagcacagca

SEQ ID NO: 1877354 - DNA, 21 bp, Homo sapiens
caggttgggccatactggcct

SEQ ID NO: 1877355 - DNA, 23 bp, Homo sapiens
caggtttatattgggaagctgta

SEQ ID NO: 1877356 - DNA, 14 bp, Homo sapiens
cagtaaataaattg

SEQ ID NO: 1877357 - DNA, 16 bp, Homo sapiens
cagtaaataaattgtt

SEQ ID NO: 1877358 - DNA, 17 bp, Homo sapiens
cagtaaataaattgttt

SEQ ID NO: 1877359 - DNA, 24 bp, Homo sapiens
cagtaaataaattgtttgaccatg

SEQ ID NO: 1877360 - DNA, 18 bp, Homo sapiens
cagtaaatacttgcagtt

SEQ ID NO: 1877361 - DNA, 19 bp, Homo sapiens
cagtaaatacttgcagttg

SEQ ID NO: 1877362 - DNA, 20 bp, Homo sapiens
cagtaaatacttgcagttgt

SEQ ID NO: 1877363 - DNA, 21 bp, Homo sapiens
cagtaaatacttgcagttgtg

SEQ ID NO: 1877364 - DNA, 23 bp, Homo sapiens
cagtaaatacttgcagttgtgat

SEQ ID NO: 1877365 - DNA, 15 bp, Homo sapiens
cagtcacctcatgga

SEQ ID NO: 1877366 - DNA, 20 bp, Homo sapiens
cagtcctctccacctagtgg

SEQ ID NO: 1877367 - DNA, 22 bp, Homo sapiens
cagtcctctccacctagtggct

SEQ ID NO: 1877368 - DNA, 18 bp, Homo sapiens
cagtcgcgctgcctgtgt

SEQ ID NO: 1877369 - DNA, 21 bp, Homo sapiens
cagtctgttccccatggccac

SEQ ID NO: 1877370 - DNA, 17 bp, Homo sapiens
cagtctttaagatcttg

SEQ ID NO: 1877371 - DNA, 16 bp, Homo sapiens
cagtgactcgggctcc

SEQ ID NO: 1877372 - DNA, 18 bp, Homo sapiens
cagtgactcgggctcctg

SEQ ID NO: 1877373 - DNA, 22 bp, Homo sapiens
cagtgactcgggctcctgtgcc

SEQ ID NO: 1877374 - DNA, 17 bp, Homo sapiens
cagtgcagcttgcagtc

SEQ ID NO: 1877375 - DNA, 19 bp, Homo sapiens
cagtgcccattcctcacct

SEQ ID NO: 1877376 - DNA, 18 bp, Homo sapiens
cagtgccgccgcctcgcc

SEQ ID NO: 1877377 - DNA, 20 bp, Homo sapiens
cagtgccgccgcctcgccca

SEQ ID NO: 1877378 - DNA, 23 bp, Homo sapiens
cagtgcctttcttctctccagtg

SEQ ID NO: 1877379 - DNA, 17 bp, Homo sapiens
cagtgccttttggaact

SEQ ID NO: 1877380 - DNA, 14 bp, Homo sapiens
cagtgggtcccact

SEQ ID NO: 1877381 - DNA, 14 bp, Homo sapiens
cagtgtacccccgc

SEQ ID NO: 1877382 - DNA, 23 bp, Homo sapiens
cagtgtacccccgcccaggctgg

SEQ ID NO: 1877383 - DNA, 15 bp, Homo sapiens
cagtgtcttcctgtg

SEQ ID NO: 1877384 - DNA, 16 bp, Homo sapiens
cagtgtcttcctgtgg

SEQ ID NO: 1877385 - DNA, 17 bp, Homo sapiens
cagtgtcttcctgtggg

SEQ ID NO: 1877386 - DNA, 21 bp, Homo sapiens
cagtgtgtggctttcagagcc

SEQ ID NO: 1877387 - DNA, 17 bp, Homo sapiens
cagtgttaggcctggca

SEQ ID NO: 1877388 - DNA, 22 bp, Homo sapiens
cagttctgaagaagatggtacc

SEQ ID NO: 1877389 - DNA, 19 bp, Homo sapiens
cagttgaacactagtctgt

SEQ ID NO: 1877390 - DNA, 22 bp, Homo sapiens
cagttgaacactagtctgtgta

SEQ ID NO: 1877391 - DNA, 15 bp, Homo sapiens
cagttgaactgcagg

SEQ ID NO: 1877392 - DNA, 19 bp, Homo sapiens
cagttggcttctgtgcctg

SEQ ID NO: 1877393 - DNA, 15 bp, Homo sapiens
cagttgtgtcataaa

SEQ ID NO: 1877394 - DNA, 21 bp, Homo sapiens
cagttgttctttagaggcttt

SEQ ID NO: 1877395 - DNA, 13 bp, Homo sapiens
cagttgttttccc

SEQ ID NO: 1877396 - DNA, 20 bp, Homo sapiens
cagtttttataatagatttt

SEQ ID NO: 1877397 - DNA, 17 bp, Homo sapiens
cataagatatttttcat

SEQ ID NO: 1877398 - DNA, 23 bp, Homo sapiens
cataatggttgtgaaatgtaaca

SEQ ID NO: 1877399 - DNA, 18 bp, Homo sapiens
catactggcctcgcctgg

SEQ ID NO: 1877400 - DNA, 22 bp, Homo sapiens
catactggcctcgcctggcctg

SEQ ID NO: 1877401 - DNA, 19 bp, Homo sapiens
catagacccatctggaggc

SEQ ID NO: 1877402 - DNA, 18 bp, Homo sapiens
catataaaagttgcgttt

SEQ ID NO: 1877403 - DNA, 15 bp, Homo sapiens
catatataacaatgc

SEQ ID NO: 1877404 - DNA, 14 bp, Homo sapiens
catattgtgtgtaa

SEQ ID NO: 1877405 - DNA, 17 bp, Homo sapiens
catcacttcttccactg

SEQ ID NO: 1877406 - DNA, 22 bp, Homo sapiens
catcagtgtacccccgcccagg

SEQ ID NO: 1877407 - DNA, 24 bp, Homo sapiens
catcagtgtacccccgcccaggct

SEQ ID NO: 1877408 - DNA, 13 bp, Homo sapiens
catccctggcccc

SEQ ID NO: 1877409 - DNA, 22 bp, Homo sapiens
catccctggccccctccctgga

SEQ ID NO: 1877410 - DNA, 15 bp, Homo sapiens
catcctggcccatca

SEQ ID NO: 1877411 - DNA, 12 bp, Homo sapiens
catccttctgcc

SEQ ID NO: 1877412 - DNA, 22 bp, Homo sapiens
catctagcagtaaatacttgca

SEQ ID NO: 1877413 - DNA, 11 bp, Homo sapiens
catctctgctg

SEQ ID NO: 1877414 - DNA, 20 bp, Homo sapiens
catctctgctgcttctgggc

SEQ ID NO: 1877415 - DNA, 11 bp, Homo sapiens
catctgcccag

SEQ ID NO: 1877416 - DNA, 13 bp, Homo sapiens
catctgcccagga

SEQ ID NO: 1877417 - DNA, 18 bp, Homo sapiens
catctggaggctcccatg

SEQ ID NO: 1877418 - DNA, 19 bp, Homo sapiens
catctggaggctcccatgg

SEQ ID NO: 1877419 - DNA, 16 bp, Homo sapiens
catctgggccaccagc

SEQ ID NO: 1877420 - DNA, 21 bp, Homo sapiens
catcttccaggtggggtgagg

SEQ ID NO: 1877421 - DNA, 20 bp, Homo sapiens
catcttgcccgctcaggctg

SEQ ID NO: 1877422 - DNA, 17 bp, Homo sapiens
catctttgtttttaaaa

SEQ ID NO: 1877423 - DNA, 17 bp, Homo sapiens
catgaagcaaactaact

SEQ ID NO: 1877424 - DNA, 15 bp, Homo sapiens
catgacttttccatg

SEQ ID NO: 1877425 - DNA, 16 bp, Homo sapiens
catgcaagtagctggc

SEQ ID NO: 1877426 - DNA, 17 bp, Homo sapiens
catgccccctcgtgcca

SEQ ID NO: 1877427 - DNA, 19 bp, Homo sapiens
catgccccctcgtgccagt

SEQ ID NO: 1877428 - DNA, 10 bp, Homo sapiens
catgccctgc

SEQ ID NO: 1877429 - DNA, 20 bp, Homo sapiens
catgccctgccaagcctgga

SEQ ID NO: 1877430 - DNA, 21 bp, Homo sapiens
catgccctgccaagcctggag

SEQ ID NO: 1877431 - DNA, 22 bp, Homo sapiens
catgccctgccaagcctggagc

SEQ ID NO: 1877432 - DNA, 23 bp, Homo sapiens
catgctggatgaccccatgctcc

SEQ ID NO: 1877433 - DNA, 21 bp, Homo sapiens
catgctggttacctgttccat

SEQ ID NO: 1877434 - DNA, 23 bp, Homo sapiens
catgctgtctacactaagagaga

SEQ ID NO: 1877435 - DNA, 16 bp, Homo sapiens
catggaatttgtaagt

SEQ ID NO: 1877436 - DNA, 13 bp, Homo sapiens
catgggcactgct

SEQ ID NO: 1877437 - DNA, 19 bp, Homo sapiens
catgggcactgctgggtgg

SEQ ID NO: 1877438 - DNA, 13 bp, Homo sapiens
catgggggaggct

SEQ ID NO: 1877439 - DNA, 16 bp, Homo sapiens
catgggggaggctctg

SEQ ID NO: 1877440 - DNA, 21 bp, Homo sapiens
catgtaacagttgtgtcataa

SEQ ID NO: 1877441 - DNA, 18 bp, Homo sapiens
catgtaagctgaaaatat

SEQ ID NO: 1877442 - DNA, 23 bp, Homo sapiens
catgtcaccggtcagtgcctttt

SEQ ID NO: 1877443 - DNA, 12 bp, Homo sapiens
catgtgcctgta

SEQ ID NO: 1877444 - DNA, 19 bp, Homo sapiens
catgtgctggtaaatgtta

SEQ ID NO: 1877445 - DNA, 14 bp, Homo sapiens
catgtgggggaagg

SEQ ID NO: 1877446 - DNA, 15 bp, Homo sapiens
catgtgggggaaggc

SEQ ID NO: 1877447 - DNA, 13 bp, Homo sapiens
cattattgagttc

SEQ ID NO: 1877448 - DNA, 22 bp, Homo sapiens
cattccaactatctcatttcca

SEQ ID NO: 1877449 - DNA, 23 bp, Homo sapiens
cattcctcaccttttcccgggga

SEQ ID NO: 1877450 - DNA, 17 bp, Homo sapiens
cattctgcctgcctggg

SEQ ID NO: 1877451 - DNA, 19 bp, Homo sapiens
cattctgcctgcctgggaa

SEQ ID NO: 1877452 - DNA, 16 bp, Homo sapiens
cattgcctttccaggg

SEQ ID NO: 1877453 - DNA, 23 bp, Homo sapiens
cattgcctttccagggttattta

SEQ ID NO: 1877454 - DNA, 14 bp, Homo sapiens
ccaagcaagtatta

SEQ ID NO: 1877455 - DNA, 16 bp, Homo sapiens
ccaagcctggagcccc

SEQ ID NO: 1877456 - DNA, 14 bp, Homo sapiens
ccaagctgtgccac

SEQ ID NO: 1877457 - DNA, 22 bp, Homo sapiens
ccaagctgtgccaccctgggct

SEQ ID NO: 1877458 - DNA, 16 bp, Homo sapiens
ccaagcttaaggagag

SEQ ID NO: 1877459 - DNA, 19 bp, Homo sapiens
ccaagcttaaggagaggag

SEQ ID NO: 1877460 - DNA, 13 bp, Homo sapiens
ccaataaaaacat

SEQ ID NO: 1877461 - DNA, 20 bp, Homo sapiens
ccacaccaagctgtgccacc

SEQ ID NO: 1877462 - DNA, 23 bp, Homo sapiens
ccacaccaagctgtgccaccctg

SEQ ID NO: 1877463 - DNA, 16 bp, Homo sapiens
ccacagaagtgctttc

SEQ ID NO: 1877464 - DNA, 17 bp, Homo sapiens
ccacagagtgtggtccc

SEQ ID NO: 1877465 - DNA, 14 bp, Homo sapiens
ccacagcccacgtc

SEQ ID NO: 1877466 - DNA, 18 bp, Homo sapiens
ccacagcccacgtcctgt

SEQ ID NO: 1877467 - DNA, 21 bp, Homo sapiens
ccacagtgttggcgagaggag

SEQ ID NO: 1877468 - DNA, 23 bp, Homo sapiens
ccacagtgttggcgagaggaggg

SEQ ID NO: 1877469 - DNA, 21 bp, Homo sapiens
ccaccagctccactggcctgc

SEQ ID NO: 1877470 - DNA, 14 bp, Homo sapiens
ccacccatgtcacc

SEQ ID NO: 1877471 - DNA, 16 bp, Homo sapiens
ccaccgcatgccccct

SEQ ID NO: 1877472 - DNA, 18 bp, Homo sapiens
ccacctagtggctgtcca

SEQ ID NO: 1877473 - DNA, 22 bp, Homo sapiens
ccacctagtggctgtccagtgc

SEQ ID NO: 1877474 - DNA, 23 bp, Homo sapiens
ccacctagtggctgtccagtgcc

SEQ ID NO: 1877475 - DNA, 19 bp, Homo sapiens
ccacctgaggccccaggtg

SEQ ID NO: 1877476 - DNA, 12 bp, Homo sapiens
ccacctgcctga

SEQ ID NO: 1877477 - DNA, 15 bp, Homo sapiens
ccacctgcctgacca

SEQ ID NO: 1877478 - DNA, 13 bp, Homo sapiens
ccacctgccttct

SEQ ID NO: 1877479 - DNA, 12 bp, Homo sapiens
ccacctgggctg

SEQ ID NO: 1877480 - DNA, 15 bp, Homo sapiens
ccacgaggaggaacc

SEQ ID NO: 1877481 - DNA, 19 bp, Homo sapiens
ccacgccctggggagtgag

SEQ ID NO: 1877482 - DNA, 23 bp, Homo sapiens
ccactaatcaggaggccaggcca

SEQ ID NO: 1877483 - DNA, 14 bp, Homo sapiens
ccactcacaacagc

SEQ ID NO: 1877484 - DNA, 14 bp, Homo sapiens
ccactgcaccccct

SEQ ID NO: 1877485 - DNA, 19 bp, Homo sapiens
ccactgcaccccctcctgc

SEQ ID NO: 1877486 - DNA, 20 bp, Homo sapiens
ccactgcaccccctcctgct

SEQ ID NO: 1877487 - DNA, 23 bp, Homo sapiens
ccacttcccaggtaagcaggagg

SEQ ID NO: 1877488 - DNA, 13 bp, Homo sapiens
ccacttcccctcc

SEQ ID NO: 1877489 - DNA, 14 bp, Homo sapiens
ccacttcccctcct

SEQ ID NO: 1877490 - DNA, 17 bp, Homo sapiens
ccagagcttcagggctg

SEQ ID NO: 1877491 - DNA, 15 bp, Homo sapiens
ccagagtctggagct

SEQ ID NO: 1877492 - DNA, 14 bp, Homo sapiens
ccagcacccgggct

SEQ ID NO: 1877493 - DNA, 20 bp, Homo sapiens
ccagcacccgggctcaggga

SEQ ID NO: 1877494 - DNA, 14 bp, Homo sapiens
ccagccccacagcc

SEQ ID NO: 1877495 - DNA, 15 bp, Homo sapiens
ccagccccacagccc

SEQ ID NO: 1877496 - DNA, 21 bp, Homo sapiens
ccagccccacagcccacgtcc

SEQ ID NO: 1877497 - DNA, 13 bp, Homo sapiens
ccagcctctgctc

SEQ ID NO: 1877498 - DNA, 13 bp, Homo sapiens
ccagcctggccca

SEQ ID NO: 1877499 - DNA, 18 bp, Homo sapiens
ccagcctggcccagctcc

SEQ ID NO: 1877500 - DNA, 17 bp, Homo sapiens
ccagctccactggcctg

SEQ ID NO: 1877501 - DNA, 18 bp, Homo sapiens
ccagctccactggcctgc

SEQ ID NO: 1877502 - DNA, 22 bp, Homo sapiens
ccagctccactggcctgcccgt

SEQ ID NO: 1877503 - DNA, 13 bp, Homo sapiens
ccagctgggctgt

SEQ ID NO: 1877504 - DNA, 21 bp, Homo sapiens
ccaggaccaagcttaaggaga

SEQ ID NO: 1877505 - DNA, 18 bp, Homo sapiens
ccaggacggggccggcca

SEQ ID NO: 1877506 - DNA, 18 bp, Homo sapiens
ccaggctggccagcccca

SEQ ID NO: 1877507 - DNA, 16 bp, Homo sapiens
ccagggccccggggcc

SEQ ID NO: 1877508 - DNA, 17 bp, Homo sapiens
ccaggggcaggcacagc

SEQ ID NO: 1877509 - DNA, 18 bp, Homo sapiens
ccaggggcaggcacagca

SEQ ID NO: 1877510 - DNA, 22 bp, Homo sapiens
ccaggtgggcgggcagcacagc

SEQ ID NO: 1877511 - DNA, 15 bp, Homo sapiens
ccaggtgtctagagg

SEQ ID NO: 1877512 - DNA, 22 bp, Homo sapiens
ccagtcctcacatgcccgctgt

SEQ ID NO: 1877513 - DNA, 17 bp, Homo sapiens
ccagtcgcgctgcctgt

SEQ ID NO: 1877514 - DNA, 21 bp, Homo sapiens
ccagtcgcgctgcctgtgtgg

SEQ ID NO: 1877515 - DNA, 16 bp, Homo sapiens
ccagtgaccaaccttt

SEQ ID NO: 1877516 - DNA, 13 bp, Homo sapiens
ccagtgcccattc

SEQ ID NO: 1877517 - DNA, 15 bp, Homo sapiens
ccagtgtcttcctgt

SEQ ID NO: 1877518 - DNA, 16 bp, Homo sapiens
ccagtgtcttcctgtg

SEQ ID NO: 1877519 - DNA, 18 bp, Homo sapiens
ccagtgtgtggctttcag

SEQ ID NO: 1877520 - DNA, 23 bp, Homo sapiens
ccagttgaacactagtctgtgta

SEQ ID NO: 1877521 - DNA, 19 bp, Homo sapiens
ccagttgaactgcaggaag

SEQ ID NO: 1877522 - DNA, 15 bp, Homo sapiens
ccataccaggtgcta

SEQ ID NO: 1877523 - DNA, 15 bp, Homo sapiens
ccatacctttccagg

SEQ ID NO: 1877524 - DNA, 18 bp, Homo sapiens
ccatactggcctcgcctg

SEQ ID NO: 1877525 - DNA, 22 bp, Homo sapiens
ccatactggcctcgcctggcct

SEQ ID NO: 1877526 - DNA, 13 bp, Homo sapiens
ccatcaacctctg

SEQ ID NO: 1877527 - DNA, 21 bp, Homo sapiens
ccatcagcaggctccagttga

SEQ ID NO: 1877528 - DNA, 22 bp, Homo sapiens
ccatcagcaggctccagttgaa

SEQ ID NO: 1877529 - DNA, 23 bp, Homo sapiens
ccatcagtgtacccccgcccagg

SEQ ID NO: 1877530 - DNA, 14 bp, Homo sapiens
ccatcccccctcac

SEQ ID NO: 1877531 - DNA, 20 bp, Homo sapiens
ccatcccccctcaccagggg

SEQ ID NO: 1877532 - DNA, 21 bp, Homo sapiens
ccatcccccctcaccaggggc

SEQ ID NO: 1877533 - DNA, 22 bp, Homo sapiens
ccatcccccctcaccaggggca

SEQ ID NO: 1877534 - DNA, 15 bp, Homo sapiens
ccatcctgccacagg

SEQ ID NO: 1877535 - DNA, 12 bp, Homo sapiens
ccatcctggccc

SEQ ID NO: 1877536 - DNA, 20 bp, Homo sapiens
ccatctctgctgcttctggg

SEQ ID NO: 1877537 - DNA, 21 bp, Homo sapiens
ccatctctgctgcttctgggc

SEQ ID NO: 1877538 - DNA, 14 bp, Homo sapiens
ccatcttccaggtg

SEQ ID NO: 1877539 - DNA, 16 bp, Homo sapiens
ccatcttccaggtggg

SEQ ID NO: 1877540 - DNA, 18 bp, Homo sapiens
ccatgccctgccaagcct

SEQ ID NO: 1877541 - DNA, 20 bp, Homo sapiens
ccatggcttccaaggtggtc

SEQ ID NO: 1877542 - DNA, 14 bp, Homo sapiens
ccatgggcactgct

SEQ ID NO: 1877543 - DNA, 17 bp, Homo sapiens
ccatgggcactgctggg

SEQ ID NO: 1877544 - DNA, 20 bp, Homo sapiens
ccatgtcaccggtcagtgcc

SEQ ID NO: 1877545 - DNA, 13 bp, Homo sapiens
ccatgttggctag

SEQ ID NO: 1877546 - DNA, 17 bp, Homo sapiens
ccattattgagttcctc

SEQ ID NO: 1877547 - DNA, 22 bp, Homo sapiens
ccattcctcaccttttcccggg

SEQ ID NO: 1877548 - DNA, 11 bp, Homo sapiens
ccatttttcct

SEQ ID NO: 1877549 - DNA, 13 bp, Homo sapiens
cccaactccagaa

SEQ ID NO: 1877550 - DNA, 13 bp, Homo sapiens
aacttatttgagt

SEQ ID NO: 1877551 - DNA, 21 bp, Homo sapiens
aacttcagcggtttatataag

SEQ ID NO: 1877552 - DNA, 19 bp, Homo sapiens
aacttttttttttttaaca

SEQ ID NO: 1877553 - DNA, 20 bp, Homo sapiens
aacttttttttttttaacat

SEQ ID NO: 1877554 - DNA, 23 bp, Homo sapiens
aacttttttttttttaacatctt

SEQ ID NO: 1877555 - DNA, 19 bp, Homo sapiens
aagaaaattagtaattgta

SEQ ID NO: 1877556 - DNA, 13 bp, Homo sapiens
aagacaatataat

SEQ ID NO: 1877557 - DNA, 18 bp, Homo sapiens
aagagagaaaacttattt

SEQ ID NO: 1877558 - DNA, 19 bp, Homo sapiens
aagagatgaacatctgggg

SEQ ID NO: 1877559 - DNA, 17 bp, Homo sapiens
aagagatttttcatgat

SEQ ID NO: 1877560 - DNA, 17 bp, Homo sapiens
aagatatttttcatgat

SEQ ID NO: 1877561 - DNA, 23 bp, Homo sapiens
aagatcttggcttaatttaatgt

SEQ ID NO: 1877562 - DNA, 16 bp, Homo sapiens
aagatttaccacttgt

SEQ ID NO: 1877563 - DNA, 16 bp, Homo sapiens
aagatttccatataaa

SEQ ID NO: 1877564 - DNA, 12 bp, Homo sapiens
aagcaaatgtgt

SEQ ID NO: 1877565 - DNA, 11 bp, Homo sapiens
aagcacctcaa

SEQ ID NO: 1877566 - DNA, 21 bp, Homo sapiens
aagcacgtggtaaaacacttg

SEQ ID NO: 1877567 - DNA, 11 bp, Homo sapiens
aagcagctctt

SEQ ID NO: 1877568 - DNA, 21 bp, Homo sapiens
aagcaggaggaggtgccaaca

SEQ ID NO: 1877569 - DNA, 13 bp, Homo sapiens
aagccatttaact

SEQ ID NO: 1877570 - DNA, 17 bp, Homo sapiens
aagcctctgtgtcactg

SEQ ID NO: 1877571 - DNA, 18 bp, Homo sapiens
aagcctctgtgtcactgg

SEQ ID NO: 1877572 - DNA, 20 bp, Homo sapiens
aagcctctgtgtcactggct

SEQ ID NO: 1877573 - DNA, 22 bp, Homo sapiens
aagcctctgtgtcactggctgc

SEQ ID NO: 1877574 - DNA, 15 bp, Homo sapiens
aagcctggagcccct

SEQ ID NO: 1877575 - DNA, 12 bp, Homo sapiens
aagccttcattt

SEQ ID NO: 1877576 - DNA, 13 bp, Homo sapiens
aagccttcatttg

SEQ ID NO: 1877577 - DNA, 23 bp, Homo sapiens
aagcggaaaaggttttattttgt

SEQ ID NO: 1877578 - DNA, 14 bp, Homo sapiens
aagctgtgccaccc

SEQ ID NO: 1877579 - DNA, 13 bp, Homo sapiens
aaggaaatatatt

SEQ ID NO: 1877580 - DNA, 15 bp, Homo sapiens
aaggaaatatatttg

SEQ ID NO: 1877581 - DNA, 22 bp, Homo sapiens
aaggaagggcatccttctgcct

SEQ ID NO: 1877582 - DNA, 21 bp, Homo sapiens
aaggaccctgtttctgtagaa

SEQ ID NO: 1877583 - DNA, 22 bp, Homo sapiens
aaggaccctgtttctgtagaaa

SEQ ID NO: 1877584 - DNA, 18 bp, Homo sapiens
aaggagattttccttcct

SEQ ID NO: 1877585 - DNA, 23 bp, Homo sapiens
aaggaggatggcatataatacaa

SEQ ID NO: 1877586 - DNA, 13 bp, Homo sapiens
aaggaggctggct

SEQ ID NO: 1877587 - DNA, 16 bp, Homo sapiens
aaggcctcccacagtg

SEQ ID NO: 1877588 - DNA, 13 bp, Homo sapiens
aaggccttgctgt

SEQ ID NO: 1877589 - DNA, 14 bp, Homo sapiens
aagggcatccttct

SEQ ID NO: 1877590 - DNA, 17 bp, Homo sapiens
aagggcatccttctgcc

SEQ ID NO: 1877591 - DNA, 15 bp, Homo sapiens
aagggctgttataat

SEQ ID NO: 1877592 - DNA, 21 bp, Homo sapiens
aaggggcaggaatcaaggagc

SEQ ID NO: 1877593 - DNA, 14 bp, Homo sapiens
aagggttgagctgg

SEQ ID NO: 1877594 - DNA, 13 bp, Homo sapiens
aaggtacttcaaa

SEQ ID NO: 1877595 - DNA, 14 bp, Homo sapiens
aaggtacttcaaat

SEQ ID NO: 1877596 - DNA, 14 bp, Homo sapiens
aaggtgcttgggct

SEQ ID NO: 1877597 - DNA, 19 bp, Homo sapiens
aaggtgcttgggcttctgc

SEQ ID NO: 1877598 - DNA, 23 bp, Homo sapiens
aagtacagaatagaatacattga

SEQ ID NO: 1877599 - DNA, 21 bp, Homo sapiens
aagtatgttagtgcaaattgt

SEQ ID NO: 1877600 - DNA, 18 bp, Homo sapiens
aagtccaagcatttagat

SEQ ID NO: 1877601 - DNA, 20 bp, Homo sapiens
aagtctaaagtttacagtaa

SEQ ID NO: 1877602 - DNA, 23 bp, Homo sapiens
aagtctattgtttgttgtgcttg

SEQ ID NO: 1877603 - DNA, 18 bp, Homo sapiens
aagtgattgtatgaattt

SEQ ID NO: 1877604 - DNA, 15 bp, Homo sapiens
aagtgcagtcatttg

SEQ ID NO: 1877605 - DNA, 23 bp, Homo sapiens
aagtgtttcataaatttgagagt

SEQ ID NO: 1877606 - DNA, 12 bp, Homo sapiens
aagtttacagta

SEQ ID NO: 1877607 - DNA, 21 bp, Homo sapiens
aagtttacagtaaataaattg

SEQ ID NO: 1877608 - DNA, 17 bp, Homo sapiens
aagtttatgtctaaaga

SEQ ID NO: 1877609 - DNA, 18 bp, Homo sapiens
aagtttgttcacttaaat

SEQ ID NO: 1877610 - DNA, 14 bp, Homo sapiens
aagtttgttgaaaa

SEQ ID NO: 1877611 - DNA, 20 bp, Homo sapiens
aataaaaacattttgaagtg

SEQ ID NO: 1877612 - DNA, 12 bp, Homo sapiens
aataaaattgta

SEQ ID NO: 1877613 - DNA, 14 bp, Homo sapiens
aataaagctcaagg

SEQ ID NO: 1877614 - DNA, 17 bp, Homo sapiens
aataatatattttaaat

SEQ ID NO: 1877615 - DNA, 17 bp, Homo sapiens
aataatttttatatttg

SEQ ID NO: 1877616 - DNA, 13 bp, Homo sapiens
aatacagaattga

SEQ ID NO: 1877617 - DNA, 19 bp, Homo sapiens
aatacattgatacaaagta

SEQ ID NO: 1877618 - DNA, 23 bp, Homo sapiens
aataccaccatttaaaaatgtta

SEQ ID NO: 1877619 - DNA, 12 bp, Homo sapiens
aatacttgcagt

SEQ ID NO: 1877620 - DNA, 14 bp, Homo sapiens
aatacttgcagttg

SEQ ID NO: 1877621 - DNA, 16 bp, Homo sapiens
aatacttgcagttgtg

SEQ ID NO: 1877622 - DNA, 22 bp, Homo sapiens
aatagaagcccaaattcatata

SEQ ID NO: 1877623 - DNA, 13 bp, Homo sapiens
aatagatatataa

SEQ ID NO: 1877624 - DNA, 21 bp, Homo sapiens
aatagatatccacttgagaca

SEQ ID NO: 1877625 - DNA, 15 bp, Homo sapiens
aatagatgtcttcat

SEQ ID NO: 1877626 - DNA, 16 bp, Homo sapiens
aatagtcaaattgtgt

SEQ ID NO: 1877627 - DNA, 12 bp, Homo sapiens
aatatataaaca

SEQ ID NO: 1877628 - DNA, 14 bp, Homo sapiens
aatatataaacact

SEQ ID NO: 1877629 - DNA, 20 bp, Homo sapiens
aatatcacttgtcaataaaa

SEQ ID NO: 1877630 - DNA, 15 bp, Homo sapiens
aatatttattttaat

SEQ ID NO: 1877631 - DNA, 17 bp, Homo sapiens
aatcagcctacaggcct

SEQ ID NO: 1877632 - DNA, 23 bp, Homo sapiens
aatcataagatatttttcatgat

SEQ ID NO: 1877633 - DNA, 20 bp, Homo sapiens
aatcatgaagatatttttcc

SEQ ID NO: 1877634 - DNA, 19 bp, Homo sapiens
aatcatgaattagttttat

SEQ ID NO: 1877635 - DNA, 16 bp, Homo sapiens
aatctcaatatttcag

SEQ ID NO: 1877636 - DNA, 18 bp, Homo sapiens
aatctgtttgtgcaaaca

SEQ ID NO: 1877637 - DNA, 22 bp, Homo sapiens
aatctgtttgtgcaaacataat

SEQ ID NO: 1877638 - DNA, 21 bp, Homo sapiens
aatgacagaatgctgttttaa

SEQ ID NO: 1877639 - DNA, 21 bp, Homo sapiens
aatgagagacacactgaagaa

SEQ ID NO: 1877640 - DNA, 13 bp, Homo sapiens
aatgagggctgag

SEQ ID NO: 1877641 - DNA, 17 bp, Homo sapiens
aatgataactggaaact

SEQ ID NO: 1877642 - DNA, 13 bp, Homo sapiens
aatgatagaactt

SEQ ID NO: 1877643 - DNA, 15 bp, Homo sapiens
aatgatagaactttg

SEQ ID NO: 1877644 - DNA, 20 bp, Homo sapiens
aatgctgtattttaaaagaa

SEQ ID NO: 1877645 - DNA, 21 bp, Homo sapiens
aatgctgtattttaaaagaat

SEQ ID NO: 1877646 - DNA, 12 bp, Homo sapiens
aatggttgtgaa

SEQ ID NO: 1877647 - DNA, 21 bp, Homo sapiens
aatggttgtgaaatgtaacat

SEQ ID NO: 1877648 - DNA, 13 bp, Homo sapiens
aatgtaacatgaa

SEQ ID NO: 1877649 - DNA, 14 bp, Homo sapiens
aatgtaacatgaag

SEQ ID NO: 1877650 - DNA, 17 bp, Homo sapiens
aatgtattaatctgttt

SEQ ID NO: 1877651 - DNA, 18 bp, Homo sapiens
aatgtattgattacaaat

SEQ ID NO: 1877652 - DNA, 18 bp, Homo sapiens
aatgtgtgggatcattgc

SEQ ID NO: 1877653 - DNA, 21 bp, Homo sapiens
aatgtgtgggatcattgcatt

SEQ ID NO: 1877654 - DNA, 15 bp, Homo sapiens
aattacgtttaaagt

SEQ ID NO: 1877655 - DNA, 12 bp, Homo sapiens
aattattgtaca

SEQ ID NO: 1877656 - DNA, 13 bp, Homo sapiens
aattattgtgatt

SEQ ID NO: 1877657 - DNA, 19 bp, Homo sapiens
aattcatgtaacagttgtg

SEQ ID NO: 1877658 - DNA, 19 bp, Homo sapiens
aattctttcacttgatgtt

SEQ ID NO: 1877659 - DNA, 21 bp, Homo sapiens
aattgaggagagggactgaat

SEQ ID NO: 1877660 - DNA, 23 bp, Homo sapiens
aattgctatgttttgacattttt

SEQ ID NO: 1877661 - DNA, 15 bp, Homo sapiens
aattggagctcgtgg

SEQ ID NO: 1877662 - DNA, 18 bp, Homo sapiens
aattgggtgtgccctggc

SEQ ID NO: 1877663 - DNA, 15 bp, Homo sapiens
aattgtatagagata

SEQ ID NO: 1877664 - DNA, 23 bp, Homo sapiens
aattgtatagagatatgcagaag

SEQ ID NO: 1877665 - DNA, 18 bp, Homo sapiens
aatttaggtaaataaagc

SEQ ID NO: 1877666 - DNA, 19 bp, Homo sapiens
aatttaggtaaataaagct

SEQ ID NO: 1877667 - DNA, 14 bp, Homo sapiens
aatttgtatctgaa

SEQ ID NO: 1877668 - DNA, 15 bp, Homo sapiens
aatttgtcatgttac

SEQ ID NO: 1877669 - DNA, 20 bp, Homo sapiens
aatttgtcatgttactaaat

SEQ ID NO: 1877670 - DNA, 17 bp, Homo sapiens
aattttgtgaagcaaaa

SEQ ID NO: 1877671 - DNA, 23 bp, Homo sapiens
acaaagtactcctcacttttcaa

SEQ ID NO: 1877672 - DNA, 17 bp, Homo sapiens
acaaataaacagttgtt

SEQ ID NO: 1877673 - DNA, 21 bp, Homo sapiens
acaaatctcaagcaaacagct

SEQ ID NO: 1877674 - DNA, 17 bp, Homo sapiens
acaacttgtgttctatt

SEQ ID NO: 1877675 - DNA, 22 bp, Homo sapiens
acaagctcacagacctttgaac

SEQ ID NO: 1877676 - DNA, 22 bp, Homo sapiens
acaatgctgtattttaaaagaa

SEQ ID NO: 1877677 - DNA, 23 bp, Homo sapiens
acacactcgggttaagaaatacc

SEQ ID NO: 1877678 - DNA, 15 bp, Homo sapiens
acacatgaagtccaa

SEQ ID NO: 1877679 - DNA, 17 bp, Homo sapiens
acaccaagctgtgccac

SEQ ID NO: 1877680 - DNA, 22 bp, Homo sapiens
acaccaagctgtgccaccctgg

SEQ ID NO: 1877681 - DNA, 16 bp, Homo sapiens
acacccttggacttga

SEQ ID NO: 1877682 - DNA, 16 bp, Homo sapiens
acacctctgggccctg

SEQ ID NO: 1877683 - DNA, 17 bp, Homo sapiens
acacctctgggccctgc

SEQ ID NO: 1877684 - DNA, 18 bp, Homo sapiens
acacctctgggccctgca

SEQ ID NO: 1877685 - DNA, 17 bp, Homo sapiens
acaccttaggttgacat

SEQ ID NO: 1877686 - DNA, 21 bp, Homo sapiens
acactaaacagactatttaac

SEQ ID NO: 1877687 - DNA, 17 bp, Homo sapiens
acactaagagagaatga

SEQ ID NO: 1877688 - DNA, 19 bp, Homo sapiens
acactaagagagaatgaga

SEQ ID NO: 1877689 - DNA, 12 bp, Homo sapiens
acactagtctgt

SEQ ID NO: 1877690 - DNA, 16 bp, Homo sapiens
acactagtctgtgtaa

SEQ ID NO: 1877691 - DNA, 14 bp, Homo sapiens
acactccacagtgt

SEQ ID NO: 1877692 - DNA, 18 bp, Homo sapiens
acactgcggggcttggct

SEQ ID NO: 1877693 - DNA, 15 bp, Homo sapiens
acacttatattttga

SEQ ID NO: 1877694 - DNA, 19 bp, Homo sapiens
acacttatattttgatttt

SEQ ID NO: 1877695 - DNA, 19 bp, Homo sapiens
acacttcagcctgtgcagg

SEQ ID NO: 1877696 - DNA, 14 bp, Homo sapiens
acagaaaaatactt

SEQ ID NO: 1877697 - DNA, 20 bp, Homo sapiens
acagaaaaatactttgattt

SEQ ID NO: 1877698 - DNA, 16 bp, Homo sapiens
acagaagctccaggta

SEQ ID NO: 1877699 - DNA, 21 bp, Homo sapiens
acagactagaagtatttgtgg

SEQ ID NO: 1877700 - DNA, 17 bp, Homo sapiens
acagactatttaacttg

SEQ ID NO: 1877701 - DNA, 16 bp, Homo sapiens
acagagaaaagtcagg

SEQ ID NO: 1877702 - DNA, 19 bp, Homo sapiens
acagagaaaagtcaggtgc

SEQ ID NO: 1877703 - DNA, 21 bp, Homo sapiens
acagagaaaagtcaggtgcag

SEQ ID NO: 1877704 - DNA, 16 bp, Homo sapiens
acagagtgtggtccct

SEQ ID NO: 1877705 - DNA, 16 bp, Homo sapiens
acagcaaggaggctgg

SEQ ID NO: 1877706 - DNA, 21 bp, Homo sapiens
acagcaaggaggctggctggg

SEQ ID NO: 1877707 - DNA, 16 bp, Homo sapiens
acagcaaggcacctgc

SEQ ID NO: 1877708 - DNA, 15 bp, Homo sapiens
acagcccacgtcctg

SEQ ID NO: 1877709 - DNA, 14 bp, Homo sapiens
acagccctcccgcc

SEQ ID NO: 1877710 - DNA, 18 bp, Homo sapiens
acagccctcccgcccctt

SEQ ID NO: 1877711 - DNA, 21 bp, Homo sapiens
acagcccttctttccacagaa

SEQ ID NO: 1877712 - DNA, 16 bp, Homo sapiens
acagcctcttagatgc

SEQ ID NO: 1877713 - DNA, 23 bp, Homo sapiens
acagctgtatgattcccagccag

SEQ ID NO: 1877714 - DNA, 17 bp, Homo sapiens
acaggcaaaccaataca

SEQ ID NO: 1877715 - DNA, 15 bp, Homo sapiens
acaggggctcaggat

SEQ ID NO: 1877716 - DNA, 13 bp, Homo sapiens
acaggttggccag

SEQ ID NO: 1877717 - DNA, 12 bp, Homo sapiens
acagtaaataaa

SEQ ID NO: 1877718 - DNA, 14 bp, Homo sapiens
acagtaaataaatt

SEQ ID NO: 1877719 - DNA, 23 bp, Homo sapiens
acagtaaataaattgtttgacca

SEQ ID NO: 1877720 - DNA, 18 bp, Homo sapiens
acagtgactcgggctcct

SEQ ID NO: 1877721 - DNA, 19 bp, Homo sapiens
acagtgactcgggctcctg

SEQ ID NO: 1877722 - DNA, 20 bp, Homo sapiens
acagtgactcgggctcctgt

SEQ ID NO: 1877723 - DNA, 18 bp, Homo sapiens
acagtgcagcttgcagtc

SEQ ID NO: 1877724 - DNA, 16 bp, Homo sapiens
acagtgtctgggctga

SEQ ID NO: 1877725 - DNA, 21 bp, Homo sapiens
acagtgttaggcctggcacag

SEQ ID NO: 1877726 - DNA, 16 bp, Homo sapiens
acagtgttctgagccc

SEQ ID NO: 1877727 - DNA, 20 bp, Homo sapiens
acagtttaataccacagctt

SEQ ID NO: 1877728 - DNA, 20 bp, Homo sapiens
acataataccaccatttaaa

SEQ ID NO: 1877729 - DNA, 21 bp, Homo sapiens
acataatggttgtgaaatgta

SEQ ID NO: 1877730 - DNA, 19 bp, Homo sapiens
acatatataacaatgctgt

SEQ ID NO: 1877731 - DNA, 17 bp, Homo sapiens
acatccagtggggtctc

SEQ ID NO: 1877732 - DNA, 20 bp, Homo sapiens
acatcccttacctgggaaag

SEQ ID NO: 1877733 - DNA, 19 bp, Homo sapiens
acatctttgtttttaaaat

SEQ ID NO: 1877734 - DNA, 13 bp, Homo sapiens
acatgagtgtcaa

SEQ ID NO: 1877735 - DNA, 11 bp, Homo sapiens
acatgggacat

SEQ ID NO: 1877736 - DNA, 14 bp, Homo sapiens
acatgggacatttg

SEQ ID NO: 1877737 - DNA, 15 bp, Homo sapiens
acatgggacatttgc

SEQ ID NO: 1877738 - DNA, 19 bp, Homo sapiens
acattaaagccctgtgtta

SEQ ID NO: 1877739 - DNA, 12 bp, Homo sapiens
acatttaacata

SEQ ID NO: 1877740 - DNA, 23 bp, Homo sapiens
accaaaaatctcaatatttcaga

SEQ ID NO: 1877741 - DNA, 20 bp, Homo sapiens
accaacccagccgctgcccg

SEQ ID NO: 1877742 - DNA, 17 bp, Homo sapiens
accaacccatgccctgc

SEQ ID NO: 1877743 - DNA, 14 bp, Homo sapiens
accaagctgtgcca

SEQ ID NO: 1877744 - DNA, 19 bp, Homo sapiens
accaagcttaaggagagga

SEQ ID NO: 1877745 - DNA, 20 bp, Homo sapiens
accaagcttaaggagaggag

SEQ ID NO: 1877746 - DNA, 23 bp, Homo sapiens
accaagtttcaggtattaagaaa

SEQ ID NO: 1877747 - DNA, 13 bp, Homo sapiens
accaatcatgaat

SEQ ID NO: 1877748 - DNA, 18 bp, Homo sapiens
accacagcaaggcacctg

SEQ ID NO: 1877749 - DNA, 19 bp, Homo sapiens
accacagcaaggcacctgc

SEQ ID NO: 1877750 - DNA, 21 bp, Homo sapiens
accacagcaaggcacctgcag

SEQ ID NO: 1877751 - DNA, 16 bp, Homo sapiens
accactgtgtatttaa

SEQ ID NO: 1877752 - DNA, 19 bp, Homo sapiens
accacttgtgttttgcaag

SEQ ID NO: 1877753 - DNA, 23 bp, Homo sapiens
accacttgtgttttgcaagccag

SEQ ID NO: 1877754 - DNA, 13 bp, Homo sapiens
accagagtctgga

SEQ ID NO: 1877755 - DNA, 20 bp, Homo sapiens
accagcctgaccaacatggt

SEQ ID NO: 1877756 - DNA, 17 bp, Homo sapiens
accagctccactggcct

SEQ ID NO: 1877757 - DNA, 17 bp, Homo sapiens
accaggggcaggcacag

SEQ ID NO: 1877758 - DNA, 18 bp, Homo sapiens
accaggggcaggcacagc

SEQ ID NO: 1877759 - DNA, 19 bp, Homo sapiens
accaggggcaggcacagca

SEQ ID NO: 1877760 - DNA, 18 bp, Homo sapiens
accaggtgtctagaggca

SEQ ID NO: 1877761 - DNA, 16 bp, Homo sapiens
acccacagagtgtggt

SEQ ID NO: 1877762 - DNA, 17 bp, Homo sapiens
acccacgaggaggaacc

SEQ ID NO: 1877763 - DNA, 23 bp, Homo sapiens
acccagaaaaaaagcccaacaca

SEQ ID NO: 1877764 - DNA, 16 bp, Homo sapiens
acccagccgctgcccg

SEQ ID NO: 1877765 - DNA, 18 bp, Homo sapiens
acccagccgctgcccggc

SEQ ID NO: 1877766 - DNA, 16 bp, Homo sapiens
acccagtctgttcccc

SEQ ID NO: 1877767 - DNA, 14 bp, Homo sapiens
acccatctggaggc

SEQ ID NO: 1877768 - DNA, 23 bp, Homo sapiens
acccatgtcaccggtcagtgcct

SEQ ID NO: 1877769 - DNA, 16 bp, Homo sapiens
accccatctctgctgc

SEQ ID NO: 1877770 - DNA, 22 bp, Homo sapiens
accccatctctgctgcttctgg

SEQ ID NO: 1877771 - DNA, 13 bp, Homo sapiens
accccatctgccc

SEQ ID NO: 1877772 - DNA, 15 bp, Homo sapiens
accccatctgcccag

SEQ ID NO: 1877773 - DNA, 18 bp, Homo sapiens
acccccagcacccgggct

SEQ ID NO: 1877774 - DNA, 16 bp, Homo sapiens
acccccgcccaggctg

SEQ ID NO: 1877775 - DNA, 12 bp, Homo sapiens
acccctcccctc

SEQ ID NO: 1877776 - DNA, 20 bp, Homo sapiens
accccttttcagcttctgct

SEQ ID NO: 1877777 - DNA, 23 bp, Homo sapiens
accccttttcagcttctgctggg

SEQ ID NO: 1877778 - DNA, 16 bp, Homo sapiens
acccgttcacattttt

SEQ ID NO: 1877779 - DNA, 18 bp, Homo sapiens
accctacacctctgggcc

SEQ ID NO: 1877780 - DNA, 19 bp, Homo sapiens
accctacacctctgggccc

SEQ ID NO: 1877781 - DNA, 22 bp, Homo sapiens
accctacacctctgggccctgc

SEQ ID NO: 1877782 - DNA, 13 bp, Homo sapiens
accctcccctccc

SEQ ID NO: 1877783 - DNA, 14 bp, Homo sapiens
accctccctgctgt

SEQ ID NO: 1877784 - DNA, 13 bp, Homo sapiens
accctgtttctgt

SEQ ID NO: 1877785 - DNA, 18 bp, Homo sapiens
acccttggacttgaggat

SEQ ID NO: 1877786 - DNA, 22 bp, Homo sapiens
accgcatgccccctcgtgccag

SEQ ID NO: 1877787 - DNA, 15 bp, Homo sapiens
accggtcagtgcctt

SEQ ID NO: 1877788 - DNA, 22 bp, Homo sapiens
acctagtggctgtccagtgccc

SEQ ID NO: 1877789 - DNA, 16 bp, Homo sapiens
acctcaagtgcaagga

SEQ ID NO: 1877790 - DNA, 17 bp, Homo sapiens
acctctgaggactctgg

SEQ ID NO: 1877791 - DNA, 23 bp, Homo sapiens
acctctgggccctgcaggaggcc

SEQ ID NO: 1877792 - DNA, 18 bp, Homo sapiens
acctgagtctgctatatt

SEQ ID NO: 1877793 - DNA, 23 bp, Homo sapiens
acctgccttctcactagctgtct

SEQ ID NO: 1877794 - DNA, 18 bp, Homo sapiens
acctgggctgggagaagg

SEQ ID NO: 1877795 - DNA, 18 bp, Homo sapiens
acctgtcatctgggccac

SEQ ID NO: 1877796 - DNA, 23 bp, Homo sapiens
accttagctacatagcagacttt

SEQ ID NO: 1877797 - DNA, 16 bp, Homo sapiens
acctttcagctgtgaa

SEQ ID NO: 1877798 - DNA, 17 bp, Homo sapiens
acgaggtggtagctctg

SEQ ID NO: 1877799 - DNA, 12 bp, Homo sapiens
acgccctgggga

SEQ ID NO: 1877800 - DNA, 15 bp, Homo sapiens
acggatggaaggaga

SEQ ID NO: 1877801 - DNA, 14 bp, Homo sapiens
acggggccggccag

SEQ ID NO: 1877802 - DNA, 17 bp, Homo sapiens
acgtgtatgtttcttct

SEQ ID NO: 1877803 - DNA, 20 bp, Homo sapiens
actaaatggtgttacattaa

SEQ ID NO: 1877804 - DNA, 21 bp, Homo sapiens
actaacttttttttttttaac

SEQ ID NO: 1877805 - DNA, 23 bp, Homo sapiens
actaacttttttttttttaacat

SEQ ID NO: 1877806 - DNA, 19 bp, Homo sapiens
actaataaaaaactgtgaa

SEQ ID NO: 1877807 - DNA, 23 bp, Homo sapiens
actaccctacacctctgggccct

SEQ ID NO: 1877808 - DNA, 20 bp, Homo sapiens
actagagtttagctggaaaa

SEQ ID NO: 1877809 - DNA, 18 bp, Homo sapiens
actagtatttctatgaaa

SEQ ID NO: 1877810 - DNA, 17 bp, Homo sapiens
actagtctgtgtaactt

SEQ ID NO: 1877811 - DNA, 18 bp, Homo sapiens
actagtctgtgtaacttt

SEQ ID NO: 1877812 - DNA, 16 bp, Homo sapiens
actatagtgtaataat

SEQ ID NO: 1877813 - DNA, 20 bp, Homo sapiens
actatagtgtaataatgtta

SEQ ID NO: 1877814 - DNA, 17 bp, Homo sapiens
actatattgtttgctaa

SEQ ID NO: 1877815 - DNA, 22 bp, Homo sapiens
actatattgtttgctaagcatt

SEQ ID NO: 1877816 - DNA, 16 bp, Homo sapiens
actatctcatttccaa

SEQ ID NO: 1877817 - DNA, 15 bp, Homo sapiens
actatttaacttgag

SEQ ID NO: 1877818 - DNA, 17 bp, Homo sapiens
actcacaacagctgcct

SEQ ID NO: 1877819 - DNA, 18 bp, Homo sapiens
actccagaaagtgacaag

SEQ ID NO: 1877820 - DNA, 17 bp, Homo sapiens
actcccacttccctgac

SEQ ID NO: 1877821 - DNA, 15 bp, Homo sapiens
actcgggctcctgtg

SEQ ID NO: 1877822 - DNA, 17 bp, Homo sapiens
actcgggctcctgtgcc

SEQ ID NO: 1877823 - DNA, 19 bp, Homo sapiens
actcgggctcctgtgccct

SEQ ID NO: 1877824 - DNA, 17 bp, Homo sapiens
actcgggttaagaaata

SEQ ID NO: 1877825 - DNA, 22 bp, Homo sapiens
actcggtcaaaatattttttaa

SEQ ID NO: 1877826 - DNA, 19 bp, Homo sapiens
actcgttaatttgtagtgt

SEQ ID NO: 1877827 - DNA, 19 bp, Homo sapiens
actctatagttattgtttt

SEQ ID NO: 1877828 - DNA, 22 bp, Homo sapiens
actctcactatgctgctatgga

SEQ ID NO: 1877829 - DNA, 21 bp, Homo sapiens
actctgtgcccatgggcactg

SEQ ID NO: 1877830 - DNA, 15 bp, Homo sapiens
actcttaagaagact

SEQ ID NO: 1877831 - DNA, 21 bp, Homo sapiens
actcttaagaagactgcatta

SEQ ID NO: 1877832 - DNA, 16 bp, Homo sapiens
actctttttgtacctg

SEQ ID NO: 1877833 - DNA, 22 bp, Homo sapiens
actgaagaagcaccaatcatga

SEQ ID NO: 1877834 - DNA, 15 bp, Homo sapiens
actgactcttaagaa

SEQ ID NO: 1877835 - DNA, 17 bp, Homo sapiens
actgactcttaagaaga

SEQ ID NO: 1877836 - DNA, 18 bp, Homo sapiens
actgactcttaagaagac

SEQ ID NO: 1877837 - DNA, 17 bp, Homo sapiens
actgaggtggtggacat

SEQ ID NO: 1877838 - DNA, 19 bp, Homo sapiens
actgatatgggtcttgata

SEQ ID NO: 1877839 - DNA, 21 bp, Homo sapiens
actgcaccccctcctgctgca

SEQ ID NO: 1877840 - DNA, 13 bp, Homo sapiens
actgcagaggagc

SEQ ID NO: 1877841 - DNA, 13 bp, Homo sapiens
actgccttctcaa

SEQ ID NO: 1877842 - DNA, 22 bp, Homo sapiens
actgccttctcaactccaaact

SEQ ID NO: 1877843 - DNA, 20 bp, Homo sapiens
actgctgggtggcccatccc

SEQ ID NO: 1877844 - DNA, 17 bp, Homo sapiens
actggaggcaggactcc

SEQ ID NO: 1877845 - DNA, 16 bp, Homo sapiens
actggccagaggcagc

SEQ ID NO: 1877846 - DNA, 18 bp, Homo sapiens
actggcctcgcctggcct

SEQ ID NO: 1877847 - DNA, 23 bp, Homo sapiens
actggcctgttctgtaggagaga

SEQ ID NO: 1877848 - DNA, 22 bp, Homo sapiens
actggctgcctccactcccact

SEQ ID NO: 1877849 - DNA, 14 bp, Homo sapiens
actgggaacccctt

SEQ ID NO: 1877850 - DNA, 18 bp, Homo sapiens
actgggacaggggagaac

SEQ ID NO: 1877851 - DNA, 20 bp, Homo sapiens
actgtaggcgcccctggggt

SEQ ID NO: 1877852 - DNA, 13 bp, Homo sapiens
actgtcctgctcc

SEQ ID NO: 1877853 - DNA, 16 bp, Homo sapiens
actgtcctgctccaca

SEQ ID NO: 1877854 - DNA, 21 bp, Homo sapiens
actgtgtgttgacactgtttt

SEQ ID NO: 1877855 - DNA, 20 bp, Homo sapiens
actgttcccataacccctag

SEQ ID NO: 1877856 - DNA, 15 bp, Homo sapiens
actgtttcttgcact

SEQ ID NO: 1877857 - DNA, 17 bp, Homo sapiens
actgtttcttgcactga

SEQ ID NO: 1877858 - DNA, 13 bp, Homo sapiens
actgttttcctta

SEQ ID NO: 1877859 - DNA, 18 bp, Homo sapiens
acttagaataaaattgta

SEQ ID NO: 1877860 - DNA, 22 bp, Homo sapiens
acttatttgagtgattatttgt

SEQ ID NO: 1877861 - DNA, 20 bp, Homo sapiens
acttcaaatccttgaagatt

SEQ ID NO: 1877862 - DNA, 23 bp, Homo sapiens
acttcaagacatcaccatcagca

SEQ ID NO: 1877863 - DNA, 16 bp, Homo sapiens
acttcagcctgtgcag

SEQ ID NO: 1877864 - DNA, 15 bp, Homo sapiens
acttcaggggctgcc

SEQ ID NO: 1877865 - DNA, 16 bp, Homo sapiens
acttcaggggctgccc

SEQ ID NO: 1877866 - DNA, 17 bp, Homo sapiens
acttcaggggctgcccg

SEQ ID NO: 1877867 - DNA, 17 bp, Homo sapiens
acttcccctcctacccc

SEQ ID NO: 1877868 - DNA, 20 bp, Homo sapiens
acttgaattttcccactgca

SEQ ID NO: 1877869 - DNA, 22 bp, Homo sapiens
acttgagaagtctaattcacag

SEQ ID NO: 1877870 - DNA, 18 bp, Homo sapiens
acttgagggtaataaact

SEQ ID NO: 1877871 - DNA, 15 bp, Homo sapiens
acttgatgtttgtta

SEQ ID NO: 1877872 - DNA, 18 bp, Homo sapiens
acttgcagttgtgatata

SEQ ID NO: 1877873 - DNA, 14 bp, Homo sapiens
actttaaacatcta

SEQ ID NO: 1877874 - DNA, 17 bp, Homo sapiens
actttaaacatctagca

SEQ ID NO: 1877875 - DNA, 17 bp, Homo sapiens
acttttccatgtatcta

SEQ ID NO: 1877876 - DNA, 19 bp, Homo sapiens
agaaaacaaggatgaatta

SEQ ID NO: 1877877 - DNA, 12 bp, Homo sapiens
agaaaacattta

SEQ ID NO: 1877878 - DNA, 20 bp, Homo sapiens
agaaaacatttaacataatg

SEQ ID NO: 1877879 - DNA, 17 bp, Homo sapiens
agaaaagaaaacattta

SEQ ID NO: 1877880 - DNA, 17 bp, Homo sapiens
agaaacaggcccagaga

SEQ ID NO: 1877881 - DNA, 17 bp, Homo sapiens
agaatgagagacacact

SEQ ID NO: 1877882 - DNA, 17 bp, Homo sapiens
agaatgattatgaatta

SEQ ID NO: 1877883 - DNA, 16 bp, Homo sapiens
agaattgactgcagtt

SEQ ID NO: 1877884 - DNA, 12 bp, Homo sapiens
agacacacatga

SEQ ID NO: 1877885 - DNA, 15 bp, Homo sapiens
agacacacatgaagt

SEQ ID NO: 1877886 - DNA, 22 bp, Homo sapiens
agacacttatattttgatttta

SEQ ID NO: 1877887 - DNA, 18 bp, Homo sapiens
agacagtatataactaac

SEQ ID NO: 1877888 - DNA, 18 bp, Homo sapiens
agacatgccaactcggga

SEQ ID NO: 1877889 - DNA, 20 bp, Homo sapiens
agacccatctggaggctccc

SEQ ID NO: 1877890 - DNA, 14 bp, Homo sapiens
agacggatggaagg

SEQ ID NO: 1877891 - DNA, 15 bp, Homo sapiens
agacggatggaagga

SEQ ID NO: 1877892 - DNA, 17 bp, Homo sapiens
agacggatggaaggaga

SEQ ID NO: 1877893 - DNA, 18 bp, Homo sapiens
agacggatggaaggagag

SEQ ID NO: 1877894 - DNA, 14 bp, Homo sapiens
agactgcagaggag

SEQ ID NO: 1877895 - DNA, 17 bp, Homo sapiens
agactgcattatattta

SEQ ID NO: 1877896 - DNA, 18 bp, Homo sapiens
agactttcccaaatgtat

SEQ ID NO: 1877897 - DNA, 19 bp, Homo sapiens
agagaaaacttatttgagt

SEQ ID NO: 1877898 - DNA, 17 bp, Homo sapiens
agagaacttccagatcc

SEQ ID NO: 1877899 - DNA, 16 bp, Homo sapiens
agagacacactgaaga

SEQ ID NO: 1877900 - DNA, 21 bp, Homo sapiens
agagagaaaacttatttgagt

SEQ ID NO: 1877901 - DNA, 17 bp, Homo sapiens
agagagcagcttctgcc

SEQ ID NO: 1877902 - DNA, 19 bp, Homo sapiens
agagagcagcttctgccac

SEQ ID NO: 1877903 - DNA, 20 bp, Homo sapiens
agagatacccacagagtgtg

SEQ ID NO: 1877904 - DNA, 20 bp, Homo sapiens
agagatatgcagaaggaagg

SEQ ID NO: 1877905 - DNA, 14 bp, Homo sapiens
agagcacagccctc

SEQ ID NO: 1877906 - DNA, 20 bp, Homo sapiens
agagcagcttctgccacttc

SEQ ID NO: 1877907 - DNA, 16 bp, Homo sapiens
agagcatctgctctga

SEQ ID NO: 1877908 - DNA, 18 bp, Homo sapiens
agagcatctgctctgaga

SEQ ID NO: 1877909 - DNA, 22 bp, Homo sapiens
agagcttgatctgtgatttctt

SEQ ID NO: 1877910 - DNA, 21 bp, Homo sapiens
tggtctgctcgggcccaggcc

SEQ ID NO: 1877911 - DNA, 14 bp, Homo sapiens
tggtgcagccccag

SEQ ID NO: 1877912 - DNA, 17 bp, Homo sapiens
tggtgcagccccaggac

SEQ ID NO: 1877913 - DNA, 21 bp, Homo sapiens
tggtgcagccccaggaccaag

SEQ ID NO: 1877914 - DNA, 19 bp, Homo sapiens
tggtgcggtaggtgctggc

SEQ ID NO: 1877915 - DNA, 21 bp, Homo sapiens
tggtgcggtaggtgctggcct

SEQ ID NO: 1877916 - DNA, 17 bp, Homo sapiens
tggttacctgttccatt

SEQ ID NO: 1877917 - DNA, 17 bp, Homo sapiens
tggttcccttgatgaag

SEQ ID NO: 1877918 - DNA, 14 bp, Homo sapiens
tggttcttttttca

SEQ ID NO: 1877919 - DNA, 16 bp, Homo sapiens
tggttgtgaaatgtaa

SEQ ID NO: 1877920 - DNA, 14 bp, Homo sapiens
tgtaaaattgtata

SEQ ID NO: 1877921 - DNA, 13 bp, Homo sapiens
tgtaacagttgtg

SEQ ID NO: 1877922 - DNA, 17 bp, Homo sapiens
tgtaacagttgtgtcat

SEQ ID NO: 1877923 - DNA, 20 bp, Homo sapiens
tgtaacagttgtgtcataaa

SEQ ID NO: 1877924 - DNA, 17 bp, Homo sapiens
tgtaactttaaacatct

SEQ ID NO: 1877925 - DNA, 17 bp, Homo sapiens
tgtaactttctctatga

SEQ ID NO: 1877926 - DNA, 19 bp, Homo sapiens
tgtaagtttatgtctaaag

SEQ ID NO: 1877927 - DNA, 16 bp, Homo sapiens
tgtacccccgcccagg

SEQ ID NO: 1877928 - DNA, 22 bp, Homo sapiens
tgtaccgatgatactgtttctt

SEQ ID NO: 1877929 - DNA, 14 bp, Homo sapiens
tgtacgtgggagag

SEQ ID NO: 1877930 - DNA, 20 bp, Homo sapiens
tgtaggagaggttgtctgtg

SEQ ID NO: 1877931 - DNA, 17 bp, Homo sapiens
tgtaggcgcccctgggg

SEQ ID NO: 1877932 - DNA, 15 bp, Homo sapiens
tgtagtgttggagaa

SEQ ID NO: 1877933 - DNA, 19 bp, Homo sapiens
tgtagtgttggagaagaac

SEQ ID NO: 1877934 - DNA, 22 bp, Homo sapiens
tgtagtgttggagaagaactga

SEQ ID NO: 1877935 - DNA, 13 bp, Homo sapiens
tgtataaaataat

SEQ ID NO: 1877936 - DNA, 19 bp, Homo sapiens
tgtattaatctgtttgtgc

SEQ ID NO: 1877937 - DNA, 18 bp, Homo sapiens
tgtattttaaaagaatga

SEQ ID NO: 1877938 - DNA, 21 bp, Homo sapiens
tgtatttttcttgctgttcag

SEQ ID NO: 1877939 - DNA, 21 bp, Homo sapiens
tgtcaataaaatccatacatt

SEQ ID NO: 1877940 - DNA, 17 bp, Homo sapiens
tgtcaatacccctgtta

SEQ ID NO: 1877941 - DNA, 20 bp, Homo sapiens
tgtcaatcagcctagttgat

SEQ ID NO: 1877942 - DNA, 17 bp, Homo sapiens
tgtcaccggtcagtgcc

SEQ ID NO: 1877943 - DNA, 13 bp, Homo sapiens
tgtcactggctgc

SEQ ID NO: 1877944 - DNA, 18 bp, Homo sapiens
tgtcactggctgcctcca

SEQ ID NO: 1877945 - DNA, 17 bp, Homo sapiens
tgtcagatcgttcattg

SEQ ID NO: 1877946 - DNA, 23 bp, Homo sapiens
tgtcagtgccgccgcctcgccca

SEQ ID NO: 1877947 - DNA, 18 bp, Homo sapiens
tgtccagtgcccattcct

SEQ ID NO: 1877948 - DNA, 15 bp, Homo sapiens
tgtcccctcttgccc

SEQ ID NO: 1877949 - DNA, 17 bp, Homo sapiens
tgtcccctcttgcccca

SEQ ID NO: 1877950 - DNA, 17 bp, Homo sapiens
tgtcctgctccacagtg

SEQ ID NO: 1877951 - DNA, 14 bp, Homo sapiens
tgtcgcgccttctc

SEQ ID NO: 1877952 - DNA, 20 bp, Homo sapiens
tgtcgcgccttctccccccc

SEQ ID NO: 1877953 - DNA, 23 bp, Homo sapiens
tgtctacacagatgttcacccaa

SEQ ID NO: 1877954 - DNA, 23 bp, Homo sapiens
tgtcttcatcacttcttccactg

SEQ ID NO: 1877955 - DNA, 14 bp, Homo sapiens
tgtcttcctgtggg

SEQ ID NO: 1877956 - DNA, 12 bp, Homo sapiens
tgtgaaatgtaa

SEQ ID NO: 1877957 - DNA, 14 bp, Homo sapiens
tgtgaaatgtaaca

SEQ ID NO: 1877958 - DNA, 15 bp, Homo sapiens
tgtgaaatgtaacat

SEQ ID NO: 1877959 - DNA, 21 bp, Homo sapiens
tgtgattacgtgtatgtttct

SEQ ID NO: 1877960 - DNA, 19 bp, Homo sapiens
tgtgatttcccgtggcccc

SEQ ID NO: 1877961 - DNA, 14 bp, Homo sapiens
tgtgatttcttctc

SEQ ID NO: 1877962 - DNA, 14 bp, Homo sapiens
tgtgcagacgccac

SEQ ID NO: 1877963 - DNA, 17 bp, Homo sapiens
tgtgccaccctgggctc

SEQ ID NO: 1877964 - DNA, 14 bp, Homo sapiens
tgtgcccatgggca

SEQ ID NO: 1877965 - DNA, 19 bp, Homo sapiens
tgtgcccatgggcactgct

SEQ ID NO: 1877966 - DNA, 15 bp, Homo sapiens
tgtgccccccatcct

SEQ ID NO: 1877967 - DNA, 19 bp, Homo sapiens
tgtgccccccatcctggcc

SEQ ID NO: 1877968 - DNA, 20 bp, Homo sapiens
tgtgccccccatcctggccc

SEQ ID NO: 1877969 - DNA, 23 bp, Homo sapiens
tgtgccccccatcctggcccatc

SEQ ID NO: 1877970 - DNA, 14 bp, Homo sapiens
tgtgggctgcactc

SEQ ID NO: 1877971 - DNA, 23 bp, Homo sapiens
tgtgggggaagagcacagccctc

SEQ ID NO: 1877972 - DNA, 17 bp, Homo sapiens
tgtgggggaaggccttg

SEQ ID NO: 1877973 - DNA, 22 bp, Homo sapiens
tgtgtcactggctgcctccact

SEQ ID NO: 1877974 - DNA, 21 bp, Homo sapiens
tgtgtgaaaggtacttcaaat

SEQ ID NO: 1877975 - DNA, 12 bp, Homo sapiens
tgtgtgggaggg

SEQ ID NO: 1877976 - DNA, 14 bp, Homo sapiens
tgtgtgggagggcg

SEQ ID NO: 1877977 - DNA, 13 bp, Homo sapiens
tgtgtgttctgta

SEQ ID NO: 1877978 - DNA, 12 bp, Homo sapiens
tgtgttgacact

SEQ ID NO: 1877979 - DNA, 18 bp, Homo sapiens
tgtgttggggggcaaggt

SEQ ID NO: 1877980 - DNA, 19 bp, Homo sapiens
tgtgttttgcaagccagat

SEQ ID NO: 1877981 - DNA, 22 bp, Homo sapiens
tgttacattaaagccctgtgtt

SEQ ID NO: 1877982 - DNA, 23 bp, Homo sapiens
tgttactaaatggtgttacatta

SEQ ID NO: 1877983 - DNA, 20 bp, Homo sapiens
tgttagaccagaaagtgtgt

SEQ ID NO: 1877984 - DNA, 21 bp, Homo sapiens
tgttagcatgctggtgagcca

SEQ ID NO: 1877985 - DNA, 20 bp, Homo sapiens
tgttaggcctggcacagtgt

SEQ ID NO: 1877986 - DNA, 21 bp, Homo sapiens
tgttaggcctggcacagtgtc

SEQ ID NO: 1877987 - DNA, 22 bp, Homo sapiens
tgttagggagatgagttgcagt

SEQ ID NO: 1877988 - DNA, 23 bp, Homo sapiens
tgttagggagatgagttgcagtt

SEQ ID NO: 1877989 - DNA, 17 bp, Homo sapiens
tgttatttgtacagttc

SEQ ID NO: 1877990 - DNA, 13 bp, Homo sapiens
tgttcaaattttt

SEQ ID NO: 1877991 - DNA, 19 bp, Homo sapiens
tgagctttccggggaggag

SEQ ID NO: 1877992 - DNA, 19 bp, Homo sapiens
tgaggaaagcatgtattca

SEQ ID NO: 1877993 - DNA, 13 bp, Homo sapiens
tgaggactctgga

SEQ ID NO: 1877994 - DNA, 23 bp, Homo sapiens
tgaggatgcactggcctgttctg

SEQ ID NO: 1877995 - DNA, 19 bp, Homo sapiens
tgaggatgggatgtatttt

SEQ ID NO: 1877996 - DNA, 23 bp, Homo sapiens
tgaggatgggatgtatttttctt

SEQ ID NO: 1877997 - DNA, 20 bp, Homo sapiens
tgaggcacatgtcagcaagt

SEQ ID NO: 1877998 - DNA, 21 bp, Homo sapiens
tgaggcaggggagtctgcttg

SEQ ID NO: 1877999 - DNA, 19 bp, Homo sapiens
tgaggcagtgggtcccact

SEQ ID NO: 1878000 - DNA, 22 bp, Homo sapiens
tgaggcagtgggtcccacttcc

SEQ ID NO: 1878001 - DNA, 21 bp, Homo sapiens
tgagggtaataaacttagaat

SEQ ID NO: 1878002 - DNA, 16 bp, Homo sapiens
tgaggtggtggacatc

SEQ ID NO: 1878003 - DNA, 10 bp, Homo sapiens
tgagtgtcaa

SEQ ID NO: 1878004 - DNA, 23 bp, Homo sapiens
tgagttatctgattttttttgta

SEQ ID NO: 1878005 - DNA, 13 bp, Homo sapiens
tgagttgcagttt

SEQ ID NO: 1878006 - DNA, 16 bp, Homo sapiens
tgataactggaaactt

SEQ ID NO: 1878007 - DNA, 14 bp, Homo sapiens
tgatactgtttctt

SEQ ID NO: 1878008 - DNA, 15 bp, Homo sapiens
tgatactgtttcttg

SEQ ID NO: 1878009 - DNA, 21 bp, Homo sapiens
tgatactgtttcttgcactga

SEQ ID NO: 1878010 - DNA, 20 bp, Homo sapiens
tgatataaaggaccctgttt

SEQ ID NO: 1878011 - DNA, 22 bp, Homo sapiens
tgatataaaggaccctgtttct

SEQ ID NO: 1878012 - DNA, 23 bp, Homo sapiens
tgatataaaggaccctgtttctg

SEQ ID NO: 1878013 - DNA, 16 bp, Homo sapiens
tgatctgtgatttctt

SEQ ID NO: 1878014 - DNA, 15 bp, Homo sapiens
tgatcttaggtttgt

SEQ ID NO: 1878015 - DNA, 11 bp, Homo sapiens
tgatgaagaag

SEQ ID NO: 1878016 - DNA, 12 bp, Homo sapiens
tgatgaagaagt

SEQ ID NO: 1878017 - DNA, 15 bp, Homo sapiens
tgatgccacaccaag

SEQ ID NO: 1878018 - DNA, 17 bp, Homo sapiens
tgatgccacaccaagct

SEQ ID NO: 1878019 - DNA, 20 bp, Homo sapiens
tgatgccacaccaagctgtg

SEQ ID NO: 1878020 - DNA, 14 bp, Homo sapiens
tgatgctgggctgg

SEQ ID NO: 1878021 - DNA, 16 bp, Homo sapiens
tgatgctgggctgggt

SEQ ID NO: 1878022 - DNA, 19 bp, Homo sapiens
tgattaaatgtctgacaca

SEQ ID NO: 1878023 - DNA, 17 bp, Homo sapiens
tgattacaaataaacag

SEQ ID NO: 1878024 - DNA, 23 bp, Homo sapiens
tgattataagccctgcataatgt

SEQ ID NO: 1878025 - DNA, 21 bp, Homo sapiens
tgattatgaattacatttgta

SEQ ID NO: 1878026 - DNA, 22 bp, Homo sapiens
tgatttatctgagtcaactcct

SEQ ID NO: 1878027 - DNA, 21 bp, Homo sapiens
tgatttcccgtggccccagcc

SEQ ID NO: 1878028 - DNA, 16 bp, Homo sapiens
tgattttaataatata

SEQ ID NO: 1878029 - DNA, 16 bp, Homo sapiens
tgcaagtagctggctg

SEQ ID NO: 1878030 - DNA, 21 bp, Homo sapiens
tgcaattcatgtaacagttgt

SEQ ID NO: 1878031 - DNA, 22 bp, Homo sapiens
tgcaattcatgtaacagttgtg

SEQ ID NO: 1878032 - DNA, 23 bp, Homo sapiens
tgcaattcatgtaacagttgtgt

SEQ ID NO: 1878033 - DNA, 23 bp, Homo sapiens
tgcaccaacccagccgctgcccg

SEQ ID NO: 1878034 - DNA, 12 bp, Homo sapiens
tgcaccccctcc

SEQ ID NO: 1878035 - DNA, 14 bp, Homo sapiens
tgcaccccctcctg

SEQ ID NO: 1878036 - DNA, 15 bp, Homo sapiens
tgcaccccctcctgc

SEQ ID NO: 1878037 - DNA, 12 bp, Homo sapiens
tgcactctgtgc

SEQ ID NO: 1878038 - DNA, 14 bp, Homo sapiens
tgcactgaatatat

SEQ ID NO: 1878039 - DNA, 23 bp, Homo sapiens
tgcactggcctgttctgtaggag

SEQ ID NO: 1878040 - DNA, 13 bp, Homo sapiens
tgcactgtcctgc

SEQ ID NO: 1878041 - DNA, 16 bp, Homo sapiens
tgcactgtcctgctcc

SEQ ID NO: 1878042 - DNA, 19 bp, Homo sapiens
tgcagagagcacctggtgg

SEQ ID NO: 1878043 - DNA, 15 bp, Homo sapiens
tgcagaggggcaggc

SEQ ID NO: 1878044 - DNA, 20 bp, Homo sapiens
tgcagaggggcaggccctgc

SEQ ID NO: 1878045 - DNA, 21 bp, Homo sapiens
tgcagaggggcaggccctgca

SEQ ID NO: 1878046 - DNA, 13 bp, Homo sapiens
tgcagcaggcaga

SEQ ID NO: 1878047 - DNA, 19 bp, Homo sapiens
tgcagcaggcagaggagag

SEQ ID NO: 1878048 - DNA, 12 bp, Homo sapiens
tgcaggaggcct

SEQ ID NO: 1878049 - DNA, 14 bp, Homo sapiens
tgcaggaggcctgg

SEQ ID NO: 1878050 - DNA, 17 bp, Homo sapiens
tgcaggaggcctgggag

SEQ ID NO: 1878051 - DNA, 19 bp, Homo sapiens
tgcaggcgactggaggcag

SEQ ID NO: 1878052 - DNA, 23 bp, Homo sapiens
tgcaggttgggccatactggcct

SEQ ID NO: 1878053 - DNA, 16 bp, Homo sapiens
tgcagtatgaaaataa

SEQ ID NO: 1878054 - DNA, 23 bp, Homo sapiens
tgcagtcatttgtggttagaatc

SEQ ID NO: 1878055 - DNA, 20 bp, Homo sapiens
tgcagtccgttgctgaaaat

SEQ ID NO: 1878056 - DNA, 12 bp, Homo sapiens
tgcagttctgaa

SEQ ID NO: 1878057 - DNA, 19 bp, Homo sapiens
tgcagtttttataatagat

SEQ ID NO: 1878058 - DNA, 12 bp, Homo sapiens
tgcataccctca

SEQ ID NO: 1878059 - DNA, 15 bp, Homo sapiens
tgcattatatttatt

SEQ ID NO: 1878060 - DNA, 16 bp, Homo sapiens
tgcatttccagaaatc

SEQ ID NO: 1878061 - DNA, 15 bp, Homo sapiens
tgccaagcctggagc

SEQ ID NO: 1878062 - DNA, 19 bp, Homo sapiens
tgccacaccaagctgtgcc

SEQ ID NO: 1878063 - DNA, 13 bp, Homo sapiens
tgccaccctgggc

SEQ ID NO: 1878064 - DNA, 20 bp, Homo sapiens
tgccaccctgggctctgtgg

SEQ ID NO: 1878065 - DNA, 17 bp, Homo sapiens
tgccagtcgcgctgcct

SEQ ID NO: 1878066 - DNA, 19 bp, Homo sapiens
tgccagtcgcgctgcctgt

SEQ ID NO: 1878067 - DNA, 17 bp, Homo sapiens
tgcccatgggcactgct

SEQ ID NO: 1878068 - DNA, 20 bp, Homo sapiens
tgcccatgggcactgctggg

SEQ ID NO: 1878069 - DNA, 17 bp, Homo sapiens
tgccccagctgggctgt

SEQ ID NO: 1878070 - DNA, 16 bp, Homo sapiens
tgccccattcaacatc

SEQ ID NO: 1878071 - DNA, 12 bp, Homo sapiens
tgccccccatcc

SEQ ID NO: 1878072 - DNA, 16 bp, Homo sapiens
tgccccccatcctggc

SEQ ID NO: 1878073 - DNA, 13 bp, Homo sapiens
tgccccctcgtgc

SEQ ID NO: 1878074 - DNA, 16 bp, Homo sapiens
tgccccctcgtgccag

SEQ ID NO: 1878075 - DNA, 15 bp, Homo sapiens
tgcccgctcccagtg

SEQ ID NO: 1878076 - DNA, 17 bp, Homo sapiens
tgcccgctgtcccaggg

SEQ ID NO: 1878077 - DNA, 22 bp, Homo sapiens
tgcccggcgccctctgtcctga

SEQ ID NO: 1878078 - DNA, 18 bp, Homo sapiens
tgccctgccaagcctgga

SEQ ID NO: 1878079 - DNA, 19 bp, Homo sapiens
tgccctgccaagcctggag

SEQ ID NO: 1878080 - DNA, 22 bp, Homo sapiens
tgccctggctcccaagggaggc

SEQ ID NO: 1878081 - DNA, 11 bp, Homo sapiens
tgccctgggcc

SEQ ID NO: 1878082 - DNA, 21 bp, Homo sapiens
tgccctgggccagcccaggat

SEQ ID NO: 1878083 - DNA, 23 bp, Homo sapiens
tgggagggcgaggcgggggagcc

SEQ ID NO: 1878084 - DNA, 16 bp, Homo sapiens
tgggcactgctgggtg

SEQ ID NO: 1878085 - DNA, 21 bp, Homo sapiens
tgggcactgctgggtggccca

SEQ ID NO: 1878086 - DNA, 13 bp, Homo sapiens
tgggcaggtcctg

SEQ ID NO: 1878087 - DNA, 17 bp, Homo sapiens
tgggcaggtcctgggga

SEQ ID NO: 1878088 - DNA, 20 bp, Homo sapiens
tgggcaggtcctggggaggc

SEQ ID NO: 1878089 - DNA, 14 bp, Homo sapiens
tgggcatttatatt

SEQ ID NO: 1878090 - DNA, 21 bp, Homo sapiens
tgggccaccagctccactggc

SEQ ID NO: 1878091 - DNA, 15 bp, Homo sapiens
tgggccatactggcc

SEQ ID NO: 1878092 - DNA, 13 bp, Homo sapiens
tgggccctgcagg

SEQ ID NO: 1878093 - DNA, 14 bp, Homo sapiens
tgggcctgatggag

SEQ ID NO: 1878094 - DNA, 17 bp, Homo sapiens
tgggcctgatggagagg

SEQ ID NO: 1878095 - DNA, 18 bp, Homo sapiens
tgggcctgatggagagga

SEQ ID NO: 1878096 - DNA, 20 bp, Homo sapiens
tgggcctgatggagaggaga

SEQ ID NO: 1878097 - DNA, 13 bp, Homo sapiens
tgggctgggagaa

SEQ ID NO: 1878098 - DNA, 18 bp, Homo sapiens
tgggctggggcctgatgg

SEQ ID NO: 1878099 - DNA, 15 bp, Homo sapiens
tggggaaggaccaac

SEQ ID NO: 1878100 - DNA, 19 bp, Homo sapiens
tggggcctatcagtgtgcc

SEQ ID NO: 1878101 - DNA, 19 bp, Homo sapiens
tggggcctgatggggaggg

SEQ ID NO: 1878102 - DNA, 19 bp, Homo sapiens
tgggggaagagcacagccc

SEQ ID NO: 1878103 - DNA, 22 bp, Homo sapiens
tgggggaagagcacagccctcc

SEQ ID NO: 1878104 - DNA, 20 bp, Homo sapiens
tggggggcaaggtgggggag

SEQ ID NO: 1878105 - DNA, 16 bp, Homo sapiens
tgggtagacacacatg

SEQ ID NO: 1878106 - DNA, 21 bp, Homo sapiens
tgggtatcaccactggagatc

SEQ ID NO: 1878107 - DNA, 22 bp, Homo sapiens
tgggtatcaccactggagatca

SEQ ID NO: 1878108 - DNA, 22 bp, Homo sapiens
tgggtgcgaccccatctgccca

SEQ ID NO: 1878109 - DNA, 15 bp, Homo sapiens
tgggttggcgcaccc

SEQ ID NO: 1878110 - DNA, 23 bp, Homo sapiens
tgggttggcgcaccctcccctcc

SEQ ID NO: 1878111 - DNA, 21 bp, Homo sapiens
tggtaagtaatgagggctgag

SEQ ID NO: 1878112 - DNA, 23 bp, Homo sapiens
tggtactaagaggctatttaaaa

SEQ ID NO: 1878113 - DNA, 21 bp, Homo sapiens
tggtatgttttcaggctagat

SEQ ID NO: 1878114 - DNA, 18 bp, Homo sapiens
tggtctgctcgggcccag

SEQ ID NO: 1878115 - DNA, 17 bp, Homo sapiens
ttagaatcttgttttgt

SEQ ID NO: 1878116 - DNA, 20 bp, Homo sapiens
ttagaccagaaagtgtgtgt

SEQ ID NO: 1878117 - DNA, 20 bp, Homo sapiens
ttagaggctttcaaatgtac

SEQ ID NO: 1878118 - DNA, 14 bp, Homo sapiens
ttagcttcagttgt

SEQ ID NO: 1878119 - DNA, 15 bp, Homo sapiens
ttagcttcagttgtt

SEQ ID NO: 1878120 - DNA, 14 bp, Homo sapiens
ttaggcctggcaca

SEQ ID NO: 1878121 - DNA, 21 bp, Homo sapiens
ttagggagatgagttgcagtt

SEQ ID NO: 1878122 - DNA, 16 bp, Homo sapiens
ttagggttatgattaa

SEQ ID NO: 1878123 - DNA, 20 bp, Homo sapiens
ttataaaaaatggtgcctga

SEQ ID NO: 1878124 - DNA, 13 bp, Homo sapiens
ttataatagattt

SEQ ID NO: 1878125 - DNA, 16 bp, Homo sapiens
ttataattttgtgaag

SEQ ID NO: 1878126 - DNA, 13 bp, Homo sapiens
ttatatttgaaat

SEQ ID NO: 1878127 - DNA, 15 bp, Homo sapiens
ttatatttgaaatat

SEQ ID NO: 1878128 - DNA, 16 bp, Homo sapiens
ttatccacaaagtact

SEQ ID NO: 1878129 - DNA, 14 bp, Homo sapiens
ttatcgaaactcat

SEQ ID NO: 1878130 - DNA, 18 bp, Homo sapiens
ttatctaatcatgaaact

SEQ ID NO: 1878131 - DNA, 16 bp, Homo sapiens
ttatcttaaaactcct

SEQ ID NO: 1878132 - DNA, 21 bp, Homo sapiens
ttatgaattacatttgtataa

SEQ ID NO: 1878133 - DNA, 22 bp, Homo sapiens
ttatgattaagtaatgataact

SEQ ID NO: 1878134 - DNA, 21 bp, Homo sapiens
ttatggcactagtatttctat

SEQ ID NO: 1878135 - DNA, 19 bp, Homo sapiens
ttatgttaaaactgggaca

SEQ ID NO: 1878136 - DNA, 16 bp, Homo sapiens
ttattactgtaagaaa

SEQ ID NO: 1878137 - DNA, 21 bp, Homo sapiens
ttattcaggaaaagcctctgt

SEQ ID NO: 1878138 - DNA, 17 bp, Homo sapiens
ttattgtgattacgtgt

SEQ ID NO: 1878139 - DNA, 16 bp, Homo sapiens
ttatttagtaaagttt

SEQ ID NO: 1878140 - DNA, 14 bp, Homo sapiens
ttatttatgcctct

SEQ ID NO: 1878141 - DNA, 13 bp, Homo sapiens
ttatttgtacagt

SEQ ID NO: 1878142 - DNA, 15 bp, Homo sapiens
ttattttgtaattat

SEQ ID NO: 1878143 - DNA, 18 bp, Homo sapiens
ttattttgtaattattgt

SEQ ID NO: 1878144 - DNA, 18 bp, Homo sapiens
ttatttttacattctgaa

SEQ ID NO: 1878145 - DNA, 17 bp, Homo sapiens
ttcaaatccttgaagat

SEQ ID NO: 1878146 - DNA, 12 bp, Homo sapiens
ttcaaatgtacc

SEQ ID NO: 1878147 - DNA, 17 bp, Homo sapiens
ttcacatttttgtattt

SEQ ID NO: 1878148 - DNA, 22 bp, Homo sapiens
ttcagagcctcctttctggctt

SEQ ID NO: 1878149 - DNA, 17 bp, Homo sapiens
ttcagcggtttatataa

SEQ ID NO: 1878150 - DNA, 23 bp, Homo sapiens
ttcagctgtgaacatggactctt

SEQ ID NO: 1878151 - DNA, 20 bp, Homo sapiens
ttcagcttctgctgggctgg

SEQ ID NO: 1878152 - DNA, 22 bp, Homo sapiens
ttcaggggctgcccgctcccag

SEQ ID NO: 1878153 - DNA, 23 bp, Homo sapiens
ttcaggggctgcccgctcccagt

SEQ ID NO: 1878154 - DNA, 14 bp, Homo sapiens
ttcagttgttcttt

SEQ ID NO: 1878155 - DNA, 16 bp, Homo sapiens
ttcatcacttcttcca

SEQ ID NO: 1878156 - DNA, 16 bp, Homo sapiens
ttcatctgttgttctg

SEQ ID NO: 1878157 - DNA, 23 bp, Homo sapiens
ttcatgacttttccatgtatcta

SEQ ID NO: 1878158 - DNA, 17 bp, Homo sapiens
ttcatgattttgaaatc

SEQ ID NO: 1878159 - DNA, 13 bp, Homo sapiens
ttcatgtaacagt

SEQ ID NO: 1878160 - DNA, 23 bp, Homo sapiens
ttcatgtggcacttgggcattta

SEQ ID NO: 1878161 - DNA, 17 bp, Homo sapiens
ttcattgcctttccagg

SEQ ID NO: 1878162 - DNA, 20 bp, Homo sapiens
ttccaaggtggtctgctcgg

SEQ ID NO: 1878163 - DNA, 19 bp, Homo sapiens
ttccacgtactgcagcctc

SEQ ID NO: 1878164 - DNA, 21 bp, Homo sapiens
ttccagggtcaaagtacagaa

SEQ ID NO: 1878165 - DNA, 20 bp, Homo sapiens
ttccattattgagttcctcc

SEQ ID NO: 1878166 - DNA, 12 bp, Homo sapiens
ttccattgttgt

SEQ ID NO: 1878167 - DNA, 12 bp, Homo sapiens
ttcccaaatgta

SEQ ID NO: 1878168 - DNA, 17 bp, Homo sapiens
ttcccacctctgaggac

SEQ ID NO: 1878169 - DNA, 11 bp, Homo sapiens
ttcccactgca

SEQ ID NO: 1878170 - DNA, 13 bp, Homo sapiens
ttcccactgcacc

SEQ ID NO: 1878171 - DNA, 20 bp, Homo sapiens
ttcccactgcaccccctcct

SEQ ID NO: 1878172 - DNA, 24 bp, Homo sapiens
ttcccactgcaccccctcctgctg

SEQ ID NO: 1878173 - DNA, 22 bp, Homo sapiens
ttccccgagggatgatgccaca

SEQ ID NO: 1878174 - DNA, 21 bp, Homo sapiens
ttcccgagcaaagtctaaagt

SEQ ID NO: 1878175 - DNA, 17 bp, Homo sapiens
ttcccgtggccccagcc

SEQ ID NO: 1878176 - DNA, 17 bp, Homo sapiens
ttccctgacactgcggg

SEQ ID NO: 1878177 - DNA, 23 bp, Homo sapiens
ttcctcagttcatccattctatt

SEQ ID NO: 1878178 - DNA, 23 bp, Homo sapiens
ttctcccccccggggctgggttg

SEQ ID NO: 1878179 - DNA, 13 bp, Homo sapiens
ttctgaagaagat

SEQ ID NO: 1878180 - DNA, 15 bp, Homo sapiens
ttctgcctgcctggg

SEQ ID NO: 1878181 - DNA, 15 bp, Homo sapiens
ttctgctgggctggg

SEQ ID NO: 1878182 - DNA, 19 bp, Homo sapiens
ttctggagcaggtggcttg

SEQ ID NO: 1878183 - DNA, 21 bp, Homo sapiens
ttctgtagaaaagaaaacatt

SEQ ID NO: 1878184 - DNA, 14 bp, Homo sapiens
ttctgtagctcagt

SEQ ID NO: 1878185 - DNA, 17 bp, Homo sapiens
ttctgtggtcacagtga

SEQ ID NO: 1878186 - DNA, 19 bp, Homo sapiens
ttcttagggttatgattaa

SEQ ID NO: 1878187 - DNA, 21 bp, Homo sapiens
ttcttcacagtgcagcttgca

SEQ ID NO: 1878188 - DNA, 12 bp, Homo sapiens
ttcttgccctga

SEQ ID NO: 1878189 - DNA, 14 bp, Homo sapiens
ttctttaacttaat

SEQ ID NO: 1878190 - DNA, 18 bp, Homo sapiens
ttctttagaggctttcaa

SEQ ID NO: 1878191 - DNA, 23 bp, Homo sapiens
ttctttagaggctttcaaatgta

SEQ ID NO: 1878192 - DNA, 20 bp, Homo sapiens
ttctttcacttgatgtttgt

SEQ ID NO: 1878193 - DNA, 20 bp, Homo sapiens
ttttaacgtggcttgtagaa

SEQ ID NO: 1878194 - DNA, 22 bp, Homo sapiens
ttttaagctgtaaaaagagaga

SEQ ID NO: 1878195 - DNA, 12 bp, Homo sapiens
ttttaataatgt

SEQ ID NO: 1878196 - DNA, 16 bp, Homo sapiens
ttttaataatgtttca

SEQ ID NO: 1878197 - DNA, 13 bp, Homo sapiens
ttttaccaagttt

SEQ ID NO: 1878198 - DNA, 15 bp, Homo sapiens
ttttactctgtgtaa

SEQ ID NO: 1878199 - DNA, 23 bp, Homo sapiens
ttttactctgtgtaaagacttga

SEQ ID NO: 1878200 - DNA, 19 bp, Homo sapiens
ttttaggcagggatttgag

SEQ ID NO: 1878201 - DNA, 16 bp, Homo sapiens
ttttataaaaaatggt

SEQ ID NO: 1878202 - DNA, 19 bp, Homo sapiens
ttttataaacctctaattt

SEQ ID NO: 1878203 - DNA, 23 bp, Homo sapiens
ttttataattttgtgaagcaaaa

SEQ ID NO: 1878204 - DNA, 13 bp, Homo sapiens
ttttatatttgaa

SEQ ID NO: 1878205 - DNA, 18 bp, Homo sapiens
ttttatatttgaaatatt

SEQ ID NO: 1878206 - DNA, 20 bp, Homo sapiens
ttttattttgtaattattgt

SEQ ID NO: 1878207 - DNA, 20 bp, Homo sapiens
ttttcagcttctgctgggct

SEQ ID NO: 1878208 - DNA, 12 bp, Homo sapiens
ttttcatctgtt

SEQ ID NO: 1878209 - DNA, 16 bp, Homo sapiens
ttttccttttcatctg

SEQ ID NO: 1878210 - DNA, 17 bp, Homo sapiens
ttttccttttcatctgt

SEQ ID NO: 1878211 - DNA, 16 bp, Homo sapiens
ttttctctaggaaata

SEQ ID NO: 1878212 - DNA, 18 bp, Homo sapiens
ttttcttatccacaaagt

SEQ ID NO: 1878213 - DNA, 13 bp, Homo sapiens
ttttcttcacagt

SEQ ID NO: 1878214 - DNA, 22 bp, Homo sapiens
ttttgtcgaatttttattattt

SEQ ID NO: 1878215 - DNA, 19 bp, Homo sapiens
tttttaaagtttgttcact

SEQ ID NO: 1878216 - DNA, 14 bp, Homo sapiens
tttttaagctgtaa

SEQ ID NO: 1878217 - DNA, 23 bp, Homo sapiens
tttttaagctgtaaaaagagaga

SEQ ID NO: 1878218 - DNA, 13 bp, Homo sapiens
tttttataataga

SEQ ID NO: 1878219 - DNA, 15 bp, Homo sapiens
tttttataatagatt

SEQ ID NO: 1878220 - DNA, 19 bp, Homo sapiens
tttttctctaggaaatatt

SEQ ID NO: 1878221 - DNA, 12 bp, Homo sapiens
tttttttgtagc

SEQ ID NO: 1878222 - DNA, 16 bp, Homo sapiens
tcattgcctttccagg

SEQ ID NO: 1878223 - DNA, 16 bp, Homo sapiens
tcatttccaagcaagt

SEQ ID NO: 1878224 - DNA, 21 bp, Homo sapiens
tccaactatctcatttccaag

SEQ ID NO: 1878225 - DNA, 23 bp, Homo sapiens
tccaaggtggtctgctcgggccc

SEQ ID NO: 1878226 - DNA, 21 bp, Homo sapiens
tccaataaaaacattttgaag

SEQ ID NO: 1878227 - DNA, 13 bp, Homo sapiens
tccacagtgttta

SEQ ID NO: 1878228 - DNA, 13 bp, Homo sapiens
tccacgccctggg

SEQ ID NO: 1878229 - DNA, 15 bp, Homo sapiens
tccacgccctgggga

SEQ ID NO: 1878230 - DNA, 15 bp, Homo sapiens
tccacgtactgcagc

SEQ ID NO: 1878231 - DNA, 19 bp, Homo sapiens
tccagagtcaactgttccc

SEQ ID NO: 1878232 - DNA, 21 bp, Homo sapiens
tccagctttgttcttcttaaa

SEQ ID NO: 1878233 - DNA, 20 bp, Homo sapiens
tccagtcctcacatgcccgc

SEQ ID NO: 1878234 - DNA, 21 bp, Homo sapiens
tccagtcctcacatgcccgct

SEQ ID NO: 1878235 - DNA, 19 bp, Homo sapiens
tccatcagatgtgttcctc

SEQ ID NO: 1878236 - DNA, 13 bp, Homo sapiens
tccatccctggcc

SEQ ID NO: 1878237 - DNA, 23 bp, Homo sapiens
tcccacagtgactcgggctcctg

SEQ ID NO: 1878238 - DNA, 18 bp, Homo sapiens
tcccagctgacagtcctc

SEQ ID NO: 1878239 - DNA, 24 bp, Homo sapiens
tcccagctgacagtcctctccacc

SEQ ID NO: 1878240 - DNA, 23 bp, Homo sapiens
tcccaggggtctccctgagcctg

SEQ ID NO: 1878241 - DNA, 19 bp, Homo sapiens
tcccaggtaagcaggagga

SEQ ID NO: 1878242 - DNA, 17 bp, Homo sapiens
tcccagtgtcttcctgt

SEQ ID NO: 1878243 - DNA, 19 bp, Homo sapiens
tcccagtgtcttcctgtgg

SEQ ID NO: 1878244 - DNA, 22 bp, Homo sapiens
tcccataacccctagtcatcgt

SEQ ID NO: 1878245 - DNA, 22 bp, Homo sapiens
tcccccgggaggggcccgcttg

SEQ ID NO: 1878246 - DNA, 22 bp, Homo sapiens
tccccgagggatgatgccacac

SEQ ID NO: 1878247 - DNA, 14 bp, Homo sapiens
tcccctccatccct

SEQ ID NO: 1878248 - DNA, 15 bp, Homo sapiens
tcccctccatccctg

SEQ ID NO: 1878249 - DNA, 13 bp, Homo sapiens
tcccctcctaccc

SEQ ID NO: 1878250 - DNA, 17 bp, Homo sapiens
tcccctcctacccctcc

SEQ ID NO: 1878251 - DNA, 22 bp, Homo sapiens
tcccctcctacccctcccagct

SEQ ID NO: 1878252 - DNA, 19 bp, Homo sapiens
tcccgagcaaagtctaaag

SEQ ID NO: 1878253 - DNA, 20 bp, Homo sapiens
tcccgagcaaagtctaaagt

SEQ ID NO: 1878254 - DNA, 15 bp, Homo sapiens
tcccgccccttcccc

SEQ ID NO: 1878255 - DNA, 14 bp, Homo sapiens
tcccgtggccccag

SEQ ID NO: 1878256 - DNA, 16 bp, Homo sapiens
tcccgtggccccagcc

SEQ ID NO: 1878257 - DNA, 18 bp, Homo sapiens
tcccgtggccccagcctg

SEQ ID NO: 1878258 - DNA, 20 bp, Homo sapiens
tcccgtggccccagcctggc

SEQ ID NO: 1878259 - DNA, 21 bp, Homo sapiens
tcccgtggccccagcctggcc

SEQ ID NO: 1878260 - DNA, 17 bp, Homo sapiens
tccctcaaagaggcctt

SEQ ID NO: 1878261 - DNA, 16 bp, Homo sapiens
tccctgacactgcggg

SEQ ID NO: 1878262 - DNA, 13 bp, Homo sapiens
tccctgagcctgc

SEQ ID NO: 1878263 - DNA, 14 bp, Homo sapiens
tccctgagcctgcc

SEQ ID NO: 1878264 - DNA, 19 bp, Homo sapiens
tccctgagcctgccccagc

SEQ ID NO: 1878265 - DNA, 20 bp, Homo sapiens
tccctgagcctgccccagct

SEQ ID NO: 1878266 - DNA, 21 bp, Homo sapiens
tccctgagcctgccccagctg

SEQ ID NO: 1878267 - DNA, 14 bp, Homo sapiens
tccctgctgtcccc

SEQ ID NO: 1878268 - DNA, 21 bp, Homo sapiens
tccctgctgtcccctcttgcc

SEQ ID NO: 1878269 - DNA, 18 bp, Homo sapiens
tccctggatgacattaaa

SEQ ID NO: 1878270 - DNA, 14 bp, Homo sapiens
tccctggtcccttg

SEQ ID NO: 1878271 - DNA, 16 bp, Homo sapiens
tccggaatagatgtct

SEQ ID NO: 1878272 - DNA, 15 bp, Homo sapiens
tccggggaggagcct

SEQ ID NO: 1878273 - DNA, 20 bp, Homo sapiens
tccggggaggagccttggag

SEQ ID NO: 1878274 - DNA, 14 bp, Homo sapiens
tccgttcccacctc

SEQ ID NO: 1878275 - DNA, 14 bp, Homo sapiens
tccgttgctgaaaa

SEQ ID NO: 1878276 - DNA, 18 bp, Homo sapiens
tcctacacccttggactt

SEQ ID NO: 1878277 - DNA, 20 bp, Homo sapiens
tcctacacccttggacttga

SEQ ID NO: 1878278 - DNA, 14 bp, Homo sapiens
tcctacccctccca

SEQ ID NO: 1878279 - DNA, 17 bp, Homo sapiens
tcctacccctcccagct

SEQ ID NO: 1878280 - DNA, 14 bp, Homo sapiens
tcctagaggacctg

SEQ ID NO: 1878281 - DNA, 15 bp, Homo sapiens
tcctcacatgcccgc

SEQ ID NO: 1878282 - DNA, 15 bp, Homo sapiens
tcctcaccttttccc

SEQ ID NO: 1878283 - DNA, 21 bp, Homo sapiens
tcctccaccgccatggcttcc

SEQ ID NO: 1878284 - DNA, 22 bp, Homo sapiens
tcctccaccgccatggcttcca

SEQ ID NO: 1878285 - DNA, 17 bp, Homo sapiens
tcctctccccatgatgt

SEQ ID NO: 1878286 - DNA, 23 bp, Homo sapiens
tcctctgctatgcattttcttca

SEQ ID NO: 1878287 - DNA, 13 bp, Homo sapiens
tcctcttatttgc

SEQ ID NO: 1878288 - DNA, 14 bp, Homo sapiens
tcctctttgcatgg

SEQ ID NO: 1878289 - DNA, 16 bp, Homo sapiens
tcctgaaagacaatat

SEQ ID NO: 1878290 - DNA, 15 bp, Homo sapiens
tcctgattaaatgtc

SEQ ID NO: 1878291 - DNA, 15 bp, Homo sapiens
tcctgctccacagtg

SEQ ID NO: 1878292 - DNA, 17 bp, Homo sapiens
tcctgctgcaccaaccc

SEQ ID NO: 1878293 - DNA, 22 bp, Homo sapiens
tcctgctgcaccaacccagccg

SEQ ID NO: 1878294 - DNA, 16 bp, Homo sapiens
tcctggaaatcagggt

SEQ ID NO: 1878295 - DNA, 10 bp, Homo sapiens
tcctggagcc

SEQ ID NO: 1878296 - DNA, 14 bp, Homo sapiens
tcctggggaggctg

SEQ ID NO: 1878297 - DNA, 19 bp, Homo sapiens
tcctggggaggctgagact

SEQ ID NO: 1878298 - DNA, 20 bp, Homo sapiens
tcctggggaggctgagactg

SEQ ID NO: 1878299 - DNA, 16 bp, Homo sapiens
tcctgtataatttaac

SEQ ID NO: 1878300 - DNA, 13 bp, Homo sapiens
tcctgtcagtgcc

SEQ ID NO: 1878301 - DNA, 18 bp, Homo sapiens
tccttacctatttcctca

SEQ ID NO: 1878302 - DNA, 19 bp, Homo sapiens
tccttacctatttcctcag

SEQ ID NO: 1878303 - DNA, 15 bp, Homo sapiens
tccttctgccttttt

SEQ ID NO: 1878304 - DNA, 17 bp, Homo sapiens
tccttcttgccctgagc

SEQ ID NO: 1878305 - DNA, 18 bp, Homo sapiens
tccttcttgccctgagct

SEQ ID NO: 1878306 - DNA, 16 bp, Homo sapiens
tccttgccctgggcca

SEQ ID NO: 1878307 - DNA, 13 bp, Homo sapiens
tcctttctccaat

SEQ ID NO: 1878308 - DNA, 13 bp, Homo sapiens
tccttttcatctg

SEQ ID NO: 1878309 - DNA, 22 bp, Homo sapiens
tcctttttgcagtatatttctg

SEQ ID NO: 1878310 - DNA, 15 bp, Homo sapiens
tcgaatttttattat

SEQ ID NO: 1878311 - DNA, 13 bp, Homo sapiens
tcgcgctgcctgt

SEQ ID NO: 1878312 - DNA, 16 bp, Homo sapiens
tcgctgatgctgggct

SEQ ID NO: 1878313 - DNA, 18 bp, Homo sapiens
tcgctgatgctgggctgg

SEQ ID NO: 1878314 - DNA, 19 bp, Homo sapiens
tcgctgatgctgggctggg

SEQ ID NO: 1878315 - DNA, 22 bp, Homo sapiens
tcgctgatgctgggctgggtgc

SEQ ID NO: 1878316 - DNA, 16 bp, Homo sapiens
tcgcttcatgtaacta

SEQ ID NO: 1878317 - DNA, 12 bp, Homo sapiens
tcggctcctgct

SEQ ID NO: 1878318 - DNA, 18 bp, Homo sapiens
tcggctcctgctgcacca

SEQ ID NO: 1878319 - DNA, 14 bp, Homo sapiens
tcgggctcctgtgc

SEQ ID NO: 1878320 - DNA, 15 bp, Homo sapiens
tcgggctcctgtgcc

SEQ ID NO: 1878321 - DNA, 17 bp, Homo sapiens
tcgggctcctgtgccct

SEQ ID NO: 1878322 - DNA, 21 bp, Homo sapiens
tcggggggcgagggaggggag

SEQ ID NO: 1878323 - DNA, 16 bp, Homo sapiens
tcgggttaagaaatac

SEQ ID NO: 1878324 - DNA, 17 bp, Homo sapiens
tcgggttaagaaatacc

SEQ ID NO: 1878325 - DNA, 20 bp, Homo sapiens
tcgtgccagtcgcgctgcct

SEQ ID NO: 1878326 - DNA, 21 bp, Homo sapiens
tcgtgccagtcgcgctgcctg

SEQ ID NO: 1878327 - DNA, 22 bp, Homo sapiens
tcgtgccagtcgcgctgcctgt

SEQ ID NO: 1878328 - DNA, 15 bp, Homo sapiens
tctaaagtttacagt

SEQ ID NO: 1878329 - DNA, 19 bp, Homo sapiens
tctaaagtttacagtaaat

SEQ ID NO: 1878330 - DNA, 22 bp, Homo sapiens
tctaaagtttacagtaaataaa

SEQ ID NO: 1878331 - DNA, 18 bp, Homo sapiens
tctaagtgtttcataaat

SEQ ID NO: 1878332 - DNA, 18 bp, Homo sapiens
tctaatcatgaaactccc

SEQ ID NO: 1878333 - DNA, 23 bp, Homo sapiens
gtgtgccctggctcccaagggag

SEQ ID NO: 1878334 - DNA, 18 bp, Homo sapiens
gtgttaggcctggcacag

SEQ ID NO: 1878335 - DNA, 24 bp, Homo sapiens
gtgttaggcctggcacagtgtctg

SEQ ID NO: 1878336 - DNA, 13 bp, Homo sapiens
gtgttctgagccc

SEQ ID NO: 1878337 - DNA, 15 bp, Homo sapiens
gttaaagctgccggc

SEQ ID NO: 1878338 - DNA, 21 bp, Homo sapiens
gttacattaaagccctgtgtt

SEQ ID NO: 1878339 - DNA, 18 bp, Homo sapiens
gttaccgctggccgagct

SEQ ID NO: 1878340 - DNA, 23 bp, Homo sapiens
gttacctctgcctcagaaaacaa

SEQ ID NO: 1878341 - DNA, 20 bp, Homo sapiens
gttagatattattttagctt

SEQ ID NO: 1878342 - DNA, 17 bp, Homo sapiens
gttagccaatatttttc

SEQ ID NO: 1878343 - DNA, 13 bp, Homo sapiens
gttaggcctggca

SEQ ID NO: 1878344 - DNA, 23 bp, Homo sapiens
gttattattactctacactgaaa

SEQ ID NO: 1878345 - DNA, 15 bp, Homo sapiens
gttatttagtaaagt

SEQ ID NO: 1878346 - DNA, 20 bp, Homo sapiens
gttatttgtacagttcagtt

SEQ ID NO: 1878347 - DNA, 16 bp, Homo sapiens
gttcatccattctatt

SEQ ID NO: 1878348 - DNA, 14 bp, Homo sapiens
gttcctctttgcat

SEQ ID NO: 1878349 - DNA, 12 bp, Homo sapiens
gttctgaagaag

SEQ ID NO: 1878350 - DNA, 14 bp, Homo sapiens
gttctgtaggagag

SEQ ID NO: 1878351 - DNA, 19 bp, Homo sapiens
gttctgtaggagagactgg

SEQ ID NO: 1878352 - DNA, 22 bp, Homo sapiens
gttctgtaggagagactggcca

SEQ ID NO: 1878353 - DNA, 18 bp, Homo sapiens
gttgaactgcaggaagag

SEQ ID NO: 1878354 - DNA, 19 bp, Homo sapiens
gttgaactgcaggaagaga

SEQ ID NO: 1878355 - DNA, 17 bp, Homo sapiens
gttgacactgttttcct

SEQ ID NO: 1878356 - DNA, 13 bp, Homo sapiens
gttgacatgggac

SEQ ID NO: 1878357 - DNA, 18 bp, Homo sapiens
gttgacattcagaaaact

SEQ ID NO: 1878358 - DNA, 17 bp, Homo sapiens
gttgcaggtgtccgggg

SEQ ID NO: 1878359 - DNA, 22 bp, Homo sapiens
gttgccgggcctggactgtcct

SEQ ID NO: 1878360 - DNA, 16 bp, Homo sapiens
gttgcctgctgagctg

SEQ ID NO: 1878361 - DNA, 18 bp, Homo sapiens
gttgcctgctgagctgtg

SEQ ID NO: 1878362 - DNA, 16 bp, Homo sapiens
gttggcttctgtgcct

SEQ ID NO: 1878363 - DNA, 21 bp, Homo sapiens
gttgggccatactggcctcgc

SEQ ID NO: 1878364 - DNA, 16 bp, Homo sapiens
gttggtggtgcagccc

SEQ ID NO: 1878365 - DNA, 17 bp, Homo sapiens
gttgtctccctggccct

SEQ ID NO: 1878366 - DNA, 14 bp, Homo sapiens
gttgtgaaatgtaa

SEQ ID NO: 1878367 - DNA, 17 bp, Homo sapiens
gttgtgaaatgtaacat

SEQ ID NO: 1878368 - DNA, 21 bp, Homo sapiens
gtttaaagtgcagtcatttgt

SEQ ID NO: 1878369 - DNA, 23 bp, Homo sapiens
gtttaaagtgcagtcatttgtgg

SEQ ID NO: 1878370 - DNA, 14 bp, Homo sapiens
gtttaagttgtatt

SEQ ID NO: 1878371 - DNA, 20 bp, Homo sapiens
gtttagcaggctgcagcagg

SEQ ID NO: 1878372 - DNA, 20 bp, Homo sapiens
gtttatataagcttgtattc

SEQ ID NO: 1878373 - DNA, 21 bp, Homo sapiens
gtttctgtagaaaagaaaaca

SEQ ID NO: 1878374 - DNA, 22 bp, Homo sapiens
gtttctgtagaaaagaaaacat

SEQ ID NO: 1878375 - DNA, 15 bp, Homo sapiens
gtttgttttttcatg

SEQ ID NO: 1878376 - DNA, 14 bp, Homo sapiens
gttttgacattttt

SEQ ID NO: 1878377 - DNA, 17 bp, Homo sapiens
gtttttaaaatagaatg

SEQ ID NO: 1878378 - DNA, 19 bp, Homo sapiens
gtttttctacttttaaaga

SEQ ID NO: 1878379 - DNA, 23 bp, Homo sapiens
gtttttttttaaaaaagaaacat

SEQ ID NO: 1878380 - DNA, 17 bp, Homo sapiens
taaaaaatggtgcctga

SEQ ID NO: 1878381 - DNA, 15 bp, Homo sapiens
taaaaacattttgaa

SEQ ID NO: 1878382 - DNA, 19 bp, Homo sapiens
taaaaagagagaaaactta

SEQ ID NO: 1878383 - DNA, 20 bp, Homo sapiens
taaaaagagagaaaacttat

SEQ ID NO: 1878384 - DNA, 21 bp, Homo sapiens
taaaaatgttctattttaatt

SEQ ID NO: 1878385 - DNA, 11 bp, Homo sapiens
taaaacacttg

SEQ ID NO: 1878386 - DNA, 14 bp, Homo sapiens
taaaagatgaaggc

SEQ ID NO: 1878387 - DNA, 22 bp, Homo sapiens
taaaagatgaaggctgtatcta

SEQ ID NO: 1878388 - DNA, 20 bp, Homo sapiens
taaaataatttttatatttg

SEQ ID NO: 1878389 - DNA, 15 bp, Homo sapiens
taaaatccatacatt

SEQ ID NO: 1878390 - DNA, 18 bp, Homo sapiens
taaaatccatacatttgt

SEQ ID NO: 1878391 - DNA, 16 bp, Homo sapiens
taaaatgaaatgtttt

SEQ ID NO: 1878392 - DNA, 21 bp, Homo sapiens
taaaatgtcagtgtttgggaa

SEQ ID NO: 1878393 - DNA, 14 bp, Homo sapiens
taaaattgtaaaat

SEQ ID NO: 1878394 - DNA, 16 bp, Homo sapiens
taaaattgtaaaattg

SEQ ID NO: 1878395 - DNA, 23 bp, Homo sapiens
taaaattgtatagagatatgcag

SEQ ID NO: 1878396 - DNA, 16 bp, Homo sapiens
taaacagttgttactt

SEQ ID NO: 1878397 - DNA, 15 bp, Homo sapiens
taaacttagaataaa

SEQ ID NO: 1878398 - DNA, 19 bp, Homo sapiens
taaacttagaataaaattg

SEQ ID NO: 1878399 - DNA, 20 bp, Homo sapiens
taaacttagaataaaattgt

SEQ ID NO: 1878400 - DNA, 21 bp, Homo sapiens
taaacttagaataaaattgta

SEQ ID NO: 1878401 - DNA, 20 bp, Homo sapiens
taaagccctgtgttaagtgt

SEQ ID NO: 1878402 - DNA, 18 bp, Homo sapiens
taaagtctattgtttgtt

SEQ ID NO: 1878403 - DNA, 13 bp, Homo sapiens
taaagtttacagt

SEQ ID NO: 1878404 - DNA, 14 bp, Homo sapiens
taaagtttacagta

SEQ ID NO: 1878405 - DNA, 16 bp, Homo sapiens
taaagtttacagtaaa

SEQ ID NO: 1878406 - DNA, 17 bp, Homo sapiens
taaagtttacagtaaat

SEQ ID NO: 1878407 - DNA, 20 bp, Homo sapiens
taaagtttggtattgtaaaa

SEQ ID NO: 1878408 - DNA, 11 bp, Homo sapiens
taaagtttgtt

SEQ ID NO: 1878409 - DNA, 13 bp, Homo sapiens
taaagtttgttca

SEQ ID NO: 1878410 - DNA, 14 bp, Homo sapiens
taaagtttgttcac

SEQ ID NO: 1878411 - DNA, 19 bp, Homo sapiens
taaagtttgttcacttaaa

SEQ ID NO: 1878412 - DNA, 12 bp, Homo sapiens
taaagtttgttg

SEQ ID NO: 1878413 - DNA, 12 bp, Homo sapiens
taaataaattgt

SEQ ID NO: 1878414 - DNA, 14 bp, Homo sapiens
taaatggtgttaca

SEQ ID NO: 1878415 - DNA, 18 bp, Homo sapiens
taaatggtgttacattaa

SEQ ID NO: 1878416 - DNA, 19 bp, Homo sapiens
taaatgtctgacacattaa

SEQ ID NO: 1878417 - DNA, 19 bp, Homo sapiens
taaattacacaataaagca

SEQ ID NO: 1878418 - DNA, 20 bp, Homo sapiens
taaattacacaataaagcag

SEQ ID NO: 1878419 - DNA, 21 bp, Homo sapiens
taaattgtcagatcgttcatt

SEQ ID NO: 1878420 - DNA, 20 bp, Homo sapiens
taaatttaggtaaataaagc

SEQ ID NO: 1878421 - DNA, 21 bp, Homo sapiens
taaatttaggtaaataaagct

SEQ ID NO: 1878422 - DNA, 19 bp, Homo sapiens
taacataatggttgtgaaa

SEQ ID NO: 1878423 - DNA, 20 bp, Homo sapiens
taacataatggttgtgaaat

SEQ ID NO: 1878424 - DNA, 22 bp, Homo sapiens
taacatctttgtttttaaaata

SEQ ID NO: 1878425 - DNA, 12 bp, Homo sapiens
taacgtggcttg

SEQ ID NO: 1878426 - DNA, 15 bp, Homo sapiens
taactggaaacttca

SEQ ID NO: 1878427 - DNA, 15 bp, Homo sapiens
taactggagctccga

SEQ ID NO: 1878428 - DNA, 15 bp, Homo sapiens
taacttaattgctat

SEQ ID NO: 1878429 - DNA, 13 bp, Homo sapiens
taactttaaacat

SEQ ID NO: 1878430 - DNA, 15 bp, Homo sapiens
taactttctctatga

SEQ ID NO: 1878431 - DNA, 20 bp, Homo sapiens
taacttttttttttttaaca

SEQ ID NO: 1878432 - DNA, 16 bp, Homo sapiens
taagaaaaaattcttt

SEQ ID NO: 1878433 - DNA, 21 bp, Homo sapiens
taagaaaaaattctttcactt

SEQ ID NO: 1878434 - DNA, 23 bp, Homo sapiens
taagaaaaaattctttcacttga

SEQ ID NO: 1878435 - DNA, 13 bp, Homo sapiens
taagagagaatga

SEQ ID NO: 1878436 - DNA, 18 bp, Homo sapiens
taagagcttgatctgtga

SEQ ID NO: 1878437 - DNA, 14 bp, Homo sapiens
taagatatttttca

SEQ ID NO: 1878438 - DNA, 15 bp, Homo sapiens
taagatatttttcat

SEQ ID NO: 1878439 - DNA, 19 bp, Homo sapiens
taagatatttttcatgatt

SEQ ID NO: 1878440 - DNA, 23 bp, Homo sapiens
taagcaggaggaggtgccaacag

SEQ ID NO: 1878441 - DNA, 20 bp, Homo sapiens
taagccatttaactggagct

SEQ ID NO: 1878442 - DNA, 12 bp, Homo sapiens
taagctgtaaaa

SEQ ID NO: 1878443 - DNA, 14 bp, Homo sapiens
tataattttgtgaa

SEQ ID NO: 1878444 - DNA, 13 bp, Homo sapiens
tataccttctcaa

SEQ ID NO: 1878445 - DNA, 13 bp, Homo sapiens
tatagtccagctt

SEQ ID NO: 1878446 - DNA, 21 bp, Homo sapiens
tatataaacactccacagtgt

SEQ ID NO: 1878447 - DNA, 17 bp, Homo sapiens
tatataacaatgctgta

SEQ ID NO: 1878448 - DNA, 23 bp, Homo sapiens
tatataagaaaaaattctttcac

SEQ ID NO: 1878449 - DNA, 16 bp, Homo sapiens
tatatgcttctgtttt

SEQ ID NO: 1878450 - DNA, 19 bp, Homo sapiens
tatatttattactgtaaga

SEQ ID NO: 1878451 - DNA, 20 bp, Homo sapiens
tatatttattactgtaagaa

SEQ ID NO: 1878452 - DNA, 22 bp, Homo sapiens
tatattttaagccttcatttgc

SEQ ID NO: 1878453 - DNA, 19 bp, Homo sapiens
tatcaattaccacaccatc

SEQ ID NO: 1878454 - DNA, 21 bp, Homo sapiens
tatcagggatcctctctccag

SEQ ID NO: 1878455 - DNA, 17 bp, Homo sapiens
tatcagtgtgcccccca

SEQ ID NO: 1878456 - DNA, 21 bp, Homo sapiens
tatcatatatatacatacatg

SEQ ID NO: 1878457 - DNA, 22 bp, Homo sapiens
tatccacaaagtactcctcact

SEQ ID NO: 1878458 - DNA, 16 bp, Homo sapiens
tatcctatctctccaa

SEQ ID NO: 1878459 - DNA, 20 bp, Homo sapiens
tatcgcaccactgtgtattt

SEQ ID NO: 1878460 - DNA, 20 bp, Homo sapiens
tatctatttttttttctttt

SEQ ID NO: 1878461 - DNA, 16 bp, Homo sapiens
tatgattcccagccag

SEQ ID NO: 1878462 - DNA, 13 bp, Homo sapiens
tatgtacttcatg

SEQ ID NO: 1878463 - DNA, 15 bp, Homo sapiens
tatgtcatgcctcac

SEQ ID NO: 1878464 - DNA, 16 bp, Homo sapiens
tatgtctaaagagctt

SEQ ID NO: 1878465 - DNA, 23 bp, Homo sapiens
tatgttctagtgatttcctgtat

SEQ ID NO: 1878466 - DNA, 14 bp, Homo sapiens
tattaaaaatagat

SEQ ID NO: 1878467 - DNA, 18 bp, Homo sapiens
tattactctacactgaaa

SEQ ID NO: 1878468 - DNA, 21 bp, Homo sapiens
tattactctacactgaaacgt

SEQ ID NO: 1878469 - DNA, 16 bp, Homo sapiens
tattatgttaaaactg

SEQ ID NO: 1878470 - DNA, 19 bp, Homo sapiens
tattattactctacactga

SEQ ID NO: 1878471 - DNA, 15 bp, Homo sapiens
tattgtaaaacattc

SEQ ID NO: 1878472 - DNA, 18 bp, Homo sapiens
tattgttttatgttctag

SEQ ID NO: 1878473 - DNA, 14 bp, Homo sapiens
tatttaacttgagg

SEQ ID NO: 1878474 - DNA, 21 bp, Homo sapiens
tatttagtaaagtttgttgaa

SEQ ID NO: 1878475 - DNA, 16 bp, Homo sapiens
tatttattttaataat

SEQ ID NO: 1878476 - DNA, 21 bp, Homo sapiens
tatttccccaacatgtaataa

SEQ ID NO: 1878477 - DNA, 21 bp, Homo sapiens
tatttctatgaaatattatgt

SEQ ID NO: 1878478 - DNA, 22 bp, Homo sapiens
tatttctatgaaatattatgtt

SEQ ID NO: 1878479 - DNA, 18 bp, Homo sapiens
tattttaaaagaatgatt

SEQ ID NO: 1878480 - DNA, 19 bp, Homo sapiens
tattttaataatgtttcaa

SEQ ID NO: 1878481 - DNA, 22 bp, Homo sapiens
tattttaataatgtttcaaaca

SEQ ID NO: 1878482 - DNA, 18 bp, Homo sapiens
tattttaggcagggattt

SEQ ID NO: 1878483 - DNA, 21 bp, Homo sapiens
tattttaggcagggatttgag

SEQ ID NO: 1878484 - DNA, 21 bp, Homo sapiens
tattttcatgacttttccatg

SEQ ID NO: 1878485 - DNA, 16 bp, Homo sapiens
tattttgattttacat

SEQ ID NO: 1878486 - DNA, 14 bp, Homo sapiens
tattttgtaattat

SEQ ID NO: 1878487 - DNA, 20 bp, Homo sapiens
tatttttcatgattttgaaa

SEQ ID NO: 1878488 - DNA, 20 bp, Homo sapiens
tatttttttaagctgtaaaa

SEQ ID NO: 1878489 - DNA, 22 bp, Homo sapiens
tatttttttttctttttaaagt

SEQ ID NO: 1878490 - DNA, 17 bp, Homo sapiens
tcaaacatatataacaa

SEQ ID NO: 1878491 - DNA, 18 bp, Homo sapiens
tcaaactgtcttggctgt

SEQ ID NO: 1878492 - DNA, 21 bp, Homo sapiens
tcaaatggagaaacaggccca

SEQ ID NO: 1878493 - DNA, 14 bp, Homo sapiens
tcaaattgtgtgaa

SEQ ID NO: 1878494 - DNA, 15 bp, Homo sapiens
tcaaattgtgtgaaa

SEQ ID NO: 1878495 - DNA, 16 bp, Homo sapiens
tcaacccctcccctcc

SEQ ID NO: 1878496 - DNA, 14 bp, Homo sapiens
tcaagtcagctctt

SEQ ID NO: 1878497 - DNA, 22 bp, Homo sapiens
tcaataagcctcagctttctaa

SEQ ID NO: 1878498 - DNA, 16 bp, Homo sapiens
tcaatacccctgttaa

SEQ ID NO: 1878499 - DNA, 19 bp, Homo sapiens
tcaatgacacccctggcct

SEQ ID NO: 1878500 - DNA, 15 bp, Homo sapiens
tcaatgttttcagtt

SEQ ID NO: 1878501 - DNA, 14 bp, Homo sapiens
tcaatttgtcatgt

SEQ ID NO: 1878502 - DNA, 17 bp, Homo sapiens
tcacacggggtatttta

SEQ ID NO: 1878503 - DNA, 12 bp, Homo sapiens
tcacagtgcagc

SEQ ID NO: 1878504 - DNA, 23 bp, Homo sapiens
tcacataccagagtctggagctg

SEQ ID NO: 1878505 - DNA, 14 bp, Homo sapiens
tcacatgcccgctg

SEQ ID NO: 1878506 - DNA, 19 bp, Homo sapiens
tcacatgcccgctgtccca

SEQ ID NO: 1878507 - DNA, 22 bp, Homo sapiens
tcaccatcagcaggctccagtt

SEQ ID NO: 1878508 - DNA, 17 bp, Homo sapiens
tcacccccactctgcat

SEQ ID NO: 1878509 - DNA, 15 bp, Homo sapiens
tcaccggtcagtgcc

SEQ ID NO: 1878510 - DNA, 15 bp, Homo sapiens
tcactatgctgctat

SEQ ID NO: 1878511 - DNA, 18 bp, Homo sapiens
tcactattcaagtattag

SEQ ID NO: 1878512 - DNA, 20 bp, Homo sapiens
tcactctgtggtccagagtc

SEQ ID NO: 1878513 - DNA, 15 bp, Homo sapiens
tcacttaaattcttt

SEQ ID NO: 1878514 - DNA, 17 bp, Homo sapiens
tcacttaaattcttttg

SEQ ID NO: 1878515 - DNA, 18 bp, Homo sapiens
tcacttaaattcttttga

SEQ ID NO: 1878516 - DNA, 18 bp, Homo sapiens
tcacttcttccactgtgt

SEQ ID NO: 1878517 - DNA, 21 bp, Homo sapiens
tcagagcctcctttctggctt

SEQ ID NO: 1878518 - DNA, 23 bp, Homo sapiens
tcagagtccttgcaaaattgtct

SEQ ID NO: 1878519 - DNA, 17 bp, Homo sapiens
tcagatgtgttcctcca

SEQ ID NO: 1878520 - DNA, 20 bp, Homo sapiens
tcagccagtgaccaaccttt

SEQ ID NO: 1878521 - DNA, 19 bp, Homo sapiens
tcagcctacaggcctcaca

SEQ ID NO: 1878522 - DNA, 22 bp, Homo sapiens
tcagctcttctccatcctacca

SEQ ID NO: 1878523 - DNA, 14 bp, Homo sapiens
tcagcttctgctgg

SEQ ID NO: 1878524 - DNA, 18 bp, Homo sapiens
tcagcttctgctgggctg

SEQ ID NO: 1878525 - DNA, 17 bp, Homo sapiens
tcaggctagatgtatgt

SEQ ID NO: 1878526 - DNA, 16 bp, Homo sapiens
tcagggaccacagcaa

SEQ ID NO: 1878527 - DNA, 12 bp, Homo sapiens
tcagggctgggc

SEQ ID NO: 1878528 - DNA, 19 bp, Homo sapiens
tcagggctgggcaggtcct

SEQ ID NO: 1878529 - DNA, 22 bp, Homo sapiens
tcagggctgggcaggtcctggg

SEQ ID NO: 1878530 - DNA, 13 bp, Homo sapiens
tcaggggctgccc

SEQ ID NO: 1878531 - DNA, 16 bp, Homo sapiens
tcaggggctgcccgct

SEQ ID NO: 1878532 - DNA, 21 bp, Homo sapiens
tcaggggctgcccgctcccag

SEQ ID NO: 1878533 - DNA, 15 bp, Homo sapiens
tcaggtgcagtccca

SEQ ID NO: 1878534 - DNA, 23 bp, Homo sapiens
tcaggtgcagtcccagtccttga

SEQ ID NO: 1878535 - DNA, 16 bp, Homo sapiens
tcagtgccgccgcctc

SEQ ID NO: 1878536 - DNA, 21 bp, Homo sapiens
tcagtgccgccgcctcgccca

SEQ ID NO: 1878537 - DNA, 23 bp, Homo sapiens
tcagtgccgccgcctcgcccacc

SEQ ID NO: 1878538 - DNA, 20 bp, Homo sapiens
tcagtgctttttccttttca

SEQ ID NO: 1878539 - DNA, 19 bp, Homo sapiens
tcagtgtgccccccatcct

SEQ ID NO: 1878540 - DNA, 20 bp, Homo sapiens
tcagtgtgccccccatcctg

SEQ ID NO: 1878541 - DNA, 22 bp, Homo sapiens
tcagtgtgccccccatcctggc

SEQ ID NO: 1878542 - DNA, 18 bp, Homo sapiens
tcagttcctctttgcatg

SEQ ID NO: 1878543 - DNA, 19 bp, Homo sapiens
tcagttctcttgattttca

SEQ ID NO: 1878544 - DNA, 12 bp, Homo sapiens
tcagttgttttc

SEQ ID NO: 1878545 - DNA, 14 bp, Homo sapiens
tcataaattacaca

SEQ ID NO: 1878546 - DNA, 18 bp, Homo sapiens
tcataagatatttttcat

SEQ ID NO: 1878547 - DNA, 21 bp, Homo sapiens
tcataagatatttttcatgat

SEQ ID NO: 1878548 - DNA, 14 bp, Homo sapiens
tcatagacccatct

SEQ ID NO: 1878549 - DNA, 18 bp, Homo sapiens
tcatattttctttcaaaa

SEQ ID NO: 1878550 - DNA, 18 bp, Homo sapiens
tcatcacttcttccactg

SEQ ID NO: 1878551 - DNA, 22 bp, Homo sapiens
tcatcatgtatcgcttcatgta

SEQ ID NO: 1878552 - DNA, 21 bp, Homo sapiens
tcatctgggccaccagctcca

SEQ ID NO: 1878553 - DNA, 11 bp, Homo sapiens
tcatgaaaatt

SEQ ID NO: 1878554 - DNA, 16 bp, Homo sapiens
tcatgaattagtttta

SEQ ID NO: 1878555 - DNA, 21 bp, Homo sapiens
tcatgaattagttttatatgc

SEQ ID NO: 1878556 - DNA, 18 bp, Homo sapiens
tcatgacttttccatgta

SEQ ID NO: 1878557 - DNA, 18 bp, Homo sapiens
ctgcaccccctcctgctg

SEQ ID NO: 1878558 - DNA, 19 bp, Homo sapiens
ctgcaccccctcctgctgc

SEQ ID NO: 1878559 - DNA, 16 bp, Homo sapiens
ctgcactctgtgccca

SEQ ID NO: 1878560 - DNA, 14 bp, Homo sapiens
ctgcactgtcctgc

SEQ ID NO: 1878561 - DNA, 15 bp, Homo sapiens
ctgcactgtcctgct

SEQ ID NO: 1878562 - DNA, 21 bp, Homo sapiens
ctgcagagagcacctggtggg

SEQ ID NO: 1878563 - DNA, 12 bp, Homo sapiens
ctgcagaggagc

SEQ ID NO: 1878564 - DNA, 23 bp, Homo sapiens
ctgcagaggagccacctgggctg

SEQ ID NO: 1878565 - DNA, 21 bp, Homo sapiens
ctgcagaggggcaggccctgc

SEQ ID NO: 1878566 - DNA, 13 bp, Homo sapiens
ctgcagcaggcag

SEQ ID NO: 1878567 - DNA, 21 bp, Homo sapiens
ctgcagcaggcagaggagagt

SEQ ID NO: 1878568 - DNA, 17 bp, Homo sapiens
ctgcaggaggcctggga

SEQ ID NO: 1878569 - DNA, 18 bp, Homo sapiens
ctgcaggaggcctgggag

SEQ ID NO: 1878570 - DNA, 13 bp, Homo sapiens
ctgcataccctca

SEQ ID NO: 1878571 - DNA, 17 bp, Homo sapiens
ctgcataccctcatcaa

SEQ ID NO: 1878572 - DNA, 13 bp, Homo sapiens
ctgccaagcctgg

SEQ ID NO: 1878573 - DNA, 16 bp, Homo sapiens
ctgccaagcctggagc

SEQ ID NO: 1878574 - DNA, 21 bp, Homo sapiens
ctgcccaggacggggccggcc

SEQ ID NO: 1878575 - DNA, 13 bp, Homo sapiens
ctgccccagctgg

SEQ ID NO: 1878576 - DNA, 18 bp, Homo sapiens
ctgccccagctgggctgt

SEQ ID NO: 1878577 - DNA, 17 bp, Homo sapiens
ctgcccgctcccagtgt

SEQ ID NO: 1878578 - DNA, 20 bp, Homo sapiens
ctgcccggcgccctctgtcc

SEQ ID NO: 1878579 - DNA, 16 bp, Homo sapiens
ctgcctccactcccac

SEQ ID NO: 1878580 - DNA, 13 bp, Homo sapiens
ctgcctgcctggg

SEQ ID NO: 1878581 - DNA, 15 bp, Homo sapiens
ctgcctgcctgggaa

SEQ ID NO: 1878582 - DNA, 16 bp, Homo sapiens
ctgcctgcctgggaac

SEQ ID NO: 1878583 - DNA, 20 bp, Homo sapiens
ctgcctggaagagcagccct

SEQ ID NO: 1878584 - DNA, 20 bp, Homo sapiens
ctgctaccctccctgctgtc

SEQ ID NO: 1878585 - DNA, 14 bp, Homo sapiens
ctgctatgcatttt

SEQ ID NO: 1878586 - DNA, 20 bp, Homo sapiens
ctgctatggacgacctccag

SEQ ID NO: 1878587 - DNA, 12 bp, Homo sapiens
ctgctccacagt

SEQ ID NO: 1878588 - DNA, 19 bp, Homo sapiens
ctgctcgggcccaggccat

SEQ ID NO: 1878589 - DNA, 22 bp, Homo sapiens
ctgctcgggcccaggccatctt

SEQ ID NO: 1878590 - DNA, 18 bp, Homo sapiens
ctgctctccttgccctgg

SEQ ID NO: 1878591 - DNA, 22 bp, Homo sapiens
ctgctctccttgccctgggcca

SEQ ID NO: 1878592 - DNA, 13 bp, Homo sapiens
ctgctctgagacg

SEQ ID NO: 1878593 - DNA, 15 bp, Homo sapiens
ctgctgcaccaaccc

SEQ ID NO: 1878594 - DNA, 17 bp, Homo sapiens
ctgctgcaccaacccag

SEQ ID NO: 1878595 - DNA, 19 bp, Homo sapiens
ctgctgcaccaacccagcc

SEQ ID NO: 1878596 - DNA, 20 bp, Homo sapiens
ctgctgcaccaacccagccg

SEQ ID NO: 1878597 - DNA, 16 bp, Homo sapiens
ctgctgcagaggggca

SEQ ID NO: 1878598 - DNA, 17 bp, Homo sapiens
ctgctgcagaggggcag

SEQ ID NO: 1878599 - DNA, 21 bp, Homo sapiens
ctgctgcagaggggcaggccc

SEQ ID NO: 1878600 - DNA, 15 bp, Homo sapiens
ctgctgcttctgggc

SEQ ID NO: 1878601 - DNA, 19 bp, Homo sapiens
ctgctgcttctgggcctga

SEQ ID NO: 1878602 - DNA, 13 bp, Homo sapiens
ctgctgggctggg

SEQ ID NO: 1878603 - DNA, 15 bp, Homo sapiens
ctgctgggctggggc

SEQ ID NO: 1878604 - DNA, 17 bp, Homo sapiens
ctgctgggctggggcct

SEQ ID NO: 1878605 - DNA, 14 bp, Homo sapiens
ctgctgggtggccc

SEQ ID NO: 1878606 - DNA, 15 bp, Homo sapiens
ctgctgggtggccca

SEQ ID NO: 1878607 - DNA, 17 bp, Homo sapiens
ctgctgggtggcccatc

SEQ ID NO: 1878608 - DNA, 20 bp, Homo sapiens
ctgctggtaatttgtatctg

SEQ ID NO: 1878609 - DNA, 14 bp, Homo sapiens
ctgctgtcccctct

SEQ ID NO: 1878610 - DNA, 19 bp, Homo sapiens
ctgctgtcccctcttgccc

SEQ ID NO: 1878611 - DNA, 22 bp, Homo sapiens
ctgctgtcccctcttgccccaa

SEQ ID NO: 1878612 - DNA, 13 bp, Homo sapiens
ctgcttctgggcc

SEQ ID NO: 1878613 - DNA, 14 bp, Homo sapiens
ctgcttctgggcct

SEQ ID NO: 1878614 - DNA, 16 bp, Homo sapiens
ctggaagagcagccct

SEQ ID NO: 1878615 - DNA, 22 bp, Homo sapiens
ctggacccacgaggaggaacca

SEQ ID NO: 1878616 - DNA, 12 bp, Homo sapiens
ctggactgtcct

SEQ ID NO: 1878617 - DNA, 12 bp, Homo sapiens
gtaacagttgtg

SEQ ID NO: 1878618 - DNA, 16 bp, Homo sapiens
gtaactttaaacatct

SEQ ID NO: 1878619 - DNA, 12 bp, Homo sapiens
gtaatatattgc

SEQ ID NO: 1878620 - DNA, 20 bp, Homo sapiens
gtaatatattgctgctggta

SEQ ID NO: 1878621 - DNA, 23 bp, Homo sapiens
gtaattacctgtcatctgggcca

SEQ ID NO: 1878622 - DNA, 18 bp, Homo sapiens
gtacagaatagaatacat

SEQ ID NO: 1878623 - DNA, 19 bp, Homo sapiens
gtacagttcagttcctctt

SEQ ID NO: 1878624 - DNA, 22 bp, Homo sapiens
gtaccaggtctcctccaccgcc

SEQ ID NO: 1878625 - DNA, 13 bp, Homo sapiens
gtacccccgccca

SEQ ID NO: 1878626 - DNA, 17 bp, Homo sapiens
gtacccccgcccaggct

SEQ ID NO: 1878627 - DNA, 18 bp, Homo sapiens
gtacccccgcccaggctg

SEQ ID NO: 1878628 - DNA, 19 bp, Homo sapiens
gtacgtgggagaggcagaa

SEQ ID NO: 1878629 - DNA, 22 bp, Homo sapiens
gtactaactcctaggaaaatac

SEQ ID NO: 1878630 - DNA, 15 bp, Homo sapiens
gtacttcatgctgtc

SEQ ID NO: 1878631 - DNA, 23 bp, Homo sapiens
gtagaaaagaaaacatttaacat

SEQ ID NO: 1878632 - DNA, 16 bp, Homo sapiens
gtagctctgagccctc

SEQ ID NO: 1878633 - DNA, 22 bp, Homo sapiens
gtagctggctgtactgccaagg

SEQ ID NO: 1878634 - DNA, 14 bp, Homo sapiens
gtaggagagactgg

SEQ ID NO: 1878635 - DNA, 20 bp, Homo sapiens
gtaggcgcccctggggtggg

SEQ ID NO: 1878636 - DNA, 12 bp, Homo sapiens
gtaggtgctggc

SEQ ID NO: 1878637 - DNA, 15 bp, Homo sapiens
gtaggtgctggcctc

SEQ ID NO: 1878638 - DNA, 14 bp, Homo sapiens
gtagtgttggagaa

SEQ ID NO: 1878639 - DNA, 15 bp, Homo sapiens
gtagtgttggagaag

SEQ ID NO: 1878640 - DNA, 20 bp, Homo sapiens
gtagtgttggagaagaactg

SEQ ID NO: 1878641 - DNA, 20 bp, Homo sapiens
gtatctatttttttttcttt

SEQ ID NO: 1878642 - DNA, 20 bp, Homo sapiens
gtatctcggacctttcagct

SEQ ID NO: 1878643 - DNA, 14 bp, Homo sapiens
gtatctgaaggaga

SEQ ID NO: 1878644 - DNA, 14 bp, Homo sapiens
gtatgattcccagc

SEQ ID NO: 1878645 - DNA, 17 bp, Homo sapiens
gtatgttagtgcaaatt

SEQ ID NO: 1878646 - DNA, 17 bp, Homo sapiens
gtattaatctgtttgtg

SEQ ID NO: 1878647 - DNA, 23 bp, Homo sapiens
gtattgcgaaacaacttgtgttc

SEQ ID NO: 1878648 - DNA, 13 bp, Homo sapiens
gtattgtaaaaca

SEQ ID NO: 1878649 - DNA, 15 bp, Homo sapiens
gtattgtaaaacatt

SEQ ID NO: 1878650 - DNA, 19 bp, Homo sapiens
gtattgtaaaacattcaca

SEQ ID NO: 1878651 - DNA, 17 bp, Homo sapiens
gtatttctatgaaatat

SEQ ID NO: 1878652 - DNA, 16 bp, Homo sapiens
gtattttaaaagaatg

SEQ ID NO: 1878653 - DNA, 17 bp, Homo sapiens
gtattttaaaagaatga

SEQ ID NO: 1878654 - DNA, 22 bp, Homo sapiens
gtcaactccaggacttgcttcc

SEQ ID NO: 1878655 - DNA, 21 bp, Homo sapiens
gtcaatgacacccctggcctg

SEQ ID NO: 1878656 - DNA, 16 bp, Homo sapiens
gtcaccggtcagtgcc

SEQ ID NO: 1878657 - DNA, 19 bp, Homo sapiens
gtcaccggtcagtgccttt

SEQ ID NO: 1878658 - DNA, 14 bp, Homo sapiens
gtcacctcatggaa

SEQ ID NO: 1878659 - DNA, 16 bp, Homo sapiens
gtcagatcgttcattg

SEQ ID NO: 1878660 - DNA, 13 bp, Homo sapiens
gtcatctgggcca

SEQ ID NO: 1878661 - DNA, 18 bp, Homo sapiens
gtcatgcctcactttctt

SEQ ID NO: 1878662 - DNA, 20 bp, Homo sapiens
gtcatggtggccacggccac

SEQ ID NO: 1878663 - DNA, 20 bp, Homo sapiens
gtcatgtaagctgaaaatat

SEQ ID NO: 1878664 - DNA, 21 bp, Homo sapiens
gtccaagcatttagatgtata

SEQ ID NO: 1878665 - DNA, 19 bp, Homo sapiens
gtccagagcttcagggctg

SEQ ID NO: 1878666 - DNA, 13 bp, Homo sapiens
gtccagtgcccat

SEQ ID NO: 1878667 - DNA, 16 bp, Homo sapiens
gtcccacttcccctcc

SEQ ID NO: 1878668 - DNA, 17 bp, Homo sapiens
gtcccaggggtctccct

SEQ ID NO: 1878669 - DNA, 21 bp, Homo sapiens
gtcccaggggtctccctgagc

SEQ ID NO: 1878670 - DNA, 16 bp, Homo sapiens
gtcccctcttgcccca

SEQ ID NO: 1878671 - DNA, 16 bp, Homo sapiens
gtccctccactaggag

SEQ ID NO: 1878672 - DNA, 22 bp, Homo sapiens
gtcctaggtgaccccatctctg

SEQ ID NO: 1878673 - DNA, 17 bp, Homo sapiens
gtcctgacttcaggggc

SEQ ID NO: 1878674 - DNA, 16 bp, Homo sapiens
gtcctgctccacagtg

SEQ ID NO: 1878675 - DNA, 23 bp, Homo sapiens
gtcctggggaggctgagactgca

SEQ ID NO: 1878676 - DNA, 21 bp, Homo sapiens
gtcctgtcagtgccgccgcct

SEQ ID NO: 1878677 - DNA, 22 bp, Homo sapiens
gtcctgtcagtgccgccgcctc

SEQ ID NO: 1878678 - DNA, 16 bp, Homo sapiens
gtcgaatttttattat

SEQ ID NO: 1878679 - DNA, 17 bp, Homo sapiens
gtcgcgctgcctgtgtg

SEQ ID NO: 1878680 - DNA, 15 bp, Homo sapiens
gtcgggggatgagga

SEQ ID NO: 1878681 - DNA, 15 bp, Homo sapiens
gtctaaagtttacag

SEQ ID NO: 1878682 - DNA, 23 bp, Homo sapiens
gtctacactaagagagaatgaga

SEQ ID NO: 1878683 - DNA, 20 bp, Homo sapiens
gtctaggactttagggatct

SEQ ID NO: 1878684 - DNA, 18 bp, Homo sapiens
gtctccctggccctcaag

SEQ ID NO: 1878685 - DNA, 21 bp, Homo sapiens
gtctcctccaccgccatggct

SEQ ID NO: 1878686 - DNA, 17 bp, Homo sapiens
gtctcgctgatgctggg

SEQ ID NO: 1878687 - DNA, 13 bp, Homo sapiens
gtctgactgtttc

SEQ ID NO: 1878688 - DNA, 21 bp, Homo sapiens
gtctgctcgggcccaggccat

SEQ ID NO: 1878689 - DNA, 23 bp, Homo sapiens
gtctttaagatcttggcttaatt

SEQ ID NO: 1878690 - DNA, 13 bp, Homo sapiens
gtgaatccctcaa

SEQ ID NO: 1878691 - DNA, 22 bp, Homo sapiens
gtgaccccttttcagcttctgc

SEQ ID NO: 1878692 - DNA, 17 bp, Homo sapiens
gtgactcgggctcctgt

SEQ ID NO: 1878693 - DNA, 20 bp, Homo sapiens
gtgaggcaggggagtctgct

SEQ ID NO: 1878694 - DNA, 13 bp, Homo sapiens
gtgaggcagtggg

SEQ ID NO: 1878695 - DNA, 23 bp, Homo sapiens
gtgaggcagtgggtcccacttcc

SEQ ID NO: 1878696 - DNA, 21 bp, Homo sapiens
gtgatcttaggtttgtttttt

SEQ ID NO: 1878697 - DNA, 19 bp, Homo sapiens
gtgattatttgttatttgt

SEQ ID NO: 1878698 - DNA, 19 bp, Homo sapiens
gtgcagccccaggaccaag

SEQ ID NO: 1878699 - DNA, 15 bp, Homo sapiens
gtgcagcttgcagtc

SEQ ID NO: 1878700 - DNA, 12 bp, Homo sapiens
gtgccaccctgg

SEQ ID NO: 1878701 - DNA, 14 bp, Homo sapiens
gtgccaccctgggc

SEQ ID NO: 1878702 - DNA, 16 bp, Homo sapiens
gtgccaccctgggctc

SEQ ID NO: 1878703 - DNA, 17 bp, Homo sapiens
gtgcccattcctcacct

SEQ ID NO: 1878704 - DNA, 17 bp, Homo sapiens
gtgccgccgcctcgccc

SEQ ID NO: 1878705 - DNA, 18 bp, Homo sapiens
gtgcctgattcggctgtc

SEQ ID NO: 1878706 - DNA, 22 bp, Homo sapiens
gtgcctgattcggctgtctcag

SEQ ID NO: 1878707 - DNA, 18 bp, Homo sapiens
gtgcgaccccatctgccc

SEQ ID NO: 1878708 - DNA, 18 bp, Homo sapiens
gtgcggtaggtgctggcc

SEQ ID NO: 1878709 - DNA, 17 bp, Homo sapiens
gtgctagggtgcctgct

SEQ ID NO: 1878710 - DNA, 19 bp, Homo sapiens
gtgctagggtgcctgctct

SEQ ID NO: 1878711 - DNA, 19 bp, Homo sapiens
gtgctgctaccctccctgc

SEQ ID NO: 1878712 - DNA, 16 bp, Homo sapiens
gtgctttttccttttc

SEQ ID NO: 1878713 - DNA, 18 bp, Homo sapiens
gtgctttttccttttcat

SEQ ID NO: 1878714 - DNA, 21 bp, Homo sapiens
gtggcccatcccccctcacca

SEQ ID NO: 1878715 - DNA, 13 bp, Homo sapiens
gtggccccagcct

SEQ ID NO: 1878716 - DNA, 14 bp, Homo sapiens
gtggccccagcctg

SEQ ID NO: 1878717 - DNA, 19 bp, Homo sapiens
gtggcgccccctggtggga

SEQ ID NO: 1878718 - DNA, 15 bp, Homo sapiens
gtggctgtccagtgc

SEQ ID NO: 1878719 - DNA, 17 bp, Homo sapiens
gtggctgtccagtgccc

SEQ ID NO: 1878720 - DNA, 13 bp, Homo sapiens
gtgggagaggcag

SEQ ID NO: 1878721 - DNA, 18 bp, Homo sapiens
gtgggagggcgaggcggg

SEQ ID NO: 1878722 - DNA, 21 bp, Homo sapiens
gtgggctgcactctgtgccca

SEQ ID NO: 1878723 - DNA, 20 bp, Homo sapiens
gtggggctaggggctggggc

SEQ ID NO: 1878724 - DNA, 22 bp, Homo sapiens
gtgggggaagagcacagccctc

SEQ ID NO: 1878725 - DNA, 11 bp, Homo sapiens
gtgggggagcc

SEQ ID NO: 1878726 - DNA, 13 bp, Homo sapiens
gtgggggagcctg

SEQ ID NO: 1878727 - DNA, 14 bp, Homo sapiens
gtggtagctctgag

SEQ ID NO: 1878728 - DNA, 17 bp, Homo sapiens
gtggtagctctgagccc

SEQ ID NO: 1878729 - DNA, 20 bp, Homo sapiens
gtggtccctccactaggagt

SEQ ID NO: 1878730 - DNA, 22 bp, Homo sapiens
gtggtgcagccccaggaccaag

SEQ ID NO: 1878731 - DNA, 13 bp, Homo sapiens
gtgtaactcacca

SEQ ID NO: 1878732 - DNA, 23 bp, Homo sapiens
gtgtaactcaccagcctctgctc

SEQ ID NO: 1878733 - DNA, 17 bp, Homo sapiens
gtgtacccccgcccagg

SEQ ID NO: 1878734 - DNA, 12 bp, Homo sapiens
gtgtatgtttct

SEQ ID NO: 1878735 - DNA, 14 bp, Homo sapiens
gtgtcaactccagg

SEQ ID NO: 1878736 - DNA, 18 bp, Homo sapiens
gtgtcactggctgcctcc

SEQ ID NO: 1878737 - DNA, 13 bp, Homo sapiens
ctggactgtccta

SEQ ID NO: 1878738 - DNA, 18 bp, Homo sapiens
ctggactgtcctaggtga

SEQ ID NO: 1878739 - DNA, 15 bp, Homo sapiens
ctggagatcaccagt

SEQ ID NO: 1878740 - DNA, 14 bp, Homo sapiens
ctggagcccctgtg

SEQ ID NO: 1878741 - DNA, 20 bp, Homo sapiens
ctggagcccctgtgtgggag

SEQ ID NO: 1878742 - DNA, 21 bp, Homo sapiens
ctggagctgagctacctgggg

SEQ ID NO: 1878743 - DNA, 15 bp, Homo sapiens
ctggaggcaggactc

SEQ ID NO: 1878744 - DNA, 13 bp, Homo sapiens
ctggaggctccca

SEQ ID NO: 1878745 - DNA, 11 bp, Homo sapiens
ctggaggtggc

SEQ ID NO: 1878746 - DNA, 15 bp, Homo sapiens
ctggatgacattaaa

SEQ ID NO: 1878747 - DNA, 21 bp, Homo sapiens
ctggcacagtgtctgggctga

SEQ ID NO: 1878748 - DNA, 15 bp, Homo sapiens
ctggccagaggcagc

SEQ ID NO: 1878749 - DNA, 15 bp, Homo sapiens
ctggccagccccaca

SEQ ID NO: 1878750 - DNA, 15 bp, Homo sapiens
ctggccccctccctg

SEQ ID NO: 1878751 - DNA, 17 bp, Homo sapiens
ctggccctcaaggcctc

SEQ ID NO: 1878752 - DNA, 22 bp, Homo sapiens
ctggccgggaccccgagcctgg

SEQ ID NO: 1878753 - DNA, 19 bp, Homo sapiens
ctggcctgactcccatgca

SEQ ID NO: 1878754 - DNA, 17 bp, Homo sapiens
ctggcctgttctgtagg

SEQ ID NO: 1878755 - DNA, 19 bp, Homo sapiens
ctggctccacgccctgggg

SEQ ID NO: 1878756 - DNA, 23 bp, Homo sapiens
ctggctccacgccctggggagtg

SEQ ID NO: 1878757 - DNA, 15 bp, Homo sapiens
ctggctcccaaggga

SEQ ID NO: 1878758 - DNA, 16 bp, Homo sapiens
ctggctgcctccactc

SEQ ID NO: 1878759 - DNA, 13 bp, Homo sapiens
ctggctggggcct

SEQ ID NO: 1878760 - DNA, 21 bp, Homo sapiens
ctggctggggcctatcagtgt

SEQ ID NO: 1878761 - DNA, 23 bp, Homo sapiens
ctggctggggcctatcagtgtgc

SEQ ID NO: 1878762 - DNA, 24 bp, Homo sapiens
ctggctggggcctatcagtgtgcc

SEQ ID NO: 1878763 - DNA, 20 bp, Homo sapiens
ctggctgggttttcaggggc

SEQ ID NO: 1878764 - DNA, 15 bp, Homo sapiens
ctgggaacggggtgg

SEQ ID NO: 1878765 - DNA, 15 bp, Homo sapiens
ctgggaggcttcagt

SEQ ID NO: 1878766 - DNA, 17 bp, Homo sapiens
ctgggcaggtcctgggg

SEQ ID NO: 1878767 - DNA, 21 bp, Homo sapiens
ctgggcaggtcctggggaggc

SEQ ID NO: 1878768 - DNA, 22 bp, Homo sapiens
ctgggcaggtcctggggaggct

SEQ ID NO: 1878769 - DNA, 15 bp, Homo sapiens
ctgggccagcccagg

SEQ ID NO: 1878770 - DNA, 14 bp, Homo sapiens
ctgggccctgcagg

SEQ ID NO: 1878771 - DNA, 15 bp, Homo sapiens
ctgggccctgcagga

SEQ ID NO: 1878772 - DNA, 18 bp, Homo sapiens
ctgggccctgcaggaggc

SEQ ID NO: 1878773 - DNA, 21 bp, Homo sapiens
ctgggcctgatggagaggaga

SEQ ID NO: 1878774 - DNA, 22 bp, Homo sapiens
ctgggcctgatggagaggagaa

SEQ ID NO: 1878775 - DNA, 14 bp, Homo sapiens
ctgggctctgtggg

SEQ ID NO: 1878776 - DNA, 18 bp, Homo sapiens
ctgggctctgtgggctgc

SEQ ID NO: 1878777 - DNA, 22 bp, Homo sapiens
ctgggctctgtgggctgcactc

SEQ ID NO: 1878778 - DNA, 12 bp, Homo sapiens
ctgggctgactg

SEQ ID NO: 1878779 - DNA, 20 bp, Homo sapiens
ctgggctggggcctgatggg

SEQ ID NO: 1878780 - DNA, 12 bp, Homo sapiens
ctgggctgggtg

SEQ ID NO: 1878781 - DNA, 22 bp, Homo sapiens
ctgggctgggtgcgaccccatc

SEQ ID NO: 1878782 - DNA, 20 bp, Homo sapiens
ctgggctgttggctgggggc

SEQ ID NO: 1878783 - DNA, 11 bp, Homo sapiens
ctggggaagga

SEQ ID NO: 1878784 - DNA, 13 bp, Homo sapiens
ctggggaggctga

SEQ ID NO: 1878785 - DNA, 22 bp, Homo sapiens
ctggggaggctgagactgcaga

SEQ ID NO: 1878786 - DNA, 15 bp, Homo sapiens
ctggggccaaataaa

SEQ ID NO: 1878787 - DNA, 19 bp, Homo sapiens
caaacagccacgaggtggt

SEQ ID NO: 1878788 - DNA, 18 bp, Homo sapiens
caaaccaatacagaattg

SEQ ID NO: 1878789 - DNA, 21 bp, Homo sapiens
caaactgactcttaagaagac

SEQ ID NO: 1878790 - DNA, 17 bp, Homo sapiens
caaactggggcctccct

SEQ ID NO: 1878791 - DNA, 22 bp, Homo sapiens
caaagtacagaatagaatacat

SEQ ID NO: 1878792 - DNA, 15 bp, Homo sapiens
caaagtctaaagttt

SEQ ID NO: 1878793 - DNA, 17 bp, Homo sapiens
caaataaacagttgtta

SEQ ID NO: 1878794 - DNA, 11 bp, Homo sapiens
caaataaagtc

SEQ ID NO: 1878795 - DNA, 12 bp, Homo sapiens
caaataaagtct

SEQ ID NO: 1878796 - DNA, 20 bp, Homo sapiens
caaatggagaaacaggccca

SEQ ID NO: 1878797 - DNA, 17 bp, Homo sapiens
caaatgtattgattaca

SEQ ID NO: 1878798 - DNA, 23 bp, Homo sapiens
caacagtgttaggcctggcacag

SEQ ID NO: 1878799 - DNA, 17 bp, Homo sapiens
caacccagccgctgccc

SEQ ID NO: 1878800 - DNA, 13 bp, Homo sapiens
caacccccagcac

SEQ ID NO: 1878801 - DNA, 20 bp, Homo sapiens
caacccccagcacccgggct

SEQ ID NO: 1878802 - DNA, 14 bp, Homo sapiens
caacttactactga

SEQ ID NO: 1878803 - DNA, 14 bp, Homo sapiens
caagacctgaaaat

SEQ ID NO: 1878804 - DNA, 19 bp, Homo sapiens
caagactgcacatcaaaat

SEQ ID NO: 1878805 - DNA, 16 bp, Homo sapiens
caagcatttagatgta

SEQ ID NO: 1878806 - DNA, 21 bp, Homo sapiens
caagccagattttcctgaaaa

SEQ ID NO: 1878807 - DNA, 14 bp, Homo sapiens
caagctgctgtggc

SEQ ID NO: 1878808 - DNA, 20 bp, Homo sapiens
caagctgtgccaccctgggc

SEQ ID NO: 1878809 - DNA, 21 bp, Homo sapiens
caagctgtgccaccctgggct

SEQ ID NO: 1878810 - DNA, 18 bp, Homo sapiens
caagcttaaggagaggag

SEQ ID NO: 1878811 - DNA, 22 bp, Homo sapiens
caaggaccaaagggggccctgg

SEQ ID NO: 1878812 - DNA, 14 bp, Homo sapiens
caaggaggctggct

SEQ ID NO: 1878813 - DNA, 16 bp, Homo sapiens
caaggaggctggctgg

SEQ ID NO: 1878814 - DNA, 15 bp, Homo sapiens
caaggcacctgcagg

SEQ ID NO: 1878815 - DNA, 13 bp, Homo sapiens
caaggcctcccac

SEQ ID NO: 1878816 - DNA, 18 bp, Homo sapiens
caaggtgggggagcctgg

SEQ ID NO: 1878817 - DNA, 22 bp, Homo sapiens
caaggtgggggagcctggagcc

SEQ ID NO: 1878818 - DNA, 20 bp, Homo sapiens
caaggtggtctgctcgggcc

SEQ ID NO: 1878819 - DNA, 16 bp, Homo sapiens
caagtagctggctgta

SEQ ID NO: 1878820 - DNA, 15 bp, Homo sapiens
caagtgcaaggacca

SEQ ID NO: 1878821 - DNA, 13 bp, Homo sapiens
caataaagcagtc

SEQ ID NO: 1878822 - DNA, 17 bp, Homo sapiens
caataaagcagtcctgt

SEQ ID NO: 1878823 - DNA, 17 bp, Homo sapiens
caatacagaattgactg

SEQ ID NO: 1878824 - DNA, 23 bp, Homo sapiens
caatacatcccttacctgggaaa

SEQ ID NO: 1878825 - DNA, 21 bp, Homo sapiens
caatacccctagtatctggct

SEQ ID NO: 1878826 - DNA, 18 bp, Homo sapiens
caattcatcctcactcag

SEQ ID NO: 1878827 - DNA, 23 bp, Homo sapiens
caattcatgtaacagttgtgtca

SEQ ID NO: 1878828 - DNA, 18 bp, Homo sapiens
cacaagactgcacatcaa

SEQ ID NO: 1878829 - DNA, 21 bp, Homo sapiens
cacacaaattatcttaaaact

SEQ ID NO: 1878830 - DNA, 16 bp, Homo sapiens
agggatgatgccacac

SEQ ID NO: 1878831 - DNA, 18 bp, Homo sapiens
agggatgatgccacacca

SEQ ID NO: 1878832 - DNA, 18 bp, Homo sapiens
agggcatccttctgcctt

SEQ ID NO: 1878833 - DNA, 21 bp, Homo sapiens
agggcgaggcgggggagcctg

SEQ ID NO: 1878834 - DNA, 21 bp, Homo sapiens
agggctgagtttgcacagtgg

SEQ ID NO: 1878835 - DNA, 20 bp, Homo sapiens
agggctgggcaggtcctggg

SEQ ID NO: 1878836 - DNA, 22 bp, Homo sapiens
agggctgttataatctttcaca

SEQ ID NO: 1878837 - DNA, 17 bp, Homo sapiens
aggggcaggcacagcac

SEQ ID NO: 1878838 - DNA, 23 bp, Homo sapiens
aggggcaggccctgcactgtcct

SEQ ID NO: 1878839 - DNA, 15 bp, Homo sapiens
aggggcccgcttgcc

SEQ ID NO: 1878840 - DNA, 19 bp, Homo sapiens
aggggcccgcttgcctcgg

SEQ ID NO: 1878841 - DNA, 17 bp, Homo sapiens
aggggcccggatccagg

SEQ ID NO: 1878842 - DNA, 23 bp, Homo sapiens
aggggcccggatccaggattctg

SEQ ID NO: 1878843 - DNA, 13 bp, Homo sapiens
aggggctgcccgc

SEQ ID NO: 1878844 - DNA, 15 bp, Homo sapiens
aggggctgcccgctc

SEQ ID NO: 1878845 - DNA, 17 bp, Homo sapiens
aggggctgcccgctccc

SEQ ID NO: 1878846 - DNA, 12 bp, Homo sapiens
aggggctggggc

SEQ ID NO: 1878847 - DNA, 20 bp, Homo sapiens
aggggctttggaagctctgt

SEQ ID NO: 1878848 - DNA, 14 bp, Homo sapiens
agggggccctggct

SEQ ID NO: 1878849 - DNA, 23 bp, Homo sapiens
aggggtctccctgagcctgcccc

SEQ ID NO: 1878850 - DNA, 22 bp, Homo sapiens
agggtcatatcactcaggccct

SEQ ID NO: 1878851 - DNA, 14 bp, Homo sapiens
agggtttcattgtg

SEQ ID NO: 1878852 - DNA, 15 bp, Homo sapiens
aggtaaataaagctc

SEQ ID NO: 1878853 - DNA, 20 bp, Homo sapiens
aggtcaatgacacccctggc

SEQ ID NO: 1878854 - DNA, 13 bp, Homo sapiens
aggtccagcatcc

SEQ ID NO: 1878855 - DNA, 22 bp, Homo sapiens
aggtcctggggaggctgagact

SEQ ID NO: 1878856 - DNA, 12 bp, Homo sapiens
aggtctcctcca

SEQ ID NO: 1878857 - DNA, 13 bp, Homo sapiens
aggtctcctccac

SEQ ID NO: 1878858 - DNA, 23 bp, Homo sapiens
aggtctcgctgatgctgggctgg

SEQ ID NO: 1878859 - DNA, 21 bp, Homo sapiens
aggtgaccccatctctgctgc

SEQ ID NO: 1878860 - DNA, 23 bp, Homo sapiens
aggtgctgctaccctccctgctg

SEQ ID NO: 1878861 - DNA, 11 bp, Homo sapiens
aggtgctggcc

SEQ ID NO: 1878862 - DNA, 17 bp, Homo sapiens
aggtgcttgggcttctg

SEQ ID NO: 1878863 - DNA, 19 bp, Homo sapiens
aggtgggcgggcagcacag

SEQ ID NO: 1878864 - DNA, 22 bp, Homo sapiens
aggtgggggagcctggagcccc

SEQ ID NO: 1878865 - DNA, 15 bp, Homo sapiens
aggtggtagctctga

SEQ ID NO: 1878866 - DNA, 20 bp, Homo sapiens
aggtggtctgctcgggccca

SEQ ID NO: 1878867 - DNA, 21 bp, Homo sapiens
aggtggtctgctcgggcccag

SEQ ID NO: 1878868 - DNA, 22 bp, Homo sapiens
aggtggtctgctcgggcccagg

SEQ ID NO: 1878869 - DNA, 17 bp, Homo sapiens
aggtgtctagaggcaac

SEQ ID NO: 1878870 - DNA, 21 bp, Homo sapiens
aggttgggccatactggcctc

SEQ ID NO: 1878871 - DNA, 22 bp, Homo sapiens
aggttgggccatactggcctcg

SEQ ID NO: 1878872 - DNA, 18 bp, Homo sapiens
aggtttctccttgaagca

SEQ ID NO: 1878873 - DNA, 14 bp, Homo sapiens
agtaaataaattgt

SEQ ID NO: 1878874 - DNA, 16 bp, Homo sapiens
agtaaataaattgttt

SEQ ID NO: 1878875 - DNA, 18 bp, Homo sapiens
agtaaataaattgtttga

SEQ ID NO: 1878876 - DNA, 19 bp, Homo sapiens
agtaaataaattgtttgac

SEQ ID NO: 1878877 - DNA, 18 bp, Homo sapiens
agtaaatacttgcagttg

SEQ ID NO: 1878878 - DNA, 17 bp, Homo sapiens
agtaatgataactggaa

SEQ ID NO: 1878879 - DNA, 15 bp, Homo sapiens
agtaatttgtagatt

SEQ ID NO: 1878880 - DNA, 15 bp, Homo sapiens
agtacccccctgaga

SEQ ID NO: 1878881 - DNA, 20 bp, Homo sapiens
agtactcctcacttttcaat

SEQ ID NO: 1878882 - DNA, 17 bp, Homo sapiens
atcataagatatttttc

SEQ ID NO: 1878883 - DNA, 21 bp, Homo sapiens
atcatagacccatctggaggc

SEQ ID NO: 1878884 - DNA, 20 bp, Homo sapiens
atcatatatatacatacatg

SEQ ID NO: 1878885 - DNA, 18 bp, Homo sapiens
atcatgaagatatttttc

SEQ ID NO: 1878886 - DNA, 17 bp, Homo sapiens
atcatgaattagtttta

SEQ ID NO: 1878887 - DNA, 22 bp, Homo sapiens
atccatttcttttactctgtgt

SEQ ID NO: 1878888 - DNA, 23 bp, Homo sapiens
atccatttcttttactctgtgta

SEQ ID NO: 1878889 - DNA, 21 bp, Homo sapiens
atcctaccacaatgcagtgcc

SEQ ID NO: 1878890 - DNA, 21 bp, Homo sapiens
atcctatctctccaaccagat

SEQ ID NO: 1878891 - DNA, 11 bp, Homo sapiens
atcctggagcc

SEQ ID NO: 1878892 - DNA, 13 bp, Homo sapiens
atcctggagcccc

SEQ ID NO: 1878893 - DNA, 14 bp, Homo sapiens
atcctggcccatca

SEQ ID NO: 1878894 - DNA, 17 bp, Homo sapiens
atcgcttcatgtaacta

SEQ ID NO: 1878895 - DNA, 22 bp, Homo sapiens
atctaaactggattcacagctc

SEQ ID NO: 1878896 - DNA, 13 bp, Homo sapiens
atctcaatatttc

SEQ ID NO: 1878897 - DNA, 19 bp, Homo sapiens
atctctgctgcttctgggc

SEQ ID NO: 1878898 - DNA, 13 bp, Homo sapiens
atctgaaggagat

SEQ ID NO: 1878899 - DNA, 12 bp, Homo sapiens
atctgctctgag

SEQ ID NO: 1878900 - DNA, 17 bp, Homo sapiens
atctggaggctcccatg

SEQ ID NO: 1878901 - DNA, 14 bp, Homo sapiens
atctggggaaggac

SEQ ID NO: 1878902 - DNA, 16 bp, Homo sapiens
atctgtgatttcttct

SEQ ID NO: 1878903 - DNA, 17 bp, Homo sapiens
atcttggcttaatttaa

SEQ ID NO: 1878904 - DNA, 20 bp, Homo sapiens
atcttgttttgtttgcttcc

SEQ ID NO: 1878905 - DNA, 22 bp, Homo sapiens
atctttggacagaagcagctct

SEQ ID NO: 1878906 - DNA, 22 bp, Homo sapiens
atcttttaaaatgaaatgtttt

SEQ ID NO: 1878907 - DNA, 13 bp, Homo sapiens
atgaaatattatg

SEQ ID NO: 1878908 - DNA, 21 bp, Homo sapiens
atgaaatattatgttaaaact

SEQ ID NO: 1878909 - DNA, 17 bp, Homo sapiens
atgaacatctggggact

SEQ ID NO: 1878910 - DNA, 23 bp, Homo sapiens
atgaagtccaagcatttagatgt

SEQ ID NO: 1878911 - DNA, 15 bp, Homo sapiens
atgaattaagttttt

SEQ ID NO: 1878912 - DNA, 23 bp, Homo sapiens
atgaattagttttatatgcttct

SEQ ID NO: 1878913 - DNA, 13 bp, Homo sapiens
atgagttgcagtt

SEQ ID NO: 1878914 - DNA, 14 bp, Homo sapiens
atgataactggaaa

SEQ ID NO: 1878915 - DNA, 15 bp, Homo sapiens
atgatactgtttctt

SEQ ID NO: 1878916 - DNA, 21 bp, Homo sapiens
atgatactgtttcttgcactg

SEQ ID NO: 1878917 - DNA, 18 bp, Homo sapiens
atgatgccacaccaagct

SEQ ID NO: 1878918 - DNA, 22 bp, Homo sapiens
atgatgccacaccaagctgtgc

SEQ ID NO: 1878919 - DNA, 24 bp, Homo sapiens
atgatgccacaccaagctgtgcca

SEQ ID NO: 1878920 - DNA, 14 bp, Homo sapiens
atgcactggcctgt

SEQ ID NO: 1878921 - DNA, 18 bp, Homo sapiens
atgcactggcctgttctg

SEQ ID NO: 1878922 - DNA, 24 bp, Homo sapiens
atgcactggcctgttctgtaggag

SEQ ID NO: 1878923 - DNA, 15 bp, Homo sapiens
atgcagttctgaaga

SEQ ID NO: 1878924 - DNA, 18 bp, Homo sapiens
atgcagttctgaagaaga

SEQ ID NO: 1878925 - DNA, 14 bp, Homo sapiens
atgcattttcttca

SEQ ID NO: 1878926 - DNA, 15 bp, Homo sapiens
atgcattttcttcac

SEQ ID NO: 1878927 - DNA, 18 bp, Homo sapiens
atgcattttcttcacagt

SEQ ID NO: 1878928 - DNA, 20 bp, Homo sapiens
atgcattttcttcacagtgc

SEQ ID NO: 1878929 - DNA, 18 bp, Homo sapiens
atgccaactcgggagcat

SEQ ID NO: 1878930 - DNA, 15 bp, Homo sapiens
atgccccctcgtgcc

SEQ ID NO: 1878931 - DNA, 14 bp, Homo sapiens
atgcccgctgtccc

SEQ ID NO: 1878932 - DNA, 17 bp, Homo sapiens
atgccctgccaagcctg

SEQ ID NO: 1878933 - DNA, 19 bp, Homo sapiens
atgccctgccaagcctgga

SEQ ID NO: 1878934 - DNA, 21 bp, Homo sapiens
atgccctgccaagcctggagc

SEQ ID NO: 1878935 - DNA, 22 bp, Homo sapiens
atgctggatgaccccatgctcc

SEQ ID NO: 1878936 - DNA, 16 bp, Homo sapiens
atgctgggctgggtgc

SEQ ID NO: 1878937 - DNA, 14 bp, Homo sapiens
atgctggtgagcca

SEQ ID NO: 1878938 - DNA, 21 bp, Homo sapiens
atgcttctgttttataatttt

SEQ ID NO: 1878939 - DNA, 16 bp, Homo sapiens
atggaaggagagaggt

SEQ ID NO: 1878940 - DNA, 23 bp, Homo sapiens
atggaattggagctcgtgggaca

SEQ ID NO: 1878941 - DNA, 15 bp, Homo sapiens
atggaatttgtaagt

SEQ ID NO: 1878942 - DNA, 16 bp, Homo sapiens
atggagaaacaggccc

SEQ ID NO: 1878943 - DNA, 14 bp, Homo sapiens
atggcactagtatt

SEQ ID NO: 1878944 - DNA, 16 bp, Homo sapiens
atggcactagtatttc

SEQ ID NO: 1878945 - DNA, 15 bp, Homo sapiens
atggcagggaagctt

SEQ ID NO: 1878946 - DNA, 11 bp, Homo sapiens
atggctgctgg

SEQ ID NO: 1878947 - DNA, 21 bp, Homo sapiens
atggcttccaaggtggtctgc

SEQ ID NO: 1878948 - DNA, 21 bp, Homo sapiens
atgggacatttgctcatggaa

SEQ ID NO: 1878949 - DNA, 13 bp, Homo sapiens
atgggacattttt

SEQ ID NO: 1878950 - DNA, 23 bp, Homo sapiens
atgggcactgctgggtggcccat

SEQ ID NO: 1878951 - DNA, 14 bp, Homo sapiens
atgggggaggctct

SEQ ID NO: 1878952 - DNA, 9 bp, Homo sapiens
atggtgcct

SEQ ID NO: 1878953 - DNA, 21 bp, Homo sapiens
atggttcccttgatgaagaag

SEQ ID NO: 1878954 - DNA, 19 bp, Homo sapiens
atgtaaagaacataaataa

SEQ ID NO: 1878955 - DNA, 16 bp, Homo sapiens
atgtaaagtgatattt

SEQ ID NO: 1878956 - DNA, 15 bp, Homo sapiens
atgtaacatgaagca

SEQ ID NO: 1878957 - DNA, 16 bp, Homo sapiens
atgtaacatgaagcaa

SEQ ID NO: 1878958 - DNA, 14 bp, Homo sapiens
atgtaactagaatt

SEQ ID NO: 1878959 - DNA, 20 bp, Homo sapiens
atgtaccgatgatactgttt

SEQ ID NO: 1878960 - DNA, 23 bp, Homo sapiens
atgtaccgatgatactgtttctt

SEQ ID NO: 1878961 - DNA, 15 bp, Homo sapiens
atgtatctacctcac

SEQ ID NO: 1878962 - DNA, 14 bp, Homo sapiens
atgtattgattaca

SEQ ID NO: 1878963 - DNA, 15 bp, Homo sapiens
atgtatttttcttgc

SEQ ID NO: 1878964 - DNA, 22 bp, Homo sapiens
atgtatttttcttgctgttcag

SEQ ID NO: 1878965 - DNA, 19 bp, Homo sapiens
atgtcaccggtcagtgcct

SEQ ID NO: 1878966 - DNA, 21 bp, Homo sapiens
atgtcaccggtcagtgccttt

SEQ ID NO: 1878967 - DNA, 11 bp, Homo sapiens
atgtctaaaga

SEQ ID NO: 1878968 - DNA, 16 bp, Homo sapiens
atgtctgacacattaa

SEQ ID NO: 1878969 - DNA, 20 bp, Homo sapiens
atgtgtgggatcattgcatt

SEQ ID NO: 1878970 - DNA, 20 bp, Homo sapiens
atgtgttcctccattttctt

SEQ ID NO: 1878971 - DNA, 15 bp, Homo sapiens
atgttactaaatggt

SEQ ID NO: 1878972 - DNA, 18 bp, Homo sapiens
atgtttcaaacatatata

SEQ ID NO: 1878973 - DNA, 21 bp, Homo sapiens
atgtttcaaacatatataaca

SEQ ID NO: 1878974 - DNA, 22 bp, Homo sapiens
atgtttcttctttcttttaagc

SEQ ID NO: 1878975 - DNA, 22 bp, Homo sapiens
atgtttgctcagcttctccaac

SEQ ID NO: 1878976 - DNA, 17 bp, Homo sapiens
atgttttcaggctagat

SEQ ID NO: 1878977 - DNA, 21 bp, Homo sapiens
attaaagaagggttgagctgg

SEQ ID NO: 1878978 - DNA, 15 bp, Homo sapiens
attaaatccaataaa

SEQ ID NO: 1878979 - DNA, 13 bp, Homo sapiens
attaagtaatgat

SEQ ID NO: 1878980 - DNA, 19 bp, Homo sapiens
attaatctgtttgtgcaaa

SEQ ID NO: 1878981 - DNA, 20 bp, Homo sapiens
attacaaataaacagttgtt

SEQ ID NO: 1878982 - DNA, 19 bp, Homo sapiens
attacacaataaagcagtc

SEQ ID NO: 1878983 - DNA, 17 bp, Homo sapiens
attacatttgtataaaa

SEQ ID NO: 1878984 - DNA, 17 bp, Homo sapiens
attacgtgtatgtttct

SEQ ID NO: 1878985 - DNA, 19 bp, Homo sapiens
attacgtgtatgtttcttc

SEQ ID NO: 1878986 - DNA, 18 bp, Homo sapiens
attactctacactgaaac

SEQ ID NO: 1878987 - DNA, 14 bp, Homo sapiens
attagtaattgtaa

SEQ ID NO: 1878988 - DNA, 15 bp, Homo sapiens
attagtaattgtaag

SEQ ID NO: 1878989 - DNA, 15 bp, Homo sapiens
attagtaattgtcaa

SEQ ID NO: 1878990 - DNA, 19 bp, Homo sapiens
attataagccctgcataat

SEQ ID NO: 1878991 - DNA, 15 bp, Homo sapiens
attatatttattact

SEQ ID NO: 1878992 - DNA, 12 bp, Homo sapiens
attatcttaaaa

SEQ ID NO: 1878993 - DNA, 14 bp, Homo sapiens
attatgaattacat

SEQ ID NO: 1878994 - DNA, 22 bp, Homo sapiens
attatttgttatttgtacagtt

SEQ ID NO: 1878995 - DNA, 18 bp, Homo sapiens
attattttagcttcagtt

SEQ ID NO: 1878996 - DNA, 12 bp, Homo sapiens
attcaagtatta

SEQ ID NO: 1878997 - DNA, 14 bp, Homo sapiens
attcatgtaacagt

SEQ ID NO: 1878998 - DNA, 17 bp, Homo sapiens
attcatgtaacagttgt

SEQ ID NO: 1878999 - DNA, 18 bp, Homo sapiens
attcatgtaacagttgtg

SEQ ID NO: 1879000 - DNA, 16 bp, Homo sapiens
cactgtcctgctccac

SEQ ID NO: 1879001 - DNA, 21 bp, Homo sapiens
cactgtcctgctccacagtgt

SEQ ID NO: 1879002 - DNA, 19 bp, Homo sapiens
cactgtgggtagacacaca

SEQ ID NO: 1879003 - DNA, 15 bp, Homo sapiens
cactgtgtatttaac

SEQ ID NO: 1879004 - DNA, 16 bp, Homo sapiens
cacttaaattcttttg

SEQ ID NO: 1879005 - DNA, 21 bp, Homo sapiens
cacttcaagtgaccaccagga

SEQ ID NO: 1879006 - DNA, 21 bp, Homo sapiens
cacttcccctcctacccctcc

SEQ ID NO: 1879007 - DNA, 20 bp, Homo sapiens
cacttccctgacactgcggg

SEQ ID NO: 1879008 - DNA, 16 bp, Homo sapiens
cacttgggtcttccct

SEQ ID NO: 1879009 - DNA, 17 bp, Homo sapiens
cacttttcaatttgtca

SEQ ID NO: 1879010 - DNA, 21 bp, Homo sapiens
cagaacacttcagcctgtgca

SEQ ID NO: 1879011 - DNA, 21 bp, Homo sapiens
cagaaggaagggcatccttct

SEQ ID NO: 1879012 - DNA, 16 bp, Homo sapiens
cagaatagaatacatt

SEQ ID NO: 1879013 - DNA, 16 bp, Homo sapiens
cagaatgctgttttaa

SEQ ID NO: 1879014 - DNA, 17 bp, Homo sapiens
cagaattgactgcagtt

SEQ ID NO: 1879015 - DNA, 18 bp, Homo sapiens
cagaattgactgcagttg

SEQ ID NO: 1879016 - DNA, 16 bp, Homo sapiens
cagagcttcagggctg

SEQ ID NO: 1879017 - DNA, 17 bp, Homo sapiens
cagagcttcagggctgg

SEQ ID NO: 1879018 - DNA, 17 bp, Homo sapiens
cagaggagccacctggg

SEQ ID NO: 1879019 - DNA, 20 bp, Homo sapiens
cagaggagccacctgggctg

SEQ ID NO: 1879020 - DNA, 21 bp, Homo sapiens
cagaggagccacctgggctgg

SEQ ID NO: 1879021 - DNA, 19 bp, Homo sapiens
cagaggcagctaaggggca

SEQ ID NO: 1879022 - DNA, 20 bp, Homo sapiens
cagaggggcaggccctgcac

SEQ ID NO: 1879023 - DNA, 23 bp, Homo sapiens
cagagtctggagctgagctacct

SEQ ID NO: 1879024 - DNA, 14 bp, Homo sapiens
cagataatcacaat

SEQ ID NO: 1879025 - DNA, 23 bp, Homo sapiens
cagatccccagctttctcctctg

SEQ ID NO: 1879026 - DNA, 13 bp, Homo sapiens
cagatcctggaaa

SEQ ID NO: 1879027 - DNA, 14 bp, Homo sapiens
cagatcgttcattg

SEQ ID NO: 1879028 - DNA, 15 bp, Homo sapiens
cagattttcctgaaa

SEQ ID NO: 1879029 - DNA, 15 bp, Homo sapiens
cagcaaggcacctgc

SEQ ID NO: 1879030 - DNA, 17 bp, Homo sapiens
cagcaaggcacctgcag

SEQ ID NO: 1879031 - DNA, 19 bp, Homo sapiens
cagcacagcaaggaggctg

SEQ ID NO: 1879032 - DNA, 18 bp, Homo sapiens
cagcacagggatccgact

SEQ ID NO: 1879033 - DNA, 16 bp, Homo sapiens
cagcacccgggctcag

SEQ ID NO: 1879034 - DNA, 18 bp, Homo sapiens
cagcaggcagaggagagt

SEQ ID NO: 1879035 - DNA, 11 bp, Homo sapiens
cagcaggtgct

SEQ ID NO: 1879036 - DNA, 15 bp, Homo sapiens
cagcaggtgctgcta

SEQ ID NO: 1879037 - DNA, 15 bp, Homo sapiens
cagcagtgagcttct

SEQ ID NO: 1879038 - DNA, 15 bp, Homo sapiens
cagccacgaggtggt

SEQ ID NO: 1879039 - DNA, 16 bp, Homo sapiens
cagcccacgtcctgtc

SEQ ID NO: 1879040 - DNA, 20 bp, Homo sapiens
cagtgactcgggctcctgtg

SEQ ID NO: 1879041 - DNA, 19 bp, Homo sapiens
cagtgccgccgcctcgccc

SEQ ID NO: 1879042 - DNA, 23 bp, Homo sapiens
cagtgccgccgcctcgcccaccg

SEQ ID NO: 1879043 - DNA, 12 bp, Homo sapiens
cagtgctttttc

SEQ ID NO: 1879044 - DNA, 23 bp, Homo sapiens
cagtggccaagatcacagtggcc

SEQ ID NO: 1879045 - DNA, 14 bp, Homo sapiens
cagtggccacggcc

SEQ ID NO: 1879046 - DNA, 15 bp, Homo sapiens
cagtgggtcccactt

SEQ ID NO: 1879047 - DNA, 17 bp, Homo sapiens
cagtgggtcccacttcc

SEQ ID NO: 1879048 - DNA, 18 bp, Homo sapiens
cagtgtacccccgcccag

SEQ ID NO: 1879049 - DNA, 20 bp, Homo sapiens
cagtgtacccccgcccaggc

SEQ ID NO: 1879050 - DNA, 21 bp, Homo sapiens
cagtgtacccccgcccaggct

SEQ ID NO: 1879051 - DNA, 13 bp, Homo sapiens
cagtgtctgggct

SEQ ID NO: 1879052 - DNA, 13 bp, Homo sapiens
cagtgtcttcctg

SEQ ID NO: 1879053 - DNA, 19 bp, Homo sapiens
cagtgtgaatatatggtct

SEQ ID NO: 1879054 - DNA, 15 bp, Homo sapiens
cagtgtgaggctgta

SEQ ID NO: 1879055 - DNA, 13 bp, Homo sapiens
cagtgtgcccccc

SEQ ID NO: 1879056 - DNA, 17 bp, Homo sapiens
cagtgtgccccccatcc

SEQ ID NO: 1879057 - DNA, 23 bp, Homo sapiens
cagtgtgccccccatcctggccc

SEQ ID NO: 1879058 - DNA, 21 bp, Homo sapiens
cagtgttaggcctggcacagt

SEQ ID NO: 1879059 - DNA, 22 bp, Homo sapiens
cagtgttaggcctggcacagtg

SEQ ID NO: 1879060 - DNA, 16 bp, Homo sapiens
cagtgttctgagcccc

SEQ ID NO: 1879061 - DNA, 15 bp, Homo sapiens
cagtgtttatattgg

SEQ ID NO: 1879062 - DNA, 17 bp, Homo sapiens
cagtgtttgggaaatta

SEQ ID NO: 1879063 - DNA, 15 bp, Homo sapiens
cagttcctctttgca

SEQ ID NO: 1879064 - DNA, 18 bp, Homo sapiens
cagttcctctttgcatgg

SEQ ID NO: 1879065 - DNA, 23 bp, Homo sapiens
cagttcctctttgcatggaattt

SEQ ID NO: 1879066 - DNA, 12 bp, Homo sapiens
cagttctgaaga

SEQ ID NO: 1879067 - DNA, 13 bp, Homo sapiens
cagttctgaagaa

SEQ ID NO: 1879068 - DNA, 16 bp, Homo sapiens
cagttctgaagaagat

SEQ ID NO: 1879069 - DNA, 14 bp, Homo sapiens
cagttgaacagact

SEQ ID NO: 1879070 - DNA, 10 bp, Homo sapiens
cagttgaact

SEQ ID NO: 1879071 - DNA, 20 bp, Homo sapiens
cagttggcttctgtgcctga

SEQ ID NO: 1879072 - DNA, 22 bp, Homo sapiens
cagttgtgtcataaattacaca

SEQ ID NO: 1879073 - DNA, 13 bp, Homo sapiens
cagtttttataat

SEQ ID NO: 1879074 - DNA, 20 bp, Homo sapiens
cataataccaccatttaaaa

SEQ ID NO: 1879075 - DNA, 16 bp, Homo sapiens
cataatggttgtgaaa

SEQ ID NO: 1879076 - DNA, 19 bp, Homo sapiens
cataatggttgtgaaatgt

SEQ ID NO: 1879077 - DNA, 20 bp, Homo sapiens
cataatggttgtgaaatgta

SEQ ID NO: 1879078 - DNA, 24 bp, Homo sapiens
cataatgttaagctttattgtgat

SEQ ID NO: 1879079 - DNA, 22 bp, Homo sapiens
cataccagagtctggagctgag

SEQ ID NO: 1879080 - DNA, 22 bp, Homo sapiens
catacctttccagggtcaaagt

SEQ ID NO: 1879081 - DNA, 12 bp, Homo sapiens
catactggcctc

SEQ ID NO: 1879082 - DNA, 17 bp, Homo sapiens
catactggcctcgcctg

SEQ ID NO: 1879083 - DNA, 20 bp, Homo sapiens
catataaaagttgcgtttaa

SEQ ID NO: 1879084 - DNA, 22 bp, Homo sapiens
catataaaagttgcgtttaagt

SEQ ID NO: 1879085 - DNA, 13 bp, Homo sapiens
catatataacaat

SEQ ID NO: 1879086 - DNA, 15 bp, Homo sapiens
catcacttcttccac

SEQ ID NO: 1879087 - DNA, 23 bp, Homo sapiens
catccagtggggtctcagtccag

SEQ ID NO: 1879088 - DNA, 23 bp, Homo sapiens
catcccaaaatcataagatattt

SEQ ID NO: 1879089 - DNA, 13 bp, Homo sapiens
catcccccctcac

SEQ ID NO: 1879090 - DNA, 17 bp, Homo sapiens
catcccccctcaccagg

SEQ ID NO: 1879091 - DNA, 21 bp, Homo sapiens
catccctggccccctccctgg

SEQ ID NO: 1879092 - DNA, 23 bp, Homo sapiens
catccctggccccctccctggat

SEQ ID NO: 1879093 - DNA, 21 bp, Homo sapiens
catcctaccacaatgcagtgc

SEQ ID NO: 1879094 - DNA, 15 bp, Homo sapiens
catcctgccacagga

SEQ ID NO: 1879095 - DNA, 11 bp, Homo sapiens
catcctggccc

SEQ ID NO: 1879096 - DNA, 12 bp, Homo sapiens
catcctggccca

SEQ ID NO: 1879097 - DNA, 16 bp, Homo sapiens
catctagcagtaaata

SEQ ID NO: 1879098 - DNA, 22 bp, Homo sapiens
catctagtgagcagtcaggaaa

SEQ ID NO: 1879099 - DNA, 18 bp, Homo sapiens
catctctgctgcttctgg

SEQ ID NO: 1879100 - DNA, 19 bp, Homo sapiens
catctctgctgcttctggg

SEQ ID NO: 1879101 - DNA, 22 bp, Homo sapiens
catctgttgttctgtggtcaca

SEQ ID NO: 1879102 - DNA, 18 bp, Homo sapiens
catcttgcccgctcaggc

SEQ ID NO: 1879103 - DNA, 19 bp, Homo sapiens
catgaagcatgagttatct

SEQ ID NO: 1879104 - DNA, 24 bp, Homo sapiens
catgattttgaaatcatgaagata

SEQ ID NO: 1879105 - DNA, 14 bp, Homo sapiens
catgcaagtagctg

SEQ ID NO: 1879106 - DNA, 15 bp, Homo sapiens
catgccccctcgtgc

SEQ ID NO: 1879107 - DNA, 12 bp, Homo sapiens
catgctggatga

SEQ ID NO: 1879108 - DNA, 20 bp, Homo sapiens
catggaattggagctcgtgg

SEQ ID NO: 1879109 - DNA, 15 bp, Homo sapiens
catgggcactgctgg

SEQ ID NO: 1879110 - DNA, 23 bp, Homo sapiens
catgtaagctgaaaatatggcaa

SEQ ID NO: 1879111 - DNA, 19 bp, Homo sapiens
catgtcaccggtcagtgcc

SEQ ID NO: 1879112 - DNA, 20 bp, Homo sapiens
catgtgctagtaattggaaa

SEQ ID NO: 1879113 - DNA, 23 bp, Homo sapiens
catgtgggggaaggccttgctgt

SEQ ID NO: 1879114 - DNA, 18 bp, Homo sapiens
cattaaagccctgtgtta

SEQ ID NO: 1879115 - DNA, 21 bp, Homo sapiens
cattaaagccctgtgttaagt

SEQ ID NO: 1879116 - DNA, 12 bp, Homo sapiens
cattagagctta

SEQ ID NO: 1879117 - DNA, 17 bp, Homo sapiens
cattcaagtcagctctt

SEQ ID NO: 1879118 - DNA, 14 bp, Homo sapiens
cattcagaaaactt

SEQ ID NO: 1879119 - DNA, 18 bp, Homo sapiens
cattctgcctgcctggga

SEQ ID NO: 1879120 - DNA, 21 bp, Homo sapiens
cattcttatttcatgaaaatt

SEQ ID NO: 1879121 - DNA, 22 bp, Homo sapiens
cattgatacaaagtacagaaaa

SEQ ID NO: 1879122 - DNA, 15 bp, Homo sapiens
cattgcatttccaga

SEQ ID NO: 1879123 - DNA, 14 bp, Homo sapiens
cattggcagcaggt

SEQ ID NO: 1879124 - DNA, 21 bp, Homo sapiens
cattggcagcaggtgctgcta

SEQ ID NO: 1879125 - DNA, 10 bp, Homo sapiens
catttaacat

SEQ ID NO: 1879126 - DNA, 22 bp, Homo sapiens
catttaacataatggttgtgaa

SEQ ID NO: 1879127 - DNA, 14 bp, Homo sapiens
catttcttttactc

SEQ ID NO: 1879128 - DNA, 15 bp, Homo sapiens
catttgctcatggaa

SEQ ID NO: 1879129 - DNA, 16 bp, Homo sapiens
catttgtataaaataa

SEQ ID NO: 1879130 - DNA, 19 bp, Homo sapiens
catttgtataaaataattt

SEQ ID NO: 1879131 - DNA, 19 bp, Homo sapiens
catttgtggttagaatctt

SEQ ID NO: 1879132 - DNA, 22 bp, Homo sapiens
catttgtggttagaatcttgtt

SEQ ID NO: 1879133 - DNA, 15 bp, Homo sapiens
cattttcttcacagt

SEQ ID NO: 1879134 - DNA, 18 bp, Homo sapiens
catttttccagagctgca

SEQ ID NO: 1879135 - DNA, 14 bp, Homo sapiens
ccaaataaagtctc

SEQ ID NO: 1879136 - DNA, 12 bp, Homo sapiens
ccaaatgtattg

SEQ ID NO: 1879137 - DNA, 23 bp, Homo sapiens
ccaacagtgttaggcctggcaca

SEQ ID NO: 1879138 - DNA, 21 bp, Homo sapiens
ccaacccccagcacccgggct

SEQ ID NO: 1879139 - DNA, 18 bp, Homo sapiens
ccaagagatgaacatctg

SEQ ID NO: 1879140 - DNA, 13 bp, Homo sapiens
ccaagctgtgcca

SEQ ID NO: 1879141 - DNA, 16 bp, Homo sapiens
ccaagctgtgccaccc

SEQ ID NO: 1879142 - DNA, 17 bp, Homo sapiens
ccaagctgtgccaccct

SEQ ID NO: 1879143 - DNA, 21 bp, Homo sapiens
ccaagctgtgccaccctgggc

SEQ ID NO: 1879144 - DNA, 20 bp, Homo sapiens
ccaagcttaaggagaggaga

SEQ ID NO: 1879145 - DNA, 22 bp, Homo sapiens
ccaagcttaaggagaggagagc

SEQ ID NO: 1879146 - DNA, 11 bp, Homo sapiens
ccaagggaggc

SEQ ID NO: 1879147 - DNA, 18 bp, Homo sapiens
ccacagaagctccaggta

SEQ ID NO: 1879148 - DNA, 17 bp, Homo sapiens
ccacagcaaggcacctg

SEQ ID NO: 1879149 - DNA, 19 bp, Homo sapiens
ccacagcaaggcacctgca

SEQ ID NO: 1879150 - DNA, 23 bp, Homo sapiens
ccacagcgctggccgggaccccg

SEQ ID NO: 1879151 - DNA, 22 bp, Homo sapiens
ccacagtgttggcgagaggagg

SEQ ID NO: 1879152 - DNA, 15 bp, Homo sapiens
ccaccatttaaaaat

SEQ ID NO: 1879153 - DNA, 15 bp, Homo sapiens
ccaccctgggctctg

SEQ ID NO: 1879154 - DNA, 17 bp, Homo sapiens
ccaccgcatgccccctc

SEQ ID NO: 1879155 - DNA, 14 bp, Homo sapiens
ccaccgccatggct

SEQ ID NO: 1879156 - DNA, 16 bp, Homo sapiens
ccacctagtggctgtc

SEQ ID NO: 1879157 - DNA, 16 bp, Homo sapiens
ccacctgggctgggag

SEQ ID NO: 1879158 - DNA, 17 bp, Homo sapiens
ccacctgggctgggaga

SEQ ID NO: 1879159 - DNA, 14 bp, Homo sapiens
ccacggccacagtc

SEQ ID NO: 1879160 - DNA, 14 bp, Homo sapiens
ctccatccctggcc

SEQ ID NO: 1879161 - DNA, 15 bp, Homo sapiens
ctccatccctggccc

SEQ ID NO: 1879162 - DNA, 12 bp, Homo sapiens
ctcccacagtga

SEQ ID NO: 1879163 - DNA, 20 bp, Homo sapiens
ctcccacagtgactcgggct

SEQ ID NO: 1879164 - DNA, 23 bp, Homo sapiens
ctcccagctgacagtcctctcca

SEQ ID NO: 1879165 - DNA, 21 bp, Homo sapiens
ctcccagtgtcttcctgtggg

SEQ ID NO: 1879166 - DNA, 14 bp, Homo sapiens
ctcccccccggggc

SEQ ID NO: 1879167 - DNA, 17 bp, Homo sapiens
ctcccccgggaggggcc

SEQ ID NO: 1879168 - DNA, 21 bp, Homo sapiens
ctcccccgggaggggcccgct

SEQ ID NO: 1879169 - DNA, 14 bp, Homo sapiens
ctcccctccatccc

SEQ ID NO: 1879170 - DNA, 19 bp, Homo sapiens
ctcccctccatccctggcc

SEQ ID NO: 1879171 - DNA, 23 bp, Homo sapiens
ctcccctccatccctggccccct

SEQ ID NO: 1879172 - DNA, 21 bp, Homo sapiens
ctcccgccccttccccgaggg

SEQ ID NO: 1879173 - DNA, 12 bp, Homo sapiens
ctccctgagcct

SEQ ID NO: 1879174 - DNA, 14 bp, Homo sapiens
ctccctgagcctgc

SEQ ID NO: 1879175 - DNA, 15 bp, Homo sapiens
ctccctgagcctgcc

SEQ ID NO: 1879176 - DNA, 21 bp, Homo sapiens
ctccctgagcctgccccagct

SEQ ID NO: 1879177 - DNA, 11 bp, Homo sapiens
ctccctgctgt

SEQ ID NO: 1879178 - DNA, 14 bp, Homo sapiens
ctccctgctgtccc

SEQ ID NO: 1879179 - DNA, 20 bp, Homo sapiens
ctccgatttaactgggaacc

SEQ ID NO: 1879180 - DNA, 19 bp, Homo sapiens
ctccggaatagatgtcttc

SEQ ID NO: 1879181 - DNA, 13 bp, Homo sapiens
ctccgtcatttga

SEQ ID NO: 1879182 - DNA, 20 bp, Homo sapiens
ctccgttcccacctctgagg

SEQ ID NO: 1879183 - DNA, 17 bp, Homo sapiens
ctcctaaggaaattgag

SEQ ID NO: 1879184 - DNA, 14 bp, Homo sapiens
ctcctacccctccc

SEQ ID NO: 1879185 - DNA, 16 bp, Homo sapiens
ctcctacccctcccag

SEQ ID NO: 1879186 - DNA, 18 bp, Homo sapiens
ctcctccaccgccatggc

SEQ ID NO: 1879187 - DNA, 19 bp, Homo sapiens
ctcctccaccgccatggct

SEQ ID NO: 1879188 - DNA, 22 bp, Homo sapiens
ctcctccaccgccatggcttcc

SEQ ID NO: 1879189 - DNA, 18 bp, Homo sapiens
ctcctgctgcaccaaccc

SEQ ID NO: 1879190 - DNA, 21 bp, Homo sapiens
ctcctgctgcaccaacccagc

SEQ ID NO: 1879191 - DNA, 22 bp, Homo sapiens
ctcctgctgcaccaacccagcc

SEQ ID NO: 1879192 - DNA, 13 bp, Homo sapiens
ctcctgtgccctt

SEQ ID NO: 1879193 - DNA, 18 bp, Homo sapiens
ctccttcttgccctgagc

SEQ ID NO: 1879194 - DNA, 13 bp, Homo sapiens
ctccttgccctgg

SEQ ID NO: 1879195 - DNA, 14 bp, Homo sapiens
ctcctttctggctt

SEQ ID NO: 1879196 - DNA, 16 bp, Homo sapiens
ctcgcctggcctgagg

SEQ ID NO: 1879197 - DNA, 23 bp, Homo sapiens
ctcgctgatgctgggctgggtgc

SEQ ID NO: 1879198 - DNA, 16 bp, Homo sapiens
ctcggctcctgctgca

SEQ ID NO: 1879199 - DNA, 16 bp, Homo sapiens
ctcgggcccaggccat

SEQ ID NO: 1879200 - DNA, 14 bp, Homo sapiens
ctcgggctcctgtg

SEQ ID NO: 1879201 - DNA, 18 bp, Homo sapiens
ctcgggttaagaaatacc

SEQ ID NO: 1879202 - DNA, 16 bp, Homo sapiens
ctctaatttattttgt

SEQ ID NO: 1879203 - DNA, 15 bp, Homo sapiens
ctctaggaaatattt

SEQ ID NO: 1879204 - DNA, 15 bp, Homo sapiens
ctctccccatgatgt

SEQ ID NO: 1879205 - DNA, 16 bp, Homo sapiens
ctctccccatgatgtt

SEQ ID NO: 1879206 - DNA, 13 bp, Homo sapiens
ctctccttgccct

SEQ ID NO: 1879207 - DNA, 14 bp, Homo sapiens
ctctccttgccctg

SEQ ID NO: 1879208 - DNA, 18 bp, Homo sapiens
ctctccttgccctgggcc

SEQ ID NO: 1879209 - DNA, 23 bp, Homo sapiens
ctctgagacggatggaaggagag

SEQ ID NO: 1879210 - DNA, 11 bp, Homo sapiens
ctctgagccct

SEQ ID NO: 1879211 - DNA, 19 bp, Homo sapiens
ctctgaggactctggaccc

SEQ ID NO: 1879212 - DNA, 20 bp, Homo sapiens
ctctgctgcttctgggcctg

SEQ ID NO: 1879213 - DNA, 16 bp, Homo sapiens
ctctggaccccaggcc

SEQ ID NO: 1879214 - DNA, 24 bp, Homo sapiens
ctctgggccctgcaggaggcctgg

SEQ ID NO: 1879215 - DNA, 22 bp, Homo sapiens
ctctgtatttgaatcagcctac

SEQ ID NO: 1879216 - DNA, 14 bp, Homo sapiens
ctctgtgcccatgg

SEQ ID NO: 1879217 - DNA, 22 bp, Homo sapiens
ctctgtgcccatgggcactgct

SEQ ID NO: 1879218 - DNA, 13 bp, Homo sapiens
ctctgtgggctgc

SEQ ID NO: 1879219 - DNA, 14 bp, Homo sapiens
ctctgtgggctgca

SEQ ID NO: 1879220 - DNA, 19 bp, Homo sapiens
ctctgttgcaggtgtccgg

SEQ ID NO: 1879221 - DNA, 18 bp, Homo sapiens
ctcttaaaaagacactta

SEQ ID NO: 1879222 - DNA, 21 bp, Homo sapiens
ctcttagatgcagttctgaag

SEQ ID NO: 1879223 - DNA, 22 bp, Homo sapiens
ctcttagatgcagttctgaaga

SEQ ID NO: 1879224 - DNA, 13 bp, Homo sapiens
ctcttgattttca

SEQ ID NO: 1879225 - DNA, 12 bp, Homo sapiens
ctcttgcctgta

SEQ ID NO: 1879226 - DNA, 15 bp, Homo sapiens
ctgaaaatatgtctg

SEQ ID NO: 1879227 - DNA, 22 bp, Homo sapiens
ctgaacaaagcacctcaagtgc

SEQ ID NO: 1879228 - DNA, 16 bp, Homo sapiens
ctgaagagatacccac

SEQ ID NO: 1879229 - DNA, 12 bp, Homo sapiens
ctgaaggagatt

SEQ ID NO: 1879230 - DNA, 18 bp, Homo sapiens
ctgaaggagattttcctt

SEQ ID NO: 1879231 - DNA, 16 bp, Homo sapiens
ctgaatatataaacac

SEQ ID NO: 1879232 - DNA, 13 bp, Homo sapiens
ctgacactgcggg

SEQ ID NO: 1879233 - DNA, 18 bp, Homo sapiens
ctgaccatcccatgagca

SEQ ID NO: 1879234 - DNA, 19 bp, Homo sapiens
ctgaccatcccatgagcag

SEQ ID NO: 1879235 - DNA, 16 bp, Homo sapiens
ctgactcccatgcaag

SEQ ID NO: 1879236 - DNA, 14 bp, Homo sapiens
ctgactctgtgctg

SEQ ID NO: 1879237 - DNA, 15 bp, Homo sapiens
ctgactctgtgctga

SEQ ID NO: 1879238 - DNA, 21 bp, Homo sapiens
ctgacttcaggggctgcccgc

SEQ ID NO: 1879239 - DNA, 21 bp, Homo sapiens
ctgagacggatggaaggagag

SEQ ID NO: 1879240 - DNA, 14 bp, Homo sapiens
ctgagagaaaataa

SEQ ID NO: 1879241 - DNA, 20 bp, Homo sapiens
ctgagagcatgtgggggaag

SEQ ID NO: 1879242 - DNA, 20 bp, Homo sapiens
ctgagcccccacctgcctga

SEQ ID NO: 1879243 - DNA, 21 bp, Homo sapiens
ctgagccctccttcttgccct

SEQ ID NO: 1879244 - DNA, 15 bp, Homo sapiens
ctgagcctgccccag

SEQ ID NO: 1879245 - DNA, 22 bp, Homo sapiens
ctgagcctgccccagctgggct

SEQ ID NO: 1879246 - DNA, 23 bp, Homo sapiens
ctgagctttccggggaggagcct

SEQ ID NO: 1879247 - DNA, 13 bp, Homo sapiens
ctgaggtggtgga

SEQ ID NO: 1879248 - DNA, 15 bp, Homo sapiens
ctgaggtggtggaca

SEQ ID NO: 1879249 - DNA, 17 bp, Homo sapiens
ctgaggtggtggacatc

SEQ ID NO: 1879250 - DNA, 21 bp, Homo sapiens
ctgagtctgctatattttcat

SEQ ID NO: 1879251 - DNA, 15 bp, Homo sapiens
ctgatatttgctgga

SEQ ID NO: 1879252 - DNA, 21 bp, Homo sapiens
ctgatgatttagagtgctgtc

SEQ ID NO: 1879253 - DNA, 17 bp, Homo sapiens
ctgatgctgggctgggt

SEQ ID NO: 1879254 - DNA, 13 bp, Homo sapiens
ctgatggagagga

SEQ ID NO: 1879255 - DNA, 15 bp, Homo sapiens
ctgatggctgctgga

SEQ ID NO: 1879256 - DNA, 18 bp, Homo sapiens
ctgatggctgctggaggg

SEQ ID NO: 1879257 - DNA, 23 bp, Homo sapiens
ctgatggctgctggaggggacgc

SEQ ID NO: 1879258 - DNA, 16 bp, Homo sapiens
ctgattcggctgtctc

SEQ ID NO: 1879259 - DNA, 16 bp, Homo sapiens
ctgcaccaacccagcc

SEQ ID NO: 1879260 - DNA, 14 bp, Homo sapiens
ctgcaccccctcct

SEQ ID NO: 1879261 - DNA, 14 bp, Homo sapiens
ctgcactctgtgcc

SEQ ID NO: 1879262 - DNA, 15 bp, Homo sapiens
ctgcactctgtgccc

SEQ ID NO: 1879263 - DNA, 20 bp, Homo sapiens
ctgcactctgtgcccatggg

SEQ ID NO: 1879264 - DNA, 22 bp, Homo sapiens
ctgcactctgtgcccatgggca

SEQ ID NO: 1879265 - DNA, 11 bp, Homo sapiens
ctgcactgtcc

SEQ ID NO: 1879266 - DNA, 18 bp, Homo sapiens
ctgcactgtcctgctcca

SEQ ID NO: 1879267 - DNA, 19 bp, Homo sapiens
ctgcactgtcctgctccac

SEQ ID NO: 1879268 - DNA, 19 bp, Homo sapiens
ctgcagagagcacctggtg

SEQ ID NO: 1879269 - DNA, 18 bp, Homo sapiens
ctgcagaggagccacctg

SEQ ID NO: 1879270 - DNA, 17 bp, Homo sapiens
ctgcagaggggcaggcc

SEQ ID NO: 1879271 - DNA, 23 bp, Homo sapiens
ctgcagaggggcaggccctgcac

SEQ ID NO: 1879272 - DNA, 13 bp, Homo sapiens
ctgcaggaagaga

SEQ ID NO: 1879273 - DNA, 16 bp, Homo sapiens
cgcccaggctggccag

SEQ ID NO: 1879274 - DNA, 17 bp, Homo sapiens
cgcccaggctggccagc

SEQ ID NO: 1879275 - DNA, 20 bp, Homo sapiens
cgcccaggctggccagcccc

SEQ ID NO: 1879276 - DNA, 12 bp, Homo sapiens
cgccccctggtg

SEQ ID NO: 1879277 - DNA, 12 bp, Homo sapiens
cgcccctggggt

SEQ ID NO: 1879278 - DNA, 13 bp, Homo sapiens
cgcccctggggtg

SEQ ID NO: 1879279 - DNA, 16 bp, Homo sapiens
cgcctcgcccaccgca

SEQ ID NO: 1879280 - DNA, 21 bp, Homo sapiens
cgccttttcttggttcttttt

SEQ ID NO: 1879281 - DNA, 13 bp, Homo sapiens
cgcgctgcctgtg

SEQ ID NO: 1879282 - DNA, 15 bp, Homo sapiens
cgcgctgcctgtgtg

SEQ ID NO: 1879283 - DNA, 18 bp, Homo sapiens
cgctagaggaagcagcca

SEQ ID NO: 1879284 - DNA, 21 bp, Homo sapiens
cgctcccagtgtcttcctgtg

SEQ ID NO: 1879285 - DNA, 13 bp, Homo sapiens
cgctgatgctggg

SEQ ID NO: 1879286 - DNA, 22 bp, Homo sapiens
cgctgcccggcgccctctgtcc

SEQ ID NO: 1879287 - DNA, 13 bp, Homo sapiens
cgctgcctgtgtg

SEQ ID NO: 1879288 - DNA, 23 bp, Homo sapiens
cgcttgcctcggctcctgctgca

SEQ ID NO: 1879289 - DNA, 13 bp, Homo sapiens
cggatggaaggag

SEQ ID NO: 1879290 - DNA, 16 bp, Homo sapiens
cggatttatttttcca

SEQ ID NO: 1879291 - DNA, 18 bp, Homo sapiens
cggccacggccacagtca

SEQ ID NO: 1879292 - DNA, 12 bp, Homo sapiens
cggctcctgctg

SEQ ID NO: 1879293 - DNA, 15 bp, Homo sapiens
cggctcctgctgcac

SEQ ID NO: 1879294 - DNA, 23 bp, Homo sapiens
cgggaccccgagcctggctccaa

SEQ ID NO: 1879295 - DNA, 18 bp, Homo sapiens
cgggagcattctgcctgc

SEQ ID NO: 1879296 - DNA, 20 bp, Homo sapiens
cgggctcagggaccacagca

SEQ ID NO: 1879297 - DNA, 14 bp, Homo sapiens
cgggctcctgtgcc

SEQ ID NO: 1879298 - DNA, 16 bp, Homo sapiens
cgggctcctgtgccct

SEQ ID NO: 1879299 - DNA, 18 bp, Homo sapiens
cggggaggagccttggag

SEQ ID NO: 1879300 - DNA, 10 bp, Homo sapiens
cggggctggg

SEQ ID NO: 1879301 - DNA, 15 bp, Homo sapiens
cgggggagcctggag

SEQ ID NO: 1879302 - DNA, 15 bp, Homo sapiens
cgggggatcctggag

SEQ ID NO: 1879303 - DNA, 18 bp, Homo sapiens
cgggggatcctggagccc

SEQ ID NO: 1879304 - DNA, 19 bp, Homo sapiens
cgggggatcctggagcccc

SEQ ID NO: 1879305 - DNA, 19 bp, Homo sapiens
cggggtggacgagggagtg

SEQ ID NO: 1879306 - DNA, 15 bp, Homo sapiens
cggtaggtgctggcc

SEQ ID NO: 1879307 - DNA, 13 bp, Homo sapiens
cggtcagtgcctt

SEQ ID NO: 1879308 - DNA, 12 bp, Homo sapiens
cggtgaggcagg

SEQ ID NO: 1879309 - DNA, 15 bp, Homo sapiens
cggtttatataagct

SEQ ID NO: 1879310 - DNA, 18 bp, Homo sapiens
cgtcatttgacaggggct

SEQ ID NO: 1879311 - DNA, 14 bp, Homo sapiens
cgtcctgtcagtgc

SEQ ID NO: 1879312 - DNA, 17 bp, Homo sapiens
cgtgccagtcgcgctgc

SEQ ID NO: 1879313 - DNA, 20 bp, Homo sapiens
cgtgccagtcgcgctgcctg

SEQ ID NO: 1879314 - DNA, 21 bp, Homo sapiens
cgtgccagtcgcgctgcctgt

SEQ ID NO: 1879315 - DNA, 12 bp, Homo sapiens
cgtggccccagc

SEQ ID NO: 1879316 - DNA, 14 bp, Homo sapiens
cgtggccccagcct

SEQ ID NO: 1879317 - DNA, 17 bp, Homo sapiens
cgtggccccagcctggc

SEQ ID NO: 1879318 - DNA, 19 bp, Homo sapiens
cgtggccccagcctggccc

SEQ ID NO: 1879319 - DNA, 21 bp, Homo sapiens
cgtggccccagcctggcccag

SEQ ID NO: 1879320 - DNA, 16 bp, Homo sapiens
cgtgggagaggcagaa

SEQ ID NO: 1879321 - DNA, 17 bp, Homo sapiens
cgtgtcttcaattaaaa

SEQ ID NO: 1879322 - DNA, 17 bp, Homo sapiens
cgttcccacctctgagg

SEQ ID NO: 1879323 - DNA, 19 bp, Homo sapiens
cgttgccgggcctggactg

SEQ ID NO: 1879324 - DNA, 18 bp, Homo sapiens
cgttgtctccctggccct

SEQ ID NO: 1879325 - DNA, 21 bp, Homo sapiens
cgtttaaagtgcagtcatttg

SEQ ID NO: 1879326 - DNA, 21 bp, Homo sapiens
ctaaaggttgtgttgcctgct

SEQ ID NO: 1879327 - DNA, 21 bp, Homo sapiens
ctaaagtttacagtaaataaa

SEQ ID NO: 1879328 - DNA, 15 bp, Homo sapiens
ctaaatggtgttaca

SEQ ID NO: 1879329 - DNA, 14 bp, Homo sapiens
ctaacacccagtct

SEQ ID NO: 1879330 - DNA, 20 bp, Homo sapiens
ctaagaggctatttaaaagt

SEQ ID NO: 1879331 - DNA, 17 bp, Homo sapiens
ctaagtgtttcataaat

SEQ ID NO: 1879332 - DNA, 23 bp, Homo sapiens
ctaatagttttattaataaacat

SEQ ID NO: 1879333 - DNA, 14 bp, Homo sapiens
ctaatttattttgt

SEQ ID NO: 1879334 - DNA, 12 bp, Homo sapiens
ctacaggcctca

SEQ ID NO: 1879335 - DNA, 13 bp, Homo sapiens
ctacccctcccag

SEQ ID NO: 1879336 - DNA, 17 bp, Homo sapiens
ctacccctcccagctga

SEQ ID NO: 1879337 - DNA, 18 bp, Homo sapiens
ctacccctcccagctgac

SEQ ID NO: 1879338 - DNA, 16 bp, Homo sapiens
ctaccctacacctctg

SEQ ID NO: 1879339 - DNA, 19 bp, Homo sapiens
ctaccctacacctctgggc

SEQ ID NO: 1879340 - DNA, 18 bp, Homo sapiens
ctaccctccctgctgtcc

SEQ ID NO: 1879341 - DNA, 15 bp, Homo sapiens
ctacggagggaccag

SEQ ID NO: 1879342 - DNA, 15 bp, Homo sapiens
ctagaagtatttgtg

SEQ ID NO: 1879343 - DNA, 18 bp, Homo sapiens
ctagaggcaacagtgttc

SEQ ID NO: 1879344 - DNA, 12 bp, Homo sapiens
ctaggaaaatac

SEQ ID NO: 1879345 - DNA, 22 bp, Homo sapiens
ctaggaaatatttattttaata

SEQ ID NO: 1879346 - DNA, 18 bp, Homo sapiens
ctaggactttagggatct

SEQ ID NO: 1879347 - DNA, 11 bp, Homo sapiens
ctaggggctgg

SEQ ID NO: 1879348 - DNA, 14 bp, Homo sapiens
ctagtatctggctg

SEQ ID NO: 1879349 - DNA, 15 bp, Homo sapiens
ctagtcatcgtttgt

SEQ ID NO: 1879350 - DNA, 16 bp, Homo sapiens
ctagtggctgtccagt

SEQ ID NO: 1879351 - DNA, 19 bp, Homo sapiens
ctagtggctgtccagtgcc

SEQ ID NO: 1879352 - DNA, 21 bp, Homo sapiens
ctatatactcactttctagat

SEQ ID NO: 1879353 - DNA, 20 bp, Homo sapiens
ctatcagagcctctcccaca

SEQ ID NO: 1879354 - DNA, 17 bp, Homo sapiens
ctatcagtgtgcccccc

SEQ ID NO: 1879355 - DNA, 21 bp, Homo sapiens
ctatcagtgtgccccccatcc

SEQ ID NO: 1879356 - DNA, 19 bp, Homo sapiens
ctatgaactctgttttctt

SEQ ID NO: 1879357 - DNA, 13 bp, Homo sapiens
ctatgcgttttta

SEQ ID NO: 1879358 - DNA, 21 bp, Homo sapiens
ctatttaaaagtataaaactg

SEQ ID NO: 1879359 - DNA, 15 bp, Homo sapiens
ctatttaacttgagg

SEQ ID NO: 1879360 - DNA, 17 bp, Homo sapiens
ctcaaaagattgtttta

SEQ ID NO: 1879361 - DNA, 20 bp, Homo sapiens
ctcaaggcctcccacagtga

SEQ ID NO: 1879362 - DNA, 16 bp, Homo sapiens
ctcacatgcccgctgt

SEQ ID NO: 1879363 - DNA, 15 bp, Homo sapiens
ctcaccaggggcagg

SEQ ID NO: 1879364 - DNA, 20 bp, Homo sapiens
ctcaccaggggcaggcacag

SEQ ID NO: 1879365 - DNA, 21 bp, Homo sapiens
ctcaccaggggcaggcacagc

SEQ ID NO: 1879366 - DNA, 21 bp, Homo sapiens
ctcactagctgtctcaggagt

SEQ ID NO: 1879367 - DNA, 14 bp, Homo sapiens
ctcactatgctgct

SEQ ID NO: 1879368 - DNA, 14 bp, Homo sapiens
ctcactttcttcta

SEQ ID NO: 1879369 - DNA, 23 bp, Homo sapiens
ctcagaaaacaaggatgaattaa

SEQ ID NO: 1879370 - DNA, 22 bp, Homo sapiens
ctcagatccccagctttctcct

SEQ ID NO: 1879371 - DNA, 21 bp, Homo sapiens
ctcaggatattcactctgtgg

SEQ ID NO: 1879372 - DNA, 17 bp, Homo sapiens
ctcaggctgaccacttt

SEQ ID NO: 1879373 - DNA, 18 bp, Homo sapiens
ctcagtccagtcctcaca

SEQ ID NO: 1879374 - DNA, 18 bp, Homo sapiens
ctcagttcatccattcta

SEQ ID NO: 1879375 - DNA, 21 bp, Homo sapiens
ctcatatccagtattgttcct

SEQ ID NO: 1879376 - DNA, 12 bp, Homo sapiens
ctcatttccaag

SEQ ID NO: 1879377 - DNA, 14 bp, Homo sapiens
ctcatttccaagca

SEQ ID NO: 1879378 - DNA, 18 bp, Homo sapiens
ctcattttaggcaaatat

SEQ ID NO: 1879379 - DNA, 17 bp, Homo sapiens
ctccaaaccctcgaggc

SEQ ID NO: 1879380 - DNA, 21 bp, Homo sapiens
ctccaaactgactcttaagaa

SEQ ID NO: 1879381 - DNA, 13 bp, Homo sapiens
ctccacagtgttg

SEQ ID NO: 1879382 - DNA, 16 bp, Homo sapiens
ccacgtactgcagcct

SEQ ID NO: 1879383 - DNA, 18 bp, Homo sapiens
ccacgtcctgtcagtgcc

SEQ ID NO: 1879384 - DNA, 21 bp, Homo sapiens
ccactcccacttccctgacac

SEQ ID NO: 1879385 - DNA, 15 bp, Homo sapiens
ccactcctcttattt

SEQ ID NO: 1879386 - DNA, 15 bp, Homo sapiens
ccactcctgacccag

SEQ ID NO: 1879387 - DNA, 11 bp, Homo sapiens
ccactggcctg

SEQ ID NO: 1879388 - DNA, 16 bp, Homo sapiens
ccactggcctgcccgt

SEQ ID NO: 1879389 - DNA, 17 bp, Homo sapiens
ccactgtgtgttgacac

SEQ ID NO: 1879390 - DNA, 17 bp, Homo sapiens
ccacttccctgacactg

SEQ ID NO: 1879391 - DNA, 12 bp, Homo sapiens
ccagagtctgga

SEQ ID NO: 1879392 - DNA, 16 bp, Homo sapiens
ccagagtctggagctg

SEQ ID NO: 1879393 - DNA, 15 bp, Homo sapiens
ccagatcctggaaat

SEQ ID NO: 1879394 - DNA, 23 bp, Homo sapiens
ccagcacccgggctcagggacca

SEQ ID NO: 1879395 - DNA, 20 bp, Homo sapiens
ccagcatcctgattaaatgt

SEQ ID NO: 1879396 - DNA, 12 bp, Homo sapiens
ccagcctggccc

SEQ ID NO: 1879397 - DNA, 19 bp, Homo sapiens
ccagcctggcccagctccc

SEQ ID NO: 1879398 - DNA, 15 bp, Homo sapiens
ccagctcccccggga

SEQ ID NO: 1879399 - DNA, 21 bp, Homo sapiens
ccagctctcagttacaagtgc

SEQ ID NO: 1879400 - DNA, 15 bp, Homo sapiens
ccagctgacagtcct

SEQ ID NO: 1879401 - DNA, 20 bp, Homo sapiens
ccagctgacagtcctctcca

SEQ ID NO: 1879402 - DNA, 22 bp, Homo sapiens
ccagctgacagtcctctccacc

SEQ ID NO: 1879403 - DNA, 12 bp, Homo sapiens
ccagctgggctg

SEQ ID NO: 1879404 - DNA, 20 bp, Homo sapiens
ccaggacggggccggccagg

SEQ ID NO: 1879405 - DNA, 23 bp, Homo sapiens
ccaggacggggccggccaggtgg

SEQ ID NO: 1879406 - DNA, 20 bp, Homo sapiens
cctcctgctgcagaggggca

SEQ ID NO: 1879407 - DNA, 16 bp, Homo sapiens
cctccttcttgccctg

SEQ ID NO: 1879408 - DNA, 17 bp, Homo sapiens
cctccttcttgccctga

SEQ ID NO: 1879409 - DNA, 15 bp, Homo sapiens
cctcgcctggcctga

SEQ ID NO: 1879410 - DNA, 15 bp, Homo sapiens
cctcggctcctgctg

SEQ ID NO: 1879411 - DNA, 16 bp, Homo sapiens
cctcggctcctgctgc

SEQ ID NO: 1879412 - DNA, 22 bp, Homo sapiens
cctcggctcctgctgcaccaac

SEQ ID NO: 1879413 - DNA, 13 bp, Homo sapiens
cctcgtgccagtc

SEQ ID NO: 1879414 - DNA, 17 bp, Homo sapiens
cctctccacctagtggc

SEQ ID NO: 1879415 - DNA, 19 bp, Homo sapiens
cctctgctatgcattttct

SEQ ID NO: 1879416 - DNA, 20 bp, Homo sapiens
cctctgctatgcattttctt

SEQ ID NO: 1879417 - DNA, 12 bp, Homo sapiens
cctctgggccct

SEQ ID NO: 1879418 - DNA, 19 bp, Homo sapiens
cctctgggccctgcaggag

SEQ ID NO: 1879419 - DNA, 21 bp, Homo sapiens
cctctgggccctgcaggaggc

SEQ ID NO: 1879420 - DNA, 23 bp, Homo sapiens
cctctgggccctgcaggaggcct

SEQ ID NO: 1879421 - DNA, 13 bp, Homo sapiens
cctctgtcctgac

SEQ ID NO: 1879422 - DNA, 14 bp, Homo sapiens
cctctgtcctgact

SEQ ID NO: 1879423 - DNA, 16 bp, Homo sapiens
cctctgtgtcactggc

SEQ ID NO: 1879424 - DNA, 22 bp, Homo sapiens
cctctgtgtcactggctgcctc

SEQ ID NO: 1879425 - DNA, 23 bp, Homo sapiens
cctctgtgtcactggctgcctcc

SEQ ID NO: 1879426 - DNA, 21 bp, Homo sapiens
cctctgttggaaattgggtgt

SEQ ID NO: 1879427 - DNA, 20 bp, Homo sapiens
cctgaacaaagcacctcaag

SEQ ID NO: 1879428 - DNA, 23 bp, Homo sapiens
cctgaacaaagcacctcaagtgc

SEQ ID NO: 1879429 - DNA, 22 bp, Homo sapiens
cctgacactgcggggcttggct

SEQ ID NO: 1879430 - DNA, 20 bp, Homo sapiens
cctgacttcaggggctgccc

SEQ ID NO: 1879431 - DNA, 20 bp, Homo sapiens
cctgagctttccggggagga

SEQ ID NO: 1879432 - DNA, 21 bp, Homo sapiens
cctgagctttccggggaggag

SEQ ID NO: 1879433 - DNA, 14 bp, Homo sapiens
cctgatggagagga

SEQ ID NO: 1879434 - DNA, 18 bp, Homo sapiens
cctgatggagaggagaac

SEQ ID NO: 1879435 - DNA, 16 bp, Homo sapiens
cctgcactgtcctgct

SEQ ID NO: 1879436 - DNA, 17 bp, Homo sapiens
cctgcaggaggcctggg

SEQ ID NO: 1879437 - DNA, 17 bp, Homo sapiens
cctgcaggttgggccat

SEQ ID NO: 1879438 - DNA, 17 bp, Homo sapiens
cctgccccagctgggct

SEQ ID NO: 1879439 - DNA, 16 bp, Homo sapiens
cctgcccgttgccggg

SEQ ID NO: 1879440 - DNA, 21 bp, Homo sapiens
cctgcccgttgccgggcctgg

SEQ ID NO: 1879441 - DNA, 14 bp, Homo sapiens
cctgcctctaccca

SEQ ID NO: 1879442 - DNA, 14 bp, Homo sapiens
cctgcctcttaaat

SEQ ID NO: 1879443 - DNA, 20 bp, Homo sapiens
cctgcctgaccatcccatga

SEQ ID NO: 1879444 - DNA, 14 bp, Homo sapiens
cctgctccacagtg

SEQ ID NO: 1879445 - DNA, 18 bp, Homo sapiens
cctgctctccttgccctg

SEQ ID NO: 1879446 - DNA, 21 bp, Homo sapiens
cctgctctccttgccctgggc

SEQ ID NO: 1879447 - DNA, 17 bp, Homo sapiens
cctgctgcaccaaccca

SEQ ID NO: 1879448 - DNA, 23 bp, Homo sapiens
cctgctgcaccaacccagccgct

SEQ ID NO: 1879449 - DNA, 14 bp, Homo sapiens
cctgctgcagaggg

SEQ ID NO: 1879450 - DNA, 16 bp, Homo sapiens
cctgctgcagaggggc

SEQ ID NO: 1879451 - DNA, 22 bp, Homo sapiens
cctgctgcagaggggcaggccc

SEQ ID NO: 1879452 - DNA, 23 bp, Homo sapiens
cctgctgcagaggggcaggccct

SEQ ID NO: 1879453 - DNA, 15 bp, Homo sapiens
cctgctgtcccctct

SEQ ID NO: 1879454 - DNA, 23 bp, Homo sapiens
cctggaaatcagggttagtattg

SEQ ID NO: 1879455 - DNA, 16 bp, Homo sapiens
cctggaagagcagccc

SEQ ID NO: 1879456 - DNA, 14 bp, Homo sapiens
cctggagcccctgt

SEQ ID NO: 1879457 - DNA, 20 bp, Homo sapiens
cctggagcccctgtgtggga

SEQ ID NO: 1879458 - DNA, 21 bp, Homo sapiens
cctggagcccctgtgttgggg

SEQ ID NO: 1879459 - DNA, 23 bp, Homo sapiens
cctggcacagtgtctgggctgac

SEQ ID NO: 1879460 - DNA, 14 bp, Homo sapiens
cctggcccagctcc

SEQ ID NO: 1879461 - DNA, 15 bp, Homo sapiens
cctggcccagctccc

SEQ ID NO: 1879462 - DNA, 20 bp, Homo sapiens
cctggcccagctcccccggg

SEQ ID NO: 1879463 - DNA, 13 bp, Homo sapiens
cctggccccctcc

SEQ ID NO: 1879464 - DNA, 22 bp, Homo sapiens
cctggccctcaaggcctcccac

SEQ ID NO: 1879465 - DNA, 23 bp, Homo sapiens
cctggccctcaaggcctcccaca

SEQ ID NO: 1879466 - DNA, 17 bp, Homo sapiens
cctggcctgactcccat

SEQ ID NO: 1879467 - DNA, 16 bp, Homo sapiens
cctggcctgaggtctc

SEQ ID NO: 1879468 - DNA, 20 bp, Homo sapiens
cctggctccaaaccctcgag

SEQ ID NO: 1879469 - DNA, 19 bp, Homo sapiens
cctggctcccaagggaggc

SEQ ID NO: 1879470 - DNA, 16 bp, Homo sapiens
cctgggctgggagaag

SEQ ID NO: 1879471 - DNA, 13 bp, Homo sapiens
cctggggaggctg

SEQ ID NO: 1879472 - DNA, 18 bp, Homo sapiens
cctggggaggctgagact

SEQ ID NO: 1879473 - DNA, 19 bp, Homo sapiens
cctggggaggctgagactg

SEQ ID NO: 1879474 - DNA, 18 bp, Homo sapiens
cctggggagtgagcttgg

SEQ ID NO: 1879475 - DNA, 17 bp, Homo sapiens
cctggtagaatagatat

SEQ ID NO: 1879476 - DNA, 23 bp, Homo sapiens
cctggtgggacaacaaagaggac

SEQ ID NO: 1879477 - DNA, 12 bp, Homo sapiens
cctgtcagtgcc

SEQ ID NO: 1879478 - DNA, 14 bp, Homo sapiens
cctgtcatctgggc

SEQ ID NO: 1879479 - DNA, 20 bp, Homo sapiens
cctgtgggggaagagcacag

SEQ ID NO: 1879480 - DNA, 23 bp, Homo sapiens
cctgtgggggaagagcacagccc

SEQ ID NO: 1879481 - DNA, 15 bp, Homo sapiens
cctgttctgtaggag

SEQ ID NO: 1879482 - DNA, 14 bp, Homo sapiens
cctgtttctgtaga

SEQ ID NO: 1879483 - DNA, 15 bp, Homo sapiens
ccttattcaggaaaa

SEQ ID NO: 1879484 - DNA, 21 bp, Homo sapiens
ccttcatttgcaattcatgta

SEQ ID NO: 1879485 - DNA, 13 bp, Homo sapiens
ccttccccgaggg

SEQ ID NO: 1879486 - DNA, 12 bp, Homo sapiens
ccttccctctgt

SEQ ID NO: 1879487 - DNA, 23 bp, Homo sapiens
ccttctcccccccggggctgggt

SEQ ID NO: 1879488 - DNA, 18 bp, Homo sapiens
ccttctgaacatgagtgt

SEQ ID NO: 1879489 - DNA, 16 bp, Homo sapiens
ccttctgccacctgcc

SEQ ID NO: 1879490 - DNA, 13 bp, Homo sapiens
ccttcttgccctg

SEQ ID NO: 1879491 - DNA, 22 bp, Homo sapiens
ccttctttgtagaactgcccat

SEQ ID NO: 1879492 - DNA, 11 bp, Homo sapiens
ccttgaagcaa

SEQ ID NO: 1879493 - DNA, 15 bp, Homo sapiens
ccttgaagcaaatgt

SEQ ID NO: 1879494 - DNA, 16 bp, Homo sapiens
ccttgaagcaaatgtg

SEQ ID NO: 1879495 - DNA, 14 bp, Homo sapiens
ccttgatgaagaag

SEQ ID NO: 1879496 - DNA, 12 bp, Homo sapiens
ccttgccctggg

SEQ ID NO: 1879497 - DNA, 15 bp, Homo sapiens
ccttgccctgggcca

SEQ ID NO: 1879498 - DNA, 13 bp, Homo sapiens
ccttggacttgag

SEQ ID NO: 1879499 - DNA, 16 bp, Homo sapiens
ccttggcccacctgag

SEQ ID NO: 1879500 - DNA, 22 bp, Homo sapiens
ccttggcccacctgaggcccca

SEQ ID NO: 1879501 - DNA, 15 bp, Homo sapiens
cctttacttgacctc

SEQ ID NO: 1879502 - DNA, 21 bp, Homo sapiens
cctttccagggtcaaagtaca

SEQ ID NO: 1879503 - DNA, 18 bp, Homo sapiens
cctttccagggttattta

SEQ ID NO: 1879504 - DNA, 21 bp, Homo sapiens
ccttttcagcttctgctgggc

SEQ ID NO: 1879505 - DNA, 16 bp, Homo sapiens
ccttttcccggggagg

SEQ ID NO: 1879506 - DNA, 22 bp, Homo sapiens
ccttttttatttttttaagctg

SEQ ID NO: 1879507 - DNA, 22 bp, Homo sapiens
cgaaaatcatataatcttacaa

SEQ ID NO: 1879508 - DNA, 15 bp, Homo sapiens
cgaccccatctgccc

SEQ ID NO: 1879509 - DNA, 14 bp, Homo sapiens
cgagaggaggggcc

SEQ ID NO: 1879510 - DNA, 18 bp, Homo sapiens
gaaaataatcattcttat

SEQ ID NO: 1879511 - DNA, 14 bp, Homo sapiens
gaaacaggcccaga

SEQ ID NO: 1879512 - DNA, 23 bp, Homo sapiens
gaaacttcagcggtttatataag

SEQ ID NO: 1879513 - DNA, 16 bp, Homo sapiens
gaaagaccatttttcc

SEQ ID NO: 1879514 - DNA, 22 bp, Homo sapiens
gaaaggcaagagctcaaggtca

SEQ ID NO: 1879515 - DNA, 17 bp, Homo sapiens
gaaagtgtgtgtgttct

SEQ ID NO: 1879516 - DNA, 16 bp, Homo sapiens
gaaatattatgttaaa

SEQ ID NO: 1879517 - DNA, 17 bp, Homo sapiens
gaaatatttattttaat

SEQ ID NO: 1879518 - DNA, 22 bp, Homo sapiens
gaaatatttattttaataatgt

SEQ ID NO: 1879519 - DNA, 22 bp, Homo sapiens
gaaatgacagaatgctgtttta

SEQ ID NO: 1879520 - DNA, 15 bp, Homo sapiens
ctgcaggttgggcca

SEQ ID NO: 1879521 - DNA, 16 bp, Homo sapiens
ctgcagtatgaaaata

SEQ ID NO: 1879522 - DNA, 17 bp, Homo sapiens
ctgcagtatgaaaataa

SEQ ID NO: 1879523 - DNA, 17 bp, Homo sapiens
gaggcgggggagcctgg

SEQ ID NO: 1879524 - DNA, 20 bp, Homo sapiens
gaggcgggggagcctggagc

SEQ ID NO: 1879525 - DNA, 14 bp, Homo sapiens
gaggctctgaagag

SEQ ID NO: 1879526 - DNA, 15 bp, Homo sapiens
gaggctctgaagaga

SEQ ID NO: 1879527 - DNA, 12 bp, Homo sapiens
gaggctggctgg

SEQ ID NO: 1879528 - DNA, 20 bp, Homo sapiens
gaggctggggcggggctgga

SEQ ID NO: 1879529 - DNA, 16 bp, Homo sapiens
gaggctttcaaatgta

SEQ ID NO: 1879530 - DNA, 21 bp, Homo sapiens
gagggaccaggtgtctagagg

SEQ ID NO: 1879531 - DNA, 22 bp, Homo sapiens
gagggaccaggtgtctagaggc

SEQ ID NO: 1879532 - DNA, 13 bp, Homo sapiens
gaggggaggtggc

SEQ ID NO: 1879533 - DNA, 15 bp, Homo sapiens
gaggggcaggccctg

SEQ ID NO: 1879534 - DNA, 23 bp, Homo sapiens
gaggggcaggccctgcactgtcc

SEQ ID NO: 1879535 - DNA, 17 bp, Homo sapiens
gaggggcccgcttgcct

SEQ ID NO: 1879536 - DNA, 17 bp, Homo sapiens
gaggtctcgctgatgct

SEQ ID NO: 1879537 - DNA, 22 bp, Homo sapiens
gaggtggtagctctgagccctc

SEQ ID NO: 1879538 - DNA, 14 bp, Homo sapiens
gcctgccccagctg

SEQ ID NO: 1879539 - DNA, 16 bp, Homo sapiens
gcctgccccagctggg

SEQ ID NO: 1879540 - DNA, 13 bp, Homo sapiens
gcctgcctgggaa

SEQ ID NO: 1879541 - DNA, 19 bp, Homo sapiens
gcctgctctccttgccctg

SEQ ID NO: 1879542 - DNA, 20 bp, Homo sapiens
gcctgctctccttgccctgg

SEQ ID NO: 1879543 - DNA, 15 bp, Homo sapiens
gcctggaagagcagc

SEQ ID NO: 1879544 - DNA, 14 bp, Homo sapiens
gcctggagcccctg

SEQ ID NO: 1879545 - DNA, 11 bp, Homo sapiens
gcctggcccag

SEQ ID NO: 1879546 - DNA, 14 bp, Homo sapiens
gcctggcccagctc

SEQ ID NO: 1879547 - DNA, 23 bp, Homo sapiens
gcctggctccaaaccctcgaggc

SEQ ID NO: 1879548 - DNA, 18 bp, Homo sapiens
gcctgttctgtaggagag

SEQ ID NO: 1879549 - DNA, 22 bp, Homo sapiens
gcctgttctgtaggagagactg

SEQ ID NO: 1879550 - DNA, 16 bp, Homo sapiens
gccttccccctgccct

SEQ ID NO: 1879551 - DNA, 23 bp, Homo sapiens
gccttctcccccccggggctggg

SEQ ID NO: 1879552 - DNA, 18 bp, Homo sapiens
gccttggggctgatgcag

SEQ ID NO: 1879553 - DNA, 12 bp, Homo sapiens
gccttgtgtaca

SEQ ID NO: 1879554 - DNA, 16 bp, Homo sapiens
gcgaccccatctgccc

SEQ ID NO: 1879555 - DNA, 14 bp, Homo sapiens
gcgactggaggcag

SEQ ID NO: 1879556 - DNA, 24 bp, Homo sapiens
gcgaggcgggggatcctggagccc

SEQ ID NO: 1879557 - DNA, 16 bp, Homo sapiens
gcgagggaggggaggt

SEQ ID NO: 1879558 - DNA, 19 bp, Homo sapiens
gcgagggaggggaggtggc

SEQ ID NO: 1879559 - DNA, 15 bp, Homo sapiens
gcgcaccctcccctc

SEQ ID NO: 1879560 - DNA, 18 bp, Homo sapiens
gcgcaccctcccctcccg

SEQ ID NO: 1879561 - DNA, 15 bp, Homo sapiens
gcgccccctggtggg

SEQ ID NO: 1879562 - DNA, 19 bp, Homo sapiens
ggacccacgaggaggaacc

SEQ ID NO: 1879563 - DNA, 18 bp, Homo sapiens
ggaccccgagcctggctc

SEQ ID NO: 1879564 - DNA, 17 bp, Homo sapiens
ggacctttcagctgtga

SEQ ID NO: 1879565 - DNA, 17 bp, Homo sapiens
ggactctggaccccagg

SEQ ID NO: 1879566 - DNA, 11 bp, Homo sapiens
ggactgtccta

SEQ ID NO: 1879567 - DNA, 14 bp, Homo sapiens
ggactgtcctaggt

SEQ ID NO: 1879568 - DNA, 18 bp, Homo sapiens
ggactgtcctaggtgacc

SEQ ID NO: 1879569 - DNA, 16 bp, Homo sapiens
ggagaaacaggcccag

SEQ ID NO: 1879570 - DNA, 11 bp, Homo sapiens
ggagaagaact

SEQ ID NO: 1879571 - DNA, 16 bp, Homo sapiens
ggagagactggccaga

SEQ ID NO: 1879572 - DNA, 22 bp, Homo sapiens
ggagagagcagcttctgccact

SEQ ID NO: 1879573 - DNA, 12 bp, Homo sapiens
ggagagaggttg

SEQ ID NO: 1879574 - DNA, 14 bp, Homo sapiens
ggagaggagagcat

SEQ ID NO: 1879575 - DNA, 15 bp, Homo sapiens
ggagaggcagaaagg

SEQ ID NO: 1879576 - DNA, 22 bp, Homo sapiens
ggagcattctgcctgcctggga

SEQ ID NO: 1879577 - DNA, 15 bp, Homo sapiens
ggagccacctgggct

SEQ ID NO: 1879578 - DNA, 20 bp, Homo sapiens
ggagcccctgtgtgggaggg

SEQ ID NO: 1879579 - DNA, 15 bp, Homo sapiens
ggagcctggagcccc

SEQ ID NO: 1879580 - DNA, 14 bp, Homo sapiens
ggaggagccttgga

SEQ ID NO: 1879581 - DNA, 15 bp, Homo sapiens
ggaggagccttggag

SEQ ID NO: 1879582 - DNA, 14 bp, Homo sapiens
ggaggcctgggagg

SEQ ID NO: 1879583 - DNA, 14 bp, Homo sapiens
ggaggctcccatgg

SEQ ID NO: 1879584 - DNA, 18 bp, Homo sapiens
ggaggctcccatgggcta

SEQ ID NO: 1879585 - DNA, 20 bp, Homo sapiens
ggaggctgagactgcagagg

SEQ ID NO: 1879586 - DNA, 12 bp, Homo sapiens
ggagggaccagg

SEQ ID NO: 1879587 - DNA, 17 bp, Homo sapiens
ggagggaccaggtgtct

SEQ ID NO: 1879588 - DNA, 21 bp, Homo sapiens
ggagggcgaggcgggggagcc

SEQ ID NO: 1879589 - DNA, 12 bp, Homo sapiens
ggaggggaggtg

SEQ ID NO: 1879590 - DNA, 14 bp, Homo sapiens
ggagtgagcttggt

SEQ ID NO: 1879591 - DNA, 15 bp, Homo sapiens
ggatcctggagcccc

SEQ ID NO: 1879592 - DNA, 16 bp, Homo sapiens
ggatctggggaaggac

SEQ ID NO: 1879593 - DNA, 14 bp, Homo sapiens
ggatgcactggcct

SEQ ID NO: 1879594 - DNA, 12 bp, Homo sapiens
ggatggaaggag

SEQ ID NO: 1879595 - DNA, 15 bp, Homo sapiens
ggatggaaggagaga

SEQ ID NO: 1879596 - DNA, 20 bp, Homo sapiens
ggattgtacgtgggagaggc

SEQ ID NO: 1879597 - DNA, 12 bp, Homo sapiens
ggattttgagta

SEQ ID NO: 1879598 - DNA, 16 bp, Homo sapiens
ggcaacagtgttctga

SEQ ID NO: 1879599 - DNA, 19 bp, Homo sapiens
ggcactgctgggtggccca

SEQ ID NO: 1879600 - DNA, 20 bp, Homo sapiens
ggcactgctgggtggcccat

SEQ ID NO: 1879601 - DNA, 15 bp, Homo sapiens
ggcagcaggtgctgc

SEQ ID NO: 1879602 - DNA, 15 bp, Homo sapiens
ggcagggatttgagg

SEQ ID NO: 1879603 - DNA, 18 bp, Homo sapiens
ggcaggtcctggggaggc

SEQ ID NO: 1879604 - DNA, 20 bp, Homo sapiens
ggcaggtcctggggaggctg

SEQ ID NO: 1879605 - DNA, 23 bp, Homo sapiens
ggcagtgggtcccacttcccctc

SEQ ID NO: 1879606 - DNA, 16 bp, Homo sapiens
ggcatccttctgcctt

SEQ ID NO: 1879607 - DNA, 15 bp, Homo sapiens
ggcatgggggaggct

SEQ ID NO: 1879608 - DNA, 18 bp, Homo sapiens
ggcatgggggaggctctg

SEQ ID NO: 1879609 - DNA, 18 bp, Homo sapiens
ggccagaaaaccctggta

SEQ ID NO: 1879610 - DNA, 14 bp, Homo sapiens
ggccagcccaggat

SEQ ID NO: 1879611 - DNA, 14 bp, Homo sapiens
ggccagccccacag

SEQ ID NO: 1879612 - DNA, 15 bp, Homo sapiens
ggccagccccacagc

SEQ ID NO: 1879613 - DNA, 15 bp, Homo sapiens
ggccatactggcctc

SEQ ID NO: 1879614 - DNA, 22 bp, Homo sapiens
ggccatactggcctcgcctggc

SEQ ID NO: 1879615 - DNA, 14 bp, Homo sapiens
ggcccagctccccc

SEQ ID NO: 1879616 - DNA, 16 bp, Homo sapiens
ggcccagctcccccgg

SEQ ID NO: 1879617 - DNA, 13 bp, Homo sapiens
ggcccaggccatc

SEQ ID NO: 1879618 - DNA, 16 bp, Homo sapiens
ggcccatcagtgtacc

SEQ ID NO: 1879619 - DNA, 13 bp, Homo sapiens
ggcccatcccccc

SEQ ID NO: 1879620 - DNA, 18 bp, Homo sapiens
ggcccatcccccctcacc

SEQ ID NO: 1879621 - DNA, 14 bp, Homo sapiens
ggccccagcctggc

SEQ ID NO: 1879622 - DNA, 16 bp, Homo sapiens
ggccccagcctggccc

SEQ ID NO: 1879623 - DNA, 18 bp, Homo sapiens
ggccccagcctggcccag

SEQ ID NO: 1879624 - DNA, 19 bp, Homo sapiens
ggccccagcctggcccagc

SEQ ID NO: 1879625 - DNA, 12 bp, Homo sapiens
ggccccaggtca

SEQ ID NO: 1879626 - DNA, 13 bp, Homo sapiens
ggccccctccctg

SEQ ID NO: 1879627 - DNA, 19 bp, Homo sapiens
ggcccgcttgcctcggctc

SEQ ID NO: 1879628 - DNA, 21 bp, Homo sapiens
ggcccgcttgcctcggctcct

SEQ ID NO: 1879629 - DNA, 23 bp, Homo sapiens
ggcccgcttgcctcggctcctgc

SEQ ID NO: 1879630 - DNA, 16 bp, Homo sapiens
ggccctcaaggcctcc

SEQ ID NO: 1879631 - DNA, 20 bp, Homo sapiens
ggccctgcactgtcctgctc

SEQ ID NO: 1879632 - DNA, 21 bp, Homo sapiens
ggccctgcactgtcctgctcc

SEQ ID NO: 1879633 - DNA, 13 bp, Homo sapiens
ggccctgcaggag

SEQ ID NO: 1879634 - DNA, 17 bp, Homo sapiens
ggccctgcaggaggcct

SEQ ID NO: 1879635 - DNA, 23 bp, Homo sapiens
ggccctgcaggaggcctgggagg

SEQ ID NO: 1879636 - DNA, 23 bp, Homo sapiens
ggccgggaccccgagcctggctc

SEQ ID NO: 1879637 - DNA, 15 bp, Homo sapiens
ggcctatcagtgtgc

SEQ ID NO: 1879638 - DNA, 18 bp, Homo sapiens
atgaattacatttgtata

SEQ ID NO: 1879639 - DNA, 21 bp, Homo sapiens
atgaattagttttatatgctt

SEQ ID NO: 1879640 - DNA, 13 bp, Homo sapiens
atgaattgcattt

SEQ ID NO: 1879641 - DNA, 21 bp, Homo sapiens
atgaccagcagcagctttcag

SEQ ID NO: 1879642 - DNA, 13 bp, Homo sapiens
atgagagacacac

SEQ ID NO: 1879643 - DNA, 14 bp, Homo sapiens
atgagagacacact

SEQ ID NO: 1879644 - DNA, 19 bp, Homo sapiens
atgagagacacactgaaga

SEQ ID NO: 1879645 - DNA, 20 bp, Homo sapiens
atgagagacacactgaagaa

SEQ ID NO: 1879646 - DNA, 21 bp, Homo sapiens
atgagagacacactgaagaag

SEQ ID NO: 1879647 - DNA, 15 bp, Homo sapiens
atgagcagtccagag

SEQ ID NO: 1879648 - DNA, 15 bp, Homo sapiens
atgataactggaaac

SEQ ID NO: 1879649 - DNA, 14 bp, Homo sapiens
atgattaagtaatg

SEQ ID NO: 1879650 - DNA, 12 bp, Homo sapiens
atgattcccagc

SEQ ID NO: 1879651 - DNA, 18 bp, Homo sapiens
atgatttagagtgctgtc

SEQ ID NO: 1879652 - DNA, 16 bp, Homo sapiens
atgcattttcttcaca

SEQ ID NO: 1879653 - DNA, 16 bp, Homo sapiens
atgccaactcgggagc

SEQ ID NO: 1879654 - DNA, 15 bp, Homo sapiens
atgccacaccaagct

SEQ ID NO: 1879655 - DNA, 17 bp, Homo sapiens
atgccacaccaagctgt

SEQ ID NO: 1879656 - DNA, 22 bp, Homo sapiens
atgccacaccaagctgtgccac

SEQ ID NO: 1879657 - DNA, 18 bp, Homo sapiens
atgcccgctgtcccaggg

SEQ ID NO: 1879658 - DNA, 20 bp, Homo sapiens
atgccctgccaagcctggag

SEQ ID NO: 1879659 - DNA, 23 bp, Homo sapiens
atgcctcactttcttctagctga

SEQ ID NO: 1879660 - DNA, 14 bp, Homo sapiens
atgccttttcccaa

SEQ ID NO: 1879661 - DNA, 16 bp, Homo sapiens
atgctccgtcatttga

SEQ ID NO: 1879662 - DNA, 12 bp, Homo sapiens
tgactgcagttg

SEQ ID NO: 1879663 - DNA, 18 bp, Homo sapiens
tgactgtaggcgcccctg

SEQ ID NO: 1879664 - DNA, 17 bp, Homo sapiens
tgacttcaggggctgcc

SEQ ID NO: 1879665 - DNA, 18 bp, Homo sapiens
tgacttcaggggctgccc

SEQ ID NO: 1879666 - DNA, 22 bp, Homo sapiens
tgacttcaggggctgcccgctc

SEQ ID NO: 1879667 - DNA, 21 bp, Homo sapiens
tgagaaagtcttatttattca

SEQ ID NO: 1879668 - DNA, 17 bp, Homo sapiens
tgagacggatggaagga

SEQ ID NO: 1879669 - DNA, 23 bp, Homo sapiens
tgagacggatggaaggagagagg

SEQ ID NO: 1879670 - DNA, 18 bp, Homo sapiens
tgagactatgcgttttta

SEQ ID NO: 1879671 - DNA, 15 bp, Homo sapiens
tgagactcgtctcaa

SEQ ID NO: 1879672 - DNA, 13 bp, Homo sapiens
tgagagaaaataa

SEQ ID NO: 1879673 - DNA, 22 bp, Homo sapiens
tgagagacacactgaagaagca

SEQ ID NO: 1879674 - DNA, 22 bp, Homo sapiens
tgagataatgtgatattataca

SEQ ID NO: 1879675 - DNA, 17 bp, Homo sapiens
tgagcccccacctgcct

SEQ ID NO: 1879676 - DNA, 19 bp, Homo sapiens
tgagcccccacctgcctga

SEQ ID NO: 1879677 - DNA, 13 bp, Homo sapiens
agcaaggcacctg

SEQ ID NO: 1879678 - DNA, 16 bp, Homo sapiens
agcaaggcacctgcag

SEQ ID NO: 1879679 - DNA, 22 bp, Homo sapiens
agcacagcaaggaggctggctg

SEQ ID NO: 1879680 - DNA, 22 bp, Homo sapiens
agcacagccctcccgccccttc

SEQ ID NO: 1879681 - DNA, 22 bp, Homo sapiens
agcacagcctcttagatgcagt

SEQ ID NO: 1879682 - DNA, 14 bp, Homo sapiens
agcacctcaagtgc

SEQ ID NO: 1879683 - DNA, 19 bp, Homo sapiens
agcacctcaagtgcaagga

SEQ ID NO: 1879684 - DNA, 17 bp, Homo sapiens
agcagcttcagttgttt

SEQ ID NO: 1879685 - DNA, 15 bp, Homo sapiens
agcagcttctgccac

SEQ ID NO: 1879686 - DNA, 16 bp, Homo sapiens
agcagcttctgccact

SEQ ID NO: 1879687 - DNA, 20 bp, Homo sapiens
agcagcttctgccacttccc

SEQ ID NO: 1879688 - DNA, 16 bp, Homo sapiens
agcaggaggaggtgcc

SEQ ID NO: 1879689 - DNA, 15 bp, Homo sapiens
agcaggcagaggaga

SEQ ID NO: 1879690 - DNA, 16 bp, Homo sapiens
agcaggtgctgctacc

SEQ ID NO: 1879691 - DNA, 13 bp, Homo sapiens
agcaggtggcttg

SEQ ID NO: 1879692 - DNA, 17 bp, Homo sapiens
agcagtcaggaaagaga

SEQ ID NO: 1879693 - DNA, 19 bp, Homo sapiens
agcagtcaggaaagagaac

SEQ ID NO: 1879694 - DNA, 17 bp, Homo sapiens
agcagtgagcttctatt

SEQ ID NO: 1879695 - DNA, 15 bp, Homo sapiens
agcagtttgaaattg

SEQ ID NO: 1879696 - DNA, 14 bp, Homo sapiens
agcatctgctctga

SEQ ID NO: 1879697 - DNA, 16 bp, Homo sapiens
agcatctgctctgaga

SEQ ID NO: 1879698 - DNA, 17 bp, Homo sapiens
agcatgtgggggaaggc

SEQ ID NO: 1879699 - DNA, 13 bp, Homo sapiens
agccacctgggct

SEQ ID NO: 1879700 - DNA, 19 bp, Homo sapiens
agccacctgggctgggaga

SEQ ID NO: 1879701 - DNA, 14 bp, Homo sapiens
agccacgaggtggt

SEQ ID NO: 1879702 - DNA, 15 bp, Homo sapiens
agccagattttcctg

SEQ ID NO: 1879703 - DNA, 16 bp, Homo sapiens
agccagctctgcatta

SEQ ID NO: 1879704 - DNA, 17 bp, Homo sapiens
agcccaacacacactcg

SEQ ID NO: 1879705 - DNA, 16 bp, Homo sapiens
agcccacatccagtgg

SEQ ID NO: 1879706 - DNA, 10 bp, Homo sapiens
agcccaggat

SEQ ID NO: 1879707 - DNA, 12 bp, Homo sapiens
agccccacagcc

SEQ ID NO: 1879708 - DNA, 18 bp, Homo sapiens
agccccacagcccacgtc

SEQ ID NO: 1879709 - DNA, 14 bp, Homo sapiens
agccccaggaccaa

SEQ ID NO: 1879710 - DNA, 15 bp, Homo sapiens
agccccaggaccaag

SEQ ID NO: 1879711 - DNA, 19 bp, Homo sapiens
agcccctgtgtgggagggc

SEQ ID NO: 1879712 - DNA, 13 bp, Homo sapiens
agcccctgtgttg

SEQ ID NO: 1879713 - DNA, 18 bp, Homo sapiens
agccctccttcttgccct

SEQ ID NO: 1879714 - DNA, 19 bp, Homo sapiens
agccctccttcttgccctg

SEQ ID NO: 1879715 - DNA, 22 bp, Homo sapiens
agccctccttcttgccctgagc

SEQ ID NO: 1879716 - DNA, 19 bp, Homo sapiens
agccctgaacaaagcacct

SEQ ID NO: 1879717 - DNA, 18 bp, Homo sapiens
agccgctgcccggcgccc

SEQ ID NO: 1879718 - DNA, 13 bp, Homo sapiens
agcctcctctctc

SEQ ID NO: 1879719 - DNA, 19 bp, Homo sapiens
agcctctgtgtcactggct

SEQ ID NO: 1879720 - DNA, 18 bp, Homo sapiens
agcctggagcccctgtgt

SEQ ID NO: 1879721 - DNA, 22 bp, Homo sapiens
agcctggagcccctgtgtggga

SEQ ID NO: 1879722 - DNA, 16 bp, Homo sapiens
agcctggcccagctcc

SEQ ID NO: 1879723 - DNA, 18 bp, Homo sapiens
agcctggcccagctcccc

SEQ ID NO: 1879724 - DNA, 13 bp, Homo sapiens
agcctggctccaa

SEQ ID NO: 1879725 - DNA, 20 bp, Homo sapiens
agcctggctccaaaccctcg

SEQ ID NO: 1879726 - DNA, 22 bp, Homo sapiens
agccttcatttgcaattcatgt

SEQ ID NO: 1879727 - DNA, 13 bp, Homo sapiens
agccttggagtgt

SEQ ID NO: 1879728 - DNA, 21 bp, Homo sapiens
agctcaaggtcaatgacaccc

SEQ ID NO: 1879729 - DNA, 15 bp, Homo sapiens
agctccactggcctg

SEQ ID NO: 1879730 - DNA, 16 bp, Homo sapiens
agctccactggcctgc

SEQ ID NO: 1879731 - DNA, 22 bp, Homo sapiens
agctccttgagggcaagagcca

SEQ ID NO: 1879732 - DNA, 13 bp, Homo sapiens
agctgacagtcct

SEQ ID NO: 1879733 - DNA, 16 bp, Homo sapiens
agctgagctacctggg

SEQ ID NO: 1879734 - DNA, 18 bp, Homo sapiens
agctgctatatattttaa

SEQ ID NO: 1879735 - DNA, 10 bp, Homo sapiens
agctgggctg

SEQ ID NO: 1879736 - DNA, 13 bp, Homo sapiens
agctgtagaggac

SEQ ID NO: 1879737 - DNA, 14 bp, Homo sapiens
agctgtatgattcc

SEQ ID NO: 1879738 - DNA, 18 bp, Homo sapiens
agctgtgccaccctgggc

SEQ ID NO: 1879739 - DNA, 19 bp, Homo sapiens
agctgtgccaccctgggct

SEQ ID NO: 1879740 - DNA, 21 bp, Homo sapiens
agctgtgccaccctgggctct

SEQ ID NO: 1879741 - DNA, 14 bp, Homo sapiens
agcttaaggagagg

SEQ ID NO: 1879742 - DNA, 13 bp, Homo sapiens
agcttctgccact

SEQ ID NO: 1879743 - DNA, 14 bp, Homo sapiens
agcttctgctgggc

SEQ ID NO: 1879744 - DNA, 17 bp, Homo sapiens
agcttctgctgggctgg

SEQ ID NO: 1879745 - DNA, 15 bp, Homo sapiens
agcttgatctgtgat

SEQ ID NO: 1879746 - DNA, 19 bp, Homo sapiens
agcttgatctgtgatttct

SEQ ID NO: 1879747 - DNA, 21 bp, Homo sapiens
agcttgatctgtgatttcttc

SEQ ID NO: 1879748 - DNA, 22 bp, Homo sapiens
agcttgatctgtgatttcttct

SEQ ID NO: 1879749 - DNA, 22 bp, Homo sapiens
agcttgcagtccgttgctgaaa

SEQ ID NO: 1879750 - DNA, 14 bp, Homo sapiens
agctttaaatcatt

SEQ ID NO: 1879751 - DNA, 23 bp, Homo sapiens
agctttattgtgattacgtgtat

SEQ ID NO: 1879752 - DNA, 22 bp, Homo sapiens
agctttccggggaggagccttg

SEQ ID NO: 1879753 - DNA, 15 bp, Homo sapiens
aggaaaagcctctgt

SEQ ID NO: 1879754 - DNA, 12 bp, Homo sapiens
aggaaatatatt

SEQ ID NO: 1879755 - DNA, 19 bp, Homo sapiens
aggaaatatatttgtaaaa

SEQ ID NO: 1879756 - DNA, 12 bp, Homo sapiens
aggaaatattta

SEQ ID NO: 1879757 - DNA, 20 bp, Homo sapiens
aggaagggcatccttctgcc

SEQ ID NO: 1879758 - DNA, 17 bp, Homo sapiens
aggacactgatatgggt

SEQ ID NO: 1879759 - DNA, 18 bp, Homo sapiens
aggaccctgtttctgtag

SEQ ID NO: 1879760 - DNA, 21 bp, Homo sapiens
aggacggggccggccaggtgg

SEQ ID NO: 1879761 - DNA, 12 bp, Homo sapiens
aggactctggac

SEQ ID NO: 1879762 - DNA, 18 bp, Homo sapiens
aggactttagggatctgg

SEQ ID NO: 1879763 - DNA, 17 bp, Homo sapiens
aggagagagcagcttct

SEQ ID NO: 1879764 - DNA, 20 bp, Homo sapiens
aggagagagcagcttctgcc

SEQ ID NO: 1879765 - DNA, 13 bp, Homo sapiens
aggagaggagagc

SEQ ID NO: 1879766 - DNA, 14 bp, Homo sapiens
aggagattttcctt

SEQ ID NO: 1879767 - DNA, 15 bp, Homo sapiens
aggagattttccttc

SEQ ID NO: 1879768 - DNA, 20 bp, Homo sapiens
aggagcagcttcagttgttt

SEQ ID NO: 1879769 - DNA, 23 bp, Homo sapiens
aggagccacctgggctgggagaa

SEQ ID NO: 1879770 - DNA, 14 bp, Homo sapiens
aggagccttggagt

SEQ ID NO: 1879771 - DNA, 17 bp, Homo sapiens
aggaggcctgggagggc

SEQ ID NO: 1879772 - DNA, 13 bp, Homo sapiens
aggaggtggcttc

SEQ ID NO: 1879773 - DNA, 20 bp, Homo sapiens
aggagtacccccagcccaag

SEQ ID NO: 1879774 - DNA, 22 bp, Homo sapiens
aggagtacccccagcccaagag

SEQ ID NO: 1879775 - DNA, 20 bp, Homo sapiens
aggatatggcagggaagctt

SEQ ID NO: 1879776 - DNA, 12 bp, Homo sapiens
aggatgcactgg

SEQ ID NO: 1879777 - DNA, 17 bp, Homo sapiens
aggatgcactggcctgt

SEQ ID NO: 1879778 - DNA, 21 bp, Homo sapiens
aggcacctgcaggttgggcca

SEQ ID NO: 1879779 - DNA, 17 bp, Homo sapiens
aggcagaaagggtaggt

SEQ ID NO: 1879780 - DNA, 15 bp, Homo sapiens
aggcagaggagagta

SEQ ID NO: 1879781 - DNA, 17 bp, Homo sapiens
aggcagctaaggggcag

SEQ ID NO: 1879782 - DNA, 16 bp, Homo sapiens
aggcagggatttgagg

SEQ ID NO: 1879783 - DNA, 17 bp, Homo sapiens
aggcaggggagtctgct

SEQ ID NO: 1879784 - DNA, 19 bp, Homo sapiens
aggccatcttccaggtggg

SEQ ID NO: 1879785 - DNA, 21 bp, Homo sapiens
aggccatgggcactgtgggta

SEQ ID NO: 1879786 - DNA, 16 bp, Homo sapiens
aggccctgcactgtcc

SEQ ID NO: 1879787 - DNA, 18 bp, Homo sapiens
aggccctgcactgtcctg

SEQ ID NO: 1879788 - DNA, 13 bp, Homo sapiens
aggcctcccacag

SEQ ID NO: 1879789 - DNA, 14 bp, Homo sapiens
aggcctcccacagt

SEQ ID NO: 1879790 - DNA, 15 bp, Homo sapiens
aggcctcccacagtg

SEQ ID NO: 1879791 - DNA, 14 bp, Homo sapiens
aggcctggcacagt

SEQ ID NO: 1879792 - DNA, 15 bp, Homo sapiens
aggcctggcacagtg

SEQ ID NO: 1879793 - DNA, 18 bp, Homo sapiens
aggcctggcacagtgtct

SEQ ID NO: 1879794 - DNA, 16 bp, Homo sapiens
aggcctgggagggcaa

SEQ ID NO: 1879795 - DNA, 12 bp, Homo sapiens
aggccttgctgt

SEQ ID NO: 1879796 - DNA, 17 bp, Homo sapiens
cactagctgtctcagga

SEQ ID NO: 1879797 - DNA, 14 bp, Homo sapiens
cactagtatttcta

SEQ ID NO: 1879798 - DNA, 13 bp, Homo sapiens
cactagtctgtgt

SEQ ID NO: 1879799 - DNA, 14 bp, Homo sapiens
cactagtctgtgta

SEQ ID NO: 1879800 - DNA, 14 bp, Homo sapiens
cactcccacttccc

SEQ ID NO: 1879801 - DNA, 13 bp, Homo sapiens
cactctgtggtcc

SEQ ID NO: 1879802 - DNA, 19 bp, Homo sapiens
cactgaatatataaacact

SEQ ID NO: 1879803 - DNA, 20 bp, Homo sapiens
cactgcggggcttggctgag

SEQ ID NO: 1879804 - DNA, 13 bp, Homo sapiens
cactgctgggtgg

SEQ ID NO: 1879805 - DNA, 18 bp, Homo sapiens
cactgctgggtggcccat

SEQ ID NO: 1879806 - DNA, 14 bp, Homo sapiens
cactggctgcctcc

SEQ ID NO: 1879807 - DNA, 15 bp, Homo sapiens
cactggctgcctcca

SEQ ID NO: 1879808 - DNA, 17 bp, Homo sapiens
cactggctgcctccact

SEQ ID NO: 1879809 - DNA, 19 bp, Homo sapiens
cactggctgcctccactcc

SEQ ID NO: 1879810 - DNA, 23 bp, Homo sapiens
cactggctgcctccactcccact

SEQ ID NO: 1879811 - DNA, 11 bp, Homo sapiens
cactgtcctgc

SEQ ID NO: 1879812 - DNA, 12 bp, Homo sapiens
cactgtcctgct

SEQ ID NO: 1879813 - DNA, 15 bp, Homo sapiens
cactgtcctgctcca

SEQ ID NO: 1879814 - DNA, 23 bp, Homo sapiens
cactgtgtgttgacactgttttc

SEQ ID NO: 1879815 - DNA, 16 bp, Homo sapiens
cacttcagcctgtgca

SEQ ID NO: 1879816 - DNA, 23 bp, Homo sapiens
cacttcccaggtaagcaggagga

SEQ ID NO: 1879817 - DNA, 13 bp, Homo sapiens
cacttcccctcct

SEQ ID NO: 1879818 - DNA, 15 bp, Homo sapiens
cacttccctgacact

SEQ ID NO: 1879819 - DNA, 21 bp, Homo sapiens
cacttcttccactgtgtgttg

SEQ ID NO: 1879820 - DNA, 16 bp, Homo sapiens
cacttgtcaataaaat

SEQ ID NO: 1879821 - DNA, 17 bp, Homo sapiens
cacttgtgttttgcaag

SEQ ID NO: 1879822 - DNA, 19 bp, Homo sapiens
cacttgtgttttgcaagcc

SEQ ID NO: 1879823 - DNA, 22 bp, Homo sapiens
cactttcttctagctgagcttt

SEQ ID NO: 1879824 - DNA, 20 bp, Homo sapiens
cagaaaaaaagcccaacaca

SEQ ID NO: 1879825 - DNA, 13 bp, Homo sapiens
cagaaaaatactt

SEQ ID NO: 1879826 - DNA, 16 bp, Homo sapiens
cagaaaaccctggtaa

SEQ ID NO: 1879827 - DNA, 21 bp, Homo sapiens
cagaaagtgtgtgtgttctgt

SEQ ID NO: 1879828 - DNA, 22 bp, Homo sapiens
cagaaagtgtgtgtgttctgta

SEQ ID NO: 1879829 - DNA, 17 bp, Homo sapiens
cagaccattgtctcaga

SEQ ID NO: 1879830 - DNA, 17 bp, Homo sapiens
cagacgccacagtctcc

SEQ ID NO: 1879831 - DNA, 19 bp, Homo sapiens
cagactatttaacttgagg

SEQ ID NO: 1879832 - DNA, 23 bp, Homo sapiens
cagactctttttgtacctggtga

SEQ ID NO: 1879833 - DNA, 17 bp, Homo sapiens
cagactttcccaaatgt

SEQ ID NO: 1879834 - DNA, 19 bp, Homo sapiens
cagactttcccaaatgtat

SEQ ID NO: 1879835 - DNA, 22 bp, Homo sapiens
cagactttcccaaatgtattga

SEQ ID NO: 1879836 - DNA, 20 bp, Homo sapiens
cagagcctcctttctggctt

SEQ ID NO: 1879837 - DNA, 15 bp, Homo sapiens
cagagcttcagggct

SEQ ID NO: 1879838 - DNA, 19 bp, Homo sapiens
cagagcttcagggctgggc

SEQ ID NO: 1879839 - DNA, 17 bp, Homo sapiens
cagaggagagtaccccc

SEQ ID NO: 1879840 - DNA, 23 bp, Homo sapiens
cagaggagagtacccccctgaga

SEQ ID NO: 1879841 - DNA, 18 bp, Homo sapiens
cagaggagccacctgggc

SEQ ID NO: 1879842 - DNA, 18 bp, Homo sapiens
cagaggggcaggccctgc

SEQ ID NO: 1879843 - DNA, 22 bp, Homo sapiens
cagaggggcaggccctgcactg

SEQ ID NO: 1879844 - DNA, 15 bp, Homo sapiens
cagagtgtggtccct

SEQ ID NO: 1879845 - DNA, 18 bp, Homo sapiens
cagagttagatattattt

SEQ ID NO: 1879846 - DNA, 14 bp, Homo sapiens
cagatcctggaaat

SEQ ID NO: 1879847 - DNA, 18 bp, Homo sapiens
cagatcgttcattgcctt

SEQ ID NO: 1879848 - DNA, 14 bp, Homo sapiens
cagattgtcagctc

SEQ ID NO: 1879849 - DNA, 14 bp, Homo sapiens
cagattttcctgaa

SEQ ID NO: 1879850 - DNA, 18 bp, Homo sapiens
cagcaaggaggctggctg

SEQ ID NO: 1879851 - DNA, 19 bp, Homo sapiens
cagcaaggaggctggctgg

SEQ ID NO: 1879852 - DNA, 20 bp, Homo sapiens
cagcaaggaggctggctggg

SEQ ID NO: 1879853 - DNA, 13 bp, Homo sapiens
cagcacagcaagg

SEQ ID NO: 1879854 - DNA, 12 bp, Homo sapiens
cagcaggcagag

SEQ ID NO: 1879855 - DNA, 14 bp, Homo sapiens
cagcaggcagagga

SEQ ID NO: 1879856 - DNA, 22 bp, Homo sapiens
cagccacgaggtggtagctctg

SEQ ID NO: 1879857 - DNA, 20 bp, Homo sapiens
cagcccacgtcctgtcagtg

SEQ ID NO: 1879858 - DNA, 16 bp, Homo sapiens
cagccccaggaccaag

SEQ ID NO: 1879859 - DNA, 20 bp, Homo sapiens
cagcccctccccacaccagt

SEQ ID NO: 1879860 - DNA, 15 bp, Homo sapiens
cagcccttctttcca

SEQ ID NO: 1879861 - DNA, 20 bp, Homo sapiens
cagcccttctttccacagaa

SEQ ID NO: 1879862 - DNA, 12 bp, Homo sapiens
cagccgctgccc

SEQ ID NO: 1879863 - DNA, 13 bp, Homo sapiens
cagccgctgcccg

SEQ ID NO: 1879864 - DNA, 16 bp, Homo sapiens
cagcctacaggcctca

SEQ ID NO: 1879865 - DNA, 16 bp, Homo sapiens
cagcctagttgatcag

SEQ ID NO: 1879866 - DNA, 15 bp, Homo sapiens
cagcctggcccagct

SEQ ID NO: 1879867 - DNA, 16 bp, Homo sapiens
cagctccactggcctg

SEQ ID NO: 1879868 - DNA, 20 bp, Homo sapiens
cagctctcagttacaagtgc

SEQ ID NO: 1879869 - DNA, 14 bp, Homo sapiens
cagctgacagtcct

SEQ ID NO: 1879870 - DNA, 15 bp, Homo sapiens
cagctgacagtcctc

SEQ ID NO: 1879871 - DNA, 17 bp, Homo sapiens
cagctgggctgttggct

SEQ ID NO: 1879872 - DNA, 20 bp, Homo sapiens
cagctgtgaacatggactct

SEQ ID NO: 1879873 - DNA, 17 bp, Homo sapiens
cagcttctgccacttcc

SEQ ID NO: 1879874 - DNA, 18 bp, Homo sapiens
cagcttctgctgggctgg

SEQ ID NO: 1879875 - DNA, 20 bp, Homo sapiens
caggaaagagaacttccaga

SEQ ID NO: 1879876 - DNA, 16 bp, Homo sapiens
caggaatcaaggagcc

SEQ ID NO: 1879877 - DNA, 20 bp, Homo sapiens
caggacccagaaaaaaagcc

SEQ ID NO: 1879878 - DNA, 20 bp, Homo sapiens
caggacggggccggccaggt

SEQ ID NO: 1879879 - DNA, 21 bp, Homo sapiens
caggactcctgggtccctggg

SEQ ID NO: 1879880 - DNA, 19 bp, Homo sapiens
caggaggaggtgccaacag

SEQ ID NO: 1879881 - DNA, 13 bp, Homo sapiens
caggaggcctggg

SEQ ID NO: 1879882 - DNA, 23 bp, Homo sapiens
caggaggcctgggagggcaaggg

SEQ ID NO: 1879883 - DNA, 21 bp, Homo sapiens
caggatggcaaccagaccatt

SEQ ID NO: 1879884 - DNA, 23 bp, Homo sapiens
caggatggttcccttgatgaaga

SEQ ID NO: 1879885 - DNA, 21 bp, Homo sapiens
caggattgtacgtgggagagg

SEQ ID NO: 1879886 - DNA, 22 bp, Homo sapiens
caggattgtacgtgggagaggc

SEQ ID NO: 1879887 - DNA, 16 bp, Homo sapiens
caggcacagcacaggg

SEQ ID NO: 1879888 - DNA, 13 bp, Homo sapiens
caggcagaggaga

SEQ ID NO: 1879889 - DNA, 14 bp, Homo sapiens
caggccatcttcca

SEQ ID NO: 1879890 - DNA, 12 bp, Homo sapiens
caggcccagaga

SEQ ID NO: 1879891 - DNA, 11 bp, Homo sapiens
caggccctgca

SEQ ID NO: 1879892 - DNA, 12 bp, Homo sapiens
caggccctgcac

SEQ ID NO: 1879893 - DNA, 15 bp, Homo sapiens
caggccctgcactgt

SEQ ID NO: 1879894 - DNA, 20 bp, Homo sapiens
caggcctggcaagtgggtga

SEQ ID NO: 1879895 - DNA, 13 bp, Homo sapiens
caggctagatgta

SEQ ID NO: 1879896 - DNA, 11 bp, Homo sapiens
caggctggcca

SEQ ID NO: 1879897 - DNA, 15 bp, Homo sapiens
caggctggccagccc

SEQ ID NO: 1879898 - DNA, 16 bp, Homo sapiens
caggctggccagcccc

SEQ ID NO: 1879899 - DNA, 18 bp, Homo sapiens
caggctggccagccccac

SEQ ID NO: 1879900 - DNA, 20 bp, Homo sapiens
caggctggccagccccacag

SEQ ID NO: 1879901 - DNA, 14 bp, Homo sapiens
cagggatttgagga

SEQ ID NO: 1879902 - DNA, 12 bp, Homo sapiens
cagggctgggca

SEQ ID NO: 1879903 - DNA, 14 bp, Homo sapiens
caggggagtctgct

SEQ ID NO: 1879904 - DNA, 16 bp, Homo sapiens
caggggcaggcacagc

SEQ ID NO: 1879905 - DNA, 13 bp, Homo sapiens
caggggctcagga

SEQ ID NO: 1879906 - DNA, 14 bp, Homo sapiens
caggggctcaggat

SEQ ID NO: 1879907 - DNA, 13 bp, Homo sapiens
caggggctgcccg

SEQ ID NO: 1879908 - DNA, 14 bp, Homo sapiens
caggggctgcccgc

SEQ ID NO: 1879909 - DNA, 18 bp, Homo sapiens
caggggctgcccgctccc

SEQ ID NO: 1879910 - DNA, 20 bp, Homo sapiens
caggggctgcccgctcccag

SEQ ID NO: 1879911 - DNA, 17 bp, Homo sapiens
caggggctttggaagct

SEQ ID NO: 1879912 - DNA, 16 bp, Homo sapiens
caggggtctccctgag

SEQ ID NO: 1879913 - DNA, 17 bp, Homo sapiens
caggggtctccctgagc

SEQ ID NO: 1879914 - DNA, 12 bp, Homo sapiens
caggtcctgggg

SEQ ID NO: 1879915 - DNA, 15 bp, Homo sapiens
cctgccaagcctgga

SEQ ID NO: 1879916 - DNA, 18 bp, Homo sapiens
cctgccaagcctggagcc

SEQ ID NO: 1879917 - DNA, 19 bp, Homo sapiens
cctgccccagctgggctgt

SEQ ID NO: 1879918 - DNA, 15 bp, Homo sapiens
cctgcctctacccaa

SEQ ID NO: 1879919 - DNA, 15 bp, Homo sapiens
cctgctccacagtgt

SEQ ID NO: 1879920 - DNA, 19 bp, Homo sapiens
cctgctctccttgccctgg

SEQ ID NO: 1879921 - DNA, 11 bp, Homo sapiens
cctgctgagct

SEQ ID NO: 1879922 - DNA, 12 bp, Homo sapiens
cctgctgagctg

SEQ ID NO: 1879923 - DNA, 20 bp, Homo sapiens
cctgctgcaccaacccagcc

SEQ ID NO: 1879924 - DNA, 12 bp, Homo sapiens
cctgctgtcccc

SEQ ID NO: 1879925 - DNA, 22 bp, Homo sapiens
cctgctgtcccctcttgcccca

SEQ ID NO: 1879926 - DNA, 22 bp, Homo sapiens
cctggagcccctgtgtgggagg

SEQ ID NO: 1879927 - DNA, 12 bp, Homo sapiens
cctggcacagtg

SEQ ID NO: 1879928 - DNA, 16 bp, Homo sapiens
cctggcccagctcccc

SEQ ID NO: 1879929 - DNA, 17 bp, Homo sapiens
cctggcccatcagtgta

SEQ ID NO: 1879930 - DNA, 13 bp, Homo sapiens
cctggccctcaag

SEQ ID NO: 1879931 - DNA, 16 bp, Homo sapiens
cctggcctgactccca

SEQ ID NO: 1879932 - DNA, 22 bp, Homo sapiens
cctggctccaaaccctcgaggc

SEQ ID NO: 1879933 - DNA, 18 bp, Homo sapiens
cctggctcccaagggagg

SEQ ID NO: 1879934 - DNA, 14 bp, Homo sapiens
cctgggaaagaggg

SEQ ID NO: 1879935 - DNA, 21 bp, Homo sapiens
cctgggaacggggtggacgag

SEQ ID NO: 1879936 - DNA, 12 bp, Homo sapiens
cctgggctctgt

SEQ ID NO: 1879937 - DNA, 19 bp, Homo sapiens
cctgggctctgtgggctgc

SEQ ID NO: 1879938 - DNA, 22 bp, Homo sapiens
cctgggctctgtgggctgcact

SEQ ID NO: 1879939 - DNA, 14 bp, Homo sapiens
cctgggctgggaga

SEQ ID NO: 1879940 - DNA, 21 bp, Homo sapiens
cctgggctgggagaaggtgct

SEQ ID NO: 1879941 - DNA, 22 bp, Homo sapiens
cctgggctgggagaaggtgctt

SEQ ID NO: 1879942 - DNA, 20 bp, Homo sapiens
cctggggaggctgagactgc

SEQ ID NO: 1879943 - DNA, 14 bp, Homo sapiens
cctggggagtgagc

SEQ ID NO: 1879944 - DNA, 20 bp, Homo sapiens
cctggtaagtaatgagggct

SEQ ID NO: 1879945 - DNA, 14 bp, Homo sapiens
cctgtcagtgccgc

SEQ ID NO: 1879946 - DNA, 19 bp, Homo sapiens
cctgtcagtgccgccgcct

SEQ ID NO: 1879947 - DNA, 17 bp, Homo sapiens
cctgtcatctgggccac

SEQ ID NO: 1879948 - DNA, 15 bp, Homo sapiens
cctgtgcccttattc

SEQ ID NO: 1879949 - DNA, 18 bp, Homo sapiens
cctgtggatgtaaagtga

SEQ ID NO: 1879950 - DNA, 21 bp, Homo sapiens
cctgtgggggaagagcacagc

SEQ ID NO: 1879951 - DNA, 22 bp, Homo sapiens
cctgtgggggaagagcacagcc

SEQ ID NO: 1879952 - DNA, 14 bp, Homo sapiens
cctgtgtgggaggg

SEQ ID NO: 1879953 - DNA, 15 bp, Homo sapiens
cctgtgtgggagggc

SEQ ID NO: 1879954 - DNA, 15 bp, Homo sapiens
cctgtgttggggggc

SEQ ID NO: 1879955 - DNA, 13 bp, Homo sapiens
cctgttctgtagg

SEQ ID NO: 1879956 - DNA, 12 bp, Homo sapiens
cctgtttcttcc

SEQ ID NO: 1879957 - DNA, 15 bp, Homo sapiens
ccttacctatttcct

SEQ ID NO: 1879958 - DNA, 15 bp, Homo sapiens
ccttcatttgcaatt

SEQ ID NO: 1879959 - DNA, 20 bp, Homo sapiens
ccttcctacacccttggact

SEQ ID NO: 1879960 - DNA, 16 bp, Homo sapiens
ccttctcccccccggg

SEQ ID NO: 1879961 - DNA, 23 bp, Homo sapiens
ccttctgaacatgagtgtcaact

SEQ ID NO: 1879962 - DNA, 14 bp, Homo sapiens
ccttcttgccctga

SEQ ID NO: 1879963 - DNA, 13 bp, Homo sapiens
ccttgccctgggc

SEQ ID NO: 1879964 - DNA, 15 bp, Homo sapiens
ccttggacttgagga

SEQ ID NO: 1879965 - DNA, 22 bp, Homo sapiens
cctttaaatttaggtaaataaa

SEQ ID NO: 1879966 - DNA, 21 bp, Homo sapiens
ccttttataaacctctaattt

SEQ ID NO: 1879967 - DNA, 12 bp, Homo sapiens
ccttttcccaac

SEQ ID NO: 1879968 - DNA, 14 bp, Homo sapiens
ccttttcttggttc

SEQ ID NO: 1879969 - DNA, 14 bp, Homo sapiens
cctttttgcagtat

SEQ ID NO: 1879970 - DNA, 17 bp, Homo sapiens
cgaccccatctgcccag

SEQ ID NO: 1879971 - DNA, 18 bp, Homo sapiens
cgaccccatctgcccagg

SEQ ID NO: 1879972 - DNA, 19 bp, Homo sapiens
cgaccccatctgcccagga

SEQ ID NO: 1879973 - DNA, 18 bp, Homo sapiens
cgacttgaattttcccac

SEQ ID NO: 1879974 - DNA, 15 bp, Homo sapiens
cgaggcgggggagcc

SEQ ID NO: 1879975 - DNA, 19 bp, Homo sapiens
cgaggcgggggagcctgga

SEQ ID NO: 1879976 - DNA, 22 bp, Homo sapiens
cgaggcgggggagcctggagcc

SEQ ID NO: 1879977 - DNA, 17 bp, Homo sapiens
cgatgatactgtttctt

SEQ ID NO: 1879978 - DNA, 13 bp, Homo sapiens
cgcatgccccctc

SEQ ID NO: 1879979 - DNA, 20 bp, Homo sapiens
cgcatgccccctcgtgccag

SEQ ID NO: 1879980 - DNA, 21 bp, Homo sapiens
cgcccaccgcatgccccctcg

SEQ ID NO: 1879981 - DNA, 12 bp, Homo sapiens
cgcccaggctgg

SEQ ID NO: 1879982 - DNA, 15 bp, Homo sapiens
cgcccaggctggcca

SEQ ID NO: 1879983 - DNA, 19 bp, Homo sapiens
cgcccaggctggccagccc

SEQ ID NO: 1879984 - DNA, 22 bp, Homo sapiens
cgcccaggctggccagccccac

SEQ ID NO: 1879985 - DNA, 21 bp, Homo sapiens
cgcccctcccacagcgctggc

SEQ ID NO: 1879986 - DNA, 11 bp, Homo sapiens
cgcccctgggg

SEQ ID NO: 1879987 - DNA, 16 bp, Homo sapiens
cgccctctgtcctgac

SEQ ID NO: 1879988 - DNA, 21 bp, Homo sapiens
cgccctggggagtgagcttgg

SEQ ID NO: 1879989 - DNA, 15 bp, Homo sapiens
cgcctcgcccaccgc

SEQ ID NO: 1879990 - DNA, 19 bp, Homo sapiens
cgctgcccggcgccctctg

SEQ ID NO: 1879991 - DNA, 21 bp, Homo sapiens
cgctgcccggcgccctctgtc

SEQ ID NO: 1879992 - DNA, 23 bp, Homo sapiens
cgctggccgggaccccgagcctg

SEQ ID NO: 1879993 - DNA, 11 bp, Homo sapiens
cgcttgcctcg

SEQ ID NO: 1879994 - DNA, 13 bp, Homo sapiens
cgcttgcctcggc

SEQ ID NO: 1879995 - DNA, 20 bp, Homo sapiens
cgcttgcctcggctcctgct

SEQ ID NO: 1879996 - DNA, 20 bp, Homo sapiens
cggaaaaggttttattttgt

SEQ ID NO: 1879997 - DNA, 22 bp, Homo sapiens
cggagggaccaggtgtctagag

SEQ ID NO: 1879998 - DNA, 18 bp, Homo sapiens
cggcgccctctgtcctga

SEQ ID NO: 1879999 - DNA, 13 bp, Homo sapiens
cggctcctgctgc

SEQ ID NO: 1880000 - DNA, 12 bp, Homo sapiens
cgggcctggact

SEQ ID NO: 1880001 - DNA, 13 bp, Homo sapiens
cgggcctggactg

SEQ ID NO: 1880002 - DNA, 18 bp, Homo sapiens
cgggctcagggaccacag

SEQ ID NO: 1880003 - DNA, 12 bp, Homo sapiens
cggggctgggtt

SEQ ID NO: 1880004 - DNA, 15 bp, Homo sapiens
cggggcttggctgag

SEQ ID NO: 1880005 - DNA, 13 bp, Homo sapiens
cgggggagcctgg

SEQ ID NO: 1880006 - DNA, 16 bp, Homo sapiens
cgggggagcctggagc

SEQ ID NO: 1880007 - DNA, 18 bp, Homo sapiens
cgggggagcctggagccc

SEQ ID NO: 1880008 - DNA, 16 bp, Homo sapiens
cgggggatcctggagc

SEQ ID NO: 1880009 - DNA, 15 bp, Homo sapiens
cggggggcgagggag

SEQ ID NO: 1880010 - DNA, 15 bp, Homo sapiens
cgggttaagaaatac

SEQ ID NO: 1880011 - DNA, 12 bp, Homo sapiens
cggtaggtgctg

SEQ ID NO: 1880012 - DNA, 17 bp, Homo sapiens
cggtaggtgctggcctc

SEQ ID NO: 1880013 - DNA, 19 bp, Homo sapiens
cggtcagtgccttttggaa

SEQ ID NO: 1880014 - DNA, 17 bp, Homo sapiens
cggtgaggcaggggagt

SEQ ID NO: 1880015 - DNA, 21 bp, Homo sapiens
cggtggacttagctctgagga

SEQ ID NO: 1880016 - DNA, 17 bp, Homo sapiens
cggtggtaccaggtctc

SEQ ID NO: 1880017 - DNA, 21 bp, Homo sapiens
cggtggtaccaggtctcctcc

SEQ ID NO: 1880018 - DNA, 14 bp, Homo sapiens
cgtactgcagcctc

SEQ ID NO: 1880019 - DNA, 15 bp, Homo sapiens
cgtactgcagcctcc

SEQ ID NO: 1880020 - DNA, 16 bp, Homo sapiens
cgtcctgtcagtgccg

SEQ ID NO: 1880021 - DNA, 17 bp, Homo sapiens
cgtctgtttataaacat

SEQ ID NO: 1880022 - DNA, 13 bp, Homo sapiens
cgtggccccagcc

SEQ ID NO: 1880023 - DNA, 15 bp, Homo sapiens
cgtggccccagcctg

SEQ ID NO: 1880024 - DNA, 16 bp, Homo sapiens
cgtggccccagcctgg

SEQ ID NO: 1880025 - DNA, 18 bp, Homo sapiens
cgtggccccagcctggcc

SEQ ID NO: 1880026 - DNA, 15 bp, Homo sapiens
cgtggcttgtagaat

SEQ ID NO: 1880027 - DNA, 15 bp, Homo sapiens
cgtgggagaggcaga

SEQ ID NO: 1880028 - DNA, 16 bp, Homo sapiens
cgtgtatgtttcttct

SEQ ID NO: 1880029 - DNA, 18 bp, Homo sapiens
cgttgccgggcctggact

SEQ ID NO: 1880030 - DNA, 16 bp, Homo sapiens
cgtttaagttgtatta

SEQ ID NO: 1880031 - DNA, 14 bp, Homo sapiens
ctaaagtttacagt

SEQ ID NO: 1880032 - DNA, 19 bp, Homo sapiens
ctaaagtttacagtaaata

SEQ ID NO: 1880033 - DNA, 24 bp, Homo sapiens
ctaaagtttacagtaaataaattg

SEQ ID NO: 1880034 - DNA, 20 bp, Homo sapiens
cttctgttttataattttgt

SEQ ID NO: 1880035 - DNA, 14 bp, Homo sapiens
cttcttgccctgag

SEQ ID NO: 1880036 - DNA, 17 bp, Homo sapiens
cttcttgccctgagctt

SEQ ID NO: 1880037 - DNA, 19 bp, Homo sapiens
cttctttccacagaagctc

SEQ ID NO: 1880038 - DNA, 20 bp, Homo sapiens
cttctttgtagaactgccca

SEQ ID NO: 1880039 - DNA, 13 bp, Homo sapiens
cttgaagcaaatg

SEQ ID NO: 1880040 - DNA, 19 bp, Homo sapiens
cttgaattttcccactgca

SEQ ID NO: 1880041 - DNA, 16 bp, Homo sapiens
cttgaggattttgagt

SEQ ID NO: 1880042 - DNA, 17 bp, Homo sapiens
cttgaggattttgagta

SEQ ID NO: 1880043 - DNA, 18 bp, Homo sapiens
cttgagggcaagagccac

SEQ ID NO: 1880044 - DNA, 14 bp, Homo sapiens
cttgatctgtgatt

SEQ ID NO: 1880045 - DNA, 20 bp, Homo sapiens
cttgatctgtgatttcttct

SEQ ID NO: 1880046 - DNA, 12 bp, Homo sapiens
cttgcactgaat

SEQ ID NO: 1880047 - DNA, 14 bp, Homo sapiens
cttgccccaacccc

SEQ ID NO: 1880048 - DNA, 17 bp, Homo sapiens
cttgccccaacccccag

SEQ ID NO: 1880049 - DNA, 14 bp, Homo sapiens
cttgccctgagctt

SEQ ID NO: 1880050 - DNA, 15 bp, Homo sapiens
cttgccctgggccag

SEQ ID NO: 1880051 - DNA, 15 bp, Homo sapiens
cttgcctcggctcct

SEQ ID NO: 1880052 - DNA, 18 bp, Homo sapiens
cttgcctcggctcctgct

SEQ ID NO: 1880053 - DNA, 21 bp, Homo sapiens
cttgcctcggctcctgctgca

SEQ ID NO: 1880054 - DNA, 15 bp, Homo sapiens
cttgctgatggctgc

SEQ ID NO: 1880055 - DNA, 21 bp, Homo sapiens
cttgctgatggctgctggagg

SEQ ID NO: 1880056 - DNA, 22 bp, Homo sapiens
cttgctgatggctgctggaggg

SEQ ID NO: 1880057 - DNA, 13 bp, Homo sapiens
cttggacttgagg

SEQ ID NO: 1880058 - DNA, 16 bp, Homo sapiens
cttggctgtggggcta

SEQ ID NO: 1880059 - DNA, 17 bp, Homo sapiens
cttggctgtggggctag

SEQ ID NO: 1880060 - DNA, 13 bp, Homo sapiens
cttgggcatttat

SEQ ID NO: 1880061 - DNA, 13 bp, Homo sapiens
cttgggcttctgc

SEQ ID NO: 1880062 - DNA, 22 bp, Homo sapiens
cttggtgcggtaggtgctggcc

SEQ ID NO: 1880063 - DNA, 23 bp, Homo sapiens
cttggtgcggtaggtgctggcct

SEQ ID NO: 1880064 - DNA, 18 bp, Homo sapiens
ctttaaacatctagcagt

SEQ ID NO: 1880065 - DNA, 15 bp, Homo sapiens
ctttaaatcattaga

SEQ ID NO: 1880066 - DNA, 14 bp, Homo sapiens
ctttaaatttaggt

SEQ ID NO: 1880067 - DNA, 13 bp, Homo sapiens
ctttcaaatgtac

SEQ ID NO: 1880068 - DNA, 12 bp, Homo sapiens
ctttcagagcct

SEQ ID NO: 1880069 - DNA, 13 bp, Homo sapiens
ctttcagagcctc

SEQ ID NO: 1880070 - DNA, 14 bp, Homo sapiens
ctttcagagcctcc

SEQ ID NO: 1880071 - DNA, 14 bp, Homo sapiens
ctttcagctgtgaa

SEQ ID NO: 1880072 - DNA, 16 bp, Homo sapiens
ctttgccagtctttaa

SEQ ID NO: 1880073 - DNA, 13 bp, Homo sapiens
ctttgtttttaaa

SEQ ID NO: 1880074 - DNA, 22 bp, Homo sapiens
cttttataaacctctaatttat

SEQ ID NO: 1880075 - DNA, 19 bp, Homo sapiens
cttttcaatttgtcatgtt

SEQ ID NO: 1880076 - DNA, 16 bp, Homo sapiens
cttttcagcttctgct

SEQ ID NO: 1880077 - DNA, 19 bp, Homo sapiens
cttttcagcttctgctggg

SEQ ID NO: 1880078 - DNA, 23 bp, Homo sapiens
cttttcttggttcttttttcagt

SEQ ID NO: 1880079 - DNA, 13 bp, Homo sapiens
ctttttaaagttt

SEQ ID NO: 1880080 - DNA, 20 bp, Homo sapiens
ctttttaaagtttgttcact

SEQ ID NO: 1880081 - DNA, 17 bp, Homo sapiens
cttttttcagttatttt

SEQ ID NO: 1880082 - DNA, 20 bp, Homo sapiens
cttttttttttttttacagt

SEQ ID NO: 1880083 - DNA, 14 bp, Homo sapiens
gaaaacaaggatga

SEQ ID NO: 1880084 - DNA, 17 bp, Homo sapiens
gaaaacatttaacataa

SEQ ID NO: 1880085 - DNA, 15 bp, Homo sapiens
gaaaacttatttgag

SEQ ID NO: 1880086 - DNA, 14 bp, Homo sapiens
gaaaagaaaacatt

SEQ ID NO: 1880087 - DNA, 16 bp, Homo sapiens
gaaaagaaaacattta

SEQ ID NO: 1880088 - DNA, 21 bp, Homo sapiens
gaaaagaaaacatttaacata

SEQ ID NO: 1880089 - DNA, 21 bp, Homo sapiens
gaaaagcctctgtgtcactgg

SEQ ID NO: 1880090 - DNA, 17 bp, Homo sapiens
gaaaaggttttattttg

SEQ ID NO: 1880091 - DNA, 19 bp, Homo sapiens
gaaaatatgtctgcaggtt

SEQ ID NO: 1880092 - DNA, 16 bp, Homo sapiens
gaaacacaactatatt

SEQ ID NO: 1880093 - DNA, 15 bp, Homo sapiens
gaaagagggtactag

SEQ ID NO: 1880094 - DNA, 21 bp, Homo sapiens
gaaagtgtgtgtgttctgtag

SEQ ID NO: 1880095 - DNA, 12 bp, Homo sapiens
gaaataaaatcc

SEQ ID NO: 1880096 - DNA, 13 bp, Homo sapiens
gaaatatttattt

SEQ ID NO: 1880097 - DNA, 15 bp, Homo sapiens
gaaatatttatttta

SEQ ID NO: 1880098 - DNA, 12 bp, Homo sapiens
gaaatgtaacat

SEQ ID NO: 1880099 - DNA, 13 bp, Homo sapiens
gaaatgtaacatg

SEQ ID NO: 1880100 - DNA, 13 bp, Homo sapiens
gaaattgggtgtg

SEQ ID NO: 1880101 - DNA, 20 bp, Homo sapiens
gaaattgggtgtgccctggc

SEQ ID NO: 1880102 - DNA, 23 bp, Homo sapiens
gaaattgggtgtgccctggctcc

SEQ ID NO: 1880103 - DNA, 14 bp, Homo sapiens
gaacatggtcaccc

SEQ ID NO: 1880104 - DNA, 22 bp, Homo sapiens
gaactagagtttagctggaaaa

SEQ ID NO: 1880105 - DNA, 13 bp, Homo sapiens
gaactgaaatcat

SEQ ID NO: 1880106 - DNA, 22 bp, Homo sapiens
gaacttgctgctgagtgcacca

SEQ ID NO: 1880107 - DNA, 12 bp, Homo sapiens
gaagaactgaaa

SEQ ID NO: 1880108 - DNA, 12 bp, Homo sapiens
gaagcaaatgtg

SEQ ID NO: 1880109 - DNA, 19 bp, Homo sapiens
gaagcacgtggtaaaacac

SEQ ID NO: 1880110 - DNA, 23 bp, Homo sapiens
gaaggaccaacccatgccctgcc

SEQ ID NO: 1880111 - DNA, 12 bp, Homo sapiens
gaagtccaagca

SEQ ID NO: 1880112 - DNA, 13 bp, Homo sapiens
gaataaaattgta

SEQ ID NO: 1880113 - DNA, 22 bp, Homo sapiens
gaataaaattgtaaaattgtat

SEQ ID NO: 1880114 - DNA, 15 bp, Homo sapiens
gaatacattgataca

SEQ ID NO: 1880115 - DNA, 20 bp, Homo sapiens
gaatgagagacacactgaag

SEQ ID NO: 1880116 - DNA, 21 bp, Homo sapiens
gaatgatagaactttgccagt

SEQ ID NO: 1880117 - DNA, 13 bp, Homo sapiens
gaattacatttgt

SEQ ID NO: 1880118 - DNA, 16 bp, Homo sapiens
gaattgactgcagttg

SEQ ID NO: 1880119 - DNA, 20 bp, Homo sapiens
gaattgactgcagttgaaca

SEQ ID NO: 1880120 - DNA, 22 bp, Homo sapiens
gaatttgtaagtttatgtctaa

SEQ ID NO: 1880121 - DNA, 22 bp, Homo sapiens
gaatttttaaaaaagtgatctt

SEQ ID NO: 1880122 - DNA, 15 bp, Homo sapiens
gacaagctcacagac

SEQ ID NO: 1880123 - DNA, 22 bp, Homo sapiens
gacactgcggggcttggctgag

SEQ ID NO: 1880124 - DNA, 15 bp, Homo sapiens
gacagaagcagctct

SEQ ID NO: 1880125 - DNA, 18 bp, Homo sapiens
gacaggatgtttgctcag

SEQ ID NO: 1880126 - DNA, 14 bp, Homo sapiens
gacaggggctcagg

SEQ ID NO: 1880127 - DNA, 15 bp, Homo sapiens
gacaggggctcagga

SEQ ID NO: 1880128 - DNA, 18 bp, Homo sapiens
gacagtcacctcatggaa

SEQ ID NO: 1880129 - DNA, 15 bp, Homo sapiens
gacagtcctctccac

SEQ ID NO: 1880130 - DNA, 19 bp, Homo sapiens
gacatgccaactcgggagc

SEQ ID NO: 1880131 - DNA, 23 bp, Homo sapiens
gacatgccaactcgggagcattc

SEQ ID NO: 1880132 - DNA, 22 bp, Homo sapiens
gacatgggacatttgctcatgg

SEQ ID NO: 1880133 - DNA, 14 bp, Homo sapiens
gacatgtgcctgta

SEQ ID NO: 1880134 - DNA, 16 bp, Homo sapiens
gacatttgctcatgga

SEQ ID NO: 1880135 - DNA, 22 bp, Homo sapiens
gaccaagcttaaggagaggaga

SEQ ID NO: 1880136 - DNA, 21 bp, Homo sapiens
gaccacagcaaggcacctgca

SEQ ID NO: 1880137 - DNA, 20 bp, Homo sapiens
gaccaggtgtctagaggcaa

SEQ ID NO: 1880138 - DNA, 20 bp, Homo sapiens
gaccatcccatgagcagtcc

SEQ ID NO: 1880139 - DNA, 20 bp, Homo sapiens
gaccccgagcctggctccaa

SEQ ID NO: 1880140 - DNA, 15 bp, Homo sapiens
gacctccagctctca

SEQ ID NO: 1880141 - DNA, 16 bp, Homo sapiens
gacgagggagtgtctg

SEQ ID NO: 1880142 - DNA, 22 bp, Homo sapiens
gacgagggagtgtctgtaagga

SEQ ID NO: 1880143 - DNA, 12 bp, Homo sapiens
gactcagtgttg

SEQ ID NO: 1880144 - DNA, 16 bp, Homo sapiens
gactctgtgctgagca

SEQ ID NO: 1880145 - DNA, 14 bp, Homo sapiens
gactcttaagaaga

SEQ ID NO: 1880146 - DNA, 21 bp, Homo sapiens
gactcttaagaagactgcatt

SEQ ID NO: 1880147 - DNA, 18 bp, Homo sapiens
gactctttttgtacctgg

SEQ ID NO: 1880148 - DNA, 21 bp, Homo sapiens
gactctttttgtacctggtga

SEQ ID NO: 1880149 - DNA, 23 bp, Homo sapiens
gactgcagaggagccacctgggc

SEQ ID NO: 1880150 - DNA, 14 bp, Homo sapiens
gactgggtgccacg

SEQ ID NO: 1880151 - DNA, 20 bp, Homo sapiens
gactgtaggcgcccctgggg

SEQ ID NO: 1880152 - DNA, 18 bp, Homo sapiens
gacttcaggggctgcccg

SEQ ID NO: 1880153 - DNA, 21 bp, Homo sapiens
gctgcctccactcccacttcc

SEQ ID NO: 1880154 - DNA, 20 bp, Homo sapiens
gctgcctggaagagcagccc

SEQ ID NO: 1880155 - DNA, 13 bp, Homo sapiens
gctgcctgtgtgg

SEQ ID NO: 1880156 - DNA, 18 bp, Homo sapiens
gctgctaccctccctgct

SEQ ID NO: 1880157 - DNA, 21 bp, Homo sapiens
gctgctaccctccctgctgtc

SEQ ID NO: 1880158 - DNA, 19 bp, Homo sapiens
gctgctggaggggacgctg

SEQ ID NO: 1880159 - DNA, 22 bp, Homo sapiens
gctgctggaggggacgctggct

SEQ ID NO: 1880160 - DNA, 13 bp, Homo sapiens
gctgcttctgggc

SEQ ID NO: 1880161 - DNA, 14 bp, Homo sapiens
gctgcttctgggcc

SEQ ID NO: 1880162 - DNA, 21 bp, Homo sapiens
gctggaaaagtatgttagtgc

SEQ ID NO: 1880163 - DNA, 17 bp, Homo sapiens
gctggacctcaccaagc

SEQ ID NO: 1880164 - DNA, 15 bp, Homo sapiens
gctggagtgctggct

SEQ ID NO: 1880165 - DNA, 16 bp, Homo sapiens
gctggagtgctggctc

SEQ ID NO: 1880166 - DNA, 16 bp, Homo sapiens
gctggatgaccccatg

SEQ ID NO: 1880167 - DNA, 22 bp, Homo sapiens
gctggccagccccacagcccac

SEQ ID NO: 1880168 - DNA, 21 bp, Homo sapiens
gctggctccacgccctgggga

SEQ ID NO: 1880169 - DNA, 19 bp, Homo sapiens
gctgggagaaggtgcttgg

SEQ ID NO: 1880170 - DNA, 20 bp, Homo sapiens
gctgggagaaggtgcttggg

SEQ ID NO: 1880171 - DNA, 17 bp, Homo sapiens
gctgggcaggtcctggg

SEQ ID NO: 1880172 - DNA, 22 bp, Homo sapiens
gctgggcaggtcctggggaggc

SEQ ID NO: 1880173 - DNA, 15 bp, Homo sapiens
gctgggctggggcct

SEQ ID NO: 1880174 - DNA, 14 bp, Homo sapiens
gctgggctgggtgc

SEQ ID NO: 1880175 - DNA, 15 bp, Homo sapiens
gctgggctgttggct

SEQ ID NO: 1880176 - DNA, 19 bp, Homo sapiens
gctgggctgttggctgggg

SEQ ID NO: 1880177 - DNA, 20 bp, Homo sapiens
gctggggcctatcagtgtgc

SEQ ID NO: 1880178 - DNA, 12 bp, Homo sapiens
gctggggcctga

SEQ ID NO: 1880179 - DNA, 22 bp, Homo sapiens
gctgggtgcgaccccatctgcc

SEQ ID NO: 1880180 - DNA, 21 bp, Homo sapiens
gctgggtggcccatcccccct

SEQ ID NO: 1880181 - DNA, 22 bp, Homo sapiens
gctgggttggcgcaccctcccc

SEQ ID NO: 1880182 - DNA, 21 bp, Homo sapiens
gctggtaaatgttaagccatt

SEQ ID NO: 1880183 - DNA, 22 bp, Homo sapiens
gctggtaaatgttaagccattt

SEQ ID NO: 1880184 - DNA, 17 bp, Homo sapiens
gctggttacctgttcca

SEQ ID NO: 1880185 - DNA, 15 bp, Homo sapiens
gctgtactgccaagg

SEQ ID NO: 1880186 - DNA, 22 bp, Homo sapiens
gctgtatctatttttttttctt

SEQ ID NO: 1880187 - DNA, 20 bp, Homo sapiens
gctgtattttaaaagaatga

SEQ ID NO: 1880188 - DNA, 12 bp, Homo sapiens
gctgtccagtgc

SEQ ID NO: 1880189 - DNA, 13 bp, Homo sapiens
gctgtcccagggg

SEQ ID NO: 1880190 - DNA, 21 bp, Homo sapiens
gctgtcccaggggtctccctg

SEQ ID NO: 1880191 - DNA, 12 bp, Homo sapiens
gctgtcccctct

SEQ ID NO: 1880192 - DNA, 17 bp, Homo sapiens
gctgtcccctcttgccc

SEQ ID NO: 1880193 - DNA, 18 bp, Homo sapiens
gctgtcccctcttgcccc

SEQ ID NO: 1880194 - DNA, 20 bp, Homo sapiens
gctgtctacactaagagaga

SEQ ID NO: 1880195 - DNA, 13 bp, Homo sapiens
gctgtctcaggag

SEQ ID NO: 1880196 - DNA, 18 bp, Homo sapiens
gctgtgaacatggactct

SEQ ID NO: 1880197 - DNA, 14 bp, Homo sapiens
gctgtgccaccctg

SEQ ID NO: 1880198 - DNA, 17 bp, Homo sapiens
gctgtgccaccctgggc

SEQ ID NO: 1880199 - DNA, 19 bp, Homo sapiens
gctgtgccaccctgggctc

SEQ ID NO: 1880200 - DNA, 21 bp, Homo sapiens
gctgtgccaccctgggctctg

SEQ ID NO: 1880201 - DNA, 21 bp, Homo sapiens
gctgttcagtgctttttcctt

SEQ ID NO: 1880202 - DNA, 18 bp, Homo sapiens
gcttaatttaatgtatta

SEQ ID NO: 1880203 - DNA, 13 bp, Homo sapiens
gcttcagggctgg

SEQ ID NO: 1880204 - DNA, 12 bp, Homo sapiens
gcttcagttgtt

SEQ ID NO: 1880205 - DNA, 17 bp, Homo sapiens
gcttcagttgttcttta

SEQ ID NO: 1880206 - DNA, 16 bp, Homo sapiens
gcttctgccacttccc

SEQ ID NO: 1880207 - DNA, 18 bp, Homo sapiens
gcttctgccacttcccag

SEQ ID NO: 1880208 - DNA, 14 bp, Homo sapiens
gcttctgctgggct

SEQ ID NO: 1880209 - DNA, 19 bp, Homo sapiens
gcttgctgatggctgctgg

SEQ ID NO: 1880210 - DNA, 18 bp, Homo sapiens
gcttgtagaatttttaaa

SEQ ID NO: 1880211 - DNA, 19 bp, Homo sapiens
gcttgtagaatttttaaaa

SEQ ID NO: 1880212 - DNA, 13 bp, Homo sapiens
gctttcagagcct

SEQ ID NO: 1880213 - DNA, 17 bp, Homo sapiens
gctttccggggaggagc

SEQ ID NO: 1880214 - DNA, 18 bp, Homo sapiens
gctttccggggaggagcc

SEQ ID NO: 1880215 - DNA, 18 bp, Homo sapiens
gctttctcctctgctatg

SEQ ID NO: 1880216 - DNA, 18 bp, Homo sapiens
gctttgtatccatgaggg

SEQ ID NO: 1880217 - DNA, 19 bp, Homo sapiens
ggaaatcagggttagtatt

SEQ ID NO: 1880218 - DNA, 20 bp, Homo sapiens
ggaaattaaatccaataaaa

SEQ ID NO: 1880219 - DNA, 23 bp, Homo sapiens
ggaaggaccaacccatgccctgc

SEQ ID NO: 1880220 - DNA, 11 bp, Homo sapiens
ggaaggagaga

SEQ ID NO: 1880221 - DNA, 13 bp, Homo sapiens
ggaaggagagagg

SEQ ID NO: 1880222 - DNA, 15 bp, Homo sapiens
ggaatggactgggtg

SEQ ID NO: 1880223 - DNA, 16 bp, Homo sapiens
ggaattggagctcgtg

SEQ ID NO: 1880224 - DNA, 19 bp, Homo sapiens
ggaatttgtaagtttatgt

SEQ ID NO: 1880225 - DNA, 15 bp, Homo sapiens
ggacagaagcagctc

SEQ ID NO: 1880226 - DNA, 18 bp, Homo sapiens
ggacagtcacctcatgga

SEQ ID NO: 1880227 - DNA, 21 bp, Homo sapiens
ggacagtcacctcatggaatt

SEQ ID NO: 1880228 - DNA, 20 bp, Homo sapiens
ggacatttgctcatggaatt

SEQ ID NO: 1880229 - DNA, 18 bp, Homo sapiens
ggaccaacccatgccctg

SEQ ID NO: 1880230 - DNA, 21 bp, Homo sapiens
ggaccaagcttaaggagagga

SEQ ID NO: 1880231 - DNA, 23 bp, Homo sapiens
ggaccaagcttaaggagaggaga

SEQ ID NO: 1880232 - DNA, 14 bp, Homo sapiens
ggaccctgtttctg

SEQ ID NO: 1880233 - DNA, 21 bp, Homo sapiens
ggacgctggctaaagtgggta

SEQ ID NO: 1880234 - DNA, 13 bp, Homo sapiens
ggacggggccggc

SEQ ID NO: 1880235 - DNA, 16 bp, Homo sapiens
ggacggggccggccag

SEQ ID NO: 1880236 - DNA, 20 bp, Homo sapiens
ggactgtcctaggtgacccc

SEQ ID NO: 1880237 - DNA, 18 bp, Homo sapiens
ggacttgaggattttgag

SEQ ID NO: 1880238 - DNA, 20 bp, Homo sapiens
ggactttatagatcagccag

SEQ ID NO: 1880239 - DNA, 22 bp, Homo sapiens
ggagaaggtgcttgggcttctg

SEQ ID NO: 1880240 - DNA, 14 bp, Homo sapiens
ggagagaggttgag

SEQ ID NO: 1880241 - DNA, 20 bp, Homo sapiens
ggagagcatctgctctgaga

SEQ ID NO: 1880242 - DNA, 12 bp, Homo sapiens
ggagaggagagc

SEQ ID NO: 1880243 - DNA, 23 bp, Homo sapiens
ggagaggagagcatctgctctga

SEQ ID NO: 1880244 - DNA, 12 bp, Homo sapiens
ggagaggcagaa

SEQ ID NO: 1880245 - DNA, 16 bp, Homo sapiens
ggagattttccttcct

SEQ ID NO: 1880246 - DNA, 17 bp, Homo sapiens
ggagattttccttccta

SEQ ID NO: 1880247 - DNA, 15 bp, Homo sapiens
ggagcaggtggcttg

SEQ ID NO: 1880248 - DNA, 16 bp, Homo sapiens
ggagcattctgcctgc

SEQ ID NO: 1880249 - DNA, 20 bp, Homo sapiens
ggagcattctgcctgcctgg

SEQ ID NO: 1880250 - DNA, 13 bp, Homo sapiens
ggagccacctggg

SEQ ID NO: 1880251 - DNA, 12 bp, Homo sapiens
ggagccagctct

SEQ ID NO: 1880252 - DNA, 13 bp, Homo sapiens
ggagcccctgtgt

SEQ ID NO: 1880253 - DNA, 22 bp, Homo sapiens
ggagcccctgtgtgggagggcg

SEQ ID NO: 1880254 - DNA, 16 bp, Homo sapiens
ggagctgagctacctg

SEQ ID NO: 1880255 - DNA, 20 bp, Homo sapiens
ggaggaggtggcttcatgtg

SEQ ID NO: 1880256 - DNA, 16 bp, Homo sapiens
ggaggcaggactcctg

SEQ ID NO: 1880257 - DNA, 17 bp, Homo sapiens
ggaggcaggactcctgg

SEQ ID NO: 1880258 - DNA, 13 bp, Homo sapiens
ggaggcctgggag

SEQ ID NO: 1880259 - DNA, 14 bp, Homo sapiens
ggaggctgagactg

SEQ ID NO: 1880260 - DNA, 16 bp, Homo sapiens
ggaggctggctggggc

SEQ ID NO: 1880261 - DNA, 20 bp, Homo sapiens
ggagggcgaggcgggggagc

SEQ ID NO: 1880262 - DNA, 20 bp, Homo sapiens
ggagggcgaggcgggggatc

SEQ ID NO: 1880263 - DNA, 13 bp, Homo sapiens
ggaggggacgctg

SEQ ID NO: 1880264 - DNA, 13 bp, Homo sapiens
ggaggggcccgct

SEQ ID NO: 1880265 - DNA, 18 bp, Homo sapiens
ggaggggcccgcttgcct

SEQ ID NO: 1880266 - DNA, 22 bp, Homo sapiens
ggaggggcccgcttgcctcggc

SEQ ID NO: 1880267 - DNA, 23 bp, Homo sapiens
ggaggggcccgcttgcctcggct

SEQ ID NO: 1880268 - DNA, 23 bp, Homo sapiens
ggaggtggccgtcgagttgacct

SEQ ID NO: 1880269 - DNA, 13 bp, Homo sapiens
ggagtgctggctc

SEQ ID NO: 1880270 - DNA, 22 bp, Homo sapiens
ggagtgctggctccacgccctg

SEQ ID NO: 1880271 - DNA, 13 bp, Homo sapiens
gtatgtttcttct

SEQ ID NO: 1880272 - DNA, 13 bp, Homo sapiens
gtattaatctgtt

SEQ ID NO: 1880273 - DNA, 14 bp, Homo sapiens
gtattaatctgttt

SEQ ID NO: 1880274 - DNA, 19 bp, Homo sapiens
gtattaggggtaatatatt

SEQ ID NO: 1880275 - DNA, 22 bp, Homo sapiens
gtattgattacaaataaacagt

SEQ ID NO: 1880276 - DNA, 14 bp, Homo sapiens
gtattgtaaaacat

SEQ ID NO: 1880277 - DNA, 15 bp, Homo sapiens
gtatttgaatcagcc

SEQ ID NO: 1880278 - DNA, 19 bp, Homo sapiens
gtattttaggcagggattt

SEQ ID NO: 1880279 - DNA, 16 bp, Homo sapiens
gtatttttcttgctgt

SEQ ID NO: 1880280 - DNA, 16 bp, Homo sapiens
gtcaaagtacagaata

SEQ ID NO: 1880281 - DNA, 15 bp, Homo sapiens
gtcaataaaatccat

SEQ ID NO: 1880282 - DNA, 15 bp, Homo sapiens
gtcaatgttttcagt

SEQ ID NO: 1880283 - DNA, 18 bp, Homo sapiens
gtcacagggcctggggag

SEQ ID NO: 1880284 - DNA, 14 bp, Homo sapiens
gtcactggctgcct

SEQ ID NO: 1880285 - DNA, 16 bp, Homo sapiens
gtcactggctgcctcc

SEQ ID NO: 1880286 - DNA, 21 bp, Homo sapiens
gtcactggctgcctccactcc

SEQ ID NO: 1880287 - DNA, 19 bp, Homo sapiens
gtcaggtgcagtcccagtc

SEQ ID NO: 1880288 - DNA, 20 bp, Homo sapiens
gtcatgcctcactttcttct

SEQ ID NO: 1880289 - DNA, 21 bp, Homo sapiens
gtcatttgacaggggctcagg

SEQ ID NO: 1880290 - DNA, 22 bp, Homo sapiens
gtcatttgacaggggctcagga

SEQ ID NO: 1880291 - DNA, 15 bp, Homo sapiens
gtccagtcctcacat

SEQ ID NO: 1880292 - DNA, 21 bp, Homo sapiens
gtcccctcttgccccaacccc

SEQ ID NO: 1880293 - DNA, 16 bp, Homo sapiens
gtccgttgctgaaaat

SEQ ID NO: 1880294 - DNA, 14 bp, Homo sapiens
gtcctctccaccta

SEQ ID NO: 1880295 - DNA, 18 bp, Homo sapiens
gtcctctccacctagtgg

SEQ ID NO: 1880296 - DNA, 20 bp, Homo sapiens
gtcctctccacctagtggct

SEQ ID NO: 1880297 - DNA, 20 bp, Homo sapiens
gtcctgacttcaggggctgc

SEQ ID NO: 1880298 - DNA, 21 bp, Homo sapiens
gtcctgacttcaggggctgcc

SEQ ID NO: 1880299 - DNA, 23 bp, Homo sapiens
gtcctgacttcaggggctgcccg

SEQ ID NO: 1880300 - DNA, 15 bp, Homo sapiens
gtcctggggaggctg

SEQ ID NO: 1880301 - DNA, 13 bp, Homo sapiens
gtcctgtcagtgc

SEQ ID NO: 1880302 - DNA, 15 bp, Homo sapiens
gtcctgtcagtgccg

SEQ ID NO: 1880303 - DNA, 19 bp, Homo sapiens
gtcctgtcagtgccgccgc

SEQ ID NO: 1880304 - DNA, 18 bp, Homo sapiens
gtcctgttcaaatttttt

SEQ ID NO: 1880305 - DNA, 22 bp, Homo sapiens
gtccttccctcaaagaggcctt

SEQ ID NO: 1880306 - DNA, 16 bp, Homo sapiens
gtcgcgctgcctgtgt

SEQ ID NO: 1880307 - DNA, 18 bp, Homo sapiens
gtcggggggcgagggagg

SEQ ID NO: 1880308 - DNA, 22 bp, Homo sapiens
gtcggggggcgagggaggggag

SEQ ID NO: 1880309 - DNA, 14 bp, Homo sapiens
gtctaaagagcttt

SEQ ID NO: 1880310 - DNA, 17 bp, Homo sapiens
gtctaaagtttacagta

SEQ ID NO: 1880311 - DNA, 17 bp, Homo sapiens
gtctacactaagagaga

SEQ ID NO: 1880312 - DNA, 22 bp, Homo sapiens
gtctagaggcaacagtgttctg

SEQ ID NO: 1880313 - DNA, 22 bp, Homo sapiens
gtctaggactttagggatctgg

SEQ ID NO: 1880314 - DNA, 12 bp, Homo sapiens
gtctcagtccag

SEQ ID NO: 1880315 - DNA, 15 bp, Homo sapiens
gtctccctggccctc

SEQ ID NO: 1880316 - DNA, 12 bp, Homo sapiens
gtctcctccacc

SEQ ID NO: 1880317 - DNA, 18 bp, Homo sapiens
gtctcgctgatgctgggc

SEQ ID NO: 1880318 - DNA, 19 bp, Homo sapiens
gtctcgctgatgctgggct

SEQ ID NO: 1880319 - DNA, 20 bp, Homo sapiens
gtctcgctgatgctgggctg

SEQ ID NO: 1880320 - DNA, 16 bp, Homo sapiens
gtctcggtggtaccag

SEQ ID NO: 1880321 - DNA, 15 bp, Homo sapiens
gtctgctatattttc

SEQ ID NO: 1880322 - DNA, 13 bp, Homo sapiens
gtctggaatggac

SEQ ID NO: 1880323 - DNA, 20 bp, Homo sapiens
gtctgtgtaactttaaacat

SEQ ID NO: 1880324 - DNA, 14 bp, Homo sapiens
gtcttatttcctca

SEQ ID NO: 1880325 - DNA, 12 bp, Homo sapiens
gtcttcctgtgg

SEQ ID NO: 1880326 - DNA, 18 bp, Homo sapiens
gtgaaatgtaacatgaag

SEQ ID NO: 1880327 - DNA, 13 bp, Homo sapiens
gtgacatgaagca

SEQ ID NO: 1880328 - DNA, 20 bp, Homo sapiens
gtgaccccatctctgctgct

SEQ ID NO: 1880329 - DNA, 23 bp, Homo sapiens
gtgaccccttttcagcttctgct

SEQ ID NO: 1880330 - DNA, 21 bp, Homo sapiens
gtgactcgggctcctgtgccc

SEQ ID NO: 1880331 - DNA, 14 bp, Homo sapiens
gtgatataaaggac

SEQ ID NO: 1880332 - DNA, 17 bp, Homo sapiens
gtgattacgtgtatgtt

SEQ ID NO: 1880333 - DNA, 22 bp, Homo sapiens
gtgatttcccgtggccccagcc

SEQ ID NO: 1880334 - DNA, 16 bp, Homo sapiens
gtgatttcttctccct

SEQ ID NO: 1880335 - DNA, 18 bp, Homo sapiens
gtgcaaattgtcacagga

SEQ ID NO: 1880336 - DNA, 14 bp, Homo sapiens
gtgcagacgccaca

SEQ ID NO: 1880337 - DNA, 23 bp, Homo sapiens
gtgcaggcgactggaggcaggac

SEQ ID NO: 1880338 - DNA, 11 bp, Homo sapiens
gtgccaccctg

SEQ ID NO: 1880339 - DNA, 15 bp, Homo sapiens
gtgccaccctgggct

SEQ ID NO: 1880340 - DNA, 18 bp, Homo sapiens
gtgccagtcgcgctgcct

SEQ ID NO: 1880341 - DNA, 21 bp, Homo sapiens
gtgccagtcgcgctgcctgtg

SEQ ID NO: 1880342 - DNA, 16 bp, Homo sapiens
gtgcccatgggcactg

SEQ ID NO: 1880343 - DNA, 20 bp, Homo sapiens
gtgcccatgggcactgctgg

SEQ ID NO: 1880344 - DNA, 16 bp, Homo sapiens
gtgcccattcctcacc

SEQ ID NO: 1880345 - DNA, 17 bp, Homo sapiens
gtgccccccatcctggc

SEQ ID NO: 1880346 - DNA, 19 bp, Homo sapiens
gtgccccccatcctggccc

SEQ ID NO: 1880347 - DNA, 20 bp, Homo sapiens
gtgccccccatcctggccca

SEQ ID NO: 1880348 - DNA, 22 bp, Homo sapiens
gtgccccccatcctggcccatc

SEQ ID NO: 1880349 - DNA, 22 bp, Homo sapiens
gtgccgccgcctcgcccaccgc

SEQ ID NO: 1880350 - DNA, 23 bp, Homo sapiens
gtgccgccgcctcgcccaccgca

SEQ ID NO: 1880351 - DNA, 14 bp, Homo sapiens
gtgcctgctctcct

SEQ ID NO: 1880352 - DNA, 14 bp, Homo sapiens
gtgccttttggaac

SEQ ID NO: 1880353 - DNA, 15 bp, Homo sapiens
gtgcggtaggtgctg

SEQ ID NO: 1880354 - DNA, 18 bp, Homo sapiens
gtgctagtaattggaaag

SEQ ID NO: 1880355 - DNA, 13 bp, Homo sapiens
gtgctttttcctt

SEQ ID NO: 1880356 - DNA, 16 bp, Homo sapiens
gtggcattggcagcag

SEQ ID NO: 1880357 - DNA, 18 bp, Homo sapiens
gtggcattggcagcaggt

SEQ ID NO: 1880358 - DNA, 22 bp, Homo sapiens
gtggcattggcagcaggtgctg

SEQ ID NO: 1880359 - DNA, 14 bp, Homo sapiens
gtggccacggccac

SEQ ID NO: 1880360 - DNA, 17 bp, Homo sapiens
gtggcccatcccccctc

SEQ ID NO: 1880361 - DNA, 12 bp, Homo sapiens
gtggccccagcc

SEQ ID NO: 1880362 - DNA, 15 bp, Homo sapiens
gtggccccagcctgg

SEQ ID NO: 1880363 - DNA, 18 bp, Homo sapiens
gtggccccagcctggccc

SEQ ID NO: 1880364 - DNA, 19 bp, Homo sapiens
gtggccccagcctggccca

SEQ ID NO: 1880365 - DNA, 21 bp, Homo sapiens
gtggccccagcctggcccagc

SEQ ID NO: 1880366 - DNA, 15 bp, Homo sapiens
gtggcgccccctggt

SEQ ID NO: 1880367 - DNA, 18 bp, Homo sapiens
gtggcgccccctggtggg

SEQ ID NO: 1880368 - DNA, 16 bp, Homo sapiens
gtggcttaccaagatc

SEQ ID NO: 1880369 - DNA, 17 bp, Homo sapiens
gtggctttcagagcctc

SEQ ID NO: 1880370 - DNA, 21 bp, Homo sapiens
gtgggacaacaaagaggacac

SEQ ID NO: 1880371 - DNA, 12 bp, Homo sapiens
gtgggagaggca

SEQ ID NO: 1880372 - DNA, 16 bp, Homo sapiens
gtgggggagcctggag

SEQ ID NO: 1880373 - DNA, 14 bp, Homo sapiens
gtgggtagacacac

SEQ ID NO: 1880374 - DNA, 20 bp, Homo sapiens
gtgggtcccacttcccctcc

SEQ ID NO: 1880375 - DNA, 16 bp, Homo sapiens
gtgggtttagcaggct

SEQ ID NO: 1880376 - DNA, 17 bp, Homo sapiens
gtgggtttagcaggctg

SEQ ID NO: 1880377 - DNA, 18 bp, Homo sapiens
gtggtagctctgagccct

SEQ ID NO: 1880378 - DNA, 17 bp, Homo sapiens
gtggtccctccactagg

SEQ ID NO: 1880379 - DNA, 18 bp, Homo sapiens
gtggtctgctcgggccca

SEQ ID NO: 1880380 - DNA, 19 bp, Homo sapiens
gtggtctggaatggactgg

SEQ ID NO: 1880381 - DNA, 21 bp, Homo sapiens
gtggtgcagccccaggaccaa

SEQ ID NO: 1880382 - DNA, 21 bp, Homo sapiens
gtgtaaagacttgagaagtct

SEQ ID NO: 1880383 - DNA, 14 bp, Homo sapiens
gtgtaactcaccag

SEQ ID NO: 1880384 - DNA, 15 bp, Homo sapiens
gtgtatgtttcttct

SEQ ID NO: 1880385 - DNA, 13 bp, Homo sapiens
gtgtcactggctg

SEQ ID NO: 1880386 - DNA, 14 bp, Homo sapiens
gtgtcactggctgc

SEQ ID NO: 1880387 - DNA, 12 bp, Homo sapiens
gtgtctgggctg

SEQ ID NO: 1880388 - DNA, 18 bp, Homo sapiens
gtgtctgtaaggactcag

SEQ ID NO: 1880389 - DNA, 20 bp, Homo sapiens
tattgattacaaataaacag

SEQ ID NO: 1880390 - DNA, 22 bp, Homo sapiens
tattgctgctggtaatttgtat

SEQ ID NO: 1880391 - DNA, 20 bp, Homo sapiens
tattgggaaggaaatatatt

SEQ ID NO: 1880392 - DNA, 18 bp, Homo sapiens
tattgtaaaacattcaca

SEQ ID NO: 1880393 - DNA, 13 bp, Homo sapiens
tattgtgattacg

SEQ ID NO: 1880394 - DNA, 23 bp, Homo sapiens
tattgtgattacgtgtatgtttc

SEQ ID NO: 1880395 - DNA, 16 bp, Homo sapiens
tattgttttatgttct

SEQ ID NO: 1880396 - DNA, 17 bp, Homo sapiens
tattgttttatgttcta

SEQ ID NO: 1880397 - DNA, 20 bp, Homo sapiens
tatttatgcctctgtattta

SEQ ID NO: 1880398 - DNA, 14 bp, Homo sapiens
tatttattttaata

SEQ ID NO: 1880399 - DNA, 19 bp, Homo sapiens
tatttgtacagttcagttc

SEQ ID NO: 1880400 - DNA, 14 bp, Homo sapiens
tattttaaaagaat

SEQ ID NO: 1880401 - DNA, 16 bp, Homo sapiens
tattttgtaattattg

SEQ ID NO: 1880402 - DNA, 20 bp, Homo sapiens
tcaaacagccacgaggtggt

SEQ ID NO: 1880403 - DNA, 17 bp, Homo sapiens
tcaaatttttttttaac

SEQ ID NO: 1880404 - DNA, 20 bp, Homo sapiens
tcaaatttttttttaacgtg

SEQ ID NO: 1880405 - DNA, 23 bp, Homo sapiens
tcaacccctcccctccatccctg

SEQ ID NO: 1880406 - DNA, 15 bp, Homo sapiens
tcaactccaggactt

SEQ ID NO: 1880407 - DNA, 14 bp, Homo sapiens
tcaaggcctcccac

SEQ ID NO: 1880408 - DNA, 15 bp, Homo sapiens
tcaaggcctcccaca

SEQ ID NO: 1880409 - DNA, 20 bp, Homo sapiens
tcaagtcctgcctcttaaat

SEQ ID NO: 1880410 - DNA, 16 bp, Homo sapiens
tcaagtgcaaggacca

SEQ ID NO: 1880411 - DNA, 16 bp, Homo sapiens
tcacagacctttgaac

SEQ ID NO: 1880412 - DNA, 15 bp, Homo sapiens
tcacataccagagtc

SEQ ID NO: 1880413 - DNA, 16 bp, Homo sapiens
tcacataccagagtct

SEQ ID NO: 1880414 - DNA, 15 bp, Homo sapiens
tcaccagcctctgct

SEQ ID NO: 1880415 - DNA, 16 bp, Homo sapiens
tcaccagcctctgctc

SEQ ID NO: 1880416 - DNA, 22 bp, Homo sapiens
tcaccaggggcaggcacagcac

SEQ ID NO: 1880417 - DNA, 12 bp, Homo sapiens
tcacctcatgga

SEQ ID NO: 1880418 - DNA, 19 bp, Homo sapiens
tcacttgatgtttgttaga

SEQ ID NO: 1880419 - DNA, 17 bp, Homo sapiens
tcacttgtcaataaaat

SEQ ID NO: 1880420 - DNA, 18 bp, Homo sapiens
tcagatccccagctttct

SEQ ID NO: 1880421 - DNA, 23 bp, Homo sapiens
tcagatgtgttcctccattttct

SEQ ID NO: 1880422 - DNA, 24 bp, Homo sapiens
tcagatgtgttcctccattttctt

SEQ ID NO: 1880423 - DNA, 22 bp, Homo sapiens
tcagcaggctccagttgaacac

SEQ ID NO: 1880424 - DNA, 14 bp, Homo sapiens
tcagccatgtattt

SEQ ID NO: 1880425 - DNA, 16 bp, Homo sapiens
tcagcttctgctgggc

SEQ ID NO: 1880426 - DNA, 21 bp, Homo sapiens
tcagcttctgctgggctgggg

SEQ ID NO: 1880427 - DNA, 22 bp, Homo sapiens
tcagcttctgctgggctggggc

SEQ ID NO: 1880428 - DNA, 23 bp, Homo sapiens
tcagcttctgctgggctggggcc

SEQ ID NO: 1880429 - DNA, 18 bp, Homo sapiens
tcaggaaaagcctctgtg

SEQ ID NO: 1880430 - DNA, 20 bp, Homo sapiens
tcaggatattcactctgtgg

SEQ ID NO: 1880431 - DNA, 13 bp, Homo sapiens
tcagggaccacag

SEQ ID NO: 1880432 - DNA, 14 bp, Homo sapiens
tcagggctgggcag

SEQ ID NO: 1880433 - DNA, 15 bp, Homo sapiens
tcagggctgggcagg

SEQ ID NO: 1880434 - DNA, 15 bp, Homo sapiens
tcaggtattaagaaa

SEQ ID NO: 1880435 - DNA, 17 bp, Homo sapiens
tcaggtattaagaaaat

SEQ ID NO: 1880436 - DNA, 20 bp, Homo sapiens
tcagtgccgccgcctcgccc

SEQ ID NO: 1880437 - DNA, 15 bp, Homo sapiens
tcagtgctttttcct

SEQ ID NO: 1880438 - DNA, 23 bp, Homo sapiens
tcagtgctttttccttttcatct

SEQ ID NO: 1880439 - DNA, 17 bp, Homo sapiens
tcagtgtacccccgccc

SEQ ID NO: 1880440 - DNA, 21 bp, Homo sapiens
tcagtgtacccccgcccaggc

SEQ ID NO: 1880441 - DNA, 22 bp, Homo sapiens
tcagtgtacccccgcccaggct

SEQ ID NO: 1880442 - DNA, 23 bp, Homo sapiens
tcagtgtacccccgcccaggctg

SEQ ID NO: 1880443 - DNA, 23 bp, Homo sapiens
tcagttcccagacagctttttag

SEQ ID NO: 1880444 - DNA, 21 bp, Homo sapiens
tcagttcctctttgcatggaa

SEQ ID NO: 1880445 - DNA, 14 bp, Homo sapiens
tcagttgttcttta

SEQ ID NO: 1880446 - DNA, 21 bp, Homo sapiens
tcatataaaagttgcgtttaa

SEQ ID NO: 1880447 - DNA, 13 bp, Homo sapiens
tcatctccagtgt

SEQ ID NO: 1880448 - DNA, 22 bp, Homo sapiens
tcatgaattagttttatatgct

SEQ ID NO: 1880449 - DNA, 17 bp, Homo sapiens
tcatgacttttccatgt

SEQ ID NO: 1880450 - DNA, 18 bp, Homo sapiens
tcatggtggccacggcca

SEQ ID NO: 1880451 - DNA, 23 bp, Homo sapiens
tcatggtggccacggccacagcc

SEQ ID NO: 1880452 - DNA, 14 bp, Homo sapiens
tcatgtttaagaaa

SEQ ID NO: 1880453 - DNA, 16 bp, Homo sapiens
tcatgtttaagaaatt

SEQ ID NO: 1880454 - DNA, 13 bp, Homo sapiens
tcatttccaagca

SEQ ID NO: 1880455 - DNA, 17 bp, Homo sapiens
tcatttgcaattcatgt

SEQ ID NO: 1880456 - DNA, 17 bp, Homo sapiens
tcatttgtggttagaat

SEQ ID NO: 1880457 - DNA, 17 bp, Homo sapiens
tccaagcatttagatgt

SEQ ID NO: 1880458 - DNA, 22 bp, Homo sapiens
tccaataaaaacattttgaagt

SEQ ID NO: 1880459 - DNA, 19 bp, Homo sapiens
tccaatccgttcccttctg

SEQ ID NO: 1880460 - DNA, 19 bp, Homo sapiens
tccacagaagctccaggta

SEQ ID NO: 1880461 - DNA, 15 bp, Homo sapiens
tccacagtgtttata

SEQ ID NO: 1880462 - DNA, 21 bp, Homo sapiens
tccacctagtggctgtccagt

SEQ ID NO: 1880463 - DNA, 14 bp, Homo sapiens
tccacgccctgggg

SEQ ID NO: 1880464 - DNA, 16 bp, Homo sapiens
tccacgccctggggag

SEQ ID NO: 1880465 - DNA, 17 bp, Homo sapiens
tccacgtactgcagcct

SEQ ID NO: 1880466 - DNA, 12 bp, Homo sapiens
tccactcccact

SEQ ID NO: 1880467 - DNA, 17 bp, Homo sapiens
tccactggcctgcccgt

SEQ ID NO: 1880468 - DNA, 20 bp, Homo sapiens
tccactgtgtgttgacactg

SEQ ID NO: 1880469 - DNA, 14 bp, Homo sapiens
tccagatcctggaa

SEQ ID NO: 1880470 - DNA, 17 bp, Homo sapiens
tccagatcctggaaatc

SEQ ID NO: 1880471 - DNA, 22 bp, Homo sapiens
tccagcatcctgattaaatgtc

SEQ ID NO: 1880472 - DNA, 19 bp, Homo sapiens
tccaggtagagggtgtgta

SEQ ID NO: 1880473 - DNA, 21 bp, Homo sapiens
tccaggtggggtgaggcagtg

SEQ ID NO: 1880474 - DNA, 13 bp, Homo sapiens
tccatataaatat

SEQ ID NO: 1880475 - DNA, 20 bp, Homo sapiens
tccatccctggccccctccc

SEQ ID NO: 1880476 - DNA, 22 bp, Homo sapiens
tccatccctggccccctccctg

SEQ ID NO: 1880477 - DNA, 20 bp, Homo sapiens
tccatgagggtttcattgtg

SEQ ID NO: 1880478 - DNA, 13 bp, Homo sapiens
tcccaccagccca

SEQ ID NO: 1880479 - DNA, 17 bp, Homo sapiens
tcccactcacaacagct

SEQ ID NO: 1880480 - DNA, 22 bp, Homo sapiens
tcccactcacaacagctgcctg

SEQ ID NO: 1880481 - DNA, 18 bp, Homo sapiens
tcccactgcaccccctcc

SEQ ID NO: 1880482 - DNA, 21 bp, Homo sapiens
tcccactgcaccccctcctgc

SEQ ID NO: 1880483 - DNA, 17 bp, Homo sapiens
tcccagctgacagtcct

SEQ ID NO: 1880484 - DNA, 22 bp, Homo sapiens
tcccagctgacagtcctctcca

SEQ ID NO: 1880485 - DNA, 18 bp, Homo sapiens
tcccaggggtctccctga

SEQ ID NO: 1880486 - DNA, 18 bp, Homo sapiens
tcccaggtaagcaggagg

SEQ ID NO: 1880487 - DNA, 17 bp, Homo sapiens
tcccataacccctagtc

SEQ ID NO: 1880488 - DNA, 14 bp, Homo sapiens
tcccatgggctagg

SEQ ID NO: 1880489 - DNA, 18 bp, Homo sapiens
tccccagtactgaggtgg

SEQ ID NO: 1880490 - DNA, 22 bp, Homo sapiens
tcccccactcctcttatttgct

SEQ ID NO: 1880491 - DNA, 16 bp, Homo sapiens
tcccctccatccctgg

SEQ ID NO: 1880492 - DNA, 14 bp, Homo sapiens
tcccctcctacccc

SEQ ID NO: 1880493 - DNA, 20 bp, Homo sapiens
tcccctcctacccctcccag

SEQ ID NO: 1880494 - DNA, 15 bp, Homo sapiens
tcccgtggccccagc

SEQ ID NO: 1880495 - DNA, 17 bp, Homo sapiens
tcccgtggccccagcct

SEQ ID NO: 1880496 - DNA, 13 bp, Homo sapiens
tccctctgttgga

SEQ ID NO: 1880497 - DNA, 16 bp, Homo sapiens
tccctgagcctgcccc

SEQ ID NO: 1880498 - DNA, 13 bp, Homo sapiens
tccctgctgtccc

SEQ ID NO: 1880499 - DNA, 17 bp, Homo sapiens
tccctgctgtcccctct

SEQ ID NO: 1880500 - DNA, 18 bp, Homo sapiens
tccctggccccctccctg

SEQ ID NO: 1880501 - DNA, 15 bp, Homo sapiens
tcccttctgccacct

SEQ ID NO: 1880502 - DNA, 15 bp, Homo sapiens
tcccttgatgaagaa

SEQ ID NO: 1880503 - DNA, 16 bp, Homo sapiens
tcccttgatgaagaag

SEQ ID NO: 1880504 - DNA, 21 bp, Homo sapiens
tccgttcccacctctgaggac

SEQ ID NO: 1880505 - DNA, 19 bp, Homo sapiens
tccgttgctgaaaatgatt

SEQ ID NO: 1880506 - DNA, 20 bp, Homo sapiens
tggctccaaaccctcgaggc

SEQ ID NO: 1880507 - DNA, 15 bp, Homo sapiens
tggctccacgccctg

SEQ ID NO: 1880508 - DNA, 14 bp, Homo sapiens
tggctcccaaggga

SEQ ID NO: 1880509 - DNA, 16 bp, Homo sapiens
tggctcccaagggagg

SEQ ID NO: 1880510 - DNA, 15 bp, Homo sapiens
tggctcttgcctgta

SEQ ID NO: 1880511 - DNA, 17 bp, Homo sapiens
tggctgtccagtgccca

SEQ ID NO: 1880512 - DNA, 13 bp, Homo sapiens
tggcttcatgtgg

SEQ ID NO: 1880513 - DNA, 18 bp, Homo sapiens
tggcttcatgtggcactt

SEQ ID NO: 1880514 - DNA, 14 bp, Homo sapiens
tgggagggcaaggg

SEQ ID NO: 1880515 - DNA, 23 bp, Homo sapiens
tgggatgtatttttcttgctgtt

SEQ ID NO: 1880516 - DNA, 17 bp, Homo sapiens
tgggcactgctgggtgg

SEQ ID NO: 1880517 - DNA, 22 bp, Homo sapiens
tgggcactgctgggtggcccat

SEQ ID NO: 1880518 - DNA, 15 bp, Homo sapiens
tgggcaggtcctggg

SEQ ID NO: 1880519 - DNA, 21 bp, Homo sapiens
tgggcaggtcctggggaggct

SEQ ID NO: 1880520 - DNA, 15 bp, Homo sapiens
tgggccctgcaggag

SEQ ID NO: 1880521 - DNA, 18 bp, Homo sapiens
tgggccctgcaggaggcc

SEQ ID NO: 1880522 - DNA, 20 bp, Homo sapiens
tgggccctgcaggaggcctg

SEQ ID NO: 1880523 - DNA, 21 bp, Homo sapiens
tgggccctgcaggaggcctgg

SEQ ID NO: 1880524 - DNA, 19 bp, Homo sapiens
tgggcctgatggagaggag

SEQ ID NO: 1880525 - DNA, 21 bp, Homo sapiens
tgggctctgtgggctgcactc

SEQ ID NO: 1880526 - DNA, 17 bp, Homo sapiens
tgggctgcactctgtgc

SEQ ID NO: 1880527 - DNA, 12 bp, Homo sapiens
tgggctgggaga

SEQ ID NO: 1880528 - DNA, 13 bp, Homo sapiens
tggggaggctgag

SEQ ID NO: 1880529 - DNA, 19 bp, Homo sapiens
tggggagtgagcttggtgc

SEQ ID NO: 1880530 - DNA, 22 bp, Homo sapiens
tggggcctatcagtgtgccccc

SEQ ID NO: 1880531 - DNA, 18 bp, Homo sapiens
tggggctaggggctgggg

SEQ ID NO: 1880532 - DNA, 18 bp, Homo sapiens
tgggggaagagcacagcc

SEQ ID NO: 1880533 - DNA, 19 bp, Homo sapiens
tgggggagcctggagcccc

SEQ ID NO: 1880534 - DNA, 12 bp, Homo sapiens
tgggggaggctc

SEQ ID NO: 1880535 - DNA, 16 bp, Homo sapiens
tgggggcatgggggag

SEQ ID NO: 1880536 - DNA, 18 bp, Homo sapiens
tgggggcatgggggaggc

SEQ ID NO: 1880537 - DNA, 22 bp, Homo sapiens
tgggtaggccttggcccacctg

SEQ ID NO: 1880538 - DNA, 13 bp, Homo sapiens
tgggtgcgacccc

SEQ ID NO: 1880539 - DNA, 21 bp, Homo sapiens
tgggtgcgaccccatctgccc

SEQ ID NO: 1880540 - DNA, 15 bp, Homo sapiens
tgggtgtgccctggc

SEQ ID NO: 1880541 - DNA, 16 bp, Homo sapiens
tgggtgtgccctggct

SEQ ID NO: 1880542 - DNA, 18 bp, Homo sapiens
tgggtgtgccctggctcc

SEQ ID NO: 1880543 - DNA, 17 bp, Homo sapiens
tgggttggcgcaccctc

SEQ ID NO: 1880544 - DNA, 14 bp, Homo sapiens
tggtaaaacacttg

SEQ ID NO: 1880545 - DNA, 15 bp, Homo sapiens
tggtaccaggtctcc

SEQ ID NO: 1880546 - DNA, 13 bp, Homo sapiens
tggtagctctgag

SEQ ID NO: 1880547 - DNA, 16 bp, Homo sapiens
tggtagctctgagccc

SEQ ID NO: 1880548 - DNA, 17 bp, Homo sapiens
tggtctgctcgggccca

SEQ ID NO: 1880549 - DNA, 19 bp, Homo sapiens
tggtctgctcgggcccagg

SEQ ID NO: 1880550 - DNA, 17 bp, Homo sapiens
tggtctggaatggactg

SEQ ID NO: 1880551 - DNA, 22 bp, Homo sapiens
tggtctggaatggactgggtgc

SEQ ID NO: 1880552 - DNA, 24 bp, Homo sapiens
tggtgaaaccctgtctctactaaa

SEQ ID NO: 1880553 - DNA, 10 bp, Homo sapiens
tggtgcctga

SEQ ID NO: 1880554 - DNA, 21 bp, Homo sapiens
tggtgcctgattcggctgtct

SEQ ID NO: 1880555 - DNA, 18 bp, Homo sapiens
tggtgtcgcgccttctcc

SEQ ID NO: 1880556 - DNA, 15 bp, Homo sapiens
tggtgttacattaaa

SEQ ID NO: 1880557 - DNA, 20 bp, Homo sapiens
tggttacctgttccattgtt

SEQ ID NO: 1880558 - DNA, 16 bp, Homo sapiens
tggttcccttgatgaa

SEQ ID NO: 1880559 - DNA, 15 bp, Homo sapiens
tggttgtgaaatgta

SEQ ID NO: 1880560 - DNA, 19 bp, Homo sapiens
tggttgtgaaatgtaacat

SEQ ID NO: 1880561 - DNA, 13 bp, Homo sapiens
tgtaacatgaagc

SEQ ID NO: 1880562 - DNA, 14 bp, Homo sapiens
tgtaactttaaaca

SEQ ID NO: 1880563 - DNA, 20 bp, Homo sapiens
tgtaaggactcagtgttgac

SEQ ID NO: 1880564 - DNA, 15 bp, Homo sapiens
tgtaataatgttatt

SEQ ID NO: 1880565 - DNA, 11 bp, Homo sapiens
tgtaattattg

SEQ ID NO: 1880566 - DNA, 14 bp, Homo sapiens
tgtacagttcagtt

SEQ ID NO: 1880567 - DNA, 20 bp, Homo sapiens
tgtacagttcagttcctctt

SEQ ID NO: 1880568 - DNA, 19 bp, Homo sapiens
tgtacccccgcccaggctg

SEQ ID NO: 1880569 - DNA, 18 bp, Homo sapiens
tgtacctggtgacccctt

SEQ ID NO: 1880570 - DNA, 18 bp, Homo sapiens
tgtagaaaagaaaacatt

SEQ ID NO: 1880571 - DNA, 17 bp, Homo sapiens
tgtagtgttggagaaga

SEQ ID NO: 1880572 - DNA, 22 bp, Homo sapiens
tgtataatttaacagtgccctt

SEQ ID NO: 1880573 - DNA, 15 bp, Homo sapiens
tgtatctacctcact

SEQ ID NO: 1880574 - DNA, 14 bp, Homo sapiens
tgtattaatctgtt

SEQ ID NO: 1880575 - DNA, 20 bp, Homo sapiens
tgtattaatctgtttgtgca

SEQ ID NO: 1880576 - DNA, 21 bp, Homo sapiens
tgtattgattacaaataaaca

SEQ ID NO: 1880577 - DNA, 19 bp, Homo sapiens
tgtattttaaaagaatgat

SEQ ID NO: 1880578 - DNA, 20 bp, Homo sapiens
tgtatttttcttgctgttca

SEQ ID NO: 1880579 - DNA, 22 bp, Homo sapiens
tgtatttttcttgctgttcagt

SEQ ID NO: 1880580 - DNA, 23 bp, Homo sapiens
tgtatttttcttgctgttcagtg

SEQ ID NO: 1880581 - DNA, 14 bp, Homo sapiens
tgtcactggctgcc

SEQ ID NO: 1880582 - DNA, 17 bp, Homo sapiens
tgtcactggctgcctcc

SEQ ID NO: 1880583 - DNA, 22 bp, Homo sapiens
tgtcactggctgcctccactcc

SEQ ID NO: 1880584 - DNA, 13 bp, Homo sapiens
tgtcagtgccgcc

SEQ ID NO: 1880585 - DNA, 13 bp, Homo sapiens
tgtccagtgccca

SEQ ID NO: 1880586 - DNA, 15 bp, Homo sapiens
tgtccagtgcccatt

SEQ ID NO: 1880587 - DNA, 21 bp, Homo sapiens
tgtcctgacttcaggggctgc

SEQ ID NO: 1880588 - DNA, 22 bp, Homo sapiens
tgtcctgacttcaggggctgcc

SEQ ID NO: 1880589 - DNA, 14 bp, Homo sapiens
tgtcctgctccaca

SEQ ID NO: 1880590 - DNA, 18 bp, Homo sapiens
tgtcctgctccacagtgt

SEQ ID NO: 1880591 - DNA, 21 bp, Homo sapiens
tgtcgaatttttattatttgt

SEQ ID NO: 1880592 - DNA, 19 bp, Homo sapiens
tgtctaaagagctttagtc

SEQ ID NO: 1880593 - DNA, 17 bp, Homo sapiens
tgtctacactaagagag

SEQ ID NO: 1880594 - DNA, 19 bp, Homo sapiens
tgtctcaggagtagtctca

SEQ ID NO: 1880595 - DNA, 15 bp, Homo sapiens
tgtctccctggccct

SEQ ID NO: 1880596 - DNA, 16 bp, Homo sapiens
tgtctccctggccctc

SEQ ID NO: 1880597 - DNA, 15 bp, Homo sapiens
tgtctgatgtttgtt

SEQ ID NO: 1880598 - DNA, 17 bp, Homo sapiens
tgtctgcaggtttctcc

SEQ ID NO: 1880599 - DNA, 11 bp, Homo sapiens
tgtctgggctg

SEQ ID NO: 1880600 - DNA, 12 bp, Homo sapiens
tgtctgggctga

SEQ ID NO: 1880601 - DNA, 20 bp, Homo sapiens
tgtgatttcccgtggcccca

SEQ ID NO: 1880602 - DNA, 20 bp, Homo sapiens
tgtgatttcttctccctcct

SEQ ID NO: 1880603 - DNA, 14 bp, Homo sapiens
tgtgcaaacataat

SEQ ID NO: 1880604 - DNA, 12 bp, Homo sapiens
tgtgccaccctg

SEQ ID NO: 1880605 - DNA, 22 bp, Homo sapiens
tgtgcccatgggcactgctggg

SEQ ID NO: 1880606 - DNA, 13 bp, Homo sapiens
tgtgccccccatc

SEQ ID NO: 1880607 - DNA, 16 bp, Homo sapiens
tgtgccccccatcctg

SEQ ID NO: 1880608 - DNA, 18 bp, Homo sapiens
tgtgccccccatcctggc

SEQ ID NO: 1880609 - DNA, 13 bp, Homo sapiens
tgtgccctggctc

SEQ ID NO: 1880610 - DNA, 15 bp, Homo sapiens
tgtgccctggctccc

SEQ ID NO: 1880611 - DNA, 17 bp, Homo sapiens
tgtgcctgactctgtgc

SEQ ID NO: 1880612 - DNA, 15 bp, Homo sapiens
tgtgctgagcacaga

SEQ ID NO: 1880613 - DNA, 18 bp, Homo sapiens
tgtgggatcattgcattt

SEQ ID NO: 1880614 - DNA, 20 bp, Homo sapiens
tgtgggctgcactctgtgcc

SEQ ID NO: 1880615 - DNA, 13 bp, Homo sapiens
tgtgggggaaggc

SEQ ID NO: 1880616 - DNA, 16 bp, Homo sapiens
tgtgtaactttaaaca

SEQ ID NO: 1880617 - DNA, 13 bp, Homo sapiens
tgtgtaagtagat

SEQ ID NO: 1880618 - DNA, 17 bp, Homo sapiens
tgtgtcactggctgcct

SEQ ID NO: 1880619 - DNA, 16 bp, Homo sapiens
tgtgtcataaattaca

SEQ ID NO: 1880620 - DNA, 21 bp, Homo sapiens
tgtgtcggggggcgagggagg

SEQ ID NO: 1880621 - DNA, 18 bp, Homo sapiens
tgtgttcctccattttct

SEQ ID NO: 1880622 - DNA, 14 bp, Homo sapiens
tgtgttgacactgt

SEQ ID NO: 1880623 - DNA, 17 bp, Homo sapiens
tgtgttgacactgtttt

SEQ ID NO: 1880624 - DNA, 13 bp, Homo sapiens
tgttaaagccaga

SEQ ID NO: 1880625 - DNA, 19 bp, Homo sapiens
aggtctcgctgatgctggg

SEQ ID NO: 1880626 - DNA, 14 bp, Homo sapiens
aggtgcagtcccag

SEQ ID NO: 1880627 - DNA, 17 bp, Homo sapiens
aggtgctagggtgcctg

SEQ ID NO: 1880628 - DNA, 18 bp, Homo sapiens
aggtgctagggtgcctgc

SEQ ID NO: 1880629 - DNA, 21 bp, Homo sapiens
aggtgctgctaccctccctgc

SEQ ID NO: 1880630 - DNA, 13 bp, Homo sapiens
aggtgctggcctc

SEQ ID NO: 1880631 - DNA, 20 bp, Homo sapiens
aggtgcttgggcttctgcgg

SEQ ID NO: 1880632 - DNA, 19 bp, Homo sapiens
aggtggcgccccctggtgg

SEQ ID NO: 1880633 - DNA, 16 bp, Homo sapiens
aggtgggcgggcagca

SEQ ID NO: 1880634 - DNA, 20 bp, Homo sapiens
aggtgggcgggcagcacagc

SEQ ID NO: 1880635 - DNA, 16 bp, Homo sapiens
aggtgggggagcctgg

SEQ ID NO: 1880636 - DNA, 17 bp, Homo sapiens
aggtgggggagcctgga

SEQ ID NO: 1880637 - DNA, 19 bp, Homo sapiens
aggtgggggagcctggagc

SEQ ID NO: 1880638 - DNA, 21 bp, Homo sapiens
aggtggtagctctgagccctc

SEQ ID NO: 1880639 - DNA, 14 bp, Homo sapiens
aggtggtggacatc

SEQ ID NO: 1880640 - DNA, 17 bp, Homo sapiens
aggttgacattcagaaa

SEQ ID NO: 1880641 - DNA, 18 bp, Homo sapiens
aggttgaggatgcactgg

SEQ ID NO: 1880642 - DNA, 23 bp, Homo sapiens
aggttgaggatgcactggcctgt

SEQ ID NO: 1880643 - DNA, 20 bp, Homo sapiens
aggttgggccatactggcct

SEQ ID NO: 1880644 - DNA, 23 bp, Homo sapiens
aggttgtgttgcctgctgagctg

SEQ ID NO: 1880645 - DNA, 14 bp, Homo sapiens
aggttttattttgt

SEQ ID NO: 1880646 - DNA, 22 bp, Homo sapiens
agtaaatacttgcagttgtgat

SEQ ID NO: 1880647 - DNA, 13 bp, Homo sapiens
agtaatgataact

SEQ ID NO: 1880648 - DNA, 16 bp, Homo sapiens
agtacccccctgagag

SEQ ID NO: 1880649 - DNA, 19 bp, Homo sapiens
agtacccccctgagagcat

SEQ ID NO: 1880650 - DNA, 19 bp, Homo sapiens
agtacccgttcacattttt

SEQ ID NO: 1880651 - DNA, 21 bp, Homo sapiens
agtagctggctgtactgccaa

SEQ ID NO: 1880652 - DNA, 15 bp, Homo sapiens
agtataaaactgctt

SEQ ID NO: 1880653 - DNA, 22 bp, Homo sapiens
agtatctcggacctttcagctg

SEQ ID NO: 1880654 - DNA, 13 bp, Homo sapiens
agtatctggctgg

SEQ ID NO: 1880655 - DNA, 16 bp, Homo sapiens
agtatctggctgggtt

SEQ ID NO: 1880656 - DNA, 12 bp, Homo sapiens
agtatgaaaata

SEQ ID NO: 1880657 - DNA, 21 bp, Homo sapiens
agtattagaataccacaggaa

SEQ ID NO: 1880658 - DNA, 15 bp, Homo sapiens
agtattgtccaggtc

SEQ ID NO: 1880659 - DNA, 16 bp, Homo sapiens
agtattgtccaggtct

SEQ ID NO: 1880660 - DNA, 19 bp, Homo sapiens
agtcaaattgtgtgaaagg

SEQ ID NO: 1880661 - DNA, 23 bp, Homo sapiens
agtcaatgttttcagttctcttg

SEQ ID NO: 1880662 - DNA, 16 bp, Homo sapiens
agtcaggaaagagaac

SEQ ID NO: 1880663 - DNA, 13 bp, Homo sapiens
agtcatgtgctgg

SEQ ID NO: 1880664 - DNA, 23 bp, Homo sapiens
agtcatttgtggttagaatcttg

SEQ ID NO: 1880665 - DNA, 15 bp, Homo sapiens
agtccgttgctgaaa

SEQ ID NO: 1880666 - DNA, 13 bp, Homo sapiens
agtcctctccacc

SEQ ID NO: 1880667 - DNA, 19 bp, Homo sapiens
agtcctctccacctagtgg

SEQ ID NO: 1880668 - DNA, 17 bp, Homo sapiens
agtcgcgctgcctgtgt

SEQ ID NO: 1880669 - DNA, 18 bp, Homo sapiens
agtctaaagtttacagta

SEQ ID NO: 1880670 - DNA, 18 bp, Homo sapiens
agtctatcaatcaactta

SEQ ID NO: 1880671 - DNA, 16 bp, Homo sapiens
agtctcatatcaggga

SEQ ID NO: 1880672 - DNA, 19 bp, Homo sapiens
agtctccccagatatggac

SEQ ID NO: 1880673 - DNA, 17 bp, Homo sapiens
agtctggagctgagcta

SEQ ID NO: 1880674 - DNA, 17 bp, Homo sapiens
agtctgtgtaactttaa

SEQ ID NO: 1880675 - DNA, 20 bp, Homo sapiens
agtgaaactcgttaatttgt

SEQ ID NO: 1880676 - DNA, 12 bp, Homo sapiens
agtgacatgaag

SEQ ID NO: 1880677 - DNA, 19 bp, Homo sapiens
agtgactcgggctcctgtg

SEQ ID NO: 1880678 - DNA, 20 bp, Homo sapiens
agtgactcgggctcctgtgc

SEQ ID NO: 1880679 - DNA, 17 bp, Homo sapiens
agtgcccattcctcacc

SEQ ID NO: 1880680 - DNA, 16 bp, Homo sapiens
agtgccgccgcctcgc

SEQ ID NO: 1880681 - DNA, 22 bp, Homo sapiens
agtgccgccgcctcgcccaccg

SEQ ID NO: 1880682 - DNA, 21 bp, Homo sapiens
agtgctggctccacgccctgg

SEQ ID NO: 1880683 - DNA, 20 bp, Homo sapiens
agtggcattggcagcaggtg

SEQ ID NO: 1880684 - DNA, 17 bp, Homo sapiens
agtggctgtccagtgcc

SEQ ID NO: 1880685 - DNA, 19 bp, Homo sapiens
agtggctgtccagtgccca

SEQ ID NO: 1880686 - DNA, 16 bp, Homo sapiens
agtgggtcccacttcc

SEQ ID NO: 1880687 - DNA, 21 bp, Homo sapiens
agtgggtcccacttcccctcc

SEQ ID NO: 1880688 - DNA, 14 bp, Homo sapiens
agtgtaataatgtt

SEQ ID NO: 1880689 - DNA, 19 bp, Homo sapiens
agtgtaattacctgtcatc

SEQ ID NO: 1880690 - DNA, 19 bp, Homo sapiens
agtgtacccccgcccaggc

SEQ ID NO: 1880691 - DNA, 22 bp, Homo sapiens
agtgtacccccgcccaggctgg

SEQ ID NO: 1880692 - DNA, 16 bp, Homo sapiens
agtgtcttcctgtggg

SEQ ID NO: 1880693 - DNA, 20 bp, Homo sapiens
agtgtgaatatatggtctgt

SEQ ID NO: 1880694 - DNA, 22 bp, Homo sapiens
attgctatgttttgacattttt

SEQ ID NO: 1880695 - DNA, 16 bp, Homo sapiens
attggagctcgtggaa

SEQ ID NO: 1880696 - DNA, 20 bp, Homo sapiens
attgggaaggaaatatattt

SEQ ID NO: 1880697 - DNA, 15 bp, Homo sapiens
attgggtatcaccac

SEQ ID NO: 1880698 - DNA, 13 bp, Homo sapiens
attgggtgtgccc

SEQ ID NO: 1880699 - DNA, 17 bp, Homo sapiens
attgggtgtgccctggc

SEQ ID NO: 1880700 - DNA, 13 bp, Homo sapiens
attgtctagtgaa

SEQ ID NO: 1880701 - DNA, 12 bp, Homo sapiens
attgtctcagag

SEQ ID NO: 1880702 - DNA, 14 bp, Homo sapiens
attgtctcagagca

SEQ ID NO: 1880703 - DNA, 12 bp, Homo sapiens
attgtgtgttag

SEQ ID NO: 1880704 - DNA, 15 bp, Homo sapiens
attgttgtcaaatgc

SEQ ID NO: 1880705 - DNA, 13 bp, Homo sapiens
atttaactgcctt

SEQ ID NO: 1880706 - DNA, 20 bp, Homo sapiens
atttaactggagctccgatt

SEQ ID NO: 1880707 - DNA, 22 bp, Homo sapiens
atttaccacttgtgttttgcaa

SEQ ID NO: 1880708 - DNA, 14 bp, Homo sapiens
atttaggtaaataa

SEQ ID NO: 1880709 - DNA, 15 bp, Homo sapiens
atttaggtaaataaa

SEQ ID NO: 1880710 - DNA, 19 bp, Homo sapiens
atttaggtaaataaagctc

SEQ ID NO: 1880711 - DNA, 19 bp, Homo sapiens
atttagtaaagtttgttga

SEQ ID NO: 1880712 - DNA, 21 bp, Homo sapiens
atttagtaaagtttgttgaaa

SEQ ID NO: 1880713 - DNA, 19 bp, Homo sapiens
atttatctgagtcaactcc

SEQ ID NO: 1880714 - DNA, 22 bp, Homo sapiens
atttattactgtaagaaaatat

SEQ ID NO: 1880715 - DNA, 15 bp, Homo sapiens
atttattttgtttaa

SEQ ID NO: 1880716 - DNA, 22 bp, Homo sapiens
atttccatataaatattagaaa

SEQ ID NO: 1880717 - DNA, 18 bp, Homo sapiens
atttcccgtggccccagc

SEQ ID NO: 1880718 - DNA, 22 bp, Homo sapiens
atttcccgtggccccagcctgg

SEQ ID NO: 1880719 - DNA, 23 bp, Homo sapiens
atttcccgtggccccagcctggc

SEQ ID NO: 1880720 - DNA, 18 bp, Homo sapiens
atttctatgaaatattat

SEQ ID NO: 1880721 - DNA, 11 bp, Homo sapiens
atttcttttac

SEQ ID NO: 1880722 - DNA, 17 bp, Homo sapiens
atttcttttactctgtg

SEQ ID NO: 1880723 - DNA, 20 bp, Homo sapiens
atttcttttactctgtgtaa

SEQ ID NO: 1880724 - DNA, 23 bp, Homo sapiens
atttgaatcagcctacaggcctc

SEQ ID NO: 1880725 - DNA, 19 bp, Homo sapiens
atttgaggagcagcttcag

SEQ ID NO: 1880726 - DNA, 23 bp, Homo sapiens
atttgaggagcagcttcagttgt

SEQ ID NO: 1880727 - DNA, 21 bp, Homo sapiens
atttgcagctgagagaaaata

SEQ ID NO: 1880728 - DNA, 22 bp, Homo sapiens
atttgcagctgagagaaaataa

SEQ ID NO: 1880729 - DNA, 17 bp, Homo sapiens
atttgctcatggaattg

SEQ ID NO: 1880730 - DNA, 23 bp, Homo sapiens
atttggtaaggggaattgaggac

SEQ ID NO: 1880731 - DNA, 18 bp, Homo sapiens
atttgtacagttcagttc

SEQ ID NO: 1880732 - DNA, 18 bp, Homo sapiens
atttgtagtgttggagaa

SEQ ID NO: 1880733 - DNA, 22 bp, Homo sapiens
atttgtagtgttggagaagaac

SEQ ID NO: 1880734 - DNA, 15 bp, Homo sapiens
atttgtataaaataa

SEQ ID NO: 1880735 - DNA, 19 bp, Homo sapiens
atttgtataaaataatttt

SEQ ID NO: 1880736 - DNA, 14 bp, Homo sapiens
atttgtatctgaag

SEQ ID NO: 1880737 - DNA, 22 bp, Homo sapiens
atttgtgggaggagtgacatga

SEQ ID NO: 1880738 - DNA, 23 bp, Homo sapiens
atttgtgggaggagtgacatgaa

SEQ ID NO: 1880739 - DNA, 19 bp, Homo sapiens
atttgttttcccgccaagc

SEQ ID NO: 1880740 - DNA, 17 bp, Homo sapiens
attttaaaagaatgatt

SEQ ID NO: 1880741 - DNA, 18 bp, Homo sapiens
attttaagccttcatttg

SEQ ID NO: 1880742 - DNA, 13 bp, Homo sapiens
attttaataatat

SEQ ID NO: 1880743 - DNA, 12 bp, Homo sapiens
attttaataatg

SEQ ID NO: 1880744 - DNA, 16 bp, Homo sapiens
attttagcttcagttg

SEQ ID NO: 1880745 - DNA, 10 bp, Homo sapiens
attttcttca

SEQ ID NO: 1880746 - DNA, 14 bp, Homo sapiens
attttgattttaca

SEQ ID NO: 1880747 - DNA, 21 bp, Homo sapiens
attttgtaattattgtgattt

SEQ ID NO: 1880748 - DNA, 18 bp, Homo sapiens
atttttaatatatactat

SEQ ID NO: 1880749 - DNA, 15 bp, Homo sapiens
atttttatatttgaa

SEQ ID NO: 1880750 - DNA, 16 bp, Homo sapiens
atttttatatttgaaa

SEQ ID NO: 1880751 - DNA, 17 bp, Homo sapiens
atttttatccatttctt

SEQ ID NO: 1880752 - DNA, 15 bp, Homo sapiens
atttttcacttcaaa

SEQ ID NO: 1880753 - DNA, 19 bp, Homo sapiens
atttttcatgattttgaaa

SEQ ID NO: 1880754 - DNA, 20 bp, Homo sapiens
atttttcctccactgaacta

SEQ ID NO: 1880755 - DNA, 17 bp, Homo sapiens
atttttgaatgtgattt

SEQ ID NO: 1880756 - DNA, 20 bp, Homo sapiens
attttttctctaggaaatat

SEQ ID NO: 1880757 - DNA, 19 bp, Homo sapiens
attttttttaaagtttggt

SEQ ID NO: 1880758 - DNA, 23 bp, Homo sapiens
atttttttttaacgtggcttgta

SEQ ID NO: 1880759 - DNA, 19 bp, Homo sapiens
caaaaatctcaatatttca

SEQ ID NO: 1880760 - DNA, 15 bp, Homo sapiens
caaaaattagccggg

SEQ ID NO: 1880761 - DNA, 16 bp, Homo sapiens
caaaattttttctcta

SEQ ID NO: 1880762 - DNA, 22 bp, Homo sapiens
caaaattttttctctaggaaat

SEQ ID NO: 1880763 - DNA, 16 bp, Homo sapiens
caaactgactcttaag

SEQ ID NO: 1880764 - DNA, 17 bp, Homo sapiens
caaactgactcttaaga

SEQ ID NO: 1880765 - DNA, 16 bp, Homo sapiens
caaagtactcctcact

SEQ ID NO: 1880766 - DNA, 16 bp, Homo sapiens
caaagtctaaagttta

SEQ ID NO: 1880767 - DNA, 19 bp, Homo sapiens
caaagtctaaagtttacag

SEQ ID NO: 1880768 - DNA, 20 bp, Homo sapiens
caaagtctaaagtttacagt

SEQ ID NO: 1880769 - DNA, 16 bp, Homo sapiens
caaataaacagttgtt

SEQ ID NO: 1880770 - DNA, 20 bp, Homo sapiens
caaataatttttcacttcaa

SEQ ID NO: 1880771 - DNA, 15 bp, Homo sapiens
caaatccttgaagat

SEQ ID NO: 1880772 - DNA, 12 bp, Homo sapiens
caaatgtattga

SEQ ID NO: 1880773 - DNA, 15 bp, Homo sapiens
caaattcatataaaa

SEQ ID NO: 1880774 - DNA, 16 bp, Homo sapiens
caacaaagaggacacc

SEQ ID NO: 1880775 - DNA, 22 bp, Homo sapiens
caacagtgttaggcctggcaca

SEQ ID NO: 1880776 - DNA, 17 bp, Homo sapiens
caacagtgttctgagcc

SEQ ID NO: 1880777 - DNA, 15 bp, Homo sapiens
caacccccagcaccc

SEQ ID NO: 1880778 - DNA, 22 bp, Homo sapiens
caacccctcccctccatccctg

SEQ ID NO: 1880779 - DNA, 14 bp, Homo sapiens
caacttgtgttcta

SEQ ID NO: 1880780 - DNA, 16 bp, Homo sapiens
caacttgtgttctatt

SEQ ID NO: 1880781 - DNA, 18 bp, Homo sapiens
caagaaaggcaagagctc

SEQ ID NO: 1880782 - DNA, 17 bp, Homo sapiens
caagatcacataccaga

SEQ ID NO: 1880783 - DNA, 14 bp, Homo sapiens
caagcaagtattag

SEQ ID NO: 1880784 - DNA, 19 bp, Homo sapiens
caagcccttccctctgttg

SEQ ID NO: 1880785 - DNA, 17 bp, Homo sapiens
caagcctggagcccctg

SEQ ID NO: 1880786 - DNA, 15 bp, Homo sapiens
caagctgtgccaccc

SEQ ID NO: 1880787 - DNA, 17 bp, Homo sapiens
caagcttaaggagagga

SEQ ID NO: 1880788 - DNA, 20 bp, Homo sapiens
caagcttaaggagaggagag

SEQ ID NO: 1880789 - DNA, 21 bp, Homo sapiens
caagcttaaggagaggagagc

SEQ ID NO: 1880790 - DNA, 23 bp, Homo sapiens
caagcttaaggagaggagagcat

SEQ ID NO: 1880791 - DNA, 19 bp, Homo sapiens
caaggaggctggctggggc

SEQ ID NO: 1880792 - DNA, 13 bp, Homo sapiens
caaggcacctgca

SEQ ID NO: 1880793 - DNA, 17 bp, Homo sapiens
caaggcctcccacagtg

SEQ ID NO: 1880794 - DNA, 13 bp, Homo sapiens
caaggtacctagg

SEQ ID NO: 1880795 - DNA, 14 bp, Homo sapiens
caagtagctggctg

SEQ ID NO: 1880796 - DNA, 14 bp, Homo sapiens
caagtattagaata

SEQ ID NO: 1880797 - DNA, 15 bp, Homo sapiens
caagtcaaatggaga

SEQ ID NO: 1880798 - DNA, 12 bp, Homo sapiens
caagtgcaagga

SEQ ID NO: 1880799 - DNA, 18 bp, Homo sapiens
caataaaaacattttgaa

SEQ ID NO: 1880800 - DNA, 22 bp, Homo sapiens
caataaaaacattttgaagtgt

SEQ ID NO: 1880801 - DNA, 23 bp, Homo sapiens
caataaaatccatacatttgtgt

SEQ ID NO: 1880802 - DNA, 16 bp, Homo sapiens
caataaatagaccatt

SEQ ID NO: 1880803 - DNA, 23 bp, Homo sapiens
caatacagaattgactgcagttg

SEQ ID NO: 1880804 - DNA, 22 bp, Homo sapiens
caatacccctagtatctggctg

SEQ ID NO: 1880805 - DNA, 17 bp, Homo sapiens
caatagtcaaattgtgt

SEQ ID NO: 1880806 - DNA, 21 bp, Homo sapiens
caatatttcagataatcacaa

SEQ ID NO: 1880807 - DNA, 12 bp, Homo sapiens
caatatttttct

SEQ ID NO: 1880808 - DNA, 16 bp, Homo sapiens
caatgcagtgcctttc

SEQ ID NO: 1880809 - DNA, 15 bp, Homo sapiens
caatgctgtatttta

SEQ ID NO: 1880810 - DNA, 14 bp, Homo sapiens
caattcatgtaaca

SEQ ID NO: 1880811 - DNA, 17 bp, Homo sapiens
caattcatgtaacagtt

SEQ ID NO: 1880812 - DNA, 13 bp, Homo sapiens
cacaactatattg

SEQ ID NO: 1880813 - DNA, 23 bp, Homo sapiens
cacacactcgggttaagaaatac

SEQ ID NO: 1880814 - DNA, 17 bp, Homo sapiens
atgcagttctgaagaag

SEQ ID NO: 1880815 - DNA, 19 bp, Homo sapiens
atgcagttctgaagaagat

SEQ ID NO: 1880816 - DNA, 13 bp, Homo sapiens
atgcattttcttc

SEQ ID NO: 1880817 - DNA, 20 bp, Homo sapiens
atgccacaccaagctgtgcc

SEQ ID NO: 1880818 - DNA, 23 bp, Homo sapiens
atgccacaccaagctgtgccacc

SEQ ID NO: 1880819 - DNA, 17 bp, Homo sapiens
atgccccctcgtgccag

SEQ ID NO: 1880820 - DNA, 18 bp, Homo sapiens
atgccccctcgtgccagt

SEQ ID NO: 1880821 - DNA, 22 bp, Homo sapiens
atgccttttcccaactccagaa

SEQ ID NO: 1880822 - DNA, 20 bp, Homo sapiens
atgctggttacctgttccat

SEQ ID NO: 1880823 - DNA, 21 bp, Homo sapiens
atgctggttacctgttccatt

SEQ ID NO: 1880824 - DNA, 22 bp, Homo sapiens
atgctggttacctgttccattg

SEQ ID NO: 1880825 - DNA, 22 bp, Homo sapiens
atgctgtattttaaaagaatga

SEQ ID NO: 1880826 - DNA, 23 bp, Homo sapiens
atgctgtctacactaagagagaa

SEQ ID NO: 1880827 - DNA, 15 bp, Homo sapiens
atggaaggagagagg

SEQ ID NO: 1880828 - DNA, 12 bp, Homo sapiens
atggaatttgta

SEQ ID NO: 1880829 - DNA, 21 bp, Homo sapiens
atggaatttgtaagtttatgt

SEQ ID NO: 1880830 - DNA, 23 bp, Homo sapiens
atggacgacctccagctctcagt

SEQ ID NO: 1880831 - DNA, 12 bp, Homo sapiens
atggagaggaga

SEQ ID NO: 1880832 - DNA, 16 bp, Homo sapiens
atggcttccaaggtgg

SEQ ID NO: 1880833 - DNA, 23 bp, Homo sapiens
atggcttcctggcaatagtcaaa

SEQ ID NO: 1880834 - DNA, 22 bp, Homo sapiens
atgggcactgctgggtggccca

SEQ ID NO: 1880835 - DNA, 18 bp, Homo sapiens
atgggggaggctctgaag

SEQ ID NO: 1880836 - DNA, 23 bp, Homo sapiens
atggtatcaataaatagaccatt

SEQ ID NO: 1880837 - DNA, 11 bp, Homo sapiens
atggtgcctga

SEQ ID NO: 1880838 - DNA, 22 bp, Homo sapiens
atggtgcctgattcggctgtct

SEQ ID NO: 1880839 - DNA, 13 bp, Homo sapiens
atggttaactaat

SEQ ID NO: 1880840 - DNA, 16 bp, Homo sapiens
atggttgtgaaatgta

SEQ ID NO: 1880841 - DNA, 20 bp, Homo sapiens
atggttgtgaaatgtaacat

SEQ ID NO: 1880842 - DNA, 23 bp, Homo sapiens
atggttgtgaaatgtaacatgaa

SEQ ID NO: 1880843 - DNA, 14 bp, Homo sapiens
atgtaacagttgtg

SEQ ID NO: 1880844 - DNA, 22 bp, Homo sapiens
atgtaactctatagttattgtt

SEQ ID NO: 1880845 - DNA, 18 bp, Homo sapiens
atgtatttttcttgctgt

SEQ ID NO: 1880846 - DNA, 22 bp, Homo sapiens
atgtcaccggtcagtgcctttt

SEQ ID NO: 1880847 - DNA, 22 bp, Homo sapiens
atgtcatgcctcactttcttct

SEQ ID NO: 1880848 - DNA, 18 bp, Homo sapiens
atgtctgcaggtttctcc

SEQ ID NO: 1880849 - DNA, 22 bp, Homo sapiens
atgtgtacaaaagtttcatcct

SEQ ID NO: 1880850 - DNA, 18 bp, Homo sapiens
atgtgtattacaaatatt

SEQ ID NO: 1880851 - DNA, 23 bp, Homo sapiens
atgtgttcctccattttcttatc

SEQ ID NO: 1880852 - DNA, 15 bp, Homo sapiens
attaaatgtctgaca

SEQ ID NO: 1880853 - DNA, 21 bp, Homo sapiens
attaaatgtctgacacattaa

SEQ ID NO: 1880854 - DNA, 23 bp, Homo sapiens
attaaatgtctgacacattaatg

SEQ ID NO: 1880855 - DNA, 15 bp, Homo sapiens
attaagtaatgataa

SEQ ID NO: 1880856 - DNA, 23 bp, Homo sapiens
attaagtaatgataactggaaac

SEQ ID NO: 1880857 - DNA, 17 bp, Homo sapiens
attaatattcctcagtt

SEQ ID NO: 1880858 - DNA, 20 bp, Homo sapiens
attacatttgtataaaataa

SEQ ID NO: 1880859 - DNA, 14 bp, Homo sapiens
attacgtgtatgtt

SEQ ID NO: 1880860 - DNA, 20 bp, Homo sapiens
attacgtgtatgtttcttct

SEQ ID NO: 1880861 - DNA, 20 bp, Homo sapiens
attacgtttaaagtgcagtc

SEQ ID NO: 1880862 - DNA, 17 bp, Homo sapiens
attactctacactgaaa

SEQ ID NO: 1880863 - DNA, 15 bp, Homo sapiens
attactctgaaattg

SEQ ID NO: 1880864 - DNA, 16 bp, Homo sapiens
attactgtaagaaaat

SEQ ID NO: 1880865 - DNA, 15 bp, Homo sapiens
attagagcttaaatt

SEQ ID NO: 1880866 - DNA, 16 bp, Homo sapiens
attagtaattgtaagt

SEQ ID NO: 1880867 - DNA, 22 bp, Homo sapiens
attataagccctgcataatgtt

SEQ ID NO: 1880868 - DNA, 20 bp, Homo sapiens
attatgaattacatttgtat

SEQ ID NO: 1880869 - DNA, 21 bp, Homo sapiens
attatgttaaaactgggacag

SEQ ID NO: 1880870 - DNA, 18 bp, Homo sapiens
attattactctacactga

SEQ ID NO: 1880871 - DNA, 12 bp, Homo sapiens
attattgagttc

SEQ ID NO: 1880872 - DNA, 16 bp, Homo sapiens
attattgagttcctcc

SEQ ID NO: 1880873 - DNA, 19 bp, Homo sapiens
attattttagcttcagttg

SEQ ID NO: 1880874 - DNA, 20 bp, Homo sapiens
attattttagcttcagttgt

SEQ ID NO: 1880875 - DNA, 21 bp, Homo sapiens
attattttagcttcagttgtt

SEQ ID NO: 1880876 - DNA, 13 bp, Homo sapiens
attcagaaaactt

SEQ ID NO: 1880877 - DNA, 19 bp, Homo sapiens
attcaggaaaagcctctgt

SEQ ID NO: 1880878 - DNA, 14 bp, Homo sapiens
attcatataaaagt

SEQ ID NO: 1880879 - DNA, 15 bp, Homo sapiens
attcatataaaagtt

SEQ ID NO: 1880880 - DNA, 16 bp, Homo sapiens
attcatataaaagttg

SEQ ID NO: 1880881 - DNA, 16 bp, Homo sapiens
attcatattttctttc

SEQ ID NO: 1880882 - DNA, 20 bp, Homo sapiens
attcatattttctttcaaaa

SEQ ID NO: 1880883 - DNA, 16 bp, Homo sapiens
attctgcctgcctggg

SEQ ID NO: 1880884 - DNA, 14 bp, Homo sapiens
attgactgcagttg

SEQ ID NO: 1880885 - DNA, 21 bp, Homo sapiens
attgagctggacctcaccaag

SEQ ID NO: 1880886 - DNA, 22 bp, Homo sapiens
attgaggagagggactgaatag

SEQ ID NO: 1880887 - DNA, 19 bp, Homo sapiens
attgatcggagcctcctct

SEQ ID NO: 1880888 - DNA, 14 bp, Homo sapiens
attgcatttccaga

SEQ ID NO: 1880889 - DNA, 21 bp, Homo sapiens
actgcagaggagccacctggg

SEQ ID NO: 1880890 - DNA, 23 bp, Homo sapiens
actgcagaggagccacctgggct

SEQ ID NO: 1880891 - DNA, 14 bp, Homo sapiens
actgcaggaagaga

SEQ ID NO: 1880892 - DNA, 14 bp, Homo sapiens
actgcattatattt

SEQ ID NO: 1880893 - DNA, 13 bp, Homo sapiens
actgccaaggtac

SEQ ID NO: 1880894 - DNA, 16 bp, Homo sapiens
actgcggggcttggct

SEQ ID NO: 1880895 - DNA, 18 bp, Homo sapiens
actgcggggcttggctga

SEQ ID NO: 1880896 - DNA, 18 bp, Homo sapiens
actgctgggtggcccatc

SEQ ID NO: 1880897 - DNA, 14 bp, Homo sapiens
actggaggcaggac

SEQ ID NO: 1880898 - DNA, 17 bp, Homo sapiens
actggcctcgcctggcc

SEQ ID NO: 1880899 - DNA, 23 bp, Homo sapiens
actggcctcgcctggcctgaggt

SEQ ID NO: 1880900 - DNA, 22 bp, Homo sapiens
actggcctgttctgtaggagag

SEQ ID NO: 1880901 - DNA, 14 bp, Homo sapiens
actggctgcctcca

SEQ ID NO: 1880902 - DNA, 21 bp, Homo sapiens
actggctgcctccactcccac

SEQ ID NO: 1880903 - DNA, 13 bp, Homo sapiens
actgtaagaaaat

SEQ ID NO: 1880904 - DNA, 22 bp, Homo sapiens
actgtaagaaaatatcacttgt

SEQ ID NO: 1880905 - DNA, 21 bp, Homo sapiens
actgtaggcgcccctggggtg

SEQ ID NO: 1880906 - DNA, 12 bp, Homo sapiens
actgtcctgctc

SEQ ID NO: 1880907 - DNA, 17 bp, Homo sapiens
actgtcctgctccacag

SEQ ID NO: 1880908 - DNA, 19 bp, Homo sapiens
actgtcctgctccacagtg

SEQ ID NO: 1880909 - DNA, 21 bp, Homo sapiens
actgtcttggctgtggggcta

SEQ ID NO: 1880910 - DNA, 16 bp, Homo sapiens
actgtttcttgcactg

SEQ ID NO: 1880911 - DNA, 15 bp, Homo sapiens
acttaaattcttttg

SEQ ID NO: 1880912 - DNA, 16 bp, Homo sapiens
acttaaattcttttga

SEQ ID NO: 1880913 - DNA, 15 bp, Homo sapiens
acttagaataaaatt

SEQ ID NO: 1880914 - DNA, 16 bp, Homo sapiens
acttagaataaaattg

SEQ ID NO: 1880915 - DNA, 17 bp, Homo sapiens
acttagaataaaattgt

SEQ ID NO: 1880916 - DNA, 15 bp, Homo sapiens
acttagctctgagga

SEQ ID NO: 1880917 - DNA, 16 bp, Homo sapiens
acttatattttgattt

SEQ ID NO: 1880918 - DNA, 17 bp, Homo sapiens
acttatattttgatttt

SEQ ID NO: 1880919 - DNA, 11 bp, Homo sapiens
acttatttgag

SEQ ID NO: 1880920 - DNA, 12 bp, Homo sapiens
acttatttgagt

SEQ ID NO: 1880921 - DNA, 18 bp, Homo sapiens
acttcaaatccttgaaga

SEQ ID NO: 1880922 - DNA, 17 bp, Homo sapiens
acttcagcggtttatat

SEQ ID NO: 1880923 - DNA, 18 bp, Homo sapiens
acttcagcggtttatata

SEQ ID NO: 1880924 - DNA, 19 bp, Homo sapiens
acttcagcggtttatataa

SEQ ID NO: 1880925 - DNA, 14 bp, Homo sapiens
acttcttccactgt

SEQ ID NO: 1880926 - DNA, 15 bp, Homo sapiens
acttcttccactgtg

SEQ ID NO: 1880927 - DNA, 15 bp, Homo sapiens
acttgagggtaataa

SEQ ID NO: 1880928 - DNA, 21 bp, Homo sapiens
acttgctgcagtatgaaaata

SEQ ID NO: 1880929 - DNA, 17 bp, Homo sapiens
acttgcttccaagccct

SEQ ID NO: 1880930 - DNA, 15 bp, Homo sapiens
acttgggtcttccct

SEQ ID NO: 1880931 - DNA, 16 bp, Homo sapiens
acttgtcaataaaatc

SEQ ID NO: 1880932 - DNA, 15 bp, Homo sapiens
actttaaacatctag

SEQ ID NO: 1880933 - DNA, 15 bp, Homo sapiens
actttcccaaatgta

SEQ ID NO: 1880934 - DNA, 16 bp, Homo sapiens
actttcccaaatgtat

SEQ ID NO: 1880935 - DNA, 21 bp, Homo sapiens
acttttccatgtatctacctc

SEQ ID NO: 1880936 - DNA, 20 bp, Homo sapiens
acttttttttttttaacatc

SEQ ID NO: 1880937 - DNA, 21 bp, Homo sapiens
acttttttttttttaacatct

SEQ ID NO: 1880938 - DNA, 22 bp, Homo sapiens
acttttttttttttaacatctt

SEQ ID NO: 1880939 - DNA, 16 bp, Homo sapiens
agaaaacatttaacat

SEQ ID NO: 1880940 - DNA, 17 bp, Homo sapiens
agaaaacatttaacata

SEQ ID NO: 1880941 - DNA, 15 bp, Homo sapiens
agaaaagaaaacatt

SEQ ID NO: 1880942 - DNA, 21 bp, Homo sapiens
agaaaagaaaacatttaacat

SEQ ID NO: 1880943 - DNA, 16 bp, Homo sapiens
agaaacacaactatat

SEQ ID NO: 1880944 - DNA, 14 bp, Homo sapiens
agaaacaggcccag

SEQ ID NO: 1880945 - DNA, 15 bp, Homo sapiens
agaaacatttggtaa

SEQ ID NO: 1880946 - DNA, 22 bp, Homo sapiens
agaaagaaaattagtaattgta

SEQ ID NO: 1880947 - DNA, 19 bp, Homo sapiens
agaaaggcaagagctcaag

SEQ ID NO: 1880948 - DNA, 17 bp, Homo sapiens
agaaagtgtgtgtgttc

SEQ ID NO: 1880949 - DNA, 22 bp, Homo sapiens
agaaagtgtgtgtgttctgtag

SEQ ID NO: 1880950 - DNA, 13 bp, Homo sapiens
agaagaactgaaa

SEQ ID NO: 1880951 - DNA, 14 bp, Homo sapiens
agaagaactgaaat

SEQ ID NO: 1880952 - DNA, 13 bp, Homo sapiens
agaagcagctctt

SEQ ID NO: 1880953 - DNA, 22 bp, Homo sapiens
agaagcccaaattcatataaaa

SEQ ID NO: 1880954 - DNA, 17 bp, Homo sapiens
agaatgatagaactttg

SEQ ID NO: 1880955 - DNA, 21 bp, Homo sapiens
agacacttatattttgatttt

SEQ ID NO: 1880956 - DNA, 23 bp, Homo sapiens
agacccccccccccaacagaaca

SEQ ID NO: 1880957 - DNA, 17 bp, Homo sapiens
agactatttaacttgag

SEQ ID NO: 1880958 - DNA, 21 bp, Homo sapiens
agactgcattatatttattac

SEQ ID NO: 1880959 - DNA, 17 bp, Homo sapiens
agactttcccaaatgta

SEQ ID NO: 1880960 - DNA, 18 bp, Homo sapiens
agagaaaacttatttgag

SEQ ID NO: 1880961 - DNA, 20 bp, Homo sapiens
agagaaaacttatttgagtg

SEQ ID NO: 1880962 - DNA, 13 bp, Homo sapiens
agagactggccag

SEQ ID NO: 1880963 - DNA, 12 bp, Homo sapiens
agagagcacctg

SEQ ID NO: 1880964 - DNA, 13 bp, Homo sapiens
agagatttttcat

SEQ ID NO: 1880965 - DNA, 11 bp, Homo sapiens
agagcacagcc

SEQ ID NO: 1880966 - DNA, 15 bp, Homo sapiens
agagcacagccctcc

SEQ ID NO: 1880967 - DNA, 18 bp, Homo sapiens
agagcaggtgctggctct

SEQ ID NO: 1880968 - DNA, 17 bp, Homo sapiens
agagcatctgctctgag

SEQ ID NO: 1880969 - DNA, 18 bp, Homo sapiens
agagcatgtgggggaagg

SEQ ID NO: 1880970 - DNA, 19 bp, Homo sapiens
agagcatgtgggggaaggc

SEQ ID NO: 1880971 - DNA, 20 bp, Homo sapiens
agagcctcctttctggcttt

SEQ ID NO: 1880972 - DNA, 21 bp, Homo sapiens
agaggagagcatctgctctga

SEQ ID NO: 1880973 - DNA, 22 bp, Homo sapiens
agaggagagcatctgctctgag

SEQ ID NO: 1880974 - DNA, 23 bp, Homo sapiens
agaggagagcatctgctctgaga

SEQ ID NO: 1880975 - DNA, 15 bp, Homo sapiens
agaggctatttaaaa

SEQ ID NO: 1880976 - DNA, 17 bp, Homo sapiens
agaggctttcaaatgta

SEQ ID NO: 1880977 - DNA, 16 bp, Homo sapiens
agagtacccccctgag

SEQ ID NO: 1880978 - DNA, 21 bp, Homo sapiens
agagtccttgcaaaattgtct

SEQ ID NO: 1880979 - DNA, 13 bp, Homo sapiens
agagtctggagct

SEQ ID NO: 1880980 - DNA, 17 bp, Homo sapiens
agagtttagctggaaaa

SEQ ID NO: 1880981 - DNA, 22 bp, Homo sapiens
agatatggaccatcagtgactc

SEQ ID NO: 1880982 - DNA, 15 bp, Homo sapiens
agatattaccagttt

SEQ ID NO: 1880983 - DNA, 23 bp, Homo sapiens
agatatttacatgaattgcattt

SEQ ID NO: 1880984 - DNA, 16 bp, Homo sapiens
agatatttttcatgat

SEQ ID NO: 1880985 - DNA, 15 bp, Homo sapiens
agatcacagtggcca

SEQ ID NO: 1880986 - DNA, 18 bp, Homo sapiens
agatccccagctttctcc

SEQ ID NO: 1880987 - DNA, 14 bp, Homo sapiens
agatcctggaaatc

SEQ ID NO: 1880988 - DNA, 17 bp, Homo sapiens
agatgaacatctgggga

SEQ ID NO: 1880989 - DNA, 16 bp, Homo sapiens
agatgagttgcagttt

SEQ ID NO: 1880990 - DNA, 17 bp, Homo sapiens
agatgagttgcagtttt

SEQ ID NO: 1880991 - DNA, 20 bp, Homo sapiens
agatgagttgcagtttttat

SEQ ID NO: 1880992 - DNA, 17 bp, Homo sapiens
agatgcagttctgaaga

SEQ ID NO: 1880993 - DNA, 21 bp, Homo sapiens
agatgcagttctgaagaagat

SEQ ID NO: 1880994 - DNA, 17 bp, Homo sapiens
agatgttggtggtgcag

SEQ ID NO: 1880995 - DNA, 16 bp, Homo sapiens
agatttaccacttgtg

SEQ ID NO: 1880996 - DNA, 18 bp, Homo sapiens
agatttccatataaatat

SEQ ID NO: 1880997 - DNA, 15 bp, Homo sapiens
agattttcctgaaaa

SEQ ID NO: 1880998 - DNA, 15 bp, Homo sapiens
agcaaagtctaaagt

SEQ ID NO: 1880999 - DNA, 14 bp, Homo sapiens
agcaaattagtaat

SEQ ID NO: 1881000 - DNA, 17 bp, Homo sapiens
agcaaggaggctggctg

SEQ ID NO: 1881001 - DNA, 19 bp, Homo sapiens
agcacagcaaggaggctgg

SEQ ID NO: 1881002 - DNA, 23 bp, Homo sapiens
agcacagcaaggaggctggctgg

SEQ ID NO: 1881003 - DNA, 14 bp, Homo sapiens
agcacagccctccc

SEQ ID NO: 1881004 - DNA, 15 bp, Homo sapiens
agcacagccctcccg

SEQ ID NO: 1881005 - DNA, 15 bp, Homo sapiens
agcacccgggctcag

SEQ ID NO: 1881006 - DNA, 22 bp, Homo sapiens
agcacctcaagtgcaaggacca

SEQ ID NO: 1881007 - DNA, 17 bp, Homo sapiens
agcacgtggtaaaacac

SEQ ID NO: 1881008 - DNA, 21 bp, Homo sapiens
agcagacccatacctttccag

SEQ ID NO: 1881009 - DNA, 20 bp, Homo sapiens
agcagactttcccaaatgta

SEQ ID NO: 1881010 - DNA, 21 bp, Homo sapiens
agcagactttcccaaatgtat

SEQ ID NO: 1881011 - DNA, 21 bp, Homo sapiens
agcaggctgcagcaggcagag

SEQ ID NO: 1881012 - DNA, 18 bp, Homo sapiens
agcaggtgctgctaccct

SEQ ID NO: 1881013 - DNA, 20 bp, Homo sapiens
agcaggtgctgctaccctcc

SEQ ID NO: 1881014 - DNA, 19 bp, Homo sapiens
agcagtaaatacttgcagt

SEQ ID NO: 1881015 - DNA, 18 bp, Homo sapiens
agcagtcaggaaagagaa

SEQ ID NO: 1881016 - DNA, 22 bp, Homo sapiens
agcatgtgggggaaggccttgc

SEQ ID NO: 1881017 - DNA, 14 bp, Homo sapiens
agcattctgcctgc

SEQ ID NO: 1881018 - DNA, 21 bp, Homo sapiens
agcattctgcctgcctgggaa

SEQ ID NO: 1881019 - DNA, 14 bp, Homo sapiens
agccaatatttttc

SEQ ID NO: 1881020 - DNA, 22 bp, Homo sapiens
agccacacaagggtcctttctc

SEQ ID NO: 1881021 - DNA, 14 bp, Homo sapiens
agccacctgggctg

SEQ ID NO: 1881022 - DNA, 19 bp, Homo sapiens
agccagattttcctgaaaa

SEQ ID NO: 1881023 - DNA, 23 bp, Homo sapiens
agccagttggcttctgtgcctga

SEQ ID NO: 1881024 - DNA, 14 bp, Homo sapiens
agcccacgtcctgt

SEQ ID NO: 1881025 - DNA, 15 bp, Homo sapiens
agcccacgtcctgtc

SEQ ID NO: 1881026 - DNA, 22 bp, Homo sapiens
agcccaggattgtacgtgggag

SEQ ID NO: 1881027 - DNA, 11 bp, Homo sapiens
agccccaggac

SEQ ID NO: 1881028 - DNA, 17 bp, Homo sapiens
agcccccacctgcctga

SEQ ID NO: 1881029 - DNA, 11 bp, Homo sapiens
agcccctgtgt

SEQ ID NO: 1881030 - DNA, 12 bp, Homo sapiens
agcccctgtgtc

SEQ ID NO: 1881031 - DNA, 23 bp, Homo sapiens
agcccctgtgtgggagggcgagg

SEQ ID NO: 1881032 - DNA, 23 bp, Homo sapiens
agccctccttcttgccctgagct

SEQ ID NO: 1881033 - DNA, 16 bp, Homo sapiens
agccctgcataatgtt

SEQ ID NO: 1881034 - DNA, 18 bp, Homo sapiens
agccctgcataatgttaa

SEQ ID NO: 1881035 - DNA, 19 bp, Homo sapiens
agcccttctttccacagaa

SEQ ID NO: 1881036 - DNA, 12 bp, Homo sapiens
agccgctgcccg

SEQ ID NO: 1881037 - DNA, 22 bp, Homo sapiens
agccgctgcccggcgccctctg

SEQ ID NO: 1881038 - DNA, 13 bp, Homo sapiens
agcctacaggcct

SEQ ID NO: 1881039 - DNA, 18 bp, Homo sapiens
agcctccgttcccacctc

SEQ ID NO: 1881040 - DNA, 12 bp, Homo sapiens
agcctctgctct

SEQ ID NO: 1881041 - DNA, 11 bp, Homo sapiens
agcctctgtgt

SEQ ID NO: 1881042 - DNA, 13 bp, Homo sapiens
agcctctgtgtca

SEQ ID NO: 1881043 - DNA, 20 bp, Homo sapiens
agcctctgtgtcactggctg

SEQ ID NO: 1881044 - DNA, 15 bp, Homo sapiens
agcctgccccagctg

SEQ ID NO: 1881045 - DNA, 19 bp, Homo sapiens
agcctgccccagctgggct

SEQ ID NO: 1881046 - DNA, 20 bp, Homo sapiens
agcctgccccagctgggctg

SEQ ID NO: 1881047 - DNA, 11 bp, Homo sapiens
agcctggagcc

SEQ ID NO: 1881048 - DNA, 15 bp, Homo sapiens
agcctggagcccctg

SEQ ID NO: 1881049 - DNA, 16 bp, Homo sapiens
agcctggagcccctgt

SEQ ID NO: 1881050 - DNA, 13 bp, Homo sapiens
agcctggcccagc

SEQ ID NO: 1881051 - DNA, 15 bp, Homo sapiens
agcctggcccagctc

SEQ ID NO: 1881052 - DNA, 19 bp, Homo sapiens
agcgctagaggaagcagcc

SEQ ID NO: 1881053 - DNA, 20 bp, Homo sapiens
agcgctagaggaagcagcca

SEQ ID NO: 1881054 - DNA, 22 bp, Homo sapiens
agcggaaaaggttttattttgt

SEQ ID NO: 1881055 - DNA, 17 bp, Homo sapiens
agctacatagcagactt

SEQ ID NO: 1881056 - DNA, 11 bp, Homo sapiens
agctacctggg

SEQ ID NO: 1881057 - DNA, 14 bp, Homo sapiens
agctacctggggtg

SEQ ID NO: 1881058 - DNA, 18 bp, Homo sapiens
agctccggaatagatgtc

SEQ ID NO: 1881059 - DNA, 21 bp, Homo sapiens
agctccttgagggcaagagcc

SEQ ID NO: 1881060 - DNA, 12 bp, Homo sapiens
agctctgagccc

SEQ ID NO: 1881061 - DNA, 14 bp, Homo sapiens
agctctgagccctc

SEQ ID NO: 1881062 - DNA, 19 bp, Homo sapiens
agctcttaaaaagacactt

SEQ ID NO: 1881063 - DNA, 21 bp, Homo sapiens
agctgacagtcctctccacct

SEQ ID NO: 1881064 - DNA, 20 bp, Homo sapiens
agctgcagagagcacctggt

SEQ ID NO: 1881065 - DNA, 20 bp, Homo sapiens
agctgcctggaagagcagcc

SEQ ID NO: 1881066 - DNA, 17 bp, Homo sapiens
cacaccaagctgtgcca

SEQ ID NO: 1881067 - DNA, 23 bp, Homo sapiens
cacaccaagctgtgccaccctgg

SEQ ID NO: 1881068 - DNA, 19 bp, Homo sapiens
cacagaagtgctttcttct

SEQ ID NO: 1881069 - DNA, 22 bp, Homo sapiens
cacagagtgtggtccctccact

SEQ ID NO: 1881070 - DNA, 15 bp, Homo sapiens
cacagcaaggcacct

SEQ ID NO: 1881071 - DNA, 17 bp, Homo sapiens
cacagcccacgtcctgt

SEQ ID NO: 1881072 - DNA, 11 bp, Homo sapiens
cacagccctcc

SEQ ID NO: 1881073 - DNA, 20 bp, Homo sapiens
cacaggaaccacaagactgc

SEQ ID NO: 1881074 - DNA, 17 bp, Homo sapiens
cacaggacccagaaaaa

SEQ ID NO: 1881075 - DNA, 18 bp, Homo sapiens
cacagtgactcgggctcc

SEQ ID NO: 1881076 - DNA, 20 bp, Homo sapiens
cacagtgactcgggctcctg

SEQ ID NO: 1881077 - DNA, 16 bp, Homo sapiens
cacagtgcagcttgca

SEQ ID NO: 1881078 - DNA, 14 bp, Homo sapiens
cacagtggtctgga

SEQ ID NO: 1881079 - DNA, 14 bp, Homo sapiens
cacagtgtctgggc

SEQ ID NO: 1881080 - DNA, 16 bp, Homo sapiens
cacagtgtctgggctg

SEQ ID NO: 1881081 - DNA, 13 bp, Homo sapiens
cacagtgtttata

SEQ ID NO: 1881082 - DNA, 18 bp, Homo sapiens
cacataccagagtctgga

SEQ ID NO: 1881083 - DNA, 13 bp, Homo sapiens
cacatgcccgctg

SEQ ID NO: 1881084 - DNA, 18 bp, Homo sapiens
cacatgggtgaacactca

SEQ ID NO: 1881085 - DNA, 21 bp, Homo sapiens
caccaagctgtgccaccctgg

SEQ ID NO: 1881086 - DNA, 22 bp, Homo sapiens
caccactatagtgtaataatgt

SEQ ID NO: 1881087 - DNA, 15 bp, Homo sapiens
caccagctccactgg

SEQ ID NO: 1881088 - DNA, 23 bp, Homo sapiens
caccagtgtgtggctttcagagc

SEQ ID NO: 1881089 - DNA, 23 bp, Homo sapiens
caccagttgaactgcaggaagag

SEQ ID NO: 1881090 - DNA, 14 bp, Homo sapiens
caccatttaaaaat

SEQ ID NO: 1881091 - DNA, 17 bp, Homo sapiens
caccatttaaaaatgtt

SEQ ID NO: 1881092 - DNA, 15 bp, Homo sapiens
caccccctcctgctg

SEQ ID NO: 1881093 - DNA, 16 bp, Homo sapiens
caccccctcctgctgc

SEQ ID NO: 1881094 - DNA, 21 bp, Homo sapiens
caccctgggctctgtgggctg

SEQ ID NO: 1881095 - DNA, 13 bp, Homo sapiens
cacccttggactt

SEQ ID NO: 1881096 - DNA, 16 bp, Homo sapiens
cacccttggacttgag

SEQ ID NO: 1881097 - DNA, 16 bp, Homo sapiens
caccgcatgccccctc

SEQ ID NO: 1881098 - DNA, 15 bp, Homo sapiens
caccggtcagtgcct

SEQ ID NO: 1881099 - DNA, 18 bp, Homo sapiens
caccggtcagtgcctttt

SEQ ID NO: 1881100 - DNA, 15 bp, Homo sapiens
cacctagtggctgtc

SEQ ID NO: 1881101 - DNA, 16 bp, Homo sapiens
cacctagtggctgtcc

SEQ ID NO: 1881102 - DNA, 18 bp, Homo sapiens
cacctagtggctgtccag

SEQ ID NO: 1881103 - DNA, 23 bp, Homo sapiens
cacctcaagtgcaaggaccaaag

SEQ ID NO: 1881104 - DNA, 18 bp, Homo sapiens
cacctctgaggactctgg

SEQ ID NO: 1881105 - DNA, 20 bp, Homo sapiens
cacctctgggccctgcagga

SEQ ID NO: 1881106 - DNA, 18 bp, Homo sapiens
cacctgcaggttgggcca

SEQ ID NO: 1881107 - DNA, 11 bp, Homo sapiens
cacctgcctga

SEQ ID NO: 1881108 - DNA, 11 bp, Homo sapiens
cacctgggctg

SEQ ID NO: 1881109 - DNA, 21 bp, Homo sapiens
cacgaggtggtagctctgagc

SEQ ID NO: 1881110 - DNA, 15 bp, Homo sapiens
cacggggtattttag

SEQ ID NO: 1881111 - DNA, 14 bp, Homo sapiens
cacgtcctgtcagt

SEQ ID NO: 1881112 - DNA, 17 bp, Homo sapiens
cactaagagagaatgag

SEQ ID NO: 1881113 - DNA, 19 bp, Homo sapiens
cactagtatttctatgaaa

SEQ ID NO: 1881114 - DNA, 15 bp, Homo sapiens
cactatgctgctatg

SEQ ID NO: 1881115 - DNA, 19 bp, Homo sapiens
cactccacagtgtttatat

SEQ ID NO: 1881116 - DNA, 13 bp, Homo sapiens
cactcccacttcc

SEQ ID NO: 1881117 - DNA, 18 bp, Homo sapiens
cactcgggttaagaaata

SEQ ID NO: 1881118 - DNA, 24 bp, Homo sapiens
cactctcactatgctgctatggac

SEQ ID NO: 1881119 - DNA, 12 bp, Homo sapiens
cactctgtgccc

SEQ ID NO: 1881120 - DNA, 21 bp, Homo sapiens
cactctgtgcccatgggcact

SEQ ID NO: 1881121 - DNA, 19 bp, Homo sapiens
cactctgtggtccagagtc

SEQ ID NO: 1881122 - DNA, 11 bp, Homo sapiens
cactgaagaag

SEQ ID NO: 1881123 - DNA, 20 bp, Homo sapiens
cactgaatatataaacactc

SEQ ID NO: 1881124 - DNA, 13 bp, Homo sapiens
cactgcaccccct

SEQ ID NO: 1881125 - DNA, 15 bp, Homo sapiens
cactgcaccccctcc

SEQ ID NO: 1881126 - DNA, 20 bp, Homo sapiens
cactgcaccccctcctgctg

SEQ ID NO: 1881127 - DNA, 21 bp, Homo sapiens
cactgcaccccctcctgctgc

SEQ ID NO: 1881128 - DNA, 19 bp, Homo sapiens
cactgcggggcttggctga

SEQ ID NO: 1881129 - DNA, 14 bp, Homo sapiens
cactgctgggtggc

SEQ ID NO: 1881130 - DNA, 22 bp, Homo sapiens
cactgctgggtggcccatcccc

SEQ ID NO: 1881131 - DNA, 10 bp, Homo sapiens
cactggcctg

SEQ ID NO: 1881132 - DNA, 21 bp, Homo sapiens
cactggcctgttctgtaggag

SEQ ID NO: 1881133 - DNA, 20 bp, Homo sapiens
cactggctgcctccactccc

SEQ ID NO: 1881134 - DNA, 21 bp, Homo sapiens
cactggctgcctccactccca

SEQ ID NO: 1881135 - DNA, 17 bp, Homo sapiens
cactgtgtgttgacact

SEQ ID NO: 1881136 - DNA, 13 bp, Homo sapiens
cagaagcagctct

SEQ ID NO: 1881137 - DNA, 22 bp, Homo sapiens
cagaatagaatacattgataca

SEQ ID NO: 1881138 - DNA, 12 bp, Homo sapiens
cagaatgctgtt

SEQ ID NO: 1881139 - DNA, 18 bp, Homo sapiens
cagaatgctgttttaaaa

SEQ ID NO: 1881140 - DNA, 22 bp, Homo sapiens
cagaattgactgcagttgaaca

SEQ ID NO: 1881141 - DNA, 19 bp, Homo sapiens
cagacccatacctttccag

SEQ ID NO: 1881142 - DNA, 16 bp, Homo sapiens
cagactagaagtattt

SEQ ID NO: 1881143 - DNA, 18 bp, Homo sapiens
cagactttcccaaatgta

SEQ ID NO: 1881144 - DNA, 16 bp, Homo sapiens
cagaggggcaggccct

SEQ ID NO: 1881145 - DNA, 17 bp, Homo sapiens
cagagtcaactgttccc

SEQ ID NO: 1881146 - DNA, 14 bp, Homo sapiens
cagagtctggagct

SEQ ID NO: 1881147 - DNA, 23 bp, Homo sapiens
cagcaaggcacctgcaggttggg

SEQ ID NO: 1881148 - DNA, 21 bp, Homo sapiens
cagcacagcaaggaggctggc

SEQ ID NO: 1881149 - DNA, 22 bp, Homo sapiens
cagcacagcctcttagatgcag

SEQ ID NO: 1881150 - DNA, 15 bp, Homo sapiens
cagcaggcagaggag

SEQ ID NO: 1881151 - DNA, 16 bp, Homo sapiens
cagcaggcagaggaga

SEQ ID NO: 1881152 - DNA, 14 bp, Homo sapiens
cagcaggtgctgct

SEQ ID NO: 1881153 - DNA, 23 bp, Homo sapiens
cagcaggtgctgctaccctccct

SEQ ID NO: 1881154 - DNA, 22 bp, Homo sapiens
cagccaagtcggttagtggaag

SEQ ID NO: 1881155 - DNA, 12 bp, Homo sapiens
cagccccacagc

SEQ ID NO: 1881156 - DNA, 13 bp, Homo sapiens
cagccccacagcc

SEQ ID NO: 1881157 - DNA, 14 bp, Homo sapiens
cagccccacagccc

SEQ ID NO: 1881158 - DNA, 16 bp, Homo sapiens
cagccccacagcccac

SEQ ID NO: 1881159 - DNA, 20 bp, Homo sapiens
cagccctcccgccccttccc

SEQ ID NO: 1881160 - DNA, 16 bp, Homo sapiens
cagccgctgcccggcg

SEQ ID NO: 1881161 - DNA, 22 bp, Homo sapiens
cagccgctgcccggcgccctct

SEQ ID NO: 1881162 - DNA, 16 bp, Homo sapiens
cagcctaatcaagtca

SEQ ID NO: 1881163 - DNA, 14 bp, Homo sapiens
cagcctacaggcct

SEQ ID NO: 1881164 - DNA, 12 bp, Homo sapiens
cagcctccagag

SEQ ID NO: 1881165 - DNA, 17 bp, Homo sapiens
cagctaaggggcaggaa

SEQ ID NO: 1881166 - DNA, 12 bp, Homo sapiens
cagctcccccgg

SEQ ID NO: 1881167 - DNA, 16 bp, Homo sapiens
cagctctgctatgagt

SEQ ID NO: 1881168 - DNA, 18 bp, Homo sapiens
cagctctgctatgagtgt

SEQ ID NO: 1881169 - DNA, 16 bp, Homo sapiens
cagctgacagtcctct

SEQ ID NO: 1881170 - DNA, 17 bp, Homo sapiens
cagctgagagaaaataa

SEQ ID NO: 1881171 - DNA, 22 bp, Homo sapiens
cagctgcctggaagagcagccc

SEQ ID NO: 1881172 - DNA, 11 bp, Homo sapiens
cagctgggctg

SEQ ID NO: 1881173 - DNA, 18 bp, Homo sapiens
cagctgtatgattcccag

SEQ ID NO: 1881174 - DNA, 14 bp, Homo sapiens
cagcttctgccact

SEQ ID NO: 1881175 - DNA, 23 bp, Homo sapiens
cagcttctgccacttcccaggta

SEQ ID NO: 1881176 - DNA, 14 bp, Homo sapiens
cagcttctgctggg

SEQ ID NO: 1881177 - DNA, 16 bp, Homo sapiens
cagcttctgctgggct

SEQ ID NO: 1881178 - DNA, 18 bp, Homo sapiens
cagctttcagctcttaaa

SEQ ID NO: 1881179 - DNA, 17 bp, Homo sapiens
cagctttttaccaagtt

SEQ ID NO: 1881180 - DNA, 18 bp, Homo sapiens
caggaaaagcctctgtgt

SEQ ID NO: 1881181 - DNA, 19 bp, Homo sapiens
caggaaaagcctctgtgtc

SEQ ID NO: 1881182 - DNA, 23 bp, Homo sapiens
caggaccaagcttaaggagagga

SEQ ID NO: 1881183 - DNA, 22 bp, Homo sapiens
caggacggggccggccaggtgg

SEQ ID NO: 1881184 - DNA, 14 bp, Homo sapiens
caggaggcctggga

SEQ ID NO: 1881185 - DNA, 18 bp, Homo sapiens
caggattctgggaggctt

SEQ ID NO: 1881186 - DNA, 17 bp, Homo sapiens
caggattgtacgtggga

SEQ ID NO: 1881187 - DNA, 19 bp, Homo sapiens
gcctcttaaataaaccttt

SEQ ID NO: 1881188 - DNA, 16 bp, Homo sapiens
gcctgactctgtgctg

SEQ ID NO: 1881189 - DNA, 17 bp, Homo sapiens
gcctgaggtctcgctga

SEQ ID NO: 1881190 - DNA, 15 bp, Homo sapiens
gcctgatggagagga

SEQ ID NO: 1881191 - DNA, 20 bp, Homo sapiens
gcctgattcggctgtctcag

SEQ ID NO: 1881192 - DNA, 15 bp, Homo sapiens
gcctgccccagctgg

SEQ ID NO: 1881193 - DNA, 21 bp, Homo sapiens
gcctgcccgttgccgggcctg

SEQ ID NO: 1881194 - DNA, 12 bp, Homo sapiens
gcctgcctggga

SEQ ID NO: 1881195 - DNA, 18 bp, Homo sapiens
gcctgctctccttgccct

SEQ ID NO: 1881196 - DNA, 21 bp, Homo sapiens
gcctgctctccttgccctggg

SEQ ID NO: 1881197 - DNA, 22 bp, Homo sapiens
gcctgctctccttgccctgggc

SEQ ID NO: 1881198 - DNA, 17 bp, Homo sapiens
gcctggaagagcagccc

SEQ ID NO: 1881199 - DNA, 16 bp, Homo sapiens
gcctggcacagtgtct

SEQ ID NO: 1881200 - DNA, 23 bp, Homo sapiens
gcctggcacagtgtctgggctga

SEQ ID NO: 1881201 - DNA, 20 bp, Homo sapiens
gcctgggtggcagagtgaga

SEQ ID NO: 1881202 - DNA, 21 bp, Homo sapiens
gcctgttagcatgctggtgag

SEQ ID NO: 1881203 - DNA, 17 bp, Homo sapiens
gcctgttctgtaggaga

SEQ ID NO: 1881204 - DNA, 16 bp, Homo sapiens
gccttccgctcccacc

SEQ ID NO: 1881205 - DNA, 17 bp, Homo sapiens
gccttccgctcccacca

SEQ ID NO: 1881206 - DNA, 21 bp, Homo sapiens
gccttccgctcccaccagccc

SEQ ID NO: 1881207 - DNA, 19 bp, Homo sapiens
gccttggcccacctgaggc

SEQ ID NO: 1881208 - DNA, 12 bp, Homo sapiens
gcctttccaggg

SEQ ID NO: 1881209 - DNA, 18 bp, Homo sapiens
gccttttataaacctcta

SEQ ID NO: 1881210 - DNA, 19 bp, Homo sapiens
gcgaccccatctgcccagg

SEQ ID NO: 1881211 - DNA, 21 bp, Homo sapiens
gcgaccccatctgcccaggac

SEQ ID NO: 1881212 - DNA, 19 bp, Homo sapiens
gcgaggcgggggagcctgg

SEQ ID NO: 1881213 - DNA, 20 bp, Homo sapiens
gcgaggcgggggagcctgga

SEQ ID NO: 1881214 - DNA, 24 bp, Homo sapiens
gcgaggcgggggagcctggagccc

SEQ ID NO: 1881215 - DNA, 21 bp, Homo sapiens
gcgaggcgggggatcctggag

SEQ ID NO: 1881216 - DNA, 22 bp, Homo sapiens
gcgaggcgggggatcctggagc

SEQ ID NO: 1881217 - DNA, 11 bp, Homo sapiens
gcgagggaggg

SEQ ID NO: 1881218 - DNA, 12 bp, Homo sapiens
gcgagggagggg

SEQ ID NO: 1881219 - DNA, 16 bp, Homo sapiens
gcgcaccctcccctcc

SEQ ID NO: 1881220 - DNA, 12 bp, Homo sapiens
gcgcccctgggg

SEQ ID NO: 1881221 - DNA, 14 bp, Homo sapiens
gcgctgcctgtgtg

SEQ ID NO: 1881222 - DNA, 14 bp, Homo sapiens
gcgggcagcacagc

SEQ ID NO: 1881223 - DNA, 11 bp, Homo sapiens
gcgggggagcc

SEQ ID NO: 1881224 - DNA, 16 bp, Homo sapiens
gcgggggagcctggag

SEQ ID NO: 1881225 - DNA, 13 bp, Homo sapiens
gcggtgaggcagg

SEQ ID NO: 1881226 - DNA, 15 bp, Homo sapiens
gcgtttaagttgtat

SEQ ID NO: 1881227 - DNA, 14 bp, Homo sapiens
gctaagcattccaa

SEQ ID NO: 1881228 - DNA, 14 bp, Homo sapiens
gctaaggggcagga

SEQ ID NO: 1881229 - DNA, 13 bp, Homo sapiens
gctagatgtatgt

SEQ ID NO: 1881230 - DNA, 14 bp, Homo sapiens
gctatattttcatg

SEQ ID NO: 1881231 - DNA, 12 bp, Homo sapiens
gctatgcatttt

SEQ ID NO: 1881232 - DNA, 19 bp, Homo sapiens
gctatgcattttcttcaca

SEQ ID NO: 1881233 - DNA, 19 bp, Homo sapiens
gctatgttttgacattttt

SEQ ID NO: 1881234 - DNA, 16 bp, Homo sapiens
gctatttaaaagtata

SEQ ID NO: 1881235 - DNA, 21 bp, Homo sapiens
gctcacacggggtattttagg

SEQ ID NO: 1881236 - DNA, 16 bp, Homo sapiens
gctcaggatattcact

SEQ ID NO: 1881237 - DNA, 20 bp, Homo sapiens
gctcagggaccacagcaagg

SEQ ID NO: 1881238 - DNA, 16 bp, Homo sapiens
gctccaaaccctcgag

SEQ ID NO: 1881239 - DNA, 18 bp, Homo sapiens
gctccaaaccctcgaggc

SEQ ID NO: 1881240 - DNA, 18 bp, Homo sapiens
gctccacgccctggggag

SEQ ID NO: 1881241 - DNA, 18 bp, Homo sapiens
gctccactggcctgcccg

SEQ ID NO: 1881242 - DNA, 16 bp, Homo sapiens
gctcccaccagcccac

SEQ ID NO: 1881243 - DNA, 18 bp, Homo sapiens
gctcccaccagcccacat

SEQ ID NO: 1881244 - DNA, 13 bp, Homo sapiens
gctcccagtgtct

SEQ ID NO: 1881245 - DNA, 23 bp, Homo sapiens
gctcccagtgtcttcctgtgggg

SEQ ID NO: 1881246 - DNA, 15 bp, Homo sapiens
gctcctgctgcacca

SEQ ID NO: 1881247 - DNA, 12 bp, Homo sapiens
gctcctgtgccc

SEQ ID NO: 1881248 - DNA, 15 bp, Homo sapiens
gctcctgtgccctta

SEQ ID NO: 1881249 - DNA, 15 bp, Homo sapiens
gctcgggcccaggcc

SEQ ID NO: 1881250 - DNA, 17 bp, Homo sapiens
gctctccttgccctggg

SEQ ID NO: 1881251 - DNA, 20 bp, Homo sapiens
gctctccttgccctgggcca

SEQ ID NO: 1881252 - DNA, 12 bp, Homo sapiens
gctctgtgggct

SEQ ID NO: 1881253 - DNA, 20 bp, Homo sapiens
gctctgttgcaggtgtccgg

SEQ ID NO: 1881254 - DNA, 16 bp, Homo sapiens
gctcttaaaaagacac

SEQ ID NO: 1881255 - DNA, 13 bp, Homo sapiens
gctcttgcctgta

SEQ ID NO: 1881256 - DNA, 19 bp, Homo sapiens
gctgacagtcctctccacc

SEQ ID NO: 1881257 - DNA, 14 bp, Homo sapiens
gctgagctgtgccc

SEQ ID NO: 1881258 - DNA, 23 bp, Homo sapiens
gctgagtttgcacagtggtctgg

SEQ ID NO: 1881259 - DNA, 20 bp, Homo sapiens
gctgatgctgggctgggtgc

SEQ ID NO: 1881260 - DNA, 13 bp, Homo sapiens
gctgcaccaaccc

SEQ ID NO: 1881261 - DNA, 18 bp, Homo sapiens
gctgcaccaacccagccg

SEQ ID NO: 1881262 - DNA, 17 bp, Homo sapiens
gctgcactctgtgccca

SEQ ID NO: 1881263 - DNA, 12 bp, Homo sapiens
gctgcagagggg

SEQ ID NO: 1881264 - DNA, 15 bp, Homo sapiens
gctgcagaggggcag

SEQ ID NO: 1881265 - DNA, 21 bp, Homo sapiens
gctgcagaggggcaggccctg

SEQ ID NO: 1881266 - DNA, 14 bp, Homo sapiens
gctgcagcaggcag

SEQ ID NO: 1881267 - DNA, 15 bp, Homo sapiens
gctgcagcaggcaga

SEQ ID NO: 1881268 - DNA, 16 bp, Homo sapiens
gctgcagcaggcagag

SEQ ID NO: 1881269 - DNA, 22 bp, Homo sapiens
gctgcagcaggcagaggagagt

SEQ ID NO: 1881270 - DNA, 14 bp, Homo sapiens
gctgcccgctccca

SEQ ID NO: 1881271 - DNA, 20 bp, Homo sapiens
gctgcccgctcccagtgtct

SEQ ID NO: 1881272 - DNA, 18 bp, Homo sapiens
gctgcccggcgccctctg

SEQ ID NO: 1881273 - DNA, 12 bp, Homo sapiens
gctgcctccact

SEQ ID NO: 1881274 - DNA, 15 bp, Homo sapiens
gctgcctccactccc

SEQ ID NO: 1881275 - DNA, 14 bp, Homo sapiens
gctgctaccctccc

SEQ ID NO: 1881276 - DNA, 19 bp, Homo sapiens
gctgctaccctccctgctg

SEQ ID NO: 1881277 - DNA, 20 bp, Homo sapiens
gctgctaccctccctgctgt

SEQ ID NO: 1881278 - DNA, 23 bp, Homo sapiens
gctgctaccctccctgctgtccc

SEQ ID NO: 1881279 - DNA, 20 bp, Homo sapiens
gctgctgtggccatcaacct

SEQ ID NO: 1881280 - DNA, 19 bp, Homo sapiens
gctggatgaccccatgctc

SEQ ID NO: 1881281 - DNA, 14 bp, Homo sapiens
gctggccagcccca

SEQ ID NO: 1881282 - DNA, 19 bp, Homo sapiens
gctggccagccccacagcc

SEQ ID NO: 1881283 - DNA, 20 bp, Homo sapiens
gctggctccacgccctgggg

SEQ ID NO: 1881284 - DNA, 21 bp, Homo sapiens
gctggctgtactgccaaggta

SEQ ID NO: 1881285 - DNA, 22 bp, Homo sapiens
gctggctgtactgccaaggtac

SEQ ID NO: 1881286 - DNA, 12 bp, Homo sapiens
gctgggagaagg

SEQ ID NO: 1881287 - DNA, 16 bp, Homo sapiens
gctgggcaggtcctgg

SEQ ID NO: 1881288 - DNA, 23 bp, Homo sapiens
gctgggcaggtcctggggaggct

SEQ ID NO: 1881289 - DNA, 17 bp, Homo sapiens
gctgggctggggcctga

SEQ ID NO: 1881290 - DNA, 12 bp, Homo sapiens
gctgggctgggt

SEQ ID NO: 1881291 - DNA, 15 bp, Homo sapiens
gctgggctgggtgcg

SEQ ID NO: 1881292 - DNA, 15 bp, Homo sapiens
gctggggcctgatgg

SEQ ID NO: 1881293 - DNA, 14 bp, Homo sapiens
gctgggtggcccat

SEQ ID NO: 1881294 - DNA, 16 bp, Homo sapiens
gctgggtggcccatcc

SEQ ID NO: 1881295 - DNA, 20 bp, Homo sapiens
gctgggtggcccatcccccc

SEQ ID NO: 1881296 - DNA, 21 bp, Homo sapiens
gctgggttggcgcaccctccc

SEQ ID NO: 1881297 - DNA, 21 bp, Homo sapiens
gctgggttttcaggggctttg

SEQ ID NO: 1881298 - DNA, 22 bp, Homo sapiens
gctgggttttcaggggctttgg

SEQ ID NO: 1881299 - DNA, 16 bp, Homo sapiens
gctggtaaatgttaag

SEQ ID NO: 1881300 - DNA, 17 bp, Homo sapiens
gctgtactgccaaggta

SEQ ID NO: 1881301 - DNA, 16 bp, Homo sapiens
gctgtatctatttttt

SEQ ID NO: 1881302 - DNA, 12 bp, Homo sapiens
gctgtattttaa

SEQ ID NO: 1881303 - DNA, 13 bp, Homo sapiens
gctgtattttaaa

SEQ ID NO: 1881304 - DNA, 21 bp, Homo sapiens
gctgtattttaaaagaatgat

SEQ ID NO: 1881305 - DNA, 22 bp, Homo sapiens
gctgtattttaaaagaatgatt

SEQ ID NO: 1881306 - DNA, 15 bp, Homo sapiens
gctgtccagtgccca

SEQ ID NO: 1881307 - DNA, 23 bp, Homo sapiens
gctgtccagtgcccattcctcac

SEQ ID NO: 1881308 - DNA, 13 bp, Homo sapiens
ggcagggaagctt

SEQ ID NO: 1881309 - DNA, 14 bp, Homo sapiens
ggcaggggagtctg

SEQ ID NO: 1881310 - DNA, 16 bp, Homo sapiens
ggcaggggagtctgct

SEQ ID NO: 1881311 - DNA, 19 bp, Homo sapiens
ggcaggtcctggggaggct

SEQ ID NO: 1881312 - DNA, 19 bp, Homo sapiens
ggcatccttctgccttttt

SEQ ID NO: 1881313 - DNA, 19 bp, Homo sapiens
ggcatgggggaggctctga

SEQ ID NO: 1881314 - DNA, 21 bp, Homo sapiens
ggccacagccactaatcagga

SEQ ID NO: 1881315 - DNA, 22 bp, Homo sapiens
ggccacagtcatggtggccacg

SEQ ID NO: 1881316 - DNA, 21 bp, Homo sapiens
ggccaccagctccactggcct

SEQ ID NO: 1881317 - DNA, 13 bp, Homo sapiens
ggccagaggcagc

SEQ ID NO: 1881318 - DNA, 13 bp, Homo sapiens
ggccagccccaca

SEQ ID NO: 1881319 - DNA, 19 bp, Homo sapiens
ggccagccccacagcccac

SEQ ID NO: 1881320 - DNA, 23 bp, Homo sapiens
ggccagccccacagcccacgtcc

SEQ ID NO: 1881321 - DNA, 23 bp, Homo sapiens
ggccaggtgggcgggcagcacag

SEQ ID NO: 1881322 - DNA, 18 bp, Homo sapiens
ggccatcttccaggtggg

SEQ ID NO: 1881323 - DNA, 22 bp, Homo sapiens
ggccatcttccaggtggggtga

SEQ ID NO: 1881324 - DNA, 12 bp, Homo sapiens
ggcccagctccc

SEQ ID NO: 1881325 - DNA, 15 bp, Homo sapiens
ggcccagctcccccg

SEQ ID NO: 1881326 - DNA, 22 bp, Homo sapiens
ggcccatcagtgtacccccgcc

SEQ ID NO: 1881327 - DNA, 19 bp, Homo sapiens
ggcccatcccccctcacca

SEQ ID NO: 1881328 - DNA, 12 bp, Homo sapiens
ggccccagcctg

SEQ ID NO: 1881329 - DNA, 21 bp, Homo sapiens
ggccccagcctggcccagctc

SEQ ID NO: 1881330 - DNA, 22 bp, Homo sapiens
ggccccagcctggcccagctcc

SEQ ID NO: 1881331 - DNA, 11 bp, Homo sapiens
ggccccaggtc

SEQ ID NO: 1881332 - DNA, 22 bp, Homo sapiens
ggcccgcttgcctcggctcctg

SEQ ID NO: 1881333 - DNA, 16 bp, Homo sapiens
ggcccggatccaggat

SEQ ID NO: 1881334 - DNA, 23 bp, Homo sapiens
ggcccgttgtctccctggccctc

SEQ ID NO: 1881335 - DNA, 19 bp, Homo sapiens
ggccctcaaggcctcccac

SEQ ID NO: 1881336 - DNA, 23 bp, Homo sapiens
ggccctcaaggcctcccacagtg

SEQ ID NO: 1881337 - DNA, 15 bp, Homo sapiens
ggccctgcactgtcc

SEQ ID NO: 1881338 - DNA, 16 bp, Homo sapiens
ggccctgcactgtcct

SEQ ID NO: 1881339 - DNA, 18 bp, Homo sapiens
ggccctgcaggaggcctg

SEQ ID NO: 1881340 - DNA, 21 bp, Homo sapiens
ggccctgcaggaggcctggga

SEQ ID NO: 1881341 - DNA, 22 bp, Homo sapiens
ggccctgcaggaggcctgggag

SEQ ID NO: 1881342 - DNA, 14 bp, Homo sapiens
ggccggccaggtgg

SEQ ID NO: 1881343 - DNA, 15 bp, Homo sapiens
ggccggccaggtggg

SEQ ID NO: 1881344 - DNA, 16 bp, Homo sapiens
ggccggccaggtgggc

SEQ ID NO: 1881345 - DNA, 17 bp, Homo sapiens
ggccggccaggtgggcg

SEQ ID NO: 1881346 - DNA, 17 bp, Homo sapiens
ggcctatcagtgtgccc

SEQ ID NO: 1881347 - DNA, 23 bp, Homo sapiens
ggcctatcagtgtgccccccatc

SEQ ID NO: 1881348 - DNA, 15 bp, Homo sapiens
ggcctcgcctggcct

SEQ ID NO: 1881349 - DNA, 19 bp, Homo sapiens
ggcctgatggagaggagaa

SEQ ID NO: 1881350 - DNA, 20 bp, Homo sapiens
ggcctgatggagaggagaac

SEQ ID NO: 1881351 - DNA, 22 bp, Homo sapiens
ggcctggcacagtgtctgggct

SEQ ID NO: 1881352 - DNA, 15 bp, Homo sapiens
ggcgagaggaggggc

SEQ ID NO: 1881353 - DNA, 19 bp, Homo sapiens
ggcgaggcgggggagcctg

SEQ ID NO: 1881354 - DNA, 22 bp, Homo sapiens
ggcgaggcgggggagcctggag

SEQ ID NO: 1881355 - DNA, 20 bp, Homo sapiens
ggcgagggaggggaggtggc

SEQ ID NO: 1881356 - DNA, 19 bp, Homo sapiens
ggcggaggttgcagtgagc

SEQ ID NO: 1881357 - DNA, 13 bp, Homo sapiens
ggcgggggagcct

SEQ ID NO: 1881358 - DNA, 17 bp, Homo sapiens
ggcgggggagcctggag

SEQ ID NO: 1881359 - DNA, 14 bp, Homo sapiens
ggcgggggatcctg

SEQ ID NO: 1881360 - DNA, 17 bp, Homo sapiens
ggcgggggatcctggag

SEQ ID NO: 1881361 - DNA, 11 bp, Homo sapiens
ggcgtttcttt

SEQ ID NO: 1881362 - DNA, 14 bp, Homo sapiens
ggctaggggctggg

SEQ ID NO: 1881363 - DNA, 16 bp, Homo sapiens
ggctcccatgggctag

SEQ ID NO: 1881364 - DNA, 11 bp, Homo sapiens
ggctcctgctg

SEQ ID NO: 1881365 - DNA, 23 bp, Homo sapiens
ggctcctgctgcaccaacccagc

SEQ ID NO: 1881366 - DNA, 13 bp, Homo sapiens
ggctcctgtgccc

SEQ ID NO: 1881367 - DNA, 14 bp, Homo sapiens
ggctcctgtgccct

SEQ ID NO: 1881368 - DNA, 17 bp, Homo sapiens
ggctgagactgcagagg

SEQ ID NO: 1881369 - DNA, 15 bp, Homo sapiens
ggctgagagagtggc

SEQ ID NO: 1881370 - DNA, 20 bp, Homo sapiens
ggctgcactctgtgcccatg

SEQ ID NO: 1881371 - DNA, 21 bp, Homo sapiens
ggctgcactctgtgcccatgg

SEQ ID NO: 1881372 - DNA, 16 bp, Homo sapiens
ggctgcccgctcccag

SEQ ID NO: 1881373 - DNA, 20 bp, Homo sapiens
ggctgcctccactcccactt

SEQ ID NO: 1881374 - DNA, 16 bp, Homo sapiens
ggctggaggtggcgcc

SEQ ID NO: 1881375 - DNA, 13 bp, Homo sapiens
ggctggccagccc

SEQ ID NO: 1881376 - DNA, 15 bp, Homo sapiens
ggctggccagcccca

SEQ ID NO: 1881377 - DNA, 18 bp, Homo sapiens
ggctggccagccccacag

SEQ ID NO: 1881378 - DNA, 20 bp, Homo sapiens
ggctggccagccccacagcc

SEQ ID NO: 1881379 - DNA, 17 bp, Homo sapiens
ggctgggagaaggtgct

SEQ ID NO: 1881380 - DNA, 21 bp, Homo sapiens
ggctgggcaggtcctggggag

SEQ ID NO: 1881381 - DNA, 23 bp, Homo sapiens
ggctgggcaggtcctggggaggc

SEQ ID NO: 1881382 - DNA, 22 bp, Homo sapiens
ggctggggcctatcagtgtgcc

SEQ ID NO: 1881383 - DNA, 17 bp, Homo sapiens
ggctgggggcatggggg

SEQ ID NO: 1881384 - DNA, 16 bp, Homo sapiens
ggctgggttggcgcac

SEQ ID NO: 1881385 - DNA, 18 bp, Homo sapiens
ggctgggttttcaggggc

SEQ ID NO: 1881386 - DNA, 23 bp, Homo sapiens
ggctgggttttcaggggctttgg

SEQ ID NO: 1881387 - DNA, 20 bp, Homo sapiens
ggcttctgcggtgaggcagg

SEQ ID NO: 1881388 - DNA, 13 bp, Homo sapiens
ggcttctgtgcct

SEQ ID NO: 1881389 - DNA, 17 bp, Homo sapiens
ggcttgctgatggctgc

SEQ ID NO: 1881390 - DNA, 15 bp, Homo sapiens
ggcttggagtgggtt

SEQ ID NO: 1881391 - DNA, 15 bp, Homo sapiens
gggaagagcacagcc

SEQ ID NO: 1881392 - DNA, 14 bp, Homo sapiens
gggaagctttcacc

SEQ ID NO: 1881393 - DNA, 22 bp, Homo sapiens
gggacagtcacctcatggaatt

SEQ ID NO: 1881394 - DNA, 16 bp, Homo sapiens
gggaggcccatgtgac

SEQ ID NO: 1881395 - DNA, 19 bp, Homo sapiens
gggaggctgagactgcaga

SEQ ID NO: 1881396 - DNA, 14 bp, Homo sapiens
gggaggggaggtgg

SEQ ID NO: 1881397 - DNA, 15 bp, Homo sapiens
gggaggggaggtggc

SEQ ID NO: 1881398 - DNA, 20 bp, Homo sapiens
gggcaaggtgggggagcctg

SEQ ID NO: 1881399 - DNA, 21 bp, Homo sapiens
gggcaaggtgggggagcctgg

SEQ ID NO: 1881400 - DNA, 23 bp, Homo sapiens
gggcaaggtgggggagcctggag

SEQ ID NO: 1881401 - DNA, 16 bp, Homo sapiens
gggcactgctgggtgg

SEQ ID NO: 1881402 - DNA, 21 bp, Homo sapiens
gggcactgctgggtggcccat

SEQ ID NO: 1881403 - DNA, 13 bp, Homo sapiens
gggcagcacagca

SEQ ID NO: 1881404 - DNA, 14 bp, Homo sapiens
gggcagcacagcaa

SEQ ID NO: 1881405 - DNA, 19 bp, Homo sapiens
gggcaggaatcaaggagcc

SEQ ID NO: 1881406 - DNA, 12 bp, Homo sapiens
gggcaggcacag

SEQ ID NO: 1881407 - DNA, 13 bp, Homo sapiens
gggcaggccctgc

SEQ ID NO: 1881408 - DNA, 19 bp, Homo sapiens
gggcaggccctgcactgtc

SEQ ID NO: 1881409 - DNA, 21 bp, Homo sapiens
gggcaggccctgcactgtcct

SEQ ID NO: 1881410 - DNA, 15 bp, Homo sapiens
gggcaggtcctgggg

SEQ ID NO: 1881411 - DNA, 21 bp, Homo sapiens
gggcaggtcctggggaggctg

SEQ ID NO: 1881412 - DNA, 21 bp, Homo sapiens
gggcatgggggaggctctgaa

SEQ ID NO: 1881413 - DNA, 22 bp, Homo sapiens
gggccaccagctccactggcct

SEQ ID NO: 1881414 - DNA, 14 bp, Homo sapiens
gggccagcccagga

SEQ ID NO: 1881415 - DNA, 14 bp, Homo sapiens
gggccatactggcc

SEQ ID NO: 1881416 - DNA, 17 bp, Homo sapiens
gggccatactggcctcg

SEQ ID NO: 1881417 - DNA, 15 bp, Homo sapiens
gggcccggatccagg

SEQ ID NO: 1881418 - DNA, 16 bp, Homo sapiens
gggcccgttgtctccc

SEQ ID NO: 1881419 - DNA, 20 bp, Homo sapiens
gggcccgttgtctccctggc

SEQ ID NO: 1881420 - DNA, 16 bp, Homo sapiens
gggccctgcaggaggc

SEQ ID NO: 1881421 - DNA, 15 bp, Homo sapiens
gggcctatcagtgtg

SEQ ID NO: 1881422 - DNA, 22 bp, Homo sapiens
gggcctatcagtgtgcccccca

SEQ ID NO: 1881423 - DNA, 18 bp, Homo sapiens
gggcctgatggagaggag

SEQ ID NO: 1881424 - DNA, 16 bp, Homo sapiens
gggcctgatggggagg

SEQ ID NO: 1881425 - DNA, 15 bp, Homo sapiens
gggcgggcagcacag

SEQ ID NO: 1881426 - DNA, 14 bp, Homo sapiens
gtccagtgcccatt

SEQ ID NO: 1881427 - DNA, 22 bp, Homo sapiens
gtcccaggggtctccctgagcc

SEQ ID NO: 1881428 - DNA, 15 bp, Homo sapiens
gtcccctcttgcccc

SEQ ID NO: 1881429 - DNA, 14 bp, Homo sapiens
gtccctgggaaaga

SEQ ID NO: 1881430 - DNA, 15 bp, Homo sapiens
gtcctacggagggac

SEQ ID NO: 1881431 - DNA, 13 bp, Homo sapiens
gtcctctccacct

SEQ ID NO: 1881432 - DNA, 14 bp, Homo sapiens
gtcctgctccacag

SEQ ID NO: 1881433 - DNA, 14 bp, Homo sapiens
gtcctggggaggct

SEQ ID NO: 1881434 - DNA, 21 bp, Homo sapiens
gtcctggggaggctgagactg

SEQ ID NO: 1881435 - DNA, 22 bp, Homo sapiens
gtcctggggaggctgagactgc

SEQ ID NO: 1881436 - DNA, 16 bp, Homo sapiens
gtccttccctcaaaga

SEQ ID NO: 1881437 - DNA, 13 bp, Homo sapiens
gtcgcgctgcctg

SEQ ID NO: 1881438 - DNA, 20 bp, Homo sapiens
gtcggggggcgagggagggg

SEQ ID NO: 1881439 - DNA, 13 bp, Homo sapiens
gtctattctagtc

SEQ ID NO: 1881440 - DNA, 12 bp, Homo sapiens
gtctccctgagc

SEQ ID NO: 1881441 - DNA, 14 bp, Homo sapiens
gtctccctgagcct

SEQ ID NO: 1881442 - DNA, 16 bp, Homo sapiens
gtctccctgagcctgc

SEQ ID NO: 1881443 - DNA, 12 bp, Homo sapiens
gtctccctggcc

SEQ ID NO: 1881444 - DNA, 13 bp, Homo sapiens
gtctccctggccc

SEQ ID NO: 1881445 - DNA, 14 bp, Homo sapiens
gtctccctggccct

SEQ ID NO: 1881446 - DNA, 22 bp, Homo sapiens
gtctcggtggtaccaggtctcc

SEQ ID NO: 1881447 - DNA, 17 bp, Homo sapiens
gtctgctatattttcat

SEQ ID NO: 1881448 - DNA, 19 bp, Homo sapiens
gtctgctcgggcccaggcc

SEQ ID NO: 1881449 - DNA, 22 bp, Homo sapiens
gtctgctcgggcccaggccatc

SEQ ID NO: 1881450 - DNA, 15 bp, Homo sapiens
gtctggaatggactg

SEQ ID NO: 1881451 - DNA, 17 bp, Homo sapiens
gtctggaatggactggg

SEQ ID NO: 1881452 - DNA, 11 bp, Homo sapiens
gtctgggctga

SEQ ID NO: 1881453 - DNA, 19 bp, Homo sapiens
gtctgtaaggactcagtgt

SEQ ID NO: 1881454 - DNA, 21 bp, Homo sapiens
gtctgttccccatggccactt

SEQ ID NO: 1881455 - DNA, 17 bp, Homo sapiens
gtctgtttataaacatt

SEQ ID NO: 1881456 - DNA, 15 bp, Homo sapiens
gtcttcaattaaaag

SEQ ID NO: 1881457 - DNA, 19 bp, Homo sapiens
gtcttcatcacttcttcca

SEQ ID NO: 1881458 - DNA, 14 bp, Homo sapiens
gtcttcctgtgggg

SEQ ID NO: 1881459 - DNA, 17 bp, Homo sapiens
gtgaaaccctgtctcta

SEQ ID NO: 1881460 - DNA, 20 bp, Homo sapiens
gtgaaactcgttaatttgta

SEQ ID NO: 1881461 - DNA, 13 bp, Homo sapiens
gtgaaatgtaaca

SEQ ID NO: 1881462 - DNA, 14 bp, Homo sapiens
gtgacatgaagcat

SEQ ID NO: 1881463 - DNA, 17 bp, Homo sapiens
gtgaccccatctctgct

SEQ ID NO: 1881464 - DNA, 19 bp, Homo sapiens
gtgaccccttttcagcttc

SEQ ID NO: 1881465 - DNA, 18 bp, Homo sapiens
gtgactcgggctcctgtg

SEQ ID NO: 1881466 - DNA, 21 bp, Homo sapiens
gtgattacgtgtatgtttctt

SEQ ID NO: 1881467 - DNA, 18 bp, Homo sapiens
gtgatttcccgtggcccc

SEQ ID NO: 1881468 - DNA, 20 bp, Homo sapiens
gtgatttcccgtggccccag

SEQ ID NO: 1881469 - DNA, 21 bp, Homo sapiens
gtgatttcccgtggccccagc

SEQ ID NO: 1881470 - DNA, 23 bp, Homo sapiens
gtgatttcccgtggccccagcct

SEQ ID NO: 1881471 - DNA, 13 bp, Homo sapiens
gtgcaaggaccaa

SEQ ID NO: 1881472 - DNA, 14 bp, Homo sapiens
gtgcagccccagga

SEQ ID NO: 1881473 - DNA, 23 bp, Homo sapiens
gtgcaggtttatattgggaagct

SEQ ID NO: 1881474 - DNA, 21 bp, Homo sapiens
gtgccaacagtgttaggcctg

SEQ ID NO: 1881475 - DNA, 20 bp, Homo sapiens
gtgccaccctgggctctgtg

SEQ ID NO: 1881476 - DNA, 21 bp, Homo sapiens
gtgccaccctgggctctgtgg

SEQ ID NO: 1881477 - DNA, 22 bp, Homo sapiens
gtgccaccctgggctctgtggg

SEQ ID NO: 1881478 - DNA, 13 bp, Homo sapiens
gtgccacggtgga

SEQ ID NO: 1881479 - DNA, 16 bp, Homo sapiens
gtgccagtcgcgctgc

SEQ ID NO: 1881480 - DNA, 17 bp, Homo sapiens
gtgccagtcgcgctgcc

SEQ ID NO: 1881481 - DNA, 19 bp, Homo sapiens
gtgccagtcgcgctgcctg

SEQ ID NO: 1881482 - DNA, 14 bp, Homo sapiens
gtgcccatgggcac

SEQ ID NO: 1881483 - DNA, 19 bp, Homo sapiens
gtgcccatgggcactgctg

SEQ ID NO: 1881484 - DNA, 10 bp, Homo sapiens
gtgccctggc

SEQ ID NO: 1881485 - DNA, 12 bp, Homo sapiens
gtgccctggctc

SEQ ID NO: 1881486 - DNA, 23 bp, Homo sapiens
gtgccctggctcccaagggaggc

SEQ ID NO: 1881487 - DNA, 22 bp, Homo sapiens
gtgcctgctctccttgccctgg

SEQ ID NO: 1881488 - DNA, 23 bp, Homo sapiens
gtgcctgctctccttgccctggg

SEQ ID NO: 1881489 - DNA, 16 bp, Homo sapiens
gtgcgaccccatctgc

SEQ ID NO: 1881490 - DNA, 20 bp, Homo sapiens
gtgcgaccccatctgcccag

SEQ ID NO: 1881491 - DNA, 16 bp, Homo sapiens
gtgcggtaggtgctgg

SEQ ID NO: 1881492 - DNA, 15 bp, Homo sapiens
gtgctagggtgcctg

SEQ ID NO: 1881493 - DNA, 22 bp, Homo sapiens
gtgctagggtgcctgctctcct

SEQ ID NO: 1881494 - DNA, 18 bp, Homo sapiens
gtgctgctaccctccctg

SEQ ID NO: 1881495 - DNA, 16 bp, Homo sapiens
gtgcttgggcttctgc

SEQ ID NO: 1881496 - DNA, 23 bp, Homo sapiens
gtgctttcttctcccaattcatc

SEQ ID NO: 1881497 - DNA, 20 bp, Homo sapiens
gtgctttttccttttcatct

SEQ ID NO: 1881498 - DNA, 13 bp, Homo sapiens
gtggacgagggag

SEQ ID NO: 1881499 - DNA, 16 bp, Homo sapiens
gtggccccagcctggc

SEQ ID NO: 1881500 - DNA, 22 bp, Homo sapiens
gtggccccagcctggcccagct

SEQ ID NO: 1881501 - DNA, 18 bp, Homo sapiens
gtggctgtccagtgccca

SEQ ID NO: 1881502 - DNA, 19 bp, Homo sapiens
gtggctgtccagtgcccat

SEQ ID NO: 1881503 - DNA, 14 bp, Homo sapiens
gtggcttgtagaat

SEQ ID NO: 1881504 - DNA, 22 bp, Homo sapiens
gtgggatcattgcatttccaga

SEQ ID NO: 1881505 - DNA, 18 bp, Homo sapiens
gtgggcgggcagcacagc

SEQ ID NO: 1881506 - DNA, 19 bp, Homo sapiens
gtgggctgcactctgtgcc

SEQ ID NO: 1881507 - DNA, 21 bp, Homo sapiens
gtggggctaggggctggggcc

SEQ ID NO: 1881508 - DNA, 17 bp, Homo sapiens
gtggggtctcagtccag

SEQ ID NO: 1881509 - DNA, 21 bp, Homo sapiens
gtgggtcccacttcccctcct

SEQ ID NO: 1881510 - DNA, 24 bp, Homo sapiens
gtgggttggcttgctgatggctgc

SEQ ID NO: 1881511 - DNA, 22 bp, Homo sapiens
gtggtctgctcgggcccaggcc

SEQ ID NO: 1881512 - DNA, 16 bp, Homo sapiens
gtggtgcagccccagg

SEQ ID NO: 1881513 - DNA, 18 bp, Homo sapiens
gtggtgcagccccaggac

SEQ ID NO: 1881514 - DNA, 13 bp, Homo sapiens
gtggttagaatct

SEQ ID NO: 1881515 - DNA, 21 bp, Homo sapiens
gtggttagaatcttgttttgt

SEQ ID NO: 1881516 - DNA, 16 bp, Homo sapiens
gtgtaactttaaacat

SEQ ID NO: 1881517 - DNA, 19 bp, Homo sapiens
gtgtaactttaaacatcta

SEQ ID NO: 1881518 - DNA, 19 bp, Homo sapiens
gtgtacccccgcccaggct

SEQ ID NO: 1881519 - DNA, 15 bp, Homo sapiens
gtgtcactggctgcc

SEQ ID NO: 1881520 - DNA, 16 bp, Homo sapiens
gtgtcactggctgcct

SEQ ID NO: 1881521 - DNA, 19 bp, Homo sapiens
gtgtcactggctgcctcca

SEQ ID NO: 1881522 - DNA, 20 bp, Homo sapiens
gtgtcggggggcgagggagg

SEQ ID NO: 1881523 - DNA, 13 bp, Homo sapiens
gtgtcttcctgtg

SEQ ID NO: 1881524 - DNA, 18 bp, Homo sapiens
gtgtgccccccatcctgg

SEQ ID NO: 1881525 - DNA, 21 bp, Homo sapiens
gtgtgccccccatcctggccc

SEQ ID NO: 1881526 - DNA, 12 bp, Homo sapiens
gtgtgccctggc

SEQ ID NO: 1881527 - DNA, 13 bp, Homo sapiens
gtgtgccctggct

SEQ ID NO: 1881528 - DNA, 13 bp, Homo sapiens
gtgtggtccctcc

SEQ ID NO: 1881529 - DNA, 13 bp, Homo sapiens
gtgtgttctgtag

SEQ ID NO: 1881530 - DNA, 15 bp, Homo sapiens
gtgttaggcctggca

SEQ ID NO: 1881531 - DNA, 21 bp, Homo sapiens
gtgttaggcctggcacagtgt

SEQ ID NO: 1881532 - DNA, 21 bp, Homo sapiens
gtgttctgagcccccacctgc

SEQ ID NO: 1881533 - DNA, 13 bp, Homo sapiens
gttaagctttatt

SEQ ID NO: 1881534 - DNA, 18 bp, Homo sapiens
gttacctgttccattgtt

SEQ ID NO: 1881535 - DNA, 22 bp, Homo sapiens
gttacttagcaagacctgaaaa

SEQ ID NO: 1881536 - DNA, 22 bp, Homo sapiens
gttagggagatgagttgcagtt

SEQ ID NO: 1881537 - DNA, 13 bp, Homo sapiens
gttatttgtacag

SEQ ID NO: 1881538 - DNA, 12 bp, Homo sapiens
gttcaaattttt

SEQ ID NO: 1881539 - DNA, 12 bp, Homo sapiens
gttcacattttt

SEQ ID NO: 1881540 - DNA, 14 bp, Homo sapiens
gttcagtaccacat

SEQ ID NO: 1881541 - DNA, 16 bp, Homo sapiens
gttcctccattttctt

SEQ ID NO: 1881542 - DNA, 15 bp, Homo sapiens
gttctgaagaagatg

SEQ ID NO: 1881543 - DNA, 19 bp, Homo sapiens
gttctgagcccccacctgc

SEQ ID NO: 1881544 - DNA, 18 bp, Homo sapiens
gttctgtggtcacagtga

SEQ ID NO: 1881545 - DNA, 16 bp, Homo sapiens
gttcttttttcagtta

SEQ ID NO: 1881546 - DNA, 15 bp, Homo sapiens
gttgaactgcaggaa

SEQ ID NO: 1881547 - DNA, 16 bp, Homo sapiens
taagctttattgtgat

SEQ ID NO: 1881548 - DNA, 23 bp, Homo sapiens
taataaacttagaataaaattgt

SEQ ID NO: 1881549 - DNA, 15 bp, Homo sapiens
taataaggttgaaca

SEQ ID NO: 1881550 - DNA, 14 bp, Homo sapiens
taataatgtttcaa

SEQ ID NO: 1881551 - DNA, 15 bp, Homo sapiens
taatacacacagtta

SEQ ID NO: 1881552 - DNA, 16 bp, Homo sapiens
taataccacagctttt

SEQ ID NO: 1881553 - DNA, 21 bp, Homo sapiens
taatagattttttttaaagtt

SEQ ID NO: 1881554 - DNA, 14 bp, Homo sapiens
taatatattgctgc

SEQ ID NO: 1881555 - DNA, 16 bp, Homo sapiens
taatatcatagaccca

SEQ ID NO: 1881556 - DNA, 19 bp, Homo sapiens
taatctgtttgtgcaaaca

SEQ ID NO: 1881557 - DNA, 20 bp, Homo sapiens
taatctgtttgtgcaaacat

SEQ ID NO: 1881558 - DNA, 20 bp, Homo sapiens
taatgacatcaccacagttt

SEQ ID NO: 1881559 - DNA, 21 bp, Homo sapiens
taatgttgtatgtcttgttta

SEQ ID NO: 1881560 - DNA, 15 bp, Homo sapiens
taatgtttcaaacat

SEQ ID NO: 1881561 - DNA, 17 bp, Homo sapiens
taattacgtttaaagtg

SEQ ID NO: 1881562 - DNA, 22 bp, Homo sapiens
taattggaaaggcagctctaaa

SEQ ID NO: 1881563 - DNA, 13 bp, Homo sapiens
taatttaatgtat

SEQ ID NO: 1881564 - DNA, 18 bp, Homo sapiens
taatttaatgtattaatc

SEQ ID NO: 1881565 - DNA, 18 bp, Homo sapiens
taattttgtgaagcaaaa

SEQ ID NO: 1881566 - DNA, 12 bp, Homo sapiens
taatttttatat

SEQ ID NO: 1881567 - DNA, 17 bp, Homo sapiens
taatttttatatttgaa

SEQ ID NO: 1881568 - DNA, 19 bp, Homo sapiens
taatttttatatttgaaat

SEQ ID NO: 1881569 - DNA, 17 bp, Homo sapiens
taatttttcacttcaaa

SEQ ID NO: 1881570 - DNA, 22 bp, Homo sapiens
tacaaaaattagccgggggtgg

SEQ ID NO: 1881571 - DNA, 13 bp, Homo sapiens
tacacctctgggc

SEQ ID NO: 1881572 - DNA, 13 bp, Homo sapiens
tacactatcttaa

SEQ ID NO: 1881573 - DNA, 15 bp, Homo sapiens
tacagaaaaatactt

SEQ ID NO: 1881574 - DNA, 20 bp, Homo sapiens
tacagaattgactgcagttg

SEQ ID NO: 1881575 - DNA, 13 bp, Homo sapiens
tacagtaaataaa

SEQ ID NO: 1881576 - DNA, 15 bp, Homo sapiens
tacagtaaataaatt

SEQ ID NO: 1881577 - DNA, 16 bp, Homo sapiens
tacagtaaataaattg

SEQ ID NO: 1881578 - DNA, 23 bp, Homo sapiens
tctgggccctgcaggaggcctgg

SEQ ID NO: 1881579 - DNA, 19 bp, Homo sapiens
tctgggctgtctattctag

SEQ ID NO: 1881580 - DNA, 12 bp, Homo sapiens
tctggggaagga

SEQ ID NO: 1881581 - DNA, 23 bp, Homo sapiens
tctgtagaaaagaaaacatttaa

SEQ ID NO: 1881582 - DNA, 17 bp, Homo sapiens
tctgtaggagagactgg

SEQ ID NO: 1881583 - DNA, 23 bp, Homo sapiens
tctgtatttccccaacatgtaat

SEQ ID NO: 1881584 - DNA, 13 bp, Homo sapiens
tctgtcacttaat

SEQ ID NO: 1881585 - DNA, 19 bp, Homo sapiens
tctgtgagattcattcatg

SEQ ID NO: 1881586 - DNA, 15 bp, Homo sapiens
tctgtgatttcttct

SEQ ID NO: 1881587 - DNA, 20 bp, Homo sapiens
tctgtgcccatgggcactgc

SEQ ID NO: 1881588 - DNA, 13 bp, Homo sapiens
tctgtgctgagca

SEQ ID NO: 1881589 - DNA, 16 bp, Homo sapiens
tctgtgggctgcactc

SEQ ID NO: 1881590 - DNA, 19 bp, Homo sapiens
tctgtgggctgcactctgt

SEQ ID NO: 1881591 - DNA, 15 bp, Homo sapiens
tctgtggtccagagt

SEQ ID NO: 1881592 - DNA, 16 bp, Homo sapiens
tctgtggtccagagtc

SEQ ID NO: 1881593 - DNA, 15 bp, Homo sapiens
tctgtgtaaagactt

SEQ ID NO: 1881594 - DNA, 17 bp, Homo sapiens
tctgtgtcactggctgc

SEQ ID NO: 1881595 - DNA, 15 bp, Homo sapiens
tctgttgttctgtgg

SEQ ID NO: 1881596 - DNA, 22 bp, Homo sapiens
tctgttttataattttgtgaag

SEQ ID NO: 1881597 - DNA, 12 bp, Homo sapiens
tcttaaaactcc

SEQ ID NO: 1881598 - DNA, 21 bp, Homo sapiens
tcttaagagcttgatctgtga

SEQ ID NO: 1881599 - DNA, 22 bp, Homo sapiens
tcttagggttatgattaagtaa

SEQ ID NO: 1881600 - DNA, 16 bp, Homo sapiens
tcttatccacaaagta

SEQ ID NO: 1881601 - DNA, 17 bp, Homo sapiens
tcttatccacaaagtac

SEQ ID NO: 1881602 - DNA, 18 bp, Homo sapiens
tcttatggccaaattcaa

SEQ ID NO: 1881603 - DNA, 11 bp, Homo sapiens
tcttatttgct

SEQ ID NO: 1881604 - DNA, 18 bp, Homo sapiens
tcttcatcacttcttcca

SEQ ID NO: 1881605 - DNA, 19 bp, Homo sapiens
tcttcatcacttcttccac

SEQ ID NO: 1881606 - DNA, 22 bp, Homo sapiens
tcttccactgtgtgttgacact

SEQ ID NO: 1881607 - DNA, 17 bp, Homo sapiens
tcttctagctgagcttt

SEQ ID NO: 1881608 - DNA, 21 bp, Homo sapiens
tcttgccccaacccccagcac

SEQ ID NO: 1881609 - DNA, 23 bp, Homo sapiens
tcttgccccaacccccagcaccc

SEQ ID NO: 1881610 - DNA, 11 bp, Homo sapiens
tcttgccctga

SEQ ID NO: 1881611 - DNA, 20 bp, Homo sapiens
tctttaacttaattgctatg

SEQ ID NO: 1881612 - DNA, 23 bp, Homo sapiens
tctttagaggctttcaaatgtac

SEQ ID NO: 1881613 - DNA, 17 bp, Homo sapiens
tctttccacagaagctc

SEQ ID NO: 1881614 - DNA, 12 bp, Homo sapiens
tctttgcatgga

SEQ ID NO: 1881615 - DNA, 19 bp, Homo sapiens
tctttggacagaagcagct

SEQ ID NO: 1881616 - DNA, 21 bp, Homo sapiens
tctttggacagaagcagctct

SEQ ID NO: 1881617 - DNA, 22 bp, Homo sapiens
tctttggacagaagcagctctt

SEQ ID NO: 1881618 - DNA, 12 bp, Homo sapiens
tctttgttttta

SEQ ID NO: 1881619 - DNA, 22 bp, Homo sapiens
tcttttgaggatgggatgtatt

SEQ ID NO: 1881620 - DNA, 16 bp, Homo sapiens
tgaaaccctgtctcta

SEQ ID NO: 1881621 - DNA, 21 bp, Homo sapiens
tgaacagactagaagtatttg

SEQ ID NO: 1881622 - DNA, 23 bp, Homo sapiens
tgaactagagtttagctggaaaa

SEQ ID NO: 1881623 - DNA, 20 bp, Homo sapiens
tatttgctggagtgctggct

SEQ ID NO: 1881624 - DNA, 20 bp, Homo sapiens
tatttgtgggaggagtgaca

SEQ ID NO: 1881625 - DNA, 12 bp, Homo sapiens
tatttttcatga

SEQ ID NO: 1881626 - DNA, 13 bp, Homo sapiens
tatttttcttgct

SEQ ID NO: 1881627 - DNA, 19 bp, Homo sapiens
tatttttcttgctgttcag

SEQ ID NO: 1881628 - DNA, 23 bp, Homo sapiens
tcaaaaacactctcactatgctg

SEQ ID NO: 1881629 - DNA, 21 bp, Homo sapiens
tcaaaatatgccccattcaac

SEQ ID NO: 1881630 - DNA, 19 bp, Homo sapiens
tcaaactggggcctccctg

SEQ ID NO: 1881631 - DNA, 15 bp, Homo sapiens
tcaaatccttgaaga

SEQ ID NO: 1881632 - DNA, 15 bp, Homo sapiens
tcaacccctcccctc

SEQ ID NO: 1881633 - DNA, 19 bp, Homo sapiens
tcaactccaaactgactct

SEQ ID NO: 1881634 - DNA, 22 bp, Homo sapiens
tcaactccaaactgactcttaa

SEQ ID NO: 1881635 - DNA, 19 bp, Homo sapiens
tcaagaaaggcaagagctc

SEQ ID NO: 1881636 - DNA, 21 bp, Homo sapiens
tcaagcaaacagcttcacaaa

SEQ ID NO: 1881637 - DNA, 18 bp, Homo sapiens
tcaaggcctcccacagtg

SEQ ID NO: 1881638 - DNA, 19 bp, Homo sapiens
tcaaggcctcccacagtga

SEQ ID NO: 1881639 - DNA, 21 bp, Homo sapiens
tcaataaaatccatacatttg

SEQ ID NO: 1881640 - DNA, 19 bp, Homo sapiens
tcaatatttcagataatca

SEQ ID NO: 1881641 - DNA, 22 bp, Homo sapiens
tcacagtgcagcttgcagtccg

SEQ ID NO: 1881642 - DNA, 13 bp, Homo sapiens
tcacataccagag

SEQ ID NO: 1881643 - DNA, 22 bp, Homo sapiens
tcacatgcccgctgtcccaggg

SEQ ID NO: 1881644 - DNA, 19 bp, Homo sapiens
tcaccaggggcaggcacag

SEQ ID NO: 1881645 - DNA, 21 bp, Homo sapiens
tcaccaggggcaggcacagca

SEQ ID NO: 1881646 - DNA, 13 bp, Homo sapiens
tcacctcatggaa

SEQ ID NO: 1881647 - DNA, 18 bp, Homo sapiens
tcactagctgtctcagga

SEQ ID NO: 1881648 - DNA, 15 bp, Homo sapiens
tcactggctgcctcc

SEQ ID NO: 1881649 - DNA, 16 bp, Homo sapiens
tcacttcttccactgt

SEQ ID NO: 1881650 - DNA, 14 bp, Homo sapiens
tcactttctagatt

SEQ ID NO: 1881651 - DNA, 15 bp, Homo sapiens
tcacttttcaatttg

SEQ ID NO: 1881652 - DNA, 22 bp, Homo sapiens
tcacttttcaatttgtcatgtt

SEQ ID NO: 1881653 - DNA, 19 bp, Homo sapiens
tcagagcaggtgctggctc

SEQ ID NO: 1881654 - DNA, 14 bp, Homo sapiens
tcagatcgttcatt

SEQ ID NO: 1881655 - DNA, 15 bp, Homo sapiens
tcagatcgttcattg

SEQ ID NO: 1881656 - DNA, 21 bp, Homo sapiens
tcagctgtgaacatggactct

SEQ ID NO: 1881657 - DNA, 15 bp, Homo sapiens
tcagcttctgctggg

SEQ ID NO: 1881658 - DNA, 19 bp, Homo sapiens
tcagcttctgctgggctgg

SEQ ID NO: 1881659 - DNA, 17 bp, Homo sapiens
tcaggaaaagcctctgt

SEQ ID NO: 1881660 - DNA, 19 bp, Homo sapiens
tcaggaaaagcctctgtgt

SEQ ID NO: 1881661 - DNA, 13 bp, Homo sapiens
tcaggaaagagaa

SEQ ID NO: 1881662 - DNA, 14 bp, Homo sapiens
tcagggaccacagc

SEQ ID NO: 1881663 - DNA, 14 bp, Homo sapiens
tcaggggctgcccg

SEQ ID NO: 1881664 - DNA, 13 bp, Homo sapiens
tcaggggctttgg

SEQ ID NO: 1881665 - DNA, 14 bp, Homo sapiens
tcagtcatattctt

SEQ ID NO: 1881666 - DNA, 14 bp, Homo sapiens
tcagtgccgccgcc

SEQ ID NO: 1881667 - DNA, 13 bp, Homo sapiens
tcagtgtgccccc

SEQ ID NO: 1881668 - DNA, 14 bp, Homo sapiens
tcagtgtgcccccc

SEQ ID NO: 1881669 - DNA, 19 bp, Homo sapiens
tcagttcccagacagcttt

SEQ ID NO: 1881670 - DNA, 16 bp, Homo sapiens
tcagttcctctttgca

SEQ ID NO: 1881671 - DNA, 17 bp, Homo sapiens
tcagttcctctttgcat

SEQ ID NO: 1881672 - DNA, 19 bp, Homo sapiens
tcagttcctctttgcatgg

SEQ ID NO: 1881673 - DNA, 14 bp, Homo sapiens
tcatatatatacat

SEQ ID NO: 1881674 - DNA, 15 bp, Homo sapiens
tcatattttctttca

SEQ ID NO: 1881675 - DNA, 15 bp, Homo sapiens
tcatcacttcttcca

SEQ ID NO: 1881676 - DNA, 15 bp, Homo sapiens
tcatctgttgttctg

SEQ ID NO: 1881677 - DNA, 16 bp, Homo sapiens
tcatctgttgttctgt

SEQ ID NO: 1881678 - DNA, 18 bp, Homo sapiens
tcatgcctcactttcttc

SEQ ID NO: 1881679 - DNA, 22 bp, Homo sapiens
tcatgctaattatataatattt

SEQ ID NO: 1881680 - DNA, 21 bp, Homo sapiens
tcatggaattggagctcgtgg

SEQ ID NO: 1881681 - DNA, 16 bp, Homo sapiens
tcatgtaacagttgtg

SEQ ID NO: 1881682 - DNA, 21 bp, Homo sapiens
tcatgtgctggtaaatgttaa

SEQ ID NO: 1881683 - DNA, 21 bp, Homo sapiens
tcatgtggcacttgggcattt

SEQ ID NO: 1881684 - DNA, 13 bp, Homo sapiens
tcattagagctta

SEQ ID NO: 1881685 - DNA, 11 bp, Homo sapiens
tcattgcattt

SEQ ID NO: 1881686 - DNA, 12 bp, Homo sapiens
tcattgcatttc

SEQ ID NO: 1881687 - DNA, 14 bp, Homo sapiens
tcattgcatttcca

SEQ ID NO: 1881688 - DNA, 18 bp, Homo sapiens
tcattgcctttccagggt

SEQ ID NO: 1881689 - DNA, 13 bp, Homo sapiens
tcatttattttgt

SEQ ID NO: 1881690 - DNA, 18 bp, Homo sapiens
tcatttgcaattcatgta

SEQ ID NO: 1881691 - DNA, 15 bp, Homo sapiens
tccaaggtggtctgc

SEQ ID NO: 1881692 - DNA, 17 bp, Homo sapiens
tccacctagtggctgtc

SEQ ID NO: 1881693 - DNA, 18 bp, Homo sapiens
tccacgtactgcagcctc

SEQ ID NO: 1881694 - DNA, 23 bp, Homo sapiens
tccactgtgtgttgacactgttt

SEQ ID NO: 1881695 - DNA, 16 bp, Homo sapiens
tccagatcctggaaat

SEQ ID NO: 1881696 - DNA, 14 bp, Homo sapiens
tccaggccccaggt

SEQ ID NO: 1881697 - DNA, 23 bp, Homo sapiens
tccagtcctcacatgcccgctgt

SEQ ID NO: 1881698 - DNA, 20 bp, Homo sapiens
tccagtgcccattcctcacc

SEQ ID NO: 1881699 - DNA, 21 bp, Homo sapiens
tccagtggggtctcagtccag

SEQ ID NO: 1881700 - DNA, 23 bp, Homo sapiens
tccagttgaacactagtctgtgt

SEQ ID NO: 1881701 - DNA, 12 bp, Homo sapiens
tccatacatttg

SEQ ID NO: 1881702 - DNA, 15 bp, Homo sapiens
tccatacatttgtgt

SEQ ID NO: 1881703 - DNA, 15 bp, Homo sapiens
tgaagatatttttcc

SEQ ID NO: 1881704 - DNA, 17 bp, Homo sapiens
tgaagatttaccacttg

SEQ ID NO: 1881705 - DNA, 11 bp, Homo sapiens
tgaagtccaag

SEQ ID NO: 1881706 - DNA, 15 bp, Homo sapiens
tgaatatataaacac

SEQ ID NO: 1881707 - DNA, 16 bp, Homo sapiens
tgaatatatggtctgt

SEQ ID NO: 1881708 - DNA, 18 bp, Homo sapiens
tgaattacatttgtataa

SEQ ID NO: 1881709 - DNA, 11 bp, Homo sapiens
tgaatttcatc

SEQ ID NO: 1881710 - DNA, 14 bp, Homo sapiens
tgaattttcccact

SEQ ID NO: 1881711 - DNA, 15 bp, Homo sapiens
tgaattttcccactg

SEQ ID NO: 1881712 - DNA, 16 bp, Homo sapiens
tgaattttcccactgc

SEQ ID NO: 1881713 - DNA, 17 bp, Homo sapiens
tgaattttcccactgca

SEQ ID NO: 1881714 - DNA, 20 bp, Homo sapiens
tgacaagctcacagaccttt

SEQ ID NO: 1881715 - DNA, 17 bp, Homo sapiens
tgacacccctggcctga

SEQ ID NO: 1881716 - DNA, 20 bp, Homo sapiens
tgacactgcggggcttggct

SEQ ID NO: 1881717 - DNA, 18 bp, Homo sapiens
tgacagaatgctgtttta

SEQ ID NO: 1881718 - DNA, 15 bp, Homo sapiens
tgacagtatatgtca

SEQ ID NO: 1881719 - DNA, 17 bp, Homo sapiens
tgacatcaccacagttt

SEQ ID NO: 1881720 - DNA, 17 bp, Homo sapiens
tgacatgggacatttgc

SEQ ID NO: 1881721 - DNA, 18 bp, Homo sapiens
tgacatgggacatttgct

SEQ ID NO: 1881722 - DNA, 17 bp, Homo sapiens
tgacattcagaaaactt

SEQ ID NO: 1881723 - DNA, 12 bp, Homo sapiens
tgaccccatgct

SEQ ID NO: 1881724 - DNA, 21 bp, Homo sapiens
tgaccccttttcagcttctgc

SEQ ID NO: 1881725 - DNA, 22 bp, Homo sapiens
tgaccccttttcagcttctgct

SEQ ID NO: 1881726 - DNA, 22 bp, Homo sapiens
tgactcccatgcaagtagctgg

SEQ ID NO: 1881727 - DNA, 16 bp, Homo sapiens
tgactcgggctcctgt

SEQ ID NO: 1881728 - DNA, 17 bp, Homo sapiens
tgactcgggctcctgtg

SEQ ID NO: 1881729 - DNA, 18 bp, Homo sapiens
tgactcgggctcctgtgc

SEQ ID NO: 1881730 - DNA, 20 bp, Homo sapiens
tgactcgggctcctgtgccc

SEQ ID NO: 1881731 - DNA, 21 bp, Homo sapiens
tgactcgggctcctgtgccct

SEQ ID NO: 1881732 - DNA, 16 bp, Homo sapiens
tgactgcagttgaaca

SEQ ID NO: 1881733 - DNA, 15 bp, Homo sapiens
tgactgtttccatca

SEQ ID NO: 1881734 - DNA, 13 bp, Homo sapiens
tgacttttccatg

SEQ ID NO: 1881735 - DNA, 16 bp, Homo sapiens
tgagagacacactgaa

SEQ ID NO: 1881736 - DNA, 20 bp, Homo sapiens
tgagagacacactgaagaag

SEQ ID NO: 1881737 - DNA, 21 bp, Homo sapiens
tgagagacacactgaagaagc

SEQ ID NO: 1881738 - DNA, 21 bp, Homo sapiens
tgagcacagagaaaagtcagg

SEQ ID NO: 1881739 - DNA, 17 bp, Homo sapiens
tgagcagtcaggaaaga

SEQ ID NO: 1881740 - DNA, 20 bp, Homo sapiens
tgagcagtcaggaaagagaa

SEQ ID NO: 1881741 - DNA, 13 bp, Homo sapiens
tgagcagtccaga

SEQ ID NO: 1881742 - DNA, 23 bp, Homo sapiens
tgagccctccttcttgccctgag

SEQ ID NO: 1881743 - DNA, 17 bp, Homo sapiens
tgagctttccggggagg

SEQ ID NO: 1881744 - DNA, 18 bp, Homo sapiens
tgagctttccggggagga

SEQ ID NO: 1881745 - DNA, 16 bp, Homo sapiens
tgaggagcagcttcag

SEQ ID NO: 1881746 - DNA, 15 bp, Homo sapiens
tgaggatatggcagg

SEQ ID NO: 1881747 - DNA, 17 bp, Homo sapiens
tgaggatgcactggcct

SEQ ID NO: 1881748 - DNA, 16 bp, Homo sapiens
tgaggattttgagtat

SEQ ID NO: 1881749 - DNA, 17 bp, Homo sapiens
tgaggcacatgtcagca

SEQ ID NO: 1881750 - DNA, 23 bp, Homo sapiens
tgaggcaggggagtctgcttgtc

SEQ ID NO: 1881751 - DNA, 18 bp, Homo sapiens
tgagggtaataaacttag

SEQ ID NO: 1881752 - DNA, 22 bp, Homo sapiens
tgagggtaataaacttagaata

SEQ ID NO: 1881753 - DNA, 20 bp, Homo sapiens
tgagtgattatttgttattt

SEQ ID NO: 1881754 - DNA, 16 bp, Homo sapiens
tgagttatctgatttt

SEQ ID NO: 1881755 - DNA, 16 bp, Homo sapiens
tgatactgtttcttgc

SEQ ID NO: 1881756 - DNA, 22 bp, Homo sapiens
tgatactgtttcttgcactgaa

SEQ ID NO: 1881757 - DNA, 23 bp, Homo sapiens
tgatactgtttcttgcactgaat

SEQ ID NO: 1881758 - DNA, 16 bp, Homo sapiens
tgatatcccccagcct

SEQ ID NO: 1881759 - DNA, 24 bp, Homo sapiens
tgatcagcttattgtctagtgaaa

SEQ ID NO: 1881760 - DNA, 17 bp, Homo sapiens
tgatctgtgatttcttc

SEQ ID NO: 1881761 - DNA, 17 bp, Homo sapiens
tgatgaagaagttgata

SEQ ID NO: 1881762 - DNA, 13 bp, Homo sapiens
tgatgctgggctg

SEQ ID NO: 1881763 - DNA, 13 bp, Homo sapiens
tgatggctgctgg

SEQ ID NO: 1881764 - DNA, 22 bp, Homo sapiens
tgatgtttagaaacacaactat

SEQ ID NO: 1881765 - DNA, 16 bp, Homo sapiens
tgattaagtaatgata

SEQ ID NO: 1881766 - DNA, 23 bp, Homo sapiens
tgattaagtaatgataactggaa

SEQ ID NO: 1881767 - DNA, 21 bp, Homo sapiens
tgattacaaataaacagttgt

SEQ ID NO: 1881768 - DNA, 19 bp, Homo sapiens
tgattacgtgtatgtttct

SEQ ID NO: 1881769 - DNA, 19 bp, Homo sapiens
tgattatgaattacatttg

SEQ ID NO: 1881770 - DNA, 17 bp, Homo sapiens
tgatttcccgtggcccc

SEQ ID NO: 1881771 - DNA, 18 bp, Homo sapiens
tgatttcccgtggcccca

SEQ ID NO: 1881772 - DNA, 19 bp, Homo sapiens
tgatttcccgtggccccag

SEQ ID NO: 1881773 - DNA, 15 bp, Homo sapiens
ttacctgttccattg

SEQ ID NO: 1881774 - DNA, 19 bp, Homo sapiens
ttacgtgtatgtttcttct

SEQ ID NO: 1881775 - DNA, 18 bp, Homo sapiens
ttacttattatcttcagg

SEQ ID NO: 1881776 - DNA, 15 bp, Homo sapiens
ttagaataaaattgt

SEQ ID NO: 1881777 - DNA, 18 bp, Homo sapiens
ttagaggctttcaaatgt

SEQ ID NO: 1881778 - DNA, 19 bp, Homo sapiens
ttagaggctttcaaatgta

SEQ ID NO: 1881779 - DNA, 21 bp, Homo sapiens
ttagatgcagttctgaagaag

SEQ ID NO: 1881780 - DNA, 22 bp, Homo sapiens
ttagatgcagttctgaagaaga

SEQ ID NO: 1881781 - DNA, 13 bp, Homo sapiens
ttagctctgagga

SEQ ID NO: 1881782 - DNA, 20 bp, Homo sapiens
ttagcttcagttgttcttta

SEQ ID NO: 1881783 - DNA, 12 bp, Homo sapiens
ttaggcctggca

SEQ ID NO: 1881784 - DNA, 15 bp, Homo sapiens
ttaggcctggcacag

SEQ ID NO: 1881785 - DNA, 17 bp, Homo sapiens
ttaggcctggcacagtg

SEQ ID NO: 1881786 - DNA, 14 bp, Homo sapiens
ttagggttatgatt

SEQ ID NO: 1881787 - DNA, 13 bp, Homo sapiens
ttaggtaaataaa

SEQ ID NO: 1881788 - DNA, 16 bp, Homo sapiens
ttaggtaaataaagct

SEQ ID NO: 1881789 - DNA, 19 bp, Homo sapiens
ttataaaaaatggtgcctg

SEQ ID NO: 1881790 - DNA, 16 bp, Homo sapiens
ttataaacctctaatt

SEQ ID NO: 1881791 - DNA, 23 bp, Homo sapiens
ttataaacctctaatttattttg

SEQ ID NO: 1881792 - DNA, 11 bp, Homo sapiens
ttataatcttt

SEQ ID NO: 1881793 - DNA, 17 bp, Homo sapiens
ttataattttgtgaagc

SEQ ID NO: 1881794 - DNA, 18 bp, Homo sapiens
ttatataagcttgtattc

SEQ ID NO: 1881795 - DNA, 15 bp, Homo sapiens
ttatattgggaagct

SEQ ID NO: 1881796 - DNA, 20 bp, Homo sapiens
ttatatttattactgtaaga

SEQ ID NO: 1881797 - DNA, 13 bp, Homo sapiens
ttatccatttctt

SEQ ID NO: 1881798 - DNA, 22 bp, Homo sapiens
ttatctaatcatgaaactccct

SEQ ID NO: 1881799 - DNA, 18 bp, Homo sapiens
ttatctgagtcaactcct

SEQ ID NO: 1881800 - DNA, 13 bp, Homo sapiens
ttatgtctaaaga

SEQ ID NO: 1881801 - DNA, 14 bp, Homo sapiens
ttattaataaacat

SEQ ID NO: 1881802 - DNA, 15 bp, Homo sapiens
ttattaataaacatt

SEQ ID NO: 1881803 - DNA, 12 bp, Homo sapiens
ttattaatttga

SEQ ID NO: 1881804 - DNA, 22 bp, Homo sapiens
ttattcaggaaaagcctctgtg

SEQ ID NO: 1881805 - DNA, 15 bp, Homo sapiens
ttattgtctagtgaa

SEQ ID NO: 1881806 - DNA, 16 bp, Homo sapiens
ttattgtgatttcccg

SEQ ID NO: 1881807 - DNA, 15 bp, Homo sapiens
ttatttgtacagttc

SEQ ID NO: 1881808 - DNA, 15 bp, Homo sapiens
ttattttaataatgt

SEQ ID NO: 1881809 - DNA, 19 bp, Homo sapiens
ttattttaataatgtttca

SEQ ID NO: 1881810 - DNA, 17 bp, Homo sapiens
ttattttagcttcagtt

SEQ ID NO: 1881811 - DNA, 14 bp, Homo sapiens
ttattttgtaatta

SEQ ID NO: 1881812 - DNA, 20 bp, Homo sapiens
ttattttgtttaagtggctt

SEQ ID NO: 1881813 - DNA, 14 bp, Homo sapiens
ttcaaacatatata

SEQ ID NO: 1881814 - DNA, 21 bp, Homo sapiens
ttcaagacatcaccatcagca

SEQ ID NO: 1881815 - DNA, 19 bp, Homo sapiens
ttcagaaaacttcaagaca

SEQ ID NO: 1881816 - DNA, 18 bp, Homo sapiens
ttcagctcttaaaaagac

SEQ ID NO: 1881817 - DNA, 15 bp, Homo sapiens
ttcagcttctgctgg

SEQ ID NO: 1881818 - DNA, 17 bp, Homo sapiens
ttcagcttctgctgggc

SEQ ID NO: 1881819 - DNA, 18 bp, Homo sapiens
ttcaggaaaagcctctgt

SEQ ID NO: 1881820 - DNA, 18 bp, Homo sapiens
ttcaggacactcactaca

SEQ ID NO: 1881821 - DNA, 23 bp, Homo sapiens
ttcagttcctctttgcatggaat

SEQ ID NO: 1881822 - DNA, 13 bp, Homo sapiens
ttcagttgttctt

SEQ ID NO: 1881823 - DNA, 20 bp, Homo sapiens
ttcatataaaagttgcgttt

SEQ ID NO: 1881824 - DNA, 18 bp, Homo sapiens
ttcatgtaacagttgtgt

SEQ ID NO: 1881825 - DNA, 19 bp, Homo sapiens
ttcatgtaacagttgtgtc

SEQ ID NO: 1881826 - DNA, 22 bp, Homo sapiens
ttcattcatgtcatgtgtacaa

SEQ ID NO: 1881827 - DNA, 14 bp, Homo sapiens
ttcatttgcaattc

SEQ ID NO: 1881828 - DNA, 19 bp, Homo sapiens
ttccagatcctggaaatca

SEQ ID NO: 1881829 - DNA, 13 bp, Homo sapiens
ttcccaaatgtat

SEQ ID NO: 1881830 - DNA, 13 bp, Homo sapiens
ttcccaattgctt

SEQ ID NO: 1881831 - DNA, 19 bp, Homo sapiens
ttcccactgcaccccctcc

SEQ ID NO: 1881832 - DNA, 13 bp, Homo sapiens
ttcccctcctacc

SEQ ID NO: 1881833 - DNA, 17 bp, Homo sapiens
ttcccctcctacccctc

SEQ ID NO: 1881834 - DNA, 19 bp, Homo sapiens
ttcccctcctacccctccc

SEQ ID NO: 1881835 - DNA, 20 bp, Homo sapiens
ttcccctcctacccctccca

SEQ ID NO: 1881836 - DNA, 18 bp, Homo sapiens
ttgcctcggctcctgctg

SEQ ID NO: 1881837 - DNA, 11 bp, Homo sapiens
ttgctcatgga

SEQ ID NO: 1881838 - DNA, 17 bp, Homo sapiens
ttgctcctaatgttgaa

SEQ ID NO: 1881839 - DNA, 18 bp, Homo sapiens
ttgctgcagtatgaaaat

SEQ ID NO: 1881840 - DNA, 17 bp, Homo sapiens
ttgctggagtgctggct

SEQ ID NO: 1881841 - DNA, 22 bp, Homo sapiens
ttggaaattgggtgtgccctgg

SEQ ID NO: 1881842 - DNA, 13 bp, Homo sapiens
ttggacttgagga

SEQ ID NO: 1881843 - DNA, 17 bp, Homo sapiens
ttggagaagaactgaaa

SEQ ID NO: 1881844 - DNA, 22 bp, Homo sapiens
ttggagaagaactgaaatcata

SEQ ID NO: 1881845 - DNA, 21 bp, Homo sapiens
ttggagtgggttggcttgctg

SEQ ID NO: 1881846 - DNA, 21 bp, Homo sapiens
ttggcagcaggtgctgctacc

SEQ ID NO: 1881847 - DNA, 15 bp, Homo sapiens
ttggcgcaccctccc

SEQ ID NO: 1881848 - DNA, 20 bp, Homo sapiens
ttggcttctgtgcctgactc

SEQ ID NO: 1881849 - DNA, 22 bp, Homo sapiens
ttgggaaattaaatccaataaa

SEQ ID NO: 1881850 - DNA, 22 bp, Homo sapiens
ttgggaaggaaatatatttgta

SEQ ID NO: 1881851 - DNA, 17 bp, Homo sapiens
ttgggccatactggcct

SEQ ID NO: 1881852 - DNA, 23 bp, Homo sapiens
ttgggccatactggcctcgcctg

SEQ ID NO: 1881853 - DNA, 20 bp, Homo sapiens
ttgggcttctgcggtgaggc

SEQ ID NO: 1881854 - DNA, 17 bp, Homo sapiens
ttgggtgtgccctggct

SEQ ID NO: 1881855 - DNA, 20 bp, Homo sapiens
ttgggtgtgccctggctccc

SEQ ID NO: 1881856 - DNA, 21 bp, Homo sapiens
ttggtgcggtaggtgctggcc

SEQ ID NO: 1881857 - DNA, 12 bp, Homo sapiens
ttgtaattattg

SEQ ID NO: 1881858 - DNA, 13 bp, Homo sapiens
ttgtacctggtga

SEQ ID NO: 1881859 - DNA, 23 bp, Homo sapiens
ttgtagtgttggagaagaactga

SEQ ID NO: 1881860 - DNA, 13 bp, Homo sapiens
ttgtataaaataa

SEQ ID NO: 1881861 - DNA, 20 bp, Homo sapiens
ttgtcaataaaatccataca

SEQ ID NO: 1881862 - DNA, 17 bp, Homo sapiens
ttgtcagatcgttcatt

SEQ ID NO: 1881863 - DNA, 13 bp, Homo sapiens
ttgtcatgttact

SEQ ID NO: 1881864 - DNA, 13 bp, Homo sapiens
ttgtctcagagca

SEQ ID NO: 1881865 - DNA, 19 bp, Homo sapiens
ttgtctccctggccctcaa

SEQ ID NO: 1881866 - DNA, 11 bp, Homo sapiens
ttgtgaaatgt

SEQ ID NO: 1881867 - DNA, 22 bp, Homo sapiens
ttgtgattacgtgtatgtttct

SEQ ID NO: 1881868 - DNA, 16 bp, Homo sapiens
ttgtgcaaacataata

SEQ ID NO: 1881869 - DNA, 20 bp, Homo sapiens
ttgtgtcataaattacacaa

SEQ ID NO: 1881870 - DNA, 20 bp, Homo sapiens
ttgtgttgcctgctgagctg

SEQ ID NO: 1881871 - DNA, 18 bp, Homo sapiens
ttgttcacttaaattctt

SEQ ID NO: 1881872 - DNA, 11 bp, Homo sapiens
ttgtttgcttc

SEQ ID NO: 1881873 - DNA, 15 bp, Homo sapiens
ttgttttatgttcta

SEQ ID NO: 1881874 - DNA, 17 bp, Homo sapiens
ttgttttcccgccaagc

SEQ ID NO: 1881875 - DNA, 15 bp, Homo sapiens
tttaaaaaccttgta

SEQ ID NO: 1881876 - DNA, 14 bp, Homo sapiens
tttaaaagaatgat

SEQ ID NO: 1881877 - DNA, 17 bp, Homo sapiens
tttaaaatgaaatgttt

SEQ ID NO: 1881878 - DNA, 14 bp, Homo sapiens
tttaaatcattaga

SEQ ID NO: 1881879 - DNA, 16 bp, Homo sapiens
tttaacatctttgttt

SEQ ID NO: 1881880 - DNA, 13 bp, Homo sapiens
tttaagctgtaaa

SEQ ID NO: 1881881 - DNA, 14 bp, Homo sapiens
tttaagctgtaaaa

SEQ ID NO: 1881882 - DNA, 17 bp, Homo sapiens
tttaatgtattaatctg

SEQ ID NO: 1881883 - DNA, 19 bp, Homo sapiens
tttacagtaaataaattgt

SEQ ID NO: 1881884 - DNA, 16 bp, Homo sapiens
tttacagtatccaaaa

SEQ ID NO: 1881885 - DNA, 13 bp, Homo sapiens
tttaccacttgtg

SEQ ID NO: 1881886 - DNA, 15 bp, Homo sapiens
tttacttgtttcaga

SEQ ID NO: 1881887 - DNA, 12 bp, Homo sapiens
tttagaaacaca

SEQ ID NO: 1881888 - DNA, 20 bp, Homo sapiens
tttagctggaaaagtatgtt

SEQ ID NO: 1881889 - DNA, 14 bp, Homo sapiens
tttagcttcagttg

SEQ ID NO: 1881890 - DNA, 21 bp, Homo sapiens
tttagcttcagttgttcttta

SEQ ID NO: 1881891 - DNA, 23 bp, Homo sapiens
tttagcttcagttgttctttaga

SEQ ID NO: 1881892 - DNA, 14 bp, Homo sapiens
tttaggtaaataaa

SEQ ID NO: 1881893 - DNA, 17 bp, Homo sapiens
tttataaaaaatggtgc

SEQ ID NO: 1881894 - DNA, 22 bp, Homo sapiens
tttataattttgtgaagcaaaa

SEQ ID NO: 1881895 - DNA, 16 bp, Homo sapiens
tttatcctatctctcc

SEQ ID NO: 1881896 - DNA, 14 bp, Homo sapiens
tttatgtctaaaga

SEQ ID NO: 1881897 - DNA, 12 bp, Homo sapiens
tttatgttctag

SEQ ID NO: 1881898 - DNA, 21 bp, Homo sapiens
tttattaataaacattctatc

SEQ ID NO: 1881899 - DNA, 17 bp, Homo sapiens
tttcaaacatatataac

SEQ ID NO: 1881900 - DNA, 21 bp, Homo sapiens
tttcaagaaaggcaagagctc

SEQ ID NO: 1881901 - DNA, 14 bp, Homo sapiens
tttcacttgatgtt

SEQ ID NO: 1881902 - DNA, 21 bp, Homo sapiens
tttcagataatcacaatacat

SEQ ID NO: 1881903 - DNA, 11 bp, Homo sapiens
ttttgaagtgt

SEQ ID NO: 1881904 - DNA, 15 bp, Homo sapiens
ttttgtaattattgt

SEQ ID NO: 1881905 - DNA, 17 bp, Homo sapiens
ttttgtaattattgtga

SEQ ID NO: 1881906 - DNA, 14 bp, Homo sapiens
ttttgtgaagcaaa

SEQ ID NO: 1881907 - DNA, 16 bp, Homo sapiens
tttttataatagattt

SEQ ID NO: 1881908 - DNA, 19 bp, Homo sapiens
tttttatccatttctttta

SEQ ID NO: 1881909 - DNA, 13 bp, Homo sapiens
tttttattatttg

SEQ ID NO: 1881910 - DNA, 18 bp, Homo sapiens
tttttcatgattttgaaa

SEQ ID NO: 1881911 - DNA, 13 bp, Homo sapiens
tttttccttttca

SEQ ID NO: 1881912 - DNA, 18 bp, Homo sapiens
tttttctacttttaaaga

SEQ ID NO: 1881913 - DNA, 16 bp, Homo sapiens
tttttcttgctgttca

SEQ ID NO: 1881914 - DNA, 18 bp, Homo sapiens
tttttcttgctgttcagt

SEQ ID NO: 1881915 - DNA, 21 bp, Homo sapiens
tttttcttgctgttcagtgct

SEQ ID NO: 1881916 - DNA, 18 bp, Homo sapiens
tttttctttttaaagttt

SEQ ID NO: 1881917 - DNA, 16 bp, Homo sapiens
tttttgtacctggtga

SEQ ID NO: 1881918 - DNA, 15 bp, Homo sapiens
ttttttaacatcttt

SEQ ID NO: 1881919 - DNA, 23 bp, Homo sapiens
ttttttaacgtggcttgtagaat

SEQ ID NO: 1881920 - DNA, 13 bp, Homo sapiens
ttttttcttttta

SEQ ID NO: 1881921 - DNA, 13 bp, Homo sapiens
ttttttttaacat

SEQ ID NO: 1881922 - DNA, 21 bp, Homo sapiens
tacagtaaataaattgtttga

SEQ ID NO: 1881923 - DNA, 13 bp, Homo sapiens
tacagttaagttt

SEQ ID NO: 1881924 - DNA, 20 bp, Homo sapiens
tacatcccttacctgggaaa

SEQ ID NO: 1881925 - DNA, 14 bp, Homo sapiens
tacatgcatacact

SEQ ID NO: 1881926 - DNA, 20 bp, Homo sapiens
tacatttatagttgtaacta

SEQ ID NO: 1881927 - DNA, 18 bp, Homo sapiens
taccagagtctggagctg

SEQ ID NO: 1881928 - DNA, 14 bp, Homo sapiens
taccaggtctcctc

SEQ ID NO: 1881929 - DNA, 22 bp, Homo sapiens
taccaggtctcctccaccgcca

SEQ ID NO: 1881930 - DNA, 19 bp, Homo sapiens
tacccatgtctacacagat

SEQ ID NO: 1881931 - DNA, 12 bp, Homo sapiens
tacccccgccca

SEQ ID NO: 1881932 - DNA, 17 bp, Homo sapiens
tacccgttcacattttt

SEQ ID NO: 1881933 - DNA, 11 bp, Homo sapiens
taccctccctg

SEQ ID NO: 1881934 - DNA, 22 bp, Homo sapiens
taccctccctgctgtcccctct

SEQ ID NO: 1881935 - DNA, 16 bp, Homo sapiens
taccgatgatactgtt

SEQ ID NO: 1881936 - DNA, 17 bp, Homo sapiens
tacctgtcatctgggcc

SEQ ID NO: 1881937 - DNA, 22 bp, Homo sapiens
taccttctcaaaagattgtttt

SEQ ID NO: 1881938 - DNA, 23 bp, Homo sapiens
tacctttccagggtcaaagtaca

SEQ ID NO: 1881939 - DNA, 15 bp, Homo sapiens
tacggagggaccagg

SEQ ID NO: 1881940 - DNA, 14 bp, Homo sapiens
tacgtgggagaggc

SEQ ID NO: 1881941 - DNA, 18 bp, Homo sapiens
tacgtgtatgtttcttct

SEQ ID NO: 1881942 - DNA, 19 bp, Homo sapiens
tacgtgtatgtttcttctt

SEQ ID NO: 1881943 - DNA, 12 bp, Homo sapiens
tacgtttaaagt

SEQ ID NO: 1881944 - DNA, 17 bp, Homo sapiens
tacgtttaaagtgcagt

SEQ ID NO: 1881945 - DNA, 18 bp, Homo sapiens
tactaaatggtgttacat

SEQ ID NO: 1881946 - DNA, 15 bp, Homo sapiens
tactaagaggctatt

SEQ ID NO: 1881947 - DNA, 22 bp, Homo sapiens
tactaggggcccggatccagga

SEQ ID NO: 1881948 - DNA, 20 bp, Homo sapiens
tactcactttctagattaag

SEQ ID NO: 1881949 - DNA, 14 bp, Homo sapiens
tactctacactgaa

SEQ ID NO: 1881950 - DNA, 19 bp, Homo sapiens
tactctgtgtaaagacttg

SEQ ID NO: 1881951 - DNA, 17 bp, Homo sapiens
tactgcagcctccagag

SEQ ID NO: 1881952 - DNA, 14 bp, Homo sapiens
tactggcctcgcct

SEQ ID NO: 1881953 - DNA, 14 bp, Homo sapiens
tactgtaagaaaat

SEQ ID NO: 1881954 - DNA, 14 bp, Homo sapiens
tacttcaaatcctt

SEQ ID NO: 1881955 - DNA, 19 bp, Homo sapiens
tacttcaaatccttgaaga

SEQ ID NO: 1881956 - DNA, 14 bp, Homo sapiens
tacttgtttcagag

SEQ ID NO: 1881957 - DNA, 15 bp, Homo sapiens
tacttgtttcagagt

SEQ ID NO: 1881958 - DNA, 18 bp, Homo sapiens
tagaaaagaaaacattta

SEQ ID NO: 1881959 - DNA, 15 bp, Homo sapiens
tagaaacacaactat

SEQ ID NO: 1881960 - DNA, 20 bp, Homo sapiens
tagaactttgccagtcttta

SEQ ID NO: 1881961 - DNA, 14 bp, Homo sapiens
tagaatttttaaaa

SEQ ID NO: 1881962 - DNA, 17 bp, Homo sapiens
tagaggctttcaaatgt

SEQ ID NO: 1881963 - DNA, 18 bp, Homo sapiens
tagaggctttcaaatgta

SEQ ID NO: 1881964 - DNA, 18 bp, Homo sapiens
tagatacatgctttttaa

SEQ ID NO: 1881965 - DNA, 19 bp, Homo sapiens
tagatatccacttgagaca

SEQ ID NO: 1881966 - DNA, 16 bp, Homo sapiens
tagatgcagttctgaa

SEQ ID NO: 1881967 - DNA, 17 bp, Homo sapiens
tagatgcagttctgaag

SEQ ID NO: 1881968 - DNA, 19 bp, Homo sapiens
tagatgcagttctgaagaa

SEQ ID NO: 1881969 - DNA, 18 bp, Homo sapiens
tagatttgtattttaaaa

SEQ ID NO: 1881970 - DNA, 18 bp, Homo sapiens
tagattttttttaaagtt

SEQ ID NO: 1881971 - DNA, 17 bp, Homo sapiens
tagcaagacctgaaaat

SEQ ID NO: 1881972 - DNA, 23 bp, Homo sapiens
tagcaagacctgaaaatatgtct

SEQ ID NO: 1881973 - DNA, 22 bp, Homo sapiens
tagcagactttcccaaatgtat

SEQ ID NO: 1881974 - DNA, 23 bp, Homo sapiens
tagctacatagcagactttccca

SEQ ID NO: 1881975 - DNA, 14 bp, Homo sapiens
tagctctgagccct

SEQ ID NO: 1881976 - DNA, 15 bp, Homo sapiens
tagctgagctttaaa

SEQ ID NO: 1881977 - DNA, 20 bp, Homo sapiens
tagctgagctttaaatcatt

SEQ ID NO: 1881978 - DNA, 14 bp, Homo sapiens
tagctgtctcagga

SEQ ID NO: 1881979 - DNA, 17 bp, Homo sapiens
tagctgtctcaggagta

SEQ ID NO: 1881980 - DNA, 14 bp, Homo sapiens
tagcttcagttgtt

SEQ ID NO: 1881981 - DNA, 17 bp, Homo sapiens
taggcagggatttgagg

SEQ ID NO: 1881982 - DNA, 13 bp, Homo sapiens
tagggatctgggg

SEQ ID NO: 1881983 - DNA, 12 bp, Homo sapiens
taggggctgggg

SEQ ID NO: 1881984 - DNA, 16 bp, Homo sapiens
taggtaaataaagctc

SEQ ID NO: 1881985 - DNA, 18 bp, Homo sapiens
taggtaaataaagctcaa

SEQ ID NO: 1881986 - DNA, 19 bp, Homo sapiens
taggtaaataaagctcaag

SEQ ID NO: 1881987 - DNA, 14 bp, Homo sapiens
taggtgctggcctc

SEQ ID NO: 1881988 - DNA, 20 bp, Homo sapiens
tagtctgtgtaactttaaac

SEQ ID NO: 1881989 - DNA, 15 bp, Homo sapiens
tagtgcaaattgtca

SEQ ID NO: 1881990 - DNA, 19 bp, Homo sapiens
tagtggaggaggtggcttc

SEQ ID NO: 1881991 - DNA, 22 bp, Homo sapiens
tagtggaggaggtggcttcatg

SEQ ID NO: 1881992 - DNA, 17 bp, Homo sapiens
tataaaaaatggtgcct

SEQ ID NO: 1881993 - DNA, 19 bp, Homo sapiens
tataaaaaatggtgcctga

SEQ ID NO: 1881994 - DNA, 23 bp, Homo sapiens
tataaaataatttttatatttga

SEQ ID NO: 1881995 - DNA, 18 bp, Homo sapiens
tataaaggaccctgtttc

SEQ ID NO: 1881996 - DNA, 21 bp, Homo sapiens
tataaaggaccctgtttctgt

SEQ ID NO: 1881997 - DNA, 18 bp, Homo sapiens
tataacaatgctgtattt

SEQ ID NO: 1881998 - DNA, 22 bp, Homo sapiens
tataagaaaaaattctttcact

SEQ ID NO: 1881999 - DNA, 14 bp, Homo sapiens
tataatagattttt

SEQ ID NO: 1882000 - DNA, 17 bp, Homo sapiens
tatactcactttctaga

SEQ ID NO: 1882001 - DNA, 15 bp, Homo sapiens
tatagagatatgcag

SEQ ID NO: 1882002 - DNA, 23 bp, Homo sapiens
tatataaacactccacagtgttt

SEQ ID NO: 1882003 - DNA, 13 bp, Homo sapiens
tatataacaatgc

SEQ ID NO: 1882004 - DNA, 19 bp, Homo sapiens
tatataacaatgctgtatt

SEQ ID NO: 1882005 - DNA, 22 bp, Homo sapiens
actttttatggcactagtattt

SEQ ID NO: 1882006 - DNA, 14 bp, Homo sapiens
agaaaaatactttg

SEQ ID NO: 1882007 - DNA, 16 bp, Homo sapiens
agaaaacaaggatgaa

SEQ ID NO: 1882008 - DNA, 13 bp, Homo sapiens
agaaaacatttaa

SEQ ID NO: 1882009 - DNA, 14 bp, Homo sapiens
agaaaattagtaat

SEQ ID NO: 1882010 - DNA, 13 bp, Homo sapiens
agaaacaggccca

SEQ ID NO: 1882011 - DNA, 19 bp, Homo sapiens
agaaagtcttatttattca

SEQ ID NO: 1882012 - DNA, 20 bp, Homo sapiens
agaaagtgtgtgtgttctgt

SEQ ID NO: 1882013 - DNA, 20 bp, Homo sapiens
agaacacttcagcctgtgca

SEQ ID NO: 1882014 - DNA, 18 bp, Homo sapiens
agaagactgcattatatt

SEQ ID NO: 1882015 - DNA, 21 bp, Homo sapiens
agaagactgcattatatttat

SEQ ID NO: 1882016 - DNA, 12 bp, Homo sapiens
agaagcagctct

SEQ ID NO: 1882017 - DNA, 15 bp, Homo sapiens
agaaggtgcttgggc

SEQ ID NO: 1882018 - DNA, 14 bp, Homo sapiens
agaataaaattgta

SEQ ID NO: 1882019 - DNA, 10 bp, Homo sapiens
agaattgact

SEQ ID NO: 1882020 - DNA, 20 bp, Homo sapiens
agaatttttaaaaaagtgat

SEQ ID NO: 1882021 - DNA, 16 bp, Homo sapiens
agacacactgaagaag

SEQ ID NO: 1882022 - DNA, 16 bp, Homo sapiens
agacacttatattttg

SEQ ID NO: 1882023 - DNA, 13 bp, Homo sapiens
agacagcttttta

SEQ ID NO: 1882024 - DNA, 18 bp, Homo sapiens
agacccatacctttccag

SEQ ID NO: 1882025 - DNA, 15 bp, Homo sapiens
agacccatctggagg

SEQ ID NO: 1882026 - DNA, 16 bp, Homo sapiens
agacccatctggaggc

SEQ ID NO: 1882027 - DNA, 22 bp, Homo sapiens
agactctttttgtacctggtga

SEQ ID NO: 1882028 - DNA, 13 bp, Homo sapiens
agactgcagagga

SEQ ID NO: 1882029 - DNA, 20 bp, Homo sapiens
agagacacactgaagaagca

SEQ ID NO: 1882030 - DNA, 16 bp, Homo sapiens
agagactggccagagg

SEQ ID NO: 1882031 - DNA, 19 bp, Homo sapiens
agagagaaaacttatttga

SEQ ID NO: 1882032 - DNA, 23 bp, Homo sapiens
agagagcagcttctgccacttcc

SEQ ID NO: 1882033 - DNA, 13 bp, Homo sapiens
agagcacagccct

SEQ ID NO: 1882034 - DNA, 20 bp, Homo sapiens
agagcatctgctctgagacg

SEQ ID NO: 1882035 - DNA, 22 bp, Homo sapiens
agagcttcagggctgggcaggt

SEQ ID NO: 1882036 - DNA, 14 bp, Homo sapiens
agaggagagcatct

SEQ ID NO: 1882037 - DNA, 17 bp, Homo sapiens
agaggagccacctgggc

SEQ ID NO: 1882038 - DNA, 23 bp, Homo sapiens
agaggcaacagtgttctgagccc

SEQ ID NO: 1882039 - DNA, 20 bp, Homo sapiens
agaggcagctaaggggcagg

SEQ ID NO: 1882040 - DNA, 15 bp, Homo sapiens
agaggggcaggccct

SEQ ID NO: 1882041 - DNA, 23 bp, Homo sapiens
agagtctggagctgagctacctg

SEQ ID NO: 1882042 - DNA, 21 bp, Homo sapiens
agagtgctgtccggtggagat

SEQ ID NO: 1882043 - DNA, 16 bp, Homo sapiens
agagtttagctggaaa

SEQ ID NO: 1882044 - DNA, 23 bp, Homo sapiens
agatattgggaaggaaatatatt

SEQ ID NO: 1882045 - DNA, 13 bp, Homo sapiens
agatatttttcat

SEQ ID NO: 1882046 - DNA, 19 bp, Homo sapiens
agatatttttccatttttt

SEQ ID NO: 1882047 - DNA, 18 bp, Homo sapiens
agatcacataccagagtc

SEQ ID NO: 1882048 - DNA, 22 bp, Homo sapiens
agatcgttcattgcctttccag

SEQ ID NO: 1882049 - DNA, 19 bp, Homo sapiens
agatcttggcttaatttaa

SEQ ID NO: 1882050 - DNA, 18 bp, Homo sapiens
agatgagttgcagttttt

SEQ ID NO: 1882051 - DNA, 18 bp, Homo sapiens
agatgcagttctgaagaa

SEQ ID NO: 1882052 - DNA, 19 bp, Homo sapiens
agatgcagttctgaagaag

SEQ ID NO: 1882053 - DNA, 22 bp, Homo sapiens
agatgtatgtacttcatgctgt

SEQ ID NO: 1882054 - DNA, 15 bp, Homo sapiens
agatgttcacccaac

SEQ ID NO: 1882055 - DNA, 23 bp, Homo sapiens
agattgttttatatgtagtacta

SEQ ID NO: 1882056 - DNA, 14 bp, Homo sapiens
agattttcctgaaa

SEQ ID NO: 1882057 - DNA, 16 bp, Homo sapiens
agattttttttaaagt

SEQ ID NO: 1882058 - DNA, 18 bp, Homo sapiens
agattttttttaaagttt

SEQ ID NO: 1882059 - DNA, 23 bp, Homo sapiens
agcaaaattttttctctaggaaa

SEQ ID NO: 1882060 - DNA, 24 bp, Homo sapiens
agcaaaattttttctctaggaaat

SEQ ID NO: 1882061 - DNA, 20 bp, Homo sapiens
agcaaagtctaaagtttaca

SEQ ID NO: 1882062 - DNA, 22 bp, Homo sapiens
agcaaggaggctggctggggcc

SEQ ID NO: 1882063 - DNA, 20 bp, Homo sapiens
aagctgtgccaccctgggct

SEQ ID NO: 1882064 - DNA, 16 bp, Homo sapiens
aagcttaaggagagga

SEQ ID NO: 1882065 - DNA, 16 bp, Homo sapiens
aagctttcaccagcca

SEQ ID NO: 1882066 - DNA, 19 bp, Homo sapiens
aaggaccctgtttctgtag

SEQ ID NO: 1882067 - DNA, 13 bp, Homo sapiens
aaggcctcccaca

SEQ ID NO: 1882068 - DNA, 14 bp, Homo sapiens
aaggcctcccacag

SEQ ID NO: 1882069 - DNA, 15 bp, Homo sapiens
aaggcctcccacagt

SEQ ID NO: 1882070 - DNA, 17 bp, Homo sapiens
aaggcctcccacagtga

SEQ ID NO: 1882071 - DNA, 19 bp, Homo sapiens
aaggcctcccacagtgact

SEQ ID NO: 1882072 - DNA, 15 bp, Homo sapiens
aaggggcaggaatca

SEQ ID NO: 1882073 - DNA, 18 bp, Homo sapiens
aaggtgggggagcctgga

SEQ ID NO: 1882074 - DNA, 19 bp, Homo sapiens
aaggtgggggagcctggag

SEQ ID NO: 1882075 - DNA, 21 bp, Homo sapiens
aaggtgggggagcctggagcc

SEQ ID NO: 1882076 - DNA, 19 bp, Homo sapiens
aagtaatgataactggaaa

SEQ ID NO: 1882077 - DNA, 21 bp, Homo sapiens
aagtacagaaaaatactttga

SEQ ID NO: 1882078 - DNA, 22 bp, Homo sapiens
aagtacagaatagaatacattg

SEQ ID NO: 1882079 - DNA, 19 bp, Homo sapiens
aagtatgttagtgcaaatt

SEQ ID NO: 1882080 - DNA, 23 bp, Homo sapiens
aagtatgttagtgcaaattgtca

SEQ ID NO: 1882081 - DNA, 13 bp, Homo sapiens
aagtattagaata

SEQ ID NO: 1882082 - DNA, 20 bp, Homo sapiens
aagtattaggggtaatatat

SEQ ID NO: 1882083 - DNA, 12 bp, Homo sapiens
aagtatttgtgg

SEQ ID NO: 1882084 - DNA, 16 bp, Homo sapiens
aagtctaattcacagg

SEQ ID NO: 1882085 - DNA, 17 bp, Homo sapiens
aagtgtgtgtgttctgt

SEQ ID NO: 1882086 - DNA, 20 bp, Homo sapiens
aagtttacagtaaataaatt

SEQ ID NO: 1882087 - DNA, 16 bp, Homo sapiens
aagtttatgtctaaag

SEQ ID NO: 1882088 - DNA, 23 bp, Homo sapiens
aagtttggtattgtaaaacattc

SEQ ID NO: 1882089 - DNA, 13 bp, Homo sapiens
aataaacagttgt

SEQ ID NO: 1882090 - DNA, 19 bp, Homo sapiens
aataaacttagaataaaat

SEQ ID NO: 1882091 - DNA, 21 bp, Homo sapiens
aataaacttagaataaaattg

SEQ ID NO: 1882092 - DNA, 19 bp, Homo sapiens
aataatttttatatttgaa

SEQ ID NO: 1882093 - DNA, 22 bp, Homo sapiens
aataatttttcacttcaaaaca

SEQ ID NO: 1882094 - DNA, 21 bp, Homo sapiens
aatacagaattgactgcagtt

SEQ ID NO: 1882095 - DNA, 23 bp, Homo sapiens
aatacatcccttacctgggaaag

SEQ ID NO: 1882096 - DNA, 21 bp, Homo sapiens
aatacctttaaatttaggtaa

SEQ ID NO: 1882097 - DNA, 23 bp, Homo sapiens
aatactttgatttttatccattt

SEQ ID NO: 1882098 - DNA, 19 bp, Homo sapiens
aatagtcaaattgtgtgaa

SEQ ID NO: 1882099 - DNA, 20 bp, Homo sapiens
aatagttttattaataaaca

SEQ ID NO: 1882100 - DNA, 21 bp, Homo sapiens
aatagttttattaataaacat

SEQ ID NO: 1882101 - DNA, 22 bp, Homo sapiens
aatagttttattaataaacatt

SEQ ID NO: 1882102 - DNA, 11 bp, Homo sapiens
aatatataaac

SEQ ID NO: 1882103 - DNA, 13 bp, Homo sapiens
aatatatggtctg

SEQ ID NO: 1882104 - DNA, 14 bp, Homo sapiens
aatatatttgtaaa

SEQ ID NO: 1882105 - DNA, 22 bp, Homo sapiens
aatatcacttgtcaataaaatc

SEQ ID NO: 1882106 - DNA, 16 bp, Homo sapiens
aatattatgttaaaac

SEQ ID NO: 1882107 - DNA, 18 bp, Homo sapiens
aatatttattttaataat

SEQ ID NO: 1882108 - DNA, 19 bp, Homo sapiens
aatatttattttaataatg

SEQ ID NO: 1882109 - DNA, 17 bp, Homo sapiens
aatatttttaatatata

SEQ ID NO: 1882110 - DNA, 13 bp, Homo sapiens
aatatttttctta

SEQ ID NO: 1882111 - DNA, 16 bp, Homo sapiens
aatcagcctagttgat

SEQ ID NO: 1882112 - DNA, 22 bp, Homo sapiens
aatcagggttagtattgtccag

SEQ ID NO: 1882113 - DNA, 12 bp, Homo sapiens
aatcatgaatta

SEQ ID NO: 1882114 - DNA, 14 bp, Homo sapiens
aatccatacatttg

SEQ ID NO: 1882115 - DNA, 14 bp, Homo sapiens
aatctattttgtaa

SEQ ID NO: 1882116 - DNA, 13 bp, Homo sapiens
aatctgtttgtgc

SEQ ID NO: 1882117 - DNA, 15 bp, Homo sapiens
aatctgtttgtgcaa

SEQ ID NO: 1882118 - DNA, 20 bp, Homo sapiens
aatcttgttttgtttgcttc

SEQ ID NO: 1882119 - DNA, 22 bp, Homo sapiens
aatcttgttttgtttgcttcca

SEQ ID NO: 1882120 - DNA, 23 bp, Homo sapiens
aatcttgttttgtttgcttccat

SEQ ID NO: 1882121 - DNA, 16 bp, Homo sapiens
aatgaagttattcttg

SEQ ID NO: 1882122 - DNA, 20 bp, Homo sapiens
aatgaccagcagcagctttc

SEQ ID NO: 1882123 - DNA, 14 bp, Homo sapiens
aatgagactatgcg

SEQ ID NO: 1882124 - DNA, 15 bp, Homo sapiens
aatgataactggaaa

SEQ ID NO: 1882125 - DNA, 20 bp, Homo sapiens
aatgataactggaaacttca

SEQ ID NO: 1882126 - DNA, 16 bp, Homo sapiens
aatgctgtattttaaa

SEQ ID NO: 1882127 - DNA, 22 bp, Homo sapiens
aatgctgtattttaaaagaatg

SEQ ID NO: 1882128 - DNA, 18 bp, Homo sapiens
aatggttgtgaaatgtaa

SEQ ID NO: 1882129 - DNA, 23 bp, Homo sapiens
aatgtaccgatgatactgtttct

SEQ ID NO: 1882130 - DNA, 17 bp, Homo sapiens
aatgtatatgtcattta

SEQ ID NO: 1882131 - DNA, 15 bp, Homo sapiens
aatgtattaatctgt

SEQ ID NO: 1882132 - DNA, 19 bp, Homo sapiens
aatgtattaatctgtttgt

SEQ ID NO: 1882133 - DNA, 18 bp, Homo sapiens
aatgtcagtgtttgggaa

SEQ ID NO: 1882134 - DNA, 23 bp, Homo sapiens
aatgtttcaaacatatataacaa

SEQ ID NO: 1882135 - DNA, 17 bp, Homo sapiens
aattacacaataaagca

SEQ ID NO: 1882136 - DNA, 12 bp, Homo sapiens
cacacacgttat

SEQ ID NO: 1882137 - DNA, 20 bp, Homo sapiens
cacaccaagctgtgccaccc

SEQ ID NO: 1882138 - DNA, 22 bp, Homo sapiens
cacaccaagctgtgccaccctg

SEQ ID NO: 1882139 - DNA, 21 bp, Homo sapiens
cacactcgggttaagaaatac

SEQ ID NO: 1882140 - DNA, 13 bp, Homo sapiens
cacactgaagaag

SEQ ID NO: 1882141 - DNA, 16 bp, Homo sapiens
cacagcaaggaggctg

SEQ ID NO: 1882142 - DNA, 23 bp, Homo sapiens
cacagcaaggaggctggctgggg

SEQ ID NO: 1882143 - DNA, 16 bp, Homo sapiens
cacagcccacgtcctg

SEQ ID NO: 1882144 - DNA, 18 bp, Homo sapiens
cacagccctcccgcccct

SEQ ID NO: 1882145 - DNA, 20 bp, Homo sapiens
cacagccctcccgccccttc

SEQ ID NO: 1882146 - DNA, 17 bp, Homo sapiens
cacagcctcttagatgc

SEQ ID NO: 1882147 - DNA, 19 bp, Homo sapiens
cacaggaaccacaagactg

SEQ ID NO: 1882148 - DNA, 13 bp, Homo sapiens
cacagtgtctggg

SEQ ID NO: 1882149 - DNA, 17 bp, Homo sapiens
cacagtgtctgggctga

SEQ ID NO: 1882150 - DNA, 21 bp, Homo sapiens
cacagtgtctgggctgactgg

SEQ ID NO: 1882151 - DNA, 17 bp, Homo sapiens
cacatgaagtccaagca

SEQ ID NO: 1882152 - DNA, 14 bp, Homo sapiens
caccaacccagccg

SEQ ID NO: 1882153 - DNA, 20 bp, Homo sapiens
caccaacccagccgctgccc

SEQ ID NO: 1882154 - DNA, 21 bp, Homo sapiens
caccaacccagccgctgcccg

SEQ ID NO: 1882155 - DNA, 13 bp, Homo sapiens
caccaagctgctg

SEQ ID NO: 1882156 - DNA, 15 bp, Homo sapiens
caccaagctgtgcca

SEQ ID NO: 1882157 - DNA, 20 bp, Homo sapiens
caccagcccacatccagtgg

SEQ ID NO: 1882158 - DNA, 13 bp, Homo sapiens
caccagctccact

SEQ ID NO: 1882159 - DNA, 18 bp, Homo sapiens
caccagctccactggcct

SEQ ID NO: 1882160 - DNA, 17 bp, Homo sapiens
caccaggggcaggcaca

SEQ ID NO: 1882161 - DNA, 19 bp, Homo sapiens
caccaggggcaggcacagc

SEQ ID NO: 1882162 - DNA, 21 bp, Homo sapiens
caccaggggcaggcacagcac

SEQ ID NO: 1882163 - DNA, 21 bp, Homo sapiens
caccagtgtgtggctttcaga

SEQ ID NO: 1882164 - DNA, 17 bp, Homo sapiens
caccagttgaactgcag

SEQ ID NO: 1882165 - DNA, 17 bp, Homo sapiens
cacccagtctgttcccc

SEQ ID NO: 1882166 - DNA, 14 bp, Homo sapiens
cacccccactctgc

SEQ ID NO: 1882167 - DNA, 13 bp, Homo sapiens
cacccgggctcag

SEQ ID NO: 1882168 - DNA, 23 bp, Homo sapiens
cacccgggctcagggaccacagc

SEQ ID NO: 1882169 - DNA, 12 bp, Homo sapiens
caccctcccctc

SEQ ID NO: 1882170 - DNA, 14 bp, Homo sapiens
caccctcccctccc

SEQ ID NO: 1882171 - DNA, 20 bp, Homo sapiens
caccctgcctctacccaacc

SEQ ID NO: 1882172 - DNA, 16 bp, Homo sapiens
caccctgggctctgtg

SEQ ID NO: 1882173 - DNA, 19 bp, Homo sapiens
caccctgggctctgtgggc

SEQ ID NO: 1882174 - DNA, 22 bp, Homo sapiens
caccctgggctctgtgggctgc

SEQ ID NO: 1882175 - DNA, 14 bp, Homo sapiens
caccgcatgccccc

SEQ ID NO: 1882176 - DNA, 22 bp, Homo sapiens
caccgcatgccccctcgtgcca

SEQ ID NO: 1882177 - DNA, 13 bp, Homo sapiens
caccgccatggct

SEQ ID NO: 1882178 - DNA, 16 bp, Homo sapiens
caccgccatggcttcc

SEQ ID NO: 1882179 - DNA, 22 bp, Homo sapiens
caccgccatggcttccaaggtg

SEQ ID NO: 1882180 - DNA, 14 bp, Homo sapiens
caccggtcagtgcc

SEQ ID NO: 1882181 - DNA, 17 bp, Homo sapiens
cacctagtggctgtcca

SEQ ID NO: 1882182 - DNA, 22 bp, Homo sapiens
cacctagtggctgtccagtgcc

SEQ ID NO: 1882183 - DNA, 14 bp, Homo sapiens
cacctcatggaatt

SEQ ID NO: 1882184 - DNA, 19 bp, Homo sapiens
cacctctgaggactctgga

SEQ ID NO: 1882185 - DNA, 16 bp, Homo sapiens
cacctctgggccctgc

SEQ ID NO: 1882186 - DNA, 22 bp, Homo sapiens
cacctgcaggttgggccatact

SEQ ID NO: 1882187 - DNA, 14 bp, Homo sapiens
cacctgggctggga

SEQ ID NO: 1882188 - DNA, 11 bp, Homo sapiens
cacctggtggg

SEQ ID NO: 1882189 - DNA, 23 bp, Homo sapiens
cacggtggacttagctctgagga

SEQ ID NO: 1882190 - DNA, 16 bp, Homo sapiens
cacgtcctgtcagtgc

SEQ ID NO: 1882191 - DNA, 17 bp, Homo sapiens
cactaaacagactattt

SEQ ID NO: 1882192 - DNA, 12 bp, Homo sapiens
cactagtctgtg

SEQ ID NO: 1882193 - DNA, 15 bp, Homo sapiens
cactatagtgtaata

SEQ ID NO: 1882194 - DNA, 20 bp, Homo sapiens
cactatagtgtaataatgtt

SEQ ID NO: 1882195 - DNA, 17 bp, Homo sapiens
cactatgctgctatgga

SEQ ID NO: 1882196 - DNA, 17 bp, Homo sapiens
cactcacaacagctgcc

SEQ ID NO: 1882197 - DNA, 13 bp, Homo sapiens
cactccacagtgt

SEQ ID NO: 1882198 - DNA, 14 bp, Homo sapiens
cactccacagtgtt

SEQ ID NO: 1882199 - DNA, 14 bp, Homo sapiens
cactctgtgcccat

SEQ ID NO: 1882200 - DNA, 16 bp, Homo sapiens
cactctgtgcccatgg

SEQ ID NO: 1882201 - DNA, 18 bp, Homo sapiens
cactctgtgcccatgggc

SEQ ID NO: 1882202 - DNA, 20 bp, Homo sapiens
cactctgtggtccagagtca

SEQ ID NO: 1882203 - DNA, 13 bp, Homo sapiens
cactgaatatata

SEQ ID NO: 1882204 - DNA, 16 bp, Homo sapiens
cactgcaccccctcct

SEQ ID NO: 1882205 - DNA, 18 bp, Homo sapiens
cactgcaccccctcctgc

SEQ ID NO: 1882206 - DNA, 19 bp, Homo sapiens
cactgcaccccctcctgct

SEQ ID NO: 1882207 - DNA, 21 bp, Homo sapiens
cactgcggggcttggctgaga

SEQ ID NO: 1882208 - DNA, 13 bp, Homo sapiens
cactgctcacact

SEQ ID NO: 1882209 - DNA, 17 bp, Homo sapiens
cactgctgggtggccca

SEQ ID NO: 1882210 - DNA, 23 bp, Homo sapiens
cactgctgggtggcccatccccc

SEQ ID NO: 1882211 - DNA, 13 bp, Homo sapiens
cactggctgcctc

SEQ ID NO: 1882212 - DNA, 16 bp, Homo sapiens
cactggctgcctccac

SEQ ID NO: 1882213 - DNA, 22 bp, Homo sapiens
agctgtgccaccctgggctctg

SEQ ID NO: 1882214 - DNA, 15 bp, Homo sapiens
agcttaaggagagga

SEQ ID NO: 1882215 - DNA, 16 bp, Homo sapiens
agcttaaggagaggag

SEQ ID NO: 1882216 - DNA, 21 bp, Homo sapiens
agcttattgtctagtgaaact

SEQ ID NO: 1882217 - DNA, 17 bp, Homo sapiens
agcttcagggctgggca

SEQ ID NO: 1882218 - DNA, 15 bp, Homo sapiens
agcttctgctgggct

SEQ ID NO: 1882219 - DNA, 16 bp, Homo sapiens
agcttctgctgggctg

SEQ ID NO: 1882220 - DNA, 14 bp, Homo sapiens
agcttgatctgtga

SEQ ID NO: 1882221 - DNA, 14 bp, Homo sapiens
aggaaaagcctctg

SEQ ID NO: 1882222 - DNA, 19 bp, Homo sapiens
aggaaaagcctctgtgtca

SEQ ID NO: 1882223 - DNA, 14 bp, Homo sapiens
aggaaatatttatt

SEQ ID NO: 1882224 - DNA, 12 bp, Homo sapiens
aggaaggtggct

SEQ ID NO: 1882225 - DNA, 22 bp, Homo sapiens
aggaaggtggcttaccaagatc

SEQ ID NO: 1882226 - DNA, 14 bp, Homo sapiens
aggacactgatatg

SEQ ID NO: 1882227 - DNA, 20 bp, Homo sapiens
aggaccaacccatgccctgc

SEQ ID NO: 1882228 - DNA, 14 bp, Homo sapiens
aggaccctgtttct

SEQ ID NO: 1882229 - DNA, 16 bp, Homo sapiens
aggacggggccggcca

SEQ ID NO: 1882230 - DNA, 20 bp, Homo sapiens
aggacggggccggccaggtg

SEQ ID NO: 1882231 - DNA, 15 bp, Homo sapiens
aggagagcatctgct

SEQ ID NO: 1882232 - DNA, 19 bp, Homo sapiens
aggagagcatctgctctga

SEQ ID NO: 1882233 - DNA, 21 bp, Homo sapiens
aggagagcatctgctctgaga

SEQ ID NO: 1882234 - DNA, 12 bp, Homo sapiens
aggagaggagag

SEQ ID NO: 1882235 - DNA, 15 bp, Homo sapiens
aggagaggagagcat

SEQ ID NO: 1882236 - DNA, 18 bp, Homo sapiens
aggagattttccttccta

SEQ ID NO: 1882237 - DNA, 16 bp, Homo sapiens
aggagcagcttcagtt

SEQ ID NO: 1882238 - DNA, 16 bp, Homo sapiens
aggaggaaccaggcta

SEQ ID NO: 1882239 - DNA, 16 bp, Homo sapiens
aggaggcctgggaggg

SEQ ID NO: 1882240 - DNA, 14 bp, Homo sapiens
aggaggctggctgg

SEQ ID NO: 1882241 - DNA, 20 bp, Homo sapiens
aggaggggcccgttgtctcc

SEQ ID NO: 1882242 - DNA, 15 bp, Homo sapiens
aggaggtggcttcat

SEQ ID NO: 1882243 - DNA, 18 bp, Homo sapiens
aggagtacccccagccca

SEQ ID NO: 1882244 - DNA, 18 bp, Homo sapiens
aggatactatattttagg

SEQ ID NO: 1882245 - DNA, 18 bp, Homo sapiens
aggcaaaccaatacagaa

SEQ ID NO: 1882246 - DNA, 21 bp, Homo sapiens
aggcaacagtgttctgagccc

SEQ ID NO: 1882247 - DNA, 14 bp, Homo sapiens
aggcacctgcaggt

SEQ ID NO: 1882248 - DNA, 18 bp, Homo sapiens
aggcacctgcaggttggg

SEQ ID NO: 1882249 - DNA, 16 bp, Homo sapiens
aggcagctaaggggca

SEQ ID NO: 1882250 - DNA, 15 bp, Homo sapiens
aggcaggactcctgg

SEQ ID NO: 1882251 - DNA, 16 bp, Homo sapiens
aggcaggggagtctgc

SEQ ID NO: 1882252 - DNA, 14 bp, Homo sapiens
aggccaggccaccc

SEQ ID NO: 1882253 - DNA, 23 bp, Homo sapiens
aggccatgggcactgtgggtaga

SEQ ID NO: 1882254 - DNA, 13 bp, Homo sapiens
aggccccaggtca

SEQ ID NO: 1882255 - DNA, 24 bp, Homo sapiens
aggccctgcactgtcctgctccac

SEQ ID NO: 1882256 - DNA, 17 bp, Homo sapiens
aggcctgggagggcaag

SEQ ID NO: 1882257 - DNA, 20 bp, Homo sapiens
aggcggaggttgcagtgagc

SEQ ID NO: 1882258 - DNA, 14 bp, Homo sapiens
aggcgggggagcct

SEQ ID NO: 1882259 - DNA, 15 bp, Homo sapiens
aggcgggggagcctg

SEQ ID NO: 1882260 - DNA, 19 bp, Homo sapiens
aggcgggggagcctggagc

SEQ ID NO: 1882261 - DNA, 21 bp, Homo sapiens
aggcgggggatcctggagccc

SEQ ID NO: 1882262 - DNA, 22 bp, Homo sapiens
aggcgggggatcctggagcccc

SEQ ID NO: 1882263 - DNA, 23 bp, Homo sapiens
aggcgggggatcctggagcccct

SEQ ID NO: 1882264 - DNA, 15 bp, Homo sapiens
aggctagatgtatgt

SEQ ID NO: 1882265 - DNA, 17 bp, Homo sapiens
aggctgagactgcagag

SEQ ID NO: 1882266 - DNA, 20 bp, Homo sapiens
aggctgcagcaggcagagga

SEQ ID NO: 1882267 - DNA, 16 bp, Homo sapiens
aggctggccagcccca

SEQ ID NO: 1882268 - DNA, 21 bp, Homo sapiens
aggctggccagccccacagcc

SEQ ID NO: 1882269 - DNA, 14 bp, Homo sapiens
aggctttcaaatgt

SEQ ID NO: 1882270 - DNA, 19 bp, Homo sapiens
agggaagctttcaccagcc

SEQ ID NO: 1882271 - DNA, 22 bp, Homo sapiens
agggaagctttcaccagccaca

SEQ ID NO: 1882272 - DNA, 20 bp, Homo sapiens
agggagatgagttgcagttt

SEQ ID NO: 1882273 - DNA, 15 bp, Homo sapiens
agggaggcccatgtg

SEQ ID NO: 1882274 - DNA, 24 bp, Homo sapiens
agggatcctctctccaggccccag

SEQ ID NO: 1882275 - DNA, 22 bp, Homo sapiens
agggatctggggaaggaccaac

SEQ ID NO: 1882276 - DNA, 20 bp, Homo sapiens
ataatggttgtgaaatgtaa

SEQ ID NO: 1882277 - DNA, 18 bp, Homo sapiens
ataatgtttcaaacatat

SEQ ID NO: 1882278 - DNA, 17 bp, Homo sapiens
ataattacgtttaaagt

SEQ ID NO: 1882279 - DNA, 13 bp, Homo sapiens
ataattttgtgaa

SEQ ID NO: 1882280 - DNA, 20 bp, Homo sapiens
ataattttgtgaagcaaaat

SEQ ID NO: 1882281 - DNA, 19 bp, Homo sapiens
atacaaaggcttattaatt

SEQ ID NO: 1882282 - DNA, 22 bp, Homo sapiens
atacagaattgactgcagttga

SEQ ID NO: 1882283 - DNA, 17 bp, Homo sapiens
atacattgatacaaagt

SEQ ID NO: 1882284 - DNA, 22 bp, Homo sapiens
ataccacaggaaccacaagact

SEQ ID NO: 1882285 - DNA, 18 bp, Homo sapiens
ataccaccatttaaaaat

SEQ ID NO: 1882286 - DNA, 13 bp, Homo sapiens
atacctttccagg

SEQ ID NO: 1882287 - DNA, 17 bp, Homo sapiens
atactgtttcttgcact

SEQ ID NO: 1882288 - DNA, 14 bp, Homo sapiens
atacttgcagttgt

SEQ ID NO: 1882289 - DNA, 15 bp, Homo sapiens
atacttgcagttgtg

SEQ ID NO: 1882290 - DNA, 22 bp, Homo sapiens
atacttgcagttgtgatataaa

SEQ ID NO: 1882291 - DNA, 20 bp, Homo sapiens
atagaagcccaaattcatat

SEQ ID NO: 1882292 - DNA, 18 bp, Homo sapiens
atagaatgatagaacttt

SEQ ID NO: 1882293 - DNA, 21 bp, Homo sapiens
atagcagactttcccaaatgt

SEQ ID NO: 1882294 - DNA, 22 bp, Homo sapiens
atagcagactttcccaaatgta

SEQ ID NO: 1882295 - DNA, 19 bp, Homo sapiens
atagccctgcaaaaattca

SEQ ID NO: 1882296 - DNA, 19 bp, Homo sapiens
atagtgtaataatgttatt

SEQ ID NO: 1882297 - DNA, 22 bp, Homo sapiens
atagttattgttttatgttcta

SEQ ID NO: 1882298 - DNA, 16 bp, Homo sapiens
atagttttattaataa

SEQ ID NO: 1882299 - DNA, 22 bp, Homo sapiens
atataaatattagaaacagctt

SEQ ID NO: 1882300 - DNA, 19 bp, Homo sapiens
atataagcttgtattcctt

SEQ ID NO: 1882301 - DNA, 15 bp, Homo sapiens
atataccttctcaaa

SEQ ID NO: 1882302 - DNA, 13 bp, Homo sapiens
atatataaacact

SEQ ID NO: 1882303 - DNA, 14 bp, Homo sapiens
atatataaacactc

SEQ ID NO: 1882304 - DNA, 22 bp, Homo sapiens
atatgcttctgttttataattt

SEQ ID NO: 1882305 - DNA, 20 bp, Homo sapiens
atatggcagggaagctttca

SEQ ID NO: 1882306 - DNA, 16 bp, Homo sapiens
atatgtctgcaggttt

SEQ ID NO: 1882307 - DNA, 20 bp, Homo sapiens
atattattttagcttcagtt

SEQ ID NO: 1882308 - DNA, 23 bp, Homo sapiens
atattattttagcttcagttgtt

SEQ ID NO: 1882309 - DNA, 19 bp, Homo sapiens
atattgggaaggaaatata

SEQ ID NO: 1882310 - DNA, 22 bp, Homo sapiens
atattgggaaggaaatatattt

SEQ ID NO: 1882311 - DNA, 19 bp, Homo sapiens
atatttgaaatattgactt

SEQ ID NO: 1882312 - DNA, 21 bp, Homo sapiens
atatttgctggagtgctggct

SEQ ID NO: 1882313 - DNA, 23 bp, Homo sapiens
atattttcatgacttttccatgt

SEQ ID NO: 1882314 - DNA, 17 bp, Homo sapiens
atattttgattttacat

SEQ ID NO: 1882315 - DNA, 21 bp, Homo sapiens
atatttttcatgattttgaaa

SEQ ID NO: 1882316 - DNA, 15 bp, Homo sapiens
atcaagtcaaatgga

SEQ ID NO: 1882317 - DNA, 16 bp, Homo sapiens
atcactgctcacactg

SEQ ID NO: 1882318 - DNA, 15 bp, Homo sapiens
atcagatgtgttcct

SEQ ID NO: 1882319 - DNA, 19 bp, Homo sapiens
atcagatgtgttcctccat

SEQ ID NO: 1882320 - DNA, 19 bp, Homo sapiens
atcagcaggctccagttga

SEQ ID NO: 1882321 - DNA, 13 bp, Homo sapiens
atcagcttattgt

SEQ ID NO: 1882322 - DNA, 15 bp, Homo sapiens
atcagtgtgcccccc

SEQ ID NO: 1882323 - DNA, 15 bp, Homo sapiens
attctatctattcct

SEQ ID NO: 1882324 - DNA, 18 bp, Homo sapiens
attctgggaggcttcagt

SEQ ID NO: 1882325 - DNA, 17 bp, Homo sapiens
attcttatttcatgaaa

SEQ ID NO: 1882326 - DNA, 18 bp, Homo sapiens
attctttcacttgatgtt

SEQ ID NO: 1882327 - DNA, 22 bp, Homo sapiens
attctttcacttgatgtttgtt

SEQ ID NO: 1882328 - DNA, 16 bp, Homo sapiens
attgatacaaagtaca

SEQ ID NO: 1882329 - DNA, 19 bp, Homo sapiens
attgatacaaagtacagaa

SEQ ID NO: 1882330 - DNA, 19 bp, Homo sapiens
attgattacaaataaacag

SEQ ID NO: 1882331 - DNA, 21 bp, Homo sapiens
attgattacaaataaacagtt

SEQ ID NO: 1882332 - DNA, 21 bp, Homo sapiens
attgcatttccagaaatctgc

SEQ ID NO: 1882333 - DNA, 22 bp, Homo sapiens
attgcctttccagggttattta

SEQ ID NO: 1882334 - DNA, 17 bp, Homo sapiens
attggagctcgtgggac

SEQ ID NO: 1882335 - DNA, 18 bp, Homo sapiens
attggcagcaggtgctgc

SEQ ID NO: 1882336 - DNA, 19 bp, Homo sapiens
attggcagcaggtgctgct

SEQ ID NO: 1882337 - DNA, 13 bp, Homo sapiens
attgtaaaacatt

SEQ ID NO: 1882338 - DNA, 15 bp, Homo sapiens
attgtaaaacattca

SEQ ID NO: 1882339 - DNA, 15 bp, Homo sapiens
attgtatagagatat

SEQ ID NO: 1882340 - DNA, 21 bp, Homo sapiens
attgtatagagatatgcagaa

SEQ ID NO: 1882341 - DNA, 19 bp, Homo sapiens
attgtcagatcgttcattg

SEQ ID NO: 1882342 - DNA, 17 bp, Homo sapiens
attgtctaaaatgtcag

SEQ ID NO: 1882343 - DNA, 20 bp, Homo sapiens
attgtgattacgtgtatgtt

SEQ ID NO: 1882344 - DNA, 23 bp, Homo sapiens
attgtgattacgtgtatgtttct

SEQ ID NO: 1882345 - DNA, 24 bp, Homo sapiens
attgtgattacgtgtatgtttctt

SEQ ID NO: 1882346 - DNA, 16 bp, Homo sapiens
attgtgatttcccgtg

SEQ ID NO: 1882347 - DNA, 21 bp, Homo sapiens
attgtggggatgatgaaataa

SEQ ID NO: 1882348 - DNA, 16 bp, Homo sapiens
attgttttatgttcta

SEQ ID NO: 1882349 - DNA, 13 bp, Homo sapiens
atttaaaacatta

SEQ ID NO: 1882350 - DNA, 15 bp, Homo sapiens
atttaacataatggt

SEQ ID NO: 1882351 - DNA, 22 bp, Homo sapiens
atttaacataatggttgtgaaa

SEQ ID NO: 1882352 - DNA, 21 bp, Homo sapiens
atttaacttgagggtaataaa

SEQ ID NO: 1882353 - DNA, 22 bp, Homo sapiens
atttaacttgagggtaataaac

SEQ ID NO: 1882354 - DNA, 13 bp, Homo sapiens
atttagatgtata

SEQ ID NO: 1882355 - DNA, 18 bp, Homo sapiens
atttaggtaaataaagct

SEQ ID NO: 1882356 - DNA, 22 bp, Homo sapiens
atttaggtaaataaagctcaag

SEQ ID NO: 1882357 - DNA, 18 bp, Homo sapiens
atttagtaaagtttgttg

SEQ ID NO: 1882358 - DNA, 17 bp, Homo sapiens
atttattcatattttct

SEQ ID NO: 1882359 - DNA, 14 bp, Homo sapiens
atttcatgaaaatt

SEQ ID NO: 1882360 - DNA, 16 bp, Homo sapiens
atttcccgtggcccca

SEQ ID NO: 1882361 - DNA, 20 bp, Homo sapiens
atttcccgtggccccagcct

SEQ ID NO: 1882362 - DNA, 22 bp, Homo sapiens
atttcctcaacgttgctcccca

SEQ ID NO: 1882363 - DNA, 18 bp, Homo sapiens
atttcttttactctgtgt

SEQ ID NO: 1882364 - DNA, 19 bp, Homo sapiens
atttgcaattcatgtaaca

SEQ ID NO: 1882365 - DNA, 21 bp, Homo sapiens
atttgctggagtgctggctcc

SEQ ID NO: 1882366 - DNA, 21 bp, Homo sapiens
atttgtataaaataattttta

SEQ ID NO: 1882367 - DNA, 21 bp, Homo sapiens
atttgtatctgaaggagattt

SEQ ID NO: 1882368 - DNA, 11 bp, Homo sapiens
atttgtatttt

SEQ ID NO: 1882369 - DNA, 21 bp, Homo sapiens
atttgtggttagaatcttgtt

SEQ ID NO: 1882370 - DNA, 19 bp, Homo sapiens
atttgttatttgtacagtt

SEQ ID NO: 1882371 - DNA, 22 bp, Homo sapiens
attttaaaagaatgattatgaa

SEQ ID NO: 1882372 - DNA, 23 bp, Homo sapiens
attttaaaagaatgattatgaat

SEQ ID NO: 1882373 - DNA, 14 bp, Homo sapiens
attttaataatgtt

SEQ ID NO: 1882374 - DNA, 16 bp, Homo sapiens
attttaataatgtttc

SEQ ID NO: 1882375 - DNA, 18 bp, Homo sapiens
attttaataatgtttcaa

SEQ ID NO: 1882376 - DNA, 19 bp, Homo sapiens
attttaataatgtttcaaa

SEQ ID NO: 1882377 - DNA, 15 bp, Homo sapiens
attttagcttcagtt

SEQ ID NO: 1882378 - DNA, 21 bp, Homo sapiens
attttagcttcagttgttctt

SEQ ID NO: 1882379 - DNA, 21 bp, Homo sapiens
attttaggcagggatttgagg

SEQ ID NO: 1882380 - DNA, 14 bp, Homo sapiens
attttcccactgca

SEQ ID NO: 1882381 - DNA, 14 bp, Homo sapiens
attttcctgaaaac

SEQ ID NO: 1882382 - DNA, 21 bp, Homo sapiens
attttcttatccacaaagtac

SEQ ID NO: 1882383 - DNA, 16 bp, Homo sapiens
attttcttcacagtgc

SEQ ID NO: 1882384 - DNA, 23 bp, Homo sapiens
attttcttcacagtgcagcttgc

SEQ ID NO: 1882385 - DNA, 14 bp, Homo sapiens
attttgatgaacaa

SEQ ID NO: 1882386 - DNA, 16 bp, Homo sapiens
attttgtaattattgt

SEQ ID NO: 1882387 - DNA, 19 bp, Homo sapiens
atttttatatttgaaatat

SEQ ID NO: 1882388 - DNA, 19 bp, Homo sapiens
atttttcttgctgttcagt

SEQ ID NO: 1882389 - DNA, 15 bp, Homo sapiens
atttttgaatgtgat

SEQ ID NO: 1882390 - DNA, 18 bp, Homo sapiens
atttttttaagctgtaaa

SEQ ID NO: 1882391 - DNA, 15 bp, Homo sapiens
attttttttaaagtt

SEQ ID NO: 1882392 - DNA, 15 bp, Homo sapiens
caaaaatagccctgc

SEQ ID NO: 1882393 - DNA, 23 bp, Homo sapiens
caaaaattcagagtccttgcaaa

SEQ ID NO: 1882394 - DNA, 21 bp, Homo sapiens
caaaacagtattgacttgtat

SEQ ID NO: 1882395 - DNA, 15 bp, Homo sapiens
caaaagattgtttta

SEQ ID NO: 1882396 - DNA, 21 bp, Homo sapiens
ccccagcctggcccagctccc

SEQ ID NO: 1882397 - DNA, 13 bp, Homo sapiens
ccccagctgggct

SEQ ID NO: 1882398 - DNA, 14 bp, Homo sapiens
ccccagctgggctg

SEQ ID NO: 1882399 - DNA, 21 bp, Homo sapiens
ccccagctgggctgttggctg

SEQ ID NO: 1882400 - DNA, 15 bp, Homo sapiens
cccccacctgcctga

SEQ ID NO: 1882401 - DNA, 13 bp, Homo sapiens
cccccatcctggc

SEQ ID NO: 1882402 - DNA, 17 bp, Homo sapiens
cccccatcctggcccat

SEQ ID NO: 1882403 - DNA, 18 bp, Homo sapiens
cccccgcccaggctggcc

SEQ ID NO: 1882404 - DNA, 18 bp, Homo sapiens
cccccgggaggggcccgc

SEQ ID NO: 1882405 - DNA, 20 bp, Homo sapiens
cccccgggaggggcccgctt

SEQ ID NO: 1882406 - DNA, 22 bp, Homo sapiens
cccccgggaggggcccgcttgc

SEQ ID NO: 1882407 - DNA, 16 bp, Homo sapiens
ccccctccctggatga

SEQ ID NO: 1882408 - DNA, 19 bp, Homo sapiens
ccccgagggatgatgccac

SEQ ID NO: 1882409 - DNA, 20 bp, Homo sapiens
ccccgagggatgatgccaca

SEQ ID NO: 1882410 - DNA, 21 bp, Homo sapiens
ccccgagggatgatgccacac

SEQ ID NO: 1882411 - DNA, 22 bp, Homo sapiens
ccccgagggatgatgccacacc

SEQ ID NO: 1882412 - DNA, 16 bp, Homo sapiens
ccccgcccaggctggc

SEQ ID NO: 1882413 - DNA, 19 bp, Homo sapiens
ccccgcccaggctggccag

SEQ ID NO: 1882414 - DNA, 16 bp, Homo sapiens
ccccgggaggggcccg

SEQ ID NO: 1882415 - DNA, 21 bp, Homo sapiens
ccccggggcgtttctttgccg

SEQ ID NO: 1882416 - DNA, 17 bp, Homo sapiens
cccctcaccaggggcag

SEQ ID NO: 1882417 - DNA, 14 bp, Homo sapiens
cccctcccagctga

SEQ ID NO: 1882418 - DNA, 22 bp, Homo sapiens
cccctcccagctgacagtcctc

SEQ ID NO: 1882419 - DNA, 14 bp, Homo sapiens
cccctccctggatg

SEQ ID NO: 1882420 - DNA, 12 bp, Homo sapiens
cccctcctgctg

SEQ ID NO: 1882421 - DNA, 13 bp, Homo sapiens
cccctcctgctgc

SEQ ID NO: 1882422 - DNA, 14 bp, Homo sapiens
cccctcgtgccagt

SEQ ID NO: 1882423 - DNA, 13 bp, Homo sapiens
cccctcttgcccc

SEQ ID NO: 1882424 - DNA, 18 bp, Homo sapiens
cccctcttgccccaaccc

SEQ ID NO: 1882425 - DNA, 22 bp, Homo sapiens
cccctcttgccccaacccccag

SEQ ID NO: 1882426 - DNA, 17 bp, Homo sapiens
cccctgtgtgggagggc

SEQ ID NO: 1882427 - DNA, 23 bp, Homo sapiens
cccctgtgtgggagggcgaggcg

SEQ ID NO: 1882428 - DNA, 16 bp, Homo sapiens
ccccttttcagcttct

SEQ ID NO: 1882429 - DNA, 19 bp, Homo sapiens
ccccttttcagcttctgct

SEQ ID NO: 1882430 - DNA, 22 bp, Homo sapiens
ccccttttcagcttctgctggg

SEQ ID NO: 1882431 - DNA, 20 bp, Homo sapiens
cccgagggatgatgccacac

SEQ ID NO: 1882432 - DNA, 17 bp, Homo sapiens
cccgcccaggctggcca

SEQ ID NO: 1882433 - DNA, 14 bp, Homo sapiens
cccgctcccagtgt

SEQ ID NO: 1882434 - DNA, 15 bp, Homo sapiens
cccgcttgcctcggc

SEQ ID NO: 1882435 - DNA, 19 bp, Homo sapiens
cccgcttgcctcggctcct

SEQ ID NO: 1882436 - DNA, 14 bp, Homo sapiens
cccggcgccctctg

SEQ ID NO: 1882437 - DNA, 22 bp, Homo sapiens
cccgggaggggcccgcttgcct

SEQ ID NO: 1882438 - DNA, 20 bp, Homo sapiens
cccgggctcagggaccacag

SEQ ID NO: 1882439 - DNA, 21 bp, Homo sapiens
cccgtggccccagcctggccc

SEQ ID NO: 1882440 - DNA, 23 bp, Homo sapiens
cccgtggccccagcctggcccag

SEQ ID NO: 1882441 - DNA, 17 bp, Homo sapiens
cccgttgccgggcctgg

SEQ ID NO: 1882442 - DNA, 17 bp, Homo sapiens
cccgttgtctccctggc

SEQ ID NO: 1882443 - DNA, 15 bp, Homo sapiens
ccctacacctctggg

SEQ ID NO: 1882444 - DNA, 19 bp, Homo sapiens
ccctacacctctgggccct

SEQ ID NO: 1882445 - DNA, 18 bp, Homo sapiens
ccctagtatctggctggg

SEQ ID NO: 1882446 - DNA, 16 bp, Homo sapiens
ccctcaaagaggcctt

SEQ ID NO: 1882447 - DNA, 21 bp, Homo sapiens
ccctcaaggcctcccacagtg

SEQ ID NO: 1882448 - DNA, 17 bp, Homo sapiens
ccctccatccctggccc

SEQ ID NO: 1882449 - DNA, 17 bp, Homo sapiens
ccctcccagctgacagt

SEQ ID NO: 1882450 - DNA, 18 bp, Homo sapiens
ccctcccctccatccctg

SEQ ID NO: 1882451 - DNA, 12 bp, Homo sapiens
ccctcccctccc

SEQ ID NO: 1882452 - DNA, 14 bp, Homo sapiens
ccctcccgcccctt

SEQ ID NO: 1882453 - DNA, 13 bp, Homo sapiens
ccctccctgctgt

SEQ ID NO: 1882454 - DNA, 14 bp, Homo sapiens
ccctccctgctgtc

SEQ ID NO: 1882455 - DNA, 15 bp, Homo sapiens
ccctccctgctgtcc

SEQ ID NO: 1882456 - DNA, 17 bp, Homo sapiens
ccctccctgctgtcccc

SEQ ID NO: 1882457 - DNA, 22 bp, Homo sapiens
ccctcctacccctcccagctga

SEQ ID NO: 1882458 - DNA, 22 bp, Homo sapiens
ccctcgtgccagtcgcgctgcc

SEQ ID NO: 1882459 - DNA, 23 bp, Homo sapiens
ccctcgtgccagtcgcgctgcct

SEQ ID NO: 1882460 - DNA, 19 bp, Homo sapiens
ccctcttgccccaaccccc

SEQ ID NO: 1882461 - DNA, 20 bp, Homo sapiens
ccctgacactgcggggcttg

SEQ ID NO: 1882462 - DNA, 23 bp, Homo sapiens
ccctgagagcatgtgggggaagg

SEQ ID NO: 1882463 - DNA, 19 bp, Homo sapiens
ccctgagcctgccccagct

SEQ ID NO: 1882464 - DNA, 20 bp, Homo sapiens
ccctgagcctgccccagctg

SEQ ID NO: 1882465 - DNA, 21 bp, Homo sapiens
ccctgagcctgccccagctgg

SEQ ID NO: 1882466 - DNA, 18 bp, Homo sapiens
ccctgagctttccgggga

SEQ ID NO: 1882467 - DNA, 22 bp, Homo sapiens
ccctgagctttccggggaggag

SEQ ID NO: 1882468 - DNA, 14 bp, Homo sapiens
ccctgcactgtcct

SEQ ID NO: 1882469 - DNA, 22 bp, Homo sapiens
ccctgcactgtcctgctccaca

SEQ ID NO: 1882470 - DNA, 23 bp, Homo sapiens
ccctgcaggaggcctgggagggc

SEQ ID NO: 1882471 - DNA, 13 bp, Homo sapiens
ccctgcataatgt

SEQ ID NO: 1882472 - DNA, 21 bp, Homo sapiens
ccctgcataatgttaagcttt

SEQ ID NO: 1882473 - DNA, 23 bp, Homo sapiens
ccctgccaagcctggagcccctg

SEQ ID NO: 1882474 - DNA, 13 bp, Homo sapiens
ccctggccccctc

SEQ ID NO: 1882475 - DNA, 20 bp, Homo sapiens
ccctggccccctccctggat

SEQ ID NO: 1882476 - DNA, 20 bp, Homo sapiens
ccctggccctcaaggcctcc

SEQ ID NO: 1882477 - DNA, 18 bp, Homo sapiens
ccctggcctgactcccat

SEQ ID NO: 1882478 - DNA, 19 bp, Homo sapiens
ccctggcctgactcccatg

SEQ ID NO: 1882479 - DNA, 18 bp, Homo sapiens
ccctggggagtgagcttg

SEQ ID NO: 1882480 - DNA, 23 bp, Homo sapiens
ccctgtgtgggagggcgaggcgg

SEQ ID NO: 1882481 - DNA, 23 bp, Homo sapiens
ccctgtgttggggggcaaggtgg

SEQ ID NO: 1882482 - DNA, 14 bp, Homo sapiens
cccttccctctgtt

SEQ ID NO: 1882483 - DNA, 16 bp, Homo sapiens
cccttgatgaagaagt

SEQ ID NO: 1882484 - DNA, 16 bp, Homo sapiens
cccttttcagcttctg

SEQ ID NO: 1882485 - DNA, 20 bp, Homo sapiens
ccgacttgaattttcccact

SEQ ID NO: 1882486 - DNA, 16 bp, Homo sapiens
ccgagcctggctccaa

SEQ ID NO: 1882487 - DNA, 21 bp, Homo sapiens
ccgatgatactgtttcttgca

SEQ ID NO: 1882488 - DNA, 18 bp, Homo sapiens
ccgcccaggctggccagc

SEQ ID NO: 1882489 - DNA, 15 bp, Homo sapiens
ccgcctcgcccaccg

SEQ ID NO: 1882490 - DNA, 20 bp, Homo sapiens
ccgctcaggctgaccacttt

SEQ ID NO: 1882491 - DNA, 14 bp, Homo sapiens
ccgctgtcccaggg

SEQ ID NO: 1882492 - DNA, 15 bp, Homo sapiens
ccgctgtcccagggg

SEQ ID NO: 1882493 - DNA, 20 bp, Homo sapiens
ccgcttgcctcggctcctgc

SEQ ID NO: 1882494 - DNA, 19 bp, Homo sapiens
ccggcgccctctgtcctga

SEQ ID NO: 1882495 - DNA, 17 bp, Homo sapiens
ccgggaccccgagcctg

SEQ ID NO: 1882496 - DNA, 16 bp, Homo sapiens
ccgggaggggcccgct

SEQ ID NO: 1882497 - DNA, 12 bp, Homo sapiens
ccgggcctggac

SEQ ID NO: 1882498 - DNA, 21 bp, Homo sapiens
ccgggctcagggaccacagca

SEQ ID NO: 1882499 - DNA, 14 bp, Homo sapiens
ccggggaggagcct

SEQ ID NO: 1882500 - DNA, 16 bp, Homo sapiens
ccggggaggagccttg

SEQ ID NO: 1882501 - DNA, 15 bp, Homo sapiens
ccggggctgggttgg

SEQ ID NO: 1882502 - DNA, 13 bp, Homo sapiens
ccgtggccccagc

SEQ ID NO: 1882503 - DNA, 14 bp, Homo sapiens
ccgtggccccagcc

SEQ ID NO: 1882504 - DNA, 23 bp, Homo sapiens
ccgtggccccagcctggcccagc

SEQ ID NO: 1882505 - DNA, 18 bp, Homo sapiens
ccgttcccacctctgagg

SEQ ID NO: 1882506 - DNA, 17 bp, Homo sapiens
ccgttgccgggcctgga

SEQ ID NO: 1882507 - DNA, 18 bp, Homo sapiens
ccgttgtctccctggccc

SEQ ID NO: 1882508 - DNA, 20 bp, Homo sapiens
cctacacccttggacttgag

SEQ ID NO: 1882509 - DNA, 15 bp, Homo sapiens
cctagtatctggctg

SEQ ID NO: 1882510 - DNA, 16 bp, Homo sapiens
cctagtggctgtccag

SEQ ID NO: 1882511 - DNA, 18 bp, Homo sapiens
cctagtggctgtccagtg

SEQ ID NO: 1882512 - DNA, 17 bp, Homo sapiens
cctatcagtgtgccccc

SEQ ID NO: 1882513 - DNA, 24 bp, Homo sapiens
cctatcagtgtgccccccatcctg

SEQ ID NO: 1882514 - DNA, 14 bp, Homo sapiens
cctatttcctcaga

SEQ ID NO: 1882515 - DNA, 19 bp, Homo sapiens
ccaggattgtacgtgggag

SEQ ID NO: 1882516 - DNA, 13 bp, Homo sapiens
ccaggccatacca

SEQ ID NO: 1882517 - DNA, 16 bp, Homo sapiens
ccaggccatcttccag

SEQ ID NO: 1882518 - DNA, 18 bp, Homo sapiens
ccaggccatcttccaggt

SEQ ID NO: 1882519 - DNA, 13 bp, Homo sapiens
ccaggccccaggt

SEQ ID NO: 1882520 - DNA, 13 bp, Homo sapiens
ccaggctggccag

SEQ ID NO: 1882521 - DNA, 15 bp, Homo sapiens
ccaggggcaggcaca

SEQ ID NO: 1882522 - DNA, 16 bp, Homo sapiens
ccaggggcaggcacag

SEQ ID NO: 1882523 - DNA, 21 bp, Homo sapiens
ccaggggtctccctgagcctg

SEQ ID NO: 1882524 - DNA, 23 bp, Homo sapiens
ccaggtaagcaggaggaggtgcc

SEQ ID NO: 1882525 - DNA, 14 bp, Homo sapiens
ccaggtctcctcca

SEQ ID NO: 1882526 - DNA, 19 bp, Homo sapiens
ccaggtctcctccaccgcc

SEQ ID NO: 1882527 - DNA, 19 bp, Homo sapiens
ccaggtgggcgggcagcac

SEQ ID NO: 1882528 - DNA, 16 bp, Homo sapiens
ccagtactgaggtggt

SEQ ID NO: 1882529 - DNA, 19 bp, Homo sapiens
ccagtcctcacatgcccgc

SEQ ID NO: 1882530 - DNA, 21 bp, Homo sapiens
ccagtcctcacatgcccgctg

SEQ ID NO: 1882531 - DNA, 14 bp, Homo sapiens
ccagtcgcgctgcc

SEQ ID NO: 1882532 - DNA, 15 bp, Homo sapiens
ccagtcgcgctgcct

SEQ ID NO: 1882533 - DNA, 19 bp, Homo sapiens
ccagtcgcgctgcctgtgt

SEQ ID NO: 1882534 - DNA, 13 bp, Homo sapiens
ccagtgtcttcct

SEQ ID NO: 1882535 - DNA, 14 bp, Homo sapiens
ccagtgtcttcctg

SEQ ID NO: 1882536 - DNA, 21 bp, Homo sapiens
ccagtgtgtggctttcagagc

SEQ ID NO: 1882537 - DNA, 22 bp, Homo sapiens
ccagtgtgtggctttcagagcc

SEQ ID NO: 1882538 - DNA, 23 bp, Homo sapiens
ccagtgtgtggctttcagagcct

SEQ ID NO: 1882539 - DNA, 17 bp, Homo sapiens
ccagttagcctctgcag

SEQ ID NO: 1882540 - DNA, 21 bp, Homo sapiens
ccagttgaactgcaggaagag

SEQ ID NO: 1882541 - DNA, 21 bp, Homo sapiens
ccagttggcttctgtgcctga

SEQ ID NO: 1882542 - DNA, 13 bp, Homo sapiens
ccatacctttcca

SEQ ID NO: 1882543 - DNA, 13 bp, Homo sapiens
ccatactggcctc

SEQ ID NO: 1882544 - DNA, 20 bp, Homo sapiens
ccatactggcctcgcctggc

SEQ ID NO: 1882545 - DNA, 18 bp, Homo sapiens
ccatcaagggtacactgc

SEQ ID NO: 1882546 - DNA, 18 bp, Homo sapiens
ccatcagatgtgttcctc

SEQ ID NO: 1882547 - DNA, 16 bp, Homo sapiens
ccatccctggccccct

SEQ ID NO: 1882548 - DNA, 13 bp, Homo sapiens
ccatcctggccca

SEQ ID NO: 1882549 - DNA, 14 bp, Homo sapiens
ccatcctggcccat

SEQ ID NO: 1882550 - DNA, 16 bp, Homo sapiens
ccatcctggcccatca

SEQ ID NO: 1882551 - DNA, 15 bp, Homo sapiens
ccatctgcccaggac

SEQ ID NO: 1882552 - DNA, 14 bp, Homo sapiens
ccatctggaggctc

SEQ ID NO: 1882553 - DNA, 18 bp, Homo sapiens
ccatctggaggctcccat

SEQ ID NO: 1882554 - DNA, 15 bp, Homo sapiens
ccatgcaagtagctg

SEQ ID NO: 1882555 - DNA, 20 bp, Homo sapiens
ccatgcaagtagctggctgt

SEQ ID NO: 1882556 - DNA, 23 bp, Homo sapiens
ccatgccctgccaagcctggagc

SEQ ID NO: 1882557 - DNA, 20 bp, Homo sapiens
ccatgggcactgctgggtgg

SEQ ID NO: 1882558 - DNA, 22 bp, Homo sapiens
ccatgggcactgctgggtggcc

SEQ ID NO: 1882559 - DNA, 14 bp, Homo sapiens
ccatgggctaggag

SEQ ID NO: 1882560 - DNA, 15 bp, Homo sapiens
ccattgtctcagagc

SEQ ID NO: 1882561 - DNA, 16 bp, Homo sapiens
ccatttaactggagct

SEQ ID NO: 1882562 - DNA, 21 bp, Homo sapiens
cccacagagtgtggtccctcc

SEQ ID NO: 1882563 - DNA, 19 bp, Homo sapiens
cccacagcccacgtcctgt

SEQ ID NO: 1882564 - DNA, 14 bp, Homo sapiens
cccacatccagtgg

SEQ ID NO: 1882565 - DNA, 18 bp, Homo sapiens
cccaccgcatgccccctc

SEQ ID NO: 1882566 - DNA, 20 bp, Homo sapiens
cccaccgcatgccccctcgt

SEQ ID NO: 1882567 - DNA, 13 bp, Homo sapiens
cccacctctgagg

SEQ ID NO: 1882568 - DNA, 17 bp, Homo sapiens
cccacgaggaggaacca

SEQ ID NO: 1882569 - DNA, 19 bp, Homo sapiens
cccacgaggaggaaccagg

SEQ ID NO: 1882570 - DNA, 22 bp, Homo sapiens
cccacgaggaggaaccaggcta

SEQ ID NO: 1882571 - DNA, 22 bp, Homo sapiens
cccacgtcctgtcagtgccgcc

SEQ ID NO: 1882572 - DNA, 12 bp, Homo sapiens
cccactgcaccc

SEQ ID NO: 1882573 - DNA, 16 bp, Homo sapiens
cccacttccctgacac

SEQ ID NO: 1882574 - DNA, 19 bp, Homo sapiens
cccacttccctgacactgc

SEQ ID NO: 1882575 - DNA, 19 bp, Homo sapiens
cccagcacccgggctcagg

SEQ ID NO: 1882576 - DNA, 14 bp, Homo sapiens
cccagcccaagaga

SEQ ID NO: 1882577 - DNA, 10 bp, Homo sapiens
cccagcctgg

SEQ ID NO: 1882578 - DNA, 14 bp, Homo sapiens
cccagcctggccca

SEQ ID NO: 1882579 - DNA, 15 bp, Homo sapiens
cccagcctggcccag

SEQ ID NO: 1882580 - DNA, 17 bp, Homo sapiens
cccagcctggcccagct

SEQ ID NO: 1882581 - DNA, 19 bp, Homo sapiens
cccagctgacagtcctctc

SEQ ID NO: 1882582 - DNA, 21 bp, Homo sapiens
cccagctgacagtcctctcca

SEQ ID NO: 1882583 - DNA, 13 bp, Homo sapiens
cccagctgggctg

SEQ ID NO: 1882584 - DNA, 22 bp, Homo sapiens
cccagctgggctgttggctggg

SEQ ID NO: 1882585 - DNA, 17 bp, Homo sapiens
cccagctttctcctctg

SEQ ID NO: 1882586 - DNA, 15 bp, Homo sapiens
cccaggacggggccg

SEQ ID NO: 1882587 - DNA, 22 bp, Homo sapiens
cccaggacggggccggccaggt

SEQ ID NO: 1882588 - DNA, 23 bp, Homo sapiens
cccaggacggggccggccaggtg

SEQ ID NO: 1882589 - DNA, 18 bp, Homo sapiens
cccaggccatcttccagg

SEQ ID NO: 1882590 - DNA, 23 bp, Homo sapiens
cccaggctggccagccccacagc

SEQ ID NO: 1882591 - DNA, 14 bp, Homo sapiens
cccaggggtctccc

SEQ ID NO: 1882592 - DNA, 17 bp, Homo sapiens
cccagtctgttccccat

SEQ ID NO: 1882593 - DNA, 18 bp, Homo sapiens
cccagtgtcttcctgtgg

SEQ ID NO: 1882594 - DNA, 21 bp, Homo sapiens
cccatcagtgtacccccgccc

SEQ ID NO: 1882595 - DNA, 22 bp, Homo sapiens
cccatcccccctcaccaggggc

SEQ ID NO: 1882596 - DNA, 13 bp, Homo sapiens
cccatcctggccc

SEQ ID NO: 1882597 - DNA, 14 bp, Homo sapiens
cccatcctggccca

SEQ ID NO: 1882598 - DNA, 15 bp, Homo sapiens
cccatcctggcccat

SEQ ID NO: 1882599 - DNA, 18 bp, Homo sapiens
cccatcctggcccatcag

SEQ ID NO: 1882600 - DNA, 17 bp, Homo sapiens
cccatgccctgccaagc

SEQ ID NO: 1882601 - DNA, 21 bp, Homo sapiens
cccatgccctgccaagcctgg

SEQ ID NO: 1882602 - DNA, 21 bp, Homo sapiens
cccatgggcactgctgggtgg

SEQ ID NO: 1882603 - DNA, 22 bp, Homo sapiens
cccatgtcaccggtcagtgcct

SEQ ID NO: 1882604 - DNA, 17 bp, Homo sapiens
cccatgtctacacagat

SEQ ID NO: 1882605 - DNA, 19 bp, Homo sapiens
ccccacagcccacgtcctg

SEQ ID NO: 1882606 - DNA, 22 bp, Homo sapiens
ccccacagcccacgtcctgtca

SEQ ID NO: 1882607 - DNA, 14 bp, Homo sapiens
ccccacctgcctga

SEQ ID NO: 1882608 - DNA, 15 bp, Homo sapiens
ccccagcacccgggc

SEQ ID NO: 1882609 - DNA, 11 bp, Homo sapiens
ccccagcctgg

SEQ ID NO: 1882610 - DNA, 15 bp, Homo sapiens
ccccagcctggccca

SEQ ID NO: 1882611 - DNA, 17 bp, Homo sapiens
ccccagcctggcccagc

SEQ ID NO: 1882612 - DNA, 23 bp, Homo sapiens
cctcaacccctcccctccatccc

SEQ ID NO: 1882613 - DNA, 19 bp, Homo sapiens
cctcaaggcctcccacagt

SEQ ID NO: 1882614 - DNA, 18 bp, Homo sapiens
cctcaagtgcaaggacca

SEQ ID NO: 1882615 - DNA, 22 bp, Homo sapiens
cctcaccaggggcaggcacagc

SEQ ID NO: 1882616 - DNA, 20 bp, Homo sapiens
cctcagaaaacaaggatgaa

SEQ ID NO: 1882617 - DNA, 19 bp, Homo sapiens
cctccaccgccatggcttc

SEQ ID NO: 1882618 - DNA, 17 bp, Homo sapiens
cctccatccctggcccc

SEQ ID NO: 1882619 - DNA, 23 bp, Homo sapiens
cctcccacagtgactcgggctcc

SEQ ID NO: 1882620 - DNA, 19 bp, Homo sapiens
cctcccagctgacagtcct

SEQ ID NO: 1882621 - DNA, 20 bp, Homo sapiens
cctcccgtctactcattccc

SEQ ID NO: 1882622 - DNA, 14 bp, Homo sapiens
cctccctgctgtcc

SEQ ID NO: 1882623 - DNA, 19 bp, Homo sapiens
cctccctgctgtcccctct

SEQ ID NO: 1882624 - DNA, 22 bp, Homo sapiens
cctccctgctgtcccctcttgc

SEQ ID NO: 1882625 - DNA, 21 bp, Homo sapiens
cctccgttcccacctctgagg

SEQ ID NO: 1882626 - DNA, 19 bp, Homo sapiens
cctcctacccctcccagct

SEQ ID NO: 1882627 - DNA, 15 bp, Homo sapiens
cgagaggaggggccc

SEQ ID NO: 1882628 - DNA, 13 bp, Homo sapiens
cgagcctggctcc

SEQ ID NO: 1882629 - DNA, 14 bp, Homo sapiens
cgagctgaagaact

SEQ ID NO: 1882630 - DNA, 15 bp, Homo sapiens
cgaggaggaaccagg

SEQ ID NO: 1882631 - DNA, 18 bp, Homo sapiens
cgaggcgggggagcctgg

SEQ ID NO: 1882632 - DNA, 20 bp, Homo sapiens
cgaggcgggggagcctggag

SEQ ID NO: 1882633 - DNA, 21 bp, Homo sapiens
cgaggcgggggatcctggagc

SEQ ID NO: 1882634 - DNA, 10 bp, Homo sapiens
cgagggaggg

SEQ ID NO: 1882635 - DNA, 14 bp, Homo sapiens
cgagggaggggagg

SEQ ID NO: 1882636 - DNA, 17 bp, Homo sapiens
cgagggaggggaggtgg

SEQ ID NO: 1882637 - DNA, 17 bp, Homo sapiens
cgcccaccgcatgcccc

SEQ ID NO: 1882638 - DNA, 23 bp, Homo sapiens
cgcccaccgcatgccccctcgtg

SEQ ID NO: 1882639 - DNA, 15 bp, Homo sapiens
cagccccacagccca

SEQ ID NO: 1882640 - DNA, 18 bp, Homo sapiens
cagccccacagcccacgt

SEQ ID NO: 1882641 - DNA, 12 bp, Homo sapiens
cagccccaggac

SEQ ID NO: 1882642 - DNA, 19 bp, Homo sapiens
cagcccttctttccacaga

SEQ ID NO: 1882643 - DNA, 15 bp, Homo sapiens
cagccgctgcccggc

SEQ ID NO: 1882644 - DNA, 13 bp, Homo sapiens
cagcctggcccag

SEQ ID NO: 1882645 - DNA, 16 bp, Homo sapiens
cagcctggcccagctc

SEQ ID NO: 1882646 - DNA, 17 bp, Homo sapiens
cagcctggcccagctcc

SEQ ID NO: 1882647 - DNA, 19 bp, Homo sapiens
cagcctggcccagctcccc

SEQ ID NO: 1882648 - DNA, 20 bp, Homo sapiens
cagcgctggccgggaccccg

SEQ ID NO: 1882649 - DNA, 19 bp, Homo sapiens
cagctaaggggcaggaatc

SEQ ID NO: 1882650 - DNA, 15 bp, Homo sapiens
cagctccactggcct

SEQ ID NO: 1882651 - DNA, 17 bp, Homo sapiens
cagctccactggcctgc

SEQ ID NO: 1882652 - DNA, 20 bp, Homo sapiens
cagctcttaaaaagacactt

SEQ ID NO: 1882653 - DNA, 18 bp, Homo sapiens
cagctgacagtcctctcc

SEQ ID NO: 1882654 - DNA, 20 bp, Homo sapiens
cagctgtatgattcccagcc

SEQ ID NO: 1882655 - DNA, 14 bp, Homo sapiens
cagcttattgtcta

SEQ ID NO: 1882656 - DNA, 20 bp, Homo sapiens
cagcttattgtctagtgaaa

SEQ ID NO: 1882657 - DNA, 12 bp, Homo sapiens
cagcttcagttg

SEQ ID NO: 1882658 - DNA, 11 bp, Homo sapiens
cagcttctgcc

SEQ ID NO: 1882659 - DNA, 12 bp, Homo sapiens
cagcttctgcca

SEQ ID NO: 1882660 - DNA, 13 bp, Homo sapiens
cagcttctgccac

SEQ ID NO: 1882661 - DNA, 15 bp, Homo sapiens
cagcttctgccactt

SEQ ID NO: 1882662 - DNA, 19 bp, Homo sapiens
cagcttctgccacttccca

SEQ ID NO: 1882663 - DNA, 15 bp, Homo sapiens
cagcttctgctgggc

SEQ ID NO: 1882664 - DNA, 17 bp, Homo sapiens
caggaaaagcctctgtg

SEQ ID NO: 1882665 - DNA, 15 bp, Homo sapiens
caggaatcaaggagc

SEQ ID NO: 1882666 - DNA, 17 bp, Homo sapiens
caggaatcaaggagcct

SEQ ID NO: 1882667 - DNA, 19 bp, Homo sapiens
caggaatcaaggagcctcc

SEQ ID NO: 1882668 - DNA, 24 bp, Homo sapiens
caggacagcccttctttccacaga

SEQ ID NO: 1882669 - DNA, 22 bp, Homo sapiens
caggaccaagcttaaggagagg

SEQ ID NO: 1882670 - DNA, 16 bp, Homo sapiens
caggacggggccggcc

SEQ ID NO: 1882671 - DNA, 23 bp, Homo sapiens
caggacttgcttccaagcccttc

SEQ ID NO: 1882672 - DNA, 15 bp, Homo sapiens
caggaggcctgggag

SEQ ID NO: 1882673 - DNA, 16 bp, Homo sapiens
caggaggcctgggagg

SEQ ID NO: 1882674 - DNA, 19 bp, Homo sapiens
caggaggcctgggagggca

SEQ ID NO: 1882675 - DNA, 22 bp, Homo sapiens
caggaggcctgggagggcaagg

SEQ ID NO: 1882676 - DNA, 14 bp, Homo sapiens
caggagtagtctca

SEQ ID NO: 1882677 - DNA, 21 bp, Homo sapiens
caggatggttcccttgatgaa

SEQ ID NO: 1882678 - DNA, 19 bp, Homo sapiens
caggattgtacgtgggaga

SEQ ID NO: 1882679 - DNA, 14 bp, Homo sapiens
caggcacagcacag

SEQ ID NO: 1882680 - DNA, 14 bp, Homo sapiens
caggcagaggagag

SEQ ID NO: 1882681 - DNA, 17 bp, Homo sapiens
caggccaccctgcctct

SEQ ID NO: 1882682 - DNA, 13 bp, Homo sapiens
caggcccacagta

SEQ ID NO: 1882683 - DNA, 15 bp, Homo sapiens
caggccccaggtcat

SEQ ID NO: 1882684 - DNA, 13 bp, Homo sapiens
caggccctgcact

SEQ ID NO: 1882685 - DNA, 16 bp, Homo sapiens
caggccctgcactgtc

SEQ ID NO: 1882686 - DNA, 23 bp, Homo sapiens
caggccctgcactgtcctgctcc

SEQ ID NO: 1882687 - DNA, 15 bp, Homo sapiens
caggctccagttgaa

SEQ ID NO: 1882688 - DNA, 15 bp, Homo sapiens
caggctgcagcaggc

SEQ ID NO: 1882689 - DNA, 21 bp, Homo sapiens
caggctgcagcaggcagagga

SEQ ID NO: 1882690 - DNA, 12 bp, Homo sapiens
caggctggccag

SEQ ID NO: 1882691 - DNA, 13 bp, Homo sapiens
caggctggccagc

SEQ ID NO: 1882692 - DNA, 11 bp, Homo sapiens
cagggaagctt

SEQ ID NO: 1882693 - DNA, 15 bp, Homo sapiens
cagggaccacagcaa

SEQ ID NO: 1882694 - DNA, 11 bp, Homo sapiens
caggggacagg

SEQ ID NO: 1882695 - DNA, 17 bp, Homo sapiens
caggggagtctgcttgt

SEQ ID NO: 1882696 - DNA, 20 bp, Homo sapiens
caggggctttggaagctctg

SEQ ID NO: 1882697 - DNA, 18 bp, Homo sapiens
caggggtctccctgagcc

SEQ ID NO: 1882698 - DNA, 19 bp, Homo sapiens
caggggtctccctgagcct

SEQ ID NO: 1882699 - DNA, 20 bp, Homo sapiens
caggggtctccctgagcctg

SEQ ID NO: 1882700 - DNA, 14 bp, Homo sapiens
caggtcctggggag

SEQ ID NO: 1882701 - DNA, 19 bp, Homo sapiens
caggtctcctccaccgcca

SEQ ID NO: 1882702 - DNA, 16 bp, Homo sapiens
caggtgctagggtgcc

SEQ ID NO: 1882703 - DNA, 20 bp, Homo sapiens
caggtgctgctaccctccct

SEQ ID NO: 1882704 - DNA, 17 bp, Homo sapiens
caggtggcttgttaagg

SEQ ID NO: 1882705 - DNA, 21 bp, Homo sapiens
caggtgggcgggcagcacagc

SEQ ID NO: 1882706 - DNA, 18 bp, Homo sapiens
caggtgtctagaggcaac

SEQ ID NO: 1882707 - DNA, 13 bp, Homo sapiens
caggttgggccat

SEQ ID NO: 1882708 - DNA, 17 bp, Homo sapiens
caggttgggccatactg

SEQ ID NO: 1882709 - DNA, 22 bp, Homo sapiens
caggttgggccatactggcctc

SEQ ID NO: 1882710 - DNA, 18 bp, Homo sapiens
caggtttctccttgaagc

SEQ ID NO: 1882711 - DNA, 12 bp, Homo sapiens
cagtaccacatg

SEQ ID NO: 1882712 - DNA, 18 bp, Homo sapiens
cagtactgaggtggtgga

SEQ ID NO: 1882713 - DNA, 19 bp, Homo sapiens
cagtcacctcatggaattg

SEQ ID NO: 1882714 - DNA, 11 bp, Homo sapiens
cagtcatgtgc

SEQ ID NO: 1882715 - DNA, 16 bp, Homo sapiens
cagtcatttgtggtta

SEQ ID NO: 1882716 - DNA, 16 bp, Homo sapiens
cagtcccagtccttga

SEQ ID NO: 1882717 - DNA, 16 bp, Homo sapiens
cagtcctgttcaaatt

SEQ ID NO: 1882718 - DNA, 16 bp, Homo sapiens
cagtcgcgctgcctgt

SEQ ID NO: 1882719 - DNA, 20 bp, Homo sapiens
cagtctgactgtttccatca

SEQ ID NO: 1882720 - DNA, 16 bp, Homo sapiens
ctccaccgccatggct

SEQ ID NO: 1882721 - DNA, 20 bp, Homo sapiens
ctccaccgccatggcttcca

SEQ ID NO: 1882722 - DNA, 20 bp, Homo sapiens
ctccacctagtggctgtcca

SEQ ID NO: 1882723 - DNA, 15 bp, Homo sapiens
ctccacgccctgggg

SEQ ID NO: 1882724 - DNA, 13 bp, Homo sapiens
ctccactggcctg

SEQ ID NO: 1882725 - DNA, 18 bp, Homo sapiens
ctccactggcctgcccgt

SEQ ID NO: 1882726 - DNA, 21 bp, Homo sapiens
ctccagagagtatctgaggca

SEQ ID NO: 1882727 - DNA, 13 bp, Homo sapiens
ctccatccctggc

SEQ ID NO: 1882728 - DNA, 17 bp, Homo sapiens
ctgccaagcctggagcc

SEQ ID NO: 1882729 - DNA, 21 bp, Homo sapiens
ctgccaagcctggagcccctg

SEQ ID NO: 1882730 - DNA, 20 bp, Homo sapiens
ctgccacaggacccagaaaa

SEQ ID NO: 1882731 - DNA, 18 bp, Homo sapiens
ctgccactcctgacccag

SEQ ID NO: 1882732 - DNA, 15 bp, Homo sapiens
ctgccccagctgggc

SEQ ID NO: 1882733 - DNA, 16 bp, Homo sapiens
ctgcccgctcccagtg

SEQ ID NO: 1882734 - DNA, 21 bp, Homo sapiens
ctgcccggcgccctctgtcct

SEQ ID NO: 1882735 - DNA, 15 bp, Homo sapiens
ctgcctccactccca

SEQ ID NO: 1882736 - DNA, 14 bp, Homo sapiens
ctgcctgcctggga

SEQ ID NO: 1882737 - DNA, 12 bp, Homo sapiens
ctgcctgggaac

SEQ ID NO: 1882738 - DNA, 20 bp, Homo sapiens
ctgcctgggaacggggtgga

SEQ ID NO: 1882739 - DNA, 14 bp, Homo sapiens
ctgcggtgaggcag

SEQ ID NO: 1882740 - DNA, 16 bp, Homo sapiens
ctgcggtgaggcaggg

SEQ ID NO: 1882741 - DNA, 13 bp, Homo sapiens
ctgctatatattt

SEQ ID NO: 1882742 - DNA, 17 bp, Homo sapiens
ctgctatattttcatga

SEQ ID NO: 1882743 - DNA, 21 bp, Homo sapiens
ctgctatgcattttcttcaca

SEQ ID NO: 1882744 - DNA, 13 bp, Homo sapiens
ctgctccacagtg

SEQ ID NO: 1882745 - DNA, 16 bp, Homo sapiens
ctgctcgggcccaggc

SEQ ID NO: 1882746 - DNA, 19 bp, Homo sapiens
ctgctctccttgccctggg

SEQ ID NO: 1882747 - DNA, 20 bp, Homo sapiens
ctgctctccttgccctgggc

SEQ ID NO: 1882748 - DNA, 16 bp, Homo sapiens
ctgctgagctgtgccc

SEQ ID NO: 1882749 - DNA, 23 bp, Homo sapiens
ctgctgcaccaacccagccgctg

SEQ ID NO: 1882750 - DNA, 18 bp, Homo sapiens
ctgctgcagaggggcagg

SEQ ID NO: 1882751 - DNA, 23 bp, Homo sapiens
ctgctgcagaggggcaggccctg

SEQ ID NO: 1882752 - DNA, 20 bp, Homo sapiens
ctgctgcttctgggcctgat

SEQ ID NO: 1882753 - DNA, 18 bp, Homo sapiens
ctgctgggctggggcctg

SEQ ID NO: 1882754 - DNA, 19 bp, Homo sapiens
ctgctgggctggggcctga

SEQ ID NO: 1882755 - DNA, 14 bp, Homo sapiens
ctgcttgtcttaga

SEQ ID NO: 1882756 - DNA, 12 bp, Homo sapiens
ctggagcccctg

SEQ ID NO: 1882757 - DNA, 16 bp, Homo sapiens
ctggagcccctgtgtt

SEQ ID NO: 1882758 - DNA, 16 bp, Homo sapiens
ctggaggcaggactcc

SEQ ID NO: 1882759 - DNA, 18 bp, Homo sapiens
ctggaggggacgctggct

SEQ ID NO: 1882760 - DNA, 23 bp, Homo sapiens
ctggaggtggcgccccctggtgg

SEQ ID NO: 1882761 - DNA, 13 bp, Homo sapiens
ctggagtgctggc

SEQ ID NO: 1882762 - DNA, 22 bp, Homo sapiens
ctggagtgctggctccacgccc

SEQ ID NO: 1882763 - DNA, 22 bp, Homo sapiens
ctggattgatcggagcctcctc

SEQ ID NO: 1882764 - DNA, 14 bp, Homo sapiens
ctggcacagtgtct

SEQ ID NO: 1882765 - DNA, 16 bp, Homo sapiens
ctggccagaggcagct

SEQ ID NO: 1882766 - DNA, 16 bp, Homo sapiens
ctggccagccccacag

SEQ ID NO: 1882767 - DNA, 17 bp, Homo sapiens
ctggccagccccacagc

SEQ ID NO: 1882768 - DNA, 19 bp, Homo sapiens
ctggccagccccacagccc

SEQ ID NO: 1882769 - DNA, 21 bp, Homo sapiens
ctggccagccccacagcccac

SEQ ID NO: 1882770 - DNA, 13 bp, Homo sapiens
ctggcccagctcc

SEQ ID NO: 1882771 - DNA, 14 bp, Homo sapiens
ctggcccagctccc

SEQ ID NO: 1882772 - DNA, 18 bp, Homo sapiens
ctggccccctccctggat

SEQ ID NO: 1882773 - DNA, 20 bp, Homo sapiens
ctggccccctccctggatga

SEQ ID NO: 1882774 - DNA, 19 bp, Homo sapiens
ctggccctcaaggcctccc

SEQ ID NO: 1882775 - DNA, 12 bp, Homo sapiens
ctggcctcgcct

SEQ ID NO: 1882776 - DNA, 20 bp, Homo sapiens
ctggcctcgcctggcctgag

SEQ ID NO: 1882777 - DNA, 17 bp, Homo sapiens
ctggcctgactcccatg

SEQ ID NO: 1882778 - DNA, 20 bp, Homo sapiens
ctggctccacgccctgggga

SEQ ID NO: 1882779 - DNA, 21 bp, Homo sapiens
ctggctgcctccactcccact

SEQ ID NO: 1882780 - DNA, 22 bp, Homo sapiens
ctggctgcctccactcccactt

SEQ ID NO: 1882781 - DNA, 18 bp, Homo sapiens
ctggctggggcctatcag

SEQ ID NO: 1882782 - DNA, 18 bp, Homo sapiens
ctggctgggttttcaggg

SEQ ID NO: 1882783 - DNA, 10 bp, Homo sapiens
ctgggacagg

SEQ ID NO: 1882784 - DNA, 19 bp, Homo sapiens
ctgggagaaggtgcttggg

SEQ ID NO: 1882785 - DNA, 14 bp, Homo sapiens
ctgggagggcaagg

SEQ ID NO: 1882786 - DNA, 23 bp, Homo sapiens
ctgggcaggtcctggggaggctg

SEQ ID NO: 1882787 - DNA, 19 bp, Homo sapiens
ctgggccctgcaggaggcc

SEQ ID NO: 1882788 - DNA, 21 bp, Homo sapiens
ctgggccctgcaggaggcctg

SEQ ID NO: 1882789 - DNA, 22 bp, Homo sapiens
ctgggccctgcaggaggcctgg

SEQ ID NO: 1882790 - DNA, 17 bp, Homo sapiens
ctgggcctgatggagag

SEQ ID NO: 1882791 - DNA, 18 bp, Homo sapiens
ctgggcctgatggagagg

SEQ ID NO: 1882792 - DNA, 15 bp, Homo sapiens
ctgggctctgtgggc

SEQ ID NO: 1882793 - DNA, 16 bp, Homo sapiens
ctgggctctgtgggct

SEQ ID NO: 1882794 - DNA, 20 bp, Homo sapiens
ctgggctctgtgggctgcac

SEQ ID NO: 1882795 - DNA, 21 bp, Homo sapiens
ctgggctctgtgggctgcact

SEQ ID NO: 1882796 - DNA, 15 bp, Homo sapiens
ctgggctgactggga

SEQ ID NO: 1882797 - DNA, 14 bp, Homo sapiens
ctgggctgggagaa

SEQ ID NO: 1882798 - DNA, 18 bp, Homo sapiens
ctgggctggggcctgatg

SEQ ID NO: 1882799 - DNA, 17 bp, Homo sapiens
ctgggctgttggctggg

SEQ ID NO: 1882800 - DNA, 16 bp, Homo sapiens
ctggggaaggaccaac

SEQ ID NO: 1882801 - DNA, 20 bp, Homo sapiens
ctggggaggctgagactgca

SEQ ID NO: 1882802 - DNA, 17 bp, Homo sapiens
ctggggagtgagcttgg

SEQ ID NO: 1882803 - DNA, 21 bp, Homo sapiens
ctggggcctatcagtgtgccc

SEQ ID NO: 1882804 - DNA, 22 bp, Homo sapiens
ctggggcctatcagtgtgcccc

SEQ ID NO: 1882805 - DNA, 18 bp, Homo sapiens
ctggggcggggctggagg

SEQ ID NO: 1882806 - DNA, 21 bp, Homo sapiens
ctggggtgggtttagcaggct

SEQ ID NO: 1882807 - DNA, 16 bp, Homo sapiens
ctgggtatgaggctgg

SEQ ID NO: 1882808 - DNA, 21 bp, Homo sapiens
ctgggtgcgaccccatctgcc

SEQ ID NO: 1882809 - DNA, 14 bp, Homo sapiens
ctgggtggcccatc

SEQ ID NO: 1882810 - DNA, 15 bp, Homo sapiens
ctgggtggcccatcc

SEQ ID NO: 1882811 - DNA, 16 bp, Homo sapiens
ctgggtggcccatccc

SEQ ID NO: 1882812 - DNA, 18 bp, Homo sapiens
ctgggttggcgcaccctc

SEQ ID NO: 1882813 - DNA, 23 bp, Homo sapiens
ctgggttggcgcaccctcccctc

SEQ ID NO: 1882814 - DNA, 17 bp, Homo sapiens
ctgggttttcaggggct

SEQ ID NO: 1882815 - DNA, 20 bp, Homo sapiens
ctgggttttcaggggctttg

SEQ ID NO: 1882816 - DNA, 23 bp, Homo sapiens
ctggtaagtaatgagggctgagt

SEQ ID NO: 1882817 - DNA, 17 bp, Homo sapiens
ctggtaatttgtatctg

SEQ ID NO: 1882818 - DNA, 18 bp, Homo sapiens
ctggtaatttgtatctga

SEQ ID NO: 1882819 - DNA, 21 bp, Homo sapiens
ctggtaatttgtatctgaagg

SEQ ID NO: 1882820 - DNA, 22 bp, Homo sapiens
ctggtaatttgtatctgaagga

SEQ ID NO: 1882821 - DNA, 19 bp, Homo sapiens
ctggtggggaggaagaagt

SEQ ID NO: 1882822 - DNA, 15 bp, Homo sapiens
ctgtaaggactcagt

SEQ ID NO: 1882823 - DNA, 19 bp, Homo sapiens
ctgtaaggactcagtgttg

SEQ ID NO: 1882824 - DNA, 20 bp, Homo sapiens
ctgtagaaaagaaaacattt

SEQ ID NO: 1882825 - DNA, 22 bp, Homo sapiens
ctgtagaaaagaaaacatttaa

SEQ ID NO: 1882826 - DNA, 16 bp, Homo sapiens
ctgtaggagagactgg

SEQ ID NO: 1882827 - DNA, 23 bp, Homo sapiens
ctgtaggagagactggccagagg

SEQ ID NO: 1882828 - DNA, 19 bp, Homo sapiens
ctgtaggcgcccctggggt

SEQ ID NO: 1882829 - DNA, 17 bp, Homo sapiens
ctgtataatttaacagt

SEQ ID NO: 1882830 - DNA, 14 bp, Homo sapiens
ctgtatctattttt

SEQ ID NO: 1882831 - DNA, 18 bp, Homo sapiens
ctgtatttgaatcagcct

SEQ ID NO: 1882832 - DNA, 20 bp, Homo sapiens
ctgtattttaaaagaatgat

SEQ ID NO: 1882833 - DNA, 22 bp, Homo sapiens
ctgtattttaaaagaatgatta

SEQ ID NO: 1882834 - DNA, 17 bp, Homo sapiens
ctgtcagtgccgccgcc

SEQ ID NO: 1882835 - DNA, 18 bp, Homo sapiens
ctgtcagtgccgccgcct

SEQ ID NO: 1882836 - DNA, 22 bp, Homo sapiens
ctgtcatatgctctgatttatc

SEQ ID NO: 1882837 - DNA, 13 bp, Homo sapiens
ctgtcatctgggc

SEQ ID NO: 1882838 - DNA, 14 bp, Homo sapiens
ctgtccagtgccca

SEQ ID NO: 1882839 - DNA, 18 bp, Homo sapiens
ctgtccagtgcccattcc

SEQ ID NO: 1882840 - DNA, 22 bp, Homo sapiens
ctgtcccaggggtctccctgag

SEQ ID NO: 1882841 - DNA, 12 bp, Homo sapiens
ctgtcccctctt

SEQ ID NO: 1882842 - DNA, 18 bp, Homo sapiens
ctgtcccctcttgcccca

SEQ ID NO: 1882843 - DNA, 16 bp, Homo sapiens
ctgtcctgctccacag

SEQ ID NO: 1882844 - DNA, 18 bp, Homo sapiens
ctgtcctgctccacagtg

SEQ ID NO: 1882845 - DNA, 14 bp, Homo sapiens
ctgtgatttcttct

SEQ ID NO: 1882846 - DNA, 11 bp, Homo sapiens
ctgtgccaccc

SEQ ID NO: 1882847 - DNA, 16 bp, Homo sapiens
ctgtgccaccctgggc

SEQ ID NO: 1882848 - DNA, 20 bp, Homo sapiens
ctgtgccaccctgggctctg

SEQ ID NO: 1882849 - DNA, 23 bp, Homo sapiens
ctgtgccaccctgggctctgtgg

SEQ ID NO: 1882850 - DNA, 15 bp, Homo sapiens
ctgtgcccatgggca

SEQ ID NO: 1882851 - DNA, 20 bp, Homo sapiens
ctgtgcccatgggcactgct

SEQ ID NO: 1882852 - DNA, 13 bp, Homo sapiens
ctgtgcctgactc

SEQ ID NO: 1882853 - DNA, 15 bp, Homo sapiens
ctgtgggctgcactc

SEQ ID NO: 1882854 - DNA, 20 bp, Homo sapiens
ctgtgggctgcactctgtgc

SEQ ID NO: 1882855 - DNA, 23 bp, Homo sapiens
ctgtgggggaagagcacagccct

SEQ ID NO: 1882856 - DNA, 16 bp, Homo sapiens
ctgtgtgggagggcga

SEQ ID NO: 1882857 - DNA, 14 bp, Homo sapiens
ctgttcagtgcttt

SEQ ID NO: 1882858 - DNA, 20 bp, Homo sapiens
ctgttcagtgctttttcctt

SEQ ID NO: 1882859 - DNA, 15 bp, Homo sapiens
ctgtttcttgcactg

SEQ ID NO: 1882860 - DNA, 17 bp, Homo sapiens
ctgtttgtgcaaacata

SEQ ID NO: 1882861 - DNA, 14 bp, Homo sapiens
cttaaaaagacact

SEQ ID NO: 1882862 - DNA, 12 bp, Homo sapiens
cttaaaactcct

SEQ ID NO: 1882863 - DNA, 15 bp, Homo sapiens
cttaaattcttttga

SEQ ID NO: 1882864 - DNA, 21 bp, Homo sapiens
cttaagaagactgcattatat

SEQ ID NO: 1882865 - DNA, 23 bp, Homo sapiens
cttaagaagactgcattatattt

SEQ ID NO: 1882866 - DNA, 14 bp, Homo sapiens
cttaaggagaggag

SEQ ID NO: 1882867 - DNA, 18 bp, Homo sapiens
cttaaggagaggagagca

SEQ ID NO: 1882868 - DNA, 13 bp, Homo sapiens
cttaccaagatca

SEQ ID NO: 1882869 - DNA, 15 bp, Homo sapiens
cttagaataaaattg

SEQ ID NO: 1882870 - DNA, 16 bp, Homo sapiens
cttagaataaaattgt

SEQ ID NO: 1882871 - DNA, 20 bp, Homo sapiens
cttagatgcagttctgaaga

SEQ ID NO: 1882872 - DNA, 19 bp, Homo sapiens
cttaggttgacattcagaa

SEQ ID NO: 1882873 - DNA, 19 bp, Homo sapiens
cttatattttgattttaca

SEQ ID NO: 1882874 - DNA, 17 bp, Homo sapiens
cttatccacaaagtact

SEQ ID NO: 1882875 - DNA, 15 bp, Homo sapiens
cttatcgaaactcat

SEQ ID NO: 1882876 - DNA, 23 bp, Homo sapiens
cttatctaatcatgaaactccct

SEQ ID NO: 1882877 - DNA, 21 bp, Homo sapiens
cttattcaggaaaagcctctg

SEQ ID NO: 1882878 - DNA, 11 bp, Homo sapiens
cttatttgagt

SEQ ID NO: 1882879 - DNA, 15 bp, Homo sapiens
cttcacaaattctca

SEQ ID NO: 1882880 - DNA, 21 bp, Homo sapiens
cttcacagtgcagcttgcagt

SEQ ID NO: 1882881 - DNA, 22 bp, Homo sapiens
cttcacagtgcagcttgcagtc

SEQ ID NO: 1882882 - DNA, 16 bp, Homo sapiens
cttcaggacactcact

SEQ ID NO: 1882883 - DNA, 16 bp, Homo sapiens
cttcagggctgggcag

SEQ ID NO: 1882884 - DNA, 21 bp, Homo sapiens
cttcagggctgggcaggtcct

SEQ ID NO: 1882885 - DNA, 15 bp, Homo sapiens
cttcaggggctgccc

SEQ ID NO: 1882886 - DNA, 17 bp, Homo sapiens
cttcaggggctgcccgc

SEQ ID NO: 1882887 - DNA, 23 bp, Homo sapiens
cttcatgtggcacttgggcattt

SEQ ID NO: 1882888 - DNA, 14 bp, Homo sapiens
cttcatttgcaatt

SEQ ID NO: 1882889 - DNA, 22 bp, Homo sapiens
cttccaagcccttccctctgtt

SEQ ID NO: 1882890 - DNA, 15 bp, Homo sapiens
cttccaaggtggtct

SEQ ID NO: 1882891 - DNA, 16 bp, Homo sapiens
cttccaaggtggtctg

SEQ ID NO: 1882892 - DNA, 19 bp, Homo sapiens
cttccacgtactgcagcct

SEQ ID NO: 1882893 - DNA, 21 bp, Homo sapiens
cttccactgtgtgttgacact

SEQ ID NO: 1882894 - DNA, 13 bp, Homo sapiens
cttccattattga

SEQ ID NO: 1882895 - DNA, 21 bp, Homo sapiens
cttcccaggtaagcaggagga

SEQ ID NO: 1882896 - DNA, 23 bp, Homo sapiens
cttccccgagggatgatgccaca

SEQ ID NO: 1882897 - DNA, 23 bp, Homo sapiens
cttcctacacccttggacttgag

SEQ ID NO: 1882898 - DNA, 21 bp, Homo sapiens
cttctcaaaagattgttttat

SEQ ID NO: 1882899 - DNA, 19 bp, Homo sapiens
cttctcactagctgtctca

SEQ ID NO: 1882900 - DNA, 14 bp, Homo sapiens
cttctctccagtgc

SEQ ID NO: 1882901 - DNA, 11 bp, Homo sapiens
cttctgccact

SEQ ID NO: 1882902 - DNA, 12 bp, Homo sapiens
cttctgccactt

SEQ ID NO: 1882903 - DNA, 16 bp, Homo sapiens
cttctgccacttccca

SEQ ID NO: 1882904 - DNA, 18 bp, Homo sapiens
cttctgccacttcccagg

SEQ ID NO: 1882905 - DNA, 17 bp, Homo sapiens
cttctgcggtgaggcag

SEQ ID NO: 1882906 - DNA, 19 bp, Homo sapiens
cttctgctgggctggggcc

SEQ ID NO: 1882907 - DNA, 14 bp, Homo sapiens
cttctgggcctgat

SEQ ID NO: 1882908 - DNA, 21 bp, Homo sapiens
cttctgggcctgatggagagg

SEQ ID NO: 1882909 - DNA, 22 bp, Homo sapiens
cttctgggcctgatggagagga

SEQ ID NO: 1882910 - DNA, 12 bp, Homo sapiens
cttcttgccctg

SEQ ID NO: 1882911 - DNA, 13 bp, Homo sapiens
cttcttttgtgaa

SEQ ID NO: 1882912 - DNA, 18 bp, Homo sapiens
cttgaattttcccactgc

SEQ ID NO: 1882913 - DNA, 15 bp, Homo sapiens
cttgatctgtgattt

SEQ ID NO: 1882914 - DNA, 13 bp, Homo sapiens
cttgatgaagaag

SEQ ID NO: 1882915 - DNA, 16 bp, Homo sapiens
cttgcactgaatatat

SEQ ID NO: 1882916 - DNA, 21 bp, Homo sapiens
cttgccccaacccccagcacc

SEQ ID NO: 1882917 - DNA, 20 bp, Homo sapiens
cttgccctgagctttccggg

SEQ ID NO: 1882918 - DNA, 20 bp, Homo sapiens
cttgcctcggctcctgctgc

SEQ ID NO: 1882919 - DNA, 17 bp, Homo sapiens
cttgctgatggctgctg

SEQ ID NO: 1882920 - DNA, 19 bp, Homo sapiens
cttgggagggtcaggctgt

SEQ ID NO: 1882921 - DNA, 16 bp, Homo sapiens
cttggggctgatgcag

SEQ ID NO: 1882922 - DNA, 23 bp, Homo sapiens
cttggtaaattgtaaacagctaa

SEQ ID NO: 1882923 - DNA, 15 bp, Homo sapiens
cttggttcttttttc

SEQ ID NO: 1882924 - DNA, 16 bp, Homo sapiens
cttgtgtcaaacagta

SEQ ID NO: 1882925 - DNA, 19 bp, Homo sapiens
cttgttttgtttgcttcca

SEQ ID NO: 1882926 - DNA, 12 bp, Homo sapiens
ctttaaatcatt

SEQ ID NO: 1882927 - DNA, 19 bp, Homo sapiens
ctttaacttaattgctatg

SEQ ID NO: 1882928 - DNA, 15 bp, Homo sapiens
ctttatagatcagcc

SEQ ID NO: 1882929 - DNA, 14 bp, Homo sapiens
ctttattgtgatta

SEQ ID NO: 1882930 - DNA, 15 bp, Homo sapiens
ctttcacttgatgtt

SEQ ID NO: 1882931 - DNA, 18 bp, Homo sapiens
ctttccagggtcaaagta

SEQ ID NO: 1882932 - DNA, 19 bp, Homo sapiens
ctttccagggtcaaagtac

SEQ ID NO: 1882933 - DNA, 15 bp, Homo sapiens
ctttcccaaatgtat

SEQ ID NO: 1882934 - DNA, 21 bp, Homo sapiens
ctttcccaaatgtattgatta

SEQ ID NO: 1882935 - DNA, 17 bp, Homo sapiens
ctttctcctctgctatg

SEQ ID NO: 1882936 - DNA, 22 bp, Homo sapiens
ctttctcctctgctatgcattt

SEQ ID NO: 1882937 - DNA, 13 bp, Homo sapiens
ctttcttttaagc

SEQ ID NO: 1882938 - DNA, 21 bp, Homo sapiens
ctttgatttttatccatttct

SEQ ID NO: 1882939 - DNA, 22 bp, Homo sapiens
ctttgatttttatccatttctt

SEQ ID NO: 1882940 - DNA, 12 bp, Homo sapiens
ctttgcttcatt

SEQ ID NO: 1882941 - DNA, 23 bp, Homo sapiens
ctttgcttcattcaagtcagctc

SEQ ID NO: 1882942 - DNA, 18 bp, Homo sapiens
ctttggacagaagcagct

SEQ ID NO: 1882943 - DNA, 15 bp, Homo sapiens
cttttactctgtgta

SEQ ID NO: 1882944 - DNA, 21 bp, Homo sapiens
cttttactctgtgtaaagact

SEQ ID NO: 1882945 - DNA, 18 bp, Homo sapiens
cttttcaatttgtcatgt

SEQ ID NO: 1882946 - DNA, 17 bp, Homo sapiens
cttttcagcttctgctg

SEQ ID NO: 1882947 - DNA, 14 bp, Homo sapiens
cttttcccaaccat

SEQ ID NO: 1882948 - DNA, 14 bp, Homo sapiens
ctttttgtacctgg

SEQ ID NO: 1882949 - DNA, 12 bp, Homo sapiens
cttttttcagtt

SEQ ID NO: 1882950 - DNA, 15 bp, Homo sapiens
gaaaacatttaacat

SEQ ID NO: 1882951 - DNA, 13 bp, Homo sapiens
gaaaagcctctgt

SEQ ID NO: 1882952 - DNA, 14 bp, Homo sapiens
gaaaaggttttatt

SEQ ID NO: 1882953 - DNA, 18 bp, Homo sapiens
gaaaaggttttattttgt

SEQ ID NO: 1882954 - DNA, 14 bp, Homo sapiens
gaaaagtatgttag

SEQ ID NO: 1882955 - DNA, 20 bp, Homo sapiens
gaaaagtatgttagtgcaaa

SEQ ID NO: 1882956 - DNA, 18 bp, Homo sapiens
gagtctgctatattttca

SEQ ID NO: 1882957 - DNA, 22 bp, Homo sapiens
gagtctgcttgtcttagatgtt

SEQ ID NO: 1882958 - DNA, 13 bp, Homo sapiens
gagtgacatgaag

SEQ ID NO: 1882959 - DNA, 16 bp, Homo sapiens
gagtgacatgaagcat

SEQ ID NO: 1882960 - DNA, 14 bp, Homo sapiens
gagtgctggctcca

SEQ ID NO: 1882961 - DNA, 23 bp, Homo sapiens
gagtgctggctccacgccctggg

SEQ ID NO: 1882962 - DNA, 14 bp, Homo sapiens
gagtgggttggctt

SEQ ID NO: 1882963 - DNA, 17 bp, Homo sapiens
gagttagatattatttt

SEQ ID NO: 1882964 - DNA, 22 bp, Homo sapiens
gataaatggcttcctggcaata

SEQ ID NO: 1882965 - DNA, 13 bp, Homo sapiens
gatactgtttctt

SEQ ID NO: 1882966 - DNA, 23 bp, Homo sapiens
gatactgtttcttgcactgaata

SEQ ID NO: 1882967 - DNA, 15 bp, Homo sapiens
gatagtatcttttaa

SEQ ID NO: 1882968 - DNA, 21 bp, Homo sapiens
gatataaaggaccctgtttct

SEQ ID NO: 1882969 - DNA, 23 bp, Homo sapiens
gatataaaggaccctgtttctgt

SEQ ID NO: 1882970 - DNA, 23 bp, Homo sapiens
gatattattttagcttcagttgt

SEQ ID NO: 1882971 - DNA, 21 bp, Homo sapiens
gatatttgctggagtgctggc

SEQ ID NO: 1882972 - DNA, 16 bp, Homo sapiens
gatcattgcatttcca

SEQ ID NO: 1882973 - DNA, 16 bp, Homo sapiens
gatccccagctttctc

SEQ ID NO: 1882974 - DNA, 18 bp, Homo sapiens
gatccccagctttctcct

SEQ ID NO: 1882975 - DNA, 16 bp, Homo sapiens
gatcctggagcccctg

SEQ ID NO: 1882976 - DNA, 18 bp, Homo sapiens
gatctggggaaggaccaa

SEQ ID NO: 1882977 - DNA, 13 bp, Homo sapiens
gatctttggacag

SEQ ID NO: 1882978 - DNA, 19 bp, Homo sapiens
gatgagttgcagtttttat

SEQ ID NO: 1882979 - DNA, 14 bp, Homo sapiens
gatgatactgtttc

SEQ ID NO: 1882980 - DNA, 14 bp, Homo sapiens
gatgcactggcctg

SEQ ID NO: 1882981 - DNA, 19 bp, Homo sapiens
gatgccacaccaagctgtg

SEQ ID NO: 1882982 - DNA, 22 bp, Homo sapiens
gatgccacaccaagctgtgcca

SEQ ID NO: 1882983 - DNA, 23 bp, Homo sapiens
gatggctgctggaggggacgctg

SEQ ID NO: 1882984 - DNA, 22 bp, Homo sapiens
gatgtcttcatcacttcttcca

SEQ ID NO: 1882985 - DNA, 10 bp, Homo sapiens
gatgtttgtt

SEQ ID NO: 1882986 - DNA, 17 bp, Homo sapiens
gattacaaataaacagt

SEQ ID NO: 1882987 - DNA, 21 bp, Homo sapiens
gattacaaataaacagttgtt

SEQ ID NO: 1882988 - DNA, 21 bp, Homo sapiens
gattacgtgtatgtttcttct

SEQ ID NO: 1882989 - DNA, 23 bp, Homo sapiens
gattataagccctgcataatgtt

SEQ ID NO: 1882990 - DNA, 22 bp, Homo sapiens
gattatttgttatttgtacagt

SEQ ID NO: 1882991 - DNA, 23 bp, Homo sapiens
gattgtacgtgggagaggcagaa

SEQ ID NO: 1882992 - DNA, 12 bp, Homo sapiens
gatttaactggg

SEQ ID NO: 1882993 - DNA, 15 bp, Homo sapiens
gatttaccacttgtg

SEQ ID NO: 1882994 - DNA, 16 bp, Homo sapiens
gatttcccgtggcccc

SEQ ID NO: 1882995 - DNA, 21 bp, Homo sapiens
gatttcccgtggccccagcct

SEQ ID NO: 1882996 - DNA, 22 bp, Homo sapiens
gatttcccgtggccccagcctg

SEQ ID NO: 1882997 - DNA, 23 bp, Homo sapiens
gatttgaggagcagcttcagttg

SEQ ID NO: 1882998 - DNA, 21 bp, Homo sapiens
gattttgaaaccatgaagaga

SEQ ID NO: 1882999 - DNA, 15 bp, Homo sapiens
gcaaagtctaaagtt

SEQ ID NO: 1883000 - DNA, 13 bp, Homo sapiens
gcaaggaggctgg

SEQ ID NO: 1883001 - DNA, 16 bp, Homo sapiens
gcaaggaggctggctg

SEQ ID NO: 1883002 - DNA, 22 bp, Homo sapiens
gcaagggtcctacggagggacc

SEQ ID NO: 1883003 - DNA, 20 bp, Homo sapiens
gcaaggtgggggagcctgga

SEQ ID NO: 1883004 - DNA, 21 bp, Homo sapiens
gcaaggtgggggagcctggag

SEQ ID NO: 1883005 - DNA, 20 bp, Homo sapiens
gcaagtattagaataccaca

SEQ ID NO: 1883006 - DNA, 21 bp, Homo sapiens
gcaattcatgtaacagttgtg

SEQ ID NO: 1883007 - DNA, 19 bp, Homo sapiens
gcacaccttaggttgacat

SEQ ID NO: 1883008 - DNA, 17 bp, Homo sapiens
gcacagcaaggaggctg

SEQ ID NO: 1883009 - DNA, 16 bp, Homo sapiens
gcacagccctcccgcc

SEQ ID NO: 1883010 - DNA, 19 bp, Homo sapiens
gcacagccctcccgcccct

SEQ ID NO: 1883011 - DNA, 15 bp, Homo sapiens
gcacagcctcttaga

SEQ ID NO: 1883012 - DNA, 15 bp, Homo sapiens
gcacagtggtctgga

SEQ ID NO: 1883013 - DNA, 16 bp, Homo sapiens
gcaccaacccagccgc

SEQ ID NO: 1883014 - DNA, 18 bp, Homo sapiens
gcaccaacccagccgctg

SEQ ID NO: 1883015 - DNA, 16 bp, Homo sapiens
gcaccccctcctgctg

SEQ ID NO: 1883016 - DNA, 23 bp, Homo sapiens
gcacccgggctcagggaccacag

SEQ ID NO: 1883017 - DNA, 12 bp, Homo sapiens
gcacctggtggg

SEQ ID NO: 1883018 - DNA, 15 bp, Homo sapiens
gcacctggtggggag

SEQ ID NO: 1883019 - DNA, 20 bp, Homo sapiens
gcactctgtgcccatgggca

SEQ ID NO: 1883020 - DNA, 20 bp, Homo sapiens
gcactgaatatataaacact

SEQ ID NO: 1883021 - DNA, 14 bp, Homo sapiens
gcactgctgggtgg

SEQ ID NO: 1883022 - DNA, 18 bp, Homo sapiens
gcactgctgggtggccca

SEQ ID NO: 1883023 - DNA, 22 bp, Homo sapiens
gcactgctgggtggcccatccc

SEQ ID NO: 1883024 - DNA, 15 bp, Homo sapiens
gcactgtcctgctcc

SEQ ID NO: 1883025 - DNA, 17 bp, Homo sapiens
gcactgtcctgctccac

SEQ ID NO: 1883026 - DNA, 18 bp, Homo sapiens
gcactgtcctgctccaca

SEQ ID NO: 1883027 - DNA, 19 bp, Homo sapiens
gcagactttcccaaatgta

SEQ ID NO: 1883028 - DNA, 21 bp, Homo sapiens
gcagactttcccaaatgtatt

SEQ ID NO: 1883029 - DNA, 17 bp, Homo sapiens
gcagagagcacctggtg

SEQ ID NO: 1883030 - DNA, 18 bp, Homo sapiens
gcagaggggcaggccctg

SEQ ID NO: 1883031 - DNA, 12 bp, Homo sapiens
gcagcacagcaa

SEQ ID NO: 1883032 - DNA, 22 bp, Homo sapiens
gcagcacagcaaggaggctggc

SEQ ID NO: 1883033 - DNA, 15 bp, Homo sapiens
gcagcaggcagagga

SEQ ID NO: 1883034 - DNA, 16 bp, Homo sapiens
gcagcaggcagaggag

SEQ ID NO: 1883035 - DNA, 18 bp, Homo sapiens
gcagcaggcagaggagag

SEQ ID NO: 1883036 - DNA, 12 bp, Homo sapiens
gcagcaggtgct

SEQ ID NO: 1883037 - DNA, 20 bp, Homo sapiens
gcagcaggtgctgctaccct

SEQ ID NO: 1883038 - DNA, 19 bp, Homo sapiens
gcagcccctccccacacca

SEQ ID NO: 1883039 - DNA, 17 bp, Homo sapiens
gcagctaaggggcagga

SEQ ID NO: 1883040 - DNA, 20 bp, Homo sapiens
gcagcttctgccacttccca

SEQ ID NO: 1883041 - DNA, 15 bp, Homo sapiens
gcaggcacagcacag

SEQ ID NO: 1883042 - DNA, 15 bp, Homo sapiens
gcaggcagaggagag

SEQ ID NO: 1883043 - DNA, 15 bp, Homo sapiens
gcaggccctgcactg

SEQ ID NO: 1883044 - DNA, 17 bp, Homo sapiens
gcaggctgcagcaggca

SEQ ID NO: 1883045 - DNA, 11 bp, Homo sapiens
gcagggaagct

SEQ ID NO: 1883046 - DNA, 15 bp, Homo sapiens
gcagggaagctttca

SEQ ID NO: 1883047 - DNA, 15 bp, Homo sapiens
gcaggggagtctgct

SEQ ID NO: 1883048 - DNA, 12 bp, Homo sapiens
gcaggtcctggg

SEQ ID NO: 1883049 - DNA, 13 bp, Homo sapiens
gcaggtcctgggg

SEQ ID NO: 1883050 - DNA, 16 bp, Homo sapiens
gcaggtcctggggagg

SEQ ID NO: 1883051 - DNA, 18 bp, Homo sapiens
gcaggtcctggggaggct

SEQ ID NO: 1883052 - DNA, 22 bp, Homo sapiens
gcaggtgctgctaccctccctg

SEQ ID NO: 1883053 - DNA, 22 bp, Homo sapiens
gcaggtttatattgggaagctg

SEQ ID NO: 1883054 - DNA, 13 bp, Homo sapiens
gcagtaaatactt

SEQ ID NO: 1883055 - DNA, 18 bp, Homo sapiens
gcagtaaatacttgcagt

SEQ ID NO: 1883056 - DNA, 20 bp, Homo sapiens
gcagtaaatacttgcagttg

SEQ ID NO: 1883057 - DNA, 22 bp, Homo sapiens
gcagtaaatacttgcagttgtg

SEQ ID NO: 1883058 - DNA, 17 bp, Homo sapiens
gcagtgagcttctatta

SEQ ID NO: 1883059 - DNA, 18 bp, Homo sapiens
gcagtgggtcccacttcc

SEQ ID NO: 1883060 - DNA, 23 bp, Homo sapiens
gcagtgggtcccacttcccctcc

SEQ ID NO: 1883061 - DNA, 13 bp, Homo sapiens
gcatccttctgcc

SEQ ID NO: 1883062 - DNA, 12 bp, Homo sapiens
gcatctgctctg

SEQ ID NO: 1883063 - DNA, 14 bp, Homo sapiens
gcatctgctctgag

SEQ ID NO: 1883064 - DNA, 15 bp, Homo sapiens
gcatctgctctgaga

SEQ ID NO: 1883065 - DNA, 18 bp, Homo sapiens
gcatctgctctgagacgg

SEQ ID NO: 1883066 - DNA, 16 bp, Homo sapiens
gcatgggggaggctct

SEQ ID NO: 1883067 - DNA, 18 bp, Homo sapiens
gcatgggggaggctctga

SEQ ID NO: 1883068 - DNA, 12 bp, Homo sapiens
gcatgtggggga

SEQ ID NO: 1883069 - DNA, 23 bp, Homo sapiens
gcatgtgggggaaggccttgctg

SEQ ID NO: 1883070 - DNA, 13 bp, Homo sapiens
gcattatatttat

SEQ ID NO: 1883071 - DNA, 15 bp, Homo sapiens
gcattggcagcaggt

SEQ ID NO: 1883072 - DNA, 18 bp, Homo sapiens
gcattttcttcacagtgc

SEQ ID NO: 1883073 - DNA, 13 bp, Homo sapiens
gccaaataaagtc

SEQ ID NO: 1883074 - DNA, 18 bp, Homo sapiens
gccaagcctggagcccct

SEQ ID NO: 1883075 - DNA, 19 bp, Homo sapiens
gccacacaagggtcctttc

SEQ ID NO: 1883076 - DNA, 16 bp, Homo sapiens
gaaatgtaacatgaag

SEQ ID NO: 1883077 - DNA, 18 bp, Homo sapiens
gaaatgtaacatgaagca

SEQ ID NO: 1883078 - DNA, 19 bp, Homo sapiens
gaaattgggtgtgccctgg

SEQ ID NO: 1883079 - DNA, 22 bp, Homo sapiens
gaaattgggtgtgccctggctc

SEQ ID NO: 1883080 - DNA, 20 bp, Homo sapiens
gaacacttcagcctgtgcag

SEQ ID NO: 1883081 - DNA, 21 bp, Homo sapiens
gaactagagtttagctggaaa

SEQ ID NO: 1883082 - DNA, 14 bp, Homo sapiens
gaactgaaatcata

SEQ ID NO: 1883083 - DNA, 15 bp, Homo sapiens
gaactgcaggaagag

SEQ ID NO: 1883084 - DNA, 21 bp, Homo sapiens
gaactgcccatttccatggtg

SEQ ID NO: 1883085 - DNA, 15 bp, Homo sapiens
gaagagatttttcat

SEQ ID NO: 1883086 - DNA, 13 bp, Homo sapiens
gaagagcacagcc

SEQ ID NO: 1883087 - DNA, 20 bp, Homo sapiens
gaagagcacagccctcccgc

SEQ ID NO: 1883088 - DNA, 23 bp, Homo sapiens
gaagatattgggaaggaaatata

SEQ ID NO: 1883089 - DNA, 22 bp, Homo sapiens
gaagcatgagttatctgatttt

SEQ ID NO: 1883090 - DNA, 13 bp, Homo sapiens
gaaggccttgctg

SEQ ID NO: 1883091 - DNA, 17 bp, Homo sapiens
gaaggccttgctgtcat

SEQ ID NO: 1883092 - DNA, 14 bp, Homo sapiens
gaaggctgtatcta

SEQ ID NO: 1883093 - DNA, 22 bp, Homo sapiens
gaagtccaagcatttagatgta

SEQ ID NO: 1883094 - DNA, 19 bp, Homo sapiens
gaatacattgatacaaagt

SEQ ID NO: 1883095 - DNA, 14 bp, Homo sapiens
gaatcaaggagcct

SEQ ID NO: 1883096 - DNA, 12 bp, Homo sapiens
gaatgatagaac

SEQ ID NO: 1883097 - DNA, 22 bp, Homo sapiens
gaatgctagcagggcatggcac

SEQ ID NO: 1883098 - DNA, 14 bp, Homo sapiens
gaatgtgattttaa

SEQ ID NO: 1883099 - DNA, 18 bp, Homo sapiens
gaattacatttgtataaa

SEQ ID NO: 1883100 - DNA, 11 bp, Homo sapiens
gaattagtttt

SEQ ID NO: 1883101 - DNA, 15 bp, Homo sapiens
gaattgactgcagtt

SEQ ID NO: 1883102 - DNA, 14 bp, Homo sapiens
gaatttttattatt

SEQ ID NO: 1883103 - DNA, 17 bp, Homo sapiens
gacaacaaagaggacac

SEQ ID NO: 1883104 - DNA, 16 bp, Homo sapiens
gacagaagcagctctt

SEQ ID NO: 1883105 - DNA, 16 bp, Homo sapiens
gacatgggacatttgc

SEQ ID NO: 1883106 - DNA, 17 bp, Homo sapiens
gacatttgctcatggaa

SEQ ID NO: 1883107 - DNA, 23 bp, Homo sapiens
gaccaagcttaaggagaggagag

SEQ ID NO: 1883108 - DNA, 11 bp, Homo sapiens
gaccacagcaa

SEQ ID NO: 1883109 - DNA, 20 bp, Homo sapiens
gacccatctggaggctccca

SEQ ID NO: 1883110 - DNA, 17 bp, Homo sapiens
gaccccatctgcccagg

SEQ ID NO: 1883111 - DNA, 17 bp, Homo sapiens
gacctccagctctcagt

SEQ ID NO: 1883112 - DNA, 17 bp, Homo sapiens
gacctttcagctgtgaa

SEQ ID NO: 1883113 - DNA, 18 bp, Homo sapiens
gacgccacagtctcccca

SEQ ID NO: 1883114 - DNA, 15 bp, Homo sapiens
gacggatggaaggag

SEQ ID NO: 1883115 - DNA, 16 bp, Homo sapiens
gactcgggctcctgtg

SEQ ID NO: 1883116 - DNA, 19 bp, Homo sapiens
gactcgggctcctgtgccc

SEQ ID NO: 1883117 - DNA, 12 bp, Homo sapiens
gactgcagagga

SEQ ID NO: 1883118 - DNA, 13 bp, Homo sapiens
gactgcagaggag

SEQ ID NO: 1883119 - DNA, 14 bp, Homo sapiens
gactgcagaggagc

SEQ ID NO: 1883120 - DNA, 16 bp, Homo sapiens
gactgcagaggagcca

SEQ ID NO: 1883121 - DNA, 21 bp, Homo sapiens
gactggaggcaggactcctgg

SEQ ID NO: 1883122 - DNA, 22 bp, Homo sapiens
gactggaggcaggactcctggg

SEQ ID NO: 1883123 - DNA, 13 bp, Homo sapiens
gactggccagagg

SEQ ID NO: 1883124 - DNA, 19 bp, Homo sapiens
gacttcaggggctgcccgc

SEQ ID NO: 1883125 - DNA, 20 bp, Homo sapiens
gacttcaggggctgcccgct

SEQ ID NO: 1883126 - DNA, 21 bp, Homo sapiens
gacttcaggggctgcccgctc

SEQ ID NO: 1883127 - DNA, 21 bp, Homo sapiens
gacttgagaagtctaattcac

SEQ ID NO: 1883128 - DNA, 22 bp, Homo sapiens
gacttgagaagtctaattcaca

SEQ ID NO: 1883129 - DNA, 23 bp, Homo sapiens
gacttgaggattttgagtatctc

SEQ ID NO: 1883130 - DNA, 19 bp, Homo sapiens
gactttatagatcagccag

SEQ ID NO: 1883131 - DNA, 22 bp, Homo sapiens
gactttcccaaatgtattgatt

SEQ ID NO: 1883132 - DNA, 17 bp, Homo sapiens
gacttttccatgtatct

SEQ ID NO: 1883133 - DNA, 22 bp, Homo sapiens
gagaaaagtcaggtgcagtccc

SEQ ID NO: 1883134 - DNA, 23 bp, Homo sapiens
gagaacttccagatcctggaaat

SEQ ID NO: 1883135 - DNA, 14 bp, Homo sapiens
gagaagaactgaaa

SEQ ID NO: 1883136 - DNA, 14 bp, Homo sapiens
gagaaggtgcttgg

SEQ ID NO: 1883137 - DNA, 16 bp, Homo sapiens
gagactgcagaggagc

SEQ ID NO: 1883138 - DNA, 14 bp, Homo sapiens
gagagactggccag

SEQ ID NO: 1883139 - DNA, 21 bp, Homo sapiens
gagagactggccagaggcagc

SEQ ID NO: 1883140 - DNA, 15 bp, Homo sapiens
gagagagcagcttct

SEQ ID NO: 1883141 - DNA, 22 bp, Homo sapiens
gagagcagcttctgccacttcc

SEQ ID NO: 1883142 - DNA, 18 bp, Homo sapiens
gagagcatctgctctgag

SEQ ID NO: 1883143 - DNA, 19 bp, Homo sapiens
gagagcatctgctctgaga

SEQ ID NO: 1883144 - DNA, 15 bp, Homo sapiens
gagaggagagcatct

SEQ ID NO: 1883145 - DNA, 13 bp, Homo sapiens
gagaggttgagga

SEQ ID NO: 1883146 - DNA, 17 bp, Homo sapiens
gagaggttgtctgtggc

SEQ ID NO: 1883147 - DNA, 18 bp, Homo sapiens
gagagtacccccctgaga

SEQ ID NO: 1883148 - DNA, 11 bp, Homo sapiens
gagatatttac

SEQ ID NO: 1883149 - DNA, 12 bp, Homo sapiens
gagattttcctt

SEQ ID NO: 1883150 - DNA, 19 bp, Homo sapiens
gagcaaagtctaaagttta

SEQ ID NO: 1883151 - DNA, 12 bp, Homo sapiens
gagcacagccct

SEQ ID NO: 1883152 - DNA, 14 bp, Homo sapiens
gagcacagccctcc

SEQ ID NO: 1883153 - DNA, 20 bp, Homo sapiens
gagcagcttctgccacttcc

SEQ ID NO: 1883154 - DNA, 13 bp, Homo sapiens
gagcatctgctct

SEQ ID NO: 1883155 - DNA, 19 bp, Homo sapiens
gagcattctgcctgcctgg

SEQ ID NO: 1883156 - DNA, 15 bp, Homo sapiens
gagccacctgggctg

SEQ ID NO: 1883157 - DNA, 20 bp, Homo sapiens
gagccacctgggctgggaga

SEQ ID NO: 1883158 - DNA, 21 bp, Homo sapiens
gagccacctgggctgggagaa

SEQ ID NO: 1883159 - DNA, 20 bp, Homo sapiens
gagcccctgtgtgggagggc

SEQ ID NO: 1883160 - DNA, 21 bp, Homo sapiens
gagcccctgtgtgggagggcg

SEQ ID NO: 1883161 - DNA, 11 bp, Homo sapiens
gagccctcctt

SEQ ID NO: 1883162 - DNA, 22 bp, Homo sapiens
gagccctccttcttgccctgag

SEQ ID NO: 1883163 - DNA, 22 bp, Homo sapiens
gagcctcctctctcaaactggg

SEQ ID NO: 1883164 - DNA, 20 bp, Homo sapiens
gagcctgccccagctgggct

SEQ ID NO: 1883165 - DNA, 21 bp, Homo sapiens
gagcctgccccagctgggctg

SEQ ID NO: 1883166 - DNA, 11 bp, Homo sapiens
gagcctggagc

SEQ ID NO: 1883167 - DNA, 15 bp, Homo sapiens
gagcctggagcccct

SEQ ID NO: 1883168 - DNA, 11 bp, Homo sapiens
gagctgtgccc

SEQ ID NO: 1883169 - DNA, 13 bp, Homo sapiens
gagcttcagggct

SEQ ID NO: 1883170 - DNA, 20 bp, Homo sapiens
gagcttgatctgtgatttct

SEQ ID NO: 1883171 - DNA, 23 bp, Homo sapiens
gagcttgatctgtgatttcttct

SEQ ID NO: 1883172 - DNA, 21 bp, Homo sapiens
gagctttccggggaggagcct

SEQ ID NO: 1883173 - DNA, 22 bp, Homo sapiens
gagctttccggggaggagcctt

SEQ ID NO: 1883174 - DNA, 20 bp, Homo sapiens
gaggagagtacccccctgag

SEQ ID NO: 1883175 - DNA, 22 bp, Homo sapiens
gaggagtacccccagcccaaga

SEQ ID NO: 1883176 - DNA, 17 bp, Homo sapiens
gaggcacatgtcagcaa

SEQ ID NO: 1883177 - DNA, 14 bp, Homo sapiens
gaggcaggactcct

SEQ ID NO: 1883178 - DNA, 15 bp, Homo sapiens
gaggcaggactcctg

SEQ ID NO: 1883179 - DNA, 17 bp, Homo sapiens
gaggcaggggagtctgc

SEQ ID NO: 1883180 - DNA, 13 bp, Homo sapiens
gaggccccaggtg

SEQ ID NO: 1883181 - DNA, 12 bp, Homo sapiens
gaggcctgggag

SEQ ID NO: 1883182 - DNA, 18 bp, Homo sapiens
ttgttctgtggtcacagt

SEQ ID NO: 1883183 - DNA, 15 bp, Homo sapiens
ttgtttgcttccatt

SEQ ID NO: 1883184 - DNA, 20 bp, Homo sapiens
tttaaaaaagaaacatttgg

SEQ ID NO: 1883185 - DNA, 12 bp, Homo sapiens
tttaaacatcta

SEQ ID NO: 1883186 - DNA, 19 bp, Homo sapiens
tttaaagtgcagtcatttg

SEQ ID NO: 1883187 - DNA, 11 bp, Homo sapiens
tttaacatctt

SEQ ID NO: 1883188 - DNA, 19 bp, Homo sapiens
tttaacgtggcttgtagaa

SEQ ID NO: 1883189 - DNA, 23 bp, Homo sapiens
tttaacgtggcttgtagaatttt

SEQ ID NO: 1883190 - DNA, 13 bp, Homo sapiens
tttaagatcttgg

SEQ ID NO: 1883191 - DNA, 16 bp, Homo sapiens
tttaagccttcatttg

SEQ ID NO: 1883192 - DNA, 15 bp, Homo sapiens
tttaataatgtttca

SEQ ID NO: 1883193 - DNA, 20 bp, Homo sapiens
tttacagtaaataaattgtt

SEQ ID NO: 1883194 - DNA, 18 bp, Homo sapiens
tttacatgaattgcattt

SEQ ID NO: 1883195 - DNA, 12 bp, Homo sapiens
tttaccaagttt

SEQ ID NO: 1883196 - DNA, 13 bp, Homo sapiens
tttactctgtgta

SEQ ID NO: 1883197 - DNA, 17 bp, Homo sapiens
tttacttgtttcagagt

SEQ ID NO: 1883198 - DNA, 22 bp, Homo sapiens
tttagctggaaaagtatgttag

SEQ ID NO: 1883199 - DNA, 16 bp, Homo sapiens
tttagcttcagttgtt

SEQ ID NO: 1883200 - DNA, 17 bp, Homo sapiens
tttatatgcttctgttt

SEQ ID NO: 1883201 - DNA, 21 bp, Homo sapiens
tttatatgcttctgttttata

SEQ ID NO: 1883202 - DNA, 18 bp, Homo sapiens
tttatattgggaagctgt

SEQ ID NO: 1883203 - DNA, 17 bp, Homo sapiens
tttatccatttctttta

SEQ ID NO: 1883204 - DNA, 16 bp, Homo sapiens
tttattaataaacatt

SEQ ID NO: 1883205 - DNA, 19 bp, Homo sapiens
tttattactgtaagaaaat

SEQ ID NO: 1883206 - DNA, 22 bp, Homo sapiens
tttatttttccatttacaacaa

SEQ ID NO: 1883207 - DNA, 16 bp, Homo sapiens
tttcaaacatatataa

SEQ ID NO: 1883208 - DNA, 15 bp, Homo sapiens
tttcagataatcaca

SEQ ID NO: 1883209 - DNA, 14 bp, Homo sapiens
tttcagctgtgaac

SEQ ID NO: 1883210 - DNA, 19 bp, Homo sapiens
tttcagcttctgctgggct

SEQ ID NO: 1883211 - DNA, 14 bp, Homo sapiens
tttcatctgttgtt

SEQ ID NO: 1883212 - DNA, 16 bp, Homo sapiens
tttcatgattttgaaa

SEQ ID NO: 1883213 - DNA, 16 bp, Homo sapiens
tttccagggttattta

SEQ ID NO: 1883214 - DNA, 14 bp, Homo sapiens
tttccatggtgcaa

SEQ ID NO: 1883215 - DNA, 15 bp, Homo sapiens
tttcccactgcaccc

SEQ ID NO: 1883216 - DNA, 22 bp, Homo sapiens
tttcccgagcaaagtctaaagt

SEQ ID NO: 1883217 - DNA, 16 bp, Homo sapiens
tttcccgtggccccag

SEQ ID NO: 1883218 - DNA, 21 bp, Homo sapiens
tttcccgtggccccagcctgg

SEQ ID NO: 1883219 - DNA, 21 bp, Homo sapiens
tttccggggaggagccttgga

SEQ ID NO: 1883220 - DNA, 15 bp, Homo sapiens
tttccttttcatctg

SEQ ID NO: 1883221 - DNA, 16 bp, Homo sapiens
tttccttttcatctgt

SEQ ID NO: 1883222 - DNA, 16 bp, Homo sapiens
tttctagattaagata

SEQ ID NO: 1883223 - DNA, 20 bp, Homo sapiens
tttctcctctgctatgcatt

SEQ ID NO: 1883224 - DNA, 20 bp, Homo sapiens
tttcttactgatttttaagt

SEQ ID NO: 1883225 - DNA, 15 bp, Homo sapiens
tttcttgcactgaat

SEQ ID NO: 1883226 - DNA, 13 bp, Homo sapiens
tttcttttactct

SEQ ID NO: 1883227 - DNA, 15 bp, Homo sapiens
tttctttttaaagtt

SEQ ID NO: 1883228 - DNA, 22 bp, Homo sapiens
tttgaggagcagcttcagttgt

SEQ ID NO: 1883229 - DNA, 14 bp, Homo sapiens
tttgcaattcatgt

SEQ ID NO: 1883230 - DNA, 14 bp, Homo sapiens
tttgccagtcttta

SEQ ID NO: 1883231 - DNA, 23 bp, Homo sapiens
tttgctcacacggggtattttag

SEQ ID NO: 1883232 - DNA, 17 bp, Homo sapiens
tttggaagctctgttgc

SEQ ID NO: 1883233 - DNA, 15 bp, Homo sapiens
tttggtattgtaaaa

SEQ ID NO: 1883234 - DNA, 21 bp, Homo sapiens
tttgtaaaagatgaaggctgt

SEQ ID NO: 1883235 - DNA, 22 bp, Homo sapiens
tttgtaagttaggtaactgtat

SEQ ID NO: 1883236 - DNA, 13 bp, Homo sapiens
tttgtaagtttat

SEQ ID NO: 1883237 - DNA, 14 bp, Homo sapiens
tttgtaattattgt

SEQ ID NO: 1883238 - DNA, 15 bp, Homo sapiens
tttgtagaactgccc

SEQ ID NO: 1883239 - DNA, 17 bp, Homo sapiens
tttgtataaaataattt

SEQ ID NO: 1883240 - DNA, 19 bp, Homo sapiens
tttgtataaaataattttt

SEQ ID NO: 1883241 - DNA, 17 bp, Homo sapiens
tttgtattttgtttaaa

SEQ ID NO: 1883242 - DNA, 23 bp, Homo sapiens
tttgtgggaggagtgacatgaag

SEQ ID NO: 1883243 - DNA, 21 bp, Homo sapiens
tttgtgtcatgtttaagaaat

SEQ ID NO: 1883244 - DNA, 17 bp, Homo sapiens
tttgttatttgtacagt

SEQ ID NO: 1883245 - DNA, 19 bp, Homo sapiens
tttgttatttgtacagttc

SEQ ID NO: 1883246 - DNA, 16 bp, Homo sapiens
tttgtttgcttccatt

SEQ ID NO: 1883247 - DNA, 18 bp, Homo sapiens
tttgtttttaaaatagaa

SEQ ID NO: 1883248 - DNA, 22 bp, Homo sapiens
ttttaaaaattaaatcaacctt

SEQ ID NO: 1883249 - DNA, 21 bp, Homo sapiens
ttttaaaatagaatgatagaa

SEQ ID NO: 1883250 - DNA, 20 bp, Homo sapiens
ttttaaagagtgaaaaatga

SEQ ID NO: 1883251 - DNA, 20 bp, Homo sapiens
ttttaaagtttgttcactta

SEQ ID NO: 1883252 - DNA, 12 bp, Homo sapiens
ttttaacatctt

SEQ ID NO: 1883253 - DNA, 13 bp, Homo sapiens
ttttaataatgtt

SEQ ID NO: 1883254 - DNA, 20 bp, Homo sapiens
ttttaataatgtttcaaaca

SEQ ID NO: 1883255 - DNA, 15 bp, Homo sapiens
ttttacattctgaat

SEQ ID NO: 1883256 - DNA, 20 bp, Homo sapiens
ttttagtttaaaaaccttgt

SEQ ID NO: 1883257 - DNA, 20 bp, Homo sapiens
ttttatatgcttctgtttta

SEQ ID NO: 1883258 - DNA, 10 bp, Homo sapiens
ttttatattt

SEQ ID NO: 1883259 - DNA, 22 bp, Homo sapiens
ttttattaataaacattctatc

SEQ ID NO: 1883260 - DNA, 15 bp, Homo sapiens
ttttattttgtaatt

SEQ ID NO: 1883261 - DNA, 19 bp, Homo sapiens
ttttcaatttgtcatgtta

SEQ ID NO: 1883262 - DNA, 21 bp, Homo sapiens
ttttcatgattttgaaaccat

SEQ ID NO: 1883263 - DNA, 21 bp, Homo sapiens
ttttcatgattttgaaatcat

SEQ ID NO: 1883264 - DNA, 13 bp, Homo sapiens
ttttcccactgca

SEQ ID NO: 1883265 - DNA, 13 bp, Homo sapiens
ttttcctaagtga

SEQ ID NO: 1883266 - DNA, 14 bp, Homo sapiens
ttttccttttcatc

SEQ ID NO: 1883267 - DNA, 13 bp, Homo sapiens
ttttcttttctat

SEQ ID NO: 1883268 - DNA, 20 bp, Homo sapiens
ttttctttttaaagtttgtt

SEQ ID NO: 1883269 - DNA, 11 bp, Homo sapiens
ttttgagaaag

SEQ ID NO: 1883270 - DNA, 20 bp, Homo sapiens
ttttgaggatgggatgtatt

SEQ ID NO: 1883271 - DNA, 23 bp, Homo sapiens
ttttgatgaacaaaatttcctaa

SEQ ID NO: 1883272 - DNA, 18 bp, Homo sapiens
ttttggtctggagggaag

SEQ ID NO: 1883273 - DNA, 22 bp, Homo sapiens
tttttaaaatagaatgatagaa

SEQ ID NO: 1883274 - DNA, 12 bp, Homo sapiens
tttttaaagtct

SEQ ID NO: 1883275 - DNA, 17 bp, Homo sapiens
tttttaacgtggcttgt

SEQ ID NO: 1883276 - DNA, 21 bp, Homo sapiens
tttttaacgtggcttgtagaa

SEQ ID NO: 1883277 - DNA, 19 bp, Homo sapiens
tttttatatttgaaatatt

SEQ ID NO: 1883278 - DNA, 14 bp, Homo sapiens
tttttattatttgt

SEQ ID NO: 1883279 - DNA, 11 bp, Homo sapiens
tttttcatgat

SEQ ID NO: 1883280 - DNA, 23 bp, Homo sapiens
ttttttaaaaaagaaacatttgg

SEQ ID NO: 1883281 - DNA, 12 bp, Homo sapiens
ttttttaacatc

SEQ ID NO: 1883282 - DNA, 12 bp, Homo sapiens
ttttttaattga

SEQ ID NO: 1883283 - DNA, 19 bp, Homo sapiens
tgtaactatagtccagctt

SEQ ID NO: 1883284 - DNA, 21 bp, Homo sapiens
tgtaactatagtccagctttg

SEQ ID NO: 1883285 - DNA, 15 bp, Homo sapiens
tgtaactttaaacat

SEQ ID NO: 1883286 - DNA, 18 bp, Homo sapiens
tgtaactttctctatgaa

SEQ ID NO: 1883287 - DNA, 17 bp, Homo sapiens
tgtaagaaaatatcact

SEQ ID NO: 1883288 - DNA, 18 bp, Homo sapiens
tgtaagaaaatatcactt

SEQ ID NO: 1883289 - DNA, 16 bp, Homo sapiens
tgtaagctgaaaatat

SEQ ID NO: 1883290 - DNA, 20 bp, Homo sapiens
tgtaagtttatgtctaaaga

SEQ ID NO: 1883291 - DNA, 23 bp, Homo sapiens
tgtaatcccagctactcaggagg

SEQ ID NO: 1883292 - DNA, 12 bp, Homo sapiens
tgtaattattgt

SEQ ID NO: 1883293 - DNA, 14 bp, Homo sapiens
tgtaattattgtga

SEQ ID NO: 1883294 - DNA, 15 bp, Homo sapiens
tgtacccccgcccag

SEQ ID NO: 1883295 - DNA, 17 bp, Homo sapiens
tgtacccccgcccaggc

SEQ ID NO: 1883296 - DNA, 16 bp, Homo sapiens
tgtacgtgggagaggc

SEQ ID NO: 1883297 - DNA, 17 bp, Homo sapiens
tgtacgtgggagaggca

SEQ ID NO: 1883298 - DNA, 20 bp, Homo sapiens
tgtacgtgggagaggcagaa

SEQ ID NO: 1883299 - DNA, 13 bp, Homo sapiens
tgtagctgctata

SEQ ID NO: 1883300 - DNA, 18 bp, Homo sapiens
tgtagtgttggagaagaa

SEQ ID NO: 1883301 - DNA, 14 bp, Homo sapiens
tgtataaaataatt

SEQ ID NO: 1883302 - DNA, 23 bp, Homo sapiens
tgtataatttaacagtgcccttt

SEQ ID NO: 1883303 - DNA, 18 bp, Homo sapiens
tgtatctgaaggagattt

SEQ ID NO: 1883304 - DNA, 22 bp, Homo sapiens
tgtatctgaaggagattttcct

SEQ ID NO: 1883305 - DNA, 18 bp, Homo sapiens
tgtattaaaaatagatat

SEQ ID NO: 1883306 - DNA, 18 bp, Homo sapiens
tgtattaatctgtttgtg

SEQ ID NO: 1883307 - DNA, 14 bp, Homo sapiens
tgtattcagcttta

SEQ ID NO: 1883308 - DNA, 16 bp, Homo sapiens
tgtcactggctgcctc

SEQ ID NO: 1883309 - DNA, 13 bp, Homo sapiens
tgccaagcctgga

SEQ ID NO: 1883310 - DNA, 20 bp, Homo sapiens
tgccaagcctggagcccctg

SEQ ID NO: 1883311 - DNA, 15 bp, Homo sapiens
tgccaaggtacctag

SEQ ID NO: 1883312 - DNA, 20 bp, Homo sapiens
tgccacaccaagctgtgcca

SEQ ID NO: 1883313 - DNA, 22 bp, Homo sapiens
tgccacaccaagctgtgccacc

SEQ ID NO: 1883314 - DNA, 14 bp, Homo sapiens
tgccaccctgggct

SEQ ID NO: 1883315 - DNA, 15 bp, Homo sapiens
tgccaccctgggctc

SEQ ID NO: 1883316 - DNA, 18 bp, Homo sapiens
tgccaccctgggctctgt

SEQ ID NO: 1883317 - DNA, 21 bp, Homo sapiens
tgccaccctgggctctgtggg

SEQ ID NO: 1883318 - DNA, 16 bp, Homo sapiens
tgccagtcgcgctgcc

SEQ ID NO: 1883319 - DNA, 23 bp, Homo sapiens
tgccagtcgcgctgcctgtgtgg

SEQ ID NO: 1883320 - DNA, 17 bp, Homo sapiens
tgccagtctttaagatc

SEQ ID NO: 1883321 - DNA, 20 bp, Homo sapiens
tgccatgtagggttccctta

SEQ ID NO: 1883322 - DNA, 16 bp, Homo sapiens
tgcccatgggcactgc

SEQ ID NO: 1883323 - DNA, 18 bp, Homo sapiens
tgcccatgggcactgctg

SEQ ID NO: 1883324 - DNA, 22 bp, Homo sapiens
tgcccatgggcactgctgggtg

SEQ ID NO: 1883325 - DNA, 16 bp, Homo sapiens
tgccccaacccccagc

SEQ ID NO: 1883326 - DNA, 20 bp, Homo sapiens
tgccccaacccccagcaccc

SEQ ID NO: 1883327 - DNA, 16 bp, Homo sapiens
tgccccagctgggctg

SEQ ID NO: 1883328 - DNA, 17 bp, Homo sapiens
tgccccccatcctggcc

SEQ ID NO: 1883329 - DNA, 20 bp, Homo sapiens
tgccccccatcctggcccat

SEQ ID NO: 1883330 - DNA, 23 bp, Homo sapiens
tgccccccatcctggcccatcag

SEQ ID NO: 1883331 - DNA, 18 bp, Homo sapiens
tgccccctcgtgccagtc

SEQ ID NO: 1883332 - DNA, 13 bp, Homo sapiens
tgcccgctcccag

SEQ ID NO: 1883333 - DNA, 17 bp, Homo sapiens
tgcccgctcccagtgtc

SEQ ID NO: 1883334 - DNA, 15 bp, Homo sapiens
tgcccgctgtcccag

SEQ ID NO: 1883335 - DNA, 16 bp, Homo sapiens
tgcccggcgccctctg

SEQ ID NO: 1883336 - DNA, 15 bp, Homo sapiens
tgcccgttgccgggc

SEQ ID NO: 1883337 - DNA, 12 bp, Homo sapiens
tgccctgagctt

SEQ ID NO: 1883338 - DNA, 20 bp, Homo sapiens
tgccgccgcctcgcccaccg

SEQ ID NO: 1883339 - DNA, 20 bp, Homo sapiens
tgccgggcctggactgtcct

SEQ ID NO: 1883340 - DNA, 15 bp, Homo sapiens
tgcctccactcccac

SEQ ID NO: 1883341 - DNA, 16 bp, Homo sapiens
tgcctccactcccact

SEQ ID NO: 1883342 - DNA, 16 bp, Homo sapiens
tgcctctacccaacca

SEQ ID NO: 1883343 - DNA, 20 bp, Homo sapiens
tgcctgaccatcccatgagc

SEQ ID NO: 1883344 - DNA, 19 bp, Homo sapiens
tgcctgctctccttgccct

SEQ ID NO: 1883345 - DNA, 21 bp, Homo sapiens
tgcctgctctccttgccctgg

SEQ ID NO: 1883346 - DNA, 13 bp, Homo sapiens
tgcctgctgagct

SEQ ID NO: 1883347 - DNA, 13 bp, Homo sapiens
tgcctttccaggg

SEQ ID NO: 1883348 - DNA, 14 bp, Homo sapiens
tgcgaccccatctg

SEQ ID NO: 1883349 - DNA, 20 bp, Homo sapiens
tgcgaccccatctgcccagg

SEQ ID NO: 1883350 - DNA, 19 bp, Homo sapiens
tgcggtaggtgctggcctc

SEQ ID NO: 1883351 - DNA, 19 bp, Homo sapiens
tgctaagcattccaactat

SEQ ID NO: 1883352 - DNA, 15 bp, Homo sapiens
tgctaccctccctgc

SEQ ID NO: 1883353 - DNA, 20 bp, Homo sapiens
tgctaccctccctgctgtcc

SEQ ID NO: 1883354 - DNA, 21 bp, Homo sapiens
tgctaccctccctgctgtccc

SEQ ID NO: 1883355 - DNA, 23 bp, Homo sapiens
tgctaccctccctgctgtcccct

SEQ ID NO: 1883356 - DNA, 16 bp, Homo sapiens
tgctagggtgcctgct

SEQ ID NO: 1883357 - DNA, 20 bp, Homo sapiens
tgctagggtgcctgctctcc

SEQ ID NO: 1883358 - DNA, 18 bp, Homo sapiens
tgctatattttcatgact

SEQ ID NO: 1883359 - DNA, 22 bp, Homo sapiens
tgctatattttcatgacttttc

SEQ ID NO: 1883360 - DNA, 15 bp, Homo sapiens
tgctatgcattttct

SEQ ID NO: 1883361 - DNA, 18 bp, Homo sapiens
tgctatgcattttcttca

SEQ ID NO: 1883362 - DNA, 20 bp, Homo sapiens
tgctatgcattttcttcaca

SEQ ID NO: 1883363 - DNA, 18 bp, Homo sapiens
tgctatggacgacctcca

SEQ ID NO: 1883364 - DNA, 20 bp, Homo sapiens
tgctatgttttgacattttt

SEQ ID NO: 1883365 - DNA, 17 bp, Homo sapiens
tgctcagcttctccaac

SEQ ID NO: 1883366 - DNA, 11 bp, Homo sapiens
tgctcatggaa

SEQ ID NO: 1883367 - DNA, 14 bp, Homo sapiens
tgctcatggaattg

SEQ ID NO: 1883368 - DNA, 15 bp, Homo sapiens
tgctccgtcatttga

SEQ ID NO: 1883369 - DNA, 23 bp, Homo sapiens
tgctcgggcccaggccatcttcc

SEQ ID NO: 1883370 - DNA, 17 bp, Homo sapiens
tgctctccttgccctgg

SEQ ID NO: 1883371 - DNA, 22 bp, Homo sapiens
tgctctgagacggatggaagga

SEQ ID NO: 1883372 - DNA, 14 bp, Homo sapiens
tgctctgatttatc

SEQ ID NO: 1883373 - DNA, 14 bp, Homo sapiens
tgctgagctgtgcc

SEQ ID NO: 1883374 - DNA, 15 bp, Homo sapiens
tgctgatggctgctg

SEQ ID NO: 1883375 - DNA, 18 bp, Homo sapiens
tgctgcaccaacccagcc

SEQ ID NO: 1883376 - DNA, 19 bp, Homo sapiens
tgctgcaccaacccagccg

SEQ ID NO: 1883377 - DNA, 23 bp, Homo sapiens
tgctgctaccctccctgctgtcc

SEQ ID NO: 1883378 - DNA, 16 bp, Homo sapiens
tgctggctccacgccc

SEQ ID NO: 1883379 - DNA, 11 bp, Homo sapiens
tgctgggctgg

SEQ ID NO: 1883380 - DNA, 13 bp, Homo sapiens
tgctgggctgggg

SEQ ID NO: 1883381 - DNA, 14 bp, Homo sapiens
tgctgggctggggc

SEQ ID NO: 1883382 - DNA, 17 bp, Homo sapiens
tgctgggctggggcctg

SEQ ID NO: 1883383 - DNA, 13 bp, Homo sapiens
tgctgtcccctct

SEQ ID NO: 1883384 - DNA, 18 bp, Homo sapiens
tgctgttcagtgcttttt

SEQ ID NO: 1883385 - DNA, 13 bp, Homo sapiens
tgcttccaagccc

SEQ ID NO: 1883386 - DNA, 19 bp, Homo sapiens
tgcttccaagcccttccct

SEQ ID NO: 1883387 - DNA, 11 bp, Homo sapiens
tgcttccatta

SEQ ID NO: 1883388 - DNA, 12 bp, Homo sapiens
tgcttctgggcc

SEQ ID NO: 1883389 - DNA, 23 bp, Homo sapiens
tgcttgggcttctgcggtgaggc

SEQ ID NO: 1883390 - DNA, 19 bp, Homo sapiens
tgctttgtatccatgaggg

SEQ ID NO: 1883391 - DNA, 21 bp, Homo sapiens
tggaaggagagaggttgagga

SEQ ID NO: 1883392 - DNA, 16 bp, Homo sapiens
tggaatggactgggtg

SEQ ID NO: 1883393 - DNA, 18 bp, Homo sapiens
tggaattggagctcgtgg

SEQ ID NO: 1883394 - DNA, 17 bp, Homo sapiens
tggacttagctctgagg

SEQ ID NO: 1883395 - DNA, 12 bp, Homo sapiens
tctgaaggagat

SEQ ID NO: 1883396 - DNA, 21 bp, Homo sapiens
tctgactgtttccatcaaggg

SEQ ID NO: 1883397 - DNA, 16 bp, Homo sapiens
tctgagtcaactcctt

SEQ ID NO: 1883398 - DNA, 18 bp, Homo sapiens
tctgatgtttgttgctag

SEQ ID NO: 1883399 - DNA, 20 bp, Homo sapiens
tctgattttttttgtagctg

SEQ ID NO: 1883400 - DNA, 17 bp, Homo sapiens
tctgccacttcccaggt

SEQ ID NO: 1883401 - DNA, 14 bp, Homo sapiens
tctgcctgcctggg

SEQ ID NO: 1883402 - DNA, 17 bp, Homo sapiens
tctgctatattttcatg

SEQ ID NO: 1883403 - DNA, 11 bp, Homo sapiens
tctgctctgag

SEQ ID NO: 1883404 - DNA, 14 bp, Homo sapiens
tctgctgggctggg

SEQ ID NO: 1883405 - DNA, 17 bp, Homo sapiens
tctgctgggctggggcc

SEQ ID NO: 1883406 - DNA, 22 bp, Homo sapiens
tctgctgggctggggcctgatg

SEQ ID NO: 1883407 - DNA, 17 bp, Homo sapiens
tctggaccccaggccat

SEQ ID NO: 1883408 - DNA, 15 bp, Homo sapiens
tctgggaggcttcag

SEQ ID NO: 1883409 - DNA, 16 bp, Homo sapiens
tctgggccaccagctc

SEQ ID NO: 1883410 - DNA, 15 bp, Homo sapiens
tctgggccctgcagg

SEQ ID NO: 1883411 - DNA, 22 bp, Homo sapiens
tctgggccctgcaggaggcctg

SEQ ID NO: 1883412 - DNA, 20 bp, Homo sapiens
tctgggcctgatggagagga

SEQ ID NO: 1883413 - DNA, 23 bp, Homo sapiens
tctgtatttgaatcagcctacag

SEQ ID NO: 1883414 - DNA, 10 bp, Homo sapiens
tctgtcctga

SEQ ID NO: 1883415 - DNA, 17 bp, Homo sapiens
tctgtgagattcattca

SEQ ID NO: 1883416 - DNA, 15 bp, Homo sapiens
tctgtgcccatgggc

SEQ ID NO: 1883417 - DNA, 19 bp, Homo sapiens
tctgtgcccatgggcactg

SEQ ID NO: 1883418 - DNA, 21 bp, Homo sapiens
tctgtgcccatgggcactgct

SEQ ID NO: 1883419 - DNA, 19 bp, Homo sapiens
tctgtgctgagcacagaga

SEQ ID NO: 1883420 - DNA, 12 bp, Homo sapiens
tctgtgggctgc

SEQ ID NO: 1883421 - DNA, 23 bp, Homo sapiens
tctgtgggctgcactctgtgccc

SEQ ID NO: 1883422 - DNA, 16 bp, Homo sapiens
tctgtggtcacagtga

SEQ ID NO: 1883423 - DNA, 21 bp, Homo sapiens
tctgtgtaactttaaacatct

SEQ ID NO: 1883424 - DNA, 22 bp, Homo sapiens
tctgtgtaactttaaacatcta

SEQ ID NO: 1883425 - DNA, 15 bp, Homo sapiens
tctgtgtcactggct

SEQ ID NO: 1883426 - DNA, 16 bp, Homo sapiens
tctgtgtgtctgatgt

SEQ ID NO: 1883427 - DNA, 14 bp, Homo sapiens
tctgttgttctgtg

SEQ ID NO: 1883428 - DNA, 23 bp, Homo sapiens
tctgttgttctgtggtcacagtg

SEQ ID NO: 1883429 - DNA, 23 bp, Homo sapiens
tctgttttctttctaatgagata

SEQ ID NO: 1883430 - DNA, 15 bp, Homo sapiens
tcttaaataaacctt

SEQ ID NO: 1883431 - DNA, 19 bp, Homo sapiens
tcttaagagcttgatctgt

SEQ ID NO: 1883432 - DNA, 20 bp, Homo sapiens
tcttaagagcttgatctgtg

SEQ ID NO: 1883433 - DNA, 22 bp, Homo sapiens
tcttaagagcttgatctgtgat

SEQ ID NO: 1883434 - DNA, 19 bp, Homo sapiens
tcttatccacaaagtactc

SEQ ID NO: 1883435 - DNA, 14 bp, Homo sapiens
tccactggcctgcc

SEQ ID NO: 1883436 - DNA, 17 bp, Homo sapiens
tccactgtgtgttgaca

SEQ ID NO: 1883437 - DNA, 18 bp, Homo sapiens
tccactgtgtgttgacac

SEQ ID NO: 1883438 - DNA, 22 bp, Homo sapiens
tccagagcttcagggctgggca

SEQ ID NO: 1883439 - DNA, 16 bp, Homo sapiens
tccaggccccaggtca

SEQ ID NO: 1883440 - DNA, 16 bp, Homo sapiens
tccaggtggggtgagg

SEQ ID NO: 1883441 - DNA, 20 bp, Homo sapiens
tccagtcaggcctatctaaa

SEQ ID NO: 1883442 - DNA, 19 bp, Homo sapiens
tccatataaatattagaaa

SEQ ID NO: 1883443 - DNA, 21 bp, Homo sapiens
tccatcagatgtgttcctcca

SEQ ID NO: 1883444 - DNA, 15 bp, Homo sapiens
tccatccctggcccc

SEQ ID NO: 1883445 - DNA, 23 bp, Homo sapiens
tccatccctggccccctccctgg

SEQ ID NO: 1883446 - DNA, 20 bp, Homo sapiens
tccattattgagttcctcct

SEQ ID NO: 1883447 - DNA, 16 bp, Homo sapiens
tccatttcttttactc

SEQ ID NO: 1883448 - DNA, 13 bp, Homo sapiens
tcccaagggaggc

SEQ ID NO: 1883449 - DNA, 20 bp, Homo sapiens
tcccaagggaggcccatgtg

SEQ ID NO: 1883450 - DNA, 13 bp, Homo sapiens
tcccacagcgctg

SEQ ID NO: 1883451 - DNA, 14 bp, Homo sapiens
tcccacctctgagg

SEQ ID NO: 1883452 - DNA, 16 bp, Homo sapiens
tcccactgcaccccct

SEQ ID NO: 1883453 - DNA, 15 bp, Homo sapiens
tcccacttcccctcc

SEQ ID NO: 1883454 - DNA, 20 bp, Homo sapiens
tcccacttcccctcctaccc

SEQ ID NO: 1883455 - DNA, 18 bp, Homo sapiens
tcccagacagctttttag

SEQ ID NO: 1883456 - DNA, 16 bp, Homo sapiens
tcccagctgacagtcc

SEQ ID NO: 1883457 - DNA, 20 bp, Homo sapiens
tcccagctgacagtcctctc

SEQ ID NO: 1883458 - DNA, 21 bp, Homo sapiens
tcccaggggtctccctgagcc

SEQ ID NO: 1883459 - DNA, 15 bp, Homo sapiens
tcccagtgtcttcct

SEQ ID NO: 1883460 - DNA, 20 bp, Homo sapiens
tcccagtgtcttcctgtggg

SEQ ID NO: 1883461 - DNA, 17 bp, Homo sapiens
tcccatgcaagtagctg

SEQ ID NO: 1883462 - DNA, 15 bp, Homo sapiens
tccccagctttctcc

SEQ ID NO: 1883463 - DNA, 19 bp, Homo sapiens
tccccagctttctcctctg

SEQ ID NO: 1883464 - DNA, 19 bp, Homo sapiens
tccccagtactgaggtggt

SEQ ID NO: 1883465 - DNA, 12 bp, Homo sapiens
tcccccagcctc

SEQ ID NO: 1883466 - DNA, 18 bp, Homo sapiens
tcccccccggggctgggt

SEQ ID NO: 1883467 - DNA, 14 bp, Homo sapiens
tcccccctcaccag

SEQ ID NO: 1883468 - DNA, 21 bp, Homo sapiens
tccccgagggatgatgccaca

SEQ ID NO: 1883469 - DNA, 19 bp, Homo sapiens
tcccctcctacccctccca

SEQ ID NO: 1883470 - DNA, 21 bp, Homo sapiens
tcccctcttgccccaaccccc

SEQ ID NO: 1883471 - DNA, 17 bp, Homo sapiens
tcccgtctactcattcc

SEQ ID NO: 1883472 - DNA, 12 bp, Homo sapiens
tcccgtggcccc

SEQ ID NO: 1883473 - DNA, 22 bp, Homo sapiens
tcccgtggccccagcctggccc

SEQ ID NO: 1883474 - DNA, 23 bp, Homo sapiens
tcccgtggccccagcctggccca

SEQ ID NO: 1883475 - DNA, 12 bp, Homo sapiens
tccctgagcctg

SEQ ID NO: 1883476 - DNA, 22 bp, Homo sapiens
tccctgagcctgccccagctgg

SEQ ID NO: 1883477 - DNA, 22 bp, Homo sapiens
tccctgctgtcccctcttgccc

SEQ ID NO: 1883478 - DNA, 20 bp, Homo sapiens
tccctggatgacattaaaga

SEQ ID NO: 1883479 - DNA, 14 bp, Homo sapiens
gccacaccaagctg

SEQ ID NO: 1883480 - DNA, 16 bp, Homo sapiens
gccacaccaagctgtg

SEQ ID NO: 1883481 - DNA, 21 bp, Homo sapiens
gccacaccaagctgtgccacc

SEQ ID NO: 1883482 - DNA, 14 bp, Homo sapiens
gccacagtcatggt

SEQ ID NO: 1883483 - DNA, 14 bp, Homo sapiens
gccacagtctcccc

SEQ ID NO: 1883484 - DNA, 17 bp, Homo sapiens
gccaccagctccactgg

SEQ ID NO: 1883485 - DNA, 20 bp, Homo sapiens
gccaccagctccactggcct

SEQ ID NO: 1883486 - DNA, 19 bp, Homo sapiens
gccaccctgcctctaccca

SEQ ID NO: 1883487 - DNA, 14 bp, Homo sapiens
gccaccctgggctc

SEQ ID NO: 1883488 - DNA, 21 bp, Homo sapiens
gccaccctgggctctgtgggc

SEQ ID NO: 1883489 - DNA, 17 bp, Homo sapiens
gccacctgggctgggag

SEQ ID NO: 1883490 - DNA, 18 bp, Homo sapiens
gccacctgggctgggaga

SEQ ID NO: 1883491 - DNA, 22 bp, Homo sapiens
gccacggtggacttagctctga

SEQ ID NO: 1883492 - DNA, 23 bp, Homo sapiens
gccacggtggacttagctctgag

SEQ ID NO: 1883493 - DNA, 13 bp, Homo sapiens
gccacttcccagg

SEQ ID NO: 1883494 - DNA, 11 bp, Homo sapiens
gccagaggcag

SEQ ID NO: 1883495 - DNA, 13 bp, Homo sapiens
gccagcccaggat

SEQ ID NO: 1883496 - DNA, 16 bp, Homo sapiens
gccagccccacagccc

SEQ ID NO: 1883497 - DNA, 19 bp, Homo sapiens
gccagccccacagcccacg

SEQ ID NO: 1883498 - DNA, 19 bp, Homo sapiens
gccagtcgcgctgcctgtg

SEQ ID NO: 1883499 - DNA, 17 bp, Homo sapiens
gccagtgaccaaccttt

SEQ ID NO: 1883500 - DNA, 16 bp, Homo sapiens
gccagttggcttctgt

SEQ ID NO: 1883501 - DNA, 23 bp, Homo sapiens
gccatactggcctcgcctggcct

SEQ ID NO: 1883502 - DNA, 19 bp, Homo sapiens
gccatggcttccaaggtgg

SEQ ID NO: 1883503 - DNA, 24 bp, Homo sapiens
gccatggcttccaaggtggtctgc

SEQ ID NO: 1883504 - DNA, 19 bp, Homo sapiens
gccatgggcactgtgggta

SEQ ID NO: 1883505 - DNA, 10 bp, Homo sapiens
gcccaacaca

SEQ ID NO: 1883506 - DNA, 16 bp, Homo sapiens
gcccacatccagtggg

SEQ ID NO: 1883507 - DNA, 14 bp, Homo sapiens
gcccaccgcatgcc

SEQ ID NO: 1883508 - DNA, 19 bp, Homo sapiens
gcccaccgcatgccccctc

SEQ ID NO: 1883509 - DNA, 14 bp, Homo sapiens
gcccacgtcctgtc

SEQ ID NO: 1883510 - DNA, 16 bp, Homo sapiens
gcccacgtcctgtcag

SEQ ID NO: 1883511 - DNA, 19 bp, Homo sapiens
gcccagctcccccgggagg

SEQ ID NO: 1883512 - DNA, 18 bp, Homo sapiens
gcccaggacggggccggc

SEQ ID NO: 1883513 - DNA, 19 bp, Homo sapiens
gcccaggacggggccggcc

SEQ ID NO: 1883514 - DNA, 23 bp, Homo sapiens
gcccaggacggggccggccaggt

SEQ ID NO: 1883515 - DNA, 19 bp, Homo sapiens
gcccaggattgtacgtggg

SEQ ID NO: 1883516 - DNA, 21 bp, Homo sapiens
gcccaggattgtacgtgggag

SEQ ID NO: 1883517 - DNA, 18 bp, Homo sapiens
gcccaggctggccagccc

SEQ ID NO: 1883518 - DNA, 21 bp, Homo sapiens
gcccatcagtgtacccccgcc

SEQ ID NO: 1883519 - DNA, 15 bp, Homo sapiens
gcccatcccccctca

SEQ ID NO: 1883520 - DNA, 17 bp, Homo sapiens
gcccatcccccctcacc

SEQ ID NO: 1883521 - DNA, 18 bp, Homo sapiens
gcccatcccccctcacca

SEQ ID NO: 1883522 - DNA, 20 bp, Homo sapiens
gcccatcccccctcaccagg

SEQ ID NO: 1883523 - DNA, 21 bp, Homo sapiens
gcccatgggcactgctgggtg

SEQ ID NO: 1883524 - DNA, 16 bp, Homo sapiens
gcccattcctcacctt

SEQ ID NO: 1883525 - DNA, 16 bp, Homo sapiens
gccccaacccccagca

SEQ ID NO: 1883526 - DNA, 14 bp, Homo sapiens
gccccagcctggcc

SEQ ID NO: 1883527 - DNA, 17 bp, Homo sapiens
gccccagcctggcccag

SEQ ID NO: 1883528 - DNA, 21 bp, Homo sapiens
gccccagcctggcccagctcc

SEQ ID NO: 1883529 - DNA, 18 bp, Homo sapiens
gccccccatcctggccca

SEQ ID NO: 1883530 - DNA, 14 bp, Homo sapiens
gccccctccctgga

SEQ ID NO: 1883531 - DNA, 12 bp, Homo sapiens
gccccctcgtgc

SEQ ID NO: 1883532 - DNA, 15 bp, Homo sapiens
gcccctccccacacc

SEQ ID NO: 1883533 - DNA, 17 bp, Homo sapiens
gcccctgtgtgggaggg

SEQ ID NO: 1883534 - DNA, 17 bp, Homo sapiens
gcccctgtgttgggggg

SEQ ID NO: 1883535 - DNA, 18 bp, Homo sapiens
gcccctgtgttggggggc

SEQ ID NO: 1883536 - DNA, 22 bp, Homo sapiens
gcccctgtgttggggggcaagg

SEQ ID NO: 1883537 - DNA, 18 bp, Homo sapiens
gcccgcttgcctcggctc

SEQ ID NO: 1883538 - DNA, 14 bp, Homo sapiens
gcccggcgccctct

SEQ ID NO: 1883539 - DNA, 20 bp, Homo sapiens
gcccggcgccctctgtcctg

SEQ ID NO: 1883540 - DNA, 18 bp, Homo sapiens
gcccgttgccgggcctgg

SEQ ID NO: 1883541 - DNA, 20 bp, Homo sapiens
gcccgttgccgggcctggac

SEQ ID NO: 1883542 - DNA, 21 bp, Homo sapiens
gcccgttgtctccctggccct

SEQ ID NO: 1883543 - DNA, 22 bp, Homo sapiens
gcccgttgtctccctggccctc

SEQ ID NO: 1883544 - DNA, 20 bp, Homo sapiens
gccctcaaggcctcccacag

SEQ ID NO: 1883545 - DNA, 21 bp, Homo sapiens
gccctcaaggcctcccacagt

SEQ ID NO: 1883546 - DNA, 22 bp, Homo sapiens
gccctcaaggcctcccacagtg

SEQ ID NO: 1883547 - DNA, 23 bp, Homo sapiens
gccctcaaggcctcccacagtga

SEQ ID NO: 1883548 - DNA, 21 bp, Homo sapiens
gccctccttcttgccctgagc

SEQ ID NO: 1883549 - DNA, 12 bp, Homo sapiens
gccctctgtcct

SEQ ID NO: 1883550 - DNA, 15 bp, Homo sapiens
gccctgcactgtcct

SEQ ID NO: 1883551 - DNA, 19 bp, Homo sapiens
gccctgcactgtcctgctc

SEQ ID NO: 1883552 - DNA, 16 bp, Homo sapiens
gccctgcaggaggcct

SEQ ID NO: 1883553 - DNA, 18 bp, Homo sapiens
gccctgcaggaggcctgg

SEQ ID NO: 1883554 - DNA, 20 bp, Homo sapiens
gccctgcaggaggcctggga

SEQ ID NO: 1883555 - DNA, 15 bp, Homo sapiens
gccctgccaagcctg

SEQ ID NO: 1883556 - DNA, 21 bp, Homo sapiens
gccctgccaagcctggagccc

SEQ ID NO: 1883557 - DNA, 23 bp, Homo sapiens
gccctggctcccaagggaggccc

SEQ ID NO: 1883558 - DNA, 13 bp, Homo sapiens
gccgccgcctcgc

SEQ ID NO: 1883559 - DNA, 16 bp, Homo sapiens
gccgccgcctcgccca

SEQ ID NO: 1883560 - DNA, 23 bp, Homo sapiens
gccgggaccccgagcctggctcc

SEQ ID NO: 1883561 - DNA, 12 bp, Homo sapiens
gccgggcctgga

SEQ ID NO: 1883562 - DNA, 14 bp, Homo sapiens
gcctatcagtgtgc

SEQ ID NO: 1883563 - DNA, 19 bp, Homo sapiens
gcctcaaacagccacgagg

SEQ ID NO: 1883564 - DNA, 18 bp, Homo sapiens
gcctccactcccacttcc

SEQ ID NO: 1883565 - DNA, 12 bp, Homo sapiens
gcctcccacagt

SEQ ID NO: 1883566 - DNA, 13 bp, Homo sapiens
gcctcccacagtg

SEQ ID NO: 1883567 - DNA, 14 bp, Homo sapiens
gcctcccacagtga

SEQ ID NO: 1883568 - DNA, 15 bp, Homo sapiens
gcctccgttcccacc

SEQ ID NO: 1883569 - DNA, 16 bp, Homo sapiens
gcctccgttcccacct

SEQ ID NO: 1883570 - DNA, 23 bp, Homo sapiens
gcctcgcccaccgcatgccccct

SEQ ID NO: 1883571 - DNA, 14 bp, Homo sapiens
gcctcggctcctgc

SEQ ID NO: 1883572 - DNA, 22 bp, Homo sapiens
gcctctcgctcctcaacccctc

SEQ ID NO: 1883573 - DNA, 21 bp, Homo sapiens
gcctgaccatcccatgagcag

SEQ ID NO: 1883574 - DNA, 17 bp, Homo sapiens
gcctgatggggagggtc

SEQ ID NO: 1883575 - DNA, 20 bp, Homo sapiens
gctgtcatgtgaatccctca

SEQ ID NO: 1883576 - DNA, 16 bp, Homo sapiens
gctgtccagtgcccat

SEQ ID NO: 1883577 - DNA, 18 bp, Homo sapiens
gctgtccagtgcccattc

SEQ ID NO: 1883578 - DNA, 14 bp, Homo sapiens
gctgtcccaggggt

SEQ ID NO: 1883579 - DNA, 19 bp, Homo sapiens
gctgtcccctcttgcccca

SEQ ID NO: 1883580 - DNA, 13 bp, Homo sapiens
gctgtgccaccct

SEQ ID NO: 1883581 - DNA, 12 bp, Homo sapiens
gcttaaggagag

SEQ ID NO: 1883582 - DNA, 14 bp, Homo sapiens
gcttaaggagagga

SEQ ID NO: 1883583 - DNA, 15 bp, Homo sapiens
gcttaaggagaggag

SEQ ID NO: 1883584 - DNA, 15 bp, Homo sapiens
gcttcagggctgggc

SEQ ID NO: 1883585 - DNA, 16 bp, Homo sapiens
gcttcagggctgggca

SEQ ID NO: 1883586 - DNA, 18 bp, Homo sapiens
gcttcagggctgggcagg

SEQ ID NO: 1883587 - DNA, 18 bp, Homo sapiens
gcttcagttgttctttag

SEQ ID NO: 1883588 - DNA, 15 bp, Homo sapiens
gcttcagttgttttc

SEQ ID NO: 1883589 - DNA, 15 bp, Homo sapiens
gcttccaaggtggtc

SEQ ID NO: 1883590 - DNA, 23 bp, Homo sapiens
gcttccattattgagttcctcct

SEQ ID NO: 1883591 - DNA, 19 bp, Homo sapiens
gcttcctggcaatagtcaa

SEQ ID NO: 1883592 - DNA, 13 bp, Homo sapiens
gcttctattaaat

SEQ ID NO: 1883593 - DNA, 23 bp, Homo sapiens
gcttctgcggtgaggcaggggag

SEQ ID NO: 1883594 - DNA, 12 bp, Homo sapiens
gcttctgctggg

SEQ ID NO: 1883595 - DNA, 15 bp, Homo sapiens
gcttgcctcggctcc

SEQ ID NO: 1883596 - DNA, 21 bp, Homo sapiens
gcttgctgatggctgctggag

SEQ ID NO: 1883597 - DNA, 17 bp, Homo sapiens
gctttctcctctgctat

SEQ ID NO: 1883598 - DNA, 24 bp, Homo sapiens
gctttttccttttcatctgttgtt

SEQ ID NO: 1883599 - DNA, 12 bp, Homo sapiens
ggaaatatttat

SEQ ID NO: 1883600 - DNA, 13 bp, Homo sapiens
ggaaatatttatt

SEQ ID NO: 1883601 - DNA, 17 bp, Homo sapiens
ggaaatatttattttaa

SEQ ID NO: 1883602 - DNA, 18 bp, Homo sapiens
ggaaatatttattttaat

SEQ ID NO: 1883603 - DNA, 19 bp, Homo sapiens
ggaagagcacagccctccc

SEQ ID NO: 1883604 - DNA, 18 bp, Homo sapiens
ggaagctgtagaggacca

SEQ ID NO: 1883605 - DNA, 19 bp, Homo sapiens
ggaagctgtagaggaccag

SEQ ID NO: 1883606 - DNA, 20 bp, Homo sapiens
ggaagctttcaccagccaca

SEQ ID NO: 1883607 - DNA, 12 bp, Homo sapiens
ggaaggaccaac

SEQ ID NO: 1883608 - DNA, 14 bp, Homo sapiens
ggaaggagagaggt

SEQ ID NO: 1883609 - DNA, 17 bp, Homo sapiens
ggaagggcatccttctg

SEQ ID NO: 1883610 - DNA, 19 bp, Homo sapiens
ggaaggtggcttaccaaga

SEQ ID NO: 1883611 - DNA, 22 bp, Homo sapiens
ggaattggagctcgtgggacag

SEQ ID NO: 1883612 - DNA, 12 bp, Homo sapiens
ggaatttgtaag

SEQ ID NO: 1883613 - DNA, 19 bp, Homo sapiens
ggacaacaaagaggacacc

SEQ ID NO: 1883614 - DNA, 14 bp, Homo sapiens
ggacagaagcagct

SEQ ID NO: 1883615 - DNA, 20 bp, Homo sapiens
ggaccaagcttaaggagagg

SEQ ID NO: 1883616 - DNA, 17 bp, Homo sapiens
ggaccatcagtgactca

SEQ ID NO: 1883617 - DNA, 16 bp, Homo sapiens
taataccaccatttaa

SEQ ID NO: 1883618 - DNA, 18 bp, Homo sapiens
taataccaccatttaaaa

SEQ ID NO: 1883619 - DNA, 22 bp, Homo sapiens
taataccaccatttaaaaatgt

SEQ ID NO: 1883620 - DNA, 12 bp, Homo sapiens
taatatattgct

SEQ ID NO: 1883621 - DNA, 16 bp, Homo sapiens
taatattcctcagttc

SEQ ID NO: 1883622 - DNA, 13 bp, Homo sapiens
taatctttcacag

SEQ ID NO: 1883623 - DNA, 15 bp, Homo sapiens
taatggttgtgaaat

SEQ ID NO: 1883624 - DNA, 16 bp, Homo sapiens
taatggttgtgaaatg

SEQ ID NO: 1883625 - DNA, 19 bp, Homo sapiens
taatggttgtgaaatgtaa

SEQ ID NO: 1883626 - DNA, 14 bp, Homo sapiens
taatgttaagcttt

SEQ ID NO: 1883627 - DNA, 20 bp, Homo sapiens
taatgttgtatgtcttgttt

SEQ ID NO: 1883628 - DNA, 22 bp, Homo sapiens
taattacgtttaaagtgcagtc

SEQ ID NO: 1883629 - DNA, 23 bp, Homo sapiens
taattacgtttaaagtgcagtca

SEQ ID NO: 1883630 - DNA, 23 bp, Homo sapiens
taattataccgctatcattccaa

SEQ ID NO: 1883631 - DNA, 23 bp, Homo sapiens
taatttgtagtgttggagaagaa

SEQ ID NO: 1883632 - DNA, 13 bp, Homo sapiens
taatttgtatctg

SEQ ID NO: 1883633 - DNA, 13 bp, Homo sapiens
taattttgtgaag

SEQ ID NO: 1883634 - DNA, 18 bp, Homo sapiens
taatttttatatttgaaa

SEQ ID NO: 1883635 - DNA, 21 bp, Homo sapiens
taatttttatatttgaaatat

SEQ ID NO: 1883636 - DNA, 17 bp, Homo sapiens
tacaaataaacagttgt

SEQ ID NO: 1883637 - DNA, 18 bp, Homo sapiens
tacaaataaacagttgtt

SEQ ID NO: 1883638 - DNA, 14 bp, Homo sapiens
tacacccttggact

SEQ ID NO: 1883639 - DNA, 21 bp, Homo sapiens
tacacctctgggccctgcagg

SEQ ID NO: 1883640 - DNA, 18 bp, Homo sapiens
tacactaagagagaatga

SEQ ID NO: 1883641 - DNA, 19 bp, Homo sapiens
tacactaagagagaatgag

SEQ ID NO: 1883642 - DNA, 22 bp, Homo sapiens
tacatagcagactttcccaaat

SEQ ID NO: 1883643 - DNA, 20 bp, Homo sapiens
tacatgctggttacctgttc

SEQ ID NO: 1883644 - DNA, 22 bp, Homo sapiens
tacatgctggttacctgttcca

SEQ ID NO: 1883645 - DNA, 18 bp, Homo sapiens
tacattgatacaaagtac

SEQ ID NO: 1883646 - DNA, 19 bp, Homo sapiens
tacattgatacaaagtaca

SEQ ID NO: 1883647 - DNA, 16 bp, Homo sapiens
tacatttgtataaaat

SEQ ID NO: 1883648 - DNA, 17 bp, Homo sapiens
tacatttgtataaaata

SEQ ID NO: 1883649 - DNA, 23 bp, Homo sapiens
taccacaggaaccacaagactgc

SEQ ID NO: 1883650 - DNA, 16 bp, Homo sapiens
taccaggtctcctcca

SEQ ID NO: 1883651 - DNA, 18 bp, Homo sapiens
taccaggtctcctccacc

SEQ ID NO: 1883652 - DNA, 22 bp, Homo sapiens
taccaggtgctagggtgcctgc

SEQ ID NO: 1883653 - DNA, 23 bp, Homo sapiens
tacccaaccagggccccggggcc

SEQ ID NO: 1883654 - DNA, 15 bp, Homo sapiens
tacccccctgagagc

SEQ ID NO: 1883655 - DNA, 20 bp, Homo sapiens
tacccctagtatctggctgg

SEQ ID NO: 1883656 - DNA, 10 bp, Homo sapiens
tacccctccc

SEQ ID NO: 1883657 - DNA, 13 bp, Homo sapiens
tacccctcccagc

SEQ ID NO: 1883658 - DNA, 15 bp, Homo sapiens
tacccctcccagctg

SEQ ID NO: 1883659 - DNA, 20 bp, Homo sapiens
taccctacacctctgggccc

SEQ ID NO: 1883660 - DNA, 14 bp, Homo sapiens
taccctccctgctg

SEQ ID NO: 1883661 - DNA, 18 bp, Homo sapiens
taccctccctgctgtccc

SEQ ID NO: 1883662 - DNA, 16 bp, Homo sapiens
tacctgtcatctgggc

SEQ ID NO: 1883663 - DNA, 16 bp, Homo sapiens
tacgtgtatgtttctt

SEQ ID NO: 1883664 - DNA, 17 bp, Homo sapiens
tacgtgtatgtttcttc

SEQ ID NO: 1883665 - DNA, 13 bp, Homo sapiens
tacgtttaaagtg

SEQ ID NO: 1883666 - DNA, 15 bp, Homo sapiens
tacgtttaaagtgca

SEQ ID NO: 1883667 - DNA, 22 bp, Homo sapiens
tactaaatggtgttacattaaa

SEQ ID NO: 1883668 - DNA, 16 bp, Homo sapiens
tactactgaatctcta

SEQ ID NO: 1883669 - DNA, 20 bp, Homo sapiens
tactcctcacttttcaattt

SEQ ID NO: 1883670 - DNA, 13 bp, Homo sapiens
tatatttgaaata

SEQ ID NO: 1883671 - DNA, 12 bp, Homo sapiens
tatatttgtaaa

SEQ ID NO: 1883672 - DNA, 21 bp, Homo sapiens
tatattttaagccttcatttg

SEQ ID NO: 1883673 - DNA, 19 bp, Homo sapiens
tatcaataaatagaccatt

SEQ ID NO: 1883674 - DNA, 13 bp, Homo sapiens
tatcagtgtgccc

SEQ ID NO: 1883675 - DNA, 19 bp, Homo sapiens
tatccaaaaatagccctgc

SEQ ID NO: 1883676 - DNA, 14 bp, Homo sapiens
tatccatttctttt

SEQ ID NO: 1883677 - DNA, 23 bp, Homo sapiens
tatccatttcttttactctgtgt

SEQ ID NO: 1883678 - DNA, 23 bp, Homo sapiens
tatctaaactggattcacagctc

SEQ ID NO: 1883679 - DNA, 21 bp, Homo sapiens
tatctgaaggagattttcctt

SEQ ID NO: 1883680 - DNA, 13 bp, Homo sapiens
tatctgaggtcac

SEQ ID NO: 1883681 - DNA, 23 bp, Homo sapiens
tatgaattacatttgtataaaat

SEQ ID NO: 1883682 - DNA, 20 bp, Homo sapiens
tatgattaagtaatgataac

SEQ ID NO: 1883683 - DNA, 21 bp, Homo sapiens
tatgattaagtaatgataact

SEQ ID NO: 1883684 - DNA, 11 bp, Homo sapiens
tatgcattttc

SEQ ID NO: 1883685 - DNA, 15 bp, Homo sapiens
tatgcattttcttca

SEQ ID NO: 1883686 - DNA, 16 bp, Homo sapiens
tatgcattttcttcac

SEQ ID NO: 1883687 - DNA, 15 bp, Homo sapiens
tatgcttctgtttta

SEQ ID NO: 1883688 - DNA, 16 bp, Homo sapiens
tatgcttctgttttat

SEQ ID NO: 1883689 - DNA, 15 bp, Homo sapiens
tatggcagggaagct

SEQ ID NO: 1883690 - DNA, 12 bp, Homo sapiens
tatgtttcttct

SEQ ID NO: 1883691 - DNA, 21 bp, Homo sapiens
tatgttttcaggctagatgta

SEQ ID NO: 1883692 - DNA, 19 bp, Homo sapiens
tattaataaacattctatc

SEQ ID NO: 1883693 - DNA, 14 bp, Homo sapiens
tattactctacact

SEQ ID NO: 1883694 - DNA, 14 bp, Homo sapiens
tattactgtaagaa

SEQ ID NO: 1883695 - DNA, 21 bp, Homo sapiens
tattattactctacactgaaa

SEQ ID NO: 1883696 - DNA, 12 bp, Homo sapiens
tattcagagtta

SEQ ID NO: 1883697 - DNA, 21 bp, Homo sapiens
tattcatattttctttcaaaa

SEQ ID NO: 1883698 - DNA, 12 bp, Homo sapiens
tattgattacaa

SEQ ID NO: 1883699 - DNA, 12 bp, Homo sapiens
tattgggaagct

SEQ ID NO: 1883700 - DNA, 14 bp, Homo sapiens
tattgtaaaacatt

SEQ ID NO: 1883701 - DNA, 16 bp, Homo sapiens
tattgtaaaacattca

SEQ ID NO: 1883702 - DNA, 22 bp, Homo sapiens
tattgtgatttcccgtggcccc

SEQ ID NO: 1883703 - DNA, 23 bp, Homo sapiens
tatttaaaagtataaaactgctt

SEQ ID NO: 1883704 - DNA, 21 bp, Homo sapiens
tatttaactgccttgtgtaca

SEQ ID NO: 1883705 - DNA, 21 bp, Homo sapiens
tatttaacttgagggtaataa

SEQ ID NO: 1883706 - DNA, 18 bp, Homo sapiens
tatttagtaaagtttgtt

SEQ ID NO: 1883707 - DNA, 14 bp, Homo sapiens
tatttctatgaaat

SEQ ID NO: 1883708 - DNA, 21 bp, Homo sapiens
tatttgctggagtgctggctc

SEQ ID NO: 1883709 - DNA, 22 bp, Homo sapiens
tattttaggcagggatttgagg

SEQ ID NO: 1883710 - DNA, 21 bp, Homo sapiens
tatttttaatatatactatga

SEQ ID NO: 1883711 - DNA, 18 bp, Homo sapiens
tatttttacattctgaat

SEQ ID NO: 1883712 - DNA, 17 bp, Homo sapiens
tatttttcttgctgttc

SEQ ID NO: 1883713 - DNA, 19 bp, Homo sapiens
tatttttttaagctgtaaa

SEQ ID NO: 1883714 - DNA, 17 bp, Homo sapiens
tcaaaagattgttttat

SEQ ID NO: 1883715 - DNA, 24 bp, Homo sapiens
tcaaaattagtgctttttgtgtca

SEQ ID NO: 1883716 - DNA, 22 bp, Homo sapiens
tcaaacagtacactatcttaat

SEQ ID NO: 1883717 - DNA, 16 bp, Homo sapiens
tcaaatccttgaagat

SEQ ID NO: 1883718 - DNA, 18 bp, Homo sapiens
tcaaattgtgtgaaaggt

SEQ ID NO: 1883719 - DNA, 18 bp, Homo sapiens
ttactctacactgaaacg

SEQ ID NO: 1883720 - DNA, 17 bp, Homo sapiens
ttactctgtgtaaagac

SEQ ID NO: 1883721 - DNA, 18 bp, Homo sapiens
ttactctgtgtaaagact

SEQ ID NO: 1883722 - DNA, 14 bp, Homo sapiens
ttagaatcttgttt

SEQ ID NO: 1883723 - DNA, 20 bp, Homo sapiens
ttagatgcagttctgaagaa

SEQ ID NO: 1883724 - DNA, 19 bp, Homo sapiens
ttagcttcagttgttcttt

SEQ ID NO: 1883725 - DNA, 19 bp, Homo sapiens
ttaggcagggatttgagga

SEQ ID NO: 1883726 - DNA, 18 bp, Homo sapiens
ttaggcctggcacagtgt

SEQ ID NO: 1883727 - DNA, 12 bp, Homo sapiens
ttaggtttgttt

SEQ ID NO: 1883728 - DNA, 14 bp, Homo sapiens
ttataattttgtga

SEQ ID NO: 1883729 - DNA, 15 bp, Homo sapiens
ttataattttgtgaa

SEQ ID NO: 1883730 - DNA, 13 bp, Homo sapiens
ttatattccactt

SEQ ID NO: 1883731 - DNA, 14 bp, Homo sapiens
ttatgaattacatt

SEQ ID NO: 1883732 - DNA, 17 bp, Homo sapiens
ttatgaattacatttgt

SEQ ID NO: 1883733 - DNA, 18 bp, Homo sapiens
ttattactgtaagaaaat

SEQ ID NO: 1883734 - DNA, 19 bp, Homo sapiens
ttatttagtaaagtttgtt

SEQ ID NO: 1883735 - DNA, 14 bp, Homo sapiens
ttatttgtacagtt

SEQ ID NO: 1883736 - DNA, 15 bp, Homo sapiens
ttatttgttttcccg

SEQ ID NO: 1883737 - DNA, 16 bp, Homo sapiens
ttattttaataatgtt

SEQ ID NO: 1883738 - DNA, 17 bp, Homo sapiens
ttattttaataatgttt

SEQ ID NO: 1883739 - DNA, 20 bp, Homo sapiens
ttattttaataatgtttcaa

SEQ ID NO: 1883740 - DNA, 13 bp, Homo sapiens
ggggctcaggata

SEQ ID NO: 1883741 - DNA, 19 bp, Homo sapiens
ggggctgggttggcgcacc

SEQ ID NO: 1883742 - DNA, 17 bp, Homo sapiens
gggggaagagcacagcc

SEQ ID NO: 1883743 - DNA, 17 bp, Homo sapiens
gggggaaggccttgctg

SEQ ID NO: 1883744 - DNA, 13 bp, Homo sapiens
gggggaggctctg

SEQ ID NO: 1883745 - DNA, 20 bp, Homo sapiens
gggggcaaggtgggggagcc

SEQ ID NO: 1883746 - DNA, 12 bp, Homo sapiens
ggggtctccctg

SEQ ID NO: 1883747 - DNA, 20 bp, Homo sapiens
ggggtctccctgagcctgcc

SEQ ID NO: 1883748 - DNA, 17 bp, Homo sapiens
gggtcccacttcccctc

SEQ ID NO: 1883749 - DNA, 13 bp, Homo sapiens
gggtctccctgag

SEQ ID NO: 1883750 - DNA, 17 bp, Homo sapiens
gggtctccctgagcctg

SEQ ID NO: 1883751 - DNA, 19 bp, Homo sapiens
gggtgcgaccccatctgcc

SEQ ID NO: 1883752 - DNA, 20 bp, Homo sapiens
gggtggacgagggagtgtct

SEQ ID NO: 1883753 - DNA, 19 bp, Homo sapiens
gggtggcccatcccccctc

SEQ ID NO: 1883754 - DNA, 13 bp, Homo sapiens
ggtaaataaagct

SEQ ID NO: 1883755 - DNA, 14 bp, Homo sapiens
ggtagctctgagcc

SEQ ID NO: 1883756 - DNA, 17 bp, Homo sapiens
ggtagctctgagccctc

SEQ ID NO: 1883757 - DNA, 15 bp, Homo sapiens
ggtaggtgctggcct

SEQ ID NO: 1883758 - DNA, 16 bp, Homo sapiens
ggtaggtgctggcctc

SEQ ID NO: 1883759 - DNA, 13 bp, Homo sapiens
ggtcagtgccttt

SEQ ID NO: 1883760 - DNA, 18 bp, Homo sapiens
ggtcatcccccactgtaa

SEQ ID NO: 1883761 - DNA, 14 bp, Homo sapiens
ggtcctacggaggg

SEQ ID NO: 1883762 - DNA, 19 bp, Homo sapiens
ggtcctacggagggaccag

SEQ ID NO: 1883763 - DNA, 14 bp, Homo sapiens
ggtcctaggagagg

SEQ ID NO: 1883764 - DNA, 20 bp, Homo sapiens
ggtctccctgagcctgcccc

SEQ ID NO: 1883765 - DNA, 14 bp, Homo sapiens
ggtctcctccaccg

SEQ ID NO: 1883766 - DNA, 21 bp, Homo sapiens
ggtctcgctgatgctgggctg

SEQ ID NO: 1883767 - DNA, 23 bp, Homo sapiens
ggtctcgctgatgctgggctggg

SEQ ID NO: 1883768 - DNA, 16 bp, Homo sapiens
ggtctgctcgggccca

SEQ ID NO: 1883769 - DNA, 18 bp, Homo sapiens
ggtctgctcgggcccagg

SEQ ID NO: 1883770 - DNA, 22 bp, Homo sapiens
ggtctgctcgggcccaggccat

SEQ ID NO: 1883771 - DNA, 17 bp, Homo sapiens
ggtgacatgtgcctgta

SEQ ID NO: 1883772 - DNA, 19 bp, Homo sapiens
ggtgaccccatctctgctg

SEQ ID NO: 1883773 - DNA, 23 bp, Homo sapiens
ggtgcaaaaactcttatggccaa

SEQ ID NO: 1883774 - DNA, 16 bp, Homo sapiens
ggtgccacggtggact

SEQ ID NO: 1883775 - DNA, 21 bp, Homo sapiens
ggtgcctgattcggctgtctc

SEQ ID NO: 1883776 - DNA, 15 bp, Homo sapiens
ggtgcctgctctcct

SEQ ID NO: 1883777 - DNA, 23 bp, Homo sapiens
ggtgcctgctctccttgccctgg

SEQ ID NO: 1883778 - DNA, 21 bp, Homo sapiens
ggtgcgaccccatctgcccag

SEQ ID NO: 1883779 - DNA, 19 bp, Homo sapiens
ggtgcggtaggtgctggcc

SEQ ID NO: 1883780 - DNA, 20 bp, Homo sapiens
ggtgcggtaggtgctggcct

SEQ ID NO: 1883781 - DNA, 15 bp, Homo sapiens
ggtgctagggtgcct

SEQ ID NO: 1883782 - DNA, 16 bp, Homo sapiens
ggtgctagggtgcctg

SEQ ID NO: 1883783 - DNA, 18 bp, Homo sapiens
ggtgctagggtgcctgct

SEQ ID NO: 1883784 - DNA, 20 bp, Homo sapiens
ggtgctagggtgcctgctct

SEQ ID NO: 1883785 - DNA, 20 bp, Homo sapiens
ggtgctgctaccctccctgc

SEQ ID NO: 1883786 - DNA, 23 bp, Homo sapiens
ggtgctgctaccctccctgctgt

SEQ ID NO: 1883787 - DNA, 13 bp, Homo sapiens
ggtgcttgggctt

SEQ ID NO: 1883788 - DNA, 15 bp, Homo sapiens
ggtggacgagggagt

SEQ ID NO: 1883789 - DNA, 22 bp, Homo sapiens
ggtggacttagctctgaggagt

SEQ ID NO: 1883790 - DNA, 16 bp, Homo sapiens
ggtggcagagtgagac

SEQ ID NO: 1883791 - DNA, 22 bp, Homo sapiens
ggtggcccatcccccctcacca

SEQ ID NO: 1883792 - DNA, 18 bp, Homo sapiens
ggtggtagctctgagccc

SEQ ID NO: 1883793 - DNA, 14 bp, Homo sapiens
ggtggtctgctcgg

SEQ ID NO: 1883794 - DNA, 12 bp, Homo sapiens
ggtgtgccctgg

SEQ ID NO: 1883795 - DNA, 13 bp, Homo sapiens
ggtgtgccctggc

SEQ ID NO: 1883796 - DNA, 21 bp, Homo sapiens
gtgggacagtcacctcatgga

SEQ ID NO: 1883797 - DNA, 19 bp, Homo sapiens
gtgggcgggcagcacagca

SEQ ID NO: 1883798 - DNA, 20 bp, Homo sapiens
gtgggctgcactctgtgccc

SEQ ID NO: 1883799 - DNA, 18 bp, Homo sapiens
gtggggctaggggctggg

SEQ ID NO: 1883800 - DNA, 19 bp, Homo sapiens
gtgggggaagagcacagcc

SEQ ID NO: 1883801 - DNA, 21 bp, Homo sapiens
gtgggggaagagcacagccct

SEQ ID NO: 1883802 - DNA, 12 bp, Homo sapiens
gtgggggagcct

SEQ ID NO: 1883803 - DNA, 13 bp, Homo sapiens
gtggggtctcagt

SEQ ID NO: 1883804 - DNA, 15 bp, Homo sapiens
gtggtagctctgagc

SEQ ID NO: 1883805 - DNA, 19 bp, Homo sapiens
gtggtagctctgagccctc

SEQ ID NO: 1883806 - DNA, 19 bp, Homo sapiens
gtggtctgctcgggcccag

SEQ ID NO: 1883807 - DNA, 15 bp, Homo sapiens
gtggtgcagccccag

SEQ ID NO: 1883808 - DNA, 21 bp, Homo sapiens
gtgtaagtagataggccatgg

SEQ ID NO: 1883809 - DNA, 17 bp, Homo sapiens
gtgtcactggctgcctc

SEQ ID NO: 1883810 - DNA, 23 bp, Homo sapiens
gtgtcactggctgcctccactcc

SEQ ID NO: 1883811 - DNA, 21 bp, Homo sapiens
gtgtcggggggcgagggaggg

SEQ ID NO: 1883812 - DNA, 22 bp, Homo sapiens
gtgtgccccccatcctggccca

SEQ ID NO: 1883813 - DNA, 15 bp, Homo sapiens
gtgtgccctggctcc

SEQ ID NO: 1883814 - DNA, 16 bp, Homo sapiens
gtgtgccctggctccc

SEQ ID NO: 1883815 - DNA, 13 bp, Homo sapiens
gtgtgggagggcg

SEQ ID NO: 1883816 - DNA, 12 bp, Homo sapiens
gtgtggtccctc

SEQ ID NO: 1883817 - DNA, 19 bp, Homo sapiens
gtgttaggcctggcacagt

SEQ ID NO: 1883818 - DNA, 14 bp, Homo sapiens
gtgttcctccattt

SEQ ID NO: 1883819 - DNA, 14 bp, Homo sapiens
gtgttctattaatc

SEQ ID NO: 1883820 - DNA, 11 bp, Homo sapiens
gtgttgacact

SEQ ID NO: 1883821 - DNA, 20 bp, Homo sapiens
gtgttgacactgttttcctt

SEQ ID NO: 1883822 - DNA, 23 bp, Homo sapiens
gtgttgcctgctgagctgtgccc

SEQ ID NO: 1883823 - DNA, 22 bp, Homo sapiens
gtgtttatcctatctctccaac

SEQ ID NO: 1883824 - DNA, 11 bp, Homo sapiens
gttaagaaata

SEQ ID NO: 1883825 - DNA, 12 bp, Homo sapiens
gttaagaaatac

SEQ ID NO: 1883826 - DNA, 13 bp, Homo sapiens
gttaagaaatacc

SEQ ID NO: 1883827 - DNA, 22 bp, Homo sapiens
gttaagccatttaactggagct

SEQ ID NO: 1883828 - DNA, 16 bp, Homo sapiens
gttacctgttccattg

SEQ ID NO: 1883829 - DNA, 18 bp, Homo sapiens
gttagaatcttgttttgt

SEQ ID NO: 1883830 - DNA, 19 bp, Homo sapiens
gttagaatcttgttttgtt

SEQ ID NO: 1883831 - DNA, 23 bp, Homo sapiens
gttagcagcagtgagcttctatt

SEQ ID NO: 1883832 - DNA, 16 bp, Homo sapiens
gttaggcctggcacag

SEQ ID NO: 1883833 - DNA, 16 bp, Homo sapiens
gttcacttaaattctt

SEQ ID NO: 1883834 - DNA, 17 bp, Homo sapiens
gttcacttaaattcttt

SEQ ID NO: 1883835 - DNA, 16 bp, Homo sapiens
gttcattgcctttcca

SEQ ID NO: 1883836 - DNA, 17 bp, Homo sapiens
gttcccctttgcttcat

SEQ ID NO: 1883837 - DNA, 15 bp, Homo sapiens
gttcccttctgccac

SEQ ID NO: 1883838 - DNA, 13 bp, Homo sapiens
gttcctctttgca

SEQ ID NO: 1883839 - DNA, 14 bp, Homo sapiens
gttctgaagaagat

SEQ ID NO: 1883840 - DNA, 19 bp, Homo sapiens
gttcttctaccacccacca

SEQ ID NO: 1883841 - DNA, 19 bp, Homo sapiens
gttctttagaggctttcaa

SEQ ID NO: 1883842 - DNA, 15 bp, Homo sapiens
gttcttttttcagtt

SEQ ID NO: 1883843 - DNA, 14 bp, Homo sapiens
gttgaactgcagga

SEQ ID NO: 1883844 - DNA, 14 bp, Homo sapiens
gttgacactgtttt

SEQ ID NO: 1883845 - DNA, 18 bp, Homo sapiens
gttgacactgttttcctt

SEQ ID NO: 1883846 - DNA, 21 bp, Homo sapiens
gttgatggtggtatgttttca

SEQ ID NO: 1883847 - DNA, 15 bp, Homo sapiens
gttgccgggcctgga

SEQ ID NO: 1883848 - DNA, 16 bp, Homo sapiens
gttgccgggcctggac

SEQ ID NO: 1883849 - DNA, 20 bp, Homo sapiens
gttggagtccagcctaatca

SEQ ID NO: 1883850 - DNA, 21 bp, Homo sapiens
gttggcgcaccctcccctccc

SEQ ID NO: 1883851 - DNA, 22 bp, Homo sapiens
gttggctgggggcatgggggag

SEQ ID NO: 1883852 - DNA, 17 bp, Homo sapiens
gttggcttgctgatggc

SEQ ID NO: 1883853 - DNA, 21 bp, Homo sapiens
acagtggccaagatcacagtg

SEQ ID NO: 1883854 - DNA, 21 bp, Homo sapiens
acagtgtctgggctgactggg

SEQ ID NO: 1883855 - DNA, 22 bp, Homo sapiens
acagtgttaggcctggcacagt

SEQ ID NO: 1883856 - DNA, 23 bp, Homo sapiens
acagtgttaggcctggcacagtg

SEQ ID NO: 1883857 - DNA, 15 bp, Homo sapiens
acagtgttctgagcc

SEQ ID NO: 1883858 - DNA, 16 bp, Homo sapiens
acagttcagttcctct

SEQ ID NO: 1883859 - DNA, 21 bp, Homo sapiens
acagttcagttcctctttgca

SEQ ID NO: 1883860 - DNA, 18 bp, Homo sapiens
acataatggttgtgaaat

SEQ ID NO: 1883861 - DNA, 20 bp, Homo sapiens
acataatggttgtgaaatgt

SEQ ID NO: 1883862 - DNA, 16 bp, Homo sapiens
acatctagcagtaaat

SEQ ID NO: 1883863 - DNA, 20 bp, Homo sapiens
acatctttgtttttaaaata

SEQ ID NO: 1883864 - DNA, 11 bp, Homo sapiens
acatgaagcat

SEQ ID NO: 1883865 - DNA, 22 bp, Homo sapiens
acatgagaaaatcagtaattgg

SEQ ID NO: 1883866 - DNA, 22 bp, Homo sapiens
acattaaagaagggttgagctg

SEQ ID NO: 1883867 - DNA, 17 bp, Homo sapiens
acattgatacaaagtac

SEQ ID NO: 1883868 - DNA, 23 bp, Homo sapiens
acattgatacaaagtacagaaaa

SEQ ID NO: 1883869 - DNA, 11 bp, Homo sapiens
acatttaacat

SEQ ID NO: 1883870 - DNA, 13 bp, Homo sapiens
acatttaacataa

SEQ ID NO: 1883871 - DNA, 16 bp, Homo sapiens
acatttaacataatgg

SEQ ID NO: 1883872 - DNA, 21 bp, Homo sapiens
acatttgtataaaataatttt

SEQ ID NO: 1883873 - DNA, 13 bp, Homo sapiens
acattttgaagtg

SEQ ID NO: 1883874 - DNA, 12 bp, Homo sapiens
accaacccagcc

SEQ ID NO: 1883875 - DNA, 13 bp, Homo sapiens
accaacccagccg

SEQ ID NO: 1883876 - DNA, 14 bp, Homo sapiens
accaacccagccgc

SEQ ID NO: 1883877 - DNA, 15 bp, Homo sapiens
accaacccagccgct

SEQ ID NO: 1883878 - DNA, 16 bp, Homo sapiens
accaacccagccgctg

SEQ ID NO: 1883879 - DNA, 18 bp, Homo sapiens
accaacccatgccctgcc

SEQ ID NO: 1883880 - DNA, 21 bp, Homo sapiens
accaagatcacataccagagt

SEQ ID NO: 1883881 - DNA, 14 bp, Homo sapiens
accaagctgctgtg

SEQ ID NO: 1883882 - DNA, 20 bp, Homo sapiens
accaagctgtgccaccctgg

SEQ ID NO: 1883883 - DNA, 12 bp, Homo sapiens
accaatacagaa

SEQ ID NO: 1883884 - DNA, 10 bp, Homo sapiens
accacagcaa

SEQ ID NO: 1883885 - DNA, 20 bp, Homo sapiens
accaggggcaggcacagcac

SEQ ID NO: 1883886 - DNA, 22 bp, Homo sapiens
accaggtgctagggtgcctgct

SEQ ID NO: 1883887 - DNA, 14 bp, Homo sapiens
accagtctgactgt

SEQ ID NO: 1883888 - DNA, 23 bp, Homo sapiens
accagttgaactgcaggaagaga

SEQ ID NO: 1883889 - DNA, 19 bp, Homo sapiens
accatgaagagatttttca

SEQ ID NO: 1883890 - DNA, 24 bp, Homo sapiens
accatgaagagatttttcatgatt

SEQ ID NO: 1883891 - DNA, 18 bp, Homo sapiens
accattgtctcagagcag

SEQ ID NO: 1883892 - DNA, 13 bp, Homo sapiens
accatttaaaaat

SEQ ID NO: 1883893 - DNA, 16 bp, Homo sapiens
acccaccagttgaatt

SEQ ID NO: 1883894 - DNA, 13 bp, Homo sapiens
acccagccgctgc

SEQ ID NO: 1883895 - DNA, 14 bp, Homo sapiens
acccagccgctgcc

SEQ ID NO: 1883896 - DNA, 17 bp, Homo sapiens
acccatacctttccagg

SEQ ID NO: 1883897 - DNA, 14 bp, Homo sapiens
acccatgccctgcc

SEQ ID NO: 1883898 - DNA, 20 bp, Homo sapiens
acccatgtcaccggtcagtg

SEQ ID NO: 1883899 - DNA, 14 bp, Homo sapiens
accccatctgccca

SEQ ID NO: 1883900 - DNA, 13 bp, Homo sapiens
acccccgcccagg

SEQ ID NO: 1883901 - DNA, 15 bp, Homo sapiens
acccccgcccaggct

SEQ ID NO: 1883902 - DNA, 20 bp, Homo sapiens
acccccgcccaggctggcca

SEQ ID NO: 1883903 - DNA, 23 bp, Homo sapiens
acccccgcccaggctggccagcc

SEQ ID NO: 1883904 - DNA, 13 bp, Homo sapiens
accccctcctgct

SEQ ID NO: 1883905 - DNA, 13 bp, Homo sapiens
acccctcccagct

SEQ ID NO: 1883906 - DNA, 14 bp, Homo sapiens
acccctcccagctg

SEQ ID NO: 1883907 - DNA, 22 bp, Homo sapiens
acccctcccagctgacagtcct

SEQ ID NO: 1883908 - DNA, 19 bp, Homo sapiens
acccctcccctccatccct

SEQ ID NO: 1883909 - DNA, 21 bp, Homo sapiens
acccctgttaagcaattcctt

SEQ ID NO: 1883910 - DNA, 17 bp, Homo sapiens
accccttttcagcttct

SEQ ID NO: 1883911 - DNA, 19 bp, Homo sapiens
accccttttcagcttctgc

SEQ ID NO: 1883912 - DNA, 13 bp, Homo sapiens
acccgggctcagg

SEQ ID NO: 1883913 - DNA, 17 bp, Homo sapiens
accctacacctctgggc

SEQ ID NO: 1883914 - DNA, 23 bp, Homo sapiens
accctacacctctgggccctgca

SEQ ID NO: 1883915 - DNA, 12 bp, Homo sapiens
accctcccctcc

SEQ ID NO: 1883916 - DNA, 11 bp, Homo sapiens
accctccctgc

SEQ ID NO: 1883917 - DNA, 18 bp, Homo sapiens
accctcgaggcggatctt

SEQ ID NO: 1883918 - DNA, 18 bp, Homo sapiens
accctgggctctgtgggc

SEQ ID NO: 1883919 - DNA, 19 bp, Homo sapiens
accctgggctctgtgggct

SEQ ID NO: 1883920 - DNA, 12 bp, Homo sapiens
accctgtttctg

SEQ ID NO: 1883921 - DNA, 14 bp, Homo sapiens
accggtcagtgcct

SEQ ID NO: 1883922 - DNA, 21 bp, Homo sapiens
acctagggtgatattaaccag

SEQ ID NO: 1883923 - DNA, 16 bp, Homo sapiens
acctagtggctgtcca

SEQ ID NO: 1883924 - DNA, 19 bp, Homo sapiens
acctcaagtgcaaggacca

SEQ ID NO: 1883925 - DNA, 12 bp, Homo sapiens
acctctgaggac

SEQ ID NO: 1883926 - DNA, 18 bp, Homo sapiens
acctctgcctcagaaaac

SEQ ID NO: 1883927 - DNA, 20 bp, Homo sapiens
acctctgcctcagaaaacaa

SEQ ID NO: 1883928 - DNA, 14 bp, Homo sapiens
acctctgggccctg

SEQ ID NO: 1883929 - DNA, 16 bp, Homo sapiens
acctctgggccctgca

SEQ ID NO: 1883930 - DNA, 18 bp, Homo sapiens
acctctgggccctgcagg

SEQ ID NO: 1883931 - DNA, 19 bp, Homo sapiens
acctctgggccctgcagga

SEQ ID NO: 1883932 - DNA, 13 bp, Homo sapiens
acctgcaggttgg

SEQ ID NO: 1883933 - DNA, 17 bp, Homo sapiens
acctgcaggttgggcca

SEQ ID NO: 1883934 - DNA, 16 bp, Homo sapiens
acctgggctgggagaa

SEQ ID NO: 1883935 - DNA, 22 bp, Homo sapiens
acctggggtgggggccaagtca

SEQ ID NO: 1883936 - DNA, 15 bp, Homo sapiens
acctgtcatctgggc

SEQ ID NO: 1883937 - DNA, 16 bp, Homo sapiens
acctgtcatctgggcc

SEQ ID NO: 1883938 - DNA, 19 bp, Homo sapiens
accttgctttgatggaata

SEQ ID NO: 1883939 - DNA, 17 bp, Homo sapiens
acctttcagctgtgaac

SEQ ID NO: 1883940 - DNA, 21 bp, Homo sapiens
acctttccagggtcaaagtac

SEQ ID NO: 1883941 - DNA, 22 bp, Homo sapiens
acgaggtggtagctctgagccc

SEQ ID NO: 1883942 - DNA, 22 bp, Homo sapiens
acgccctggggagtgagcttgg

SEQ ID NO: 1883943 - DNA, 17 bp, Homo sapiens
acggagggaccaggtgt

SEQ ID NO: 1883944 - DNA, 17 bp, Homo sapiens
acggatggaaggagaga

SEQ ID NO: 1883945 - DNA, 17 bp, Homo sapiens
acggccacggccacagt

SEQ ID NO: 1883946 - DNA, 18 bp, Homo sapiens
acggggccggccaggtgg

SEQ ID NO: 1883947 - DNA, 20 bp, Homo sapiens
acgtactgcagcctccagag

SEQ ID NO: 1883948 - DNA, 17 bp, Homo sapiens
acgtgggagaggcagaa

SEQ ID NO: 1883949 - DNA, 18 bp, Homo sapiens
acgtgggagaggcagaaa

SEQ ID NO: 1883950 - DNA, 14 bp, Homo sapiens
acgtgtatgtttct

SEQ ID NO: 1883951 - DNA, 16 bp, Homo sapiens
acgtgtatgtttcttc

SEQ ID NO: 1883952 - DNA, 19 bp, Homo sapiens
actaaatggtgttacatta

SEQ ID NO: 1883953 - DNA, 16 bp, Homo sapiens
actaagagagaatgag

SEQ ID NO: 1883954 - DNA, 18 bp, Homo sapiens
actaagaggctatttaaa

SEQ ID NO: 1883955 - DNA, 20 bp, Homo sapiens
actagtatttctatgaaata

SEQ ID NO: 1883956 - DNA, 13 bp, Homo sapiens
actagtctgtgta

SEQ ID NO: 1883957 - DNA, 15 bp, Homo sapiens
actatctcatttcca

SEQ ID NO: 1883958 - DNA, 14 bp, Homo sapiens
actatttaacttga

SEQ ID NO: 1883959 - DNA, 17 bp, Homo sapiens
actcaccagcctctgct

SEQ ID NO: 1883960 - DNA, 15 bp, Homo sapiens
actcactttctagat

SEQ ID NO: 1883961 - DNA, 14 bp, Homo sapiens
actcagtgttgact

SEQ ID NO: 1883962 - DNA, 21 bp, Homo sapiens
actccaaactgactcttaaga

SEQ ID NO: 1883963 - DNA, 16 bp, Homo sapiens
actcccacttccctga

SEQ ID NO: 1883964 - DNA, 16 bp, Homo sapiens
actcctaggaaaatac

SEQ ID NO: 1883965 - DNA, 16 bp, Homo sapiens
actcctcttatttgct

SEQ ID NO: 1883966 - DNA, 18 bp, Homo sapiens
actcgggctcctgtgccc

SEQ ID NO: 1883967 - DNA, 19 bp, Homo sapiens
actcgggttaagaaatacc

SEQ ID NO: 1883968 - DNA, 14 bp, Homo sapiens
actcgttaatttgt

SEQ ID NO: 1883969 - DNA, 24 bp, Homo sapiens
actctgtgcccatgggcactgctg

SEQ ID NO: 1883970 - DNA, 11 bp, Homo sapiens
actctgtgctg

SEQ ID NO: 1883971 - DNA, 18 bp, Homo sapiens
actgaaacgtattcagag

SEQ ID NO: 1883972 - DNA, 23 bp, Homo sapiens
atgcccgctgtcccaggggtctc

SEQ ID NO: 1883973 - DNA, 17 bp, Homo sapiens
atgcctcactttcttct

SEQ ID NO: 1883974 - DNA, 18 bp, Homo sapiens
atgcctcactttcttcta

SEQ ID NO: 1883975 - DNA, 20 bp, Homo sapiens
atgccttttcccaactccag

SEQ ID NO: 1883976 - DNA, 14 bp, Homo sapiens
atgctgggctgggt

SEQ ID NO: 1883977 - DNA, 16 bp, Homo sapiens
atgctggttacctgtt

SEQ ID NO: 1883978 - DNA, 19 bp, Homo sapiens
atgctgtattttaaaagaa

SEQ ID NO: 1883979 - DNA, 23 bp, Homo sapiens
atgctgtattttaaaagaatgat

SEQ ID NO: 1883980 - DNA, 14 bp, Homo sapiens
atggaaggagagag

SEQ ID NO: 1883981 - DNA, 18 bp, Homo sapiens
atggacgacctccagctc

SEQ ID NO: 1883982 - DNA, 20 bp, Homo sapiens
atggagaaacaggcccagag

SEQ ID NO: 1883983 - DNA, 14 bp, Homo sapiens
atggcagggaagct

SEQ ID NO: 1883984 - DNA, 22 bp, Homo sapiens
atgggacatttgctcatggaat

SEQ ID NO: 1883985 - DNA, 18 bp, Homo sapiens
atgggcactgctgggtgg

SEQ ID NO: 1883986 - DNA, 16 bp, Homo sapiens
atgggtgctatcagag

SEQ ID NO: 1883987 - DNA, 18 bp, Homo sapiens
atggtcacccccactctg

SEQ ID NO: 1883988 - DNA, 17 bp, Homo sapiens
atggttgtgaaatgtaa

SEQ ID NO: 1883989 - DNA, 21 bp, Homo sapiens
atggttgtgaaatgtaacatg

SEQ ID NO: 1883990 - DNA, 16 bp, Homo sapiens
atgtaacagttgtgtc

SEQ ID NO: 1883991 - DNA, 12 bp, Homo sapiens
atgtaacatgaa

SEQ ID NO: 1883992 - DNA, 16 bp, Homo sapiens
atgtaagctgaaaata

SEQ ID NO: 1883993 - DNA, 22 bp, Homo sapiens
atgtaataaggttgaacacttt

SEQ ID NO: 1883994 - DNA, 16 bp, Homo sapiens
atgtacttcatgctgt

SEQ ID NO: 1883995 - DNA, 22 bp, Homo sapiens
atgtaggaaagaccatttttcc

SEQ ID NO: 1883996 - DNA, 20 bp, Homo sapiens
atgtatatgtcatttatttt

SEQ ID NO: 1883997 - DNA, 12 bp, Homo sapiens
atgtattaatct

SEQ ID NO: 1883998 - DNA, 16 bp, Homo sapiens
atgtattaatctgttt

SEQ ID NO: 1883999 - DNA, 24 bp, Homo sapiens
atgtattcagctttagtagatatt

SEQ ID NO: 1884000 - DNA, 22 bp, Homo sapiens
atgtattgattacaaataaaca

SEQ ID NO: 1884001 - DNA, 17 bp, Homo sapiens
atgtcagtgtttgggaa

SEQ ID NO: 1884002 - DNA, 21 bp, Homo sapiens
atgtcatgcctcactttcttc

SEQ ID NO: 1884003 - DNA, 23 bp, Homo sapiens
atgtcatgcctcactttcttcta

SEQ ID NO: 1884004 - DNA, 21 bp, Homo sapiens
atgtcatgtgtacaaaagttt

SEQ ID NO: 1884005 - DNA, 13 bp, Homo sapiens
atgtctaaagagc

SEQ ID NO: 1884006 - DNA, 20 bp, Homo sapiens
atgtcttcatcacttcttcc

SEQ ID NO: 1884007 - DNA, 23 bp, Homo sapiens
atgtcttcatcacttcttccact

SEQ ID NO: 1884008 - DNA, 20 bp, Homo sapiens
atgtgctagtaattggaaag

SEQ ID NO: 1884009 - DNA, 14 bp, Homo sapiens
atgtgggggaaggc

SEQ ID NO: 1884010 - DNA, 18 bp, Homo sapiens
atgtgttcctccattttc

SEQ ID NO: 1884011 - DNA, 15 bp, Homo sapiens
atgttgacatgggac

SEQ ID NO: 1884012 - DNA, 15 bp, Homo sapiens
atgttttcaggctag

SEQ ID NO: 1884013 - DNA, 20 bp, Homo sapiens
attaaagaagggttgagctg

SEQ ID NO: 1884014 - DNA, 22 bp, Homo sapiens
attaaagccctgtgttaagtgt

SEQ ID NO: 1884015 - DNA, 21 bp, Homo sapiens
attaaatgtatatgtcattta

SEQ ID NO: 1884016 - DNA, 21 bp, Homo sapiens
attaagtaatgataactggaa

SEQ ID NO: 1884017 - DNA, 16 bp, Homo sapiens
attaatcgtgtcttca

SEQ ID NO: 1884018 - DNA, 21 bp, Homo sapiens
attaatcgtgtcttcaattaa

SEQ ID NO: 1884019 - DNA, 16 bp, Homo sapiens
attacaaataaacagt

SEQ ID NO: 1884020 - DNA, 18 bp, Homo sapiens
attacacaataaagcagt

SEQ ID NO: 1884021 - DNA, 13 bp, Homo sapiens
attacatttgtat

SEQ ID NO: 1884022 - DNA, 15 bp, Homo sapiens
attacatttgtataa

SEQ ID NO: 1884023 - DNA, 18 bp, Homo sapiens
attacatttgtataaaat

SEQ ID NO: 1884024 - DNA, 21 bp, Homo sapiens
attacgtgtatgtttcttctt

SEQ ID NO: 1884025 - DNA, 14 bp, Homo sapiens
attactctacactg

SEQ ID NO: 1884026 - DNA, 14 bp, Homo sapiens
attagagcttaaat

SEQ ID NO: 1884027 - DNA, 20 bp, Homo sapiens
attataagccctgcataatg

SEQ ID NO: 1884028 - DNA, 23 bp, Homo sapiens
attataagccctgcataatgtta

SEQ ID NO: 1884029 - DNA, 18 bp, Homo sapiens
attatatttattactgta

SEQ ID NO: 1884030 - DNA, 17 bp, Homo sapiens
attatgaattacatttg

SEQ ID NO: 1884031 - DNA, 18 bp, Homo sapiens
attatgaattacatttgt

SEQ ID NO: 1884032 - DNA, 19 bp, Homo sapiens
attatgaattacatttgta

SEQ ID NO: 1884033 - DNA, 22 bp, Homo sapiens
attatgaattacatttgtataa

SEQ ID NO: 1884034 - DNA, 20 bp, Homo sapiens
attattactctacactgaaa

SEQ ID NO: 1884035 - DNA, 14 bp, Homo sapiens
attatttgttttcc

SEQ ID NO: 1884036 - DNA, 13 bp, Homo sapiens
attcagagtcctt

SEQ ID NO: 1884037 - DNA, 20 bp, Homo sapiens
attccccggggcgtttcttt

SEQ ID NO: 1884038 - DNA, 22 bp, Homo sapiens
attcctgtggatgtaaagtgat

SEQ ID NO: 1884039 - DNA, 18 bp, Homo sapiens
attctgcctgcctgggaa

SEQ ID NO: 1884040 - DNA, 12 bp, Homo sapiens
attctttcactt

SEQ ID NO: 1884041 - DNA, 23 bp, Homo sapiens
attctttcacttgatgtttgtta

SEQ ID NO: 1884042 - DNA, 13 bp, Homo sapiens
attgactttttat

SEQ ID NO: 1884043 - DNA, 18 bp, Homo sapiens
attgactttttatggcac

SEQ ID NO: 1884044 - DNA, 22 bp, Homo sapiens
attgaggacactgatatgggtc

SEQ ID NO: 1884045 - DNA, 23 bp, Homo sapiens
attgatcggagcctcctctctca

SEQ ID NO: 1884046 - DNA, 15 bp, Homo sapiens
attgctgctggtaat

SEQ ID NO: 1884047 - DNA, 19 bp, Homo sapiens
attggagctcgtgggacag

SEQ ID NO: 1884048 - DNA, 22 bp, Homo sapiens
attggcagcaggtgctgctacc

SEQ ID NO: 1884049 - DNA, 15 bp, Homo sapiens
attgggtgtgccctg

SEQ ID NO: 1884050 - DNA, 16 bp, Homo sapiens
attgggtgtgccctgg

SEQ ID NO: 1884051 - DNA, 19 bp, Homo sapiens
attgggtgtgccctggctc

SEQ ID NO: 1884052 - DNA, 17 bp, Homo sapiens
attgtaaaattgtatag

SEQ ID NO: 1884053 - DNA, 14 bp, Homo sapiens
attgtgatttcccg

SEQ ID NO: 1884054 - DNA, 23 bp, Homo sapiens
attgtgatttcccgtggccccag

SEQ ID NO: 1884055 - DNA, 15 bp, Homo sapiens
atttaaaaatgttag

SEQ ID NO: 1884056 - DNA, 13 bp, Homo sapiens
atttaacataatg

SEQ ID NO: 1884057 - DNA, 20 bp, Homo sapiens
atttaactgggaaccccttc

SEQ ID NO: 1884058 - DNA, 20 bp, Homo sapiens
atttaacttgagggtaataa

SEQ ID NO: 1884059 - DNA, 19 bp, Homo sapiens
atttaatgtattaatctgt

SEQ ID NO: 1884060 - DNA, 21 bp, Homo sapiens
atttaatgtattaatctgttt

SEQ ID NO: 1884061 - DNA, 18 bp, Homo sapiens
atttacatgaattgcatt

SEQ ID NO: 1884062 - DNA, 21 bp, Homo sapiens
atttacatgaattgcatttta

SEQ ID NO: 1884063 - DNA, 20 bp, Homo sapiens
atttattactgtaagaaaat

SEQ ID NO: 1884064 - DNA, 17 bp, Homo sapiens
atttattttaataatgt

SEQ ID NO: 1884065 - DNA, 19 bp, Homo sapiens
atttattttaataatgttt

SEQ ID NO: 1884066 - DNA, 15 bp, Homo sapiens
atttcccgtggcccc

SEQ ID NO: 1884067 - DNA, 21 bp, Homo sapiens
atttcccgtggccccagcctg

SEQ ID NO: 1884068 - DNA, 19 bp, Homo sapiens
atttcctaattttgagaaa

SEQ ID NO: 1884069 - DNA, 24 bp, Homo sapiens
atttcctcaacgttgctccccatc

SEQ ID NO: 1884070 - DNA, 22 bp, Homo sapiens
atttcctgtataatttaacagt

SEQ ID NO: 1884071 - DNA, 21 bp, Homo sapiens
atttcgtctgtttataaacat

SEQ ID NO: 1884072 - DNA, 15 bp, Homo sapiens
atttctatgaaatat

SEQ ID NO: 1884073 - DNA, 13 bp, Homo sapiens
atttctgaaatga

SEQ ID NO: 1884074 - DNA, 14 bp, Homo sapiens
atttgaaatattga

SEQ ID NO: 1884075 - DNA, 18 bp, Homo sapiens
atttgacaggggctcagg

SEQ ID NO: 1884076 - DNA, 21 bp, Homo sapiens
atttgcaattcatgtaacagt

SEQ ID NO: 1884077 - DNA, 22 bp, Homo sapiens
atttgcaattcatgtaacagtt

SEQ ID NO: 1884078 - DNA, 14 bp, Homo sapiens
atttgctcatggaa

SEQ ID NO: 1884079 - DNA, 22 bp, Homo sapiens
atttgctggagtgctggctcca

SEQ ID NO: 1884080 - DNA, 14 bp, Homo sapiens
atttgtaagtttat

SEQ ID NO: 1884081 - DNA, 22 bp, Homo sapiens
atttgtaagtttatgtctaaag

SEQ ID NO: 1884082 - DNA, 14 bp, Homo sapiens
atttgtataaaata

SEQ ID NO: 1884083 - DNA, 19 bp, Homo sapiens
atttgtggttagaatcttg

SEQ ID NO: 1884084 - DNA, 17 bp, Homo sapiens
atttgttatttgtacag

SEQ ID NO: 1884085 - DNA, 18 bp, Homo sapiens
atttgttatttgtacagt

SEQ ID NO: 1884086 - DNA, 13 bp, Homo sapiens
atttgttttcccg

SEQ ID NO: 1884087 - DNA, 19 bp, Homo sapiens
attttaagccttcatttgc

SEQ ID NO: 1884088 - DNA, 15 bp, Homo sapiens
attttaataatgttt

SEQ ID NO: 1884089 - DNA, 16 bp, Homo sapiens
ccaacccatgccctgc

SEQ ID NO: 1884090 - DNA, 15 bp, Homo sapiens
ccaactcgggagcat

SEQ ID NO: 1884091 - DNA, 17 bp, Homo sapiens
ccaagatcacagtggcc

SEQ ID NO: 1884092 - DNA, 12 bp, Homo sapiens
ccaagcctggag

SEQ ID NO: 1884093 - DNA, 18 bp, Homo sapiens
ccaagctgtgccaccctg

SEQ ID NO: 1884094 - DNA, 19 bp, Homo sapiens
ccaagggaggcccatgtga

SEQ ID NO: 1884095 - DNA, 17 bp, Homo sapiens
ccaaggtacctaggttg

SEQ ID NO: 1884096 - DNA, 13 bp, Homo sapiens
ccaaggtggtctg

SEQ ID NO: 1884097 - DNA, 23 bp, Homo sapiens
ccaaggtggtctgctcgggccca

SEQ ID NO: 1884098 - DNA, 23 bp, Homo sapiens
ccaataaaaacattttgaagtgt

SEQ ID NO: 1884099 - DNA, 13 bp, Homo sapiens
ccacaccaagctg

SEQ ID NO: 1884100 - DNA, 14 bp, Homo sapiens
ccacaccaagctgt

SEQ ID NO: 1884101 - DNA, 18 bp, Homo sapiens
ccacaccaagctgtgcca

SEQ ID NO: 1884102 - DNA, 18 bp, Homo sapiens
ccacagagtgtggtccct

SEQ ID NO: 1884103 - DNA, 20 bp, Homo sapiens
ccacagcaaggcacctgcag

SEQ ID NO: 1884104 - DNA, 20 bp, Homo sapiens
ccacagtgcctaataatact

SEQ ID NO: 1884105 - DNA, 22 bp, Homo sapiens
ccacatcccactcacaacagct

SEQ ID NO: 1884106 - DNA, 19 bp, Homo sapiens
ccaccagctccactggcct

SEQ ID NO: 1884107 - DNA, 13 bp, Homo sapiens
ccaccctgggctc

SEQ ID NO: 1884108 - DNA, 23 bp, Homo sapiens
ccaccctgggctctgtgggctgc

SEQ ID NO: 1884109 - DNA, 13 bp, Homo sapiens
ccaccgcatgccc

SEQ ID NO: 1884110 - DNA, 13 bp, Homo sapiens
ccaccgccatggc

SEQ ID NO: 1884111 - DNA, 18 bp, Homo sapiens
ccaccgccatggcttcca

SEQ ID NO: 1884112 - DNA, 15 bp, Homo sapiens
ccacctagtggctgt

SEQ ID NO: 1884113 - DNA, 13 bp, Homo sapiens
ccacctctgagga

SEQ ID NO: 1884114 - DNA, 14 bp, Homo sapiens
ccacctgggctggg

SEQ ID NO: 1884115 - DNA, 16 bp, Homo sapiens
ccacgaggaggaacca

SEQ ID NO: 1884116 - DNA, 21 bp, Homo sapiens
ccacgaggtggtagctctgag

SEQ ID NO: 1884117 - DNA, 22 bp, Homo sapiens
ccacgaggtggtagctctgagc

SEQ ID NO: 1884118 - DNA, 23 bp, Homo sapiens
ccacgaggtggtagctctgagcc

SEQ ID NO: 1884119 - DNA, 12 bp, Homo sapiens
ccacgccctggg

SEQ ID NO: 1884120 - DNA, 13 bp, Homo sapiens
ccacgtactgcag

SEQ ID NO: 1884121 - DNA, 15 bp, Homo sapiens
ccacgtcctgtcagt

SEQ ID NO: 1884122 - DNA, 16 bp, Homo sapiens
ccacgtcctgtcagtg

SEQ ID NO: 1884123 - DNA, 19 bp, Homo sapiens
ccacgtcctgtcagtgccg

SEQ ID NO: 1884124 - DNA, 20 bp, Homo sapiens
ccactcacaacagctgcctg

SEQ ID NO: 1884125 - DNA, 17 bp, Homo sapiens
ccactcccacttccctg

SEQ ID NO: 1884126 - DNA, 22 bp, Homo sapiens
ccactcccacttccctgacact

SEQ ID NO: 1884127 - DNA, 23 bp, Homo sapiens
ccactcccacttccctgacactg

SEQ ID NO: 1884128 - DNA, 22 bp, Homo sapiens
ccactgcaccccctcctgctgc

SEQ ID NO: 1884129 - DNA, 23 bp, Homo sapiens
ccactgcaccccctcctgctgca

SEQ ID NO: 1884130 - DNA, 16 bp, Homo sapiens
ccacttgggtcttccc

SEQ ID NO: 1884131 - DNA, 21 bp, Homo sapiens
ccagaaaaaaagcccaacaca

SEQ ID NO: 1884132 - DNA, 16 bp, Homo sapiens
ccagaatttaaaccta

SEQ ID NO: 1884133 - DNA, 19 bp, Homo sapiens
ccagagcttcagggctggg

SEQ ID NO: 1884134 - DNA, 21 bp, Homo sapiens
ccagaggcagctaaggggcag

SEQ ID NO: 1884135 - DNA, 23 bp, Homo sapiens
ccagaggcagctaaggggcagga

SEQ ID NO: 1884136 - DNA, 13 bp, Homo sapiens
ccagagtctggag

SEQ ID NO: 1884137 - DNA, 18 bp, Homo sapiens
ccagcacccgggctcagg

SEQ ID NO: 1884138 - DNA, 17 bp, Homo sapiens
ccagcccacatccagtg

SEQ ID NO: 1884139 - DNA, 12 bp, Homo sapiens
ccagcccaggat

SEQ ID NO: 1884140 - DNA, 13 bp, Homo sapiens
ccagccccacagc

SEQ ID NO: 1884141 - DNA, 19 bp, Homo sapiens
ccagccccacagcccacgt

SEQ ID NO: 1884142 - DNA, 14 bp, Homo sapiens
ccagccctgaacaa

SEQ ID NO: 1884143 - DNA, 14 bp, Homo sapiens
ccagccgctgcccg

SEQ ID NO: 1884144 - DNA, 23 bp, Homo sapiens
ccagccgctgcccggcgccctct

SEQ ID NO: 1884145 - DNA, 14 bp, Homo sapiens
ccagcctggcccag

SEQ ID NO: 1884146 - DNA, 15 bp, Homo sapiens
ccagcctggcccagc

SEQ ID NO: 1884147 - DNA, 16 bp, Homo sapiens
ccagcctggcccagct

SEQ ID NO: 1884148 - DNA, 21 bp, Homo sapiens
ccagctgacagtcctctccac

SEQ ID NO: 1884149 - DNA, 23 bp, Homo sapiens
ccagctgacagtcctctccacct

SEQ ID NO: 1884150 - DNA, 22 bp, Homo sapiens
ccaggaccaagcttaaggagag

SEQ ID NO: 1884151 - DNA, 16 bp, Homo sapiens
ccaggacggggccggc

SEQ ID NO: 1884152 - DNA, 21 bp, Homo sapiens
ccaggacggggccggccaggt

SEQ ID NO: 1884153 - DNA, 18 bp, Homo sapiens
ccaggccataccaggtgc

SEQ ID NO: 1884154 - DNA, 15 bp, Homo sapiens
ccaggctggccagcc

SEQ ID NO: 1884155 - DNA, 16 bp, Homo sapiens
ccaggctggccagccc

SEQ ID NO: 1884156 - DNA, 20 bp, Homo sapiens
ccaggctggccagccccaca

SEQ ID NO: 1884157 - DNA, 21 bp, Homo sapiens
ccaggctggccagccccacag

SEQ ID NO: 1884158 - DNA, 22 bp, Homo sapiens
ccaggctggccagccccacagc

SEQ ID NO: 1884159 - DNA, 23 bp, Homo sapiens
ccaggctggccagccccacagcc

SEQ ID NO: 1884160 - DNA, 20 bp, Homo sapiens
ccaggggtctccctgagcct

SEQ ID NO: 1884161 - DNA, 15 bp, Homo sapiens
ccaggtctcctccac

SEQ ID NO: 1884162 - DNA, 20 bp, Homo sapiens
ccaggtgctagggtgcctgc

SEQ ID NO: 1884163 - DNA, 20 bp, Homo sapiens
ccaggtgggaacatggtcac

SEQ ID NO: 1884164 - DNA, 20 bp, Homo sapiens
ccaggtgggcgggcagcaca

SEQ ID NO: 1884165 - DNA, 20 bp, Homo sapiens
ccaggtggggtgaggcagtg

SEQ ID NO: 1884166 - DNA, 23 bp, Homo sapiens
ccaggtggggtgaggcagtgggt

SEQ ID NO: 1884167 - DNA, 18 bp, Homo sapiens
ccaggtgtctagaggcaa

SEQ ID NO: 1884168 - DNA, 14 bp, Homo sapiens
ccagtcatgtgctg

SEQ ID NO: 1884169 - DNA, 15 bp, Homo sapiens
ccagtcatgtgctgg

SEQ ID NO: 1884170 - DNA, 18 bp, Homo sapiens
ccagtcctcacatgcccg

SEQ ID NO: 1884171 - DNA, 20 bp, Homo sapiens
ccagtcctcacatgcccgct

SEQ ID NO: 1884172 - DNA, 16 bp, Homo sapiens
ccagtcgcgctgcctg

SEQ ID NO: 1884173 - DNA, 16 bp, Homo sapiens
ccagtctgttccccat

SEQ ID NO: 1884174 - DNA, 18 bp, Homo sapiens
ccagtgcccattcctcac

SEQ ID NO: 1884175 - DNA, 17 bp, Homo sapiens
ccagtgtcttcctgtgg

SEQ ID NO: 1884176 - DNA, 22 bp, Homo sapiens
ccagttagcctctgcaggatgt

SEQ ID NO: 1884177 - DNA, 22 bp, Homo sapiens
ccagttgaactgcaggaagaga

SEQ ID NO: 1884178 - DNA, 17 bp, Homo sapiens
ccatactggcctcgcct

SEQ ID NO: 1884179 - DNA, 21 bp, Homo sapiens
ccatactggcctcgcctggcc

SEQ ID NO: 1884180 - DNA, 19 bp, Homo sapiens
ccatcccccctcaccaggg

SEQ ID NO: 1884181 - DNA, 13 bp, Homo sapiens
ccatccctggccc

SEQ ID NO: 1884182 - DNA, 23 bp, Homo sapiens
ccatccctggccccctccctgga

SEQ ID NO: 1884183 - DNA, 17 bp, Homo sapiens
ccatcctggcccatcag

SEQ ID NO: 1884184 - DNA, 14 bp, Homo sapiens
ccatctctgctgct

SEQ ID NO: 1884185 - DNA, 12 bp, Homo sapiens
ccatctgcccag

SEQ ID NO: 1884186 - DNA, 16 bp, Homo sapiens
ccatctgcccaggacg

SEQ ID NO: 1884187 - DNA, 19 bp, Homo sapiens
ccatcttgcccgctcaggc

SEQ ID NO: 1884188 - DNA, 21 bp, Homo sapiens
ccatcttgcccgctcaggctg

SEQ ID NO: 1884189 - DNA, 22 bp, Homo sapiens
ccatgaagagatttttcatgat

SEQ ID NO: 1884190 - DNA, 16 bp, Homo sapiens
ccatgatgtttagaaa

SEQ ID NO: 1884191 - DNA, 15 bp, Homo sapiens
ccatgccctgccaag

SEQ ID NO: 1884192 - DNA, 15 bp, Homo sapiens
ccatgggcactgctg

SEQ ID NO: 1884193 - DNA, 15 bp, Homo sapiens
ccatgtatctacctc

SEQ ID NO: 1884194 - DNA, 12 bp, Homo sapiens
ccatttctttta

SEQ ID NO: 1884195 - DNA, 11 bp, Homo sapiens
cccaaatgtat

SEQ ID NO: 1884196 - DNA, 12 bp, Homo sapiens
cccaacccccag

SEQ ID NO: 1884197 - DNA, 13 bp, Homo sapiens
cccaacccccagc

SEQ ID NO: 1884198 - DNA, 14 bp, Homo sapiens
cccaacccccagca

SEQ ID NO: 1884199 - DNA, 15 bp, Homo sapiens
cccaacccccagcac

SEQ ID NO: 1884200 - DNA, 15 bp, Homo sapiens
cccacagcccacgtc

SEQ ID NO: 1884201 - DNA, 18 bp, Homo sapiens
cccacagcccacgtcctg

SEQ ID NO: 1884202 - DNA, 14 bp, Homo sapiens
cccaccgcatgccc

SEQ ID NO: 1884203 - DNA, 14 bp, Homo sapiens
cccacctctgagga

SEQ ID NO: 1884204 - DNA, 15 bp, Homo sapiens
cccacctctgaggac

SEQ ID NO: 1884205 - DNA, 16 bp, Homo sapiens
cccacctgaggcccca

SEQ ID NO: 1884206 - DNA, 15 bp, Homo sapiens
cccacgtcctgtcag

SEQ ID NO: 1884207 - DNA, 20 bp, Homo sapiens
ccctgcaggaggcctgggag

SEQ ID NO: 1884208 - DNA, 15 bp, Homo sapiens
ccctgccaagcctgg

SEQ ID NO: 1884209 - DNA, 16 bp, Homo sapiens
ccctgccaagcctgga

SEQ ID NO: 1884210 - DNA, 17 bp, Homo sapiens
ccctgctgtcccctctt

SEQ ID NO: 1884211 - DNA, 15 bp, Homo sapiens
ccctggctcccaagg

SEQ ID NO: 1884212 - DNA, 18 bp, Homo sapiens
ccctggctcccaagggag

SEQ ID NO: 1884213 - DNA, 17 bp, Homo sapiens
ccctgggctctgtgggc

SEQ ID NO: 1884214 - DNA, 23 bp, Homo sapiens
ccctggtaagtaatgagggctga

SEQ ID NO: 1884215 - DNA, 16 bp, Homo sapiens
cccttggacttgagga

SEQ ID NO: 1884216 - DNA, 18 bp, Homo sapiens
cccttttcagcttctgct

SEQ ID NO: 1884217 - DNA, 15 bp, Homo sapiens
ccgaaaatcatataa

SEQ ID NO: 1884218 - DNA, 21 bp, Homo sapiens
ccgacttgaattttcccactg

SEQ ID NO: 1884219 - DNA, 22 bp, Homo sapiens
ccgacttgaattttcccactgc

SEQ ID NO: 1884220 - DNA, 11 bp, Homo sapiens
ccgagattgca

SEQ ID NO: 1884221 - DNA, 18 bp, Homo sapiens
ccgagcaaagtctaaagt

SEQ ID NO: 1884222 - DNA, 20 bp, Homo sapiens
ccgagcaaagtctaaagttt

SEQ ID NO: 1884223 - DNA, 13 bp, Homo sapiens
ccgcatgccccct

SEQ ID NO: 1884224 - DNA, 18 bp, Homo sapiens
ccgcatgccccctcgtgc

SEQ ID NO: 1884225 - DNA, 19 bp, Homo sapiens
ccgcatgccccctcgtgcc

SEQ ID NO: 1884226 - DNA, 15 bp, Homo sapiens
ccgccatggcttcca

SEQ ID NO: 1884227 - DNA, 14 bp, Homo sapiens
ccgcccaggctggc

SEQ ID NO: 1884228 - DNA, 16 bp, Homo sapiens
ccgcccaggctggcca

SEQ ID NO: 1884229 - DNA, 17 bp, Homo sapiens
ccgccccttccccgagg

SEQ ID NO: 1884230 - DNA, 16 bp, Homo sapiens
ccgccgcctcgcccac

SEQ ID NO: 1884231 - DNA, 14 bp, Homo sapiens
ccgcctcgcccacc

SEQ ID NO: 1884232 - DNA, 21 bp, Homo sapiens
ccgcctcgcccaccgcatgcc

SEQ ID NO: 1884233 - DNA, 15 bp, Homo sapiens
ccgctcccagtgtct

SEQ ID NO: 1884234 - DNA, 20 bp, Homo sapiens
ccgctcccagtgtcttcctg

SEQ ID NO: 1884235 - DNA, 23 bp, Homo sapiens
ccgctgcccggcgccctctgtcc

SEQ ID NO: 1884236 - DNA, 13 bp, Homo sapiens
ccgcttgcctcgg

SEQ ID NO: 1884237 - DNA, 21 bp, Homo sapiens
ccgcttgcctcggctcctgct

SEQ ID NO: 1884238 - DNA, 22 bp, Homo sapiens
ccgcttgcctcggctcctgctg

SEQ ID NO: 1884239 - DNA, 13 bp, Homo sapiens
ccggccaggtggg

SEQ ID NO: 1884240 - DNA, 14 bp, Homo sapiens
ccggcgccctctgt

SEQ ID NO: 1884241 - DNA, 17 bp, Homo sapiens
ccggcgccctctgtcct

SEQ ID NO: 1884242 - DNA, 15 bp, Homo sapiens
ccgggaggggcccgc

SEQ ID NO: 1884243 - DNA, 22 bp, Homo sapiens
ccgggaggggcccgcttgcctc

SEQ ID NO: 1884244 - DNA, 14 bp, Homo sapiens
ccgggcctggactg

SEQ ID NO: 1884245 - DNA, 22 bp, Homo sapiens
ccgggctcagggaccacagcaa

SEQ ID NO: 1884246 - DNA, 17 bp, Homo sapiens
ccggggaggagccttgg

SEQ ID NO: 1884247 - DNA, 13 bp, Homo sapiens
ccggtcagtgcct

SEQ ID NO: 1884248 - DNA, 16 bp, Homo sapiens
ccgtggccccagcctg

SEQ ID NO: 1884249 - DNA, 22 bp, Homo sapiens
ccgtggccccagcctggcccag

SEQ ID NO: 1884250 - DNA, 19 bp, Homo sapiens
ccgttcccacctctgagga

SEQ ID NO: 1884251 - DNA, 19 bp, Homo sapiens
ccgttgccgggcctggact

SEQ ID NO: 1884252 - DNA, 14 bp, Homo sapiens
ccgttgctgaaaat

SEQ ID NO: 1884253 - DNA, 19 bp, Homo sapiens
ccgttgtctccctggccct

SEQ ID NO: 1884254 - DNA, 20 bp, Homo sapiens
ccgttgtctccctggccctc

SEQ ID NO: 1884255 - DNA, 21 bp, Homo sapiens
ccgttgtctccctggccctca

SEQ ID NO: 1884256 - DNA, 22 bp, Homo sapiens
cctaatgacatcaccacagttt

SEQ ID NO: 1884257 - DNA, 18 bp, Homo sapiens
cctacacctctgggccct

SEQ ID NO: 1884258 - DNA, 14 bp, Homo sapiens
cctacccctcccag

SEQ ID NO: 1884259 - DNA, 15 bp, Homo sapiens
cctacccctcccagc

SEQ ID NO: 1884260 - DNA, 16 bp, Homo sapiens
cctacccctcccagct

SEQ ID NO: 1884261 - DNA, 17 bp, Homo sapiens
cctacccctcccagctg

SEQ ID NO: 1884262 - DNA, 18 bp, Homo sapiens
cctacccctcccagctga

SEQ ID NO: 1884263 - DNA, 14 bp, Homo sapiens
cctagtatctggct

SEQ ID NO: 1884264 - DNA, 17 bp, Homo sapiens
cctagtatctggctggg

SEQ ID NO: 1884265 - DNA, 17 bp, Homo sapiens
cctagtggctgtccagt

SEQ ID NO: 1884266 - DNA, 18 bp, Homo sapiens
cctatcagtgtgcccccc

SEQ ID NO: 1884267 - DNA, 19 bp, Homo sapiens
cctcaacgttgctccccat

SEQ ID NO: 1884268 - DNA, 15 bp, Homo sapiens
cctcaaggcctccca

SEQ ID NO: 1884269 - DNA, 20 bp, Homo sapiens
cctcaaggcctcccacagtg

SEQ ID NO: 1884270 - DNA, 21 bp, Homo sapiens
cctcaaggcctcccacagtga

SEQ ID NO: 1884271 - DNA, 16 bp, Homo sapiens
cctcacatgcccgctg

SEQ ID NO: 1884272 - DNA, 19 bp, Homo sapiens
cctcacatgcccgctgtcc

SEQ ID NO: 1884273 - DNA, 14 bp, Homo sapiens
cctcaccaggggca

SEQ ID NO: 1884274 - DNA, 19 bp, Homo sapiens
cctcaccaggggcaggcac

SEQ ID NO: 1884275 - DNA, 20 bp, Homo sapiens
cctcaccaggggcaggcaca

SEQ ID NO: 1884276 - DNA, 12 bp, Homo sapiens
cctccactccca

SEQ ID NO: 1884277 - DNA, 14 bp, Homo sapiens
cctccactcccact

SEQ ID NO: 1884278 - DNA, 20 bp, Homo sapiens
cctccactcccacttccctg

SEQ ID NO: 1884279 - DNA, 14 bp, Homo sapiens
cctccatccctggc

SEQ ID NO: 1884280 - DNA, 12 bp, Homo sapiens
cctccattttct

SEQ ID NO: 1884281 - DNA, 12 bp, Homo sapiens
cctcccacagtg

SEQ ID NO: 1884282 - DNA, 16 bp, Homo sapiens
cctcccctccatccct

SEQ ID NO: 1884283 - DNA, 15 bp, Homo sapiens
cctcccctcccgtct

SEQ ID NO: 1884284 - DNA, 20 bp, Homo sapiens
cctccctgctgtcccctctt

SEQ ID NO: 1884285 - DNA, 12 bp, Homo sapiens
cctccctggatg

SEQ ID NO: 1884286 - DNA, 18 bp, Homo sapiens
cctccgttcccacctctg

SEQ ID NO: 1884287 - DNA, 16 bp, Homo sapiens
cctcctacccctccca

SEQ ID NO: 1884288 - DNA, 20 bp, Homo sapiens
cctcctacccctcccagctg

SEQ ID NO: 1884289 - DNA, 17 bp, Homo sapiens
cctcctgctgcagaggg

SEQ ID NO: 1884290 - DNA, 18 bp, Homo sapiens
cctcctgctgcagagggg

SEQ ID NO: 1884291 - DNA, 12 bp, Homo sapiens
cctcgcccaccg

SEQ ID NO: 1884292 - DNA, 19 bp, Homo sapiens
cctcgcccaccgcatgccc

SEQ ID NO: 1884293 - DNA, 12 bp, Homo sapiens
cctcgcctggcc

SEQ ID NO: 1884294 - DNA, 14 bp, Homo sapiens
cctcgcctggcctg

SEQ ID NO: 1884295 - DNA, 12 bp, Homo sapiens
cctcggctcctg

SEQ ID NO: 1884296 - DNA, 17 bp, Homo sapiens
cctcggctcctgctgca

SEQ ID NO: 1884297 - DNA, 19 bp, Homo sapiens
cctcggctcctgctgcacc

SEQ ID NO: 1884298 - DNA, 12 bp, Homo sapiens
cctcgtgccagt

SEQ ID NO: 1884299 - DNA, 14 bp, Homo sapiens
cctcgtgccagtcg

SEQ ID NO: 1884300 - DNA, 20 bp, Homo sapiens
cctctcgctcctcaacccct

SEQ ID NO: 1884301 - DNA, 20 bp, Homo sapiens
cctctctccaggccccaggt

SEQ ID NO: 1884302 - DNA, 22 bp, Homo sapiens
cctctgctatgcattttcttca

SEQ ID NO: 1884303 - DNA, 15 bp, Homo sapiens
cctctgggccctgca

SEQ ID NO: 1884304 - DNA, 23 bp, Homo sapiens
cctctgtatttgaatcagcctac

SEQ ID NO: 1884305 - DNA, 16 bp, Homo sapiens
cctctgtcctgacttc

SEQ ID NO: 1884306 - DNA, 14 bp, Homo sapiens
cctctgtgtcactg

SEQ ID NO: 1884307 - DNA, 18 bp, Homo sapiens
cctctgtgtcactggctg

SEQ ID NO: 1884308 - DNA, 19 bp, Homo sapiens
cctctgtgtcactggctgc

SEQ ID NO: 1884309 - DNA, 21 bp, Homo sapiens
cctctgtgtcactggctgcct

SEQ ID NO: 1884310 - DNA, 17 bp, Homo sapiens
cctcttaaataaacctt

SEQ ID NO: 1884311 - DNA, 22 bp, Homo sapiens
cctcttgccccaacccccagca

SEQ ID NO: 1884312 - DNA, 15 bp, Homo sapiens
cctctttgcatggaa

SEQ ID NO: 1884313 - DNA, 19 bp, Homo sapiens
cctgacttcaggggctgcc

SEQ ID NO: 1884314 - DNA, 22 bp, Homo sapiens
cctgacttcaggggctgcccgc

SEQ ID NO: 1884315 - DNA, 17 bp, Homo sapiens
cctgagcctgccccagc

SEQ ID NO: 1884316 - DNA, 18 bp, Homo sapiens
cctgagcctgccccagct

SEQ ID NO: 1884317 - DNA, 21 bp, Homo sapiens
cctgagcctgccccagctggg

SEQ ID NO: 1884318 - DNA, 22 bp, Homo sapiens
cctgagctttccggggaggagc

SEQ ID NO: 1884319 - DNA, 16 bp, Homo sapiens
cctgatggagaggaga

SEQ ID NO: 1884320 - DNA, 14 bp, Homo sapiens
cctgcactgtcctg

SEQ ID NO: 1884321 - DNA, 17 bp, Homo sapiens
cctgcactgtcctgctc

SEQ ID NO: 1884322 - DNA, 13 bp, Homo sapiens
cctgcaggaggcc

SEQ ID NO: 1884323 - DNA, 23 bp, Homo sapiens
cctgcaggaggcctgggagggca

SEQ ID NO: 1884324 - DNA, 21 bp, Homo sapiens
cctgcaggttgggccatactg

SEQ ID NO: 1884325 - DNA, 15 bp, Homo sapiens
ctggcccagctcccc

SEQ ID NO: 1884326 - DNA, 16 bp, Homo sapiens
ctggccctcaaggcct

SEQ ID NO: 1884327 - DNA, 18 bp, Homo sapiens
ctggccctcaaggcctcc

SEQ ID NO: 1884328 - DNA, 21 bp, Homo sapiens
ctggccctcaaggcctcccac

SEQ ID NO: 1884329 - DNA, 23 bp, Homo sapiens
ctggccctcaaggcctcccacag

SEQ ID NO: 1884330 - DNA, 24 bp, Homo sapiens
ctggccctcaaggcctcccacagt

SEQ ID NO: 1884331 - DNA, 15 bp, Homo sapiens
ctggccgagctgaag

SEQ ID NO: 1884332 - DNA, 16 bp, Homo sapiens
ctggcctcgcctggcc

SEQ ID NO: 1884333 - DNA, 18 bp, Homo sapiens
ctggcctcgcctggcctg

SEQ ID NO: 1884334 - DNA, 19 bp, Homo sapiens
ctggcctcgcctggcctga

SEQ ID NO: 1884335 - DNA, 15 bp, Homo sapiens
ctggcctgactccca

SEQ ID NO: 1884336 - DNA, 24 bp, Homo sapiens
ctggcctgaggtctcgctgatgct

SEQ ID NO: 1884337 - DNA, 22 bp, Homo sapiens
ctggcctgttctgtaggagaga

SEQ ID NO: 1884338 - DNA, 20 bp, Homo sapiens
ctggctccaaaccctcgagg

SEQ ID NO: 1884339 - DNA, 17 bp, Homo sapiens
ctggctccacgccctgg

SEQ ID NO: 1884340 - DNA, 18 bp, Homo sapiens
ctggctccacgccctggg

SEQ ID NO: 1884341 - DNA, 22 bp, Homo sapiens
ctggctccacgccctggggagt

SEQ ID NO: 1884342 - DNA, 18 bp, Homo sapiens
ctggctcccaagggaggc

SEQ ID NO: 1884343 - DNA, 18 bp, Homo sapiens
ctggctgcctccactccc

SEQ ID NO: 1884344 - DNA, 22 bp, Homo sapiens
ctggctggggcctatcagtgtg

SEQ ID NO: 1884345 - DNA, 14 bp, Homo sapiens
ctggcttggagtgg

SEQ ID NO: 1884346 - DNA, 13 bp, Homo sapiens
ctgggaacccctt

SEQ ID NO: 1884347 - DNA, 21 bp, Homo sapiens
ctgggagaaggtgcttgggct

SEQ ID NO: 1884348 - DNA, 14 bp, Homo sapiens
ctgggaggcttcag

SEQ ID NO: 1884349 - DNA, 19 bp, Homo sapiens
ctgggagggcaagggtcct

SEQ ID NO: 1884350 - DNA, 19 bp, Homo sapiens
ctgggcaggtcctggggag

SEQ ID NO: 1884351 - DNA, 13 bp, Homo sapiens
ctgggccaccagc

SEQ ID NO: 1884352 - DNA, 16 bp, Homo sapiens
ctgggccctgcaggag

SEQ ID NO: 1884353 - DNA, 17 bp, Homo sapiens
ctgggccctgcaggagg

SEQ ID NO: 1884354 - DNA, 19 bp, Homo sapiens
ctgggcctgatggagagga

SEQ ID NO: 1884355 - DNA, 13 bp, Homo sapiens
ctgggctgggaga

SEQ ID NO: 1884356 - DNA, 16 bp, Homo sapiens
ctgggctgggagaagg

SEQ ID NO: 1884357 - DNA, 15 bp, Homo sapiens
ctgggctggggcctg

SEQ ID NO: 1884358 - DNA, 15 bp, Homo sapiens
ctgggctgttggctg

SEQ ID NO: 1884359 - DNA, 12 bp, Homo sapiens
ctggggaaggac

SEQ ID NO: 1884360 - DNA, 14 bp, Homo sapiens
ctggggaaggacca

SEQ ID NO: 1884361 - DNA, 15 bp, Homo sapiens
ctggggaggctgaga

SEQ ID NO: 1884362 - DNA, 16 bp, Homo sapiens
ctggggccaaataaag

SEQ ID NO: 1884363 - DNA, 19 bp, Homo sapiens
ctggggcggggctggaggt

SEQ ID NO: 1884364 - DNA, 19 bp, Homo sapiens
ctgggtatgaggctggggc

SEQ ID NO: 1884365 - DNA, 12 bp, Homo sapiens
ctgggtggccca

SEQ ID NO: 1884366 - DNA, 13 bp, Homo sapiens
ctgggtggcccat

SEQ ID NO: 1884367 - DNA, 22 bp, Homo sapiens
ctgggttggcgcaccctcccct

SEQ ID NO: 1884368 - DNA, 14 bp, Homo sapiens
ctggtgagccaagc

SEQ ID NO: 1884369 - DNA, 17 bp, Homo sapiens
ctggttacctgttccat

SEQ ID NO: 1884370 - DNA, 19 bp, Homo sapiens
ctgtaggagagactggcca

SEQ ID NO: 1884371 - DNA, 16 bp, Homo sapiens
ctgtattttaaaagaa

SEQ ID NO: 1884372 - DNA, 19 bp, Homo sapiens
ctgtattttaaaagaatga

SEQ ID NO: 1884373 - DNA, 14 bp, Homo sapiens
ctgtcagtgccgcc

SEQ ID NO: 1884374 - DNA, 22 bp, Homo sapiens
ctgtcagtgccgccgcctcgcc

SEQ ID NO: 1884375 - DNA, 13 bp, Homo sapiens
ctgtccagtgccc

SEQ ID NO: 1884376 - DNA, 15 bp, Homo sapiens
ctgtcccctcttgcc

SEQ ID NO: 1884377 - DNA, 17 bp, Homo sapiens
ctgtcccctcttgcccc

SEQ ID NO: 1884378 - DNA, 18 bp, Homo sapiens
ctgtccctcaaaattgat

SEQ ID NO: 1884379 - DNA, 15 bp, Homo sapiens
ctgtcctaggtgacc

SEQ ID NO: 1884380 - DNA, 17 bp, Homo sapiens
ctgtcctgctccacagt

SEQ ID NO: 1884381 - DNA, 20 bp, Homo sapiens
ctgtctacactaagagagaa

SEQ ID NO: 1884382 - DNA, 13 bp, Homo sapiens
ctgtctattctag

SEQ ID NO: 1884383 - DNA, 13 bp, Homo sapiens
ctgtctcagactc

SEQ ID NO: 1884384 - DNA, 14 bp, Homo sapiens
ctgtcttggctgtg

SEQ ID NO: 1884385 - DNA, 19 bp, Homo sapiens
ctgtgatttcttctccctc

SEQ ID NO: 1884386 - DNA, 15 bp, Homo sapiens
ctgtgccaccctggg

SEQ ID NO: 1884387 - DNA, 12 bp, Homo sapiens
ctgtgcccatgg

SEQ ID NO: 1884388 - DNA, 13 bp, Homo sapiens
ctgtgcccatggg

SEQ ID NO: 1884389 - DNA, 18 bp, Homo sapiens
ctgtgggctgcactctgt

SEQ ID NO: 1884390 - DNA, 21 bp, Homo sapiens
ctgtgggctgcactctgtgcc

SEQ ID NO: 1884391 - DNA, 23 bp, Homo sapiens
ctgtgggctgcactctgtgccca

SEQ ID NO: 1884392 - DNA, 20 bp, Homo sapiens
ctgtggggctaggggctggg

SEQ ID NO: 1884393 - DNA, 21 bp, Homo sapiens
ctgtggggctaggggctgggg

SEQ ID NO: 1884394 - DNA, 21 bp, Homo sapiens
ctgtgggggaagagcacagcc

SEQ ID NO: 1884395 - DNA, 20 bp, Homo sapiens
ctgtggtccagagtcaactg

SEQ ID NO: 1884396 - DNA, 19 bp, Homo sapiens
ctgtgtaactttaaacatc

SEQ ID NO: 1884397 - DNA, 15 bp, Homo sapiens
ctgtgtcactggctg

SEQ ID NO: 1884398 - DNA, 16 bp, Homo sapiens
ctgtgtcactggctgc

SEQ ID NO: 1884399 - DNA, 17 bp, Homo sapiens
ctgtgtcactggctgcc

SEQ ID NO: 1884400 - DNA, 19 bp, Homo sapiens
ctgtgtcactggctgcctc

SEQ ID NO: 1884401 - DNA, 20 bp, Homo sapiens
ctgtgtcactggctgcctcc

SEQ ID NO: 1884402 - DNA, 21 bp, Homo sapiens
ctgtgtcactggctgcctcca

SEQ ID NO: 1884403 - DNA, 22 bp, Homo sapiens
ctgtgtcactggctgcctccac

SEQ ID NO: 1884404 - DNA, 23 bp, Homo sapiens
ctgtgtcggggggcgagggaggg

SEQ ID NO: 1884405 - DNA, 18 bp, Homo sapiens
ctgtgtgtctgatgtttg

SEQ ID NO: 1884406 - DNA, 21 bp, Homo sapiens
ctgttcccataacccctagtc

SEQ ID NO: 1884407 - DNA, 21 bp, Homo sapiens
ctgttgcaggtgtccgggggt

SEQ ID NO: 1884408 - DNA, 15 bp, Homo sapiens
ctgtttctgtagaaa

SEQ ID NO: 1884409 - DNA, 22 bp, Homo sapiens
ctgtttcttgcactgaatatat

SEQ ID NO: 1884410 - DNA, 19 bp, Homo sapiens
ctgtttgtgcaaacataat

SEQ ID NO: 1884411 - DNA, 24 bp, Homo sapiens
ctgttttaaaaacaaagaaataaa

SEQ ID NO: 1884412 - DNA, 20 bp, Homo sapiens
cttaagagcttgatctgtga

SEQ ID NO: 1884413 - DNA, 15 bp, Homo sapiens
cttaaggagaggaga

SEQ ID NO: 1884414 - DNA, 16 bp, Homo sapiens
cttaaggagaggagag

SEQ ID NO: 1884415 - DNA, 17 bp, Homo sapiens
cttaatacacacagtta

SEQ ID NO: 1884416 - DNA, 17 bp, Homo sapiens
cttaatttaatgtatta

SEQ ID NO: 1884417 - DNA, 17 bp, Homo sapiens
cttagaataaaattgta

SEQ ID NO: 1884418 - DNA, 20 bp, Homo sapiens
cttagaataaaattgtaaaa

SEQ ID NO: 1884419 - DNA, 19 bp, Homo sapiens
cttagatgcagttctgaag

SEQ ID NO: 1884420 - DNA, 18 bp, Homo sapiens
cttagcaagacctgaaaa

SEQ ID NO: 1884421 - DNA, 21 bp, Homo sapiens
cttatattaatattcctcagt

SEQ ID NO: 1884422 - DNA, 12 bp, Homo sapiens
cttatattttga

SEQ ID NO: 1884423 - DNA, 19 bp, Homo sapiens
cttcaggacactcactaca

SEQ ID NO: 1884424 - DNA, 19 bp, Homo sapiens
cttcaggggctgcccgctc

SEQ ID NO: 1884425 - DNA, 20 bp, Homo sapiens
cttcaggggctgcccgctcc

SEQ ID NO: 1884426 - DNA, 22 bp, Homo sapiens
cttcaggggctgcccgctccca

SEQ ID NO: 1884427 - DNA, 23 bp, Homo sapiens
cttcaggggctgcccgctcccag

SEQ ID NO: 1884428 - DNA, 17 bp, Homo sapiens
cttcagttaccgctggc

SEQ ID NO: 1884429 - DNA, 16 bp, Homo sapiens
cttcagttgttcttta

SEQ ID NO: 1884430 - DNA, 20 bp, Homo sapiens
cttccacgtactgcagcctc

SEQ ID NO: 1884431 - DNA, 22 bp, Homo sapiens
cttcccctcctacccctcccag

SEQ ID NO: 1884432 - DNA, 13 bp, Homo sapiens
cttccgctcccac

SEQ ID NO: 1884433 - DNA, 13 bp, Homo sapiens
cttctattaaatg

SEQ ID NO: 1884434 - DNA, 16 bp, Homo sapiens
cttctattaaatgtat

SEQ ID NO: 1884435 - DNA, 18 bp, Homo sapiens
cttctcccccccggggct

SEQ ID NO: 1884436 - DNA, 16 bp, Homo sapiens
cttctgccacctgcct

SEQ ID NO: 1884437 - DNA, 17 bp, Homo sapiens
cttctgccacttcccag

SEQ ID NO: 1884438 - DNA, 20 bp, Homo sapiens
cttctgccacttcccaggta

SEQ ID NO: 1884439 - DNA, 13 bp, Homo sapiens
cttctgccttttt

SEQ ID NO: 1884440 - DNA, 14 bp, Homo sapiens
cttctgctgggctg

SEQ ID NO: 1884441 - DNA, 11 bp, Homo sapiens
cttctgtgcct

SEQ ID NO: 1884442 - DNA, 15 bp, Homo sapiens
cttctgttttataat

SEQ ID NO: 1884443 - DNA, 19 bp, Homo sapiens
gcccgttgtctccctggcc

SEQ ID NO: 1884444 - DNA, 20 bp, Homo sapiens
gcccgttgtctccctggccc

SEQ ID NO: 1884445 - DNA, 16 bp, Homo sapiens
gccctcaaggcctccc

SEQ ID NO: 1884446 - DNA, 17 bp, Homo sapiens
gccctcaaggcctccca

SEQ ID NO: 1884447 - DNA, 18 bp, Homo sapiens
gccctccttcttgccctg

SEQ ID NO: 1884448 - DNA, 14 bp, Homo sapiens
gccctctgtcctga

SEQ ID NO: 1884449 - DNA, 20 bp, Homo sapiens
gccctgagctttccggggag

SEQ ID NO: 1884450 - DNA, 16 bp, Homo sapiens
gccctgcactgtcctg

SEQ ID NO: 1884451 - DNA, 17 bp, Homo sapiens
gccctgcactgtcctgc

SEQ ID NO: 1884452 - DNA, 18 bp, Homo sapiens
gccctgcactgtcctgct

SEQ ID NO: 1884453 - DNA, 22 bp, Homo sapiens
gccctgcactgtcctgctccac

SEQ ID NO: 1884454 - DNA, 14 bp, Homo sapiens
gccctgcaggaggc

SEQ ID NO: 1884455 - DNA, 22 bp, Homo sapiens
gccctgcaggaggcctgggagg

SEQ ID NO: 1884456 - DNA, 11 bp, Homo sapiens
gccctggctcc

SEQ ID NO: 1884457 - DNA, 13 bp, Homo sapiens
gccctggctccca

SEQ ID NO: 1884458 - DNA, 12 bp, Homo sapiens
gccctgggccag

SEQ ID NO: 1884459 - DNA, 20 bp, Homo sapiens
gccctggggagtgagcttgg

SEQ ID NO: 1884460 - DNA, 12 bp, Homo sapiens
gcccttccctct

SEQ ID NO: 1884461 - DNA, 15 bp, Homo sapiens
gcccttccctctgtt

SEQ ID NO: 1884462 - DNA, 14 bp, Homo sapiens
gccgccgcctcgcc

SEQ ID NO: 1884463 - DNA, 16 bp, Homo sapiens
gccgcctcgcccaccg

SEQ ID NO: 1884464 - DNA, 18 bp, Homo sapiens
gccggccaggtgggcggg

SEQ ID NO: 1884465 - DNA, 13 bp, Homo sapiens
gccgggcctggac

SEQ ID NO: 1884466 - DNA, 16 bp, Homo sapiens
gcctatcagtgtgccc

SEQ ID NO: 1884467 - DNA, 19 bp, Homo sapiens
gcctatcagtgtgcccccc

SEQ ID NO: 1884468 - DNA, 15 bp, Homo sapiens
gcctcactttcttct

SEQ ID NO: 1884469 - DNA, 14 bp, Homo sapiens
gcctccactcccac

SEQ ID NO: 1884470 - DNA, 22 bp, Homo sapiens
gcctccactcccacttccctga

SEQ ID NO: 1884471 - DNA, 16 bp, Homo sapiens
gcctcccacagtgact

SEQ ID NO: 1884472 - DNA, 23 bp, Homo sapiens
gcctcccacagtgactcgggctc

SEQ ID NO: 1884473 - DNA, 16 bp, Homo sapiens
gcctccctggtccctt

SEQ ID NO: 1884474 - DNA, 20 bp, Homo sapiens
gcctcgcccaccgcatgccc

SEQ ID NO: 1884475 - DNA, 14 bp, Homo sapiens
gcctcgcctggcct

SEQ ID NO: 1884476 - DNA, 15 bp, Homo sapiens
gcctcggctcctgct

SEQ ID NO: 1884477 - DNA, 16 bp, Homo sapiens
gcctcggctcctgctg

SEQ ID NO: 1884478 - DNA, 17 bp, Homo sapiens
gcctcggctcctgctgc

SEQ ID NO: 1884479 - DNA, 12 bp, Homo sapiens
gcctctgtgtca

SEQ ID NO: 1884480 - DNA, 15 bp, Homo sapiens
gcctctgtgtcactg

SEQ ID NO: 1884481 - DNA, 20 bp, Homo sapiens
gcctctgtgtcactggctgc

SEQ ID NO: 1884482 - DNA, 15 bp, Homo sapiens
gcctcttagatgcag

SEQ ID NO: 1884483 - DNA, 14 bp, Homo sapiens
gcctgactcccatg

SEQ ID NO: 1884484 - DNA, 15 bp, Homo sapiens
gcctgactcccatgc

SEQ ID NO: 1884485 - DNA, 21 bp, Homo sapiens
gcctgaggtctcgctgatgct

SEQ ID NO: 1884486 - DNA, 19 bp, Homo sapiens
gcctgccccagctgggctg

SEQ ID NO: 1884487 - DNA, 22 bp, Homo sapiens
gcctgcccgttgccgggcctgg

SEQ ID NO: 1884488 - DNA, 23 bp, Homo sapiens
gcctggactgtcctaggtgaccc

SEQ ID NO: 1884489 - DNA, 16 bp, Homo sapiens
gcctggagcccctgtg

SEQ ID NO: 1884490 - DNA, 17 bp, Homo sapiens
gcctggagcccctgtgt

SEQ ID NO: 1884491 - DNA, 23 bp, Homo sapiens
gcctggagcccctgtgtgggagg

SEQ ID NO: 1884492 - DNA, 18 bp, Homo sapiens
gcctggagcccctgtgtt

SEQ ID NO: 1884493 - DNA, 14 bp, Homo sapiens
gcctggcacagtgt

SEQ ID NO: 1884494 - DNA, 21 bp, Homo sapiens
gcctggcacagtgtctgggct

SEQ ID NO: 1884495 - DNA, 12 bp, Homo sapiens
gcctggcccagc

SEQ ID NO: 1884496 - DNA, 13 bp, Homo sapiens
gcctggcccagct

SEQ ID NO: 1884497 - DNA, 23 bp, Homo sapiens
gcctgggtggcagagtgagactc

SEQ ID NO: 1884498 - DNA, 15 bp, Homo sapiens
gcctgttctgtagga

SEQ ID NO: 1884499 - DNA, 23 bp, Homo sapiens
gcctgttctgtaggagagactgg

SEQ ID NO: 1884500 - DNA, 16 bp, Homo sapiens
gccttctcactagctg

SEQ ID NO: 1884501 - DNA, 17 bp, Homo sapiens
gccttctcccccccggg

SEQ ID NO: 1884502 - DNA, 17 bp, Homo sapiens
gcctttcttctctccag

SEQ ID NO: 1884503 - DNA, 17 bp, Homo sapiens
gcgaccccatctgccca

SEQ ID NO: 1884504 - DNA, 18 bp, Homo sapiens
gcgaccccatctgcccag

SEQ ID NO: 1884505 - DNA, 20 bp, Homo sapiens
gcgaccccatctgcccagga

SEQ ID NO: 1884506 - DNA, 14 bp, Homo sapiens
gcgaggcgggggag

SEQ ID NO: 1884507 - DNA, 21 bp, Homo sapiens
gcgaggcgggggagcctggag

SEQ ID NO: 1884508 - DNA, 22 bp, Homo sapiens
gcgaggcgggggagcctggagc

SEQ ID NO: 1884509 - DNA, 10 bp, Homo sapiens
gcgagggagg

SEQ ID NO: 1884510 - DNA, 13 bp, Homo sapiens
gcgcaccctcccc

SEQ ID NO: 1884511 - DNA, 21 bp, Homo sapiens
gcgcaccctcccctcccgtct

SEQ ID NO: 1884512 - DNA, 13 bp, Homo sapiens
gcgccctctgtcc

SEQ ID NO: 1884513 - DNA, 14 bp, Homo sapiens
gcgccctctgtcct

SEQ ID NO: 1884514 - DNA, 15 bp, Homo sapiens
gcgccctctgtcctg

SEQ ID NO: 1884515 - DNA, 16 bp, Homo sapiens
gcgccctctgtcctga

SEQ ID NO: 1884516 - DNA, 13 bp, Homo sapiens
gcgccttctcccc

SEQ ID NO: 1884517 - DNA, 19 bp, Homo sapiens
gcgctgcctgtgtggtgtc

SEQ ID NO: 1884518 - DNA, 15 bp, Homo sapiens
gcgggcagcacagca

SEQ ID NO: 1884519 - DNA, 16 bp, Homo sapiens
gcggtaggtgctggcc

SEQ ID NO: 1884520 - DNA, 17 bp, Homo sapiens
gcggtgaggcaggggag

SEQ ID NO: 1884521 - DNA, 13 bp, Homo sapiens
gctaccctccctg

SEQ ID NO: 1884522 - DNA, 14 bp, Homo sapiens
gctagatgtatgta

SEQ ID NO: 1884523 - DNA, 16 bp, Homo sapiens
gctagatgtatgtact

SEQ ID NO: 1884524 - DNA, 15 bp, Homo sapiens
gctaggggctggggc

SEQ ID NO: 1884525 - DNA, 14 bp, Homo sapiens
gctagggtgcctgc

SEQ ID NO: 1884526 - DNA, 22 bp, Homo sapiens
gctatattttcatgacttttcc

SEQ ID NO: 1884527 - DNA, 23 bp, Homo sapiens
gctatattttcatgacttttcca

SEQ ID NO: 1884528 - DNA, 19 bp, Homo sapiens
gctcaggatattcactctg

SEQ ID NO: 1884529 - DNA, 18 bp, Homo sapiens
gctcagggaccacagcaa

SEQ ID NO: 1884530 - DNA, 13 bp, Homo sapiens
gctccaaaccctc

SEQ ID NO: 1884531 - DNA, 15 bp, Homo sapiens
gctccacgccctggg

SEQ ID NO: 1884532 - DNA, 23 bp, Homo sapiens
gctccacgccctggggagtgagc

SEQ ID NO: 1884533 - DNA, 18 bp, Homo sapiens
gctcccagtgtcttcctg

SEQ ID NO: 1884534 - DNA, 20 bp, Homo sapiens
gctcccagtgtcttcctgtg

SEQ ID NO: 1884535 - DNA, 22 bp, Homo sapiens
gctcccagtgtcttcctgtggg

SEQ ID NO: 1884536 - DNA, 21 bp, Homo sapiens
gctcccccgggaggggcccgc

SEQ ID NO: 1884537 - DNA, 15 bp, Homo sapiens
gctctccttgccctg

SEQ ID NO: 1884538 - DNA, 19 bp, Homo sapiens
gctctccttgccctgggcc

SEQ ID NO: 1884539 - DNA, 20 bp, Homo sapiens
gctctgagacggatggaagg

SEQ ID NO: 1884540 - DNA, 21 bp, Homo sapiens
gctctgagacggatggaagga

SEQ ID NO: 1884541 - DNA, 18 bp, Homo sapiens
gctctgttgcaggtgtcc

SEQ ID NO: 1884542 - DNA, 14 bp, Homo sapiens
gctgacagtcctct

SEQ ID NO: 1884543 - DNA, 19 bp, Homo sapiens
gctgagactgcagaggagc

SEQ ID NO: 1884544 - DNA, 20 bp, Homo sapiens
gctgagactgcagaggagcc

SEQ ID NO: 1884545 - DNA, 14 bp, Homo sapiens
gctgagcacagaga

SEQ ID NO: 1884546 - DNA, 16 bp, Homo sapiens
gctgagctacctgggg

SEQ ID NO: 1884547 - DNA, 20 bp, Homo sapiens
gctgcaccaacccagccgct

SEQ ID NO: 1884548 - DNA, 21 bp, Homo sapiens
gctgcaccaacccagccgctg

SEQ ID NO: 1884549 - DNA, 16 bp, Homo sapiens
gctgcactctgtgccc

SEQ ID NO: 1884550 - DNA, 19 bp, Homo sapiens
gctgcactctgtgcccatg

SEQ ID NO: 1884551 - DNA, 23 bp, Homo sapiens
gctgcactctgtgcccatgggca

SEQ ID NO: 1884552 - DNA, 19 bp, Homo sapiens
gctgcagaggggcaggccc

SEQ ID NO: 1884553 - DNA, 20 bp, Homo sapiens
gctgcagaggggcaggccct

SEQ ID NO: 1884554 - DNA, 23 bp, Homo sapiens
gctgcagaggggcaggccctgca

SEQ ID NO: 1884555 - DNA, 18 bp, Homo sapiens
gctgcagcaggcagagga

SEQ ID NO: 1884556 - DNA, 18 bp, Homo sapiens
gctgcagtatgaaaataa

SEQ ID NO: 1884557 - DNA, 17 bp, Homo sapiens
gctgcccggcgccctct

SEQ ID NO: 1884558 - DNA, 19 bp, Homo sapiens
gctgcccggcgccctctgt

SEQ ID NO: 1884559 - DNA, 14 bp, Homo sapiens
gctgcctccactcc

SEQ ID NO: 1884560 - DNA, 18 bp, Homo sapiens
gctgcctccactcccact

SEQ ID NO: 1884561 - DNA, 23 bp, Homo sapiens
ggagtgctggctccacgccctgg

SEQ ID NO: 1884562 - DNA, 22 bp, Homo sapiens
ggatctttggacagaagcagct

SEQ ID NO: 1884563 - DNA, 21 bp, Homo sapiens
ggatttgaggagcagcttcag

SEQ ID NO: 1884564 - DNA, 18 bp, Homo sapiens
ggcaaggtgggggagcct

SEQ ID NO: 1884565 - DNA, 19 bp, Homo sapiens
ggcacagtgtctgggctga

SEQ ID NO: 1884566 - DNA, 12 bp, Homo sapiens
ggcactgctggg

SEQ ID NO: 1884567 - DNA, 15 bp, Homo sapiens
ggcactgctgggtgg

SEQ ID NO: 1884568 - DNA, 16 bp, Homo sapiens
ggcagatcacaaggtc

SEQ ID NO: 1884569 - DNA, 19 bp, Homo sapiens
ggcagcaggtgctgctacc

SEQ ID NO: 1884570 - DNA, 19 bp, Homo sapiens
ggcaggaatcaaggagcct

SEQ ID NO: 1884571 - DNA, 20 bp, Homo sapiens
ggcaggaatcaaggagcctc

SEQ ID NO: 1884572 - DNA, 13 bp, Homo sapiens
ggcaggcacagca

SEQ ID NO: 1884573 - DNA, 20 bp, Homo sapiens
ggcaggcagatcacaaggtc

SEQ ID NO: 1884574 - DNA, 15 bp, Homo sapiens
ggcaggggagtctgc

SEQ ID NO: 1884575 - DNA, 20 bp, Homo sapiens
ggcagtgggtcccacttccc

SEQ ID NO: 1884576 - DNA, 16 bp, Homo sapiens
ggcatgggggaggctc

SEQ ID NO: 1884577 - DNA, 19 bp, Homo sapiens
ggcattggcagcaggtgct

SEQ ID NO: 1884578 - DNA, 13 bp, Homo sapiens
ggccaaataaagt

SEQ ID NO: 1884579 - DNA, 17 bp, Homo sapiens
ggccaaataaagtctct

SEQ ID NO: 1884580 - DNA, 12 bp, Homo sapiens
ggccaccagctc

SEQ ID NO: 1884581 - DNA, 22 bp, Homo sapiens
ggccaccagctccactggcctg

SEQ ID NO: 1884582 - DNA, 23 bp, Homo sapiens
ggccaccagctccactggcctgc

SEQ ID NO: 1884583 - DNA, 15 bp, Homo sapiens
ggccagaggcagcta

SEQ ID NO: 1884584 - DNA, 13 bp, Homo sapiens
ggccagcccagga

SEQ ID NO: 1884585 - DNA, 18 bp, Homo sapiens
ggccagccccacagccca

SEQ ID NO: 1884586 - DNA, 19 bp, Homo sapiens
ggccatcttccaggtgggg

SEQ ID NO: 1884587 - DNA, 13 bp, Homo sapiens
ggccccagcctgg

SEQ ID NO: 1884588 - DNA, 16 bp, Homo sapiens
ggccccctccctggat

SEQ ID NO: 1884589 - DNA, 17 bp, Homo sapiens
ggccccctccctggatg

SEQ ID NO: 1884590 - DNA, 17 bp, Homo sapiens
ggcccgcttgcctcggc

SEQ ID NO: 1884591 - DNA, 15 bp, Homo sapiens
ggcccggatccagga

SEQ ID NO: 1884592 - DNA, 17 bp, Homo sapiens
ggcccgttgtctccctg

SEQ ID NO: 1884593 - DNA, 18 bp, Homo sapiens
ggcccgttgtctccctgg

SEQ ID NO: 1884594 - DNA, 20 bp, Homo sapiens
ggcccgttgtctccctggcc

SEQ ID NO: 1884595 - DNA, 22 bp, Homo sapiens
ggcccgttgtctccctggccct

SEQ ID NO: 1884596 - DNA, 18 bp, Homo sapiens
ggccctcaaggcctccca

SEQ ID NO: 1884597 - DNA, 14 bp, Homo sapiens
ggccctgcactgtc

SEQ ID NO: 1884598 - DNA, 18 bp, Homo sapiens
ggccctgcactgtcctgc

SEQ ID NO: 1884599 - DNA, 19 bp, Homo sapiens
ggccctgcactgtcctgct

SEQ ID NO: 1884600 - DNA, 22 bp, Homo sapiens
ggccctgcactgtcctgctcca

SEQ ID NO: 1884601 - DNA, 19 bp, Homo sapiens
ggccctgcaggaggcctgg

SEQ ID NO: 1884602 - DNA, 22 bp, Homo sapiens
ggccgggaccccgagcctggct

SEQ ID NO: 1884603 - DNA, 20 bp, Homo sapiens
ggcctatcagtgtgcccccc

SEQ ID NO: 1884604 - DNA, 11 bp, Homo sapiens
ggcctcccaca

SEQ ID NO: 1884605 - DNA, 17 bp, Homo sapiens
ggcctcgcctggcctga

SEQ ID NO: 1884606 - DNA, 16 bp, Homo sapiens
ggcctgatggagagga

SEQ ID NO: 1884607 - DNA, 12 bp, Homo sapiens
ggcctggcacag

SEQ ID NO: 1884608 - DNA, 12 bp, Homo sapiens
ggcctgggaggg

SEQ ID NO: 1884609 - DNA, 19 bp, Homo sapiens
ggcctgttctgtaggagag

SEQ ID NO: 1884610 - DNA, 23 bp, Homo sapiens
ggcctgttctgtaggagagactg

SEQ ID NO: 1884611 - DNA, 14 bp, Homo sapiens
ggccttgctgtcat

SEQ ID NO: 1884612 - DNA, 14 bp, Homo sapiens
ggcgagaggagggg

SEQ ID NO: 1884613 - DNA, 17 bp, Homo sapiens
ggcgaggcgggggagcc

SEQ ID NO: 1884614 - DNA, 12 bp, Homo sapiens
ggcgagggaggg

SEQ ID NO: 1884615 - DNA, 15 bp, Homo sapiens
ggcgagggaggggag

SEQ ID NO: 1884616 - DNA, 15 bp, Homo sapiens
ggcgccccctggtgg

SEQ ID NO: 1884617 - DNA, 17 bp, Homo sapiens
ggcgccctctgtcctga

SEQ ID NO: 1884618 - DNA, 21 bp, Homo sapiens
ggcggaggttgcagtgagccg

SEQ ID NO: 1884619 - DNA, 15 bp, Homo sapiens
ggcggggctggaggt

SEQ ID NO: 1884620 - DNA, 13 bp, Homo sapiens
ggctaggggctgg

SEQ ID NO: 1884621 - DNA, 13 bp, Homo sapiens
ggctatttaaaag

SEQ ID NO: 1884622 - DNA, 16 bp, Homo sapiens
ggctcagggaccacag

SEQ ID NO: 1884623 - DNA, 17 bp, Homo sapiens
ggctccaaaccctcgag

SEQ ID NO: 1884624 - DNA, 17 bp, Homo sapiens
ggctccacgccctgggg

SEQ ID NO: 1884625 - DNA, 17 bp, Homo sapiens
ggctccagttgaacact

SEQ ID NO: 1884626 - DNA, 13 bp, Homo sapiens
ggctcctgctgca

SEQ ID NO: 1884627 - DNA, 15 bp, Homo sapiens
ggctcctgctgcacc

SEQ ID NO: 1884628 - DNA, 16 bp, Homo sapiens
ggctcctgctgcacca

SEQ ID NO: 1884629 - DNA, 22 bp, Homo sapiens
ggctcctgctgcaccaacccag

SEQ ID NO: 1884630 - DNA, 12 bp, Homo sapiens
ggctctgtgggc

SEQ ID NO: 1884631 - DNA, 18 bp, Homo sapiens
ggctctgtgggctgcact

SEQ ID NO: 1884632 - DNA, 21 bp, Homo sapiens
ggctgagactgcagaggagcc

SEQ ID NO: 1884633 - DNA, 19 bp, Homo sapiens
ggctgagtttgcacagtgg

SEQ ID NO: 1884634 - DNA, 15 bp, Homo sapiens
ggctgcactctgtgc

SEQ ID NO: 1884635 - DNA, 18 bp, Homo sapiens
ggctgcactctgtgccca

SEQ ID NO: 1884636 - DNA, 15 bp, Homo sapiens
ggctgcagcaggcag

SEQ ID NO: 1884637 - DNA, 13 bp, Homo sapiens
ggctgcccgctcc

SEQ ID NO: 1884638 - DNA, 14 bp, Homo sapiens
ggctgcccgctccc

SEQ ID NO: 1884639 - DNA, 21 bp, Homo sapiens
ggctgcccgctcccagtgtct

SEQ ID NO: 1884640 - DNA, 16 bp, Homo sapiens
ggctgctggaggggac

SEQ ID NO: 1884641 - DNA, 11 bp, Homo sapiens
ggctggccagc

SEQ ID NO: 1884642 - DNA, 12 bp, Homo sapiens
ggctggccagcc

SEQ ID NO: 1884643 - DNA, 17 bp, Homo sapiens
ggctggccagccccaca

SEQ ID NO: 1884644 - DNA, 13 bp, Homo sapiens
ggctgggagaagg

SEQ ID NO: 1884645 - DNA, 18 bp, Homo sapiens
ggctgggagaaggtgctt

SEQ ID NO: 1884646 - DNA, 12 bp, Homo sapiens
ggctgggcaggt

SEQ ID NO: 1884647 - DNA, 20 bp, Homo sapiens
ggctggggcctatcagtgtg

SEQ ID NO: 1884648 - DNA, 19 bp, Homo sapiens
ggctggggcggggctggag

SEQ ID NO: 1884649 - DNA, 20 bp, Homo sapiens
ggctggggcggggctggagg

SEQ ID NO: 1884650 - DNA, 18 bp, Homo sapiens
ggctgggggcatggggga

SEQ ID NO: 1884651 - DNA, 19 bp, Homo sapiens
ggctgggggcatgggggag

SEQ ID NO: 1884652 - DNA, 21 bp, Homo sapiens
ggctgggggcatgggggaggc

SEQ ID NO: 1884653 - DNA, 14 bp, Homo sapiens
ggctgggtgcgacc

SEQ ID NO: 1884654 - DNA, 19 bp, Homo sapiens
ggctgggttggcgcaccct

SEQ ID NO: 1884655 - DNA, 19 bp, Homo sapiens
ggctgggttttcaggggct

SEQ ID NO: 1884656 - DNA, 11 bp, Homo sapiens
ggctgtccagt

SEQ ID NO: 1884657 - DNA, 16 bp, Homo sapiens
ggctgtccagtgccca

SEQ ID NO: 1884658 - DNA, 19 bp, Homo sapiens
ggcttgctgatggctgctg

SEQ ID NO: 1884659 - DNA, 20 bp, Homo sapiens
ggcttgctgatggctgctgg

SEQ ID NO: 1884660 - DNA, 15 bp, Homo sapiens
gggaacatggtcacc

SEQ ID NO: 1884661 - DNA, 16 bp, Homo sapiens
gggaagagcacagccc

SEQ ID NO: 1884662 - DNA, 18 bp, Homo sapiens
gggaagagcacagccctc

SEQ ID NO: 1884663 - DNA, 20 bp, Homo sapiens
gggaagctgtagaggaccag

SEQ ID NO: 1884664 - DNA, 14 bp, Homo sapiens
gggaattgaggaca

SEQ ID NO: 1884665 - DNA, 12 bp, Homo sapiens
gggaggagcctt

SEQ ID NO: 1884666 - DNA, 16 bp, Homo sapiens
gggaggctgagactgc

SEQ ID NO: 1884667 - DNA, 23 bp, Homo sapiens
gggatcctctctccaggccccag

SEQ ID NO: 1884668 - DNA, 17 bp, Homo sapiens
gggatcctggagcccct

SEQ ID NO: 1884669 - DNA, 16 bp, Homo sapiens
gggatgtatttttctt

SEQ ID NO: 1884670 - DNA, 22 bp, Homo sapiens
gggcactgctgggtggcccatc

SEQ ID NO: 1884671 - DNA, 12 bp, Homo sapiens
gggcagcacagc

SEQ ID NO: 1884672 - DNA, 21 bp, Homo sapiens
gggcaggaatcaaggagcctc

SEQ ID NO: 1884673 - DNA, 22 bp, Homo sapiens
gggcaggccctgcactgtcctg

SEQ ID NO: 1884674 - DNA, 23 bp, Homo sapiens
gggcaggccctgcactgtcctgc

SEQ ID NO: 1884675 - DNA, 13 bp, Homo sapiens
gggcaggtcctgg

SEQ ID NO: 1884676 - DNA, 22 bp, Homo sapiens
gggcatgggggaggctctgaag

SEQ ID NO: 1884677 - DNA, 15 bp, Homo sapiens
gggccagcccaggat

SEQ ID NO: 1884678 - DNA, 15 bp, Homo sapiens
gggccatactggcct

SEQ ID NO: 1884679 - DNA, 22 bp, Homo sapiens
gggccatactggcctcgcctgg

SEQ ID NO: 1884680 - DNA, 14 bp, Homo sapiens
tacaaataaacagt

SEQ ID NO: 1884681 - DNA, 15 bp, Homo sapiens
tacaaataaacagtt

SEQ ID NO: 1884682 - DNA, 21 bp, Homo sapiens
tacacaataaagcagtcctgt

SEQ ID NO: 1884683 - DNA, 14 bp, Homo sapiens
tacacctctgggcc

SEQ ID NO: 1884684 - DNA, 14 bp, Homo sapiens
tacactaagagaga

SEQ ID NO: 1884685 - DNA, 19 bp, Homo sapiens
tacagaatagaatacattg

SEQ ID NO: 1884686 - DNA, 18 bp, Homo sapiens
tacagtaaataaattgtt

SEQ ID NO: 1884687 - DNA, 22 bp, Homo sapiens
tacagttcagttcctctttgca

SEQ ID NO: 1884688 - DNA, 18 bp, Homo sapiens
tacatgaattgcatttta

SEQ ID NO: 1884689 - DNA, 20 bp, Homo sapiens
tacatgcatacactctcaaa

SEQ ID NO: 1884690 - DNA, 21 bp, Homo sapiens
tacatgcatacactctcaaag

SEQ ID NO: 1884691 - DNA, 21 bp, Homo sapiens
tacattaaagccctgtgttaa

SEQ ID NO: 1884692 - DNA, 11 bp, Homo sapiens
tacatttgtgt

SEQ ID NO: 1884693 - DNA, 18 bp, Homo sapiens
taccacaatgcagtgcct

SEQ ID NO: 1884694 - DNA, 18 bp, Homo sapiens
taccaccagtctgactgt

SEQ ID NO: 1884695 - DNA, 13 bp, Homo sapiens
tacccccctgaga

SEQ ID NO: 1884696 - DNA, 20 bp, Homo sapiens
tacccccgcccaggctggcc

SEQ ID NO: 1884697 - DNA, 14 bp, Homo sapiens
tacccctcccagct

SEQ ID NO: 1884698 - DNA, 16 bp, Homo sapiens
tacccctcccagctga

SEQ ID NO: 1884699 - DNA, 19 bp, Homo sapiens
tacccctcccagctgacag

SEQ ID NO: 1884700 - DNA, 19 bp, Homo sapiens
taccctacacctctgggcc

SEQ ID NO: 1884701 - DNA, 12 bp, Homo sapiens
taccctccctgc

SEQ ID NO: 1884702 - DNA, 15 bp, Homo sapiens
taccctccctgctgt

SEQ ID NO: 1884703 - DNA, 17 bp, Homo sapiens
taccctccctgctgtcc

SEQ ID NO: 1884704 - DNA, 23 bp, Homo sapiens
taccctccctgctgtcccctctt

SEQ ID NO: 1884705 - DNA, 13 bp, Homo sapiens
tacctatttcctc

SEQ ID NO: 1884706 - DNA, 13 bp, Homo sapiens
tacctgttccatt

SEQ ID NO: 1884707 - DNA, 20 bp, Homo sapiens
tacctgttccattgttgtca

SEQ ID NO: 1884708 - DNA, 18 bp, Homo sapiens
tacgtgggagaggcagaa

SEQ ID NO: 1884709 - DNA, 15 bp, Homo sapiens
tacgtgtatgtttct

SEQ ID NO: 1884710 - DNA, 17 bp, Homo sapiens
tactactgaatctctaa

SEQ ID NO: 1884711 - DNA, 14 bp, Homo sapiens
tactcagaattaag

SEQ ID NO: 1884712 - DNA, 18 bp, Homo sapiens
tactcattccccggggcg

SEQ ID NO: 1884713 - DNA, 11 bp, Homo sapiens
tactctgtgta

SEQ ID NO: 1884714 - DNA, 13 bp, Homo sapiens
tactctgtgtaaa

SEQ ID NO: 1884715 - DNA, 12 bp, Homo sapiens
tactgaggtggt

SEQ ID NO: 1884716 - DNA, 12 bp, Homo sapiens
tactgcagcctc

SEQ ID NO: 1884717 - DNA, 13 bp, Homo sapiens
tactgtaagaaaa

SEQ ID NO: 1884718 - DNA, 14 bp, Homo sapiens
tacttgacctccta

SEQ ID NO: 1884719 - DNA, 14 bp, Homo sapiens
tacttgcagttgtg

SEQ ID NO: 1884720 - DNA, 20 bp, Homo sapiens
tactttgatttttatccatt

SEQ ID NO: 1884721 - DNA, 23 bp, Homo sapiens
tactttgatttttatccatttct

SEQ ID NO: 1884722 - DNA, 22 bp, Homo sapiens
tagaagccccgttataactcct

SEQ ID NO: 1884723 - DNA, 14 bp, Homo sapiens
tagaataaaattgt

SEQ ID NO: 1884724 - DNA, 15 bp, Homo sapiens
tagaataaaattgta

SEQ ID NO: 1884725 - DNA, 19 bp, Homo sapiens
tagaataaaattgtaaaat

SEQ ID NO: 1884726 - DNA, 13 bp, Homo sapiens
tagaatttttaaa

SEQ ID NO: 1884727 - DNA, 13 bp, Homo sapiens
tagacacacatga

SEQ ID NO: 1884728 - DNA, 19 bp, Homo sapiens
tagagatatgcagaaggaa

SEQ ID NO: 1884729 - DNA, 20 bp, Homo sapiens
tagagatatgcagaaggaag

SEQ ID NO: 1884730 - DNA, 15 bp, Homo sapiens
tagaggaagcagcca

SEQ ID NO: 1884731 - DNA, 23 bp, Homo sapiens
tagaggcaacagtgttctgagcc

SEQ ID NO: 1884732 - DNA, 14 bp, Homo sapiens
tagataggccatgg

SEQ ID NO: 1884733 - DNA, 15 bp, Homo sapiens
tagatgcagttctga

SEQ ID NO: 1884734 - DNA, 21 bp, Homo sapiens
tagatgcagttctgaagaaga

SEQ ID NO: 1884735 - DNA, 16 bp, Homo sapiens
tagatgtatgtacttc

SEQ ID NO: 1884736 - DNA, 19 bp, Homo sapiens
tagattttttttaaagttt

SEQ ID NO: 1884737 - DNA, 21 bp, Homo sapiens
tagcaagacctgaaaatatgt

SEQ ID NO: 1884738 - DNA, 23 bp, Homo sapiens
tagcagactttcccaaatgtatt

SEQ ID NO: 1884739 - DNA, 20 bp, Homo sapiens
tagctctgagccctccttct

SEQ ID NO: 1884740 - DNA, 19 bp, Homo sapiens
tagctctgaggagtacccc

SEQ ID NO: 1884741 - DNA, 14 bp, Homo sapiens
tagctggctgtact

SEQ ID NO: 1884742 - DNA, 15 bp, Homo sapiens
taggcagggatttga

SEQ ID NO: 1884743 - DNA, 19 bp, Homo sapiens
tagggatctggggaaggac

SEQ ID NO: 1884744 - DNA, 14 bp, Homo sapiens
taggtaaataaagc

SEQ ID NO: 1884745 - DNA, 19 bp, Homo sapiens
taggtttgttttttcatgc

SEQ ID NO: 1884746 - DNA, 16 bp, Homo sapiens
tagtatctggctgggt

SEQ ID NO: 1884747 - DNA, 16 bp, Homo sapiens
tagtatttctatgaaa

SEQ ID NO: 1884748 - DNA, 13 bp, Homo sapiens
tagtcaaattgtg

SEQ ID NO: 1884749 - DNA, 22 bp, Homo sapiens
tagtctgtgtaactttaaacat

SEQ ID NO: 1884750 - DNA, 22 bp, Homo sapiens
tagtgaaactcgttaatttgta

SEQ ID NO: 1884751 - DNA, 16 bp, Homo sapiens
tagtgatttcctgtat

SEQ ID NO: 1884752 - DNA, 21 bp, Homo sapiens
tagttattgttttatgttcta

SEQ ID NO: 1884753 - DNA, 15 bp, Homo sapiens
tagttttatatgctt

SEQ ID NO: 1884754 - DNA, 16 bp, Homo sapiens
tagttttatatgcttc

SEQ ID NO: 1884755 - DNA, 21 bp, Homo sapiens
tataaaataatttttatattt

SEQ ID NO: 1884756 - DNA, 19 bp, Homo sapiens
tataaaggaccctgtttct

SEQ ID NO: 1884757 - DNA, 20 bp, Homo sapiens
tataaaggaccctgtttctg

SEQ ID NO: 1884758 - DNA, 18 bp, Homo sapiens
tataagccctgcataatg

SEQ ID NO: 1884759 - DNA, 15 bp, Homo sapiens
tataatttaacagtg

SEQ ID NO: 1884760 - DNA, 17 bp, Homo sapiens
tatagagatatgcagaa

SEQ ID NO: 1884761 - DNA, 13 bp, Homo sapiens
tatagatcagcca

SEQ ID NO: 1884762 - DNA, 13 bp, Homo sapiens
tatagtgtaataa

SEQ ID NO: 1884763 - DNA, 18 bp, Homo sapiens
tatagtgtaataatgtta

SEQ ID NO: 1884764 - DNA, 12 bp, Homo sapiens
tatataaacact

SEQ ID NO: 1884765 - DNA, 16 bp, Homo sapiens
tatatattttaagcct

SEQ ID NO: 1884766 - DNA, 15 bp, Homo sapiens
tatattgtttgctaa

SEQ ID NO: 1884767 - DNA, 15 bp, Homo sapiens
tatatttattactgt

SEQ ID NO: 1884768 - DNA, 23 bp, Homo sapiens
tatattttcatgacttttccatg

SEQ ID NO: 1884769 - DNA, 24 bp, Homo sapiens
tatattttcatgacttttccatgt

SEQ ID NO: 1884770 - DNA, 13 bp, Homo sapiens
tatattttgattt

SEQ ID NO: 1884771 - DNA, 17 bp, Homo sapiens
tatattttgattttaca

SEQ ID NO: 1884772 - DNA, 18 bp, Homo sapiens
tatattttgattttacat

SEQ ID NO: 1884773 - DNA, 15 bp, Homo sapiens
tatcagtgtgccccc

SEQ ID NO: 1884774 - DNA, 14 bp, Homo sapiens
tatcattccaaagg

SEQ ID NO: 1884775 - DNA, 15 bp, Homo sapiens
tatccatttctttta

SEQ ID NO: 1884776 - DNA, 17 bp, Homo sapiens
tatccatttcttttact

SEQ ID NO: 1884777 - DNA, 20 bp, Homo sapiens
tatccatttcttttactctg

SEQ ID NO: 1884778 - DNA, 18 bp, Homo sapiens
tatcgcttcatgtaacta

SEQ ID NO: 1884779 - DNA, 13 bp, Homo sapiens
tatctaatcatga

SEQ ID NO: 1884780 - DNA, 17 bp, Homo sapiens
tatctagtttaattaat

SEQ ID NO: 1884781 - DNA, 22 bp, Homo sapiens
tatctagtttaattaatctgta

SEQ ID NO: 1884782 - DNA, 21 bp, Homo sapiens
tatgaaatattatgttaaaac

SEQ ID NO: 1884783 - DNA, 17 bp, Homo sapiens
tatgaattacatttgta

SEQ ID NO: 1884784 - DNA, 14 bp, Homo sapiens
tatgcattttcttc

SEQ ID NO: 1884785 - DNA, 19 bp, Homo sapiens
tatgcattttcttcacagt

SEQ ID NO: 1884786 - DNA, 15 bp, Homo sapiens
tatgccccattcaac

SEQ ID NO: 1884787 - DNA, 17 bp, Homo sapiens
tatgtacttcatgctgt

SEQ ID NO: 1884788 - DNA, 12 bp, Homo sapiens
tatgtctaaaga

SEQ ID NO: 1884789 - DNA, 12 bp, Homo sapiens
tatgttaaaact

SEQ ID NO: 1884790 - DNA, 16 bp, Homo sapiens
tatgtttcttctttct

SEQ ID NO: 1884791 - DNA, 22 bp, Homo sapiens
tatgttttgacatttttagttt

SEQ ID NO: 1884792 - DNA, 15 bp, Homo sapiens
tattagaataccaca

SEQ ID NO: 1884793 - DNA, 17 bp, Homo sapiens
tattaggggtaatatat

SEQ ID NO: 1884794 - DNA, 18 bp, Homo sapiens
tattaggggtaatatatt

SEQ ID NO: 1884795 - DNA, 21 bp, Homo sapiens
tattcagagttagatattatt

SEQ ID NO: 1884796 - DNA, 19 bp, Homo sapiens
tattcagctttagtagata

SEQ ID NO: 1884797 - DNA, 16 bp, Homo sapiens
tattcttatgcagggt

SEQ ID NO: 1884798 - DNA, 18 bp, Homo sapiens
tattgattacaaataaac

SEQ ID NO: 1884799 - DNA, 19 bp, Homo sapiens
tgcagctgagagaaaataa

SEQ ID NO: 1884800 - DNA, 13 bp, Homo sapiens
tgcagcttgcagt

SEQ ID NO: 1884801 - DNA, 15 bp, Homo sapiens
tgcagcttgcagtcc

SEQ ID NO: 1884802 - DNA, 18 bp, Homo sapiens
tgcaggaggcctgggagg

SEQ ID NO: 1884803 - DNA, 22 bp, Homo sapiens
tgcaggtttatattgggaagct

SEQ ID NO: 1884804 - DNA, 23 bp, Homo sapiens
tgcaggtttatattgggaagctg

SEQ ID NO: 1884805 - DNA, 14 bp, Homo sapiens
tgcagtcccagtcc

SEQ ID NO: 1884806 - DNA, 14 bp, Homo sapiens
tgcagttctgaaga

SEQ ID NO: 1884807 - DNA, 15 bp, Homo sapiens
tgcagttctgaagaa

SEQ ID NO: 1884808 - DNA, 19 bp, Homo sapiens
tgcagttctgaagaagatg

SEQ ID NO: 1884809 - DNA, 19 bp, Homo sapiens
tgcatggaatttgtaagtt

SEQ ID NO: 1884810 - DNA, 14 bp, Homo sapiens
tgcattatatttat

SEQ ID NO: 1884811 - DNA, 13 bp, Homo sapiens
tgcattttcttca

SEQ ID NO: 1884812 - DNA, 17 bp, Homo sapiens
tgccaactcgggagcat

SEQ ID NO: 1884813 - DNA, 18 bp, Homo sapiens
tgccaagcctggagcccc

SEQ ID NO: 1884814 - DNA, 22 bp, Homo sapiens
tgccaagcctggagcccctgtg

SEQ ID NO: 1884815 - DNA, 21 bp, Homo sapiens
tgccacaccaagctgtgccac

SEQ ID NO: 1884816 - DNA, 19 bp, Homo sapiens
tgccaccctgggctctgtg

SEQ ID NO: 1884817 - DNA, 22 bp, Homo sapiens
tgccaccctgggctctgtgggc

SEQ ID NO: 1884818 - DNA, 23 bp, Homo sapiens
tgccactcctgacccagccctga

SEQ ID NO: 1884819 - DNA, 16 bp, Homo sapiens
tgccacttcccaggta

SEQ ID NO: 1884820 - DNA, 20 bp, Homo sapiens
tgccagtcgcgctgcctgtg

SEQ ID NO: 1884821 - DNA, 21 bp, Homo sapiens
tgccagtcgcgctgcctgtgt

SEQ ID NO: 1884822 - DNA, 22 bp, Homo sapiens
tgccagtcgcgctgcctgtgtg

SEQ ID NO: 1884823 - DNA, 23 bp, Homo sapiens
tgcccatgggcactgctgggtgg

SEQ ID NO: 1884824 - DNA, 13 bp, Homo sapiens
tgcccgctgtccc

SEQ ID NO: 1884825 - DNA, 19 bp, Homo sapiens
tgcccgctgtcccaggggt

SEQ ID NO: 1884826 - DNA, 15 bp, Homo sapiens
tgcccggcgccctct

SEQ ID NO: 1884827 - DNA, 24 bp, Homo sapiens
tgcccgttgccgggcctggactgt

SEQ ID NO: 1884828 - DNA, 19 bp, Homo sapiens
tgccctgagctttccgggg

SEQ ID NO: 1884829 - DNA, 23 bp, Homo sapiens
tgccctgagctttccggggagga

SEQ ID NO: 1884830 - DNA, 16 bp, Homo sapiens
tgccctgggccagccc

SEQ ID NO: 1884831 - DNA, 20 bp, Homo sapiens
tgccctgggccagcccagga

SEQ ID NO: 1884832 - DNA, 21 bp, Homo sapiens
tgccgccgcctcgcccaccgc

SEQ ID NO: 1884833 - DNA, 14 bp, Homo sapiens
tgccgggcctggac

SEQ ID NO: 1884834 - DNA, 16 bp, Homo sapiens
tgccgggcctggactg

SEQ ID NO: 1884835 - DNA, 21 bp, Homo sapiens
tgccgggcctggactgtccta

SEQ ID NO: 1884836 - DNA, 19 bp, Homo sapiens
tgcctccactcccacttcc

SEQ ID NO: 1884837 - DNA, 15 bp, Homo sapiens
tgcctcggctcctgc

SEQ ID NO: 1884838 - DNA, 17 bp, Homo sapiens
tgcctcggctcctgctg

SEQ ID NO: 1884839 - DNA, 20 bp, Homo sapiens
tgcctcggctcctgctgcac

SEQ ID NO: 1884840 - DNA, 21 bp, Homo sapiens
tgcctcggctcctgctgcacc

SEQ ID NO: 1884841 - DNA, 22 bp, Homo sapiens
tgcctcggctcctgctgcacca

SEQ ID NO: 1884842 - DNA, 19 bp, Homo sapiens
tgcctgactctgtgctgag

SEQ ID NO: 1884843 - DNA, 21 bp, Homo sapiens
tgcctgattcggctgtctcag

SEQ ID NO: 1884844 - DNA, 14 bp, Homo sapiens
tgcctgcctgggaa

SEQ ID NO: 1884845 - DNA, 23 bp, Homo sapiens
tgcctgctctccttgccctgggc

SEQ ID NO: 1884846 - DNA, 15 bp, Homo sapiens
tgccttctcaactcc

SEQ ID NO: 1884847 - DNA, 17 bp, Homo sapiens
tgccttctcaactccaa

SEQ ID NO: 1884848 - DNA, 17 bp, Homo sapiens
tgccttctcactagctg

SEQ ID NO: 1884849 - DNA, 15 bp, Homo sapiens
tgcgaccccatctgc

SEQ ID NO: 1884850 - DNA, 18 bp, Homo sapiens
tgcgaccccatctgccca

SEQ ID NO: 1884851 - DNA, 16 bp, Homo sapiens
tgcggtaggtgctggc

SEQ ID NO: 1884852 - DNA, 17 bp, Homo sapiens
tgcggtaggtgctggcc

SEQ ID NO: 1884853 - DNA, 14 bp, Homo sapiens
tgctaccctccctg

SEQ ID NO: 1884854 - DNA, 17 bp, Homo sapiens
tgctaccctccctgctg

SEQ ID NO: 1884855 - DNA, 19 bp, Homo sapiens
tgctaccctccctgctgtc

SEQ ID NO: 1884856 - DNA, 15 bp, Homo sapiens
tgctagggtgcctgc

SEQ ID NO: 1884857 - DNA, 14 bp, Homo sapiens
tgctagtaattgga

SEQ ID NO: 1884858 - DNA, 13 bp, Homo sapiens
tgctccacagtgt

SEQ ID NO: 1884859 - DNA, 20 bp, Homo sapiens
tgctctatgtgcttgtaaaa

SEQ ID NO: 1884860 - DNA, 18 bp, Homo sapiens
tgctctccttgccctggg

SEQ ID NO: 1884861 - DNA, 20 bp, Homo sapiens
tgctctccttgccctgggcc

SEQ ID NO: 1884862 - DNA, 20 bp, Homo sapiens
tgctgcaccaacccagccgc

SEQ ID NO: 1884863 - DNA, 22 bp, Homo sapiens
tgctgcaccaacccagccgctg

SEQ ID NO: 1884864 - DNA, 21 bp, Homo sapiens
tgctgcagaggggcaggccct

SEQ ID NO: 1884865 - DNA, 14 bp, Homo sapiens
tgctgctaccctcc

SEQ ID NO: 1884866 - DNA, 15 bp, Homo sapiens
tgctgctaccctccc

SEQ ID NO: 1884867 - DNA, 18 bp, Homo sapiens
tgctgctaccctccctgc

SEQ ID NO: 1884868 - DNA, 22 bp, Homo sapiens
tgctgctaccctccctgctgtc

SEQ ID NO: 1884869 - DNA, 16 bp, Homo sapiens
tgctggagtgctggct

SEQ ID NO: 1884870 - DNA, 23 bp, Homo sapiens
tgctggcctcaaacagccacgag

SEQ ID NO: 1884871 - DNA, 19 bp, Homo sapiens
tgctggctccacgccctgg

SEQ ID NO: 1884872 - DNA, 21 bp, Homo sapiens
tgctggctccacgccctgggg

SEQ ID NO: 1884873 - DNA, 22 bp, Homo sapiens
tgctggctccacgccctgggga

SEQ ID NO: 1884874 - DNA, 10 bp, Homo sapiens
tgctgggctg

SEQ ID NO: 1884875 - DNA, 14 bp, Homo sapiens
tgctgggctgggtg

SEQ ID NO: 1884876 - DNA, 15 bp, Homo sapiens
tgctgggctgggtgc

SEQ ID NO: 1884877 - DNA, 15 bp, Homo sapiens
tgctgggtggcccat

SEQ ID NO: 1884878 - DNA, 22 bp, Homo sapiens
tgctgggtggcccatcccccct

SEQ ID NO: 1884879 - DNA, 13 bp, Homo sapiens
tgctgtattttaa

SEQ ID NO: 1884880 - DNA, 10 bp, Homo sapiens
tgctgtcccc

SEQ ID NO: 1884881 - DNA, 17 bp, Homo sapiens
tgctgtcccctcttgcc

SEQ ID NO: 1884882 - DNA, 13 bp, Homo sapiens
tgcttccattatt

SEQ ID NO: 1884883 - DNA, 14 bp, Homo sapiens
tgcttctgttttat

SEQ ID NO: 1884884 - DNA, 13 bp, Homo sapiens
tggaaaggcagct

SEQ ID NO: 1884885 - DNA, 18 bp, Homo sapiens
tggaactaggttttaata

SEQ ID NO: 1884886 - DNA, 12 bp, Homo sapiens
tggaagctctgt

SEQ ID NO: 1884887 - DNA, 15 bp, Homo sapiens
tggaaggagagaggt

SEQ ID NO: 1884888 - DNA, 13 bp, Homo sapiens
tggaccccaggcc

SEQ ID NO: 1884889 - DNA, 18 bp, Homo sapiens
tggacttgaggattttga

SEQ ID NO: 1884890 - DNA, 23 bp, Homo sapiens
tggagatcaccagtgtgtggctt

SEQ ID NO: 1884891 - DNA, 14 bp, Homo sapiens
tggagcccctgtgt

SEQ ID NO: 1884892 - DNA, 14 bp, Homo sapiens
tggagctcgtggaa

SEQ ID NO: 1884893 - DNA, 19 bp, Homo sapiens
tggagctgagctacctggg

SEQ ID NO: 1884894 - DNA, 18 bp, Homo sapiens
tggaggaggtggcttcat

SEQ ID NO: 1884895 - DNA, 18 bp, Homo sapiens
tggaggtggcgccccctg

SEQ ID NO: 1884896 - DNA, 22 bp, Homo sapiens
tggaggtggcgccccctggtgg

SEQ ID NO: 1884897 - DNA, 16 bp, Homo sapiens
tggcaaccagaccatt

SEQ ID NO: 1884898 - DNA, 13 bp, Homo sapiens
tggcagcaggtgc

SEQ ID NO: 1884899 - DNA, 17 bp, Homo sapiens
tggcagcaggtgctgct

SEQ ID NO: 1884900 - DNA, 20 bp, Homo sapiens
tggccaagatcacagtggcc

SEQ ID NO: 1884901 - DNA, 21 bp, Homo sapiens
tggccacttgggtcttccctg

SEQ ID NO: 1884902 - DNA, 12 bp, Homo sapiens
tggccagcccca

SEQ ID NO: 1884903 - DNA, 13 bp, Homo sapiens
tggccagccccac

SEQ ID NO: 1884904 - DNA, 16 bp, Homo sapiens
tggccagccccacagc

SEQ ID NO: 1884905 - DNA, 23 bp, Homo sapiens
tggcccatcagtgtacccccgcc

SEQ ID NO: 1884906 - DNA, 15 bp, Homo sapiens
tggcccatcccccct

SEQ ID NO: 1884907 - DNA, 16 bp, Homo sapiens
tggccccagcctggcc

SEQ ID NO: 1884908 - DNA, 17 bp, Homo sapiens
tggccccagcctggccc

SEQ ID NO: 1884909 - DNA, 20 bp, Homo sapiens
tggccctcaaggcctcccac

SEQ ID NO: 1884910 - DNA, 23 bp, Homo sapiens
tggccctcaaggcctcccacagt

SEQ ID NO: 1884911 - DNA, 15 bp, Homo sapiens
tggcctcgcctggcc

SEQ ID NO: 1884912 - DNA, 16 bp, Homo sapiens
tggcctcgcctggcct

SEQ ID NO: 1884913 - DNA, 16 bp, Homo sapiens
tggcctgactcccatg

SEQ ID NO: 1884914 - DNA, 17 bp, Homo sapiens
tggcgagaggaggggcc

SEQ ID NO: 1884915 - DNA, 16 bp, Homo sapiens
tggctccaaaccctcg

SEQ ID NO: 1884916 - DNA, 18 bp, Homo sapiens
tggctccaaaccctcgag

SEQ ID NO: 1884917 - DNA, 17 bp, Homo sapiens
tttcttgcactgaatat

SEQ ID NO: 1884918 - DNA, 14 bp, Homo sapiens
tttctttcaaaatt

SEQ ID NO: 1884919 - DNA, 10 bp, Homo sapiens
tttgaagtgt

SEQ ID NO: 1884920 - DNA, 22 bp, Homo sapiens
tttgaatgtgattttaaagagt

SEQ ID NO: 1884921 - DNA, 20 bp, Homo sapiens
tttgaggagcagcttcagtt

SEQ ID NO: 1884922 - DNA, 21 bp, Homo sapiens
tttgaggagcagcttcagttg

SEQ ID NO: 1884923 - DNA, 16 bp, Homo sapiens
tttgagtgattatttg

SEQ ID NO: 1884924 - DNA, 22 bp, Homo sapiens
tttgatttttatccatttcttt

SEQ ID NO: 1884925 - DNA, 15 bp, Homo sapiens
tttgcaattcatgta

SEQ ID NO: 1884926 - DNA, 19 bp, Homo sapiens
tttgctaagcattccaact

SEQ ID NO: 1884927 - DNA, 14 bp, Homo sapiens
tttgctggagtgct

SEQ ID NO: 1884928 - DNA, 13 bp, Homo sapiens
tttgcttccatta

SEQ ID NO: 1884929 - DNA, 18 bp, Homo sapiens
tttggtaaggggaattga

SEQ ID NO: 1884930 - DNA, 17 bp, Homo sapiens
tttgtagtgttggagaa

SEQ ID NO: 1884931 - DNA, 13 bp, Homo sapiens
tttgtataaaata

SEQ ID NO: 1884932 - DNA, 16 bp, Homo sapiens
tttgtataaaataatt

SEQ ID NO: 1884933 - DNA, 13 bp, Homo sapiens
tttgtatctgaag

SEQ ID NO: 1884934 - DNA, 16 bp, Homo sapiens
tttgtcgaatttttat

SEQ ID NO: 1884935 - DNA, 17 bp, Homo sapiens
tttgtgaagcaaaattt

SEQ ID NO: 1884936 - DNA, 18 bp, Homo sapiens
tttgttatttgtacagtt

SEQ ID NO: 1884937 - DNA, 15 bp, Homo sapiens
tttgttcttcttaaa

SEQ ID NO: 1884938 - DNA, 14 bp, Homo sapiens
ttttaaaagaatga

SEQ ID NO: 1884939 - DNA, 15 bp, Homo sapiens
ttttaaaagaatgat

SEQ ID NO: 1884940 - DNA, 21 bp, Homo sapiens
ttttaaaagaatgattatgaa

SEQ ID NO: 1884941 - DNA, 16 bp, Homo sapiens
ttttaaaatagaatga

SEQ ID NO: 1884942 - DNA, 18 bp, Homo sapiens
ttttaaatattttttctt

SEQ ID NO: 1884943 - DNA, 18 bp, Homo sapiens
ttttaacatctttgtttt

SEQ ID NO: 1884944 - DNA, 14 bp, Homo sapiens
ttttaataatgttt

SEQ ID NO: 1884945 - DNA, 23 bp, Homo sapiens
ttttacatgctggttacctgttc

SEQ ID NO: 1884946 - DNA, 19 bp, Homo sapiens
ttttatggcactagtattt

SEQ ID NO: 1884947 - DNA, 12 bp, Homo sapiens
ttttattaataa

SEQ ID NO: 1884948 - DNA, 13 bp, Homo sapiens
ttttattatttgt

SEQ ID NO: 1884949 - DNA, 16 bp, Homo sapiens
ttttattttgtaatta

SEQ ID NO: 1884950 - DNA, 15 bp, Homo sapiens
ttttcagcttctgct

SEQ ID NO: 1884951 - DNA, 20 bp, Homo sapiens
ttttcccactgcaccccctc

SEQ ID NO: 1884952 - DNA, 22 bp, Homo sapiens
ttttcccactgcaccccctcct

SEQ ID NO: 1884953 - DNA, 20 bp, Homo sapiens
ttttcctaagtgattgtatg

SEQ ID NO: 1884954 - DNA, 13 bp, Homo sapiens
ttttcctgaaaac

SEQ ID NO: 1884955 - DNA, 14 bp, Homo sapiens
ttttctctaggaaa

SEQ ID NO: 1884956 - DNA, 20 bp, Homo sapiens
ttttggtggttttagtgatt

SEQ ID NO: 1884957 - DNA, 18 bp, Homo sapiens
ttttgtagctgctatata

SEQ ID NO: 1884958 - DNA, 18 bp, Homo sapiens
tttttaaaaaagaaacat

SEQ ID NO: 1884959 - DNA, 20 bp, Homo sapiens
tttttaaagtttgttcactt

SEQ ID NO: 1884960 - DNA, 16 bp, Homo sapiens
tttttaacatctttgt

SEQ ID NO: 1884961 - DNA, 17 bp, Homo sapiens
tttttatatttgaaata

SEQ ID NO: 1884962 - DNA, 19 bp, Homo sapiens
tttttccttttcatctgtt

SEQ ID NO: 1884963 - DNA, 21 bp, Homo sapiens
tttttgtagctgctatatatt

SEQ ID NO: 1884964 - DNA, 11 bp, Homo sapiens
ttttttaacat

SEQ ID NO: 1884965 - DNA, 12 bp, Homo sapiens
tttttttaacat

SEQ ID NO: 1884966 - DNA, 13 bp, Homo sapiens
tttttttgtagct

SEQ ID NO: 1884967 - DNA, 11 bp, Homo sapiens
ggttgcagtga

SEQ ID NO: 1884968 - DNA, 15 bp, Homo sapiens
ggttggcgcaccctc

SEQ ID NO: 1884969 - DNA, 18 bp, Homo sapiens
ggtttatattgggaagct

SEQ ID NO: 1884970 - DNA, 23 bp, Homo sapiens
ggtttctccttgaagcaaatgtg

SEQ ID NO: 1884971 - DNA, 22 bp, Homo sapiens
gtaactctatagttattgtttt

SEQ ID NO: 1884972 - DNA, 12 bp, Homo sapiens
gtaactttaaac

SEQ ID NO: 1884973 - DNA, 13 bp, Homo sapiens
gtaactttaaaca

SEQ ID NO: 1884974 - DNA, 15 bp, Homo sapiens
gtaactttaaacatc

SEQ ID NO: 1884975 - DNA, 22 bp, Homo sapiens
gtaattacctgtcatctgggcc

SEQ ID NO: 1884976 - DNA, 15 bp, Homo sapiens
gtaatttgtatctga

SEQ ID NO: 1884977 - DNA, 16 bp, Homo sapiens
gtacagaaaaatactt

SEQ ID NO: 1884978 - DNA, 13 bp, Homo sapiens
gtacagaatagaa

SEQ ID NO: 1884979 - DNA, 14 bp, Homo sapiens
gtacagttcagttc

SEQ ID NO: 1884980 - DNA, 23 bp, Homo sapiens
gtacagttcagttcctctttgca

SEQ ID NO: 1884981 - DNA, 23 bp, Homo sapiens
gtacccccgcccaggctggccag

SEQ ID NO: 1884982 - DNA, 14 bp, Homo sapiens
gtacgtgggagagg

SEQ ID NO: 1884983 - DNA, 17 bp, Homo sapiens
gtactgaggtggtggac

SEQ ID NO: 1884984 - DNA, 15 bp, Homo sapiens
gtactgccaaggtac

SEQ ID NO: 1884985 - DNA, 16 bp, Homo sapiens
gtagaactgcccattt

SEQ ID NO: 1884986 - DNA, 21 bp, Homo sapiens
gtaggagagactggccagagg

SEQ ID NO: 1884987 - DNA, 16 bp, Homo sapiens
gtaggcgcccctgggg

SEQ ID NO: 1884988 - DNA, 21 bp, Homo sapiens
gtataaaataatttttatatt

SEQ ID NO: 1884989 - DNA, 20 bp, Homo sapiens
gtatccaaaaatagccctgc

SEQ ID NO: 1884990 - DNA, 12 bp, Homo sapiens
gtatctggctgg

SEQ ID NO: 1884991 - DNA, 18 bp, Homo sapiens
gtatgtacttcatgctgt

SEQ ID NO: 1884992 - DNA, 18 bp, Homo sapiens
gtattaagaaaatctatt

SEQ ID NO: 1884993 - DNA, 16 bp, Homo sapiens
gtattgtaaaacattc

SEQ ID NO: 1884994 - DNA, 22 bp, Homo sapiens
gtatttctatgaaatattatgt

SEQ ID NO: 1884995 - DNA, 14 bp, Homo sapiens
gtatttttcttgct

SEQ ID NO: 1884996 - DNA, 14 bp, Homo sapiens
gtcaaagtacagaa

SEQ ID NO: 1884997 - DNA, 16 bp, Homo sapiens
gtcaaattgtgtgaaa

SEQ ID NO: 1884998 - DNA, 15 bp, Homo sapiens
gtcaactccaggact

SEQ ID NO: 1884999 - DNA, 21 bp, Homo sapiens
gtcaataaaatccatacattt

SEQ ID NO: 1885000 - DNA, 22 bp, Homo sapiens
gtcaataaaatccatacatttg

SEQ ID NO: 1885001 - DNA, 18 bp, Homo sapiens
gtcaccggtcagtgcctt

SEQ ID NO: 1885002 - DNA, 16 bp, Homo sapiens
gtcactgacacacacg

SEQ ID NO: 1885003 - DNA, 20 bp, Homo sapiens
gtcactggctgcctccactc

SEQ ID NO: 1885004 - DNA, 23 bp, Homo sapiens
gtcactggctgcctccactccca

SEQ ID NO: 1885005 - DNA, 17 bp, Homo sapiens
gtcagtgccgccgcctc

SEQ ID NO: 1885006 - DNA, 22 bp, Homo sapiens
gtcagtgccgccgcctcgccca

SEQ ID NO: 1885007 - DNA, 23 bp, Homo sapiens
gtcagtgccgccgcctcgcccac

SEQ ID NO: 1885008 - DNA, 14 bp, Homo sapiens
gtcataaattacac

SEQ ID NO: 1885009 - DNA, 14 bp, Homo sapiens
gtcatattcttatg

SEQ ID NO: 1885010 - DNA, 15 bp, Homo sapiens
gtcatgtttaagaaa

SEQ ID NO: 1885011 - DNA, 11 bp, Homo sapiens
gtccagagtca

SEQ ID NO: 1885012 - DNA, 21 bp, Homo sapiens
gtccagagtcaactgttccca

SEQ ID NO: 1885013 - DNA, 12 bp, Homo sapiens
gtccagtgccca

SEQ ID NO: 1885014 - DNA, 17 bp, Homo sapiens
gtcccacttcccctcct

SEQ ID NO: 1885015 - DNA, 21 bp, Homo sapiens
gtcccacttcccctcctaccc

SEQ ID NO: 1885016 - DNA, 18 bp, Homo sapiens
gtcccaggggtctccctg

SEQ ID NO: 1885017 - DNA, 20 bp, Homo sapiens
gtcccaggggtctccctgag

SEQ ID NO: 1885018 - DNA, 23 bp, Homo sapiens
gtcccaggggtctccctgagcct

SEQ ID NO: 1885019 - DNA, 13 bp, Homo sapiens
gtcccctcttgcc

SEQ ID NO: 1885020 - DNA, 23 bp, Homo sapiens
gtcccctcttgccccaaccccca

SEQ ID NO: 1885021 - DNA, 14 bp, Homo sapiens
gtcctacggaggga

SEQ ID NO: 1885022 - DNA, 22 bp, Homo sapiens
gtcctcacatgcccgctgtccc

SEQ ID NO: 1885023 - DNA, 12 bp, Homo sapiens
gtcctctccacc

SEQ ID NO: 1885024 - DNA, 17 bp, Homo sapiens
gtcctgctccacagtgt

SEQ ID NO: 1885025 - DNA, 19 bp, Homo sapiens
gtcctgctccacagtgttg

SEQ ID NO: 1885026 - DNA, 20 bp, Homo sapiens
gtcctggggaggctgagact

SEQ ID NO: 1885027 - DNA, 14 bp, Homo sapiens
gtcctgtcagtgcc

SEQ ID NO: 1885028 - DNA, 16 bp, Homo sapiens
gtcctgtcagtgccgc

SEQ ID NO: 1885029 - DNA, 12 bp, Homo sapiens
gtcgcgctgcct

SEQ ID NO: 1885030 - DNA, 18 bp, Homo sapiens
gtcgcgctgcctgtgtgg

SEQ ID NO: 1885031 - DNA, 19 bp, Homo sapiens
gtcggggggcgagggaggg

SEQ ID NO: 1885032 - DNA, 11 bp, Homo sapiens
gtctaaagttt

SEQ ID NO: 1885033 - DNA, 16 bp, Homo sapiens
gtctaaagtttacagt

SEQ ID NO: 1885034 - DNA, 20 bp, Homo sapiens
gtctactcattccccggggc

SEQ ID NO: 1885035 - DNA, 20 bp, Homo sapiens
gtctagaggcaacagtgttc

SEQ ID NO: 1885036 - DNA, 24 bp, Homo sapiens
gtctcagactctttttgtacctgg

SEQ ID NO: 1885037 - DNA, 16 bp, Homo sapiens
gtctccctggccctca

SEQ ID NO: 1885038 - DNA, 14 bp, Homo sapiens
gtctcctccaccgc

SEQ ID NO: 1885039 - DNA, 21 bp, Homo sapiens
gtctcgctgatgctgggctgg

SEQ ID NO: 1885040 - DNA, 12 bp, Homo sapiens
gtctgatgtttg

SEQ ID NO: 1885041 - DNA, 14 bp, Homo sapiens
gtctgatgtttgtt

SEQ ID NO: 1885042 - DNA, 18 bp, Homo sapiens
gtctgctatattttcatg

SEQ ID NO: 1885043 - DNA, 17 bp, Homo sapiens
gtctgctcgggcccagg

SEQ ID NO: 1885044 - DNA, 10 bp, Homo sapiens
gtctggagct

SEQ ID NO: 1885045 - DNA, 14 bp, Homo sapiens
gtctttaagatctt

SEQ ID NO: 1885046 - DNA, 17 bp, Homo sapiens
gtgaaatgtaacatgaa

SEQ ID NO: 1885047 - DNA, 20 bp, Homo sapiens
gtgaaatgtaacatgaagca

SEQ ID NO: 1885048 - DNA, 15 bp, Homo sapiens
gtgaatatatggtct

SEQ ID NO: 1885049 - DNA, 16 bp, Homo sapiens
gtgacaagctcacaga

SEQ ID NO: 1885050 - DNA, 21 bp, Homo sapiens
gtgaccccatctctgctgctt

SEQ ID NO: 1885051 - DNA, 20 bp, Homo sapiens
gtgaccccttttcagcttct

SEQ ID NO: 1885052 - DNA, 19 bp, Homo sapiens
gtgactcgggctcctgtgc

SEQ ID NO: 1885053 - DNA, 20 bp, Homo sapiens
gtgactcgggctcctgtgcc

SEQ ID NO: 1885054 - DNA, 16 bp, Homo sapiens
gtgagcagtcaggaaa

SEQ ID NO: 1885055 - DNA, 18 bp, Homo sapiens
gtgaggcaggggagtctg

SEQ ID NO: 1885056 - DNA, 17 bp, Homo sapiens
gtgatcttaggtttgtt

SEQ ID NO: 1885057 - DNA, 15 bp, Homo sapiens
gtgcagccccaggac

SEQ ID NO: 1885058 - DNA, 15 bp, Homo sapiens
gtgccagtcgcgctg

SEQ ID NO: 1885059 - DNA, 22 bp, Homo sapiens
gtgccagtcgcgctgcctgtgt

SEQ ID NO: 1885060 - DNA, 21 bp, Homo sapiens
gtgcccatgggcactgctggg

SEQ ID NO: 1885061 - DNA, 13 bp, Homo sapiens
gtgccctggctcc

SEQ ID NO: 1885062 - DNA, 14 bp, Homo sapiens
gtgccctggctccc

SEQ ID NO: 1885063 - DNA, 18 bp, Homo sapiens
gtgccgccgcctcgccca

SEQ ID NO: 1885064 - DNA, 20 bp, Homo sapiens
gtgccgccgcctcgcccacc

SEQ ID NO: 1885065 - DNA, 12 bp, Homo sapiens
gtgcctgactct

SEQ ID NO: 1885066 - DNA, 18 bp, Homo sapiens
gtgcctgactctgtgctg

SEQ ID NO: 1885067 - DNA, 19 bp, Homo sapiens
gtgcctgattcggctgtct

SEQ ID NO: 1885068 - DNA, 21 bp, Homo sapiens
gtgcctgattcggctgtctca

SEQ ID NO: 1885069 - DNA, 21 bp, Homo sapiens
gtgcctgctctccttgccctg

SEQ ID NO: 1885070 - DNA, 17 bp, Homo sapiens
gtgcggtaggtgctggc

SEQ ID NO: 1885071 - DNA, 19 bp, Homo sapiens
gtgcggtaggtgctggcct

SEQ ID NO: 1885072 - DNA, 16 bp, Homo sapiens
gtgctagggtgcctgc

SEQ ID NO: 1885073 - DNA, 15 bp, Homo sapiens
gtgctgctaccctcc

SEQ ID NO: 1885074 - DNA, 17 bp, Homo sapiens
gtgctgctaccctccct

SEQ ID NO: 1885075 - DNA, 21 bp, Homo sapiens
gtgctgctaccctccctgctg

SEQ ID NO: 1885076 - DNA, 22 bp, Homo sapiens
gtgctgctaccctccctgctgt

SEQ ID NO: 1885077 - DNA, 23 bp, Homo sapiens
gtgctgctaccctccctgctgtc

SEQ ID NO: 1885078 - DNA, 11 bp, Homo sapiens
gtgctggctcc

SEQ ID NO: 1885079 - DNA, 20 bp, Homo sapiens
gtgctggctccacgccctgg

SEQ ID NO: 1885080 - DNA, 22 bp, Homo sapiens
gtgctttttccttttcatctgt

SEQ ID NO: 1885081 - DNA, 14 bp, Homo sapiens
gtggacgagggagt

SEQ ID NO: 1885082 - DNA, 16 bp, Homo sapiens
gtggacttagctctga

SEQ ID NO: 1885083 - DNA, 20 bp, Homo sapiens
gtggcccatcccccctcacc

SEQ ID NO: 1885084 - DNA, 17 bp, Homo sapiens
gtggccccagcctggcc

SEQ ID NO: 1885085 - DNA, 20 bp, Homo sapiens
gtggccccagcctggcccag

SEQ ID NO: 1885086 - DNA, 12 bp, Homo sapiens
gtggcttcatgt

SEQ ID NO: 1885087 - DNA, 11 bp, Homo sapiens
cacctctgagg

SEQ ID NO: 1885088 - DNA, 17 bp, Homo sapiens
cacctctgaggactctg

SEQ ID NO: 1885089 - DNA, 12 bp, Homo sapiens
cacctctgggcc

SEQ ID NO: 1885090 - DNA, 16 bp, Homo sapiens
caggggacaggatggt

SEQ ID NO: 1885091 - DNA, 13 bp, Homo sapiens
caggggcaggcac

SEQ ID NO: 1885092 - DNA, 14 bp, Homo sapiens
caggggcaggcaca

SEQ ID NO: 1885093 - DNA, 15 bp, Homo sapiens
caggggcaggcacag

SEQ ID NO: 1885094 - DNA, 17 bp, Homo sapiens
caggggcaggcacagca

SEQ ID NO: 1885095 - DNA, 12 bp, Homo sapiens
caggggctgccc

SEQ ID NO: 1885096 - DNA, 19 bp, Homo sapiens
caggggctgcccgctccca

SEQ ID NO: 1885097 - DNA, 21 bp, Homo sapiens
caggggctttggaagctctgt

SEQ ID NO: 1885098 - DNA, 21 bp, Homo sapiens
caggggtctccctgagcctgc

SEQ ID NO: 1885099 - DNA, 17 bp, Homo sapiens
caggtatagactcctga

SEQ ID NO: 1885100 - DNA, 13 bp, Homo sapiens
caggtgcagtccc

SEQ ID NO: 1885101 - DNA, 15 bp, Homo sapiens
caggtgcagtcccag

SEQ ID NO: 1885102 - DNA, 18 bp, Homo sapiens
caggtgctagggtgcctg

SEQ ID NO: 1885103 - DNA, 23 bp, Homo sapiens
ctatcagtgtgccccccatcctg

SEQ ID NO: 1885104 - DNA, 18 bp, Homo sapiens
ctatgaaatattatgtta

SEQ ID NO: 1885105 - DNA, 19 bp, Homo sapiens
ctatgaaatattatgttaa

SEQ ID NO: 1885106 - DNA, 15 bp, Homo sapiens
ctatgcattttcttc

SEQ ID NO: 1885107 - DNA, 24 bp, Homo sapiens
ctatggacgacctccagctctcag

SEQ ID NO: 1885108 - DNA, 19 bp, Homo sapiens
ctatgttttgacattttta

SEQ ID NO: 1885109 - DNA, 22 bp, Homo sapiens
ctatttgttgatgcttgtgtca

SEQ ID NO: 1885110 - DNA, 19 bp, Homo sapiens
ctatttttttttcttttta

SEQ ID NO: 1885111 - DNA, 14 bp, Homo sapiens
ctcaaagaggcctt

SEQ ID NO: 1885112 - DNA, 23 bp, Homo sapiens
ctcaacccctcccctccatccct

SEQ ID NO: 1885113 - DNA, 15 bp, Homo sapiens
ctcaaggcctcccac

SEQ ID NO: 1885114 - DNA, 19 bp, Homo sapiens
ctcaaggcctcccacagtg

SEQ ID NO: 1885115 - DNA, 17 bp, Homo sapiens
ctcaagtgcaaggacca

SEQ ID NO: 1885116 - DNA, 17 bp, Homo sapiens
ctcacaacagctgcctg

SEQ ID NO: 1885117 - DNA, 14 bp, Homo sapiens
ctcaccaggggcag

SEQ ID NO: 1885118 - DNA, 13 bp, Homo sapiens
ctcactttcttct

SEQ ID NO: 1885119 - DNA, 19 bp, Homo sapiens
ctcagatccccagctttct

SEQ ID NO: 1885120 - DNA, 19 bp, Homo sapiens
ctcaggatattcactctgt

SEQ ID NO: 1885121 - DNA, 15 bp, Homo sapiens
ctcagggaccacagc

SEQ ID NO: 1885122 - DNA, 18 bp, Homo sapiens
ctcagttcccagacagct

SEQ ID NO: 1885123 - DNA, 14 bp, Homo sapiens
ctcatgctggatga

SEQ ID NO: 1885124 - DNA, 13 bp, Homo sapiens
ctcattccccggg

SEQ ID NO: 1885125 - DNA, 15 bp, Homo sapiens
ctccacctagtggct

SEQ ID NO: 1885126 - DNA, 21 bp, Homo sapiens
ctccacctagtggctgtccag

SEQ ID NO: 1885127 - DNA, 23 bp, Homo sapiens
ctccacctagtggctgtccagtg

SEQ ID NO: 1885128 - DNA, 16 bp, Homo sapiens
ctccacgccctgggga

SEQ ID NO: 1885129 - DNA, 14 bp, Homo sapiens
ctccactcccactt

SEQ ID NO: 1885130 - DNA, 12 bp, Homo sapiens
ctccactggcct

SEQ ID NO: 1885131 - DNA, 14 bp, Homo sapiens
ctccactggcctgc

SEQ ID NO: 1885132 - DNA, 15 bp, Homo sapiens
ctccaggacttgctt

SEQ ID NO: 1885133 - DNA, 17 bp, Homo sapiens
ctccaggacttgcttcc

SEQ ID NO: 1885134 - DNA, 23 bp, Homo sapiens
ctccaggacttgcttccaagccc

SEQ ID NO: 1885135 - DNA, 17 bp, Homo sapiens
ctccaggccccaggtca

SEQ ID NO: 1885136 - DNA, 19 bp, Homo sapiens
ctccatccctggccccctc

SEQ ID NO: 1885137 - DNA, 13 bp, Homo sapiens
ctcccaattcatc

SEQ ID NO: 1885138 - DNA, 11 bp, Homo sapiens
ctcccacagtg

SEQ ID NO: 1885139 - DNA, 20 bp, Homo sapiens
ctcccagctgacagtcctct

SEQ ID NO: 1885140 - DNA, 12 bp, Homo sapiens
ctcccagtgtct

SEQ ID NO: 1885141 - DNA, 15 bp, Homo sapiens
ctcccccccggggct

SEQ ID NO: 1885142 - DNA, 19 bp, Homo sapiens
ctcccccccggggctgggt

SEQ ID NO: 1885143 - DNA, 18 bp, Homo sapiens
ctcccccgggaggggccc

SEQ ID NO: 1885144 - DNA, 16 bp, Homo sapiens
ctcccctccatccctg

SEQ ID NO: 1885145 - DNA, 13 bp, Homo sapiens
ctccctgagcctg

SEQ ID NO: 1885146 - DNA, 22 bp, Homo sapiens
ctccctgagcctgccccagctg

SEQ ID NO: 1885147 - DNA, 19 bp, Homo sapiens
ctccctgctgtcccctctt

SEQ ID NO: 1885148 - DNA, 20 bp, Homo sapiens
ctccctgctgtcccctcttg

SEQ ID NO: 1885149 - DNA, 12 bp, Homo sapiens
ctccctggccct

SEQ ID NO: 1885150 - DNA, 13 bp, Homo sapiens
ctccctggccctc

SEQ ID NO: 1885151 - DNA, 15 bp, Homo sapiens
ctccctggccctcaa

SEQ ID NO: 1885152 - DNA, 21 bp, Homo sapiens
ctccgttcccacctctgagga

SEQ ID NO: 1885153 - DNA, 18 bp, Homo sapiens
ctcctacccctcccagct

SEQ ID NO: 1885154 - DNA, 23 bp, Homo sapiens
ctcctacccctcccagctgacag

SEQ ID NO: 1885155 - DNA, 15 bp, Homo sapiens
ctcctccaccgccat

SEQ ID NO: 1885156 - DNA, 16 bp, Homo sapiens
ctcctccaccgccatg

SEQ ID NO: 1885157 - DNA, 23 bp, Homo sapiens
ctcctgacccagccctgaacaaa

SEQ ID NO: 1885158 - DNA, 12 bp, Homo sapiens
ctcctgctgcag

SEQ ID NO: 1885159 - DNA, 16 bp, Homo sapiens
ctcctgctgcagaggg

SEQ ID NO: 1885160 - DNA, 12 bp, Homo sapiens
ctcctgtgccct

SEQ ID NO: 1885161 - DNA, 19 bp, Homo sapiens
ctccttcttgccctgagct

SEQ ID NO: 1885162 - DNA, 18 bp, Homo sapiens
ctccttgaagcaaatgtg

SEQ ID NO: 1885163 - DNA, 14 bp, Homo sapiens
ctccttgccctggg

SEQ ID NO: 1885164 - DNA, 15 bp, Homo sapiens
ctccttgccctgggc

SEQ ID NO: 1885165 - DNA, 16 bp, Homo sapiens
ctcgctgatgctgggc

SEQ ID NO: 1885166 - DNA, 19 bp, Homo sapiens
ctcgctgatgctgggctgg

SEQ ID NO: 1885167 - DNA, 13 bp, Homo sapiens
ctcggctcctgct

SEQ ID NO: 1885168 - DNA, 15 bp, Homo sapiens
ctcggctcctgctgc

SEQ ID NO: 1885169 - DNA, 17 bp, Homo sapiens
ctcggctcctgctgcac

SEQ ID NO: 1885170 - DNA, 14 bp, Homo sapiens
ctcgggcccaggcc

SEQ ID NO: 1885171 - DNA, 24 bp, Homo sapiens
ctcgggcccaggccatcttccagg

SEQ ID NO: 1885172 - DNA, 17 bp, Homo sapiens
ctcgggctcctgtgccc

SEQ ID NO: 1885173 - DNA, 11 bp, Homo sapiens
ctcggtggtac

SEQ ID NO: 1885174 - DNA, 19 bp, Homo sapiens
ctcggtggtaccaggtctc

SEQ ID NO: 1885175 - DNA, 21 bp, Homo sapiens
ctcgtgccagtcgcgctgcct

SEQ ID NO: 1885176 - DNA, 16 bp, Homo sapiens
ctctacactgaaacgt

SEQ ID NO: 1885177 - DNA, 20 bp, Homo sapiens
ctctacactgaaacgtattc

SEQ ID NO: 1885178 - DNA, 14 bp, Homo sapiens
ctctccacctagtg

SEQ ID NO: 1885179 - DNA, 17 bp, Homo sapiens
ctctccacctagtggct

SEQ ID NO: 1885180 - DNA, 23 bp, Homo sapiens
ctctccacctagtggctgtccag

SEQ ID NO: 1885181 - DNA, 13 bp, Homo sapiens
ctctccaggcccc

SEQ ID NO: 1885182 - DNA, 15 bp, Homo sapiens
ctctccttgccctgg

SEQ ID NO: 1885183 - DNA, 22 bp, Homo sapiens
ctctgagacggatggaaggaga

SEQ ID NO: 1885184 - DNA, 15 bp, Homo sapiens
ctctgctatgagtgt

SEQ ID NO: 1885185 - DNA, 21 bp, Homo sapiens
ctctgctatgcattttcttca

SEQ ID NO: 1885186 - DNA, 19 bp, Homo sapiens
ctctgctgcttctgggcct

SEQ ID NO: 1885187 - DNA, 15 bp, Homo sapiens
ctctggtaacctctt

SEQ ID NO: 1885188 - DNA, 11 bp, Homo sapiens
ctctgtcctga

SEQ ID NO: 1885189 - DNA, 15 bp, Homo sapiens
ctctgtgtaaagact

SEQ ID NO: 1885190 - DNA, 23 bp, Homo sapiens
ctctgtgtcactggctgcctcca

SEQ ID NO: 1885191 - DNA, 20 bp, Homo sapiens
ctctgttggaaattgggtgt

SEQ ID NO: 1885192 - DNA, 13 bp, Homo sapiens
ctcttaagaagac

SEQ ID NO: 1885193 - DNA, 15 bp, Homo sapiens
ctcttagatgcagtt

SEQ ID NO: 1885194 - DNA, 19 bp, Homo sapiens
ctcttatctttgtaataaa

SEQ ID NO: 1885195 - DNA, 12 bp, Homo sapiens
ctcttgccccaa

SEQ ID NO: 1885196 - DNA, 14 bp, Homo sapiens
ctcttgccccaacc

SEQ ID NO: 1885197 - DNA, 23 bp, Homo sapiens
ctcttgccccaacccccagcacc

SEQ ID NO: 1885198 - DNA, 19 bp, Homo sapiens
ctctttttgtacctggtga

SEQ ID NO: 1885199 - DNA, 16 bp, Homo sapiens
ctgaaggagattttcc

SEQ ID NO: 1885200 - DNA, 15 bp, Homo sapiens
ctgaatatataaaca

SEQ ID NO: 1885201 - DNA, 17 bp, Homo sapiens
ctgaatatataaacact

SEQ ID NO: 1885202 - DNA, 21 bp, Homo sapiens
ctgacagtcctctccacctag

SEQ ID NO: 1885203 - DNA, 22 bp, Homo sapiens
ctgactcccatgcaagtagctg

SEQ ID NO: 1885204 - DNA, 21 bp, Homo sapiens
ctgactcggtcaaaatatttt

SEQ ID NO: 1885205 - DNA, 16 bp, Homo sapiens
ctgactctgtgctgag

SEQ ID NO: 1885206 - DNA, 17 bp, Homo sapiens
ctgactcttaagaagac

SEQ ID NO: 1885207 - DNA, 16 bp, Homo sapiens
ctgagacggatggaag

SEQ ID NO: 1885208 - DNA, 22 bp, Homo sapiens
ctgagacggatggaaggagaga

SEQ ID NO: 1885209 - DNA, 19 bp, Homo sapiens
ctgagactgcagaggagcc

SEQ ID NO: 1885210 - DNA, 21 bp, Homo sapiens
ctgagactgcagaggagccac

SEQ ID NO: 1885211 - DNA, 13 bp, Homo sapiens
ctgagagcatgtg

SEQ ID NO: 1885212 - DNA, 23 bp, Homo sapiens
ctgagccctccttcttgccctga

SEQ ID NO: 1885213 - DNA, 13 bp, Homo sapiens
ctgagctgtgccc

SEQ ID NO: 1885214 - DNA, 13 bp, Homo sapiens
ctgaggactctgg

SEQ ID NO: 1885215 - DNA, 14 bp, Homo sapiens
ctgaggactctgga

SEQ ID NO: 1885216 - DNA, 15 bp, Homo sapiens
ctgaggactctggac

SEQ ID NO: 1885217 - DNA, 17 bp, Homo sapiens
ctgagtctgctatattt

SEQ ID NO: 1885218 - DNA, 22 bp, Homo sapiens
ctgagtctgctatattttcatg

SEQ ID NO: 1885219 - DNA, 14 bp, Homo sapiens
ctgatgctgggctg

SEQ ID NO: 1885220 - DNA, 13 bp, Homo sapiens
ctgcaccaaccca

SEQ ID NO: 1885221 - DNA, 16 bp, Homo sapiens
ctgcaccccctcctgc

SEQ ID NO: 1885222 - DNA, 16 bp, Homo sapiens
cattggcagcaggtgc

SEQ ID NO: 1885223 - DNA, 17 bp, Homo sapiens
cattggcagcaggtgct

SEQ ID NO: 1885224 - DNA, 23 bp, Homo sapiens
cattggcagcaggtgctgctacc

SEQ ID NO: 1885225 - DNA, 13 bp, Homo sapiens
cattgttgtcaaa

SEQ ID NO: 1885226 - DNA, 12 bp, Homo sapiens
catttccaagca

SEQ ID NO: 1885227 - DNA, 20 bp, Homo sapiens
catttctgatatttgctgga

SEQ ID NO: 1885228 - DNA, 14 bp, Homo sapiens
catttgctcatgga

SEQ ID NO: 1885229 - DNA, 18 bp, Homo sapiens
catttgctcatggaattg

SEQ ID NO: 1885230 - DNA, 20 bp, Homo sapiens
catttgtataaaataatttt

SEQ ID NO: 1885231 - DNA, 13 bp, Homo sapiens
catttttgtattt

SEQ ID NO: 1885232 - DNA, 13 bp, Homo sapiens
ccaaattcatata

SEQ ID NO: 1885233 - DNA, 13 bp, Homo sapiens
ccaacccagccgc

SEQ ID NO: 1885234 - DNA, 21 bp, Homo sapiens
ccaacccagccgctgcccggc

SEQ ID NO: 1885235 - DNA, 14 bp, Homo sapiens
ccaacccatgccct

SEQ ID NO: 1885236 - DNA, 14 bp, Homo sapiens
ccaacccccagcac

SEQ ID NO: 1885237 - DNA, 21 bp, Homo sapiens
ccaactccagaaagtgacaag

SEQ ID NO: 1885238 - DNA, 16 bp, Homo sapiens
taagtgattgtatgaa

SEQ ID NO: 1885239 - DNA, 20 bp, Homo sapiens
taagttatttttacattctg

SEQ ID NO: 1885240 - DNA, 18 bp, Homo sapiens
taagtttatgtctaaaga

SEQ ID NO: 1885241 - DNA, 20 bp, Homo sapiens
taagtttatgtctaaagagc

SEQ ID NO: 1885242 - DNA, 13 bp, Homo sapiens
taataaacattct

SEQ ID NO: 1885243 - DNA, 18 bp, Homo sapiens
taataaacttagaataaa

SEQ ID NO: 1885244 - DNA, 23 bp, Homo sapiens
taataccaccatttaaaaatgtt

SEQ ID NO: 1885245 - DNA, 20 bp, Homo sapiens
taatcattcttatttcatga

SEQ ID NO: 1885246 - DNA, 23 bp, Homo sapiens
taatgataactggaaacttcagc

SEQ ID NO: 1885247 - DNA, 19 bp, Homo sapiens
taatgtgtattacaaatat

SEQ ID NO: 1885248 - DNA, 19 bp, Homo sapiens
taatgttattattactcta

SEQ ID NO: 1885249 - DNA, 21 bp, Homo sapiens
taattacctgtcatctgggcc

SEQ ID NO: 1885250 - DNA, 16 bp, Homo sapiens
taattacgtttaaagt

SEQ ID NO: 1885251 - DNA, 14 bp, Homo sapiens
taatttaatgtatt

SEQ ID NO: 1885252 - DNA, 14 bp, Homo sapiens
taatttattttgtc

SEQ ID NO: 1885253 - DNA, 15 bp, Homo sapiens
taatttgactagaaa

SEQ ID NO: 1885254 - DNA, 16 bp, Homo sapiens
taatttgactagaaaa

SEQ ID NO: 1885255 - DNA, 20 bp, Homo sapiens
taatttgtagtgttggagaa

SEQ ID NO: 1885256 - DNA, 16 bp, Homo sapiens
taatttttatatttga

SEQ ID NO: 1885257 - DNA, 18 bp, Homo sapiens
tacaaaggcttattaatt

SEQ ID NO: 1885258 - DNA, 22 bp, Homo sapiens
tacaaagtacagaaaaatactt

SEQ ID NO: 1885259 - DNA, 13 bp, Homo sapiens
tacaaataaacag

SEQ ID NO: 1885260 - DNA, 19 bp, Homo sapiens
tacaaataaacagttgtta

SEQ ID NO: 1885261 - DNA, 23 bp, Homo sapiens
tacaatgaaaaggactttataga

SEQ ID NO: 1885262 - DNA, 18 bp, Homo sapiens
tacacagaaatacagtta

SEQ ID NO: 1885263 - DNA, 21 bp, Homo sapiens
tacactctcaaagcaaataat

SEQ ID NO: 1885264 - DNA, 16 bp, Homo sapiens
tacagaaaaatacttt

SEQ ID NO: 1885265 - DNA, 17 bp, Homo sapiens
tacagaaaaatactttg

SEQ ID NO: 1885266 - DNA, 19 bp, Homo sapiens
tacagaattgactgcagtt

SEQ ID NO: 1885267 - DNA, 15 bp, Homo sapiens
tacaggcctcacaca

SEQ ID NO: 1885268 - DNA, 17 bp, Homo sapiens
tacagtaaataaattgt

SEQ ID NO: 1885269 - DNA, 12 bp, Homo sapiens
tacagttcagtt

SEQ ID NO: 1885270 - DNA, 15 bp, Homo sapiens
tacattaattatcta

SEQ ID NO: 1885271 - DNA, 22 bp, Homo sapiens
taccaaaaatctcaatatttca

SEQ ID NO: 1885272 - DNA, 16 bp, Homo sapiens
taccaagtttcaggta

SEQ ID NO: 1885273 - DNA, 21 bp, Homo sapiens
taccaagtttcaggtattaag

SEQ ID NO: 1885274 - DNA, 21 bp, Homo sapiens
taccaccatttaaaaatgtta

SEQ ID NO: 1885275 - DNA, 16 bp, Homo sapiens
taccagagtctggagc

SEQ ID NO: 1885276 - DNA, 19 bp, Homo sapiens
taccagagtctggagctga

SEQ ID NO: 1885277 - DNA, 20 bp, Homo sapiens
taccaggtctcctccaccgc

SEQ ID NO: 1885278 - DNA, 16 bp, Homo sapiens
tacccccgcccaggct

SEQ ID NO: 1885279 - DNA, 17 bp, Homo sapiens
tacccccgcccaggctg

SEQ ID NO: 1885280 - DNA, 22 bp, Homo sapiens
tacccccgcccaggctggccag

SEQ ID NO: 1885281 - DNA, 17 bp, Homo sapiens
taccttgcatctcacag

SEQ ID NO: 1885282 - DNA, 16 bp, Homo sapiens
tacgtgggagaggcag

SEQ ID NO: 1885283 - DNA, 21 bp, Homo sapiens
tacgtttaaagtgcagtcatt

SEQ ID NO: 1885284 - DNA, 17 bp, Homo sapiens
tactaaatggtgttaca

SEQ ID NO: 1885285 - DNA, 15 bp, Homo sapiens
tactctacactgaaa

SEQ ID NO: 1885286 - DNA, 19 bp, Homo sapiens
tactctacactgaaacgta

SEQ ID NO: 1885287 - DNA, 18 bp, Homo sapiens
tactgtttcttgcactga

SEQ ID NO: 1885288 - DNA, 19 bp, Homo sapiens
tactgtttcttgcactgaa

SEQ ID NO: 1885289 - DNA, 20 bp, Homo sapiens
tactgtttcttgcactgaat

SEQ ID NO: 1885290 - DNA, 20 bp, Homo sapiens
tacttagcaagacctgaaaa

SEQ ID NO: 1885291 - DNA, 16 bp, Homo sapiens
tacttcatgctgtcta

SEQ ID NO: 1885292 - DNA, 16 bp, Homo sapiens
tagaaaagaaaacatt

SEQ ID NO: 1885293 - DNA, 17 bp, Homo sapiens
tagaaaagaaaacattt

SEQ ID NO: 1885294 - DNA, 21 bp, Homo sapiens
tagaaaagaaaacatttaaca

SEQ ID NO: 1885295 - DNA, 22 bp, Homo sapiens
tagaaaagaaaacatttaacat

SEQ ID NO: 1885296 - DNA, 17 bp, Homo sapiens
tagaaaatttaaaacat

SEQ ID NO: 1885297 - DNA, 22 bp, Homo sapiens
tagaaaatttaaaacattactc

SEQ ID NO: 1885298 - DNA, 14 bp, Homo sapiens
tagaagtatttgtg

SEQ ID NO: 1885299 - DNA, 17 bp, Homo sapiens
tagaatacattgataca

SEQ ID NO: 1885300 - DNA, 13 bp, Homo sapiens
tagaatcttgttt

SEQ ID NO: 1885301 - DNA, 19 bp, Homo sapiens
tagaggctttcaaatgtac

SEQ ID NO: 1885302 - DNA, 14 bp, Homo sapiens
tagagggtgtgtaa

SEQ ID NO: 1885303 - DNA, 17 bp, Homo sapiens
tagagtttagctggaaa

SEQ ID NO: 1885304 - DNA, 18 bp, Homo sapiens
tagagtttagctggaaaa

SEQ ID NO: 1885305 - DNA, 17 bp, Homo sapiens
tagataggccatgggca

SEQ ID NO: 1885306 - DNA, 20 bp, Homo sapiens
tagatgcagttctgaagaag

SEQ ID NO: 1885307 - DNA, 22 bp, Homo sapiens
tagatgctctatgtgcttgtaa

SEQ ID NO: 1885308 - DNA, 20 bp, Homo sapiens
tagatgtatgtacttcatgc

SEQ ID NO: 1885309 - DNA, 17 bp, Homo sapiens
tagattttttttaaagt

SEQ ID NO: 1885310 - DNA, 22 bp, Homo sapiens
tagcaggctgcagcaggcagag

SEQ ID NO: 1885311 - DNA, 20 bp, Homo sapiens
tagcagtaaatacttgcagt

SEQ ID NO: 1885312 - DNA, 21 bp, Homo sapiens
tagcagtaaatacttgcagtt

SEQ ID NO: 1885313 - DNA, 22 bp, Homo sapiens
tagcagtaaatacttgcagttg

SEQ ID NO: 1885314 - DNA, 18 bp, Homo sapiens
tagccaatatttttctta

SEQ ID NO: 1885315 - DNA, 12 bp, Homo sapiens
tagctctgagcc

SEQ ID NO: 1885316 - DNA, 13 bp, Homo sapiens
tagctctgagccc

SEQ ID NO: 1885317 - DNA, 16 bp, Homo sapiens
tagcttcagttgttct

SEQ ID NO: 1885318 - DNA, 19 bp, Homo sapiens
taggaaagaccatttttcc

SEQ ID NO: 1885319 - DNA, 18 bp, Homo sapiens
taggaaatatttatttta

SEQ ID NO: 1885320 - DNA, 21 bp, Homo sapiens
taggacatataccttctcaaa

SEQ ID NO: 1885321 - DNA, 16 bp, Homo sapiens
taggagagactggcca

SEQ ID NO: 1885322 - DNA, 18 bp, Homo sapiens
taggagagactggccaga

SEQ ID NO: 1885323 - DNA, 14 bp, Homo sapiens
taggcctggcacag

SEQ ID NO: 1885324 - DNA, 15 bp, Homo sapiens
taggcgcccctgggg

SEQ ID NO: 1885325 - DNA, 20 bp, Homo sapiens
tagggagatgagttgcagtt

SEQ ID NO: 1885326 - DNA, 18 bp, Homo sapiens
tagggatctggggaagga

SEQ ID NO: 1885327 - DNA, 22 bp, Homo sapiens
tagggatctggggaaggaccaa

SEQ ID NO: 1885328 - DNA, 23 bp, Homo sapiens
tagggatctggggaaggaccaac

SEQ ID NO: 1885329 - DNA, 14 bp, Homo sapiens
taggggctggggcc

SEQ ID NO: 1885330 - DNA, 23 bp, Homo sapiens
taggggctggggccaaataaagt

SEQ ID NO: 1885331 - DNA, 16 bp, Homo sapiens
taggggtaatatattg

SEQ ID NO: 1885332 - DNA, 21 bp, Homo sapiens
taggtcttaatacacacagtt

SEQ ID NO: 1885333 - DNA, 22 bp, Homo sapiens
taggtgaccccatctctgctgc

SEQ ID NO: 1885334 - DNA, 11 bp, Homo sapiens
taggtgctggc

SEQ ID NO: 1885335 - DNA, 12 bp, Homo sapiens
taggtgctggcc

SEQ ID NO: 1885336 - DNA, 17 bp, Homo sapiens
taggttgacattcagaa

SEQ ID NO: 1885337 - DNA, 18 bp, Homo sapiens
taggttgacattcagaaa

SEQ ID NO: 1885338 - DNA, 13 bp, Homo sapiens
tagtaattgtaag

SEQ ID NO: 1885339 - DNA, 15 bp, Homo sapiens
tagtatcttttaaaa

SEQ ID NO: 1885340 - DNA, 19 bp, Homo sapiens
tagtatttctatgaaatat

SEQ ID NO: 1885341 - DNA, 22 bp, Homo sapiens
tagtccagctttgttcttctta

SEQ ID NO: 1885342 - DNA, 18 bp, Homo sapiens
tagtcctagaggacctga

SEQ ID NO: 1885343 - DNA, 13 bp, Homo sapiens
tagtctgtgtaac

SEQ ID NO: 1885344 - DNA, 22 bp, Homo sapiens
tagtgagcagtcaggaaagaga

SEQ ID NO: 1885345 - DNA, 14 bp, Homo sapiens
tagtgcaaattgtc

SEQ ID NO: 1885346 - DNA, 13 bp, Homo sapiens
tagtggctgtcca

SEQ ID NO: 1885347 - DNA, 12 bp, Homo sapiens
tagtgttggaga

SEQ ID NO: 1885348 - DNA, 17 bp, Homo sapiens
tagtgttggagaagaac

SEQ ID NO: 1885349 - DNA, 22 bp, Homo sapiens
tagttagccaatatttttctta

SEQ ID NO: 1885350 - DNA, 15 bp, Homo sapiens
tagttattgttttat

SEQ ID NO: 1885351 - DNA, 13 bp, Homo sapiens
tataaaaaatggt

SEQ ID NO: 1885352 - DNA, 16 bp, Homo sapiens
tataaaactgctttgt

SEQ ID NO: 1885353 - DNA, 15 bp, Homo sapiens
tataagccctgcata

SEQ ID NO: 1885354 - DNA, 23 bp, Homo sapiens
gggaccacagcaaggcacctgca

SEQ ID NO: 1885355 - DNA, 18 bp, Homo sapiens
gggaccccgagcctggct

SEQ ID NO: 1885356 - DNA, 11 bp, Homo sapiens
gggagaggcag

SEQ ID NO: 1885357 - DNA, 12 bp, Homo sapiens
gggagaggcaga

SEQ ID NO: 1885358 - DNA, 13 bp, Homo sapiens
gggagaggcagaa

SEQ ID NO: 1885359 - DNA, 19 bp, Homo sapiens
gggagcattctgcctgcct

SEQ ID NO: 1885360 - DNA, 21 bp, Homo sapiens
gggagcattctgcctgcctgg

SEQ ID NO: 1885361 - DNA, 17 bp, Homo sapiens
gggagcctggagcccct

SEQ ID NO: 1885362 - DNA, 21 bp, Homo sapiens
gggagcctggagcccctgtgt

SEQ ID NO: 1885363 - DNA, 16 bp, Homo sapiens
gggaggagccttggag

SEQ ID NO: 1885364 - DNA, 17 bp, Homo sapiens
gggaggagccttggagt

SEQ ID NO: 1885365 - DNA, 22 bp, Homo sapiens
gggaggagccttggagtgtaat

SEQ ID NO: 1885366 - DNA, 18 bp, Homo sapiens
gggaggagtgacatgaag

SEQ ID NO: 1885367 - DNA, 14 bp, Homo sapiens
gggaggctgagact

SEQ ID NO: 1885368 - DNA, 16 bp, Homo sapiens
gggagggcgaggcggg

SEQ ID NO: 1885369 - DNA, 13 bp, Homo sapiens
gggagtgagcttg

SEQ ID NO: 1885370 - DNA, 14 bp, Homo sapiens
gggatcctctctcc

SEQ ID NO: 1885371 - DNA, 22 bp, Homo sapiens
cttccccgagggatgatgccac

SEQ ID NO: 1885372 - DNA, 13 bp, Homo sapiens
cttcccctcctac

SEQ ID NO: 1885373 - DNA, 23 bp, Homo sapiens
cttcccctcctacccctcccagc

SEQ ID NO: 1885374 - DNA, 17 bp, Homo sapiens
cttccgctcccaccagc

SEQ ID NO: 1885375 - DNA, 22 bp, Homo sapiens
cttctcccccccggggctgggt

SEQ ID NO: 1885376 - DNA, 11 bp, Homo sapiens
cttctgctggg

SEQ ID NO: 1885377 - DNA, 13 bp, Homo sapiens
cttctgctgggct

SEQ ID NO: 1885378 - DNA, 15 bp, Homo sapiens
cttctgctgggctgg

SEQ ID NO: 1885379 - DNA, 16 bp, Homo sapiens
cttctgctgggctggg

SEQ ID NO: 1885380 - DNA, 23 bp, Homo sapiens
cttctgggcctgatggagaggag

SEQ ID NO: 1885381 - DNA, 13 bp, Homo sapiens
cttcttgccctga

SEQ ID NO: 1885382 - DNA, 13 bp, Homo sapiens
cttctttccacag

SEQ ID NO: 1885383 - DNA, 13 bp, Homo sapiens
cttctttctttta

SEQ ID NO: 1885384 - DNA, 20 bp, Homo sapiens
cttgaattttcccactgcac

SEQ ID NO: 1885385 - DNA, 21 bp, Homo sapiens
cttgagaagtctaattcacag

SEQ ID NO: 1885386 - DNA, 19 bp, Homo sapiens
cttgatctgtgatttcttc

SEQ ID NO: 1885387 - DNA, 16 bp, Homo sapiens
cttgatgtttgttaga

SEQ ID NO: 1885388 - DNA, 17 bp, Homo sapiens
cttgatgtttgttagac

SEQ ID NO: 1885389 - DNA, 13 bp, Homo sapiens
cttgcactgaata

SEQ ID NO: 1885390 - DNA, 18 bp, Homo sapiens
cttgccccaacccccagc

SEQ ID NO: 1885391 - DNA, 19 bp, Homo sapiens
cttgccccaacccccagca

SEQ ID NO: 1885392 - DNA, 16 bp, Homo sapiens
cttgcctcggctcctg

SEQ ID NO: 1885393 - DNA, 19 bp, Homo sapiens
cttgcctcggctcctgctg

SEQ ID NO: 1885394 - DNA, 22 bp, Homo sapiens
cttgcctcggctcctgctgcac

SEQ ID NO: 1885395 - DNA, 16 bp, Homo sapiens
cttgctgatggctgct

SEQ ID NO: 1885396 - DNA, 21 bp, Homo sapiens
cttgctgcagtatgaaaataa

SEQ ID NO: 1885397 - DNA, 14 bp, Homo sapiens
cttgctgttcagtg

SEQ ID NO: 1885398 - DNA, 18 bp, Homo sapiens
cttggcccacctgaggcc

SEQ ID NO: 1885399 - DNA, 18 bp, Homo sapiens
cttggggctgatgcagtt

SEQ ID NO: 1885400 - DNA, 23 bp, Homo sapiens
cttggttcttttttcagttattt

SEQ ID NO: 1885401 - DNA, 23 bp, Homo sapiens
cttgtgcagacgccacagtctcc

SEQ ID NO: 1885402 - DNA, 17 bp, Homo sapiens
ctttaaatttaggtaaa

SEQ ID NO: 1885403 - DNA, 16 bp, Homo sapiens
ctttaccttttttctt

SEQ ID NO: 1885404 - DNA, 20 bp, Homo sapiens
ctttagaggctttcaaatgt

SEQ ID NO: 1885405 - DNA, 19 bp, Homo sapiens
ctttagggatctggggaag

SEQ ID NO: 1885406 - DNA, 22 bp, Homo sapiens
ctttagggatctggggaaggac

SEQ ID NO: 1885407 - DNA, 16 bp, Homo sapiens
ctttattgtgattacg

SEQ ID NO: 1885408 - DNA, 11 bp, Homo sapiens
ctttcagagcc

SEQ ID NO: 1885409 - DNA, 13 bp, Homo sapiens
ctttcagctgtga

SEQ ID NO: 1885410 - DNA, 13 bp, Homo sapiens
ctttccacagaag

SEQ ID NO: 1885411 - DNA, 19 bp, Homo sapiens
gagagcatgtgggggaagg

SEQ ID NO: 1885412 - DNA, 20 bp, Homo sapiens
gagaggacccatcctgccac

SEQ ID NO: 1885413 - DNA, 19 bp, Homo sapiens
gagatacccacagagtgtg

SEQ ID NO: 1885414 - DNA, 15 bp, Homo sapiens
gagatgaacatctgg

SEQ ID NO: 1885415 - DNA, 14 bp, Homo sapiens
gagcacctggtggg

SEQ ID NO: 1885416 - DNA, 15 bp, Homo sapiens
gagcagcttcagttg

SEQ ID NO: 1885417 - DNA, 16 bp, Homo sapiens
gagcatctgctctgag

SEQ ID NO: 1885418 - DNA, 17 bp, Homo sapiens
gagcatctgctctgaga

SEQ ID NO: 1885419 - DNA, 18 bp, Homo sapiens
gagcatgtgggggaaggc

SEQ ID NO: 1885420 - DNA, 22 bp, Homo sapiens
gagcattctgcctgcctgggaa

SEQ ID NO: 1885421 - DNA, 18 bp, Homo sapiens
gagccacctgggctggga

SEQ ID NO: 1885422 - DNA, 23 bp, Homo sapiens
gagccctccttcttgccctgagc

SEQ ID NO: 1885423 - DNA, 19 bp, Homo sapiens
gagcctccgttcccacctc

SEQ ID NO: 1885424 - DNA, 10 bp, Homo sapiens
gagcctggag

SEQ ID NO: 1885425 - DNA, 17 bp, Homo sapiens
gagctggacctcaccaa

SEQ ID NO: 1885426 - DNA, 19 bp, Homo sapiens
gagcttcagggctgggcag

SEQ ID NO: 1885427 - DNA, 21 bp, Homo sapiens
gagcttggtgcggtaggtgct

SEQ ID NO: 1885428 - DNA, 15 bp, Homo sapiens
gagctttccggggag

SEQ ID NO: 1885429 - DNA, 23 bp, Homo sapiens
gagctttccggggaggagccttg

SEQ ID NO: 1885430 - DNA, 21 bp, Homo sapiens
gaggaaggtggcttaccaaga

SEQ ID NO: 1885431 - DNA, 20 bp, Homo sapiens
gaggagaacactagacatgc

SEQ ID NO: 1885432 - DNA, 21 bp, Homo sapiens
gaggagagagcagcttctgcc

SEQ ID NO: 1885433 - DNA, 19 bp, Homo sapiens
gaggagagcatctgctctg

SEQ ID NO: 1885434 - DNA, 22 bp, Homo sapiens
gaggagccacctgggctgggag

SEQ ID NO: 1885435 - DNA, 18 bp, Homo sapiens
gaggagtgacatgaagca

SEQ ID NO: 1885436 - DNA, 12 bp, Homo sapiens
gaggatgcactg

SEQ ID NO: 1885437 - DNA, 15 bp, Homo sapiens
gaggcaggggagtct

SEQ ID NO: 1885438 - DNA, 14 bp, Homo sapiens
gaggcagtgggtcc

SEQ ID NO: 1885439 - DNA, 19 bp, Homo sapiens
gaggcagtgggtcccactt

SEQ ID NO: 1885440 - DNA, 20 bp, Homo sapiens
gaggcggaggttgcagtgag

SEQ ID NO: 1885441 - DNA, 19 bp, Homo sapiens
gaggcggatctttggacag

SEQ ID NO: 1885442 - DNA, 15 bp, Homo sapiens
gaggcgggggagcct

SEQ ID NO: 1885443 - DNA, 17 bp, Homo sapiens
gaggcgggggatcctgg

SEQ ID NO: 1885444 - DNA, 18 bp, Homo sapiens
gaggcgggggatcctgga

SEQ ID NO: 1885445 - DNA, 20 bp, Homo sapiens
gaggcgggggatcctggagc

SEQ ID NO: 1885446 - DNA, 16 bp, Homo sapiens
gaggctatttaaaagt

SEQ ID NO: 1885447 - DNA, 21 bp, Homo sapiens
gaggctcccatgggctaggag

SEQ ID NO: 1885448 - DNA, 11 bp, Homo sapiens
gaggctctgaa

SEQ ID NO: 1885449 - DNA, 12 bp, Homo sapiens
gaggctctgaag

SEQ ID NO: 1885450 - DNA, 20 bp, Homo sapiens
gaggctgagactgcagagga

SEQ ID NO: 1885451 - DNA, 17 bp, Homo sapiens
gaggctttcaaatgtac

SEQ ID NO: 1885452 - DNA, 23 bp, Homo sapiens
gagggaccaggtgtctagaggca

SEQ ID NO: 1885453 - DNA, 16 bp, Homo sapiens
gaggggacgctggcta

SEQ ID NO: 1885454 - DNA, 13 bp, Homo sapiens
gaggggcaggccc

SEQ ID NO: 1885455 - DNA, 18 bp, Homo sapiens
gaggtggcgccccctggt

SEQ ID NO: 1885456 - DNA, 16 bp, Homo sapiens
gaggtggcttcatgtg

SEQ ID NO: 1885457 - DNA, 18 bp, Homo sapiens
gaggtggtagctctgagc

SEQ ID NO: 1885458 - DNA, 20 bp, Homo sapiens
gaggtggtagctctgagccc

SEQ ID NO: 1885459 - DNA, 14 bp, Homo sapiens
gaggtggtggacat

SEQ ID NO: 1885460 - DNA, 19 bp, Homo sapiens
gaggttgaggatgcactgg

SEQ ID NO: 1885461 - DNA, 16 bp, Homo sapiens
gagtacccccctgaga

SEQ ID NO: 1885462 - DNA, 13 bp, Homo sapiens
gagtctgcttgtc

SEQ ID NO: 1885463 - DNA, 12 bp, Homo sapiens
gagtctggagct

SEQ ID NO: 1885464 - DNA, 17 bp, Homo sapiens
gagtgagcttggtgcgg

SEQ ID NO: 1885465 - DNA, 18 bp, Homo sapiens
gagtggcattggcagcag

SEQ ID NO: 1885466 - DNA, 17 bp, Homo sapiens
gagttgaccttctgaac

SEQ ID NO: 1885467 - DNA, 22 bp, Homo sapiens
gatactgtttcttgcactgaat

SEQ ID NO: 1885468 - DNA, 21 bp, Homo sapiens
gatagaactttgccagtcttt

SEQ ID NO: 1885469 - DNA, 23 bp, Homo sapiens
gatagaactttgccagtctttaa

SEQ ID NO: 1885470 - DNA, 18 bp, Homo sapiens
gatatggaccatcagtga

SEQ ID NO: 1885471 - DNA, 17 bp, Homo sapiens
gatatgggacatttttg

SEQ ID NO: 1885472 - DNA, 21 bp, Homo sapiens
gatcacagtggccacggccac

SEQ ID NO: 1885473 - DNA, 18 bp, Homo sapiens
gatcagccagtgaccaac

SEQ ID NO: 1885474 - DNA, 13 bp, Homo sapiens
gatcattgcattt

SEQ ID NO: 1885475 - DNA, 14 bp, Homo sapiens
gatcattgcatttc

SEQ ID NO: 1885476 - DNA, 19 bp, Homo sapiens
gatcctctctccaggcccc

SEQ ID NO: 1885477 - DNA, 13 bp, Homo sapiens
gatcctggaaatc

SEQ ID NO: 1885478 - DNA, 14 bp, Homo sapiens
gatcctggaaatca

SEQ ID NO: 1885479 - DNA, 11 bp, Homo sapiens
gatcctggagc

SEQ ID NO: 1885480 - DNA, 17 bp, Homo sapiens
gatcggagcctcctctc

SEQ ID NO: 1885481 - DNA, 16 bp, Homo sapiens
gatcgttcattgcctt

SEQ ID NO: 1885482 - DNA, 17 bp, Homo sapiens
gatctgtgatttcttct

SEQ ID NO: 1885483 - DNA, 14 bp, Homo sapiens
gatgagttgcagtt

SEQ ID NO: 1885484 - DNA, 17 bp, Homo sapiens
gatgagttgcagttttt

SEQ ID NO: 1885485 - DNA, 16 bp, Homo sapiens
gatgatactgtttctt

SEQ ID NO: 1885486 - DNA, 13 bp, Homo sapiens
gatgatgccacac

SEQ ID NO: 1885487 - DNA, 15 bp, Homo sapiens
gatgatgccacacca

SEQ ID NO: 1885488 - DNA, 15 bp, Homo sapiens
gatgcactggcctgt

SEQ ID NO: 1885489 - DNA, 15 bp, Homo sapiens
gatgccacaccaagc

SEQ ID NO: 1885490 - DNA, 16 bp, Homo sapiens
gatgccacaccaagct

SEQ ID NO: 1885491 - DNA, 21 bp, Homo sapiens
gatgccacaccaagctgtgcc

SEQ ID NO: 1885492 - DNA, 12 bp, Homo sapiens
gatgctgggctg

SEQ ID NO: 1885493 - DNA, 14 bp, Homo sapiens
gatgctgggctggg

SEQ ID NO: 1885494 - DNA, 11 bp, Homo sapiens
cctcccagctg

SEQ ID NO: 1885495 - DNA, 16 bp, Homo sapiens
cctcccagctgacagt

SEQ ID NO: 1885496 - DNA, 20 bp, Homo sapiens
cctcccctccatccctggcc

SEQ ID NO: 1885497 - DNA, 12 bp, Homo sapiens
cctccctgctgt

SEQ ID NO: 1885498 - DNA, 20 bp, Homo sapiens
cctccgttcccacctctgag

SEQ ID NO: 1885499 - DNA, 17 bp, Homo sapiens
cctcctacccctcccag

SEQ ID NO: 1885500 - DNA, 18 bp, Homo sapiens
cctcctacccctcccagc

SEQ ID NO: 1885501 - DNA, 15 bp, Homo sapiens
cctcctttctggctt

SEQ ID NO: 1885502 - DNA, 21 bp, Homo sapiens
cctcgcccaccgcatgccccc

SEQ ID NO: 1885503 - DNA, 13 bp, Homo sapiens
cctcgcctggcct

SEQ ID NO: 1885504 - DNA, 20 bp, Homo sapiens
cctcggctcctgctgcacca

SEQ ID NO: 1885505 - DNA, 13 bp, Homo sapiens
cctctgggccctg

SEQ ID NO: 1885506 - DNA, 17 bp, Homo sapiens
cctctgggccctgcagg

SEQ ID NO: 1885507 - DNA, 20 bp, Homo sapiens
cctctgggccctgcaggagg

SEQ ID NO: 1885508 - DNA, 17 bp, Homo sapiens
cctctgtgtcactggct

SEQ ID NO: 1885509 - DNA, 12 bp, Homo sapiens
cctcttgcccca

SEQ ID NO: 1885510 - DNA, 23 bp, Homo sapiens
cctcttgccccaacccccagcac

SEQ ID NO: 1885511 - DNA, 19 bp, Homo sapiens
cctgaacaaagcacctcaa

SEQ ID NO: 1885512 - DNA, 18 bp, Homo sapiens
cctgaccatcccatgagc

SEQ ID NO: 1885513 - DNA, 13 bp, Homo sapiens
cctgactcccatg

SEQ ID NO: 1885514 - DNA, 14 bp, Homo sapiens
cctgactcccatgc

SEQ ID NO: 1885515 - DNA, 23 bp, Homo sapiens
cctgacttcaggggctgcccgct

SEQ ID NO: 1885516 - DNA, 19 bp, Homo sapiens
cctgagagcatgtggggga

SEQ ID NO: 1885517 - DNA, 15 bp, Homo sapiens
cctgagcctgcccca

SEQ ID NO: 1885518 - DNA, 17 bp, Homo sapiens
cctgagctttccgggga

SEQ ID NO: 1885519 - DNA, 23 bp, Homo sapiens
cctgagtctgctatattttcatg

SEQ ID NO: 1885520 - DNA, 12 bp, Homo sapiens
cctgatggagag

SEQ ID NO: 1885521 - DNA, 22 bp, Homo sapiens
cctgcaaaaattcagagtcctt

SEQ ID NO: 1885522 - DNA, 18 bp, Homo sapiens
cctgcaagagtggtccta

SEQ ID NO: 1885523 - DNA, 13 bp, Homo sapiens
cctgcactgtcct

SEQ ID NO: 1885524 - DNA, 12 bp, Homo sapiens
cctgcaggaggc

SEQ ID NO: 1885525 - DNA, 15 bp, Homo sapiens
cctgcaggaggcctg

SEQ ID NO: 1885526 - DNA, 18 bp, Homo sapiens
cctgcaggaggcctggga

SEQ ID NO: 1885527 - DNA, 21 bp, Homo sapiens
cctgcaggaggcctgggaggg

SEQ ID NO: 1885528 - DNA, 14 bp, Homo sapiens
cctgccaagcctgg

SEQ ID NO: 1885529 - DNA, 22 bp, Homo sapiens
cctgccaagcctggagcccctg

SEQ ID NO: 1885530 - DNA, 14 bp, Homo sapiens
cctgccccagctgg

SEQ ID NO: 1885531 - DNA, 15 bp, Homo sapiens
cctgccccagctggg

SEQ ID NO: 1885532 - DNA, 22 bp, Homo sapiens
cctgcccgttgccgggcctgga

SEQ ID NO: 1885533 - DNA, 21 bp, Homo sapiens
cctgcctgaccatcccatgag

SEQ ID NO: 1885534 - DNA, 17 bp, Homo sapiens
cctgctctccttgccct

SEQ ID NO: 1885535 - DNA, 20 bp, Homo sapiens
cctgctctccttgccctggg

SEQ ID NO: 1885536 - DNA, 17 bp, Homo sapiens
cctgctgagctgtgccc

SEQ ID NO: 1885537 - DNA, 16 bp, Homo sapiens
cctgctgcaccaaccc

SEQ ID NO: 1885538 - DNA, 18 bp, Homo sapiens
cctgctgcaccaacccag

SEQ ID NO: 1885539 - DNA, 19 bp, Homo sapiens
cctgctgcaccaacccagc

SEQ ID NO: 1885540 - DNA, 21 bp, Homo sapiens
cctgctgcaccaacccagccg

SEQ ID NO: 1885541 - DNA, 19 bp, Homo sapiens
cctgctgtcccctcttgcc

SEQ ID NO: 1885542 - DNA, 14 bp, Homo sapiens
cctggactgtccta

SEQ ID NO: 1885543 - DNA, 16 bp, Homo sapiens
cctggatgacattaaa

SEQ ID NO: 1885544 - DNA, 23 bp, Homo sapiens
cctggcacaccttaggttgacat

SEQ ID NO: 1885545 - DNA, 13 bp, Homo sapiens
cctggcacagtgt

SEQ ID NO: 1885546 - DNA, 15 bp, Homo sapiens
cctggcacagtgtct

SEQ ID NO: 1885547 - DNA, 19 bp, Homo sapiens
cctggcacagtgtctgggc

SEQ ID NO: 1885548 - DNA, 20 bp, Homo sapiens
cctggcacagtgtctgggct

SEQ ID NO: 1885549 - DNA, 22 bp, Homo sapiens
cctggcacagtgtctgggctga

SEQ ID NO: 1885550 - DNA, 12 bp, Homo sapiens
cctggcccagct

SEQ ID NO: 1885551 - DNA, 13 bp, Homo sapiens
cctggcccagctc

SEQ ID NO: 1885552 - DNA, 18 bp, Homo sapiens
cctggcccatcagtgtac

SEQ ID NO: 1885553 - DNA, 20 bp, Homo sapiens
cctggccccctccctggatg

SEQ ID NO: 1885554 - DNA, 20 bp, Homo sapiens
cctgggagggcaagggtcct

SEQ ID NO: 1885555 - DNA, 17 bp, Homo sapiens
cctgggccagcccagga

SEQ ID NO: 1885556 - DNA, 15 bp, Homo sapiens
cctgggctgggagaa

SEQ ID NO: 1885557 - DNA, 17 bp, Homo sapiens
cctgggctgggagaagg

SEQ ID NO: 1885558 - DNA, 15 bp, Homo sapiens
cctggggaggctgag

SEQ ID NO: 1885559 - DNA, 22 bp, Homo sapiens
cctggggtgggtttagcaggct

SEQ ID NO: 1885560 - DNA, 23 bp, Homo sapiens
cctggggtgggtttagcaggctg

SEQ ID NO: 1885561 - DNA, 15 bp, Homo sapiens
cctgtcatctgggcc

SEQ ID NO: 1885562 - DNA, 17 bp, Homo sapiens
cctgtgttggggggcaa

SEQ ID NO: 1885563 - DNA, 20 bp, Homo sapiens
cctgttccattgttgtcaaa

SEQ ID NO: 1885564 - DNA, 17 bp, Homo sapiens
cctgttctgtaggagag

SEQ ID NO: 1885565 - DNA, 16 bp, Homo sapiens
ccttacctatttcctc

SEQ ID NO: 1885566 - DNA, 16 bp, Homo sapiens
ccttccgctcccacca

SEQ ID NO: 1885567 - DNA, 22 bp, Homo sapiens
ccttctcccccccggggctggg

SEQ ID NO: 1885568 - DNA, 15 bp, Homo sapiens
gatgctgggctgggt

SEQ ID NO: 1885569 - DNA, 17 bp, Homo sapiens
gatgctgggctgggtgc

SEQ ID NO: 1885570 - DNA, 14 bp, Homo sapiens
gatggaaggagaga

SEQ ID NO: 1885571 - DNA, 17 bp, Homo sapiens
gatggaaggagagaggt

SEQ ID NO: 1885572 - DNA, 14 bp, Homo sapiens
gatggagaggagaa

SEQ ID NO: 1885573 - DNA, 18 bp, Homo sapiens
gatggcaaccagaccatt

SEQ ID NO: 1885574 - DNA, 19 bp, Homo sapiens
gatggccagtcatgtgctg

SEQ ID NO: 1885575 - DNA, 20 bp, Homo sapiens
gatggccagtcatgtgctgg

SEQ ID NO: 1885576 - DNA, 12 bp, Homo sapiens
gatggctgctgg

SEQ ID NO: 1885577 - DNA, 14 bp, Homo sapiens
gatgtatttttctt

SEQ ID NO: 1885578 - DNA, 12 bp, Homo sapiens
gatgtcttcatc

SEQ ID NO: 1885579 - DNA, 21 bp, Homo sapiens
gatgtgttcctccattttctt

SEQ ID NO: 1885580 - DNA, 14 bp, Homo sapiens
gattaagtaatgat

SEQ ID NO: 1885581 - DNA, 22 bp, Homo sapiens
gattaagtaatgataactggaa

SEQ ID NO: 1885582 - DNA, 16 bp, Homo sapiens
gattacaaataaacag

SEQ ID NO: 1885583 - DNA, 22 bp, Homo sapiens
gattacaaataaacagttgtta

SEQ ID NO: 1885584 - DNA, 18 bp, Homo sapiens
gattacgtgtatgtttct

SEQ ID NO: 1885585 - DNA, 21 bp, Homo sapiens
gattatttgttatttgtacag

SEQ ID NO: 1885586 - DNA, 23 bp, Homo sapiens
gattatttgttatttgtacagtt

SEQ ID NO: 1885587 - DNA, 13 bp, Homo sapiens
gattcggctgtct

SEQ ID NO: 1885588 - DNA, 19 bp, Homo sapiens
gattgtacgtgggagaggc

SEQ ID NO: 1885589 - DNA, 22 bp, Homo sapiens
gattttaaagagtgaaaaatga

SEQ ID NO: 1885590 - DNA, 21 bp, Homo sapiens
gattttgaaatcatgaagata

SEQ ID NO: 1885591 - DNA, 18 bp, Homo sapiens
gcaaaccaatacagaatt

SEQ ID NO: 1885592 - DNA, 21 bp, Homo sapiens
gcaaaccaatacagaattgac

SEQ ID NO: 1885593 - DNA, 14 bp, Homo sapiens
gcaaagtctaaagt

SEQ ID NO: 1885594 - DNA, 16 bp, Homo sapiens
gcaaagtctaaagttt

SEQ ID NO: 1885595 - DNA, 21 bp, Homo sapiens
gcaaagtctaaagtttacagt

SEQ ID NO: 1885596 - DNA, 13 bp, Homo sapiens
gcaaattagtaat

SEQ ID NO: 1885597 - DNA, 16 bp, Homo sapiens
gcaaattgtcacagga

SEQ ID NO: 1885598 - DNA, 19 bp, Homo sapiens
gcaacagtgttctgagccc

SEQ ID NO: 1885599 - DNA, 15 bp, Homo sapiens
gcaagacctgaaaat

SEQ ID NO: 1885600 - DNA, 14 bp, Homo sapiens
gcaaggaggctggc

SEQ ID NO: 1885601 - DNA, 15 bp, Homo sapiens
gcaaggaggctggct

SEQ ID NO: 1885602 - DNA, 14 bp, Homo sapiens
gcaaggcacctgca

SEQ ID NO: 1885603 - DNA, 23 bp, Homo sapiens
gcaagggtcctacggagggacca

SEQ ID NO: 1885604 - DNA, 16 bp, Homo sapiens
gcaaggtgggggagcc

SEQ ID NO: 1885605 - DNA, 18 bp, Homo sapiens
gcaatagtcaaattgtgt

SEQ ID NO: 1885606 - DNA, 12 bp, Homo sapiens
gcacagccctcc

SEQ ID NO: 1885607 - DNA, 18 bp, Homo sapiens
gcacagccctcccgcccc

SEQ ID NO: 1885608 - DNA, 18 bp, Homo sapiens
gcacagcctcttagatgc

SEQ ID NO: 1885609 - DNA, 18 bp, Homo sapiens
gcacagtgtctgggctga

SEQ ID NO: 1885610 - DNA, 21 bp, Homo sapiens
gcacagtgtctgggctgactg

SEQ ID NO: 1885611 - DNA, 23 bp, Homo sapiens
gcacagtgtctgggctgactggg

SEQ ID NO: 1885612 - DNA, 15 bp, Homo sapiens
gcaccaacccagccg

SEQ ID NO: 1885613 - DNA, 17 bp, Homo sapiens
gcaccaacccagccgct

SEQ ID NO: 1885614 - DNA, 18 bp, Homo sapiens
gcaccactgtgtatttaa

SEQ ID NO: 1885615 - DNA, 15 bp, Homo sapiens
gcaccccctcctgct

SEQ ID NO: 1885616 - DNA, 17 bp, Homo sapiens
gcaccccctcctgctgc

SEQ ID NO: 1885617 - DNA, 19 bp, Homo sapiens
gcaccccctcctgctgcag

SEQ ID NO: 1885618 - DNA, 18 bp, Homo sapiens
gcacctcaagtgcaagga

SEQ ID NO: 1885619 - DNA, 18 bp, Homo sapiens
gcacgtggtaaaacactt

SEQ ID NO: 1885620 - DNA, 12 bp, Homo sapiens
gcactctgtgcc

SEQ ID NO: 1885621 - DNA, 21 bp, Homo sapiens
gcactctgtgcccatgggcac

SEQ ID NO: 1885622 - DNA, 19 bp, Homo sapiens
gcactgctgggtggcccat

SEQ ID NO: 1885623 - DNA, 14 bp, Homo sapiens
gcactgtcctgctc

SEQ ID NO: 1885624 - DNA, 19 bp, Homo sapiens
gcactgtcctgctccacag

SEQ ID NO: 1885625 - DNA, 19 bp, Homo sapiens
gcactgtgggtagacacac

SEQ ID NO: 1885626 - DNA, 18 bp, Homo sapiens
gcagaacacttcagcctg

SEQ ID NO: 1885627 - DNA, 22 bp, Homo sapiens
gcagaacacttcagcctgtgca

SEQ ID NO: 1885628 - DNA, 20 bp, Homo sapiens
gcagacccatacctttccag

SEQ ID NO: 1885629 - DNA, 19 bp, Homo sapiens
gcagaggagccacctgggc

SEQ ID NO: 1885630 - DNA, 21 bp, Homo sapiens
gcagaggagccacctgggctg

SEQ ID NO: 1885631 - DNA, 19 bp, Homo sapiens
gcagaggggcaggccctgc

SEQ ID NO: 1885632 - DNA, 20 bp, Homo sapiens
gcagaggggcaggccctgca

SEQ ID NO: 1885633 - DNA, 13 bp, Homo sapiens
gcagcaggcagag

SEQ ID NO: 1885634 - DNA, 14 bp, Homo sapiens
gcagcaggtgctgc

SEQ ID NO: 1885635 - DNA, 17 bp, Homo sapiens
gcagcaggtgctgctac

SEQ ID NO: 1885636 - DNA, 22 bp, Homo sapiens
gcagcaggtgctgctaccctcc

SEQ ID NO: 1885637 - DNA, 15 bp, Homo sapiens
gcagccccaggacca

SEQ ID NO: 1885638 - DNA, 13 bp, Homo sapiens
gcagcttcagttg

SEQ ID NO: 1885639 - DNA, 15 bp, Homo sapiens
gcagcttctgccact

SEQ ID NO: 1885640 - DNA, 17 bp, Homo sapiens
gcaggaatcaaggagcc

SEQ ID NO: 1885641 - DNA, 19 bp, Homo sapiens
gcaggaatcaaggagcctc

SEQ ID NO: 1885642 - DNA, 13 bp, Homo sapiens
gcaggaggaggtg

SEQ ID NO: 1885643 - DNA, 12 bp, Homo sapiens
gcaggaggcctg

SEQ ID NO: 1885644 - DNA, 16 bp, Homo sapiens
gcaggaggcctgggag

SEQ ID NO: 1885645 - DNA, 19 bp, Homo sapiens
gcaggaggcctgggagggc

SEQ ID NO: 1885646 - DNA, 23 bp, Homo sapiens
gcaggaggcctgggagggcaagg

SEQ ID NO: 1885647 - DNA, 18 bp, Homo sapiens
gcaggccctgcactgtcc

SEQ ID NO: 1885648 - DNA, 18 bp, Homo sapiens
gcaggctccagttgaaca

SEQ ID NO: 1885649 - DNA, 20 bp, Homo sapiens
gcaggctgcagcaggcagag

SEQ ID NO: 1885650 - DNA, 12 bp, Homo sapiens
gcagggaagctt

SEQ ID NO: 1885651 - DNA, 12 bp, Homo sapiens
gcaggggagtct

SEQ ID NO: 1885652 - DNA, 13 bp, Homo sapiens
gcaggggagtctg

SEQ ID NO: 1885653 - DNA, 14 bp, Homo sapiens
gcaggtgctgctac

SEQ ID NO: 1885654 - DNA, 15 bp, Homo sapiens
gcaggtgctgctacc

SEQ ID NO: 1885655 - DNA, 23 bp, Homo sapiens
gcaggtgctgctaccctccctgc

SEQ ID NO: 1885656 - DNA, 21 bp, Homo sapiens
gcaggtttctccttgaagcaa

SEQ ID NO: 1885657 - DNA, 21 bp, Homo sapiens
gcagtgggtcccacttcccct

SEQ ID NO: 1885658 - DNA, 22 bp, Homo sapiens
gcagtgggtcccacttcccctc

SEQ ID NO: 1885659 - DNA, 19 bp, Homo sapiens
gcagtttttataatagatt

SEQ ID NO: 1885660 - DNA, 22 bp, Homo sapiens
gcataatgttaagctttattgt

SEQ ID NO: 1885661 - DNA, 15 bp, Homo sapiens
gcatgagttatctga

SEQ ID NO: 1885662 - DNA, 15 bp, Homo sapiens
gcatgccccctcgtg

SEQ ID NO: 1885663 - DNA, 18 bp, Homo sapiens
gcatgccccctcgtgcca

SEQ ID NO: 1885664 - DNA, 19 bp, Homo sapiens
gcatgccccctcgtgccag

SEQ ID NO: 1885665 - DNA, 20 bp, Homo sapiens
gcatgccccctcgtgccagt

SEQ ID NO: 1885666 - DNA, 17 bp, Homo sapiens
gcatgctggtgagccaa

SEQ ID NO: 1885667 - DNA, 13 bp, Homo sapiens
gcatggaatttgt

SEQ ID NO: 1885668 - DNA, 17 bp, Homo sapiens
gcatggaatttgtaagt

SEQ ID NO: 1885669 - DNA, 19 bp, Homo sapiens
gcattctgcctgcctggga

SEQ ID NO: 1885670 - DNA, 21 bp, Homo sapiens
gcattggcagcaggtgctgct

SEQ ID NO: 1885671 - DNA, 13 bp, Homo sapiens
gcatttagatgta

SEQ ID NO: 1885672 - DNA, 12 bp, Homo sapiens
gcattttcttca

SEQ ID NO: 1885673 - DNA, 12 bp, Homo sapiens
gccaaataaagt

SEQ ID NO: 1885674 - DNA, 14 bp, Homo sapiens
gccaaataaagtct

SEQ ID NO: 1885675 - DNA, 22 bp, Homo sapiens
gccaacagtgttaggcctggca

SEQ ID NO: 1885676 - DNA, 13 bp, Homo sapiens
gccacaccaagct

SEQ ID NO: 1885677 - DNA, 17 bp, Homo sapiens
gccacaccaagctgtgc

SEQ ID NO: 1885678 - DNA, 19 bp, Homo sapiens
gccacaccaagctgtgcca

SEQ ID NO: 1885679 - DNA, 19 bp, Homo sapiens
gccacaggacccagaaaaa

SEQ ID NO: 1885680 - DNA, 12 bp, Homo sapiens
gccaccctgggc

SEQ ID NO: 1885681 - DNA, 19 bp, Homo sapiens
gccaccctgggctctgtgg

SEQ ID NO: 1885682 - DNA, 10 bp, Homo sapiens
gccacctgcc

SEQ ID NO: 1885683 - DNA, 13 bp, Homo sapiens
gccacgaggtggt

SEQ ID NO: 1885684 - DNA, 21 bp, Homo sapiens
gccacgaggtggtagctctga

SEQ ID NO: 1885685 - DNA, 15 bp, Homo sapiens
gccacggccacagtc

SEQ ID NO: 1885686 - DNA, 19 bp, Homo sapiens
gccaggtgggcgggcagca

SEQ ID NO: 1885687 - DNA, 15 bp, Homo sapiens
gccagtcgcgctgcc

SEQ ID NO: 1885688 - DNA, 18 bp, Homo sapiens
gccagtcgcgctgcctgt

SEQ ID NO: 1885689 - DNA, 20 bp, Homo sapiens
gccagtcgcgctgcctgtgt

SEQ ID NO: 1885690 - DNA, 20 bp, Homo sapiens
gccagttggcttctgtgcct

SEQ ID NO: 1885691 - DNA, 13 bp, Homo sapiens
gccatactggcct

SEQ ID NO: 1885692 - DNA, 14 bp, Homo sapiens
gccatactggcctc

SEQ ID NO: 1885693 - DNA, 20 bp, Homo sapiens
gccatactggcctcgcctgg

SEQ ID NO: 1885694 - DNA, 21 bp, Homo sapiens
gccatactggcctcgcctggc

SEQ ID NO: 1885695 - DNA, 22 bp, Homo sapiens
gccatactggcctcgcctggcc

SEQ ID NO: 1885696 - DNA, 17 bp, Homo sapiens
gccatcttccaggtggg

SEQ ID NO: 1885697 - DNA, 15 bp, Homo sapiens
gcccaacacacactc

SEQ ID NO: 1885698 - DNA, 16 bp, Homo sapiens
gcccacagctgtatga

SEQ ID NO: 1885699 - DNA, 15 bp, Homo sapiens
gcccacatccagtgg

SEQ ID NO: 1885700 - DNA, 16 bp, Homo sapiens
gcccaccgcatgcccc

SEQ ID NO: 1885701 - DNA, 13 bp, Homo sapiens
gcccacgtcctgt

SEQ ID NO: 1885702 - DNA, 23 bp, Homo sapiens
gcccacgtcctgtcagtgccgcc

SEQ ID NO: 1885703 - DNA, 17 bp, Homo sapiens
gcccagctcccccggga

SEQ ID NO: 1885704 - DNA, 20 bp, Homo sapiens
gcccaggacggggccggcca

SEQ ID NO: 1885705 - DNA, 13 bp, Homo sapiens
gcccaggccatct

SEQ ID NO: 1885706 - DNA, 14 bp, Homo sapiens
gcccaggctggcca

SEQ ID NO: 1885707 - DNA, 17 bp, Homo sapiens
gcccaggctggccagcc

SEQ ID NO: 1885708 - DNA, 19 bp, Homo sapiens
gcccaggctggccagcccc

SEQ ID NO: 1885709 - DNA, 22 bp, Homo sapiens
gcccatcagtgtacccccgccc

SEQ ID NO: 1885710 - DNA, 15 bp, Homo sapiens
gcccatgggcactgc

SEQ ID NO: 1885711 - DNA, 17 bp, Homo sapiens
gcccatgggcactgctg

SEQ ID NO: 1885712 - DNA, 18 bp, Homo sapiens
gcccatgggcactgctgg

SEQ ID NO: 1885713 - DNA, 19 bp, Homo sapiens
gccccaacccccagcaccc

SEQ ID NO: 1885714 - DNA, 14 bp, Homo sapiens
gccccacagcccac

SEQ ID NO: 1885715 - DNA, 17 bp, Homo sapiens
gccccacagcccacgtc

SEQ ID NO: 1885716 - DNA, 23 bp, Homo sapiens
gccccacagcccacgtcctgtca

SEQ ID NO: 1885717 - DNA, 12 bp, Homo sapiens
gccccagcctgg

SEQ ID NO: 1885718 - DNA, 16 bp, Homo sapiens
gccccagcctggccca

SEQ ID NO: 1885719 - DNA, 18 bp, Homo sapiens
ctggggccaaataaagtc

SEQ ID NO: 1885720 - DNA, 17 bp, Homo sapiens
ctggggcctatcagtgt

SEQ ID NO: 1885721 - DNA, 19 bp, Homo sapiens
ctgggggcatgggggaggc

SEQ ID NO: 1885722 - DNA, 21 bp, Homo sapiens
ctgggggcatgggggaggctc

SEQ ID NO: 1885723 - DNA, 23 bp, Homo sapiens
ctgggggcatgggggaggctctg

SEQ ID NO: 1885724 - DNA, 20 bp, Homo sapiens
ctggggtgggtttagcaggc

SEQ ID NO: 1885725 - DNA, 22 bp, Homo sapiens
ctggggtgggtttagcaggctg

SEQ ID NO: 1885726 - DNA, 19 bp, Homo sapiens
ctgggtgcgaccccatctg

SEQ ID NO: 1885727 - DNA, 20 bp, Homo sapiens
ctgggtggcccatcccccct

SEQ ID NO: 1885728 - DNA, 21 bp, Homo sapiens
ctgggtggcccatcccccctc

SEQ ID NO: 1885729 - DNA, 16 bp, Homo sapiens
ctgggttggcgcaccc

SEQ ID NO: 1885730 - DNA, 20 bp, Homo sapiens
ctgggttggcgcaccctccc

SEQ ID NO: 1885731 - DNA, 16 bp, Homo sapiens
ctggttacctgttcca

SEQ ID NO: 1885732 - DNA, 19 bp, Homo sapiens
ctggttacctgttccattg

SEQ ID NO: 1885733 - DNA, 21 bp, Homo sapiens
ctgtaaaaagagagaaaactt

SEQ ID NO: 1885734 - DNA, 20 bp, Homo sapiens
ctgtaagaaaatatcacttg

SEQ ID NO: 1885735 - DNA, 16 bp, Homo sapiens
ctgtagaggaccagga

SEQ ID NO: 1885736 - DNA, 14 bp, Homo sapiens
ctgtaggagagact

SEQ ID NO: 1885737 - DNA, 22 bp, Homo sapiens
ctgtaggagagactggccagag

SEQ ID NO: 1885738 - DNA, 18 bp, Homo sapiens
ctgtaggcgcccctgggg

SEQ ID NO: 1885739 - DNA, 21 bp, Homo sapiens
ctgtaggcgcccctggggtgg

SEQ ID NO: 1885740 - DNA, 15 bp, Homo sapiens
ctgtatgattcccag

SEQ ID NO: 1885741 - DNA, 14 bp, Homo sapiens
ctgtcatctgggcc

SEQ ID NO: 1885742 - DNA, 15 bp, Homo sapiens
ctgtcatctgggcca

SEQ ID NO: 1885743 - DNA, 15 bp, Homo sapiens
ctgtccagtgcccat

SEQ ID NO: 1885744 - DNA, 21 bp, Homo sapiens
ctgtcccaggggtctccctga

SEQ ID NO: 1885745 - DNA, 16 bp, Homo sapiens
ctgtcccctcttgccc

SEQ ID NO: 1885746 - DNA, 20 bp, Homo sapiens
ctgtcccctcttgccccaac

SEQ ID NO: 1885747 - DNA, 13 bp, Homo sapiens
ctgtcctgctcca

SEQ ID NO: 1885748 - DNA, 14 bp, Homo sapiens
ctgtcctgctccac

SEQ ID NO: 1885749 - DNA, 15 bp, Homo sapiens
ctgtcctgctccaca

SEQ ID NO: 1885750 - DNA, 13 bp, Homo sapiens
ctgtgccaccctg

SEQ ID NO: 1885751 - DNA, 17 bp, Homo sapiens
ctgtgccaccctgggct

SEQ ID NO: 1885752 - DNA, 18 bp, Homo sapiens
ctgtgccaccctgggctc

SEQ ID NO: 1885753 - DNA, 22 bp, Homo sapiens
ctgtgccaccctgggctctgtg

SEQ ID NO: 1885754 - DNA, 17 bp, Homo sapiens
ctgtgcccttattcagg

SEQ ID NO: 1885755 - DNA, 20 bp, Homo sapiens
ctgtgcctgactctgtgctg

SEQ ID NO: 1885756 - DNA, 22 bp, Homo sapiens
ctgtgggctgcactctgtgccc

SEQ ID NO: 1885757 - DNA, 22 bp, Homo sapiens
ctgtgggggaagagcacagccc

SEQ ID NO: 1885758 - DNA, 15 bp, Homo sapiens
ctgtggtcacagtga

SEQ ID NO: 1885759 - DNA, 13 bp, Homo sapiens
ctgtgtaaagact

SEQ ID NO: 1885760 - DNA, 19 bp, Homo sapiens
ctgtgtaaagacttgagaa

SEQ ID NO: 1885761 - DNA, 14 bp, Homo sapiens
ctgtgtgggagggc

SEQ ID NO: 1885762 - DNA, 14 bp, Homo sapiens
ctgtgtgttgacac

SEQ ID NO: 1885763 - DNA, 19 bp, Homo sapiens
ctgttataatctttcacag

SEQ ID NO: 1885764 - DNA, 13 bp, Homo sapiens
ctgttctgtagga

SEQ ID NO: 1885765 - DNA, 19 bp, Homo sapiens
ctgttctgtaggagagact

SEQ ID NO: 1885766 - DNA, 12 bp, Homo sapiens
ctgtttctgtag

SEQ ID NO: 1885767 - DNA, 14 bp, Homo sapiens
ctgttttataattt

SEQ ID NO: 1885768 - DNA, 15 bp, Homo sapiens
ctgttttataatttt

SEQ ID NO: 1885769 - DNA, 19 bp, Homo sapiens
ctgttttataattttgtga

SEQ ID NO: 1885770 - DNA, 18 bp, Homo sapiens
cttaagagcttgatctgt

SEQ ID NO: 1885771 - DNA, 21 bp, Homo sapiens
cttaagagcttgatctgtgat

SEQ ID NO: 1885772 - DNA, 23 bp, Homo sapiens
cttaatttaatgtattaatctgt

SEQ ID NO: 1885773 - DNA, 15 bp, Homo sapiens
cttacctatttcctc

SEQ ID NO: 1885774 - DNA, 22 bp, Homo sapiens
cttagatgcagttctgaagaag

SEQ ID NO: 1885775 - DNA, 15 bp, Homo sapiens
cttatattttgattt

SEQ ID NO: 1885776 - DNA, 12 bp, Homo sapiens
cttatttgagtg

SEQ ID NO: 1885777 - DNA, 13 bp, Homo sapiens
cttatttgagtga

SEQ ID NO: 1885778 - DNA, 13 bp, Homo sapiens
cttcacagtgcag

SEQ ID NO: 1885779 - DNA, 18 bp, Homo sapiens
cttcagcggtttatataa

SEQ ID NO: 1885780 - DNA, 18 bp, Homo sapiens
cttcagttgttctttaga

SEQ ID NO: 1885781 - DNA, 14 bp, Homo sapiens
cttcagttgttttc

SEQ ID NO: 1885782 - DNA, 10 bp, Homo sapiens
cttcatgtgg

SEQ ID NO: 1885783 - DNA, 21 bp, Homo sapiens
cttcattcaagtcagctcttc

SEQ ID NO: 1885784 - DNA, 18 bp, Homo sapiens
cttccaaggtggtctgct

SEQ ID NO: 1885785 - DNA, 20 bp, Homo sapiens
cttccaaggtggtctgctcg

SEQ ID NO: 1885786 - DNA, 21 bp, Homo sapiens
cttccaaggtggtctgctcgg

SEQ ID NO: 1885787 - DNA, 17 bp, Homo sapiens
cttccactgtgtgttga

SEQ ID NO: 1885788 - DNA, 16 bp, Homo sapiens
cttccattattgagtt

SEQ ID NO: 1885789 - DNA, 19 bp, Homo sapiens
ttggcgcaccctcccctcc

SEQ ID NO: 1885790 - DNA, 23 bp, Homo sapiens
ttgggaaattaaatccaataaaa

SEQ ID NO: 1885791 - DNA, 17 bp, Homo sapiens
ttgggaaggaaatatat

SEQ ID NO: 1885792 - DNA, 20 bp, Homo sapiens
ttgggcatttatattccact

SEQ ID NO: 1885793 - DNA, 18 bp, Homo sapiens
ttgggccatactggcctc

SEQ ID NO: 1885794 - DNA, 15 bp, Homo sapiens
ttgggtgtgccctgg

SEQ ID NO: 1885795 - DNA, 22 bp, Homo sapiens
ttggtaaattgtaaacagctaa

SEQ ID NO: 1885796 - DNA, 14 bp, Homo sapiens
ttgtaagtttatgt

SEQ ID NO: 1885797 - DNA, 14 bp, Homo sapiens
ttgtaattattgtg

SEQ ID NO: 1885798 - DNA, 15 bp, Homo sapiens
ttgtataaaataatt

SEQ ID NO: 1885799 - DNA, 16 bp, Homo sapiens
ttgtataaaataattt

SEQ ID NO: 1885800 - DNA, 17 bp, Homo sapiens
ttgtataaaataatttt

SEQ ID NO: 1885801 - DNA, 17 bp, Homo sapiens
ttgtatagagatatgca

SEQ ID NO: 1885802 - DNA, 17 bp, Homo sapiens
ttgtattaaaaatagat

SEQ ID NO: 1885803 - DNA, 15 bp, Homo sapiens
ttgtctaaaatgtca

SEQ ID NO: 1885804 - DNA, 13 bp, Homo sapiens
ttgtgaaatgtaa

SEQ ID NO: 1885805 - DNA, 15 bp, Homo sapiens
ttgtgaaatgtaaca

SEQ ID NO: 1885806 - DNA, 19 bp, Homo sapiens
ttgtgtcatgtttaagaaa

SEQ ID NO: 1885807 - DNA, 18 bp, Homo sapiens
ttgtgttttgcaagccag

SEQ ID NO: 1885808 - DNA, 14 bp, Homo sapiens
ttgttcttcttaaa

SEQ ID NO: 1885809 - DNA, 19 bp, Homo sapiens
tttaaaatagaatgataga

SEQ ID NO: 1885810 - DNA, 18 bp, Homo sapiens
tttaaacctatactcact

SEQ ID NO: 1885811 - DNA, 12 bp, Homo sapiens
tttaaagtctat

SEQ ID NO: 1885812 - DNA, 15 bp, Homo sapiens
tttaaagtttgttca

SEQ ID NO: 1885813 - DNA, 21 bp, Homo sapiens
tttaacataatggttgtgaaa

SEQ ID NO: 1885814 - DNA, 14 bp, Homo sapiens
tttaactgccttgt

SEQ ID NO: 1885815 - DNA, 14 bp, Homo sapiens
tttaactggagctc

SEQ ID NO: 1885816 - DNA, 15 bp, Homo sapiens
tttaactggagctcc

SEQ ID NO: 1885817 - DNA, 16 bp, Homo sapiens
tttaagttgtattaaa

SEQ ID NO: 1885818 - DNA, 14 bp, Homo sapiens
tttaataatgtttc

SEQ ID NO: 1885819 - DNA, 14 bp, Homo sapiens
tttaatgagataat

SEQ ID NO: 1885820 - DNA, 15 bp, Homo sapiens
tttacagtaaataaa

SEQ ID NO: 1885821 - DNA, 19 bp, Homo sapiens
tttactctgtgtaaagact

SEQ ID NO: 1885822 - DNA, 20 bp, Homo sapiens
tttagaaacacaactatatt

SEQ ID NO: 1885823 - DNA, 19 bp, Homo sapiens
tttagcttcagttgttctt

SEQ ID NO: 1885824 - DNA, 15 bp, Homo sapiens
tttagggatctgggg

SEQ ID NO: 1885825 - DNA, 23 bp, Homo sapiens
tttagtagatattaccagttttc

SEQ ID NO: 1885826 - DNA, 16 bp, Homo sapiens
tttataaacctctaat

SEQ ID NO: 1885827 - DNA, 17 bp, Homo sapiens
tttataaacctctaatt

SEQ ID NO: 1885828 - DNA, 13 bp, Homo sapiens
tttataatagatt

SEQ ID NO: 1885829 - DNA, 13 bp, Homo sapiens
tttatataagctt

SEQ ID NO: 1885830 - DNA, 17 bp, Homo sapiens
tttatattgggaagctg

SEQ ID NO: 1885831 - DNA, 13 bp, Homo sapiens
tttatccatttct

SEQ ID NO: 1885832 - DNA, 19 bp, Homo sapiens
tttcaaacatatataacaa

SEQ ID NO: 1885833 - DNA, 16 bp, Homo sapiens
tttcaatttgtcatgt

SEQ ID NO: 1885834 - DNA, 21 bp, Homo sapiens
tttcagctgtgaacatggact

SEQ ID NO: 1885835 - DNA, 13 bp, Homo sapiens
tttcatctgttgt

SEQ ID NO: 1885836 - DNA, 13 bp, Homo sapiens
tttccatgtatct

SEQ ID NO: 1885837 - DNA, 18 bp, Homo sapiens
tttcccactgcaccccct

SEQ ID NO: 1885838 - DNA, 22 bp, Homo sapiens
tttcccactgcaccccctcctg

SEQ ID NO: 1885839 - DNA, 21 bp, Homo sapiens
tttcccgagcaaagtctaaag

SEQ ID NO: 1885840 - DNA, 18 bp, Homo sapiens
tttcccgtggccccagcc

SEQ ID NO: 1885841 - DNA, 18 bp, Homo sapiens
tttccttacctatttcct

SEQ ID NO: 1885842 - DNA, 21 bp, Homo sapiens
tttcgtctgtttataaacatt

SEQ ID NO: 1885843 - DNA, 16 bp, Homo sapiens
tttctacttttaaaga

SEQ ID NO: 1885844 - DNA, 13 bp, Homo sapiens
tttctatgaaata

SEQ ID NO: 1885845 - DNA, 14 bp, Homo sapiens
tttctatgaaatat

SEQ ID NO: 1885846 - DNA, 12 bp, Homo sapiens
tttctctaggaa

SEQ ID NO: 1885847 - DNA, 19 bp, Homo sapiens
tttctgggctgtctattct

SEQ ID NO: 1885848 - DNA, 12 bp, Homo sapiens
tttctgtagaaa

SEQ ID NO: 1885849 - DNA, 21 bp, Homo sapiens
tttcttctagctgagctttaa

SEQ ID NO: 1885850 - DNA, 13 bp, Homo sapiens
tttcttgcactga

SEQ ID NO: 1885851 - DNA, 22 bp, Homo sapiens
tttgaggatgggatgtattttt

SEQ ID NO: 1885852 - DNA, 14 bp, Homo sapiens
tttgcaagccagat

SEQ ID NO: 1885853 - DNA, 18 bp, Homo sapiens
tttgcagtatatttctga

SEQ ID NO: 1885854 - DNA, 13 bp, Homo sapiens
tttgctagttttt

SEQ ID NO: 1885855 - DNA, 11 bp, Homo sapiens
tttgctcatgg

SEQ ID NO: 1885856 - DNA, 12 bp, Homo sapiens
tttgctcatgga

SEQ ID NO: 1885857 - DNA, 13 bp, Homo sapiens
tttgctcatggaa

SEQ ID NO: 1885858 - DNA, 21 bp, Homo sapiens
tttgtaagtttatgtctaaag

SEQ ID NO: 1885859 - DNA, 19 bp, Homo sapiens
tttgtagtgttggagaaga

SEQ ID NO: 1885860 - DNA, 21 bp, Homo sapiens
tttgtagtgttggagaagaac

SEQ ID NO: 1885861 - DNA, 20 bp, Homo sapiens
tttgtcgaatttttattatt

SEQ ID NO: 1885862 - DNA, 12 bp, Homo sapiens
tttgttatttgt

SEQ ID NO: 1885863 - DNA, 15 bp, Homo sapiens
ttttaacgtggcttg

SEQ ID NO: 1885864 - DNA, 22 bp, Homo sapiens
tgttcccctttgcttcattcaa

SEQ ID NO: 1885865 - DNA, 14 bp, Homo sapiens
tgttgacactgttt

SEQ ID NO: 1885866 - DNA, 14 bp, Homo sapiens
tgttggagaagaac

SEQ ID NO: 1885867 - DNA, 17 bp, Homo sapiens
tgttggagaagaactga

SEQ ID NO: 1885868 - DNA, 19 bp, Homo sapiens
tgttggagaagaactgaaa

SEQ ID NO: 1885869 - DNA, 13 bp, Homo sapiens
tgttgttctgtgg

SEQ ID NO: 1885870 - DNA, 21 bp, Homo sapiens
tgtttgtgcaaacataatacc

SEQ ID NO: 1885871 - DNA, 14 bp, Homo sapiens
tgttttatgttcta

SEQ ID NO: 1885872 - DNA, 18 bp, Homo sapiens
ttaaaaaagaaacatttg

SEQ ID NO: 1885873 - DNA, 12 bp, Homo sapiens
ttaaaactcctg

SEQ ID NO: 1885874 - DNA, 13 bp, Homo sapiens
ttaaaagaatgat

SEQ ID NO: 1885875 - DNA, 14 bp, Homo sapiens
ttaaacctatactc

SEQ ID NO: 1885876 - DNA, 21 bp, Homo sapiens
ttaaagccctgtgttaagtgt

SEQ ID NO: 1885877 - DNA, 14 bp, Homo sapiens
ttaaatccaataaa

SEQ ID NO: 1885878 - DNA, 20 bp, Homo sapiens
ttaaatgtatatgtcattta

SEQ ID NO: 1885879 - DNA, 22 bp, Homo sapiens
ttaaattgtcagatcgttcatt

SEQ ID NO: 1885880 - DNA, 18 bp, Homo sapiens
ttaaatttaggtaaataa

SEQ ID NO: 1885881 - DNA, 22 bp, Homo sapiens
ttaaatttaggtaaataaagct

SEQ ID NO: 1885882 - DNA, 23 bp, Homo sapiens
ttaaatttaggtaaataaagctc

SEQ ID NO: 1885883 - DNA, 18 bp, Homo sapiens
ttaacacctttaaagtgt

SEQ ID NO: 1885884 - DNA, 23 bp, Homo sapiens
ttaacataatggttgtgaaatgt

SEQ ID NO: 1885885 - DNA, 19 bp, Homo sapiens
ttaacgtggcttgtagaat

SEQ ID NO: 1885886 - DNA, 15 bp, Homo sapiens
ttaagccttcatttg

SEQ ID NO: 1885887 - DNA, 16 bp, Homo sapiens
ttaagctttattgtga

SEQ ID NO: 1885888 - DNA, 16 bp, Homo sapiens
ttaataatgtttcaaa

SEQ ID NO: 1885889 - DNA, 15 bp, Homo sapiens
ttaatcgtgtcttca

SEQ ID NO: 1885890 - DNA, 16 bp, Homo sapiens
ttaatctgtatttccc

SEQ ID NO: 1885891 - DNA, 14 bp, Homo sapiens
ttaatgaatgacca

SEQ ID NO: 1885892 - DNA, 12 bp, Homo sapiens
ttaatttaatgt

SEQ ID NO: 1885893 - DNA, 15 bp, Homo sapiens
ttacagtaaataaat

SEQ ID NO: 1885894 - DNA, 16 bp, Homo sapiens
ttacagtaaataaatt

SEQ ID NO: 1885895 - DNA, 18 bp, Homo sapiens
ttacagtaaataaattgt

SEQ ID NO: 1885896 - DNA, 22 bp, Homo sapiens
ttacagtaaataaattgtttga

SEQ ID NO: 1885897 - DNA, 20 bp, Homo sapiens
ttacatttgtataaaataat

SEQ ID NO: 1885898 - DNA, 15 bp, Homo sapiens
ttaccttattgcact

SEQ ID NO: 1885899 - DNA, 13 bp, Homo sapiens
ttactctgtgtaa

SEQ ID NO: 1885900 - DNA, 18 bp, Homo sapiens
ttacttagcaagacctga

SEQ ID NO: 1885901 - DNA, 19 bp, Homo sapiens
ttagaaacacaactatatt

SEQ ID NO: 1885902 - DNA, 14 bp, Homo sapiens
ttagaataaaattg

SEQ ID NO: 1885903 - DNA, 22 bp, Homo sapiens
ttctttcacttgatgtttgtta

SEQ ID NO: 1885904 - DNA, 18 bp, Homo sapiens
ttctttccacagaagctc

SEQ ID NO: 1885905 - DNA, 22 bp, Homo sapiens
ttctttcttttaagcagaccca

SEQ ID NO: 1885906 - DNA, 13 bp, Homo sapiens
ttcttttactctg

SEQ ID NO: 1885907 - DNA, 18 bp, Homo sapiens
ttctttttaaagtttgtt

SEQ ID NO: 1885908 - DNA, 14 bp, Homo sapiens
ttcttttttcagtt

SEQ ID NO: 1885909 - DNA, 20 bp, Homo sapiens
ttgaacactagtctgtgtaa

SEQ ID NO: 1885910 - DNA, 23 bp, Homo sapiens
ttgaacactagtctgtgtaactt

SEQ ID NO: 1885911 - DNA, 21 bp, Homo sapiens
ttgaacagactagaagtattt

SEQ ID NO: 1885912 - DNA, 17 bp, Homo sapiens
ttgaactgcaggaagag

SEQ ID NO: 1885913 - DNA, 14 bp, Homo sapiens
ttgacactgttttc

SEQ ID NO: 1885914 - DNA, 17 bp, Homo sapiens
ttgacaggggctcagga

SEQ ID NO: 1885915 - DNA, 13 bp, Homo sapiens
ttgacatgggaca

SEQ ID NO: 1885916 - DNA, 18 bp, Homo sapiens
ttgactgcagttgaacag

SEQ ID NO: 1885917 - DNA, 20 bp, Homo sapiens
ttgagaagtctaattcacag

SEQ ID NO: 1885918 - DNA, 14 bp, Homo sapiens
ttgaggacactgat

SEQ ID NO: 1885919 - DNA, 15 bp, Homo sapiens
ttgaggacactgata

SEQ ID NO: 1885920 - DNA, 19 bp, Homo sapiens
ttgaggagcagcttcagtt

SEQ ID NO: 1885921 - DNA, 16 bp, Homo sapiens
ttgaggattttgagta

SEQ ID NO: 1885922 - DNA, 12 bp, Homo sapiens
ttgagtgattat

SEQ ID NO: 1885923 - DNA, 17 bp, Homo sapiens
ttgatctgtgatttctt

SEQ ID NO: 1885924 - DNA, 21 bp, Homo sapiens
ttgatctgtgatttcttctcc

SEQ ID NO: 1885925 - DNA, 19 bp, Homo sapiens
ttgatggtggtatgttttc

SEQ ID NO: 1885926 - DNA, 18 bp, Homo sapiens
ttgattacaaataaacag

SEQ ID NO: 1885927 - DNA, 20 bp, Homo sapiens
ttgatttttatccatttctt

SEQ ID NO: 1885928 - DNA, 16 bp, Homo sapiens
ttgcactgaatatata

SEQ ID NO: 1885929 - DNA, 23 bp, Homo sapiens
ttgcactgaatatataaacactc

SEQ ID NO: 1885930 - DNA, 14 bp, Homo sapiens
ttgcagtttttata

SEQ ID NO: 1885931 - DNA, 14 bp, Homo sapiens
ttgccccaaccccc

SEQ ID NO: 1885932 - DNA, 16 bp, Homo sapiens
ttgccccaacccccag

SEQ ID NO: 1885933 - DNA, 21 bp, Homo sapiens
ttgccctgagctttccgggga

SEQ ID NO: 1885934 - DNA, 14 bp, Homo sapiens
ttgcctcggctcct

SEQ ID NO: 1885935 - DNA, 15 bp, Homo sapiens
ttgcctcggctcctg

SEQ ID NO: 1885936 - DNA, 16 bp, Homo sapiens
ttgcctcggctcctgc

SEQ ID NO: 1885937 - DNA, 12 bp, Homo sapiens
ttgcctttccag

SEQ ID NO: 1885938 - DNA, 18 bp, Homo sapiens
ttgctaagcattccaact

SEQ ID NO: 1885939 - DNA, 12 bp, Homo sapiens
ttgctcatggaa

SEQ ID NO: 1885940 - DNA, 18 bp, Homo sapiens
ttgctggagtgctggctc

SEQ ID NO: 1885941 - DNA, 19 bp, Homo sapiens
ttgctggagtgctggctcc

SEQ ID NO: 1885942 - DNA, 20 bp, Homo sapiens
ttgctggagtgctggctcca

SEQ ID NO: 1885943 - DNA, 21 bp, Homo sapiens
ttgctgttcagtgctttttcc

SEQ ID NO: 1885944 - DNA, 22 bp, Homo sapiens
ttggcagcaggtgctgctaccc

SEQ ID NO: 1885945 - DNA, 16 bp, Homo sapiens
tgctctccttgccctg

SEQ ID NO: 1885946 - DNA, 19 bp, Homo sapiens
tgctctccttgccctgggc

SEQ ID NO: 1885947 - DNA, 21 bp, Homo sapiens
tgctctccttgccctgggcca

SEQ ID NO: 1885948 - DNA, 23 bp, Homo sapiens
tgctctgagacggatggaaggag

SEQ ID NO: 1885949 - DNA, 14 bp, Homo sapiens
tgctgaaaatgatt

SEQ ID NO: 1885950 - DNA, 15 bp, Homo sapiens
tgctgagcacagaga

SEQ ID NO: 1885951 - DNA, 17 bp, Homo sapiens
tgctgatggctgctgga

SEQ ID NO: 1885952 - DNA, 14 bp, Homo sapiens
tgctgcaccaaccc

SEQ ID NO: 1885953 - DNA, 17 bp, Homo sapiens
tgctgctaccctccctg

SEQ ID NO: 1885954 - DNA, 19 bp, Homo sapiens
tgctgctaccctccctgct

SEQ ID NO: 1885955 - DNA, 20 bp, Homo sapiens
tgctgctaccctccctgctg

SEQ ID NO: 1885956 - DNA, 16 bp, Homo sapiens
tgctgcttctgggcct

SEQ ID NO: 1885957 - DNA, 17 bp, Homo sapiens
tgctgcttctgggcctg

SEQ ID NO: 1885958 - DNA, 24 bp, Homo sapiens
tgctgcttctgggcctgatggaga

SEQ ID NO: 1885959 - DNA, 20 bp, Homo sapiens
tgctggaggggacgctggct

SEQ ID NO: 1885960 - DNA, 15 bp, Homo sapiens
tgctggagtgctggc

SEQ ID NO: 1885961 - DNA, 23 bp, Homo sapiens
tgctggctccacgccctggggag

SEQ ID NO: 1885962 - DNA, 16 bp, Homo sapiens
tgctgggctgggtgcg

SEQ ID NO: 1885963 - DNA, 13 bp, Homo sapiens
tgctgggtggccc

SEQ ID NO: 1885964 - DNA, 22 bp, Homo sapiens
tgctggtaatttgtatctgaag

SEQ ID NO: 1885965 - DNA, 21 bp, Homo sapiens
tgctgtattttaaaagaatga

SEQ ID NO: 1885966 - DNA, 23 bp, Homo sapiens
tgctgtattttaaaagaatgatt

SEQ ID NO: 1885967 - DNA, 18 bp, Homo sapiens
tgctgtccggtggagatc

SEQ ID NO: 1885968 - DNA, 19 bp, Homo sapiens
tgcttctgggcctgatgga

SEQ ID NO: 1885969 - DNA, 22 bp, Homo sapiens
tgcttctgttttataattttgt

SEQ ID NO: 1885970 - DNA, 17 bp, Homo sapiens
tgcttgggcttctgcgg

SEQ ID NO: 1885971 - DNA, 17 bp, Homo sapiens
tgctttttccttttcat

SEQ ID NO: 1885972 - DNA, 22 bp, Homo sapiens
tggaaaagtatgttagtgcaaa

SEQ ID NO: 1885973 - DNA, 21 bp, Homo sapiens
tggaaattgggtgtgccctgg

SEQ ID NO: 1885974 - DNA, 20 bp, Homo sapiens
tggaactaggttttaataat

SEQ ID NO: 1885975 - DNA, 14 bp, Homo sapiens
tggaaggagagagg

SEQ ID NO: 1885976 - DNA, 14 bp, Homo sapiens
tggaatggactggg

SEQ ID NO: 1885977 - DNA, 14 bp, Homo sapiens
tggaatttgtaagt

SEQ ID NO: 1885978 - DNA, 16 bp, Homo sapiens
tggaatttgtaagttt

SEQ ID NO: 1885979 - DNA, 15 bp, Homo sapiens
tggacagaagcagct

SEQ ID NO: 1885980 - DNA, 16 bp, Homo sapiens
tggacagaagcagctc

SEQ ID NO: 1885981 - DNA, 18 bp, Homo sapiens
tggacagaagcagctctt

SEQ ID NO: 1885982 - DNA, 15 bp, Homo sapiens
tggacctcaccaagc

SEQ ID NO: 1885983 - DNA, 15 bp, Homo sapiens
tggacgacctccagc

SEQ ID NO: 1885984 - DNA, 21 bp, Homo sapiens
tggacgacctccagctctcag

SEQ ID NO: 1885985 - DNA, 15 bp, Homo sapiens
tggactgtcctaggt

SEQ ID NO: 1885986 - DNA, 18 bp, Homo sapiens
tggagaaacaggcccaga

SEQ ID NO: 1885987 - DNA, 13 bp, Homo sapiens
tggagaagaactg

SEQ ID NO: 1885988 - DNA, 14 bp, Homo sapiens
tggagaagaactga

SEQ ID NO: 1885989 - DNA, 13 bp, Homo sapiens
tggagaggagaac

SEQ ID NO: 1885990 - DNA, 16 bp, Homo sapiens
tggagcccctgtgtgg

SEQ ID NO: 1885991 - DNA, 21 bp, Homo sapiens
tggagcccctgtgtgggaggg

SEQ ID NO: 1885992 - DNA, 17 bp, Homo sapiens
tggagctcgtggaacag

SEQ ID NO: 1885993 - DNA, 20 bp, Homo sapiens
tggagctgagctacctgggg

SEQ ID NO: 1885994 - DNA, 21 bp, Homo sapiens
tggaggctcccatgggctagg

SEQ ID NO: 1885995 - DNA, 11 bp, Homo sapiens
tggagggaagc

SEQ ID NO: 1885996 - DNA, 21 bp, Homo sapiens
tggaggtggcgccccctggtg

SEQ ID NO: 1885997 - DNA, 13 bp, Homo sapiens
tggagtgctggct

SEQ ID NO: 1885998 - DNA, 20 bp, Homo sapiens
tggagtgggttggcttgctg

SEQ ID NO: 1885999 - DNA, 14 bp, Homo sapiens
tggatgacattaaa

SEQ ID NO: 1886000 - DNA, 19 bp, Homo sapiens
tggcacagtgtctgggctg

SEQ ID NO: 1886001 - DNA, 21 bp, Homo sapiens
tggcagcaggtgctgctaccc

SEQ ID NO: 1886002 - DNA, 17 bp, Homo sapiens
tggcagggaagctttca

SEQ ID NO: 1886003 - DNA, 14 bp, Homo sapiens
tggcattggcagca

SEQ ID NO: 1886004 - DNA, 19 bp, Homo sapiens
tggcattggcagcaggtgc

SEQ ID NO: 1886005 - DNA, 23 bp, Homo sapiens
tggccagccccacagcccacgtc

SEQ ID NO: 1886006 - DNA, 18 bp, Homo sapiens
tggccagtcatgtgctgg

SEQ ID NO: 1886007 - DNA, 14 bp, Homo sapiens
tggcccacctgagg

SEQ ID NO: 1886008 - DNA, 20 bp, Homo sapiens
tggcccacctgaggccccag

SEQ ID NO: 1886009 - DNA, 12 bp, Homo sapiens
tggcccagctcc

SEQ ID NO: 1886010 - DNA, 17 bp, Homo sapiens
tggcccatcccccctca

SEQ ID NO: 1886011 - DNA, 19 bp, Homo sapiens
tggcccatcccccctcacc

SEQ ID NO: 1886012 - DNA, 22 bp, Homo sapiens
tggcccatcccccctcaccagg

SEQ ID NO: 1886013 - DNA, 19 bp, Homo sapiens
tggccccagcctggcccag

SEQ ID NO: 1886014 - DNA, 22 bp, Homo sapiens
tggccccagcctggcccagctc

SEQ ID NO: 1886015 - DNA, 11 bp, Homo sapiens
tggccccctcc

SEQ ID NO: 1886016 - DNA, 18 bp, Homo sapiens
tggccctcaaggcctccc

SEQ ID NO: 1886017 - DNA, 21 bp, Homo sapiens
tggccctcaaggcctcccaca

SEQ ID NO: 1886018 - DNA, 16 bp, Homo sapiens
tggccgagctgaagaa

SEQ ID NO: 1886019 - DNA, 23 bp, Homo sapiens
tggccgggaccccgagcctggct

SEQ ID NO: 1886020 - DNA, 14 bp, Homo sapiens
tggcgcaccctccc

SEQ ID NO: 1886021 - DNA, 22 bp, Homo sapiens
tggctcccaagggaggcccatg

SEQ ID NO: 1886022 - DNA, 22 bp, Homo sapiens
tggctgctggaggggacgctgg

SEQ ID NO: 1886023 - DNA, 15 bp, Homo sapiens
tggctgtccagtgcc

SEQ ID NO: 1886024 - DNA, 16 bp, Homo sapiens
tggcttcctggcaata

SEQ ID NO: 1886025 - DNA, 17 bp, Homo sapiens
tggcttgtagaattttt

SEQ ID NO: 1886026 - DNA, 16 bp, Homo sapiens
tgggaacatggtcacc

SEQ ID NO: 1886027 - DNA, 19 bp, Homo sapiens
tgggaacggggtggacgag

SEQ ID NO: 1886028 - DNA, 21 bp, Homo sapiens
tgggaagctgtagaggaccag

SEQ ID NO: 1886029 - DNA, 21 bp, Homo sapiens
tgggacagtcacctcatggaa

SEQ ID NO: 1886030 - DNA, 19 bp, Homo sapiens
tgggacatttgctcatgga

SEQ ID NO: 1886031 - DNA, 20 bp, Homo sapiens
tgggacatttgctcatggaa

SEQ ID NO: 1886032 - DNA, 15 bp, Homo sapiens
tgccgccgcctcgcc

SEQ ID NO: 1886033 - DNA, 16 bp, Homo sapiens
tgccgccgcctcgccc

SEQ ID NO: 1886034 - DNA, 17 bp, Homo sapiens
tgccgccgcctcgccca

SEQ ID NO: 1886035 - DNA, 15 bp, Homo sapiens
tgccgggcctggact

SEQ ID NO: 1886036 - DNA, 14 bp, Homo sapiens
tgcctcactttctt

SEQ ID NO: 1886037 - DNA, 15 bp, Homo sapiens
tgcctcactttcttc

SEQ ID NO: 1886038 - DNA, 16 bp, Homo sapiens
tgcctcactttcttct

SEQ ID NO: 1886039 - DNA, 18 bp, Homo sapiens
tgcctcagaaaacaagga

SEQ ID NO: 1886040 - DNA, 14 bp, Homo sapiens
tgcctccactccca

SEQ ID NO: 1886041 - DNA, 20 bp, Homo sapiens
tgcctccactcccacttccc

SEQ ID NO: 1886042 - DNA, 13 bp, Homo sapiens
tgcctcggctcct

SEQ ID NO: 1886043 - DNA, 16 bp, Homo sapiens
tgcctcggctcctgct

SEQ ID NO: 1886044 - DNA, 22 bp, Homo sapiens
tgcctgaccatcccatgagcag

SEQ ID NO: 1886045 - DNA, 17 bp, Homo sapiens
tgcctgactctgtgctg

SEQ ID NO: 1886046 - DNA, 20 bp, Homo sapiens
tgcctgattcggctgtctca

SEQ ID NO: 1886047 - DNA, 12 bp, Homo sapiens
tgcctgcctggg

SEQ ID NO: 1886048 - DNA, 13 bp, Homo sapiens
tgcctgcctggga

SEQ ID NO: 1886049 - DNA, 20 bp, Homo sapiens
tgcctgctctccttgccctg
